United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 42

SEQ ID NO: 1500909 - RNA, 16 nt, Pseudomonas aeruginosa PA01
cgggccgaugcgcgac

SEQ ID NO: 1500910 - RNA, 14 nt, Pseudomonas aeruginosa PA01
cgggccgcagcgca

SEQ ID NO: 1500911 - RNA, 17 nt, Pseudomonas aeruginosa PA01
cgggccgcagcgcagcc

SEQ ID NO: 1500912 - RNA, 17 nt, Pseudomonas aeruginosa PA01
cgggccgcaucgcgggc

SEQ ID NO: 1500913 - RNA, 13 nt, Pseudomonas aeruginosa PA01
cgggccgcucagg

SEQ ID NO: 1500914 - RNA, 15 nt, Pseudomonas aeruginosa PA01
cgggccgcucgcgcg

SEQ ID NO: 1500915 - RNA, 16 nt, Pseudomonas aeruginosa PA01
cgggccgcucgcgcgg

SEQ ID NO: 1500916 - RNA, 18 nt, Pseudomonas aeruginosa PA01
cgggccgcucgcgcggca

SEQ ID NO: 1500917 - RNA, 22 nt, Pseudomonas aeruginosa PA01
cgggccgcgccuuucgcucagg

SEQ ID NO: 1500918 - RNA, 14 nt, Pseudomonas aeruginosa PA01
cgggccgccggcga

SEQ ID NO: 1500919 - RNA, 17 nt, Pseudomonas aeruginosa PA01
cgggccgccggcgacga

SEQ ID NO: 1500920 - RNA, 13 nt, Pseudomonas aeruginosa PA01
cgggccgcggcga

SEQ ID NO: 1500921 - RNA, 15 nt, Pseudomonas aeruginosa PA01
cgggccggagcaggc

SEQ ID NO: 1500922 - RNA, 16 nt, Pseudomonas aeruginosa PA01
cgggccggagcaggcc

SEQ ID NO: 1500923 - RNA, 22 nt, Pseudomonas aeruginosa PA01
cgggccggagcaggccaugggu

SEQ ID NO: 1500924 - RNA, 17 nt, Pseudomonas aeruginosa PA01
cgggccggcgauggccc

SEQ ID NO: 1500925 - RNA, 18 nt, Pseudomonas aeruginosa PA01
cgggccggcgauggccca

SEQ ID NO: 1500926 - RNA, 16 nt, Pseudomonas aeruginosa PA01
cgggccggccagggcg

SEQ ID NO: 1500927 - RNA, 19 nt, Pseudomonas aeruginosa PA01
cgggccggcguccaggagg

SEQ ID NO: 1500928 - RNA, 14 nt, Pseudomonas aeruginosa PA01
cgggcgacccaggc

SEQ ID NO: 1500929 - RNA, 12 nt, Pseudomonas aeruginosa PA01
cgggcgaccugc

SEQ ID NO: 1500930 - RNA, 20 nt, Pseudomonas aeruginosa PA01
cgggcgaccggaugcuccag

SEQ ID NO: 1500931 - RNA, 17 nt, Pseudomonas aeruginosa PA01
cgggcgacgaagcccuc

SEQ ID NO: 1500932 - RNA, 20 nt, Pseudomonas aeruginosa PA01
cgggcgacgaagcccucgcg

SEQ ID NO: 1500933 - RNA, 13 nt, Pseudomonas aeruginosa PA01
cgggcgaccugcu

SEQ ID NO: 1500934 - RNA, 22 nt, Pseudomonas aeruginosa PA01
cgggcgaccugcucgcgcaccg

SEQ ID NO: 1500935 - RNA, 23 nt, Pseudomonas aeruginosa PA01
cgggcgaccugcucgcgcaccgc

SEQ ID NO: 1500936 - RNA, 17 nt, Pseudomonas aeruginosa PA01
cgggcgacgugggccug

SEQ ID NO: 1500937 - RNA, 16 nt, Pseudomonas aeruginosa PA01
cgggcgaugcggucau

SEQ ID NO: 1500938 - RNA, 13 nt, Pseudomonas aeruginosa PA01
cgggccucggcgg

SEQ ID NO: 1500939 - RNA, 14 nt, Pseudomonas aeruginosa PA01
cgggccucggcggg

SEQ ID NO: 1500940 - RNA, 17 nt, Pseudomonas aeruginosa PA01
cgggcgacaaggcugag

SEQ ID NO: 1500941 - RNA, 20 nt, Pseudomonas aeruginosa PA01
cgggcgaaguagaagcgcgc

SEQ ID NO: 1500942 - RNA, 15 nt, Pseudomonas aeruginosa PA01
cgggcgaacggcagc

SEQ ID NO: 1500943 - RNA, 16 nt, Pseudomonas aeruginosa PA01
cgggcgaacggcagcg

SEQ ID NO: 1500944 - RNA, 19 nt, Pseudomonas aeruginosa PA01
cgggcgaagcgcagcuccg

SEQ ID NO: 1500945 - RNA, 19 nt, Pseudomonas aeruginosa PA01
cgggcgaaggccucgucga

SEQ ID NO: 1500946 - RNA, 16 nt, Pseudomonas aeruginosa PA01
cgggccuccuggcggc

SEQ ID NO: 1500947 - RNA, 21 nt, Pseudomonas aeruginosa PA01
cgggccgucgggcauggcgau

SEQ ID NO: 1500948 - RNA, 14 nt, Pseudomonas aeruginosa PA01
cgggcggucgaggc

SEQ ID NO: 1500949 - RNA, 18 nt, Pseudomonas aeruginosa PA01
cgggcggucgaggcccuc

SEQ ID NO: 1500950 - RNA, 16 nt, Pseudomonas aeruginosa PA01
cgggcgggugcgcgaa

SEQ ID NO: 1500951 - RNA, 14 nt, Pseudomonas aeruginosa PA01
cgggcggucgucgc

SEQ ID NO: 1500952 - RNA, 13 nt, Pseudomonas aeruginosa PA01
cgggcguagcgcg

SEQ ID NO: 1500953 - RNA, 22 nt, Pseudomonas aeruginosa PA01
cgggcguagcgcggcagcgcca

SEQ ID NO: 1500954 - RNA, 15 nt, Pseudomonas aeruginosa PA01
cgggcguagggcgaa

SEQ ID NO: 1500955 - RNA, 21 nt, Pseudomonas aeruginosa PA01
cgggcguaacggcucgccggg

SEQ ID NO: 1500956 - RNA, 16 nt, Pseudomonas aeruginosa PA01
cgggcgggucuggcgg

SEQ ID NO: 1500957 - RNA, 17 nt, Pseudomonas aeruginosa PA01
cgggcgggucuggcgga

SEQ ID NO: 1500958 - RNA, 17 nt, Pseudomonas aeruginosa PA01
cgggcggguaaagcgcc

SEQ ID NO: 1500959 - RNA, 17 nt, Pseudomonas aeruginosa PA01
cgggcgguacaggcgca

SEQ ID NO: 1500960 - RNA, 18 nt, Pseudomonas aeruginosa PA01
cgggcgguagcgggccag

SEQ ID NO: 1500961 - RNA, 21 nt, Pseudomonas aeruginosa PA01
cgggcgguagcgggccagcag

SEQ ID NO: 1500962 - RNA, 23 nt, Pseudomonas aeruginosa PA01
cgggcgguagcgggccagcagcu

SEQ ID NO: 1500963 - RNA, 18 nt, Pseudomonas aeruginosa PA01
cgggcgggaucaggucgc

SEQ ID NO: 1500964 - RNA, 22 nt, Pseudomonas aeruginosa PA01
cgggcguugguacagcucgcgc

SEQ ID NO: 1500965 - RNA, 23 nt, Pseudomonas aeruginosa PA01
cgggcguugguacagcucgcgca

SEQ ID NO: 1500966 - RNA, 16 nt, Pseudomonas aeruginosa PA01
cgggcguuggcuccgg

SEQ ID NO: 1500967 - RNA, 17 nt, Pseudomonas aeruginosa PA01
cgggcguuggcuccggg

SEQ ID NO: 1500968 - RNA, 22 nt, Pseudomonas aeruginosa PA01
cgggcguuuucguugccgcgcu

SEQ ID NO: 1500969 - RNA, 19 nt, Pseudomonas aeruginosa PA01
cgggcguuuucguuggcgc

SEQ ID NO: 1500970 - RNA, 22 nt, Pseudomonas aeruginosa PA01
cgggcguuuucguuggcgcgac

SEQ ID NO: 1500971 - RNA, 22 nt, Pseudomonas aeruginosa PA01
cgggcguuuucguuggcggcca

SEQ ID NO: 1500972 - RNA, 12 nt, Pseudomonas aeruginosa PA01
cgggcucgccca

SEQ ID NO: 1500973 - RNA, 22 nt, Pseudomonas aeruginosa PA01
cgggcgugucgaggaaggccag

SEQ ID NO: 1500974 - RNA, 16 nt, Pseudomonas aeruginosa PA01
cgggcguugcgcgccu

SEQ ID NO: 1500975 - RNA, 23 nt, Pseudomonas aeruginosa PA01
cgggcguugcgcgccucgcccca

SEQ ID NO: 1500976 - RNA, 15 nt, Pseudomonas aeruginosa PA01
cgggcguugccggca

SEQ ID NO: 1500977 - RNA, 13 nt, Pseudomonas aeruginosa PA01
cgggcguggggcg

SEQ ID NO: 1500978 - RNA, 15 nt, Pseudomonas aeruginosa PA01
cgggcguggggcgaa

SEQ ID NO: 1500979 - RNA, 14 nt, Pseudomonas aeruginosa PA01
cgggcgccaccgcg

SEQ ID NO: 1500980 - RNA, 15 nt, Pseudomonas aeruginosa PA01
cgggcgccaccgcgu

SEQ ID NO: 1500981 - RNA, 14 nt, Pseudomonas aeruginosa PA01
cgggcgcccggccg

SEQ ID NO: 1500982 - RNA, 13 nt, Pseudomonas aeruginosa PA01
cgggcgccaucgc

SEQ ID NO: 1500983 - RNA, 12 nt, Pseudomonas aeruginosa PA01
cgggcgccaggg

SEQ ID NO: 1500984 - RNA, 13 nt, Pseudomonas aeruginosa PA01
cgggcgccgcgcc

SEQ ID NO: 1500985 - RNA, 15 nt, Pseudomonas aeruginosa PA01
cgggcgccgcgccuu

SEQ ID NO: 1500986 - RNA, 16 nt, Pseudomonas aeruginosa PA01
cgggcgccgccgcugg

SEQ ID NO: 1500987 - RNA, 17 nt, Pseudomonas aeruginosa PA01
cgggcgccgccgcuggc

SEQ ID NO: 1500988 - RNA, 15 nt, Pseudomonas aeruginosa PA01
cgggcgccgaugccg

SEQ ID NO: 1500989 - RNA, 22 nt, Pseudomonas aeruginosa PA01
cgggcgccgaugccggccggca

SEQ ID NO: 1500990 - RNA, 15 nt, Pseudomonas aeruginosa PA01
cgggcgccguggauc

SEQ ID NO: 1500991 - RNA, 19 nt, Pseudomonas aeruginosa PA01
cgggcgccguggaucgccc

SEQ ID NO: 1500992 - RNA, 13 nt, Pseudomonas aeruginosa PA01
cgggcgcuuccgg

SEQ ID NO: 1500993 - RNA, 14 nt, Pseudomonas aeruginosa PA01
cgggcggaggcgag

SEQ ID NO: 1500994 - RNA, 15 nt, Pseudomonas aeruginosa PA01
cgggcggaggcgagg

SEQ ID NO: 1500995 - RNA, 17 nt, Pseudomonas aeruginosa PA01
cgggcggaugaccuguc

SEQ ID NO: 1500996 - RNA, 22 nt, Pseudomonas aeruginosa PA01
cgggcggaugaccuguccaguc

SEQ ID NO: 1500997 - RNA, 24 nt, Pseudomonas aeruginosa PA01
cgggcggaugaccuguccagucac

SEQ ID NO: 1500998 - RNA, 20 nt, Pseudomonas aeruginosa PA01
cgggcggaucagcucgauca

SEQ ID NO: 1500999 - RNA, 23 nt, Pseudomonas aeruginosa PA01
cgggcggaucagcucgaucagcc

SEQ ID NO: 1501000 - RNA, 21 nt, Pseudomonas aeruginosa PA01
cgggcggaucgagcagcggcg

SEQ ID NO: 1501001 - RNA, 23 nt, Pseudomonas aeruginosa PA01
cgggcggaucgccaaccaguagg

SEQ ID NO: 1501002 - RNA, 21 nt, Pseudomonas aeruginosa PA01
cgggcggcuuuuuucauggcg

SEQ ID NO: 1501003 - RNA, 13 nt, Pseudomonas aeruginosa PA01
cgggcggcaggcg

SEQ ID NO: 1501004 - RNA, 16 nt, Pseudomonas aeruginosa PA01
cgggcggcaggcgccg

SEQ ID NO: 1501005 - RNA, 17 nt, Pseudomonas aeruginosa PA01
cgggcggcaggcgccgg

SEQ ID NO: 1501006 - RNA, 20 nt, Pseudomonas aeruginosa PA01
cgggcggcaagggcacgugc

SEQ ID NO: 1501007 - RNA, 14 nt, Pseudomonas aeruginosa PA01
cggcugcccaacug

SEQ ID NO: 1501008 - RNA, 18 nt, Pseudomonas aeruginosa PA01
cggcugcccaagggccug

SEQ ID NO: 1501009 - RNA, 23 nt, Pseudomonas aeruginosa PA01
cggcugcccaagggccugggcgc

SEQ ID NO: 1501010 - RNA, 17 nt, Pseudomonas aeruginosa PA01
cggcucucuucggccga

SEQ ID NO: 1501011 - RNA, 15 nt, Pseudomonas aeruginosa PA01
cggcucuggcgcagg

SEQ ID NO: 1501012 - RNA, 23 nt, Pseudomonas aeruginosa PA01
cggcucuuccccuaccggcaagg

SEQ ID NO: 1501013 - RNA, 19 nt, Pseudomonas aeruginosa PA01
cggcucuuuccgggucauu

SEQ ID NO: 1501014 - RNA, 14 nt, Pseudomonas aeruginosa PA01
cggcucgggcggca

SEQ ID NO: 1501015 - RNA, 16 nt, Pseudomonas aeruginosa PA01
cggcucgggcggcaag

SEQ ID NO: 1501016 - RNA, 22 nt, Pseudomonas aeruginosa PA01
cggcucgguuccagcucgucga

SEQ ID NO: 1501017 - RNA, 18 nt, Pseudomonas aeruginosa PA01
cggcucgguuuccaccug

SEQ ID NO: 1501018 - RNA, 17 nt, Pseudomonas aeruginosa PA01
cggcugccgaggcugau

SEQ ID NO: 1501019 - RNA, 22 nt, Pseudomonas aeruginosa PA01
cggcugcccgggguuggcgcug

SEQ ID NO: 1501020 - RNA, 19 nt, Pseudomonas aeruginosa PA01
cggcugccgguacgcacca

SEQ ID NO: 1501021 - RNA, 14 nt, Pseudomonas aeruginosa PA01
cggcugccgccagc

SEQ ID NO: 1501022 - RNA, 23 nt, Pseudomonas aeruginosa PA01
cggcuggaagucgcccugcccgg

SEQ ID NO: 1501023 - RNA, 13 nt, Pseudomonas aeruginosa PA01
cggcugcuugccg

SEQ ID NO: 1501024 - RNA, 17 nt, Pseudomonas aeruginosa PA01
cggcugcuugccgcuca

SEQ ID NO: 1501025 - RNA, 14 nt, Pseudomonas aeruginosa PA01
cggcugcuugccgg

SEQ ID NO: 1501026 - RNA, 20 nt, Pseudomonas aeruginosa PA01
cggcugcuugccggugccau

SEQ ID NO: 1501027 - RNA, 14 nt, Pseudomonas aeruginosa PA01
cggcugcuuggcca

SEQ ID NO: 1501028 - RNA, 23 nt, Pseudomonas aeruginosa PA01
cggcugcugucguuccggcucag

SEQ ID NO: 1501029 - RNA, 13 nt, Pseudomonas aeruginosa PA01
cggcugcgcgccg

SEQ ID NO: 1501030 - RNA, 17 nt, Pseudomonas aeruginosa PA01
cggcugcgcgccggguc

SEQ ID NO: 1501031 - RNA, 17 nt, Pseudomonas aeruginosa PA01
cggcuggccauccgccc

SEQ ID NO: 1501032 - RNA, 22 nt, Pseudomonas aeruginosa PA01
cggcuggccauccgcccugcgg

SEQ ID NO: 1501033 - RNA, 17 nt, Pseudomonas aeruginosa PA01
cggcuggcagggcgcgu

SEQ ID NO: 1501034 - RNA, 12 nt, Pseudomonas aeruginosa PA01
cggcuggcaggu

SEQ ID NO: 1501035 - RNA, 17 nt, Pseudomonas aeruginosa PA01
cggcuggacgugcagga

SEQ ID NO: 1501036 - RNA, 15 nt, Pseudomonas aeruginosa PA01
cggcuggucggcuuc

SEQ ID NO: 1501037 - RNA, 20 nt, Pseudomonas aeruginosa PA01
cggcuggucggcuuccgccg

SEQ ID NO: 1501038 - RNA, 23 nt, Pseudomonas aeruginosa PA01
cggcuggucggcuuccgccgcca

SEQ ID NO: 1501039 - RNA, 23 nt, Pseudomonas aeruginosa PA01
cggcugggugucgaccuccgccg

SEQ ID NO: 1501040 - RNA, 12 nt, Pseudomonas aeruginosa PA01
cggcuggccgcg

SEQ ID NO: 1501041 - RNA, 17 nt, Pseudomonas aeruginosa PA01
cggcuggccgccucgcg

SEQ ID NO: 1501042 - RNA, 20 nt, Pseudomonas aeruginosa PA01
cggcuggccgccucgcgccg

SEQ ID NO: 1501043 - RNA, 23 nt, Pseudomonas aeruginosa PA01
cggcuggccgccucgcgccgcgc

SEQ ID NO: 1501044 - RNA, 21 nt, Pseudomonas aeruginosa PA01
cggcuggccgccuggccggcc

SEQ ID NO: 1501045 - RNA, 13 nt, Pseudomonas aeruginosa PA01
cggcuggccgagg

SEQ ID NO: 1501046 - RNA, 16 nt, Pseudomonas aeruginosa PA01
cggcuggccgaggacc

SEQ ID NO: 1501047 - RNA, 16 nt, Pseudomonas aeruginosa PA01
cggcuggccgagggcg

SEQ ID NO: 1501048 - RNA, 17 nt, Pseudomonas aeruginosa PA01
cggcuggccgagggcgc

SEQ ID NO: 1501049 - RNA, 16 nt, Pseudomonas aeruginosa PA01
cggcuggcccucggcg

SEQ ID NO: 1501050 - RNA, 12 nt, Pseudomonas aeruginosa PA01
cggcuggccgag

SEQ ID NO: 1501051 - RNA, 22 nt, Pseudomonas aeruginosa PA01
cggcugguucugguccaccagc

SEQ ID NO: 1501052 - RNA, 16 nt, Pseudomonas aeruginosa PA01
cggcugguugccagca

SEQ ID NO: 1501053 - RNA, 20 nt, Pseudomonas aeruginosa PA01
cggcugguugccagcagcgc

SEQ ID NO: 1501054 - RNA, 21 nt, Pseudomonas aeruginosa PA01
cggcugguugccagcagcgcu

SEQ ID NO: 1501055 - RNA, 12 nt, Pseudomonas aeruginosa PA01
cggcuucggcgg

SEQ ID NO: 1501056 - RNA, 14 nt, Pseudomonas aeruginosa PA01
cggcuucggcggcg

SEQ ID NO: 1501057 - RNA, 21 nt, Pseudomonas aeruginosa PA01
cggcuucuacgccuugcggcg

SEQ ID NO: 1501058 - RNA, 21 nt, Pseudomonas aeruginosa PA01
cggcuucgcccauggcacgca

SEQ ID NO: 1501059 - RNA, 21 nt, Pseudomonas aeruginosa PA01
cggcuucgcagaugucgguca

SEQ ID NO: 1501060 - RNA, 18 nt, Pseudomonas aeruginosa PA01
cggcuuccugggcgaagu

SEQ ID NO: 1501061 - RNA, 14 nt, Pseudomonas aeruginosa PA01
cggcuucgaccacg

SEQ ID NO: 1501062 - RNA, 21 nt, Pseudomonas aeruginosa PA01
cggcuucgaccacgacccggg

SEQ ID NO: 1501063 - RNA, 14 nt, Pseudomonas aeruginosa PA01
cggcuggucgaagc

SEQ ID NO: 1501064 - RNA, 13 nt, Pseudomonas aeruginosa PA01
cggcucgccgggu

SEQ ID NO: 1501065 - RNA, 18 nt, Pseudomonas aeruginosa PA01
cggcucgcgguucgagga

SEQ ID NO: 1501066 - RNA, 20 nt, Pseudomonas aeruginosa PA01
cggcucgcgguucgaggacu

SEQ ID NO: 1501067 - RNA, 22 nt, Pseudomonas aeruginosa PA01
cggcucgcgguucgaggacuuc

SEQ ID NO: 1501068 - RNA, 23 nt, Pseudomonas aeruginosa PA01
cggcucgcugaaauccaccagca

SEQ ID NO: 1501069 - RNA, 14 nt, Pseudomonas aeruginosa PA01
cggcucgccgcgcu

SEQ ID NO: 1501070 - RNA, 13 nt, Pseudomonas aeruginosa PA01
cggcucgcgcagc

SEQ ID NO: 1501071 - RNA, 17 nt, Pseudomonas aeruginosa PA01
cggcucgcgcagcggcg

SEQ ID NO: 1501072 - RNA, 14 nt, Pseudomonas aeruginosa PA01
cggcucgcgccggc

SEQ ID NO: 1501073 - RNA, 17 nt, Pseudomonas aeruginosa PA01
cggcucgcgccggcgcg

SEQ ID NO: 1501074 - RNA, 17 nt, Pseudomonas aeruginosa PA01
cggcucgcugacgccau

SEQ ID NO: 1501075 - RNA, 13 nt, Pseudomonas aeruginosa PA01
cggcucggcaagc

SEQ ID NO: 1501076 - RNA, 19 nt, Pseudomonas aeruginosa PA01
cggcucggcaagcgaaccg

SEQ ID NO: 1501077 - RNA, 22 nt, Pseudomonas aeruginosa PA01
cggcucggcacgcguggcgagu

SEQ ID NO: 1501078 - RNA, 16 nt, Pseudomonas aeruginosa PA01
cggcucggccagggcc

SEQ ID NO: 1501079 - RNA, 22 nt, Pseudomonas aeruginosa PA01
cggcucggccgugugccugagc

SEQ ID NO: 1501080 - RNA, 14 nt, Pseudomonas aeruginosa PA01
cggcucggcugcuu

SEQ ID NO: 1501081 - RNA, 17 nt, Pseudomonas aeruginosa PA01
cggcucggcugcuugcc

SEQ ID NO: 1501082 - RNA, 12 nt, Pseudomonas aeruginosa PA01
cggcucggcggg

SEQ ID NO: 1501083 - RNA, 19 nt, Pseudomonas aeruginosa PA01
cggcuccucugccugcgcc

SEQ ID NO: 1501084 - RNA, 16 nt, Pseudomonas aeruginosa PA01
cggcuccgcgcacgga

SEQ ID NO: 1501085 - RNA, 21 nt, Pseudomonas aeruginosa PA01
cggcuccggauggcugacccg

SEQ ID NO: 1501086 - RNA, 21 nt, Pseudomonas aeruginosa PA01
cggcuccuugcgccguugccg

SEQ ID NO: 1501087 - RNA, 22 nt, Pseudomonas aeruginosa PA01
cggcucgaacgaguggggcgga

SEQ ID NO: 1501088 - RNA, 13 nt, Pseudomonas aeruginosa PA01
cggcucgaccuug

SEQ ID NO: 1501089 - RNA, 18 nt, Pseudomonas aeruginosa PA01
cggcucgcccaugcgcgg

SEQ ID NO: 1501090 - RNA, 20 nt, Pseudomonas aeruginosa PA01
cggcucgcccaugcgcggcg

SEQ ID NO: 1501091 - RNA, 15 nt, Pseudomonas aeruginosa PA01
cggcucgccgccggg

SEQ ID NO: 1501092 - RNA, 22 nt, Pseudomonas aeruginosa PA01
cggcucgccgccgggcgcgcgc

SEQ ID NO: 1501093 - RNA, 18 nt, Pseudomonas aeruginosa PA01
cggcuccggguacuggcg

SEQ ID NO: 1501094 - RNA, 14 nt, Pseudomonas aeruginosa PA01
cggcuccggcgcca

SEQ ID NO: 1501095 - RNA, 16 nt, Pseudomonas aeruginosa PA01
cggcuccggcgccagg

SEQ ID NO: 1501096 - RNA, 17 nt, Pseudomonas aeruginosa PA01
cggcuccggcgccaggc

SEQ ID NO: 1501097 - RNA, 20 nt, Pseudomonas aeruginosa PA01
cggcuccaguugcagcaccc

SEQ ID NO: 1501098 - RNA, 16 nt, Pseudomonas aeruginosa PA01
cggcucaauccggcug

SEQ ID NO: 1501099 - RNA, 20 nt, Pseudomonas aeruginosa PA01
cggcucaacugguuggccgc

SEQ ID NO: 1501100 - RNA, 16 nt, Pseudomonas aeruginosa PA01
cggcucaccgagaacc

SEQ ID NO: 1501101 - RNA, 18 nt, Pseudomonas aeruginosa PA01
cggcucagaacagcggca

SEQ ID NO: 1501102 - RNA, 16 nt, Pseudomonas aeruginosa PA01
cggcucacgccccagc

SEQ ID NO: 1501103 - RNA, 18 nt, Pseudomonas aeruginosa PA01
cggcucacgccccagcgc

SEQ ID NO: 1501104 - RNA, 13 nt, Pseudomonas aeruginosa PA01
cggcuacucgccc

SEQ ID NO: 1501105 - RNA, 17 nt, Pseudomonas aeruginosa PA01
cggcuacucgcccgacc

SEQ ID NO: 1501106 - RNA, 20 nt, Pseudomonas aeruginosa PA01
cggcucaggccgccgcgucg

SEQ ID NO: 1501107 - RNA, 23 nt, Pseudomonas aeruginosa PA01
cggcucaggccgccgcgucgaag

SEQ ID NO: 1501108 - RNA, 18 nt, Pseudomonas aeruginosa PA01
cggcucagccgaccaccu

SEQ ID NO: 1501109 - RNA, 17 nt, Pseudomonas aeruginosa PA01
cggcucagccgcuggcg

SEQ ID NO: 1501110 - RNA, 20 nt, Pseudomonas aeruginosa PA01
cggcucagccgcuggcgucg

SEQ ID NO: 1501111 - RNA, 13 nt, Pseudomonas aeruginosa PA01
cggcucagcgcuu

SEQ ID NO: 1501112 - RNA, 21 nt, Pseudomonas aeruginosa PA01
cggcuccccuggaaugccggc

SEQ ID NO: 1501113 - RNA, 23 nt, Pseudomonas aeruginosa PA01
cggcuccccuggaaugccggccg

SEQ ID NO: 1501114 - RNA, 14 nt, Pseudomonas aeruginosa PA01
cggcuccagggcga

SEQ ID NO: 1501115 - RNA, 16 nt, Pseudomonas aeruginosa PA01
cggcuccagcuugucg

SEQ ID NO: 1501116 - RNA, 23 nt, Pseudomonas aeruginosa PA01
cggcuccagcuugucgucggccu

SEQ ID NO: 1501117 - RNA, 15 nt, Pseudomonas aeruginosa PA01
cggcuccaggaccgg

SEQ ID NO: 1501118 - RNA, 17 nt, Pseudomonas aeruginosa PA01
cggcuccaggaccggca

SEQ ID NO: 1501119 - RNA, 16 nt, Pseudomonas aeruginosa PA01
cggcuccagcaccagc

SEQ ID NO: 1501120 - RNA, 23 nt, Pseudomonas aeruginosa PA01
cggcuccagcaccagcacgcccu

SEQ ID NO: 1501121 - RNA, 14 nt, Pseudomonas aeruginosa PA01
cggcuccagccagg

SEQ ID NO: 1501122 - RNA, 18 nt, Pseudomonas aeruginosa PA01
cggcuccagccaggcccg

SEQ ID NO: 1501123 - RNA, 14 nt, Pseudomonas aeruginosa PA01
cggcuccagccggg

SEQ ID NO: 1501124 - RNA, 15 nt, Pseudomonas aeruginosa PA01
cggcuccagccgggc

SEQ ID NO: 1501125 - RNA, 22 nt, Pseudomonas aeruginosa PA01
cggcuccagccgggcuccgccg

SEQ ID NO: 1501126 - RNA, 21 nt, Pseudomonas aeruginosa PA01
cggcguugcugaucgcuccgc

SEQ ID NO: 1501127 - RNA, 16 nt, Pseudomonas aeruginosa PA01
cggcguuggcgucgcu

SEQ ID NO: 1501128 - RNA, 23 nt, Pseudomonas aeruginosa PA01
cggcguuggaauaguggaucgcc

SEQ ID NO: 1501129 - RNA, 17 nt, Pseudomonas aeruginosa PA01
cggcguuggcacgacgc

SEQ ID NO: 1501130 - RNA, 15 nt, Pseudomonas aeruginosa PA01
cggcguuggccgagg

SEQ ID NO: 1501131 - RNA, 21 nt, Pseudomonas aeruginosa PA01
cggcguuguagaucugcaccg

SEQ ID NO: 1501132 - RNA, 14 nt, Pseudomonas aeruginosa PA01
cggcguugucggcc

SEQ ID NO: 1501133 - RNA, 15 nt, Pseudomonas aeruginosa PA01
cggcguugucggcca

SEQ ID NO: 1501134 - RNA, 20 nt, Pseudomonas aeruginosa PA01
cggcguugucggccagcagc

SEQ ID NO: 1501135 - RNA, 18 nt, Pseudomonas aeruginosa PA01
cggcguuuacgcgccaag

SEQ ID NO: 1501136 - RNA, 23 nt, Pseudomonas aeruginosa PA01
cggcguuuacgcgccaagguucc

SEQ ID NO: 1501137 - RNA, 19 nt, Pseudomonas aeruginosa PA01
cggcguuuagcgcccgacg

SEQ ID NO: 1501138 - RNA, 15 nt, Pseudomonas aeruginosa PA01
cggcguuucgccggg

SEQ ID NO: 1501139 - RNA, 17 nt, Pseudomonas aeruginosa PA01
cggcguuucgccgggcc

SEQ ID NO: 1501140 - RNA, 15 nt, Pseudomonas aeruginosa PA01
cggcguuguccaggc

SEQ ID NO: 1501141 - RNA, 17 nt, Pseudomonas aeruginosa PA01
cggcuacgaaccgagcg

SEQ ID NO: 1501142 - RNA, 13 nt, Pseudomonas aeruginosa PA01
cggcuacccgcgc

SEQ ID NO: 1501143 - RNA, 12 nt, Pseudomonas aeruginosa PA01
cggcuaaccgcc

SEQ ID NO: 1501144 - RNA, 14 nt, Pseudomonas aeruginosa PA01
cggcuaaccgccuu

SEQ ID NO: 1501145 - RNA, 15 nt, Pseudomonas aeruginosa PA01
cggcuaaccgcgaag

SEQ ID NO: 1501146 - RNA, 23 nt, Pseudomonas aeruginosa PA01
cggcguuuuucauugggcagcca

SEQ ID NO: 1501147 - RNA, 20 nt, Pseudomonas aeruginosa PA01
cggcguuuuuuuauccucgc

SEQ ID NO: 1501148 - RNA, 23 nt, Pseudomonas aeruginosa PA01
cggcuacaggccguagcgcucga

SEQ ID NO: 1501149 - RNA, 14 nt, Pseudomonas aeruginosa PA01
cggcuaccagcgcu

SEQ ID NO: 1501150 - RNA, 17 nt, Pseudomonas aeruginosa PA01
cggcuaccagcgcuucg

SEQ ID NO: 1501151 - RNA, 15 nt, Pseudomonas aeruginosa PA01
cggcuaccccacgcg

SEQ ID NO: 1501152 - RNA, 18 nt, Pseudomonas aeruginosa PA01
cggcuaccccacgcgacc

SEQ ID NO: 1501153 - RNA, 15 nt, Pseudomonas aeruginosa PA01
cggcguucaccgcgc

SEQ ID NO: 1501154 - RNA, 16 nt, Pseudomonas aeruginosa PA01
cggcguucaccgcgca

SEQ ID NO: 1501155 - RNA, 19 nt, Pseudomonas aeruginosa PA01
cggcguugaacugcccgca

SEQ ID NO: 1501156 - RNA, 14 nt, Pseudomonas aeruginosa PA01
cggcguucgcccug

SEQ ID NO: 1501157 - RNA, 14 nt, Pseudomonas aeruginosa PA01
cggcguucgccgag

SEQ ID NO: 1501158 - RNA, 16 nt, Pseudomonas aeruginosa PA01
cggcguucgccgagca

SEQ ID NO: 1501159 - RNA, 17 nt, Pseudomonas aeruginosa PA01
cggcguucgccgagcaa

SEQ ID NO: 1501160 - RNA, 17 nt, Pseudomonas aeruginosa PA01
cggcguucgccgcgggc

SEQ ID NO: 1501161 - RNA, 16 nt, Pseudomonas aeruginosa PA01
cggcguucgccggguu

SEQ ID NO: 1501162 - RNA, 20 nt, Pseudomonas aeruginosa PA01
cggcguucggaccugucccg

SEQ ID NO: 1501163 - RNA, 21 nt, Pseudomonas aeruginosa PA01
cggcguuagccgccugcggcg

SEQ ID NO: 1501164 - RNA, 23 nt, Pseudomonas aeruginosa PA01
cggcguuauccgcccugcgcagc

SEQ ID NO: 1501165 - RNA, 16 nt, Pseudomonas aeruginosa PA01
cggcguuauccgccga

SEQ ID NO: 1501166 - RNA, 19 nt, Pseudomonas aeruginosa PA01
cggcgugccguggcucggc

SEQ ID NO: 1501167 - RNA, 19 nt, Pseudomonas aeruginosa PA01
cggcgugccgggccggcca

SEQ ID NO: 1501168 - RNA, 23 nt, Pseudomonas aeruginosa PA01
cggcgugcccauccgcucggcga

SEQ ID NO: 1501169 - RNA, 22 nt, Pseudomonas aeruginosa PA01
cggcguggucuccgugcuggcc

SEQ ID NO: 1501170 - RNA, 22 nt, Pseudomonas aeruginosa PA01
cggcguccugcucccuggcgga

SEQ ID NO: 1501171 - RNA, 12 nt, Pseudomonas aeruginosa PA01
cggcguccucgc

SEQ ID NO: 1501172 - RNA, 13 nt, Pseudomonas aeruginosa PA01
cggcguccucgcg

SEQ ID NO: 1501173 - RNA, 15 nt, Pseudomonas aeruginosa PA01
cggcguccucggaga

SEQ ID NO: 1501174 - RNA, 19 nt, Pseudomonas aeruginosa PA01
cggcguccacuccggcagc

SEQ ID NO: 1501175 - RNA, 20 nt, Pseudomonas aeruginosa PA01
cggcguccacuccggcagca

SEQ ID NO: 1501176 - RNA, 24 nt, Pseudomonas aeruginosa PA01
cggcguccacuccggcagcacccg

SEQ ID NO: 1501177 - RNA, 19 nt, Pseudomonas aeruginosa PA01
cggcguacuucggcgcggu

SEQ ID NO: 1501178 - RNA, 21 nt, Pseudomonas aeruginosa PA01
cggcguacuucggcgcggugc

SEQ ID NO: 1501179 - RNA, 15 nt, Pseudomonas aeruginosa PA01
cggcgucacgccgau

SEQ ID NO: 1501180 - RNA, 20 nt, Pseudomonas aeruginosa PA01
cggcgucacgccgaucccgg

SEQ ID NO: 1501181 - RNA, 22 nt, Pseudomonas aeruginosa PA01
cggcgucacgccgaucccggcg

SEQ ID NO: 1501182 - RNA, 23 nt, Pseudomonas aeruginosa PA01
cggcgucacgccgaucccggcgg

SEQ ID NO: 1501183 - RNA, 13 nt, Pseudomonas aeruginosa PA01
cggcggcccgcac

SEQ ID NO: 1501184 - RNA, 16 nt, Pseudomonas aeruginosa PA01
cggcguaaucgcgcca

SEQ ID NO: 1501185 - RNA, 22 nt, Pseudomonas aeruginosa PA01
cggcguaaucgcgccaggccgc

SEQ ID NO: 1501186 - RNA, 16 nt, Pseudomonas aeruginosa PA01
cggcguaccguuggcg

SEQ ID NO: 1501187 - RNA, 14 nt, Pseudomonas aeruginosa PA01
cggcgucuucggcg

SEQ ID NO: 1501188 - RNA, 17 nt, Pseudomonas aeruginosa PA01
cggcgucuucggcggcg

SEQ ID NO: 1501189 - RNA, 18 nt, Pseudomonas aeruginosa PA01
cggcgucuucggcggcgc

SEQ ID NO: 1501190 - RNA, 18 nt, Pseudomonas aeruginosa PA01
cggcgucuugucgaagcc

SEQ ID NO: 1501191 - RNA, 19 nt, Pseudomonas aeruginosa PA01
cggcgucuugucgaagccc

SEQ ID NO: 1501192 - RNA, 17 nt, Pseudomonas aeruginosa PA01
cggcgugcccuuuuccu

SEQ ID NO: 1501193 - RNA, 13 nt, Pseudomonas aeruginosa PA01
cggcgugccgacc

SEQ ID NO: 1501194 - RNA, 14 nt, Pseudomonas aeruginosa PA01
cggcgugccgaccu

SEQ ID NO: 1501195 - RNA, 17 nt, Pseudomonas aeruginosa PA01
cggcgugccgcaacgau

SEQ ID NO: 1501196 - RNA, 16 nt, Pseudomonas aeruginosa PA01
cggcgugccgcaggcc

SEQ ID NO: 1501197 - RNA, 19 nt, Pseudomonas aeruginosa PA01
cggcgugccgcaggccgcg

SEQ ID NO: 1501198 - RNA, 15 nt, Pseudomonas aeruginosa PA01
cggcgugaagccgcc

SEQ ID NO: 1501199 - RNA, 18 nt, Pseudomonas aeruginosa PA01
cggcgucggcugcgcugg

SEQ ID NO: 1501200 - RNA, 20 nt, Pseudomonas aeruginosa PA01
cggcgucggcugcgcugggc

SEQ ID NO: 1501201 - RNA, 14 nt, Pseudomonas aeruginosa PA01
cggcgucggcuggu

SEQ ID NO: 1501202 - RNA, 17 nt, Pseudomonas aeruginosa PA01
cggcgucggcuggucga

SEQ ID NO: 1501203 - RNA, 21 nt, Pseudomonas aeruginosa PA01
cggcgucuggggugaggccga

SEQ ID NO: 1501204 - RNA, 22 nt, Pseudomonas aeruginosa PA01
cggcgucuggggugaggccgag

SEQ ID NO: 1501205 - RNA, 18 nt, Pseudomonas aeruginosa PA01
cggcgucuuccggcucgc

SEQ ID NO: 1501206 - RNA, 14 nt, Pseudomonas aeruginosa PA01
cggcgucgcgcagg

SEQ ID NO: 1501207 - RNA, 22 nt, Pseudomonas aeruginosa PA01
cggcgucggcgaagccugcggc

SEQ ID NO: 1501208 - RNA, 13 nt, Pseudomonas aeruginosa PA01
cggcgucggcgag

SEQ ID NO: 1501209 - RNA, 16 nt, Pseudomonas aeruginosa PA01
cggcguccuugccgag

SEQ ID NO: 1501210 - RNA, 18 nt, Pseudomonas aeruginosa PA01
cggcguccuugccgagga

SEQ ID NO: 1501211 - RNA, 15 nt, Pseudomonas aeruginosa PA01
cggcguccuggucga

SEQ ID NO: 1501212 - RNA, 13 nt, Pseudomonas aeruginosa PA01
cggcgucgaccac

SEQ ID NO: 1501213 - RNA, 21 nt, Pseudomonas aeruginosa PA01
cggcgucgaccacggccuucg

SEQ ID NO: 1501214 - RNA, 17 nt, Pseudomonas aeruginosa PA01
cggguuacuucgccgau

SEQ ID NO: 1501215 - RNA, 18 nt, Pseudomonas aeruginosa PA01
cggguuacuucgccgauc

SEQ ID NO: 1501216 - RNA, 20 nt, Pseudomonas aeruginosa PA01
cggguucagucggccaggcg

SEQ ID NO: 1501217 - RNA, 19 nt, Pseudomonas aeruginosa PA01
cggguucccugcgccucga

SEQ ID NO: 1501218 - RNA, 23 nt, Pseudomonas aeruginosa PA01
cggguucccugcgccucgaccug

SEQ ID NO: 1501219 - RNA, 14 nt, Pseudomonas aeruginosa PA01
cggguucggcgaga

SEQ ID NO: 1501220 - RNA, 22 nt, Pseudomonas aeruginosa PA01
cggguucugcucgaacaucagc

SEQ ID NO: 1501221 - RNA, 14 nt, Pseudomonas aeruginosa PA01
cggguugccgcugg

SEQ ID NO: 1501222 - RNA, 17 nt, Pseudomonas aeruginosa PA01
cggguugcccggcucca

SEQ ID NO: 1501223 - RNA, 20 nt, Pseudomonas aeruginosa PA01
cggguugcccucgcagccgg

SEQ ID NO: 1501224 - RNA, 20 nt, Pseudomonas aeruginosa PA01
cggguugcgccuccgggcgu

SEQ ID NO: 1501225 - RNA, 22 nt, Pseudomonas aeruginosa PA01
cggguugaucagguucggcagc

SEQ ID NO: 1501226 - RNA, 17 nt, Pseudomonas aeruginosa PA01
cggguugauggugcggu

SEQ ID NO: 1501227 - RNA, 22 nt, Pseudomonas aeruginosa PA01
cggguugaugucgucgaacgac

SEQ ID NO: 1501228 - RNA, 16 nt, Pseudomonas aeruginosa PA01
cggguugaaggcgcgg

SEQ ID NO: 1501229 - RNA, 20 nt, Pseudomonas aeruginosa PA01
cggguugacccagagccgcu

SEQ ID NO: 1501230 - RNA, 23 nt, Pseudomonas aeruginosa PA01
cggguugaccccgaggucggcga

SEQ ID NO: 1501231 - RNA, 20 nt, Pseudomonas aeruginosa PA01
cggguugagcaccccggaga

SEQ ID NO: 1501232 - RNA, 17 nt, Pseudomonas aeruginosa PA01
cggguucuucucgucga

SEQ ID NO: 1501233 - RNA, 17 nt, Pseudomonas aeruginosa PA01
cggguucuugccgcugu

SEQ ID NO: 1501234 - RNA, 19 nt, Pseudomonas aeruginosa PA01
cggguucuugccgcuguug

SEQ ID NO: 1501235 - RNA, 16 nt, Pseudomonas aeruginosa PA01
cggguggucuugcgca

SEQ ID NO: 1501236 - RNA, 14 nt, Pseudomonas aeruginosa PA01
cgggugugcgagaa

SEQ ID NO: 1501237 - RNA, 15 nt, Pseudomonas aeruginosa PA01
cggguguccucgauc

SEQ ID NO: 1501238 - RNA, 18 nt, Pseudomonas aeruginosa PA01
cggguguccucgaucauc

SEQ ID NO: 1501239 - RNA, 16 nt, Pseudomonas aeruginosa PA01
cggguguuucggccgc

SEQ ID NO: 1501240 - RNA, 20 nt, Pseudomonas aeruginosa PA01
cggguguuucggccgcugcc

SEQ ID NO: 1501241 - RNA, 21 nt, Pseudomonas aeruginosa PA01
cggguguuucggccgcugccg

SEQ ID NO: 1501242 - RNA, 14 nt, Pseudomonas aeruginosa PA01
cggguggcaugggc

SEQ ID NO: 1501243 - RNA, 18 nt, Pseudomonas aeruginosa PA01
cggguggaacgaggcgac

SEQ ID NO: 1501244 - RNA, 15 nt, Pseudomonas aeruginosa PA01
cggguggcgucgauc

SEQ ID NO: 1501245 - RNA, 17 nt, Pseudomonas aeruginosa PA01
cgggugggacauggaga

SEQ ID NO: 1501246 - RNA, 16 nt, Pseudomonas aeruginosa PA01
cgggugcugcggaugg

SEQ ID NO: 1501247 - RNA, 23 nt, Pseudomonas aeruginosa PA01
cgggugcugcggaugggcgacga

SEQ ID NO: 1501248 - RNA, 13 nt, Pseudomonas aeruginosa PA01
cgggugcugaaga

SEQ ID NO: 1501249 - RNA, 19 nt, Pseudomonas aeruginosa PA01
cgggugcguggugcauccg

SEQ ID NO: 1501250 - RNA, 21 nt, Pseudomonas aeruginosa PA01
cgggugcguggugcauccgcc

SEQ ID NO: 1501251 - RNA, 18 nt, Pseudomonas aeruginosa PA01
cgggugcuaugcgccggg

SEQ ID NO: 1501252 - RNA, 13 nt, Pseudomonas aeruginosa PA01
cgggugcggcugg

SEQ ID NO: 1501253 - RNA, 15 nt, Pseudomonas aeruginosa PA01
cgggugcggcuggcg

SEQ ID NO: 1501254 - RNA, 19 nt, Pseudomonas aeruginosa PA01
cgggugcggcuggcgcgcg

SEQ ID NO: 1501255 - RNA, 19 nt, Pseudomonas aeruginosa PA01
cgggugcgcgccaccuggu

SEQ ID NO: 1501256 - RNA, 17 nt, Pseudomonas aeruginosa PA01
cgggugccuuccgcgcc

SEQ ID NO: 1501257 - RNA, 14 nt, Pseudomonas aeruginosa PA01
aaccagugcaccgc

SEQ ID NO: 1501258 - RNA, 16 nt, Pseudomonas aeruginosa PA01
cgggugaccgugcggg

SEQ ID NO: 1501259 - RNA, 18 nt, Pseudomonas aeruginosa PA01
cgggugaccuggccgccg

SEQ ID NO: 1501260 - RNA, 13 nt, Pseudomonas aeruginosa PA01
aaccaggcggccg

SEQ ID NO: 1501261 - RNA, 17 nt, Pseudomonas aeruginosa PA01
aaccaggggucgacgca

SEQ ID NO: 1501262 - RNA, 20 nt, Pseudomonas aeruginosa PA01
aaccaggcaauggccggcgg

SEQ ID NO: 1501263 - RNA, 22 nt, Pseudomonas aeruginosa PA01
aaccaggaaggaaugcugccac

SEQ ID NO: 1501264 - RNA, 21 nt, Pseudomonas aeruginosa PA01
aaccaggaucgaacuggccag

SEQ ID NO: 1501265 - RNA, 15 nt, Pseudomonas aeruginosa PA01
cgggugccggagaac

SEQ ID NO: 1501266 - RNA, 22 nt, Pseudomonas aeruginosa PA01
cgggugccggagaacgccgcca

SEQ ID NO: 1501267 - RNA, 16 nt, Pseudomonas aeruginosa PA01
cgggugccccaggcga

SEQ ID NO: 1501268 - RNA, 19 nt, Pseudomonas aeruginosa PA01
cgggucgcugcucagggcc

SEQ ID NO: 1501269 - RNA, 22 nt, Pseudomonas aeruginosa PA01
cgggucgcugcucagggccgcg

SEQ ID NO: 1501270 - RNA, 13 nt, Pseudomonas aeruginosa PA01
cgggucgcugccc

SEQ ID NO: 1501271 - RNA, 13 nt, Pseudomonas aeruginosa PA01
cgggucgcggcug

SEQ ID NO: 1501272 - RNA, 22 nt, Pseudomonas aeruginosa PA01
cgggucgcggcuggccgccugg

SEQ ID NO: 1501273 - RNA, 14 nt, Pseudomonas aeruginosa PA01
cgggucggcgaagu

SEQ ID NO: 1501274 - RNA, 22 nt, Pseudomonas aeruginosa PA01
cgggucggcgaaguccaccagg

SEQ ID NO: 1501275 - RNA, 23 nt, Pseudomonas aeruginosa PA01
cgggucggcgaaguccaccaggc

SEQ ID NO: 1501276 - RNA, 11 nt, Pseudomonas aeruginosa PA01
cgggucggcga

SEQ ID NO: 1501277 - RNA, 21 nt, Pseudomonas aeruginosa PA01
cgggucgggcucaugggcgau

SEQ ID NO: 1501278 - RNA, 20 nt, Pseudomonas aeruginosa PA01
cgggucgggcuucagcgccg

SEQ ID NO: 1501279 - RNA, 12 nt, Pseudomonas aeruginosa PA01
cgggucucgauc

SEQ ID NO: 1501280 - RNA, 18 nt, Pseudomonas aeruginosa PA01
cgggucucgaucagcgcc

SEQ ID NO: 1501281 - RNA, 22 nt, Pseudomonas aeruginosa PA01
cgggucucgaucagcgccgggu

SEQ ID NO: 1501282 - RNA, 22 nt, Pseudomonas aeruginosa PA01
cgggucgugcccgagcgacugg

SEQ ID NO: 1501283 - RNA, 19 nt, Pseudomonas aeruginosa PA01
cgggucgucgaagcgcagc

SEQ ID NO: 1501284 - RNA, 22 nt, Pseudomonas aeruginosa PA01
cgggucgucgaagcgcagcagg

SEQ ID NO: 1501285 - RNA, 13 nt, Pseudomonas aeruginosa PA01
cgggucgucgaug

SEQ ID NO: 1501286 - RNA, 15 nt, Pseudomonas aeruginosa PA01
cgggucugcucggcg

SEQ ID NO: 1501287 - RNA, 16 nt, Pseudomonas aeruginosa PA01
cgggucuucaggccgc

SEQ ID NO: 1501288 - RNA, 17 nt, Pseudomonas aeruginosa PA01
cgggucuucaggccgca

SEQ ID NO: 1501289 - RNA, 15 nt, Pseudomonas aeruginosa PA01
cgggucuugccgguc

SEQ ID NO: 1501290 - RNA, 15 nt, Pseudomonas aeruginosa PA01
cgggucuugcgcagg

SEQ ID NO: 1501291 - RNA, 16 nt, Pseudomonas aeruginosa PA01
cgggucuugcgcaggg

SEQ ID NO: 1501292 - RNA, 20 nt, Pseudomonas aeruginosa PA01
cgggucuugcgcagggcggc

SEQ ID NO: 1501293 - RNA, 23 nt, Pseudomonas aeruginosa PA01
cgggugaacucaugcaggccgaa

SEQ ID NO: 1501294 - RNA, 14 nt, Pseudomonas aeruginosa PA01
cgggugaaggucug

SEQ ID NO: 1501295 - RNA, 15 nt, Pseudomonas aeruginosa PA01
cgggguggccgugca

SEQ ID NO: 1501296 - RNA, 17 nt, Pseudomonas aeruginosa PA01
cgggguggccgugcagc

SEQ ID NO: 1501297 - RNA, 16 nt, Pseudomonas aeruginosa PA01
cggguagagcgcggcg

SEQ ID NO: 1501298 - RNA, 18 nt, Pseudomonas aeruginosa PA01
cggguagagcgcggcgca

SEQ ID NO: 1501299 - RNA, 19 nt, Pseudomonas aeruginosa PA01
cggguagagucgcucgcgc

SEQ ID NO: 1501300 - RNA, 20 nt, Pseudomonas aeruginosa PA01
aaccacgacgaagcgccggc

SEQ ID NO: 1501301 - RNA, 21 nt, Pseudomonas aeruginosa PA01
aaccacgacgaagcgccggcg

SEQ ID NO: 1501302 - RNA, 17 nt, Pseudomonas aeruginosa PA01
aaccacuccagcggggu

SEQ ID NO: 1501303 - RNA, 13 nt, Pseudomonas aeruginosa PA01
cggggugccgcca

SEQ ID NO: 1501304 - RNA, 15 nt, Pseudomonas aeruginosa PA01
cggggugccgccagu

SEQ ID NO: 1501305 - RNA, 11 nt, Pseudomonas aeruginosa PA01
cggggugcagg

SEQ ID NO: 1501306 - RNA, 13 nt, Pseudomonas aeruginosa PA01
cggggugcagggg

SEQ ID NO: 1501307 - RNA, 15 nt, Pseudomonas aeruginosa PA01
cggggugcaggggcg

SEQ ID NO: 1501308 - RNA, 13 nt, Pseudomonas aeruginosa PA01
cggggucgcgccg

SEQ ID NO: 1501309 - RNA, 19 nt, Pseudomonas aeruginosa PA01
cggggugauuuacaggacu

SEQ ID NO: 1501310 - RNA, 14 nt, Pseudomonas aeruginosa PA01
cggggugcgcggcg

SEQ ID NO: 1501311 - RNA, 20 nt, Pseudomonas aeruginosa PA01
cgggguggaguaccaggcca

SEQ ID NO: 1501312 - RNA, 15 nt, Pseudomonas aeruginosa PA01
cgggguauccgggca

SEQ ID NO: 1501313 - RNA, 18 nt, Pseudomonas aeruginosa PA01
cgggcucugguagccgca

SEQ ID NO: 1501314 - RNA, 21 nt, Pseudomonas aeruginosa PA01
cggggucagagggugaucagc

SEQ ID NO: 1501315 - RNA, 13 nt, Pseudomonas aeruginosa PA01
cggggucagcgcc

SEQ ID NO: 1501316 - RNA, 14 nt, Pseudomonas aeruginosa PA01
cggggucagcgccu

SEQ ID NO: 1501317 - RNA, 15 nt, Pseudomonas aeruginosa PA01
cggggucaggccgag

SEQ ID NO: 1501318 - RNA, 18 nt, Pseudomonas aeruginosa PA01
cggggucaguuccagguc

SEQ ID NO: 1501319 - RNA, 16 nt, Pseudomonas aeruginosa PA01
cgggcucuaugcgcgg

SEQ ID NO: 1501320 - RNA, 20 nt, Pseudomonas aeruginosa PA01
cggguagcguuaucgccggu

SEQ ID NO: 1501321 - RNA, 15 nt, Pseudomonas aeruginosa PA01
cggguagcugcuggg

SEQ ID NO: 1501322 - RNA, 13 nt, Pseudomonas aeruginosa PA01
cggguagcgccgg

SEQ ID NO: 1501323 - RNA, 14 nt, Pseudomonas aeruginosa PA01
cggguagcgccggu

SEQ ID NO: 1501324 - RNA, 22 nt, Pseudomonas aeruginosa PA01
cggguagggcgaauagcgccgc

SEQ ID NO: 1501325 - RNA, 19 nt, Pseudomonas aeruginosa PA01
cggguagccaugcacacgc

SEQ ID NO: 1501326 - RNA, 14 nt, Pseudomonas aeruginosa PA01
aaccagaccagcag

SEQ ID NO: 1501327 - RNA, 13 nt, Pseudomonas aeruginosa PA01
cggguaguccagc

SEQ ID NO: 1501328 - RNA, 16 nt, Pseudomonas aeruginosa PA01
cggguagucgaacugc

SEQ ID NO: 1501329 - RNA, 20 nt, Pseudomonas aeruginosa PA01
cggguagucgaacugcucga

SEQ ID NO: 1501330 - RNA, 16 nt, Pseudomonas aeruginosa PA01
cggguaucgauccagc

SEQ ID NO: 1501331 - RNA, 17 nt, Pseudomonas aeruginosa PA01
cggguaucgauccagcc

SEQ ID NO: 1501332 - RNA, 14 nt, Pseudomonas aeruginosa PA01
cggguauccagcac

SEQ ID NO: 1501333 - RNA, 16 nt, Pseudomonas aeruginosa PA01
cgggucaccaccggga

SEQ ID NO: 1501334 - RNA, 16 nt, Pseudomonas aeruginosa PA01
cgggucagcagugcgg

SEQ ID NO: 1501335 - RNA, 22 nt, Pseudomonas aeruginosa PA01
cgggucagcagugcggggcgcu

SEQ ID NO: 1501336 - RNA, 17 nt, Pseudomonas aeruginosa PA01
cgggucagcagcaccgc

SEQ ID NO: 1501337 - RNA, 22 nt, Pseudomonas aeruginosa PA01
cgggucagaccacgaagcgacc

SEQ ID NO: 1501338 - RNA, 16 nt, Pseudomonas aeruginosa PA01
cgggucaccagcgccg

SEQ ID NO: 1501339 - RNA, 14 nt, Pseudomonas aeruginosa PA01
cgggucaccagcgg

SEQ ID NO: 1501340 - RNA, 22 nt, Pseudomonas aeruginosa PA01
cgggucacgccgagggcgcggc

SEQ ID NO: 1501341 - RNA, 17 nt, Pseudomonas aeruginosa PA01
cgggucaucggcccgac

SEQ ID NO: 1501342 - RNA, 20 nt, Pseudomonas aeruginosa PA01
cgggucaucggcccgacgcc

SEQ ID NO: 1501343 - RNA, 14 nt, Pseudomonas aeruginosa PA01
cgggucaugccgcc

SEQ ID NO: 1501344 - RNA, 15 nt, Pseudomonas aeruginosa PA01
cgggucaugccgcca

SEQ ID NO: 1501345 - RNA, 14 nt, Pseudomonas aeruginosa PA01
cggguccaccgcgg

SEQ ID NO: 1501346 - RNA, 24 nt, Pseudomonas aeruginosa PA01
cggguccaccgcggccucgcuggc

SEQ ID NO: 1501347 - RNA, 13 nt, Pseudomonas aeruginosa PA01
cgggucaggccga

SEQ ID NO: 1501348 - RNA, 14 nt, Pseudomonas aeruginosa PA01
cgggucaggccgag

SEQ ID NO: 1501349 - RNA, 15 nt, Pseudomonas aeruginosa PA01
cgggucaggccgaga

SEQ ID NO: 1501350 - RNA, 20 nt, Pseudomonas aeruginosa PA01
cgggucgacuucgcaccagc

SEQ ID NO: 1501351 - RNA, 13 nt, Pseudomonas aeruginosa PA01
cgggucgaccuug

SEQ ID NO: 1501352 - RNA, 13 nt, Pseudomonas aeruginosa PA01
cgggucgacaugc

SEQ ID NO: 1501353 - RNA, 18 nt, Pseudomonas aeruginosa PA01
cgggucgacaugcaggcc

SEQ ID NO: 1501354 - RNA, 20 nt, Pseudomonas aeruginosa PA01
cgggucgacaugcaggccgg

SEQ ID NO: 1501355 - RNA, 21 nt, Pseudomonas aeruginosa PA01
cgggucgacaugcaggccggc

SEQ ID NO: 1501356 - RNA, 23 nt, Pseudomonas aeruginosa PA01
cgggucgacaugcaggccggccu

SEQ ID NO: 1501357 - RNA, 14 nt, Pseudomonas aeruginosa PA01
cgggucauuggcga

SEQ ID NO: 1501358 - RNA, 15 nt, Pseudomonas aeruginosa PA01
cgggucauuggcgaa

SEQ ID NO: 1501359 - RNA, 16 nt, Pseudomonas aeruginosa PA01
cgggucauuggcgaaa

SEQ ID NO: 1501360 - RNA, 20 nt, Pseudomonas aeruginosa PA01
cggguccaucugcaacgcgg

SEQ ID NO: 1501361 - RNA, 16 nt, Pseudomonas aeruginosa PA01
cgggucaucaccggca

SEQ ID NO: 1501362 - RNA, 17 nt, Pseudomonas aeruginosa PA01
cggguccagcggccgcg

SEQ ID NO: 1501363 - RNA, 14 nt, Pseudomonas aeruginosa PA01
cggguccaggcgcc

SEQ ID NO: 1501364 - RNA, 15 nt, Pseudomonas aeruginosa PA01
cggguccaggcgcca

SEQ ID NO: 1501365 - RNA, 17 nt, Pseudomonas aeruginosa PA01
cggguccaggcgccaga

SEQ ID NO: 1501366 - RNA, 15 nt, Pseudomonas aeruginosa PA01
cgggucgauggcugg

SEQ ID NO: 1501367 - RNA, 22 nt, Pseudomonas aeruginosa PA01
cgggucgccgcagcccuaggcg

SEQ ID NO: 1501368 - RNA, 23 nt, Pseudomonas aeruginosa PA01
cgggucgccgcagcccuaggcga

SEQ ID NO: 1501369 - RNA, 15 nt, Pseudomonas aeruginosa PA01
cgggucgcagccgag

SEQ ID NO: 1501370 - RNA, 16 nt, Pseudomonas aeruginosa PA01
cgggucgcagccgagc

SEQ ID NO: 1501371 - RNA, 14 nt, Pseudomonas aeruginosa PA01
cgggucgcagccgg

SEQ ID NO: 1501372 - RNA, 17 nt, Pseudomonas aeruginosa PA01
cgggucgaucaggcgca

SEQ ID NO: 1501373 - RNA, 15 nt, Pseudomonas aeruginosa PA01
cgggucgaggucgag

SEQ ID NO: 1501374 - RNA, 17 nt, Pseudomonas aeruginosa PA01
cgggucgagcuugccga

SEQ ID NO: 1501375 - RNA, 18 nt, Pseudomonas aeruginosa PA01
cgggucgagcuugccgag

SEQ ID NO: 1501376 - RNA, 17 nt, Pseudomonas aeruginosa PA01
cggguccuggaucacgc

SEQ ID NO: 1501377 - RNA, 18 nt, Pseudomonas aeruginosa PA01
cgggucgagccaggcgua

SEQ ID NO: 1501378 - RNA, 17 nt, Pseudomonas aeruginosa PA01
cggucaaccgcgggcga

SEQ ID NO: 1501379 - RNA, 20 nt, Pseudomonas aeruginosa PA01
cggucaaccgcgggcgaggu

SEQ ID NO: 1501380 - RNA, 16 nt, Pseudomonas aeruginosa PA01
cggucaaaccauggcg

SEQ ID NO: 1501381 - RNA, 18 nt, Pseudomonas aeruginosa PA01
cggucaaaccauggcgua

SEQ ID NO: 1501382 - RNA, 21 nt, Pseudomonas aeruginosa PA01
cgguauugaagucgucgucca

SEQ ID NO: 1501383 - RNA, 19 nt, Pseudomonas aeruginosa PA01
cgguauucuccagcaggcu

SEQ ID NO: 1501384 - RNA, 22 nt, Pseudomonas aeruginosa PA01
cgguauggaagaacaucgccug

SEQ ID NO: 1501385 - RNA, 14 nt, Pseudomonas aeruginosa PA01
cgguauguuucugg

SEQ ID NO: 1501386 - RNA, 17 nt, Pseudomonas aeruginosa PA01
cgguaucggcuugccgg

SEQ ID NO: 1501387 - RNA, 18 nt, Pseudomonas aeruginosa PA01
cgguaucggcuugccggc

SEQ ID NO: 1501388 - RNA, 23 nt, Pseudomonas aeruginosa PA01
cgguagguguacccagggugcgc

SEQ ID NO: 1501389 - RNA, 18 nt, Pseudomonas aeruginosa PA01
cgguagguagcguugcgc

SEQ ID NO: 1501390 - RNA, 15 nt, Pseudomonas aeruginosa PA01
cgguaggugagcgac

SEQ ID NO: 1501391 - RNA, 19 nt, Pseudomonas aeruginosa PA01
cgguaggugagcgacccgc

SEQ ID NO: 1501392 - RNA, 21 nt, Pseudomonas aeruginosa PA01
cgguaggugagcgacccgcug

SEQ ID NO: 1501393 - RNA, 17 nt, Pseudomonas aeruginosa PA01
cgguaggugaugcggcc

SEQ ID NO: 1501394 - RNA, 13 nt, Pseudomonas aeruginosa PA01
cgguaggugaugu

SEQ ID NO: 1501395 - RNA, 19 nt, Pseudomonas aeruginosa PA01
cgguagggcgaauagcgcc

SEQ ID NO: 1501396 - RNA, 23 nt, Pseudomonas aeruginosa PA01
cgguagggcgaauagcgccgcag

SEQ ID NO: 1501397 - RNA, 20 nt, Pseudomonas aeruginosa PA01
cgguagggaucgucgccaag

SEQ ID NO: 1501398 - RNA, 14 nt, Pseudomonas aeruginosa PA01
cgguagggccgagg

SEQ ID NO: 1501399 - RNA, 15 nt, Pseudomonas aeruginosa PA01
cgguaggggccgacg

SEQ ID NO: 1501400 - RNA, 12 nt, Pseudomonas aeruginosa PA01
cgguaggcgcgu

SEQ ID NO: 1501401 - RNA, 13 nt, Pseudomonas aeruginosa PA01
cgguagucgcugc

SEQ ID NO: 1501402 - RNA, 20 nt, Pseudomonas aeruginosa PA01
cgguagucgcugcuggcgcc

SEQ ID NO: 1501403 - RNA, 21 nt, Pseudomonas aeruginosa PA01
cgguagucgcugcuggcgccg

SEQ ID NO: 1501404 - RNA, 14 nt, Pseudomonas aeruginosa PA01
cgguagucggggca

SEQ ID NO: 1501405 - RNA, 16 nt, Pseudomonas aeruginosa PA01
cgguagcccgcggcga

SEQ ID NO: 1501406 - RNA, 18 nt, Pseudomonas aeruginosa PA01
cgguagcccgcggcgagc

SEQ ID NO: 1501407 - RNA, 20 nt, Pseudomonas aeruginosa PA01
cgguagccgaggcggccgag

SEQ ID NO: 1501408 - RNA, 18 nt, Pseudomonas aeruginosa PA01
cgguagccgaucaacgcg

SEQ ID NO: 1501409 - RNA, 23 nt, Pseudomonas aeruginosa PA01
cgguagccgaucaacgcggccag

SEQ ID NO: 1501410 - RNA, 14 nt, Pseudomonas aeruginosa PA01
cgguagcccggcag

SEQ ID NO: 1501411 - RNA, 15 nt, Pseudomonas aeruginosa PA01
cgguagcccggcagc

SEQ ID NO: 1501412 - RNA, 18 nt, Pseudomonas aeruginosa PA01
cgguagccggcgaucagc

SEQ ID NO: 1501413 - RNA, 23 nt, Pseudomonas aeruginosa PA01
cgguagccggcgaucagcgcuuc

SEQ ID NO: 1501414 - RNA, 15 nt, Pseudomonas aeruginosa PA01
cgguagcgccgcgcc

SEQ ID NO: 1501415 - RNA, 14 nt, Pseudomonas aeruginosa PA01
cgguagcgcgccug

SEQ ID NO: 1501416 - RNA, 15 nt, Pseudomonas aeruginosa PA01
cgguagcgcgccugc

SEQ ID NO: 1501417 - RNA, 15 nt, Pseudomonas aeruginosa PA01
cgguagcggaucagc

SEQ ID NO: 1501418 - RNA, 13 nt, Pseudomonas aeruginosa PA01
cgguagcggcagg

SEQ ID NO: 1501419 - RNA, 13 nt, Pseudomonas aeruginosa PA01
cgguagcggcgca

SEQ ID NO: 1501420 - RNA, 20 nt, Pseudomonas aeruginosa PA01
cgguaccucgugggugccgg

SEQ ID NO: 1501421 - RNA, 17 nt, Pseudomonas aeruginosa PA01
cgguaccgggccaggca

SEQ ID NO: 1501422 - RNA, 19 nt, Pseudomonas aeruginosa PA01
cgguaccgggccaggcaau

SEQ ID NO: 1501423 - RNA, 14 nt, Pseudomonas aeruginosa PA01
cgguacgcaccagc

SEQ ID NO: 1501424 - RNA, 16 nt, Pseudomonas aeruginosa PA01
cgguacgccgcgcugc

SEQ ID NO: 1501425 - RNA, 16 nt, Pseudomonas aeruginosa PA01
cgguacgcucaccacc

SEQ ID NO: 1501426 - RNA, 17 nt, Pseudomonas aeruginosa PA01
cgguacgcucaccacca

SEQ ID NO: 1501427 - RNA, 19 nt, Pseudomonas aeruginosa PA01
cgguacggucgaggcggag

SEQ ID NO: 1501428 - RNA, 23 nt, Pseudomonas aeruginosa PA01
cgguacggucgaggcggagaagc

SEQ ID NO: 1501429 - RNA, 20 nt, Pseudomonas aeruginosa PA01
cgguacuaucccggucgggu

SEQ ID NO: 1501430 - RNA, 14 nt, Pseudomonas aeruginosa PA01
cgguacugcgccag

SEQ ID NO: 1501431 - RNA, 17 nt, Pseudomonas aeruginosa PA01
cgguacuccuccagcau

SEQ ID NO: 1501432 - RNA, 12 nt, Pseudomonas aeruginosa PA01
cgguacucgccg

SEQ ID NO: 1501433 - RNA, 17 nt, Pseudomonas aeruginosa PA01
cgguacucgccgggcgu

SEQ ID NO: 1501434 - RNA, 23 nt, Pseudomonas aeruginosa PA01
cgguacugcugggccuugaucac

SEQ ID NO: 1501435 - RNA, 17 nt, Pseudomonas aeruginosa PA01
cgguagagacggcggcg

SEQ ID NO: 1501436 - RNA, 20 nt, Pseudomonas aeruginosa PA01
cgguagaccccggugugcgc

SEQ ID NO: 1501437 - RNA, 17 nt, Pseudomonas aeruginosa PA01
cgguagaucuccacccg

SEQ ID NO: 1501438 - RNA, 21 nt, Pseudomonas aeruginosa PA01
cggguuuggcgcccgccuugu

SEQ ID NO: 1501439 - RNA, 22 nt, Pseudomonas aeruginosa PA01
cggguuugugccguuccagcgg

SEQ ID NO: 1501440 - RNA, 22 nt, Pseudomonas aeruginosa PA01
cggguuuuuuuaugccucggcg

SEQ ID NO: 1501441 - RNA, 19 nt, Pseudomonas aeruginosa PA01
cggguuucgcugcugccgc

SEQ ID NO: 1501442 - RNA, 14 nt, Pseudomonas aeruginosa PA01
cggguuggucggca

SEQ ID NO: 1501443 - RNA, 15 nt, Pseudomonas aeruginosa PA01
cggguuggucggcac

SEQ ID NO: 1501444 - RNA, 17 nt, Pseudomonas aeruginosa PA01
cggguuggcuuccagcc

SEQ ID NO: 1501445 - RNA, 14 nt, Pseudomonas aeruginosa PA01
cggguuggcgcagg

SEQ ID NO: 1501446 - RNA, 16 nt, Pseudomonas aeruginosa PA01
cggguuggcgcaggcc

SEQ ID NO: 1501447 - RNA, 16 nt, Pseudomonas aeruginosa PA01
cggguugguggccgcg

SEQ ID NO: 1501448 - RNA, 18 nt, Pseudomonas aeruginosa PA01
cggguugguggccgcgcc

SEQ ID NO: 1501449 - RNA, 16 nt, Pseudomonas aeruginosa PA01
cggguugucguugcgc

SEQ ID NO: 1501450 - RNA, 15 nt, Pseudomonas aeruginosa PA01
cggguuuccgugcgc

SEQ ID NO: 1501451 - RNA, 21 nt, Pseudomonas aeruginosa PA01
cggguuuccgugcgcugcgcg

SEQ ID NO: 1501452 - RNA, 22 nt, Pseudomonas aeruginosa PA01
cggguuuccgugcgcugcgcgu

SEQ ID NO: 1501453 - RNA, 15 nt, Pseudomonas aeruginosa PA01
cggguuuccugcccg

SEQ ID NO: 1501454 - RNA, 15 nt, Pseudomonas aeruginosa PA01
cgguaaagcccaggu

SEQ ID NO: 1501455 - RNA, 16 nt, Pseudomonas aeruginosa PA01
cgguacagcgccuggu

SEQ ID NO: 1501456 - RNA, 20 nt, Pseudomonas aeruginosa PA01
cgguacaggcgcaccuggcg

SEQ ID NO: 1501457 - RNA, 18 nt, Pseudomonas aeruginosa PA01
cgguacauggccuucucg

SEQ ID NO: 1501458 - RNA, 17 nt, Pseudomonas aeruginosa PA01
cgguaccagcagcgccg

SEQ ID NO: 1501459 - RNA, 13 nt, Pseudomonas aeruginosa PA01
cgguaccagcgca

SEQ ID NO: 1501460 - RNA, 19 nt, Pseudomonas aeruginosa PA01
cgguaccagggaagcgcgc

SEQ ID NO: 1501461 - RNA, 21 nt, Pseudomonas aeruginosa PA01
cgguaccagggaagcgcgcgc

SEQ ID NO: 1501462 - RNA, 18 nt, Pseudomonas aeruginosa PA01
cgguacagccgguugcgu

SEQ ID NO: 1501463 - RNA, 13 nt, Pseudomonas aeruginosa PA01
cgguacccagcuu

SEQ ID NO: 1501464 - RNA, 14 nt, Pseudomonas aeruginosa PA01
cgguacccgccggc

SEQ ID NO: 1501465 - RNA, 22 nt, Pseudomonas aeruginosa PA01
cggucagcgcguucaccccgcc

SEQ ID NO: 1501466 - RNA, 12 nt, Pseudomonas aeruginosa PA01
cggucagcgacu

SEQ ID NO: 1501467 - RNA, 18 nt, Pseudomonas aeruginosa PA01
cggucagcgacuggcccu

SEQ ID NO: 1501468 - RNA, 19 nt, Pseudomonas aeruginosa PA01
cggucacucggccucggcg

SEQ ID NO: 1501469 - RNA, 18 nt, Pseudomonas aeruginosa PA01
cggucagagacagguacu

SEQ ID NO: 1501470 - RNA, 14 nt, Pseudomonas aeruginosa PA01
cggucagcagcagg

SEQ ID NO: 1501471 - RNA, 20 nt, Pseudomonas aeruginosa PA01
cggucacccauucgaugccg

SEQ ID NO: 1501472 - RNA, 15 nt, Pseudomonas aeruginosa PA01
cggucacgcaggcgc

SEQ ID NO: 1501473 - RNA, 18 nt, Pseudomonas aeruginosa PA01
cggucacgcaggcgcugg

SEQ ID NO: 1501474 - RNA, 15 nt, Pseudomonas aeruginosa PA01
cggucacgaaggcga

SEQ ID NO: 1501475 - RNA, 21 nt, Pseudomonas aeruginosa PA01
cggucacgaaggcgaucacgg

SEQ ID NO: 1501476 - RNA, 22 nt, Pseudomonas aeruginosa PA01
cggucacgccgggaauccccag

SEQ ID NO: 1501477 - RNA, 15 nt, Pseudomonas aeruginosa PA01
cggucauccgccggc

SEQ ID NO: 1501478 - RNA, 16 nt, Pseudomonas aeruginosa PA01
cggucauccgccggcg

SEQ ID NO: 1501479 - RNA, 21 nt, Pseudomonas aeruginosa PA01
cggucaucacgcuuuccggcu

SEQ ID NO: 1501480 - RNA, 19 nt, Pseudomonas aeruginosa PA01
cggucaucgccggcgccga

SEQ ID NO: 1501481 - RNA, 13 nt, Pseudomonas aeruginosa PA01
cggucaucgcgcc

SEQ ID NO: 1501482 - RNA, 15 nt, Pseudomonas aeruginosa PA01
cggucaucgcgccgc

SEQ ID NO: 1501483 - RNA, 17 nt, Pseudomonas aeruginosa PA01
cggucaucgcgccgccg

SEQ ID NO: 1501484 - RNA, 21 nt, Pseudomonas aeruginosa PA01
cggucaucgcgccgccgaagc

SEQ ID NO: 1501485 - RNA, 23 nt, Pseudomonas aeruginosa PA01
cggucaucgcgccgccgaagccg

SEQ ID NO: 1501486 - RNA, 17 nt, Pseudomonas aeruginosa PA01
cggucaugcccuugucg

SEQ ID NO: 1501487 - RNA, 17 nt, Pseudomonas aeruginosa PA01
cggucauggugccgagc

SEQ ID NO: 1501488 - RNA, 19 nt, Pseudomonas aeruginosa PA01
cggucauguccggggcgau

SEQ ID NO: 1501489 - RNA, 18 nt, Pseudomonas aeruginosa PA01
cggucauggccagcucga

SEQ ID NO: 1501490 - RNA, 12 nt, Pseudomonas aeruginosa PA01
cgguccaccagg

SEQ ID NO: 1501491 - RNA, 20 nt, Pseudomonas aeruginosa PA01
cggucagcuucgccgcccug

SEQ ID NO: 1501492 - RNA, 15 nt, Pseudomonas aeruginosa PA01
cggucaggccgagca

SEQ ID NO: 1501493 - RNA, 19 nt, Pseudomonas aeruginosa PA01
cggucaggccgagcagcgc

SEQ ID NO: 1501494 - RNA, 20 nt, Pseudomonas aeruginosa PA01
cggucaggccgagcagcgcc

SEQ ID NO: 1501495 - RNA, 20 nt, Pseudomonas aeruginosa PA01
cggucaggccgaucaccacc

SEQ ID NO: 1501496 - RNA, 23 nt, Pseudomonas aeruginosa PA01
cggucaggccgaucaccaccagc

SEQ ID NO: 1501497 - RNA, 14 nt, Pseudomonas aeruginosa PA01
cggucagcucggca

SEQ ID NO: 1501498 - RNA, 20 nt, Pseudomonas aeruginosa PA01
cggucagcucccugauccgc

SEQ ID NO: 1501499 - RNA, 20 nt, Pseudomonas aeruginosa PA01
cggucaggcucagcucggcg

SEQ ID NO: 1501500 - RNA, 23 nt, Pseudomonas aeruginosa PA01
cggucaggcucagcucggcgaug

SEQ ID NO: 1501501 - RNA, 14 nt, Pseudomonas aeruginosa PA01
cggucaggcgcugg

SEQ ID NO: 1501502 - RNA, 19 nt, Pseudomonas aeruginosa PA01
cggucaggcugaucggcgc

SEQ ID NO: 1501503 - RNA, 21 nt, Pseudomonas aeruginosa PA01
cggucaggcuggugccgcugu

SEQ ID NO: 1501504 - RNA, 21 nt, Pseudomonas aeruginosa PA01
cggucagguauucgccggcca

SEQ ID NO: 1501505 - RNA, 22 nt, Pseudomonas aeruginosa PA01
cggucagguacguuuccaguuc

SEQ ID NO: 1501506 - RNA, 18 nt, Pseudomonas aeruginosa PA01
cggucagguugaccuucu

SEQ ID NO: 1501507 - RNA, 18 nt, Pseudomonas aeruginosa PA01
cggucagguuggacaggu

SEQ ID NO: 1501508 - RNA, 16 nt, Pseudomonas aeruginosa PA01
cgguccguccagcgcg

SEQ ID NO: 1501509 - RNA, 17 nt, Pseudomonas aeruginosa PA01
cgguccguccagcgcgc

SEQ ID NO: 1501510 - RNA, 18 nt, Pseudomonas aeruginosa PA01
cgguccucgggcaccagc

SEQ ID NO: 1501511 - RNA, 21 nt, Pseudomonas aeruginosa PA01
cgguccuuguccggguagucc

SEQ ID NO: 1501512 - RNA, 21 nt, Pseudomonas aeruginosa PA01
cggucgaacugaccaccagga

SEQ ID NO: 1501513 - RNA, 14 nt, Pseudomonas aeruginosa PA01
cggucgagcagcgc

SEQ ID NO: 1501514 - RNA, 16 nt, Pseudomonas aeruginosa PA01
cggucgagcagcgccg

SEQ ID NO: 1501515 - RNA, 17 nt, Pseudomonas aeruginosa PA01
cggucgagacccgcaac

SEQ ID NO: 1501516 - RNA, 14 nt, Pseudomonas aeruginosa PA01
cgguccgccgaugc

SEQ ID NO: 1501517 - RNA, 17 nt, Pseudomonas aeruginosa PA01
cggucgacggcgugcag

SEQ ID NO: 1501518 - RNA, 20 nt, Pseudomonas aeruginosa PA01
cggucgauguccugggccac

SEQ ID NO: 1501519 - RNA, 16 nt, Pseudomonas aeruginosa PA01
cggucgaugucgcggc

SEQ ID NO: 1501520 - RNA, 20 nt, Pseudomonas aeruginosa PA01
cggucgagcucggccaggca

SEQ ID NO: 1501521 - RNA, 19 nt, Pseudomonas aeruginosa PA01
cggucgagguugcgcggca

SEQ ID NO: 1501522 - RNA, 14 nt, Pseudomonas aeruginosa PA01
cggucgaggcccuc

SEQ ID NO: 1501523 - RNA, 16 nt, Pseudomonas aeruginosa PA01
cggucgaggcccucgg

SEQ ID NO: 1501524 - RNA, 18 nt, Pseudomonas aeruginosa PA01
cggucgaggcccucggcg

SEQ ID NO: 1501525 - RNA, 20 nt, Pseudomonas aeruginosa PA01
cggucgaggcccucggcggc

SEQ ID NO: 1501526 - RNA, 14 nt, Pseudomonas aeruginosa PA01
cggucgaggcggag

SEQ ID NO: 1501527 - RNA, 23 nt, Pseudomonas aeruginosa PA01
cgguccggugaaccugaccaucg

SEQ ID NO: 1501528 - RNA, 15 nt, Pseudomonas aeruginosa PA01
cgguccgccgcggga

SEQ ID NO: 1501529 - RNA, 21 nt, Pseudomonas aeruginosa PA01
cgguccgccgcgggacgccgc

SEQ ID NO: 1501530 - RNA, 22 nt, Pseudomonas aeruginosa PA01
cgguccgcgccacgcaguggga

SEQ ID NO: 1501531 - RNA, 20 nt, Pseudomonas aeruginosa PA01
cgguccgcgguagcugcgca

SEQ ID NO: 1501532 - RNA, 14 nt, Pseudomonas aeruginosa PA01
cggucccucggggc

SEQ ID NO: 1501533 - RNA, 19 nt, Pseudomonas aeruginosa PA01
cgguccgacaaucagcggc

SEQ ID NO: 1501534 - RNA, 20 nt, Pseudomonas aeruginosa PA01
cggucccgggaaaccaccag

SEQ ID NO: 1501535 - RNA, 21 nt, Pseudomonas aeruginosa PA01
cgguccagaucgccaccccgc

SEQ ID NO: 1501536 - RNA, 18 nt, Pseudomonas aeruginosa PA01
cgguccaggggccgaugc

SEQ ID NO: 1501537 - RNA, 23 nt, Pseudomonas aeruginosa PA01
cgguccaggggccgaugccgggc

SEQ ID NO: 1501538 - RNA, 19 nt, Pseudomonas aeruginosa PA01
cgguccaggucaugcccug

SEQ ID NO: 1501539 - RNA, 17 nt, Pseudomonas aeruginosa PA01
cggucccagaccagcag

SEQ ID NO: 1501540 - RNA, 22 nt, Pseudomonas aeruginosa PA01
cggucccagaccagcagcggca

SEQ ID NO: 1501541 - RNA, 23 nt, Pseudomonas aeruginosa PA01
cggucccagaccagcagcggcag

SEQ ID NO: 1501542 - RNA, 20 nt, Pseudomonas aeruginosa PA01
cggucccagguagcgcugcg

SEQ ID NO: 1501543 - RNA, 23 nt, Pseudomonas aeruginosa PA01
cggucccagguagcgcugcgcca

SEQ ID NO: 1501544 - RNA, 15 nt, Pseudomonas aeruginosa PA01
cgguccccuccaggu

SEQ ID NO: 1501545 - RNA, 18 nt, Pseudomonas aeruginosa PA01
cgguccccuccagguagg

SEQ ID NO: 1501546 - RNA, 20 nt, Pseudomonas aeruginosa PA01
cgguccccaguagcaucccc

SEQ ID NO: 1501547 - RNA, 13 nt, Pseudomonas aeruginosa PA01
cggucccaucagc

SEQ ID NO: 1501548 - RNA, 22 nt, Pseudomonas aeruginosa PA01
aacaucgccugcuuggcggcgg

SEQ ID NO: 1501549 - RNA, 20 nt, Pseudomonas aeruginosa PA01
cggccaggucguugcgccgg

SEQ ID NO: 1501550 - RNA, 16 nt, Pseudomonas aeruginosa PA01
cggccaggucgcgggu

SEQ ID NO: 1501551 - RNA, 15 nt, Pseudomonas aeruginosa PA01
cggccaggucgaggu

SEQ ID NO: 1501552 - RNA, 13 nt, Pseudomonas aeruginosa PA01
cggccaggucgcg

SEQ ID NO: 1501553 - RNA, 13 nt, Pseudomonas aeruginosa PA01
aacauccgcggcc

SEQ ID NO: 1501554 - RNA, 18 nt, Pseudomonas aeruginosa PA01
aacauccgcggccccggc

SEQ ID NO: 1501555 - RNA, 14 nt, Pseudomonas aeruginosa PA01
cggccaggcacagg

SEQ ID NO: 1501556 - RNA, 19 nt, Pseudomonas aeruginosa PA01
cggccaggcauuccuccag

SEQ ID NO: 1501557 - RNA, 13 nt, Pseudomonas aeruginosa PA01
cggccaggccacg

SEQ ID NO: 1501558 - RNA, 19 nt, Pseudomonas aeruginosa PA01
cggccaggccacggccggc

SEQ ID NO: 1501559 - RNA, 20 nt, Pseudomonas aeruginosa PA01
cggccaggccacggccggcg

SEQ ID NO: 1501560 - RNA, 22 nt, Pseudomonas aeruginosa PA01
cggccaggccacggccggcgag

SEQ ID NO: 1501561 - RNA, 18 nt, Pseudomonas aeruginosa PA01
cggccaucagcaccagga

SEQ ID NO: 1501562 - RNA, 23 nt, Pseudomonas aeruginosa PA01
cggccaucagcaccaggaagccc

SEQ ID NO: 1501563 - RNA, 16 nt, Pseudomonas aeruginosa PA01
cggccaucagcgccag

SEQ ID NO: 1501564 - RNA, 12 nt, Pseudomonas aeruginosa PA01
cggccaucaggc

SEQ ID NO: 1501565 - RNA, 13 nt, Pseudomonas aeruginosa PA01
cggccaucaggcg

SEQ ID NO: 1501566 - RNA, 16 nt, Pseudomonas aeruginosa PA01
cggccaucaggcgcug

SEQ ID NO: 1501567 - RNA, 15 nt, Pseudomonas aeruginosa PA01
cggccauccuggccg

SEQ ID NO: 1501568 - RNA, 20 nt, Pseudomonas aeruginosa PA01
cggccauccuggccggucgu

SEQ ID NO: 1501569 - RNA, 15 nt, Pseudomonas aeruginosa PA01
cggccauccagccag

SEQ ID NO: 1501570 - RNA, 14 nt, Pseudomonas aeruginosa PA01
cggccaucgagcgc

SEQ ID NO: 1501571 - RNA, 14 nt, Pseudomonas aeruginosa PA01
cggccagguggucg

SEQ ID NO: 1501572 - RNA, 15 nt, Pseudomonas aeruginosa PA01
cggccagguugacca

SEQ ID NO: 1501573 - RNA, 19 nt, Pseudomonas aeruginosa PA01
cggccauucgcugucgagc

SEQ ID NO: 1501574 - RNA, 23 nt, Pseudomonas aeruginosa PA01
cggccauucgcugucgagcaggg

SEQ ID NO: 1501575 - RNA, 14 nt, Pseudomonas aeruginosa PA01
cggccauucggccu

SEQ ID NO: 1501576 - RNA, 17 nt, Pseudomonas aeruginosa PA01
cggccauugccgcgggc

SEQ ID NO: 1501577 - RNA, 20 nt, Pseudomonas aeruginosa PA01
cggccauuuuucaugggcgg

SEQ ID NO: 1501578 - RNA, 12 nt, Pseudomonas aeruginosa PA01
cggcccagcgcc

SEQ ID NO: 1501579 - RNA, 13 nt, Pseudomonas aeruginosa PA01
cggcccagcgccc

SEQ ID NO: 1501580 - RNA, 15 nt, Pseudomonas aeruginosa PA01
cggcccagcgccccg

SEQ ID NO: 1501581 - RNA, 23 nt, Pseudomonas aeruginosa PA01
cggccauggcgggucacgccgaa

SEQ ID NO: 1501582 - RNA, 12 nt, Pseudomonas aeruginosa PA01
cggccaucgccg

SEQ ID NO: 1501583 - RNA, 14 nt, Pseudomonas aeruginosa PA01
cggccaucggcgaa

SEQ ID NO: 1501584 - RNA, 13 nt, Pseudomonas aeruginosa PA01
cggccaucgccgu

SEQ ID NO: 1501585 - RNA, 17 nt, Pseudomonas aeruginosa PA01
cggccauuacgccgagc

SEQ ID NO: 1501586 - RNA, 13 nt, Pseudomonas aeruginosa PA01
cggccaugucccg

SEQ ID NO: 1501587 - RNA, 22 nt, Pseudomonas aeruginosa PA01
cggccauggucucgcugaccca

SEQ ID NO: 1501588 - RNA, 13 nt, Pseudomonas aeruginosa PA01
cggcccagcggca

SEQ ID NO: 1501589 - RNA, 23 nt, Pseudomonas aeruginosa PA01
cggcccagcguucggcgcuggcg

SEQ ID NO: 1501590 - RNA, 13 nt, Pseudomonas aeruginosa PA01
cggcccaggccgg

SEQ ID NO: 1501591 - RNA, 12 nt, Pseudomonas aeruginosa PA01
cggcccaggccg

SEQ ID NO: 1501592 - RNA, 13 nt, Pseudomonas aeruginosa PA01
cggccagcgccgc

SEQ ID NO: 1501593 - RNA, 23 nt, Pseudomonas aeruginosa PA01
cggccagcgugaagaccuggucc

SEQ ID NO: 1501594 - RNA, 12 nt, Pseudomonas aeruginosa PA01
cggccagcguga

SEQ ID NO: 1501595 - RNA, 16 nt, Pseudomonas aeruginosa PA01
cggccagcgcggcgcg

SEQ ID NO: 1501596 - RNA, 17 nt, Pseudomonas aeruginosa PA01
cggccagcgcggcgcgc

SEQ ID NO: 1501597 - RNA, 18 nt, Pseudomonas aeruginosa PA01
cggccagcgcggcgcgcu

SEQ ID NO: 1501598 - RNA, 16 nt, Pseudomonas aeruginosa PA01
cggccagcgcggcgga

SEQ ID NO: 1501599 - RNA, 19 nt, Pseudomonas aeruginosa PA01
cggccagcgcggcggacag

SEQ ID NO: 1501600 - RNA, 20 nt, Pseudomonas aeruginosa PA01
cggccagcguccuucggcgc

SEQ ID NO: 1501601 - RNA, 14 nt, Pseudomonas aeruginosa PA01
cggccagcgcggcg

SEQ ID NO: 1501602 - RNA, 15 nt, Pseudomonas aeruginosa PA01
cggccagcgcggccg

SEQ ID NO: 1501603 - RNA, 16 nt, Pseudomonas aeruginosa PA01
cggccagcgcggccgc

SEQ ID NO: 1501604 - RNA, 20 nt, Pseudomonas aeruginosa PA01
cggccagcgcggccgccgcc

SEQ ID NO: 1501605 - RNA, 13 nt, Pseudomonas aeruginosa PA01
cggccagcuucuc

SEQ ID NO: 1501606 - RNA, 18 nt, Pseudomonas aeruginosa PA01
cggccagcuucuccagca

SEQ ID NO: 1501607 - RNA, 15 nt, Pseudomonas aeruginosa PA01
cggccagcucgccga

SEQ ID NO: 1501608 - RNA, 18 nt, Pseudomonas aeruginosa PA01
cggccagcucgccgguca

SEQ ID NO: 1501609 - RNA, 19 nt, Pseudomonas aeruginosa PA01
cggccaggaaggccgcuuc

SEQ ID NO: 1501610 - RNA, 14 nt, Pseudomonas aeruginosa PA01
cggccaggaccagg

SEQ ID NO: 1501611 - RNA, 18 nt, Pseudomonas aeruginosa PA01
cggccaggaccagggcgg

SEQ ID NO: 1501612 - RNA, 16 nt, Pseudomonas aeruginosa PA01
cggccaggacgccacc

SEQ ID NO: 1501613 - RNA, 19 nt, Pseudomonas aeruginosa PA01
cggccaggacgccaccagg

SEQ ID NO: 1501614 - RNA, 12 nt, Pseudomonas aeruginosa PA01
cggccaccagcg

SEQ ID NO: 1501615 - RNA, 21 nt, Pseudomonas aeruginosa PA01
cggccagcaaugcccgcgccu

SEQ ID NO: 1501616 - RNA, 15 nt, Pseudomonas aeruginosa PA01
cggccagccggcgcc

SEQ ID NO: 1501617 - RNA, 16 nt, Pseudomonas aeruginosa PA01
cggccagccggcgccg

SEQ ID NO: 1501618 - RNA, 14 nt, Pseudomonas aeruginosa PA01
cggccagcaccuuc

SEQ ID NO: 1501619 - RNA, 19 nt, Pseudomonas aeruginosa PA01
cggccagccuggccagcgc

SEQ ID NO: 1501620 - RNA, 20 nt, Pseudomonas aeruginosa PA01
cggccagccuucccggcgcu

SEQ ID NO: 1501621 - RNA, 17 nt, Pseudomonas aeruginosa PA01
cggccagccuuccucgg

SEQ ID NO: 1501622 - RNA, 11 nt, Pseudomonas aeruginosa PA01
cggccagcgca

SEQ ID NO: 1501623 - RNA, 12 nt, Pseudomonas aeruginosa PA01
cggccagcgcau

SEQ ID NO: 1501624 - RNA, 17 nt, Pseudomonas aeruginosa PA01
cggccagcgcaucgagg

SEQ ID NO: 1501625 - RNA, 21 nt, Pseudomonas aeruginosa PA01
cggccagcgcaucgaggccgg

SEQ ID NO: 1501626 - RNA, 18 nt, Pseudomonas aeruginosa PA01
cggccagcgccacggcgc

SEQ ID NO: 1501627 - RNA, 14 nt, Pseudomonas aeruginosa PA01
cggccagcgccagg

SEQ ID NO: 1501628 - RNA, 17 nt, Pseudomonas aeruginosa PA01
cggccagcgccgccgcu

SEQ ID NO: 1501629 - RNA, 14 nt, Pseudomonas aeruginosa PA01
cggccgcgagcgcg

SEQ ID NO: 1501630 - RNA, 15 nt, Pseudomonas aeruginosa PA01
cggccgcgagcgcgg

SEQ ID NO: 1501631 - RNA, 18 nt, Pseudomonas aeruginosa PA01
cggccgcgagcgcggccg

SEQ ID NO: 1501632 - RNA, 12 nt, Pseudomonas aeruginosa PA01
cggccgcgccag

SEQ ID NO: 1501633 - RNA, 15 nt, Pseudomonas aeruginosa PA01
cggccgcgccagcca

SEQ ID NO: 1501634 - RNA, 14 nt, Pseudomonas aeruginosa PA01
cggccgcgccggcu

SEQ ID NO: 1501635 - RNA, 12 nt, Pseudomonas aeruginosa PA01
cggccgcgccgg

SEQ ID NO: 1501636 - RNA, 18 nt, Pseudomonas aeruginosa PA01
cggccgcgccuucagcgc

SEQ ID NO: 1501637 - RNA, 23 nt, Pseudomonas aeruginosa PA01
cggccgcgccuucagcgccagca

SEQ ID NO: 1501638 - RNA, 22 nt, Pseudomonas aeruginosa PA01
cggccgcgccuugcucaggucg

SEQ ID NO: 1501639 - RNA, 13 nt, Pseudomonas aeruginosa PA01
cggccgcugccgg

SEQ ID NO: 1501640 - RNA, 14 nt, Pseudomonas aeruginosa PA01
cggccgcugccggg

SEQ ID NO: 1501641 - RNA, 16 nt, Pseudomonas aeruginosa PA01
cggccgcugccgggcu

SEQ ID NO: 1501642 - RNA, 13 nt, Pseudomonas aeruginosa PA01
cggccgcugccgu

SEQ ID NO: 1501643 - RNA, 15 nt, Pseudomonas aeruginosa PA01
cggccgcugcgcagg

SEQ ID NO: 1501644 - RNA, 18 nt, Pseudomonas aeruginosa PA01
cggccgcugcgcaggccg

SEQ ID NO: 1501645 - RNA, 20 nt, Pseudomonas aeruginosa PA01
cggccgcugcgcaggccgag

SEQ ID NO: 1501646 - RNA, 16 nt, Pseudomonas aeruginosa PA01
cggcccucacgggccg

SEQ ID NO: 1501647 - RNA, 18 nt, Pseudomonas aeruginosa PA01
cggccgaaaucgaugucg

SEQ ID NO: 1501648 - RNA, 16 nt, Pseudomonas aeruginosa PA01
cggccgaacucuggcg

SEQ ID NO: 1501649 - RNA, 18 nt, Pseudomonas aeruginosa PA01
cggccgaacucuggcggc

SEQ ID NO: 1501650 - RNA, 19 nt, Pseudomonas aeruginosa PA01
cggccgaacucuggcggcg

SEQ ID NO: 1501651 - RNA, 20 nt, Pseudomonas aeruginosa PA01
cggccgaacucuggcggcgu

SEQ ID NO: 1501652 - RNA, 21 nt, Pseudomonas aeruginosa PA01
cggccgaacucuggcggcgua

SEQ ID NO: 1501653 - RNA, 24 nt, Pseudomonas aeruginosa PA01
cggccgaacucuggcggcguaucc

SEQ ID NO: 1501654 - RNA, 15 nt, Pseudomonas aeruginosa PA01
cggccgaacagacgc

SEQ ID NO: 1501655 - RNA, 17 nt, Pseudomonas aeruginosa PA01
cggccgaucuucagcag

SEQ ID NO: 1501656 - RNA, 18 nt, Pseudomonas aeruginosa PA01
cggccgaucuucagcagc

SEQ ID NO: 1501657 - RNA, 19 nt, Pseudomonas aeruginosa PA01
cggccgaucuucagcagca

SEQ ID NO: 1501658 - RNA, 23 nt, Pseudomonas aeruginosa PA01
cggccgaucuucagcagcaggcg

SEQ ID NO: 1501659 - RNA, 18 nt, Pseudomonas aeruginosa PA01
cggccgaauccuccagcc

SEQ ID NO: 1501660 - RNA, 19 nt, Pseudomonas aeruginosa PA01
cggccgaauccuccagccg

SEQ ID NO: 1501661 - RNA, 21 nt, Pseudomonas aeruginosa PA01
cggccgaauccuccagccggc

SEQ ID NO: 1501662 - RNA, 18 nt, Pseudomonas aeruginosa PA01
cggccgaugcuaucgcgu

SEQ ID NO: 1501663 - RNA, 21 nt, Pseudomonas aeruginosa PA01
cggccgaugcuaucgcguggc

SEQ ID NO: 1501664 - RNA, 21 nt, Pseudomonas aeruginosa PA01
cggccgauggaaaucggccac

SEQ ID NO: 1501665 - RNA, 12 nt, Pseudomonas aeruginosa PA01
cggccgaugauc

SEQ ID NO: 1501666 - RNA, 19 nt, Pseudomonas aeruginosa PA01
cggccgaugaucuccgcgc

SEQ ID NO: 1501667 - RNA, 22 nt, Pseudomonas aeruginosa PA01
cggccgaugaucuccgcgccgg

SEQ ID NO: 1501668 - RNA, 14 nt, Pseudomonas aeruginosa PA01
cggccgcaaccagc

SEQ ID NO: 1501669 - RNA, 16 nt, Pseudomonas aeruginosa PA01
cggccgcaaccagccc

SEQ ID NO: 1501670 - RNA, 13 nt, Pseudomonas aeruginosa PA01
cggccgcaccagg

SEQ ID NO: 1501671 - RNA, 16 nt, Pseudomonas aeruginosa PA01
cggccgcccgagccgc

SEQ ID NO: 1501672 - RNA, 16 nt, Pseudomonas aeruginosa PA01
cggccgccuuccucgg

SEQ ID NO: 1501673 - RNA, 12 nt, Pseudomonas aeruginosa PA01
cggccgccaggc

SEQ ID NO: 1501674 - RNA, 13 nt, Pseudomonas aeruginosa PA01
cggccgccaggcg

SEQ ID NO: 1501675 - RNA, 15 nt, Pseudomonas aeruginosa PA01
cggccgccaggcgcg

SEQ ID NO: 1501676 - RNA, 16 nt, Pseudomonas aeruginosa PA01
cggccgccaggcgcgu

SEQ ID NO: 1501677 - RNA, 13 nt, Pseudomonas aeruginosa PA01
cggccgccaggcu

SEQ ID NO: 1501678 - RNA, 20 nt, Pseudomonas aeruginosa PA01
cggccgccagcagguagacg

SEQ ID NO: 1501679 - RNA, 13 nt, Pseudomonas aeruginosa PA01
cggccgccagcag

SEQ ID NO: 1501680 - RNA, 22 nt, Pseudomonas aeruginosa PA01
cggcccgcggucacucggccuc

SEQ ID NO: 1501681 - RNA, 23 nt, Pseudomonas aeruginosa PA01
cggcccgcggucacucggccucg

SEQ ID NO: 1501682 - RNA, 17 nt, Pseudomonas aeruginosa PA01
cggcccgcggaucgcgc

SEQ ID NO: 1501683 - RNA, 17 nt, Pseudomonas aeruginosa PA01
cggcccgcgccgccucg

SEQ ID NO: 1501684 - RNA, 22 nt, Pseudomonas aeruginosa PA01
cggcccgcucuugauacccacc

SEQ ID NO: 1501685 - RNA, 14 nt, Pseudomonas aeruginosa PA01
cggcccgcgccaug

SEQ ID NO: 1501686 - RNA, 13 nt, Pseudomonas aeruginosa PA01
cggcccgccggcg

SEQ ID NO: 1501687 - RNA, 15 nt, Pseudomonas aeruginosa PA01
cggcccgccucggcg

SEQ ID NO: 1501688 - RNA, 17 nt, Pseudomonas aeruginosa PA01
cggcccgccucggcggc

SEQ ID NO: 1501689 - RNA, 16 nt, Pseudomonas aeruginosa PA01
cggcccgccgccgggg

SEQ ID NO: 1501690 - RNA, 12 nt, Pseudomonas aeruginosa PA01
cggcccgccggc

SEQ ID NO: 1501691 - RNA, 12 nt, Pseudomonas aeruginosa PA01
cggcccggucag

SEQ ID NO: 1501692 - RNA, 19 nt, Pseudomonas aeruginosa PA01
cggcccggucagcuucgcc

SEQ ID NO: 1501693 - RNA, 22 nt, Pseudomonas aeruginosa PA01
cggcccggucagcuucgccgcc

SEQ ID NO: 1501694 - RNA, 19 nt, Pseudomonas aeruginosa PA01
cggcccggagaccgugccg

SEQ ID NO: 1501695 - RNA, 19 nt, Pseudomonas aeruginosa PA01
cggcccggagaucgccgcg

SEQ ID NO: 1501696 - RNA, 15 nt, Pseudomonas aeruginosa PA01
cggcccgggcgccac

SEQ ID NO: 1501697 - RNA, 22 nt, Pseudomonas aeruginosa PA01
cggcccggggcucugccggugu

SEQ ID NO: 1501698 - RNA, 12 nt, Pseudomonas aeruginosa PA01
cggcccuugucg

SEQ ID NO: 1501699 - RNA, 18 nt, Pseudomonas aeruginosa PA01
cggcccuugucgccgcug

SEQ ID NO: 1501700 - RNA, 19 nt, Pseudomonas aeruginosa PA01
cggcccuugucgccgcugg

SEQ ID NO: 1501701 - RNA, 20 nt, Pseudomonas aeruginosa PA01
cggcccuugucgccgcuggg

SEQ ID NO: 1501702 - RNA, 22 nt, Pseudomonas aeruginosa PA01
cggcccuugucgccgcugggca

SEQ ID NO: 1501703 - RNA, 23 nt, Pseudomonas aeruginosa PA01
cggcccuuguucgcggcgaugcg

SEQ ID NO: 1501704 - RNA, 17 nt, Pseudomonas aeruginosa PA01
cggcccgcacagguaga

SEQ ID NO: 1501705 - RNA, 15 nt, Pseudomonas aeruginosa PA01
cggccccggcgcucg

SEQ ID NO: 1501706 - RNA, 14 nt, Pseudomonas aeruginosa PA01
cggcccgagggcgg

SEQ ID NO: 1501707 - RNA, 14 nt, Pseudomonas aeruginosa PA01
cggcccgagcaggc

SEQ ID NO: 1501708 - RNA, 17 nt, Pseudomonas aeruginosa PA01
cggcccgcaugaacgcc

SEQ ID NO: 1501709 - RNA, 20 nt, Pseudomonas aeruginosa PA01
cggcccgcaugaacgccucg

SEQ ID NO: 1501710 - RNA, 23 nt, Pseudomonas aeruginosa PA01
cggcccgcaugaacgccucgcca

SEQ ID NO: 1501711 - RNA, 21 nt, Pseudomonas aeruginosa PA01
cggcccgccacagaucgccag

SEQ ID NO: 1501712 - RNA, 20 nt, Pseudomonas aeruginosa PA01
cggccccgcgguacccggca

SEQ ID NO: 1501713 - RNA, 14 nt, Pseudomonas aeruginosa PA01
cggccccggccagg

SEQ ID NO: 1501714 - RNA, 12 nt, Pseudomonas aeruginosa PA01
cggcccgaccca

SEQ ID NO: 1501715 - RNA, 17 nt, Pseudomonas aeruginosa PA01
cggccccugggccggcu

SEQ ID NO: 1501716 - RNA, 19 nt, Pseudomonas aeruginosa PA01
cggccccuucagcuccagc

SEQ ID NO: 1501717 - RNA, 19 nt, Pseudomonas aeruginosa PA01
cggcagcgcguagaccacc

SEQ ID NO: 1501718 - RNA, 12 nt, Pseudomonas aeruginosa PA01
cggcagcggcgu

SEQ ID NO: 1501719 - RNA, 23 nt, Pseudomonas aeruginosa PA01
cggcagcggcgugaagccgccgc

SEQ ID NO: 1501720 - RNA, 12 nt, Pseudomonas aeruginosa PA01
cggcagcggcug

SEQ ID NO: 1501721 - RNA, 13 nt, Pseudomonas aeruginosa PA01
cggcagcggcugg

SEQ ID NO: 1501722 - RNA, 15 nt, Pseudomonas aeruginosa PA01
cggcagcggcuggcc

SEQ ID NO: 1501723 - RNA, 12 nt, Pseudomonas aeruginosa PA01
cggcagcgguga

SEQ ID NO: 1501724 - RNA, 21 nt, Pseudomonas aeruginosa PA01
cggcagcggugaagguccgcg

SEQ ID NO: 1501725 - RNA, 23 nt, Pseudomonas aeruginosa PA01
cggcagcggugaagguccgcgcc

SEQ ID NO: 1501726 - RNA, 19 nt, Pseudomonas aeruginosa PA01
cggcagcgucgagcuggcg

SEQ ID NO: 1501727 - RNA, 21 nt, Pseudomonas aeruginosa PA01
cggcagcgucgagcuggcgca

SEQ ID NO: 1501728 - RNA, 18 nt, Pseudomonas aeruginosa PA01
cggcagcgucucagcccu

SEQ ID NO: 1501729 - RNA, 19 nt, Pseudomonas aeruginosa PA01
cggcagcgucucggcugcc

SEQ ID NO: 1501730 - RNA, 20 nt, Pseudomonas aeruginosa PA01
cggcagcgucucggcugccg

SEQ ID NO: 1501731 - RNA, 15 nt, Pseudomonas aeruginosa PA01
cggcagguucagcag

SEQ ID NO: 1501732 - RNA, 16 nt, Pseudomonas aeruginosa PA01
cggcagguucagcagg

SEQ ID NO: 1501733 - RNA, 17 nt, Pseudomonas aeruginosa PA01
cggcagguucagcaggu

SEQ ID NO: 1501734 - RNA, 19 nt, Pseudomonas aeruginosa PA01
cggcagguucagcaggucg

SEQ ID NO: 1501735 - RNA, 16 nt, Pseudomonas aeruginosa PA01
cggcagguggccggaa

SEQ ID NO: 1501736 - RNA, 21 nt, Pseudomonas aeruginosa PA01
cggcagguugaugugcaguuc

SEQ ID NO: 1501737 - RNA, 23 nt, Pseudomonas aeruginosa PA01
cggcagguugaugugcaguucga

SEQ ID NO: 1501738 - RNA, 15 nt, Pseudomonas aeruginosa PA01
cggcagguugcucgc

SEQ ID NO: 1501739 - RNA, 21 nt, Pseudomonas aeruginosa PA01
cggcagguugugguugggcag

SEQ ID NO: 1501740 - RNA, 14 nt, Pseudomonas aeruginosa PA01
cggcaggcgcacgc

SEQ ID NO: 1501741 - RNA, 13 nt, Pseudomonas aeruginosa PA01
cggcaggccuucc

SEQ ID NO: 1501742 - RNA, 17 nt, Pseudomonas aeruginosa PA01
cggcaggccuuccacgc

SEQ ID NO: 1501743 - RNA, 19 nt, Pseudomonas aeruginosa PA01
cggcaggccuuccacgccu

SEQ ID NO: 1501744 - RNA, 16 nt, Pseudomonas aeruginosa PA01
cggcaggccuucgacg

SEQ ID NO: 1501745 - RNA, 16 nt, Pseudomonas aeruginosa PA01
cggcaggcggcggcgu

SEQ ID NO: 1501746 - RNA, 17 nt, Pseudomonas aeruginosa PA01
cggcaggcggcggcguu

SEQ ID NO: 1501747 - RNA, 13 nt, Pseudomonas aeruginosa PA01
cggcagggaucac

SEQ ID NO: 1501748 - RNA, 14 nt, Pseudomonas aeruginosa PA01
cggcaggcugugcc

SEQ ID NO: 1501749 - RNA, 15 nt, Pseudomonas aeruginosa PA01
cggcaggcucagcgc

SEQ ID NO: 1501750 - RNA, 16 nt, Pseudomonas aeruginosa PA01
cggcaggcucagcgca

SEQ ID NO: 1501751 - RNA, 17 nt, Pseudomonas aeruginosa PA01
cggcaggcucagcgcau

SEQ ID NO: 1501752 - RNA, 15 nt, Pseudomonas aeruginosa PA01
cggcaggcugcaucg

SEQ ID NO: 1501753 - RNA, 17 nt, Pseudomonas aeruginosa PA01
cggcaggcugcaucggc

SEQ ID NO: 1501754 - RNA, 18 nt, Pseudomonas aeruginosa PA01
cggcaggcugcaucggcu

SEQ ID NO: 1501755 - RNA, 20 nt, Pseudomonas aeruginosa PA01
cggcaggcugcaucggcucg

SEQ ID NO: 1501756 - RNA, 15 nt, Pseudomonas aeruginosa PA01
cggcaggcugcgccg

SEQ ID NO: 1501757 - RNA, 16 nt, Pseudomonas aeruginosa PA01
cggcaggcugcgccgc

SEQ ID NO: 1501758 - RNA, 15 nt, Pseudomonas aeruginosa PA01
cggcagccguccgcc

SEQ ID NO: 1501759 - RNA, 15 nt, Pseudomonas aeruginosa PA01
cggcagccgcggcug

SEQ ID NO: 1501760 - RNA, 12 nt, Pseudomonas aeruginosa PA01
cggcagccgcgu

SEQ ID NO: 1501761 - RNA, 14 nt, Pseudomonas aeruginosa PA01
cggcagccagccgc

SEQ ID NO: 1501762 - RNA, 17 nt, Pseudomonas aeruginosa PA01
cggcagccagccgccga

SEQ ID NO: 1501763 - RNA, 22 nt, Pseudomonas aeruginosa PA01
cggcagccagccgccgaagggc

SEQ ID NO: 1501764 - RNA, 14 nt, Pseudomonas aeruginosa PA01
cggcagccaccagg

SEQ ID NO: 1501765 - RNA, 15 nt, Pseudomonas aeruginosa PA01
cggcagccaccaggu

SEQ ID NO: 1501766 - RNA, 18 nt, Pseudomonas aeruginosa PA01
cggcagcgccaucaggcc

SEQ ID NO: 1501767 - RNA, 13 nt, Pseudomonas aeruginosa PA01
cggcagcgcuggc

SEQ ID NO: 1501768 - RNA, 14 nt, Pseudomonas aeruginosa PA01
cggcagcgcuggcg

SEQ ID NO: 1501769 - RNA, 20 nt, Pseudomonas aeruginosa PA01
cggcagcgcuggcgaucacc

SEQ ID NO: 1501770 - RNA, 13 nt, Pseudomonas aeruginosa PA01
cggcagcgccucg

SEQ ID NO: 1501771 - RNA, 18 nt, Pseudomonas aeruginosa PA01
cggcagcgccucggcggc

SEQ ID NO: 1501772 - RNA, 21 nt, Pseudomonas aeruginosa PA01
cggcagcgccuuuucggcacu

SEQ ID NO: 1501773 - RNA, 13 nt, Pseudomonas aeruginosa PA01
cggcagcgccgag

SEQ ID NO: 1501774 - RNA, 14 nt, Pseudomonas aeruginosa PA01
cggcagcgccgagg

SEQ ID NO: 1501775 - RNA, 15 nt, Pseudomonas aeruginosa PA01
cggcagcgccgaggu

SEQ ID NO: 1501776 - RNA, 14 nt, Pseudomonas aeruginosa PA01
cggcagcgccgcca

SEQ ID NO: 1501777 - RNA, 15 nt, Pseudomonas aeruginosa PA01
cggcagcgccgccag

SEQ ID NO: 1501778 - RNA, 20 nt, Pseudomonas aeruginosa PA01
cggcagcgccgccagcagga

SEQ ID NO: 1501779 - RNA, 13 nt, Pseudomonas aeruginosa PA01
cggcagcgccggg

SEQ ID NO: 1501780 - RNA, 14 nt, Pseudomonas aeruginosa PA01
cggcagcgccgggc

SEQ ID NO: 1501781 - RNA, 16 nt, Pseudomonas aeruginosa PA01
cggcagcgccgggcau

SEQ ID NO: 1501782 - RNA, 13 nt, Pseudomonas aeruginosa PA01
cggcagcgagcgg

SEQ ID NO: 1501783 - RNA, 16 nt, Pseudomonas aeruginosa PA01
cggcagcgaccaccac

SEQ ID NO: 1501784 - RNA, 17 nt, Pseudomonas aeruginosa PA01
cggcagcgaccaccacc

SEQ ID NO: 1501785 - RNA, 18 nt, Pseudomonas aeruginosa PA01
cggcaucgucgaagcuga

SEQ ID NO: 1501786 - RNA, 14 nt, Pseudomonas aeruginosa PA01
cggccaaccaccgg

SEQ ID NO: 1501787 - RNA, 15 nt, Pseudomonas aeruginosa PA01
cggccaaccaccggc

SEQ ID NO: 1501788 - RNA, 18 nt, Pseudomonas aeruginosa PA01
cggccaaccaccggcgca

SEQ ID NO: 1501789 - RNA, 22 nt, Pseudomonas aeruginosa PA01
cggcaugccguagacguagucg

SEQ ID NO: 1501790 - RNA, 14 nt, Pseudomonas aeruginosa PA01
cggcaugcaggugg

SEQ ID NO: 1501791 - RNA, 17 nt, Pseudomonas aeruginosa PA01
cggcaugcagguggcgc

SEQ ID NO: 1501792 - RNA, 15 nt, Pseudomonas aeruginosa PA01
cggcaugcccugccg

SEQ ID NO: 1501793 - RNA, 16 nt, Pseudomonas aeruginosa PA01
cggcaugcccugccgg

SEQ ID NO: 1501794 - RNA, 17 nt, Pseudomonas aeruginosa PA01
cggcaugcccugccggc

SEQ ID NO: 1501795 - RNA, 19 nt, Pseudomonas aeruginosa PA01
cggcaugcccugccggcgc

SEQ ID NO: 1501796 - RNA, 14 nt, Pseudomonas aeruginosa PA01
cggcauggaucaac

SEQ ID NO: 1501797 - RNA, 15 nt, Pseudomonas aeruginosa PA01
cggcaugcucagccg

SEQ ID NO: 1501798 - RNA, 19 nt, Pseudomonas aeruginosa PA01
cggcaugcucagccgcgcc

SEQ ID NO: 1501799 - RNA, 13 nt, Pseudomonas aeruginosa PA01
cggcauggccacg

SEQ ID NO: 1501800 - RNA, 15 nt, Pseudomonas aeruginosa PA01
cggcauggccacgcu

SEQ ID NO: 1501801 - RNA, 18 nt, Pseudomonas aeruginosa PA01
cggccaaccucuccccag

SEQ ID NO: 1501802 - RNA, 21 nt, Pseudomonas aeruginosa PA01
cggccaaccucuccccagacc

SEQ ID NO: 1501803 - RNA, 21 nt, Pseudomonas aeruginosa PA01
cggccaacggccgcuugaucu

SEQ ID NO: 1501804 - RNA, 17 nt, Pseudomonas aeruginosa PA01
cggccaacugagcggcg

SEQ ID NO: 1501805 - RNA, 18 nt, Pseudomonas aeruginosa PA01
cggccaacugagcggcgg

SEQ ID NO: 1501806 - RNA, 18 nt, Pseudomonas aeruginosa PA01
cggccaaugcccggaccu

SEQ ID NO: 1501807 - RNA, 20 nt, Pseudomonas aeruginosa PA01
cggccaaugcccggaccugg

SEQ ID NO: 1501808 - RNA, 18 nt, Pseudomonas aeruginosa PA01
cggccaacugggccuuga

SEQ ID NO: 1501809 - RNA, 20 nt, Pseudomonas aeruginosa PA01
cggcagucgccgcaccggcg

SEQ ID NO: 1501810 - RNA, 20 nt, Pseudomonas aeruginosa PA01
cggcagucccugccaggggc

SEQ ID NO: 1501811 - RNA, 15 nt, Pseudomonas aeruginosa PA01
cggcaguccucgccg

SEQ ID NO: 1501812 - RNA, 20 nt, Pseudomonas aeruginosa PA01
cggcaguccucgccguuggc

SEQ ID NO: 1501813 - RNA, 21 nt, Pseudomonas aeruginosa PA01
cggcaguccucgccguuggcg

SEQ ID NO: 1501814 - RNA, 22 nt, Pseudomonas aeruginosa PA01
cggcaguccucgccguuggcga

SEQ ID NO: 1501815 - RNA, 15 nt, Pseudomonas aeruginosa PA01
cggcagugcucgauc

SEQ ID NO: 1501816 - RNA, 16 nt, Pseudomonas aeruginosa PA01
cggcaucucgauggug

SEQ ID NO: 1501817 - RNA, 19 nt, Pseudomonas aeruginosa PA01
cggcaucgcguagggcgac

SEQ ID NO: 1501818 - RNA, 18 nt, Pseudomonas aeruginosa PA01
cggcaucgcguagggcgu

SEQ ID NO: 1501819 - RNA, 13 nt, Pseudomonas aeruginosa PA01
cggcaucgccggg

SEQ ID NO: 1501820 - RNA, 16 nt, Pseudomonas aeruginosa PA01
cggcaucggcgccgcg

SEQ ID NO: 1501821 - RNA, 20 nt, Pseudomonas aeruginosa PA01
cggcaucggcgccgcgcacc

SEQ ID NO: 1501822 - RNA, 13 nt, Pseudomonas aeruginosa PA01
aacaggcuggcgu

SEQ ID NO: 1501823 - RNA, 16 nt, Pseudomonas aeruginosa PA01
aacaggguggugucgu

SEQ ID NO: 1501824 - RNA, 19 nt, Pseudomonas aeruginosa PA01
aacagggcgagcagggcgc

SEQ ID NO: 1501825 - RNA, 20 nt, Pseudomonas aeruginosa PA01
aacagggcgagcagggcgcu

SEQ ID NO: 1501826 - RNA, 14 nt, Pseudomonas aeruginosa PA01
cggcacgcagcagc

SEQ ID NO: 1501827 - RNA, 15 nt, Pseudomonas aeruginosa PA01
cggcacgcagcagcu

SEQ ID NO: 1501828 - RNA, 18 nt, Pseudomonas aeruginosa PA01
cggcacgaugucgaccug

SEQ ID NO: 1501829 - RNA, 19 nt, Pseudomonas aeruginosa PA01
cggcacgaugucgaccugg

SEQ ID NO: 1501830 - RNA, 16 nt, Pseudomonas aeruginosa PA01
cggcacgcuccagggc

SEQ ID NO: 1501831 - RNA, 17 nt, Pseudomonas aeruginosa PA01
cggcacgcuccagggcg

SEQ ID NO: 1501832 - RNA, 15 nt, Pseudomonas aeruginosa PA01
cggcacgcucaggcg

SEQ ID NO: 1501833 - RNA, 11 nt, Pseudomonas aeruginosa PA01
cggcacgcucc

SEQ ID NO: 1501834 - RNA, 13 nt, Pseudomonas aeruginosa PA01
cggcacgcuccag

SEQ ID NO: 1501835 - RNA, 18 nt, Pseudomonas aeruginosa PA01
cggcacgcuccagaucgc

SEQ ID NO: 1501836 - RNA, 11 nt, Pseudomonas aeruginosa PA01
cggcacgcucu

SEQ ID NO: 1501837 - RNA, 18 nt, Pseudomonas aeruginosa PA01
cggcacgcugcuugcgca

SEQ ID NO: 1501838 - RNA, 13 nt, Pseudomonas aeruginosa PA01
cggcacgcugccg

SEQ ID NO: 1501839 - RNA, 15 nt, Pseudomonas aeruginosa PA01
cggcacgcugccgcc

SEQ ID NO: 1501840 - RNA, 16 nt, Pseudomonas aeruginosa PA01
cggcacgcugccgccg

SEQ ID NO: 1501841 - RNA, 19 nt, Pseudomonas aeruginosa PA01
cggcacgcugccgccgaug

SEQ ID NO: 1501842 - RNA, 22 nt, Pseudomonas aeruginosa PA01
cggcacggucauggccagcucg

SEQ ID NO: 1501843 - RNA, 23 nt, Pseudomonas aeruginosa PA01
cggcacggucauggccagcucga

SEQ ID NO: 1501844 - RNA, 23 nt, Pseudomonas aeruginosa PA01
cggacagcuucugguuguaagcg

SEQ ID NO: 1501845 - RNA, 21 nt, Pseudomonas aeruginosa PA01
cggacaggaaaaagcccgcgu

SEQ ID NO: 1501846 - RNA, 20 nt, Pseudomonas aeruginosa PA01
cggcaccccuugcagccagc

SEQ ID NO: 1501847 - RNA, 14 nt, Pseudomonas aeruginosa PA01
cggacacgcaggcg

SEQ ID NO: 1501848 - RNA, 16 nt, Pseudomonas aeruginosa PA01
cggacacgcaggcgcc

SEQ ID NO: 1501849 - RNA, 17 nt, Pseudomonas aeruginosa PA01
cggcacccucuuccgcg

SEQ ID NO: 1501850 - RNA, 20 nt, Pseudomonas aeruginosa PA01
cggcacccucuuccgcgcug

SEQ ID NO: 1501851 - RNA, 21 nt, Pseudomonas aeruginosa PA01
cggcacccugaccgcgagcgc

SEQ ID NO: 1501852 - RNA, 22 nt, Pseudomonas aeruginosa PA01
cggcacccugaccgcgagcgcc

SEQ ID NO: 1501853 - RNA, 17 nt, Pseudomonas aeruginosa PA01
cggcaccgacgccgaag

SEQ ID NO: 1501854 - RNA, 13 nt, Pseudomonas aeruginosa PA01
cggcaccgagccg

SEQ ID NO: 1501855 - RNA, 13 nt, Pseudomonas aeruginosa PA01
cggcaccgaucgc

SEQ ID NO: 1501856 - RNA, 14 nt, Pseudomonas aeruginosa PA01
cggcaccgaucgcc

SEQ ID NO: 1501857 - RNA, 17 nt, Pseudomonas aeruginosa PA01
cggcaccucgauggcgg

SEQ ID NO: 1501858 - RNA, 19 nt, Pseudomonas aeruginosa PA01
cggcaccucgauggcggcg

SEQ ID NO: 1501859 - RNA, 14 nt, Pseudomonas aeruginosa PA01
aacaggcagcgggc

SEQ ID NO: 1501860 - RNA, 22 nt, Pseudomonas aeruginosa PA01
cggcaccuugcgaaaagcccgc

SEQ ID NO: 1501861 - RNA, 13 nt, Pseudomonas aeruginosa PA01
cggcaccugcaga

SEQ ID NO: 1501862 - RNA, 14 nt, Pseudomonas aeruginosa PA01
cggcagcagccaac

SEQ ID NO: 1501863 - RNA, 15 nt, Pseudomonas aeruginosa PA01
cggcagcagccaacc

SEQ ID NO: 1501864 - RNA, 21 nt, Pseudomonas aeruginosa PA01
cggcagcagccaaccgucgcc

SEQ ID NO: 1501865 - RNA, 18 nt, Pseudomonas aeruginosa PA01
cggcagcagcggaucggc

SEQ ID NO: 1501866 - RNA, 19 nt, Pseudomonas aeruginosa PA01
cggcagcagggucagcagc

SEQ ID NO: 1501867 - RNA, 23 nt, Pseudomonas aeruginosa PA01
cggcagcagggucagcagcgcca

SEQ ID NO: 1501868 - RNA, 16 nt, Pseudomonas aeruginosa PA01
cggcagcagcuugccg

SEQ ID NO: 1501869 - RNA, 19 nt, Pseudomonas aeruginosa PA01
cggcagcagcuugccggca

SEQ ID NO: 1501870 - RNA, 20 nt, Pseudomonas aeruginosa PA01
cggcagcagcuugccggcau

SEQ ID NO: 1501871 - RNA, 16 nt, Pseudomonas aeruginosa PA01
cggcagcaggccgccg

SEQ ID NO: 1501872 - RNA, 17 nt, Pseudomonas aeruginosa PA01
cggcagcaggccgccgc

SEQ ID NO: 1501873 - RNA, 19 nt, Pseudomonas aeruginosa PA01
cggcagcaggccgccgcgu

SEQ ID NO: 1501874 - RNA, 13 nt, Pseudomonas aeruginosa PA01
cggcagcacggcg

SEQ ID NO: 1501875 - RNA, 14 nt, Pseudomonas aeruginosa PA01
cggcagcaccaggc

SEQ ID NO: 1501876 - RNA, 12 nt, Pseudomonas aeruginosa PA01
cggcagcacccg

SEQ ID NO: 1501877 - RNA, 19 nt, Pseudomonas aeruginosa PA01
cggcagcacccgcaccagc

SEQ ID NO: 1501878 - RNA, 15 nt, Pseudomonas aeruginosa PA01
aacagugcgcccgug

SEQ ID NO: 1501879 - RNA, 13 nt, Pseudomonas aeruginosa PA01
cggcagcaucagc

SEQ ID NO: 1501880 - RNA, 14 nt, Pseudomonas aeruginosa PA01
cggcagcaucagcc

SEQ ID NO: 1501881 - RNA, 18 nt, Pseudomonas aeruginosa PA01
cggcagcaucagccgcga

SEQ ID NO: 1501882 - RNA, 20 nt, Pseudomonas aeruginosa PA01
cggcagcaucagccgcgacg

SEQ ID NO: 1501883 - RNA, 13 nt, Pseudomonas aeruginosa PA01
cggcacuccagga

SEQ ID NO: 1501884 - RNA, 14 nt, Pseudomonas aeruginosa PA01
cggcacuccggcau

SEQ ID NO: 1501885 - RNA, 15 nt, Pseudomonas aeruginosa PA01
cggcacucggcgacc

SEQ ID NO: 1501886 - RNA, 17 nt, Pseudomonas aeruginosa PA01
cggcacucggcgaccac

SEQ ID NO: 1501887 - RNA, 24 nt, Pseudomonas aeruginosa PA01
cggcacucggcgaccacccggcgg

SEQ ID NO: 1501888 - RNA, 19 nt, Pseudomonas aeruginosa PA01
cggcacucagccagcggcg

SEQ ID NO: 1501889 - RNA, 16 nt, Pseudomonas aeruginosa PA01
cggcacuuccuuggug

SEQ ID NO: 1501890 - RNA, 16 nt, Pseudomonas aeruginosa PA01
cggcagaagcuuuccc

SEQ ID NO: 1501891 - RNA, 14 nt, Pseudomonas aeruginosa PA01
cggcagacgugcug

SEQ ID NO: 1501892 - RNA, 21 nt, Pseudomonas aeruginosa PA01
cggcagaguuucucggucgcc

SEQ ID NO: 1501893 - RNA, 12 nt, Pseudomonas aeruginosa PA01
cggcagauccgc

SEQ ID NO: 1501894 - RNA, 20 nt, Pseudomonas aeruginosa PA01
cggcgcgaaccagcagcagg

SEQ ID NO: 1501895 - RNA, 19 nt, Pseudomonas aeruginosa PA01
cggcgcgaagucgcagucg

SEQ ID NO: 1501896 - RNA, 14 nt, Pseudomonas aeruginosa PA01
cggcgcgcagggcc

SEQ ID NO: 1501897 - RNA, 18 nt, Pseudomonas aeruginosa PA01
cggcgcgcagggccagca

SEQ ID NO: 1501898 - RNA, 14 nt, Pseudomonas aeruginosa PA01
cggcgcgcccaggc

SEQ ID NO: 1501899 - RNA, 16 nt, Pseudomonas aeruginosa PA01
cggcgcgcccaggccc

SEQ ID NO: 1501900 - RNA, 18 nt, Pseudomonas aeruginosa PA01
cggcgcgcccaggcccag

SEQ ID NO: 1501901 - RNA, 21 nt, Pseudomonas aeruginosa PA01
cggcgcgcccaggcccagcgc

SEQ ID NO: 1501902 - RNA, 15 nt, Pseudomonas aeruginosa PA01
cggcgcgccauggcg

SEQ ID NO: 1501903 - RNA, 14 nt, Pseudomonas aeruginosa PA01
cggcgcgcggcagc

SEQ ID NO: 1501904 - RNA, 15 nt, Pseudomonas aeruginosa PA01
cggcgcgcggcagca

SEQ ID NO: 1501905 - RNA, 14 nt, Pseudomonas aeruginosa PA01
cggcgcgcggcggg

SEQ ID NO: 1501906 - RNA, 16 nt, Pseudomonas aeruginosa PA01
cggcgcgcuccggcgc

SEQ ID NO: 1501907 - RNA, 17 nt, Pseudomonas aeruginosa PA01
cggcgcgcuccggcgcg

SEQ ID NO: 1501908 - RNA, 20 nt, Pseudomonas aeruginosa PA01
cggcgcgcgguuucuucgcc

SEQ ID NO: 1501909 - RNA, 12 nt, Pseudomonas aeruginosa PA01
cggcgcgcugcg

SEQ ID NO: 1501910 - RNA, 20 nt, Pseudomonas aeruginosa PA01
cggcgcggcguaccagccgc

SEQ ID NO: 1501911 - RNA, 15 nt, Pseudomonas aeruginosa PA01
cggcgcggcguggcg

SEQ ID NO: 1501912 - RNA, 17 nt, Pseudomonas aeruginosa PA01
cggcgcggcguggcgga

SEQ ID NO: 1501913 - RNA, 21 nt, Pseudomonas aeruginosa PA01
cggcgcggcguggcggaagaa

SEQ ID NO: 1501914 - RNA, 14 nt, Pseudomonas aeruginosa PA01
cggcgcggcguuca

SEQ ID NO: 1501915 - RNA, 19 nt, Pseudomonas aeruginosa PA01
cggcgcggcggccgccucg

SEQ ID NO: 1501916 - RNA, 14 nt, Pseudomonas aeruginosa PA01
cggcgcgcugcggg

SEQ ID NO: 1501917 - RNA, 19 nt, Pseudomonas aeruginosa PA01
cggcgcgcugcgggucauu

SEQ ID NO: 1501918 - RNA, 16 nt, Pseudomonas aeruginosa PA01
cggcgcggaagcgccu

SEQ ID NO: 1501919 - RNA, 22 nt, Pseudomonas aeruginosa PA01
cggcgcggaagcgccugcggug

SEQ ID NO: 1501920 - RNA, 15 nt, Pseudomonas aeruginosa PA01
cggcgcggacggccu

SEQ ID NO: 1501921 - RNA, 14 nt, Pseudomonas aeruginosa PA01
cggcgcggagcugc

SEQ ID NO: 1501922 - RNA, 21 nt, Pseudomonas aeruginosa PA01
cggcgcggacauggcgcucga

SEQ ID NO: 1501923 - RNA, 12 nt, Pseudomonas aeruginosa PA01
cggcgcucaccg

SEQ ID NO: 1501924 - RNA, 14 nt, Pseudomonas aeruginosa PA01
cggcgcucaccgca

SEQ ID NO: 1501925 - RNA, 18 nt, Pseudomonas aeruginosa PA01
cggcgcuauccgccgcua

SEQ ID NO: 1501926 - RNA, 21 nt, Pseudomonas aeruginosa PA01
cggcgcuacgaaggcgugccg

SEQ ID NO: 1501927 - RNA, 18 nt, Pseudomonas aeruginosa PA01
cggcgcgggccuucaggc

SEQ ID NO: 1501928 - RNA, 22 nt, Pseudomonas aeruginosa PA01
cggcgcgggcgccgaugccggc

SEQ ID NO: 1501929 - RNA, 22 nt, Pseudomonas aeruginosa PA01
cggcgcgggcgcgcgccaccgc

SEQ ID NO: 1501930 - RNA, 17 nt, Pseudomonas aeruginosa PA01
cggcgcguuggcuggcg

SEQ ID NO: 1501931 - RNA, 21 nt, Pseudomonas aeruginosa PA01
cggcggagucguagcgcaugc

SEQ ID NO: 1501932 - RNA, 14 nt, Pseudomonas aeruginosa PA01
cggcggauacaggc

SEQ ID NO: 1501933 - RNA, 16 nt, Pseudomonas aeruginosa PA01
cggcggauacaggcgc

SEQ ID NO: 1501934 - RNA, 22 nt, Pseudomonas aeruginosa PA01
cggcggauaaacggcaugcacg

SEQ ID NO: 1501935 - RNA, 13 nt, Pseudomonas aeruginosa PA01
cggcggauaacgc

SEQ ID NO: 1501936 - RNA, 15 nt, Pseudomonas aeruginosa PA01
cggcggauaacgccg

SEQ ID NO: 1501937 - RNA, 17 nt, Pseudomonas aeruginosa PA01
cggcggauaacgccgau

SEQ ID NO: 1501938 - RNA, 16 nt, Pseudomonas aeruginosa PA01
cggcggauaacgccgg

SEQ ID NO: 1501939 - RNA, 21 nt, Pseudomonas aeruginosa PA01
cggcggauaacgccgguggcg

SEQ ID NO: 1501940 - RNA, 21 nt, Pseudomonas aeruginosa PA01
cggcggauaacgccuauggcg

SEQ ID NO: 1501941 - RNA, 17 nt, Pseudomonas aeruginosa PA01
cggcggauaacgccugc

SEQ ID NO: 1501942 - RNA, 21 nt, Pseudomonas aeruginosa PA01
cggcggauaacgccugcggcg

SEQ ID NO: 1501943 - RNA, 21 nt, Pseudomonas aeruginosa PA01
cggcggauaacgccuguggcg

SEQ ID NO: 1501944 - RNA, 22 nt, Pseudomonas aeruginosa PA01
cggcggauaacgcuacccucag

SEQ ID NO: 1501945 - RNA, 21 nt, Pseudomonas aeruginosa PA01
cggcggauaacgcuucgcagc

SEQ ID NO: 1501946 - RNA, 22 nt, Pseudomonas aeruginosa PA01
cggcggauaacgcuucgcagca

SEQ ID NO: 1501947 - RNA, 23 nt, Pseudomonas aeruginosa PA01
cggcggaugacguucccguccgg

SEQ ID NO: 1501948 - RNA, 14 nt, Pseudomonas aeruginosa PA01
cggcggaugccggc

SEQ ID NO: 1501949 - RNA, 16 nt, Pseudomonas aeruginosa PA01
cggcggaugccggcgc

SEQ ID NO: 1501950 - RNA, 19 nt, Pseudomonas aeruginosa PA01
cggcggauugacgauggcc

SEQ ID NO: 1501951 - RNA, 18 nt, Pseudomonas aeruginosa PA01
cggcggauugccagcagu

SEQ ID NO: 1501952 - RNA, 19 nt, Pseudomonas aeruginosa PA01
cggcggauuacuccgccgg

SEQ ID NO: 1501953 - RNA, 17 nt, Pseudomonas aeruginosa PA01
cggcggaucgaucagca

SEQ ID NO: 1501954 - RNA, 19 nt, Pseudomonas aeruginosa PA01
cggcggaucgaucagcagc

SEQ ID NO: 1501955 - RNA, 20 nt, Pseudomonas aeruginosa PA01
cggcggaucgaucagcagca

SEQ ID NO: 1501956 - RNA, 14 nt, Pseudomonas aeruginosa PA01
cggcggaucgaucg

SEQ ID NO: 1501957 - RNA, 17 nt, Pseudomonas aeruginosa PA01
cggcggaucgaucgauc

SEQ ID NO: 1501958 - RNA, 16 nt, Pseudomonas aeruginosa PA01
cggcggaucagcccgc

SEQ ID NO: 1501959 - RNA, 23 nt, Pseudomonas aeruginosa PA01
cggcggaucagcccgcugaccgg

SEQ ID NO: 1501960 - RNA, 14 nt, Pseudomonas aeruginosa PA01
cggcgcuccacagc

SEQ ID NO: 1501961 - RNA, 19 nt, Pseudomonas aeruginosa PA01
cggcgcuccacagcugcca

SEQ ID NO: 1501962 - RNA, 14 nt, Pseudomonas aeruginosa PA01
cggcgcuccgccga

SEQ ID NO: 1501963 - RNA, 16 nt, Pseudomonas aeruginosa PA01
cggcgcuccgccgaac

SEQ ID NO: 1501964 - RNA, 14 nt, Pseudomonas aeruginosa PA01
cggcgcuccaggcg

SEQ ID NO: 1501965 - RNA, 15 nt, Pseudomonas aeruginosa PA01
cggcgcuccaggcgg

SEQ ID NO: 1501966 - RNA, 16 nt, Pseudomonas aeruginosa PA01
cggcgcuccaacagca

SEQ ID NO: 1501967 - RNA, 17 nt, Pseudomonas aeruginosa PA01
cggcgcuccaacagcag

SEQ ID NO: 1501968 - RNA, 15 nt, Pseudomonas aeruginosa PA01
cggcgcucggccagg

SEQ ID NO: 1501969 - RNA, 16 nt, Pseudomonas aeruginosa PA01
cggcgcucggcaucga

SEQ ID NO: 1501970 - RNA, 16 nt, Pseudomonas aeruginosa PA01
cggcgcucuucagcac

SEQ ID NO: 1501971 - RNA, 17 nt, Pseudomonas aeruginosa PA01
cggcgcucuucagcacg

SEQ ID NO: 1501972 - RNA, 15 nt, Pseudomonas aeruginosa PA01
cggcgcugaaggcgg

SEQ ID NO: 1501973 - RNA, 17 nt, Pseudomonas aeruginosa PA01
cggcgcugaacagcugg

SEQ ID NO: 1501974 - RNA, 17 nt, Pseudomonas aeruginosa PA01
cggcgcucggcuccagc

SEQ ID NO: 1501975 - RNA, 15 nt, Pseudomonas aeruginosa PA01
cggcgcugagcgaga

SEQ ID NO: 1501976 - RNA, 17 nt, Pseudomonas aeruginosa PA01
cggcgcugagcgagacc

SEQ ID NO: 1501977 - RNA, 21 nt, Pseudomonas aeruginosa PA01
cggcgcugaggaucagccagc

SEQ ID NO: 1501978 - RNA, 23 nt, Pseudomonas aeruginosa PA01
cggcgcugaggaucagccagccg

SEQ ID NO: 1501979 - RNA, 14 nt, Pseudomonas aeruginosa PA01
cggcgcuggccgcg

SEQ ID NO: 1501980 - RNA, 15 nt, Pseudomonas aeruginosa PA01
cggcgcuggccgcgc

SEQ ID NO: 1501981 - RNA, 14 nt, Pseudomonas aeruginosa PA01
cggcgcuggagaga

SEQ ID NO: 1501982 - RNA, 13 nt, Pseudomonas aeruginosa PA01
cggcgcuggcgcg

SEQ ID NO: 1501983 - RNA, 19 nt, Pseudomonas aeruginosa PA01
cggcggacgcaggccgacc

SEQ ID NO: 1501984 - RNA, 23 nt, Pseudomonas aeruginosa PA01
cggcggacgcaggccgaccucgg

SEQ ID NO: 1501985 - RNA, 16 nt, Pseudomonas aeruginosa PA01
cggcggaccuccgcca

SEQ ID NO: 1501986 - RNA, 19 nt, Pseudomonas aeruginosa PA01
cggcggaccuccgccaggu

SEQ ID NO: 1501987 - RNA, 23 nt, Pseudomonas aeruginosa PA01
cggcggaccuccgccaggucgau

SEQ ID NO: 1501988 - RNA, 13 nt, Pseudomonas aeruginosa PA01
cggcggacugcuc

SEQ ID NO: 1501989 - RNA, 18 nt, Pseudomonas aeruginosa PA01
cggcggagccgucggcuc

SEQ ID NO: 1501990 - RNA, 24 nt, Pseudomonas aeruginosa PA01
cggcggagccgucggcuccgcuca

SEQ ID NO: 1501991 - RNA, 20 nt, Pseudomonas aeruginosa PA01
cggcgccaccccgccgcgca

SEQ ID NO: 1501992 - RNA, 13 nt, Pseudomonas aeruginosa PA01
cggcgccaccgcg

SEQ ID NO: 1501993 - RNA, 14 nt, Pseudomonas aeruginosa PA01
cggcgccaccgcga

SEQ ID NO: 1501994 - RNA, 17 nt, Pseudomonas aeruginosa PA01
cggcgccaccgcgacgc

SEQ ID NO: 1501995 - RNA, 21 nt, Pseudomonas aeruginosa PA01
cggcgccaccgcgacgcgcug

SEQ ID NO: 1501996 - RNA, 14 nt, Pseudomonas aeruginosa PA01
cggcgccaccgcgu

SEQ ID NO: 1501997 - RNA, 17 nt, Pseudomonas aeruginosa PA01
cggcgccagcuccagcg

SEQ ID NO: 1501998 - RNA, 12 nt, Pseudomonas aeruginosa PA01
cggcgccaggcc

SEQ ID NO: 1501999 - RNA, 19 nt, Pseudomonas aeruginosa PA01
cggcgccaggcccucggcg

SEQ ID NO: 1502000 - RNA, 20 nt, Pseudomonas aeruginosa PA01
cggcgccaggcccucggcga

SEQ ID NO: 1502001 - RNA, 21 nt, Pseudomonas aeruginosa PA01
cggcgccaggcccucggcgac

SEQ ID NO: 1502002 - RNA, 18 nt, Pseudomonas aeruginosa PA01
cggcgcccucugccgguc

SEQ ID NO: 1502003 - RNA, 18 nt, Pseudomonas aeruginosa PA01
cggcgccgaacagggcga

SEQ ID NO: 1502004 - RNA, 23 nt, Pseudomonas aeruginosa PA01
cggcgccgaacagggcgagcagg

SEQ ID NO: 1502005 - RNA, 21 nt, Pseudomonas aeruginosa PA01
cggcgccagcgccccaccagg

SEQ ID NO: 1502006 - RNA, 16 nt, Pseudomonas aeruginosa PA01
cggcgcccuugacccg

SEQ ID NO: 1502007 - RNA, 19 nt, Pseudomonas aeruginosa PA01
cggcgcccuugacccggua

SEQ ID NO: 1502008 - RNA, 15 nt, Pseudomonas aeruginosa PA01
cggcgcccuggccgc

SEQ ID NO: 1502009 - RNA, 17 nt, Pseudomonas aeruginosa PA01
cggcgcccuggccgcca

SEQ ID NO: 1502010 - RNA, 15 nt, Pseudomonas aeruginosa PA01
cggcgcccuggcucu

SEQ ID NO: 1502011 - RNA, 14 nt, Pseudomonas aeruginosa PA01
cggcgcccuggccg

SEQ ID NO: 1502012 - RNA, 19 nt, Pseudomonas aeruginosa PA01
cggcgccgauuccugggcg

SEQ ID NO: 1502013 - RNA, 13 nt, Pseudomonas aeruginosa PA01
cggcgccgaugcc

SEQ ID NO: 1502014 - RNA, 16 nt, Pseudomonas aeruginosa PA01
cggcgccgagguagua

SEQ ID NO: 1502015 - RNA, 14 nt, Pseudomonas aeruginosa PA01
cggcgccggccucc

SEQ ID NO: 1502016 - RNA, 22 nt, Pseudomonas aeruginosa PA01
cggcgccgccccguuggcgcgg

SEQ ID NO: 1502017 - RNA, 18 nt, Pseudomonas aeruginosa PA01
cggcgccggugcuggcga

SEQ ID NO: 1502018 - RNA, 19 nt, Pseudomonas aeruginosa PA01
cggcgccggugcuggcgag

SEQ ID NO: 1502019 - RNA, 19 nt, Pseudomonas aeruginosa PA01
cggcgccggugaggcgcag

SEQ ID NO: 1502020 - RNA, 17 nt, Pseudomonas aeruginosa PA01
cggcgccgggaucaccu

SEQ ID NO: 1502021 - RNA, 19 nt, Pseudomonas aeruginosa PA01
cggcgccgggaucaccucg

SEQ ID NO: 1502022 - RNA, 14 nt, Pseudomonas aeruginosa PA01
cggcgccugcugcg

SEQ ID NO: 1502023 - RNA, 16 nt, Pseudomonas aeruginosa PA01
cggcgccuggagcaga

SEQ ID NO: 1502024 - RNA, 22 nt, Pseudomonas aeruginosa PA01
cggcgccugcgcuucguuggcg

SEQ ID NO: 1502025 - RNA, 20 nt, Pseudomonas aeruginosa PA01
cggcgccugguucccucaac

SEQ ID NO: 1502026 - RNA, 13 nt, Pseudomonas aeruginosa PA01
cggcgccuucaga

SEQ ID NO: 1502027 - RNA, 16 nt, Pseudomonas aeruginosa PA01
cggcgccuucagagca

SEQ ID NO: 1502028 - RNA, 15 nt, Pseudomonas aeruginosa PA01
cggcgccuucagcgc

SEQ ID NO: 1502029 - RNA, 16 nt, Pseudomonas aeruginosa PA01
cggcgccuucagcgcc

SEQ ID NO: 1502030 - RNA, 19 nt, Pseudomonas aeruginosa PA01
cggcgccuucagcgccgcc

SEQ ID NO: 1502031 - RNA, 20 nt, Pseudomonas aeruginosa PA01
cggcgccuucagcgccgcca

SEQ ID NO: 1502032 - RNA, 21 nt, Pseudomonas aeruginosa PA01
cggcgccuucagcgccgccag

SEQ ID NO: 1502033 - RNA, 23 nt, Pseudomonas aeruginosa PA01
cggcgccuucagcgccgccaggc

SEQ ID NO: 1502034 - RNA, 15 nt, Pseudomonas aeruginosa PA01
cggcgccuucaucgc

SEQ ID NO: 1502035 - RNA, 20 nt, Pseudomonas aeruginosa PA01
cggcgccuucaucgccaccu

SEQ ID NO: 1502036 - RNA, 23 nt, Pseudomonas aeruginosa PA01
cggcgccuucaucgccaccuucc

SEQ ID NO: 1502037 - RNA, 20 nt, Pseudomonas aeruginosa PA01
cggcgccuuccugcuucagg

SEQ ID NO: 1502038 - RNA, 14 nt, Pseudomonas aeruginosa PA01
cggcgccuucgccg

SEQ ID NO: 1502039 - RNA, 23 nt, Pseudomonas aeruginosa PA01
cggcgccuugcgguccagcgagc

SEQ ID NO: 1502040 - RNA, 16 nt, Pseudomonas aeruginosa PA01
cggcgcauagccaccg

SEQ ID NO: 1502041 - RNA, 18 nt, Pseudomonas aeruginosa PA01
cggcgcauagccaccgcc

SEQ ID NO: 1502042 - RNA, 19 nt, Pseudomonas aeruginosa PA01
cggcgcauagccaccgccg

SEQ ID NO: 1502043 - RNA, 23 nt, Pseudomonas aeruginosa PA01
cggcgcauagccaccgccgacau

SEQ ID NO: 1502044 - RNA, 16 nt, Pseudomonas aeruginosa PA01
cggcgcaucagcgccg

SEQ ID NO: 1502045 - RNA, 17 nt, Pseudomonas aeruginosa PA01
cggcgcaucagcgccgg

SEQ ID NO: 1502046 - RNA, 22 nt, Pseudomonas aeruginosa PA01
cggcgcaucgucgaaacgcugg

SEQ ID NO: 1502047 - RNA, 17 nt, Pseudomonas aeruginosa PA01
cggcgcaucggcggaua

SEQ ID NO: 1502048 - RNA, 14 nt, Pseudomonas aeruginosa PA01
cggcgcaugccgca

SEQ ID NO: 1502049 - RNA, 16 nt, Pseudomonas aeruginosa PA01
cggcgcaugcgccggc

SEQ ID NO: 1502050 - RNA, 17 nt, Pseudomonas aeruginosa PA01
cggcgccaacucggccu

SEQ ID NO: 1502051 - RNA, 14 nt, Pseudomonas aeruginosa PA01
cggcgccaacugcu

SEQ ID NO: 1502052 - RNA, 17 nt, Pseudomonas aeruginosa PA01
cggcgccaacugcuugc

SEQ ID NO: 1502053 - RNA, 19 nt, Pseudomonas aeruginosa PA01
cggcgccaacugcuugccg

SEQ ID NO: 1502054 - RNA, 18 nt, Pseudomonas aeruginosa PA01
cggcgccaccgauucgcc

SEQ ID NO: 1502055 - RNA, 23 nt, Pseudomonas aeruginosa PA01
cggcgccaccgauucgccggcca

SEQ ID NO: 1502056 - RNA, 11 nt, Pseudomonas aeruginosa PA01
cggcgccaccc

SEQ ID NO: 1502057 - RNA, 21 nt, Pseudomonas aeruginosa PA01
cggcgcagaacugccgggcca

SEQ ID NO: 1502058 - RNA, 19 nt, Pseudomonas aeruginosa PA01
cggcgcagacgucuuccgg

SEQ ID NO: 1502059 - RNA, 21 nt, Pseudomonas aeruginosa PA01
cggcgcagaucgcggcgcagg

SEQ ID NO: 1502060 - RNA, 18 nt, Pseudomonas aeruginosa PA01
cggcgcacugagggucag

SEQ ID NO: 1502061 - RNA, 21 nt, Pseudomonas aeruginosa PA01
cggcgcacugagggucagccg

SEQ ID NO: 1502062 - RNA, 22 nt, Pseudomonas aeruginosa PA01
cggcgcacugagggucagccgc

SEQ ID NO: 1502063 - RNA, 17 nt, Pseudomonas aeruginosa PA01
cggcgcaaucagggcug

SEQ ID NO: 1502064 - RNA, 18 nt, Pseudomonas aeruginosa PA01
cggcgcaaucagggcugg

SEQ ID NO: 1502065 - RNA, 22 nt, Pseudomonas aeruginosa PA01
cggcgcaaucagggcugggcgc

SEQ ID NO: 1502066 - RNA, 22 nt, Pseudomonas aeruginosa PA01
cggcgcagcagggcgucggcgu

SEQ ID NO: 1502067 - RNA, 14 nt, Pseudomonas aeruginosa PA01
cggcgcagcaacug

SEQ ID NO: 1502068 - RNA, 17 nt, Pseudomonas aeruginosa PA01
cggcgcagcccagccgc

SEQ ID NO: 1502069 - RNA, 22 nt, Pseudomonas aeruginosa PA01
cggcgcagcccagccgcucgcg

SEQ ID NO: 1502070 - RNA, 16 nt, Pseudomonas aeruginosa PA01
cggcgcagccgcaagg

SEQ ID NO: 1502071 - RNA, 15 nt, Pseudomonas aeruginosa PA01
cggcgauucgcggcg

SEQ ID NO: 1502072 - RNA, 17 nt, Pseudomonas aeruginosa PA01
cggcgauucgcggcgac

SEQ ID NO: 1502073 - RNA, 20 nt, Pseudomonas aeruginosa PA01
cggcgauucgcggcgacagc

SEQ ID NO: 1502074 - RNA, 21 nt, Pseudomonas aeruginosa PA01
cggcgauucguucgagcagcu

SEQ ID NO: 1502075 - RNA, 18 nt, Pseudomonas aeruginosa PA01
cggcgauuccacgggccu

SEQ ID NO: 1502076 - RNA, 20 nt, Pseudomonas aeruginosa PA01
cggcgauuccacgggccugu

SEQ ID NO: 1502077 - RNA, 14 nt, Pseudomonas aeruginosa PA01
cggcgauggcccag

SEQ ID NO: 1502078 - RNA, 19 nt, Pseudomonas aeruginosa PA01
cggcgaugcucagcgccgg

SEQ ID NO: 1502079 - RNA, 20 nt, Pseudomonas aeruginosa PA01
cggcgaugcucagcgccggc

SEQ ID NO: 1502080 - RNA, 14 nt, Pseudomonas aeruginosa PA01
cggcgauggccgcc

SEQ ID NO: 1502081 - RNA, 15 nt, Pseudomonas aeruginosa PA01
cggcgauggccgcca

SEQ ID NO: 1502082 - RNA, 18 nt, Pseudomonas aeruginosa PA01
cggcgauggccgccagca

SEQ ID NO: 1502083 - RNA, 22 nt, Pseudomonas aeruginosa PA01
cggcgaugcgcaugcgcagcgc

SEQ ID NO: 1502084 - RNA, 15 nt, Pseudomonas aeruginosa PA01
cggcgauccgcugca

SEQ ID NO: 1502085 - RNA, 13 nt, Pseudomonas aeruginosa PA01
cggcgauccgcgc

SEQ ID NO: 1502086 - RNA, 14 nt, Pseudomonas aeruginosa PA01
cggcgauccgcgca

SEQ ID NO: 1502087 - RNA, 15 nt, Pseudomonas aeruginosa PA01
cggcgaucagcucgc

SEQ ID NO: 1502088 - RNA, 13 nt, Pseudomonas aeruginosa PA01
cggcgaucagcgc

SEQ ID NO: 1502089 - RNA, 14 nt, Pseudomonas aeruginosa PA01
cggcgaucagcgcu

SEQ ID NO: 1502090 - RNA, 17 nt, Pseudomonas aeruginosa PA01
cggcgaucagcgcuucc

SEQ ID NO: 1502091 - RNA, 15 nt, Pseudomonas aeruginosa PA01
cggcgaucagcgggc

SEQ ID NO: 1502092 - RNA, 16 nt, Pseudomonas aeruginosa PA01
cggcgaucacguccuu

SEQ ID NO: 1502093 - RNA, 19 nt, Pseudomonas aeruginosa PA01
cggcgaucagaacgaugcc

SEQ ID NO: 1502094 - RNA, 20 nt, Pseudomonas aeruginosa PA01
cggcgaucagaacgaugccg

SEQ ID NO: 1502095 - RNA, 14 nt, Pseudomonas aeruginosa PA01
cggcgaccagcguc

SEQ ID NO: 1502096 - RNA, 21 nt, Pseudomonas aeruginosa PA01
cggcgaccagcgucgcgcgug

SEQ ID NO: 1502097 - RNA, 19 nt, Pseudomonas aeruginosa PA01
cggcgaccagcccgcgcga

SEQ ID NO: 1502098 - RNA, 17 nt, Pseudomonas aeruginosa PA01
cggcgaccauguucacc

SEQ ID NO: 1502099 - RNA, 20 nt, Pseudomonas aeruginosa PA01
cggcgaccauguucaccagc

SEQ ID NO: 1502100 - RNA, 21 nt, Pseudomonas aeruginosa PA01
cggcgaccauguucaccagcg

SEQ ID NO: 1502101 - RNA, 13 nt, Pseudomonas aeruginosa PA01
cggcgacccagac

SEQ ID NO: 1502102 - RNA, 15 nt, Pseudomonas aeruginosa PA01
cggcgaccagcucga

SEQ ID NO: 1502103 - RNA, 17 nt, Pseudomonas aeruginosa PA01
cggcgaccccgaucacc

SEQ ID NO: 1502104 - RNA, 20 nt, Pseudomonas aeruginosa PA01
cggcgaccccgaucaccgga

SEQ ID NO: 1502105 - RNA, 19 nt, Pseudomonas aeruginosa PA01
cggcgacccgccguucgcc

SEQ ID NO: 1502106 - RNA, 16 nt, Pseudomonas aeruginosa PA01
cggcgacccugggguc

SEQ ID NO: 1502107 - RNA, 19 nt, Pseudomonas aeruginosa PA01
cggcgaccgaacagcgcgc

SEQ ID NO: 1502108 - RNA, 13 nt, Pseudomonas aeruginosa PA01
cggcgacgaagcc

SEQ ID NO: 1502109 - RNA, 15 nt, Pseudomonas aeruginosa PA01
cggcgacgaaggucg

SEQ ID NO: 1502110 - RNA, 16 nt, Pseudomonas aeruginosa PA01
cggcgacgaaggucgg

SEQ ID NO: 1502111 - RNA, 19 nt, Pseudomonas aeruginosa PA01
cggcgacgaaggucggcgg

SEQ ID NO: 1502112 - RNA, 22 nt, Pseudomonas aeruginosa PA01
cggcgacgaaggucggcggcag

SEQ ID NO: 1502113 - RNA, 12 nt, Pseudomonas aeruginosa PA01
cggcgaccugcg

SEQ ID NO: 1502114 - RNA, 15 nt, Pseudomonas aeruginosa PA01
cggcgaccugcggug

SEQ ID NO: 1502115 - RNA, 16 nt, Pseudomonas aeruginosa PA01
cggcgaccucuucgga

SEQ ID NO: 1502116 - RNA, 14 nt, Pseudomonas aeruginosa PA01
cggcgaccugggcg

SEQ ID NO: 1502117 - RNA, 11 nt, Pseudomonas aeruginosa PA01
cggcgaccugu

SEQ ID NO: 1502118 - RNA, 22 nt, Pseudomonas aeruginosa PA01
cggcgaccuugacgaagccggc

SEQ ID NO: 1502119 - RNA, 18 nt, Pseudomonas aeruginosa PA01
cggcgaccuuguccaggc

SEQ ID NO: 1502120 - RNA, 22 nt, Pseudomonas aeruginosa PA01
cggcgaccuuguccaggcgcug

SEQ ID NO: 1502121 - RNA, 21 nt, Pseudomonas aeruginosa PA01
cggcgaccuuguccugcggcc

SEQ ID NO: 1502122 - RNA, 15 nt, Pseudomonas aeruginosa PA01
cggcgaccgcgcgca

SEQ ID NO: 1502123 - RNA, 23 nt, Pseudomonas aeruginosa PA01
cggcgaccggccucacggguguu

SEQ ID NO: 1502124 - RNA, 22 nt, Pseudomonas aeruginosa PA01
cggcgaccucagucgugcaggu

SEQ ID NO: 1502125 - RNA, 19 nt, Pseudomonas aeruginosa PA01
cggcgacgaucacccccag

SEQ ID NO: 1502126 - RNA, 20 nt, Pseudomonas aeruginosa PA01
cggcgacgaucacccccagc

SEQ ID NO: 1502127 - RNA, 21 nt, Pseudomonas aeruginosa PA01
cggcgacgaucacccccagcg

SEQ ID NO: 1502128 - RNA, 14 nt, Pseudomonas aeruginosa PA01
cggcgacgacgaag

SEQ ID NO: 1502129 - RNA, 20 nt, Pseudomonas aeruginosa PA01
cggcgacgacgaucccggcg

SEQ ID NO: 1502130 - RNA, 14 nt, Pseudomonas aeruginosa PA01
cggcgacgaugccg

SEQ ID NO: 1502131 - RNA, 15 nt, Pseudomonas aeruginosa PA01
cggcgacgaugccgc

SEQ ID NO: 1502132 - RNA, 16 nt, Pseudomonas aeruginosa PA01
cggcgacgaugccgcc

SEQ ID NO: 1502133 - RNA, 17 nt, Pseudomonas aeruginosa PA01
cggcgacgaugccgccg

SEQ ID NO: 1502134 - RNA, 19 nt, Pseudomonas aeruginosa PA01
cggcgacgaugccgccgcc

SEQ ID NO: 1502135 - RNA, 14 nt, Pseudomonas aeruginosa PA01
cggcgacgcuggcg

SEQ ID NO: 1502136 - RNA, 16 nt, Pseudomonas aeruginosa PA01
cggcgacgcggauacc

SEQ ID NO: 1502137 - RNA, 18 nt, Pseudomonas aeruginosa PA01
cggcgacgcggauaccga

SEQ ID NO: 1502138 - RNA, 18 nt, Pseudomonas aeruginosa PA01
cggcgacgcaggacgucg

SEQ ID NO: 1502139 - RNA, 14 nt, Pseudomonas aeruginosa PA01
cggcgacgccaccc

SEQ ID NO: 1502140 - RNA, 16 nt, Pseudomonas aeruginosa PA01
cggcgacgccacccgc

SEQ ID NO: 1502141 - RNA, 18 nt, Pseudomonas aeruginosa PA01
cggcgacgccacccgcau

SEQ ID NO: 1502142 - RNA, 15 nt, Pseudomonas aeruginosa PA01
cggcgacgggaagcg

SEQ ID NO: 1502143 - RNA, 17 nt, Pseudomonas aeruginosa PA01
cggcgacgggcuucgcg

SEQ ID NO: 1502144 - RNA, 20 nt, Pseudomonas aeruginosa PA01
cggcgacgggcuucgcgacc

SEQ ID NO: 1502145 - RNA, 22 nt, Pseudomonas aeruginosa PA01
cggcgagauugcgcugagcgga

SEQ ID NO: 1502146 - RNA, 17 nt, Pseudomonas aeruginosa PA01
cggcgagcaacgcaggu

SEQ ID NO: 1502147 - RNA, 15 nt, Pseudomonas aeruginosa PA01
cggcgagaucuucag

SEQ ID NO: 1502148 - RNA, 19 nt, Pseudomonas aeruginosa PA01
cggcgagaucuucaggccg

SEQ ID NO: 1502149 - RNA, 20 nt, Pseudomonas aeruginosa PA01
cggcgagaucuucaggccga

SEQ ID NO: 1502150 - RNA, 17 nt, Pseudomonas aeruginosa PA01
cggcgagagcgccgacc

SEQ ID NO: 1502151 - RNA, 20 nt, Pseudomonas aeruginosa PA01
cggcgagagcgccgaccagc

SEQ ID NO: 1502152 - RNA, 21 nt, Pseudomonas aeruginosa PA01
cggcgagagcguccggcaggg

SEQ ID NO: 1502153 - RNA, 17 nt, Pseudomonas aeruginosa PA01
cggcgagaggucggcgc

SEQ ID NO: 1502154 - RNA, 19 nt, Pseudomonas aeruginosa PA01
cggcgagaggucggcgcgc

SEQ ID NO: 1502155 - RNA, 18 nt, Pseudomonas aeruginosa PA01
cggcgagaaaggcugcuu

SEQ ID NO: 1502156 - RNA, 21 nt, Pseudomonas aeruginosa PA01
cggcgagaaaggcugcuucgg

SEQ ID NO: 1502157 - RNA, 20 nt, Pseudomonas aeruginosa PA01
cggcgagaaagucgaucagc

SEQ ID NO: 1502158 - RNA, 23 nt, Pseudomonas aeruginosa PA01
cggcgagaaagucgaucagcgcg

SEQ ID NO: 1502159 - RNA, 21 nt, Pseudomonas aeruginosa PA01
cggcgagaacucguccggucg

SEQ ID NO: 1502160 - RNA, 23 nt, Pseudomonas aeruginosa PA01
cggcgagcaaugaaaaaggcgau

SEQ ID NO: 1502161 - RNA, 13 nt, Pseudomonas aeruginosa PA01
cggcgagcacggc

SEQ ID NO: 1502162 - RNA, 18 nt, Pseudomonas aeruginosa PA01
cggcgagcacggcgaaca

SEQ ID NO: 1502163 - RNA, 21 nt, Pseudomonas aeruginosa PA01
cggcgagcacggcgaacaccg

SEQ ID NO: 1502164 - RNA, 13 nt, Pseudomonas aeruginosa PA01
cggcgagcaggcg

SEQ ID NO: 1502165 - RNA, 17 nt, Pseudomonas aeruginosa PA01
cggcgagcaggcgaaca

SEQ ID NO: 1502166 - RNA, 23 nt, Pseudomonas aeruginosa PA01
cggcgagcaggcgggaguccagg

SEQ ID NO: 1502167 - RNA, 15 nt, Pseudomonas aeruginosa PA01
cggcgagcagguaga

SEQ ID NO: 1502168 - RNA, 16 nt, Pseudomonas aeruginosa PA01
cggcgagcagcggcgc

SEQ ID NO: 1502169 - RNA, 18 nt, Pseudomonas aeruginosa PA01
cggcgagcgagcggcaga

SEQ ID NO: 1502170 - RNA, 13 nt, Pseudomonas aeruginosa PA01
cggcgagccggcg

SEQ ID NO: 1502171 - RNA, 15 nt, Pseudomonas aeruginosa PA01
cggcgagccggcgca

SEQ ID NO: 1502172 - RNA, 15 nt, Pseudomonas aeruginosa PA01
cggcgagccgguagu

SEQ ID NO: 1502173 - RNA, 16 nt, Pseudomonas aeruginosa PA01
cggcgagccgguagug

SEQ ID NO: 1502174 - RNA, 22 nt, Pseudomonas aeruginosa PA01
cggcgagccagguuuccggcag

SEQ ID NO: 1502175 - RNA, 17 nt, Pseudomonas aeruginosa PA01
cggcgagcaucucggcc

SEQ ID NO: 1502176 - RNA, 18 nt, Pseudomonas aeruginosa PA01
cggcgagcaucucggcca

SEQ ID NO: 1502177 - RNA, 20 nt, Pseudomonas aeruginosa PA01
cggcgagcaucucggccagg

SEQ ID NO: 1502178 - RNA, 18 nt, Pseudomonas aeruginosa PA01
cggcgagccgcagcggcu

SEQ ID NO: 1502179 - RNA, 14 nt, Pseudomonas aeruginosa PA01
cggcgagccgccgg

SEQ ID NO: 1502180 - RNA, 15 nt, Pseudomonas aeruginosa PA01
cggcgagccgccggg

SEQ ID NO: 1502181 - RNA, 16 nt, Pseudomonas aeruginosa PA01
cggcgagccgccgggc

SEQ ID NO: 1502182 - RNA, 21 nt, Pseudomonas aeruginosa PA01
cggcgagccgccgggcggcgu

SEQ ID NO: 1502183 - RNA, 15 nt, Pseudomonas aeruginosa PA01
cggcgagccgcgacg

SEQ ID NO: 1502184 - RNA, 19 nt, Pseudomonas aeruginosa PA01
cggcgagccgcgacggcug

SEQ ID NO: 1502185 - RNA, 17 nt, Pseudomonas aeruginosa PA01
cggcgagggcggcgacc

SEQ ID NO: 1502186 - RNA, 18 nt, Pseudomonas aeruginosa PA01
cggcgagggcggcgaccu

SEQ ID NO: 1502187 - RNA, 13 nt, Pseudomonas aeruginosa PA01
cggcgaggccggc

SEQ ID NO: 1502188 - RNA, 14 nt, Pseudomonas aeruginosa PA01
cggcgaggccggcg

SEQ ID NO: 1502189 - RNA, 15 nt, Pseudomonas aeruginosa PA01
cggcgaggccggcga

SEQ ID NO: 1502190 - RNA, 17 nt, Pseudomonas aeruginosa PA01
cggcgaggccggcgauc

SEQ ID NO: 1502191 - RNA, 19 nt, Pseudomonas aeruginosa PA01
cggcgaggccggcgaucag

SEQ ID NO: 1502192 - RNA, 23 nt, Pseudomonas aeruginosa PA01
cggcgaggccggcgaucagcucg

SEQ ID NO: 1502193 - RNA, 14 nt, Pseudomonas aeruginosa PA01
cggcgaggaucgcc

SEQ ID NO: 1502194 - RNA, 16 nt, Pseudomonas aeruginosa PA01
cggcgaggaucgccag

SEQ ID NO: 1502195 - RNA, 19 nt, Pseudomonas aeruginosa PA01
cggcgaggaucgccagcaa

SEQ ID NO: 1502196 - RNA, 15 nt, Pseudomonas aeruginosa PA01
cggcgaggaucgcgc

SEQ ID NO: 1502197 - RNA, 17 nt, Pseudomonas aeruginosa PA01
cggcgaggaucgcgcug

SEQ ID NO: 1502198 - RNA, 13 nt, Pseudomonas aeruginosa PA01
cggcgaggccgac

SEQ ID NO: 1502199 - RNA, 14 nt, Pseudomonas aeruginosa PA01
cggcgaggccgacc

SEQ ID NO: 1502200 - RNA, 23 nt, Pseudomonas aeruginosa PA01
cggcgagcuggaucggcaggcug

SEQ ID NO: 1502201 - RNA, 15 nt, Pseudomonas aeruginosa PA01
cggcgagcgccgcgg

SEQ ID NO: 1502202 - RNA, 19 nt, Pseudomonas aeruginosa PA01
cggcgagcgccgcggcgaa

SEQ ID NO: 1502203 - RNA, 17 nt, Pseudomonas aeruginosa PA01
cggcgaguucgcgcagg

SEQ ID NO: 1502204 - RNA, 16 nt, Pseudomonas aeruginosa PA01
cggcgaggugaucgag

SEQ ID NO: 1502205 - RNA, 19 nt, Pseudomonas aeruginosa PA01
cggcgaggugaucgagggc

SEQ ID NO: 1502206 - RNA, 14 nt, Pseudomonas aeruginosa PA01
cggcgaggcguucc

SEQ ID NO: 1502207 - RNA, 18 nt, Pseudomonas aeruginosa PA01
cggcgaggcguuccaggu

SEQ ID NO: 1502208 - RNA, 20 nt, Pseudomonas aeruginosa PA01
cggcgagguugcccacggcc

SEQ ID NO: 1502209 - RNA, 23 nt, Pseudomonas aeruginosa PA01
cggcgagguugcccacggccagg

SEQ ID NO: 1502210 - RNA, 17 nt, Pseudomonas aeruginosa PA01
cggcgaguaaccaccgc

SEQ ID NO: 1502211 - RNA, 20 nt, Pseudomonas aeruginosa PA01
cggcgauaggcgcgcaacgc

SEQ ID NO: 1502212 - RNA, 15 nt, Pseudomonas aeruginosa PA01
cggcgauacccaggc

SEQ ID NO: 1502213 - RNA, 20 nt, Pseudomonas aeruginosa PA01
cggcgauacccaggccgucg

SEQ ID NO: 1502214 - RNA, 23 nt, Pseudomonas aeruginosa PA01
cggcgauacccaggccgucgagg

SEQ ID NO: 1502215 - RNA, 18 nt, Pseudomonas aeruginosa PA01
cggcgaguugcgcgaggc

SEQ ID NO: 1502216 - RNA, 19 nt, Pseudomonas aeruginosa PA01
cggcgaguugcgcgaggcg

SEQ ID NO: 1502217 - RNA, 18 nt, Pseudomonas aeruginosa PA01
cggcgaguuggccgaacu

SEQ ID NO: 1502218 - RNA, 15 nt, Pseudomonas aeruginosa PA01
cggcgaguucggcgu

SEQ ID NO: 1502219 - RNA, 13 nt, Pseudomonas aeruginosa PA01
cggccggcagcga

SEQ ID NO: 1502220 - RNA, 19 nt, Pseudomonas aeruginosa PA01
cggccggcaggcugugcca

SEQ ID NO: 1502221 - RNA, 13 nt, Pseudomonas aeruginosa PA01
cggccggcaggag

SEQ ID NO: 1502222 - RNA, 13 nt, Pseudomonas aeruginosa PA01
cggccggcaggcc

SEQ ID NO: 1502223 - RNA, 17 nt, Pseudomonas aeruginosa PA01
cggccggcagcuccggc

SEQ ID NO: 1502224 - RNA, 22 nt, Pseudomonas aeruginosa PA01
cggccggcagcuccggcgggcg

SEQ ID NO: 1502225 - RNA, 14 nt, Pseudomonas aeruginosa PA01
cggccggccacgcg

SEQ ID NO: 1502226 - RNA, 19 nt, Pseudomonas aeruginosa PA01
cggccggccacgcgaccag

SEQ ID NO: 1502227 - RNA, 20 nt, Pseudomonas aeruginosa PA01
cggccggccacgcgaccagc

SEQ ID NO: 1502228 - RNA, 12 nt, Pseudomonas aeruginosa PA01
cggccggccagg

SEQ ID NO: 1502229 - RNA, 16 nt, Pseudomonas aeruginosa PA01
cggccugccguugcac

SEQ ID NO: 1502230 - RNA, 13 nt, Pseudomonas aeruginosa PA01
cggccugcucgcg

SEQ ID NO: 1502231 - RNA, 21 nt, Pseudomonas aeruginosa PA01
cggccugcucgcgcagccagg

SEQ ID NO: 1502232 - RNA, 19 nt, Pseudomonas aeruginosa PA01
cggccugcggguucggcga

SEQ ID NO: 1502233 - RNA, 18 nt, Pseudomonas aeruginosa PA01
cggccugcgcgcaccagg

SEQ ID NO: 1502234 - RNA, 22 nt, Pseudomonas aeruginosa PA01
cggccugcgcgcaccaggccuc

SEQ ID NO: 1502235 - RNA, 18 nt, Pseudomonas aeruginosa PA01
cggccuggaucucugcga

SEQ ID NO: 1502236 - RNA, 20 nt, Pseudomonas aeruginosa PA01
cggccuggaucucugcgaga

SEQ ID NO: 1502237 - RNA, 16 nt, Pseudomonas aeruginosa PA01
cggccuggaaccgcuc

SEQ ID NO: 1502238 - RNA, 17 nt, Pseudomonas aeruginosa PA01
cggccuggaucgccuug

SEQ ID NO: 1502239 - RNA, 17 nt, Pseudomonas aeruginosa PA01
cggccugcucggcucgc

SEQ ID NO: 1502240 - RNA, 14 nt, Pseudomonas aeruginosa PA01
cggccugcugcgcc

SEQ ID NO: 1502241 - RNA, 16 nt, Pseudomonas aeruginosa PA01
cggccugcugcgccgg

SEQ ID NO: 1502242 - RNA, 17 nt, Pseudomonas aeruginosa PA01
cggccugcugcgccggc

SEQ ID NO: 1502243 - RNA, 13 nt, Pseudomonas aeruginosa PA01
cggccugcugcuc

SEQ ID NO: 1502244 - RNA, 14 nt, Pseudomonas aeruginosa PA01
cggccugcugcucg

SEQ ID NO: 1502245 - RNA, 15 nt, Pseudomonas aeruginosa PA01
cggccugcugcucga

SEQ ID NO: 1502246 - RNA, 16 nt, Pseudomonas aeruginosa PA01
cggccugcugcucgac

SEQ ID NO: 1502247 - RNA, 21 nt, Pseudomonas aeruginosa PA01
cggccugcugcucgaccgccu

SEQ ID NO: 1502248 - RNA, 19 nt, Pseudomonas aeruginosa PA01
cggccuugaggcgggccag

SEQ ID NO: 1502249 - RNA, 12 nt, Pseudomonas aeruginosa PA01
cggccuggcgca

SEQ ID NO: 1502250 - RNA, 17 nt, Pseudomonas aeruginosa PA01
cggccuggcgcagcggc

SEQ ID NO: 1502251 - RNA, 18 nt, Pseudomonas aeruginosa PA01
cggccuggcgcagcggca

SEQ ID NO: 1502252 - RNA, 14 nt, Pseudomonas aeruginosa PA01
cggccuggcgccgg

SEQ ID NO: 1502253 - RNA, 15 nt, Pseudomonas aeruginosa PA01
cggccuggcgccggg

SEQ ID NO: 1502254 - RNA, 16 nt, Pseudomonas aeruginosa PA01
cggccuggcgccgggg

SEQ ID NO: 1502255 - RNA, 17 nt, Pseudomonas aeruginosa PA01
cggccuggcgccggggu

SEQ ID NO: 1502256 - RNA, 12 nt, Pseudomonas aeruginosa PA01
cggccuggcgcg

SEQ ID NO: 1502257 - RNA, 17 nt, Pseudomonas aeruginosa PA01
cggcgaaagccggaccu

SEQ ID NO: 1502258 - RNA, 18 nt, Pseudomonas aeruginosa PA01
cggcgaaaugcaggccgg

SEQ ID NO: 1502259 - RNA, 21 nt, Pseudomonas aeruginosa PA01
cggcgaaaugcaggccggugg

SEQ ID NO: 1502260 - RNA, 22 nt, Pseudomonas aeruginosa PA01
cggcgaaaugcaggccgguggu

SEQ ID NO: 1502261 - RNA, 23 nt, Pseudomonas aeruginosa PA01
cggcgaaauggguucccagcagc

SEQ ID NO: 1502262 - RNA, 22 nt, Pseudomonas aeruginosa PA01
cggcgaaauccucgcgcaccgc

SEQ ID NO: 1502263 - RNA, 14 nt, Pseudomonas aeruginosa PA01
cggcgaacgacagc

SEQ ID NO: 1502264 - RNA, 16 nt, Pseudomonas aeruginosa PA01
cggcgaacgccggguc

SEQ ID NO: 1502265 - RNA, 16 nt, Pseudomonas aeruginosa PA01
cggcgaacccggcgcg

SEQ ID NO: 1502266 - RNA, 23 nt, Pseudomonas aeruginosa PA01
cggcgaacccggcgcggcgcagc

SEQ ID NO: 1502267 - RNA, 21 nt, Pseudomonas aeruginosa PA01
cggcgaacccucggugcggcc

SEQ ID NO: 1502268 - RNA, 19 nt, Pseudomonas aeruginosa PA01
cggcgaacaccgggccgcc

SEQ ID NO: 1502269 - RNA, 21 nt, Pseudomonas aeruginosa PA01
cggcgaacaccgggccgccgg

SEQ ID NO: 1502270 - RNA, 20 nt, Pseudomonas aeruginosa PA01
cggcgaacagguagccccgg

SEQ ID NO: 1502271 - RNA, 16 nt, Pseudomonas aeruginosa PA01
cggcgaacaucaucca

SEQ ID NO: 1502272 - RNA, 16 nt, Pseudomonas aeruginosa PA01
cggcgaaccaggcggc

SEQ ID NO: 1502273 - RNA, 17 nt, Pseudomonas aeruginosa PA01
cggcgaaccaggcggcc

SEQ ID NO: 1502274 - RNA, 19 nt, Pseudomonas aeruginosa PA01
cggcgaacucguagacgaa

SEQ ID NO: 1502275 - RNA, 21 nt, Pseudomonas aeruginosa PA01
cggcgaacgcuugagccccgg

SEQ ID NO: 1502276 - RNA, 14 nt, Pseudomonas aeruginosa PA01
cggcgaacggaccg

SEQ ID NO: 1502277 - RNA, 14 nt, Pseudomonas aeruginosa PA01
cggcgaacuggcca

SEQ ID NO: 1502278 - RNA, 15 nt, Pseudomonas aeruginosa PA01
cggcgaacggcaugc

SEQ ID NO: 1502279 - RNA, 16 nt, Pseudomonas aeruginosa PA01
cggcgaacggcaugcg

SEQ ID NO: 1502280 - RNA, 16 nt, Pseudomonas aeruginosa PA01
cggcgaacuccgccag

SEQ ID NO: 1502281 - RNA, 18 nt, Pseudomonas aeruginosa PA01
cggcgaacuccgccagcu

SEQ ID NO: 1502282 - RNA, 14 nt, Pseudomonas aeruginosa PA01
cggcgaagaacagc

SEQ ID NO: 1502283 - RNA, 15 nt, Pseudomonas aeruginosa PA01
cggcgaagccgcgcc

SEQ ID NO: 1502284 - RNA, 17 nt, Pseudomonas aeruginosa PA01
cggcgaagccugcggcg

SEQ ID NO: 1502285 - RNA, 20 nt, Pseudomonas aeruginosa PA01
cggcgaagccugcggcgaga

SEQ ID NO: 1502286 - RNA, 16 nt, Pseudomonas aeruginosa PA01
cggcgaagcggaagcg

SEQ ID NO: 1502287 - RNA, 20 nt, Pseudomonas aeruginosa PA01
cggcgaagcggaagcgcagc

SEQ ID NO: 1502288 - RNA, 22 nt, Pseudomonas aeruginosa PA01
cggcgaagcggcccuugucgcc

SEQ ID NO: 1502289 - RNA, 20 nt, Pseudomonas aeruginosa PA01
cggcgaagcguugcagcguc

SEQ ID NO: 1502290 - RNA, 12 nt, Pseudomonas aeruginosa PA01
cggcgaccaccg

SEQ ID NO: 1502291 - RNA, 13 nt, Pseudomonas aeruginosa PA01
cggcgaccaccgc

SEQ ID NO: 1502292 - RNA, 14 nt, Pseudomonas aeruginosa PA01
cggcgaccaccgcc

SEQ ID NO: 1502293 - RNA, 16 nt, Pseudomonas aeruginosa PA01
cggcgaccaccgccgg

SEQ ID NO: 1502294 - RNA, 15 nt, Pseudomonas aeruginosa PA01
cggcgaccaccgcga

SEQ ID NO: 1502295 - RNA, 20 nt, Pseudomonas aeruginosa PA01
cggcgaccaccgcgaauccg

SEQ ID NO: 1502296 - RNA, 17 nt, Pseudomonas aeruginosa PA01
cggcgacauagccggcg

SEQ ID NO: 1502297 - RNA, 18 nt, Pseudomonas aeruginosa PA01
cggcgacauagccggcga

SEQ ID NO: 1502298 - RNA, 20 nt, Pseudomonas aeruginosa PA01
cggcgacauagccggcgaac

SEQ ID NO: 1502299 - RNA, 17 nt, Pseudomonas aeruginosa PA01
cggcgaccaccacgucg

SEQ ID NO: 1502300 - RNA, 20 nt, Pseudomonas aeruginosa PA01
cggcgacaccccgaaguagc

SEQ ID NO: 1502301 - RNA, 14 nt, Pseudomonas aeruginosa PA01
cggcgacaccgcca

SEQ ID NO: 1502302 - RNA, 17 nt, Pseudomonas aeruginosa PA01
cggcgacaccgccagca

SEQ ID NO: 1502303 - RNA, 18 nt, Pseudomonas aeruginosa PA01
cggcgacaccgccagcac

SEQ ID NO: 1502304 - RNA, 14 nt, Pseudomonas aeruginosa PA01
cggcgacagcacca

SEQ ID NO: 1502305 - RNA, 17 nt, Pseudomonas aeruginosa PA01
cggcgacagcaccacgc

SEQ ID NO: 1502306 - RNA, 19 nt, Pseudomonas aeruginosa PA01
cggcgacagcaccacgccg

SEQ ID NO: 1502307 - RNA, 12 nt, Pseudomonas aeruginosa PA01
cggcgacagccg

SEQ ID NO: 1502308 - RNA, 16 nt, Pseudomonas aeruginosa PA01
cggcgacagccgggca

SEQ ID NO: 1502309 - RNA, 17 nt, Pseudomonas aeruginosa PA01
cggcgacagccgggcag

SEQ ID NO: 1502310 - RNA, 22 nt, Pseudomonas aeruginosa PA01
cggcgaagggcgcuucggcgga

SEQ ID NO: 1502311 - RNA, 22 nt, Pseudomonas aeruginosa PA01
cggcgaaguaggaguaggucac

SEQ ID NO: 1502312 - RNA, 18 nt, Pseudomonas aeruginosa PA01
cggcgaaggccgcuuggc

SEQ ID NO: 1502313 - RNA, 21 nt, Pseudomonas aeruginosa PA01
cggcgaaggcgaaccacacca

SEQ ID NO: 1502314 - RNA, 23 nt, Pseudomonas aeruginosa PA01
cggcgaagcuccucgauaaacgg

SEQ ID NO: 1502315 - RNA, 13 nt, Pseudomonas aeruginosa PA01
cggcgaaguccac

SEQ ID NO: 1502316 - RNA, 21 nt, Pseudomonas aeruginosa PA01
cggcgaaguccaccaggcgcc

SEQ ID NO: 1502317 - RNA, 22 nt, Pseudomonas aeruginosa PA01
cggcgaaguccggguugagcac

SEQ ID NO: 1502318 - RNA, 23 nt, Pseudomonas aeruginosa PA01
cggcgaaguccggguugagcacc

SEQ ID NO: 1502319 - RNA, 21 nt, Pseudomonas aeruginosa PA01
cggcgacacagacgcagccgu

SEQ ID NO: 1502320 - RNA, 16 nt, Pseudomonas aeruginosa PA01
cggcgaaugccgggcu

SEQ ID NO: 1502321 - RNA, 16 nt, Pseudomonas aeruginosa PA01
cggcgaauucgucgcc

SEQ ID NO: 1502322 - RNA, 21 nt, Pseudomonas aeruginosa PA01
cggcgaauucgucgccgccga

SEQ ID NO: 1502323 - RNA, 15 nt, Pseudomonas aeruginosa PA01
ccggagaccgugccg

SEQ ID NO: 1502324 - RNA, 17 nt, Pseudomonas aeruginosa PA01
ccggagaccgugccgcc

SEQ ID NO: 1502325 - RNA, 19 nt, Pseudomonas aeruginosa PA01
ccggagaccgugccgccgg

SEQ ID NO: 1502326 - RNA, 20 nt, Pseudomonas aeruginosa PA01
ccggagaccgugccgccggg

SEQ ID NO: 1502327 - RNA, 22 nt, Pseudomonas aeruginosa PA01
ccggagaccgugccgccggggc

SEQ ID NO: 1502328 - RNA, 15 nt, Pseudomonas aeruginosa PA01
ccggagaucgccgcg

SEQ ID NO: 1502329 - RNA, 18 nt, Pseudomonas aeruginosa PA01
ccggagaucgccgcgccg

SEQ ID NO: 1502330 - RNA, 14 nt, Pseudomonas aeruginosa PA01
ccggagaucggcug

SEQ ID NO: 1502331 - RNA, 13 nt, Pseudomonas aeruginosa PA01
ccggagaacgccg

SEQ ID NO: 1502332 - RNA, 23 nt, Pseudomonas aeruginosa PA01
ccggagaacgccgccacgccgau

SEQ ID NO: 1502333 - RNA, 18 nt, Pseudomonas aeruginosa PA01
ccggagacgauggcgacg

SEQ ID NO: 1502334 - RNA, 21 nt, Pseudomonas aeruginosa PA01
ccggagagcagcacggccucg

SEQ ID NO: 1502335 - RNA, 21 nt, Pseudomonas aeruginosa PA01
ccggagagcgaauacaccgag

SEQ ID NO: 1502336 - RNA, 14 nt, Pseudomonas aeruginosa PA01
ccggagccaacgcc

SEQ ID NO: 1502337 - RNA, 14 nt, Pseudomonas aeruginosa PA01
ccggagccaccggg

SEQ ID NO: 1502338 - RNA, 13 nt, Pseudomonas aeruginosa PA01
ccggagccgggca

SEQ ID NO: 1502339 - RNA, 16 nt, Pseudomonas aeruginosa PA01
ccggagccgggcaacg

SEQ ID NO: 1502340 - RNA, 17 nt, Pseudomonas aeruginosa PA01
ccggagcgaacgacagc

SEQ ID NO: 1502341 - RNA, 18 nt, Pseudomonas aeruginosa PA01
ccggacgggugcgcgcca

SEQ ID NO: 1502342 - RNA, 17 nt, Pseudomonas aeruginosa PA01
ccggacguuuccagcgg

SEQ ID NO: 1502343 - RNA, 21 nt, Pseudomonas aeruginosa PA01
ccggacugcccgacgaagacg

SEQ ID NO: 1502344 - RNA, 19 nt, Pseudomonas aeruginosa PA01
ccggacugccgauggugau

SEQ ID NO: 1502345 - RNA, 21 nt, Pseudomonas aeruginosa PA01
ccggacuggauucggccugcc

SEQ ID NO: 1502346 - RNA, 17 nt, Pseudomonas aeruginosa PA01
ccggacgcaccagcagg

SEQ ID NO: 1502347 - RNA, 22 nt, Pseudomonas aeruginosa PA01
ccggacgacgaaagaagccgca

SEQ ID NO: 1502348 - RNA, 15 nt, Pseudomonas aeruginosa PA01
ccggacgccgaacgc

SEQ ID NO: 1502349 - RNA, 17 nt, Pseudomonas aeruginosa PA01
ccggacgccgaacgccc

SEQ ID NO: 1502350 - RNA, 13 nt, Pseudomonas aeruginosa PA01
ccggacggcggcg

SEQ ID NO: 1502351 - RNA, 24 nt, Pseudomonas aeruginosa PA01
ccggacggcggcgucaucccguag

SEQ ID NO: 1502352 - RNA, 20 nt, Pseudomonas aeruginosa PA01
ccggacggcugaggcuggcg

SEQ ID NO: 1502353 - RNA, 18 nt, Pseudomonas aeruginosa PA01
ccggagucguagcgcgcg

SEQ ID NO: 1502354 - RNA, 20 nt, Pseudomonas aeruginosa PA01
ccggagucguagcgcgcggc

SEQ ID NO: 1502355 - RNA, 15 nt, Pseudomonas aeruginosa PA01
ccggaggggcggccg

SEQ ID NO: 1502356 - RNA, 13 nt, Pseudomonas aeruginosa PA01
ccggaggcggcga

SEQ ID NO: 1502357 - RNA, 17 nt, Pseudomonas aeruginosa PA01
ccggaggcggcgagcgu

SEQ ID NO: 1502358 - RNA, 12 nt, Pseudomonas aeruginosa PA01
ccggagcggcug

SEQ ID NO: 1502359 - RNA, 19 nt, Pseudomonas aeruginosa PA01
ccggagcuuugcagggcga

SEQ ID NO: 1502360 - RNA, 20 nt, Pseudomonas aeruginosa PA01
ccggagcuuugcagggcgau

SEQ ID NO: 1502361 - RNA, 16 nt, Pseudomonas aeruginosa PA01
ccggaggcgcacaggc

SEQ ID NO: 1502362 - RNA, 16 nt, Pseudomonas aeruginosa PA01
ccggaggcagcgaugc

SEQ ID NO: 1502363 - RNA, 13 nt, Pseudomonas aeruginosa PA01
ccggauacaccag

SEQ ID NO: 1502364 - RNA, 17 nt, Pseudomonas aeruginosa PA01
ccggauagacgccgucc

SEQ ID NO: 1502365 - RNA, 12 nt, Pseudomonas aeruginosa PA01
ccggaucagcuc

SEQ ID NO: 1502366 - RNA, 16 nt, Pseudomonas aeruginosa PA01
ccggauagaucaggcc

SEQ ID NO: 1502367 - RNA, 18 nt, Pseudomonas aeruginosa PA01
ccggauagaucaggccgg

SEQ ID NO: 1502368 - RNA, 12 nt, Pseudomonas aeruginosa PA01
ccggaucggcug

SEQ ID NO: 1502369 - RNA, 16 nt, Pseudomonas aeruginosa PA01
ccggaucggcugaccg

SEQ ID NO: 1502370 - RNA, 13 nt, Pseudomonas aeruginosa PA01
ccggaucggccuu

SEQ ID NO: 1502371 - RNA, 15 nt, Pseudomonas aeruginosa PA01
ccggaucgcccuggc

SEQ ID NO: 1502372 - RNA, 24 nt, Pseudomonas aeruginosa PA01
ccgcugcggcggucccagaccagc

SEQ ID NO: 1502373 - RNA, 12 nt, Pseudomonas aeruginosa PA01
ccgcugcggcuc

SEQ ID NO: 1502374 - RNA, 18 nt, Pseudomonas aeruginosa PA01
ccgcugcggcucgccgau

SEQ ID NO: 1502375 - RNA, 22 nt, Pseudomonas aeruginosa PA01
ccgcugcggcugcagggccagg

SEQ ID NO: 1502376 - RNA, 16 nt, Pseudomonas aeruginosa PA01
ccgcugccgccgcgca

SEQ ID NO: 1502377 - RNA, 17 nt, Pseudomonas aeruginosa PA01
ccgcugcguagggcgag

SEQ ID NO: 1502378 - RNA, 17 nt, Pseudomonas aeruginosa PA01
ccgcugcgucgucgcgg

SEQ ID NO: 1502379 - RNA, 13 nt, Pseudomonas aeruginosa PA01
ccgcugcgugcca

SEQ ID NO: 1502380 - RNA, 13 nt, Pseudomonas aeruginosa PA01
ccgcugcggccgg

SEQ ID NO: 1502381 - RNA, 15 nt, Pseudomonas aeruginosa PA01
ccgcugcuggauggg

SEQ ID NO: 1502382 - RNA, 13 nt, Pseudomonas aeruginosa PA01
ccgcugcuggcau

SEQ ID NO: 1502383 - RNA, 18 nt, Pseudomonas aeruginosa PA01
ccgcuggaaccggccggc

SEQ ID NO: 1502384 - RNA, 19 nt, Pseudomonas aeruginosa PA01
ccgcuggaaccggccggca

SEQ ID NO: 1502385 - RNA, 21 nt, Pseudomonas aeruginosa PA01
ccgcuggaaccggccggcagg

SEQ ID NO: 1502386 - RNA, 21 nt, Pseudomonas aeruginosa PA01
ccgcuggaccaguucagcgcg

SEQ ID NO: 1502387 - RNA, 19 nt, Pseudomonas aeruginosa PA01
ccggaaguggcagcgccgu

SEQ ID NO: 1502388 - RNA, 14 nt, Pseudomonas aeruginosa PA01
ccggaaucacgcug

SEQ ID NO: 1502389 - RNA, 16 nt, Pseudomonas aeruginosa PA01
ccggaaucacgucgau

SEQ ID NO: 1502390 - RNA, 17 nt, Pseudomonas aeruginosa PA01
ccggaagcuucaggcuc

SEQ ID NO: 1502391 - RNA, 23 nt, Pseudomonas aeruginosa PA01
ccggaagcuucaggcucggccug

SEQ ID NO: 1502392 - RNA, 23 nt, Pseudomonas aeruginosa PA01
ccggaaccgggguuuccucgaug

SEQ ID NO: 1502393 - RNA, 19 nt, Pseudomonas aeruginosa PA01
ccggaccguggugacgguc

SEQ ID NO: 1502394 - RNA, 14 nt, Pseudomonas aeruginosa PA01
ccggacccggcugc

SEQ ID NO: 1502395 - RNA, 17 nt, Pseudomonas aeruginosa PA01
ccggacccggcugcacg

SEQ ID NO: 1502396 - RNA, 17 nt, Pseudomonas aeruginosa PA01
ccggacauaucgaucac

SEQ ID NO: 1502397 - RNA, 15 nt, Pseudomonas aeruginosa PA01
ccggaccagaucggc

SEQ ID NO: 1502398 - RNA, 13 nt, Pseudomonas aeruginosa PA01
ccggaccagggcg

SEQ ID NO: 1502399 - RNA, 17 nt, Pseudomonas aeruginosa PA01
ccggaccagggcgccgg

SEQ ID NO: 1502400 - RNA, 21 nt, Pseudomonas aeruginosa PA01
ccggaccagggcgccgggcug

SEQ ID NO: 1502401 - RNA, 14 nt, Pseudomonas aeruginosa PA01
ccggacagccuucg

SEQ ID NO: 1502402 - RNA, 22 nt, Pseudomonas aeruginosa PA01
ccggaaucgacggauacgccag

SEQ ID NO: 1502403 - RNA, 19 nt, Pseudomonas aeruginosa PA01
ccggacaacaggccgggcg

SEQ ID NO: 1502404 - RNA, 14 nt, Pseudomonas aeruginosa PA01
ccgcguagcgccag

SEQ ID NO: 1502405 - RNA, 15 nt, Pseudomonas aeruginosa PA01
ccgcguagcgccagg

SEQ ID NO: 1502406 - RNA, 15 nt, Pseudomonas aeruginosa PA01
ccgcgucacggaccc

SEQ ID NO: 1502407 - RNA, 23 nt, Pseudomonas aeruginosa PA01
ccgcgucacggacccgcucggcc

SEQ ID NO: 1502408 - RNA, 21 nt, Pseudomonas aeruginosa PA01
ccgcguccgagagcagggccu

SEQ ID NO: 1502409 - RNA, 22 nt, Pseudomonas aeruginosa PA01
ccgcgucgaagcugucggcccg

SEQ ID NO: 1502410 - RNA, 22 nt, Pseudomonas aeruginosa PA01
ccgcgucgaagucgaucaccgc

SEQ ID NO: 1502411 - RNA, 23 nt, Pseudomonas aeruginosa PA01
ccgcguccuccuggaggacgcgg

SEQ ID NO: 1502412 - RNA, 14 nt, Pseudomonas aeruginosa PA01
ccgcgguggaggcg

SEQ ID NO: 1502413 - RNA, 17 nt, Pseudomonas aeruginosa PA01
ccgcggugcggauggca

SEQ ID NO: 1502414 - RNA, 15 nt, Pseudomonas aeruginosa PA01
ccgcggugucggcga

SEQ ID NO: 1502415 - RNA, 23 nt, Pseudomonas aeruginosa PA01
ccgcggugucggugcccucgcgg

SEQ ID NO: 1502416 - RNA, 13 nt, Pseudomonas aeruginosa PA01
ccgcggugggcuc

SEQ ID NO: 1502417 - RNA, 18 nt, Pseudomonas aeruginosa PA01
ccgcgguuuccgugcgga

SEQ ID NO: 1502418 - RNA, 23 nt, Pseudomonas aeruginosa PA01
ccgcguacggucuugcgcuugcc

SEQ ID NO: 1502419 - RNA, 14 nt, Pseudomonas aeruginosa PA01
ccgcgggucaccag

SEQ ID NO: 1502420 - RNA, 16 nt, Pseudomonas aeruginosa PA01
ccgcgggucaccagcg

SEQ ID NO: 1502421 - RNA, 18 nt, Pseudomonas aeruginosa PA01
ccgcgggucaccagcgcc

SEQ ID NO: 1502422 - RNA, 19 nt, Pseudomonas aeruginosa PA01
ccgcgggucaccagcgccg

SEQ ID NO: 1502423 - RNA, 20 nt, Pseudomonas aeruginosa PA01
ccgcgggucaccagcgccgg

SEQ ID NO: 1502424 - RNA, 12 nt, Pseudomonas aeruginosa PA01
ccgcggucgggc

SEQ ID NO: 1502425 - RNA, 15 nt, Pseudomonas aeruginosa PA01
ccgcggucgggcaga

SEQ ID NO: 1502426 - RNA, 15 nt, Pseudomonas aeruginosa PA01
ccgcggucuucccgu

SEQ ID NO: 1502427 - RNA, 12 nt, Pseudomonas aeruginosa PA01
ccgcgcugcugg

SEQ ID NO: 1502428 - RNA, 15 nt, Pseudomonas aeruginosa PA01
ccgcgcugcgccagg

SEQ ID NO: 1502429 - RNA, 18 nt, Pseudomonas aeruginosa PA01
ccgcgcugcgccaggccg

SEQ ID NO: 1502430 - RNA, 20 nt, Pseudomonas aeruginosa PA01
ccgcgggcuauucccgccgc

SEQ ID NO: 1502431 - RNA, 22 nt, Pseudomonas aeruginosa PA01
ccgcgggcuauucccgccgcuc

SEQ ID NO: 1502432 - RNA, 20 nt, Pseudomonas aeruginosa PA01
ccgcggggaggaagcucccc

SEQ ID NO: 1502433 - RNA, 21 nt, Pseudomonas aeruginosa PA01
ccgcggggaggaagcuccccg

SEQ ID NO: 1502434 - RNA, 15 nt, Pseudomonas aeruginosa PA01
ccgcuccgcggccgg

SEQ ID NO: 1502435 - RNA, 16 nt, Pseudomonas aeruginosa PA01
ccgcuccgcggccggc

SEQ ID NO: 1502436 - RNA, 16 nt, Pseudomonas aeruginosa PA01
ccgcuccggcgccgag

SEQ ID NO: 1502437 - RNA, 19 nt, Pseudomonas aeruginosa PA01
ccgcuccggcucuccccgc

SEQ ID NO: 1502438 - RNA, 14 nt, Pseudomonas aeruginosa PA01
ccgcuccggcugcg

SEQ ID NO: 1502439 - RNA, 13 nt, Pseudomonas aeruginosa PA01
ccgcuacgcggcg

SEQ ID NO: 1502440 - RNA, 22 nt, Pseudomonas aeruginosa PA01
ccgcuacccagguggucgacca

SEQ ID NO: 1502441 - RNA, 18 nt, Pseudomonas aeruginosa PA01
ccgcugaugaucgcgucg

SEQ ID NO: 1502442 - RNA, 15 nt, Pseudomonas aeruginosa PA01
ccgcugaugcgcugg

SEQ ID NO: 1502443 - RNA, 21 nt, Pseudomonas aeruginosa PA01
ccgcugaucaguaccggcagc

SEQ ID NO: 1502444 - RNA, 20 nt, Pseudomonas aeruginosa PA01
ccgcugaggauguagccggc

SEQ ID NO: 1502445 - RNA, 22 nt, Pseudomonas aeruginosa PA01
ccgcugaggauguagccggcuu

SEQ ID NO: 1502446 - RNA, 16 nt, Pseudomonas aeruginosa PA01
ccgcugaggcucgccg

SEQ ID NO: 1502447 - RNA, 11 nt, Pseudomonas aeruginosa PA01
ccgcugaagga

SEQ ID NO: 1502448 - RNA, 15 nt, Pseudomonas aeruginosa PA01
ccgcugcauggggau

SEQ ID NO: 1502449 - RNA, 19 nt, Pseudomonas aeruginosa PA01
ccgcugcaugugccaggcc

SEQ ID NO: 1502450 - RNA, 16 nt, Pseudomonas aeruginosa PA01
ccgcugcaacuccgcc

SEQ ID NO: 1502451 - RNA, 18 nt, Pseudomonas aeruginosa PA01
ccgcugcaacuccgccug

SEQ ID NO: 1502452 - RNA, 13 nt, Pseudomonas aeruginosa PA01
ccgcugcacgccu

SEQ ID NO: 1502453 - RNA, 20 nt, Pseudomonas aeruginosa PA01
ccgcugcagggcggcgcugu

SEQ ID NO: 1502454 - RNA, 19 nt, Pseudomonas aeruginosa PA01
ccgcucggcgagccgccgg

SEQ ID NO: 1502455 - RNA, 12 nt, Pseudomonas aeruginosa PA01
ccgcucggccuu

SEQ ID NO: 1502456 - RNA, 20 nt, Pseudomonas aeruginosa PA01
ccgcucggccuugagcgccg

SEQ ID NO: 1502457 - RNA, 13 nt, Pseudomonas aeruginosa PA01
ccgcucggccgcc

SEQ ID NO: 1502458 - RNA, 14 nt, Pseudomonas aeruginosa PA01
ccgcucggccgcca

SEQ ID NO: 1502459 - RNA, 15 nt, Pseudomonas aeruginosa PA01
ccgcucggccgccag

SEQ ID NO: 1502460 - RNA, 20 nt, Pseudomonas aeruginosa PA01
ccgcugaauaccaccgggcc

SEQ ID NO: 1502461 - RNA, 19 nt, Pseudomonas aeruginosa PA01
ccgcucgagggcgaccgcc

SEQ ID NO: 1502462 - RNA, 19 nt, Pseudomonas aeruginosa PA01
ccgcucgaucccggcgcgg

SEQ ID NO: 1502463 - RNA, 21 nt, Pseudomonas aeruginosa PA01
ccgcucgaucccggcgcggaa

SEQ ID NO: 1502464 - RNA, 23 nt, Pseudomonas aeruginosa PA01
ccgcucgaugcccgccagcaggc

SEQ ID NO: 1502465 - RNA, 21 nt, Pseudomonas aeruginosa PA01
ccgcucgcgcacggcgaagaa

SEQ ID NO: 1502466 - RNA, 15 nt, Pseudomonas aeruginosa PA01
ccgcucgcgguuauc

SEQ ID NO: 1502467 - RNA, 21 nt, Pseudomonas aeruginosa PA01
ccgcucgcgguuauccgccgc

SEQ ID NO: 1502468 - RNA, 23 nt, Pseudomonas aeruginosa PA01
ccggcccggagaucgccgcgccg

SEQ ID NO: 1502469 - RNA, 17 nt, Pseudomonas aeruginosa PA01
ccggcccggagcgcgag

SEQ ID NO: 1502470 - RNA, 19 nt, Pseudomonas aeruginosa PA01
ccggcccggagcgcgaggc

SEQ ID NO: 1502471 - RNA, 21 nt, Pseudomonas aeruginosa PA01
ccggcccggagcgcgaggcga

SEQ ID NO: 1502472 - RNA, 13 nt, Pseudomonas aeruginosa PA01
ccggcccggccag

SEQ ID NO: 1502473 - RNA, 15 nt, Pseudomonas aeruginosa PA01
ccggcccggccaucc

SEQ ID NO: 1502474 - RNA, 14 nt, Pseudomonas aeruginosa PA01
ccggcccgcgccgc

SEQ ID NO: 1502475 - RNA, 15 nt, Pseudomonas aeruginosa PA01
ccggcccgcgccgcc

SEQ ID NO: 1502476 - RNA, 16 nt, Pseudomonas aeruginosa PA01
ccggcccgcgccgccu

SEQ ID NO: 1502477 - RNA, 14 nt, Pseudomonas aeruginosa PA01
ccggccgcagcagg

SEQ ID NO: 1502478 - RNA, 22 nt, Pseudomonas aeruginosa PA01
ccggccgaucuucagcagcagg

SEQ ID NO: 1502479 - RNA, 21 nt, Pseudomonas aeruginosa PA01
ccggccgauggaaaucggcca

SEQ ID NO: 1502480 - RNA, 17 nt, Pseudomonas aeruginosa PA01
ccggcccgugcccgucc

SEQ ID NO: 1502481 - RNA, 18 nt, Pseudomonas aeruginosa PA01
ccggcccgugcccguccu

SEQ ID NO: 1502482 - RNA, 14 nt, Pseudomonas aeruginosa PA01
ccggcccauggcga

SEQ ID NO: 1502483 - RNA, 12 nt, Pseudomonas aeruginosa PA01
ccggcccauccg

SEQ ID NO: 1502484 - RNA, 15 nt, Pseudomonas aeruginosa PA01
ccggcccauccgccg

SEQ ID NO: 1502485 - RNA, 17 nt, Pseudomonas aeruginosa PA01
ccggcccagcguucggc

SEQ ID NO: 1502486 - RNA, 23 nt, Pseudomonas aeruginosa PA01
ccggcccagcguucggcgcuggc

SEQ ID NO: 1502487 - RNA, 14 nt, Pseudomonas aeruginosa PA01
ccggcccaggccgg

SEQ ID NO: 1502488 - RNA, 13 nt, Pseudomonas aeruginosa PA01
ccggcccaggccg

SEQ ID NO: 1502489 - RNA, 14 nt, Pseudomonas aeruginosa PA01
ccggcccagcaggc

SEQ ID NO: 1502490 - RNA, 16 nt, Pseudomonas aeruginosa PA01
ccggcccagcaggccg

SEQ ID NO: 1502491 - RNA, 19 nt, Pseudomonas aeruginosa PA01
ccggcccagcaggccggcc

SEQ ID NO: 1502492 - RNA, 14 nt, Pseudomonas aeruginosa PA01
ccggcccagccgcg

SEQ ID NO: 1502493 - RNA, 18 nt, Pseudomonas aeruginosa PA01
ccggcccagccgcggcgc

SEQ ID NO: 1502494 - RNA, 16 nt, Pseudomonas aeruginosa PA01
ccggcccacgcucagu

SEQ ID NO: 1502495 - RNA, 22 nt, Pseudomonas aeruginosa PA01
ccggcccacgcucagugcgccg

SEQ ID NO: 1502496 - RNA, 22 nt, Pseudomonas aeruginosa PA01
ccggcauagccgaacuccgcca

SEQ ID NO: 1502497 - RNA, 17 nt, Pseudomonas aeruginosa PA01
ccggcauaggcgccagc

SEQ ID NO: 1502498 - RNA, 18 nt, Pseudomonas aeruginosa PA01
ccggcauaggcgccagcc

SEQ ID NO: 1502499 - RNA, 13 nt, Pseudomonas aeruginosa PA01
ccggcaucgccau

SEQ ID NO: 1502500 - RNA, 17 nt, Pseudomonas aeruginosa PA01
ccggcaucgccauggcg

SEQ ID NO: 1502501 - RNA, 12 nt, Pseudomonas aeruginosa PA01
ccggcaucgccg

SEQ ID NO: 1502502 - RNA, 21 nt, Pseudomonas aeruginosa PA01
ccggcaucgguauucaucggc

SEQ ID NO: 1502503 - RNA, 22 nt, Pseudomonas aeruginosa PA01
ccggcaucgguauucaucggcg

SEQ ID NO: 1502504 - RNA, 12 nt, Pseudomonas aeruginosa PA01
ccggccaggccg

SEQ ID NO: 1502505 - RNA, 23 nt, Pseudomonas aeruginosa PA01
ccggccagggcgaacagcgccgc

SEQ ID NO: 1502506 - RNA, 15 nt, Pseudomonas aeruginosa PA01
ccggccagggcgcgg

SEQ ID NO: 1502507 - RNA, 15 nt, Pseudomonas aeruginosa PA01
ccggccaugcaggcc

SEQ ID NO: 1502508 - RNA, 16 nt, Pseudomonas aeruginosa PA01
ccggccaugcaggcca

SEQ ID NO: 1502509 - RNA, 17 nt, Pseudomonas aeruginosa PA01
ccggccaugcaggccag

SEQ ID NO: 1502510 - RNA, 18 nt, Pseudomonas aeruginosa PA01
ccggccaugcaggccagg

SEQ ID NO: 1502511 - RNA, 14 nt, Pseudomonas aeruginosa PA01
ccggccaugccgcc

SEQ ID NO: 1502512 - RNA, 15 nt, Pseudomonas aeruginosa PA01
ccggccaugccgccg

SEQ ID NO: 1502513 - RNA, 18 nt, Pseudomonas aeruginosa PA01
ccggccaugccgccgacg

SEQ ID NO: 1502514 - RNA, 22 nt, Pseudomonas aeruginosa PA01
ccggccaugccgccgacgccgg

SEQ ID NO: 1502515 - RNA, 18 nt, Pseudomonas aeruginosa PA01
ccggccagggucgccagc

SEQ ID NO: 1502516 - RNA, 19 nt, Pseudomonas aeruginosa PA01
ccggccagggucgccagca

SEQ ID NO: 1502517 - RNA, 20 nt, Pseudomonas aeruginosa PA01
ccggccauuacgccgagcau

SEQ ID NO: 1502518 - RNA, 17 nt, Pseudomonas aeruginosa PA01
ccggccauuccuuccag

SEQ ID NO: 1502519 - RNA, 18 nt, Pseudomonas aeruginosa PA01
ccggccauuccuuccagg

SEQ ID NO: 1502520 - RNA, 23 nt, Pseudomonas aeruginosa PA01
ccggccauucgcugucgagcagg

SEQ ID NO: 1502521 - RNA, 15 nt, Pseudomonas aeruginosa PA01
ccggccauugccgcc

SEQ ID NO: 1502522 - RNA, 13 nt, Pseudomonas aeruginosa PA01
ccggccaggccgc

SEQ ID NO: 1502523 - RNA, 15 nt, Pseudomonas aeruginosa PA01
ccggccaggccgccc

SEQ ID NO: 1502524 - RNA, 12 nt, Pseudomonas aeruginosa PA01
ccggccaggcca

SEQ ID NO: 1502525 - RNA, 17 nt, Pseudomonas aeruginosa PA01
ccggccaggccacggcg

SEQ ID NO: 1502526 - RNA, 21 nt, Pseudomonas aeruginosa PA01
ccggccaggcccucagcggcg

SEQ ID NO: 1502527 - RNA, 13 nt, Pseudomonas aeruginosa PA01
ccggccaggcgau

SEQ ID NO: 1502528 - RNA, 17 nt, Pseudomonas aeruginosa PA01
ccggccaggcgcggcgc

SEQ ID NO: 1502529 - RNA, 13 nt, Pseudomonas aeruginosa PA01
ccggccaggcgcu

SEQ ID NO: 1502530 - RNA, 15 nt, Pseudomonas aeruginosa PA01
ccggccaggcgcugg

SEQ ID NO: 1502531 - RNA, 12 nt, Pseudomonas aeruginosa PA01
ccggccaggcgg

SEQ ID NO: 1502532 - RNA, 15 nt, Pseudomonas aeruginosa PA01
ccggccaggcggucc

SEQ ID NO: 1502533 - RNA, 18 nt, Pseudomonas aeruginosa PA01
ccggcgagcacggcgaac

SEQ ID NO: 1502534 - RNA, 17 nt, Pseudomonas aeruginosa PA01
ccggcgagcaacgcagg

SEQ ID NO: 1502535 - RNA, 19 nt, Pseudomonas aeruginosa PA01
ccggcgagcaacgcagguc

SEQ ID NO: 1502536 - RNA, 17 nt, Pseudomonas aeruginosa PA01
ccggcgaucauccagcc

SEQ ID NO: 1502537 - RNA, 14 nt, Pseudomonas aeruginosa PA01
ccggcgauccgcgc

SEQ ID NO: 1502538 - RNA, 20 nt, Pseudomonas aeruginosa PA01
ccggcgaggcguuccaggug

SEQ ID NO: 1502539 - RNA, 17 nt, Pseudomonas aeruginosa PA01
ccggcgagggcggcgac

SEQ ID NO: 1502540 - RNA, 20 nt, Pseudomonas aeruginosa PA01
ccggcgaggucgggguucuu

SEQ ID NO: 1502541 - RNA, 13 nt, Pseudomonas aeruginosa PA01
ccggcgagcgagc

SEQ ID NO: 1502542 - RNA, 18 nt, Pseudomonas aeruginosa PA01
ccggcgagcgagcggcag

SEQ ID NO: 1502543 - RNA, 14 nt, Pseudomonas aeruginosa PA01
ccggcgagcgccug

SEQ ID NO: 1502544 - RNA, 15 nt, Pseudomonas aeruginosa PA01
ccggcgagcgccugg

SEQ ID NO: 1502545 - RNA, 13 nt, Pseudomonas aeruginosa PA01
ccggcgacgacga

SEQ ID NO: 1502546 - RNA, 12 nt, Pseudomonas aeruginosa PA01
ccggcgaccuca

SEQ ID NO: 1502547 - RNA, 19 nt, Pseudomonas aeruginosa PA01
ccggcgaccuuguccaggc

SEQ ID NO: 1502548 - RNA, 21 nt, Pseudomonas aeruginosa PA01
ccggcgaccuuguccaggcgc

SEQ ID NO: 1502549 - RNA, 23 nt, Pseudomonas aeruginosa PA01
ccggcgaccuuguccaggcgcug

SEQ ID NO: 1502550 - RNA, 19 nt, Pseudomonas aeruginosa PA01
ccggcgacgcaggacgucg

SEQ ID NO: 1502551 - RNA, 13 nt, Pseudomonas aeruginosa PA01
ccggcgaaugccg

SEQ ID NO: 1502552 - RNA, 14 nt, Pseudomonas aeruginosa PA01
ccggcgaaugccgg

SEQ ID NO: 1502553 - RNA, 19 nt, Pseudomonas aeruginosa PA01
ccggcgaccaccgccggga

SEQ ID NO: 1502554 - RNA, 19 nt, Pseudomonas aeruginosa PA01
ccggcgaccgcgcgcaugg

SEQ ID NO: 1502555 - RNA, 13 nt, Pseudomonas aeruginosa PA01
ccggcgaccagcg

SEQ ID NO: 1502556 - RNA, 13 nt, Pseudomonas aeruginosa PA01
ccggcgaccagcu

SEQ ID NO: 1502557 - RNA, 14 nt, Pseudomonas aeruginosa PA01
ccggcgaccagcuc

SEQ ID NO: 1502558 - RNA, 22 nt, Pseudomonas aeruginosa PA01
ccggcgaccaccacgucgaugc

SEQ ID NO: 1502559 - RNA, 15 nt, Pseudomonas aeruginosa PA01
ccggccgucgcgcac

SEQ ID NO: 1502560 - RNA, 14 nt, Pseudomonas aeruginosa PA01
ccggccggggcgcg

SEQ ID NO: 1502561 - RNA, 22 nt, Pseudomonas aeruginosa PA01
ccggccggggcgcgcccgccag

SEQ ID NO: 1502562 - RNA, 20 nt, Pseudomonas aeruginosa PA01
ccggccgccuuccucggccg

SEQ ID NO: 1502563 - RNA, 12 nt, Pseudomonas aeruginosa PA01
ccggccggggcc

SEQ ID NO: 1502564 - RNA, 12 nt, Pseudomonas aeruginosa PA01
ccggccggggcg

SEQ ID NO: 1502565 - RNA, 16 nt, Pseudomonas aeruginosa PA01
ccggccgcccgagccg

SEQ ID NO: 1502566 - RNA, 16 nt, Pseudomonas aeruginosa PA01
ccggccgccagcaggu

SEQ ID NO: 1502567 - RNA, 14 nt, Pseudomonas aeruginosa PA01
ccggccgcaggcag

SEQ ID NO: 1502568 - RNA, 17 nt, Pseudomonas aeruginosa PA01
ccggccuucaccgcgcc

SEQ ID NO: 1502569 - RNA, 22 nt, Pseudomonas aeruginosa PA01
ccggccuucaccgcgccgcgcu

SEQ ID NO: 1502570 - RNA, 16 nt, Pseudomonas aeruginosa PA01
ccggccuggcuggccu

SEQ ID NO: 1502571 - RNA, 17 nt, Pseudomonas aeruginosa PA01
ccggccugguaggccuc

SEQ ID NO: 1502572 - RNA, 23 nt, Pseudomonas aeruginosa PA01
ccggccugguaggccucgaugau

SEQ ID NO: 1502573 - RNA, 12 nt, Pseudomonas aeruginosa PA01
ccggccugguga

SEQ ID NO: 1502574 - RNA, 17 nt, Pseudomonas aeruginosa PA01
ccggccugucacgccgg

SEQ ID NO: 1502575 - RNA, 13 nt, Pseudomonas aeruginosa PA01
ccggccuggcgcc

SEQ ID NO: 1502576 - RNA, 14 nt, Pseudomonas aeruginosa PA01
ccggccuggcgccg

SEQ ID NO: 1502577 - RNA, 18 nt, Pseudomonas aeruginosa PA01
ccggccuggcgccggggu

SEQ ID NO: 1502578 - RNA, 17 nt, Pseudomonas aeruginosa PA01
ccggccuggcgucccgg

SEQ ID NO: 1502579 - RNA, 21 nt, Pseudomonas aeruginosa PA01
ccggccugcgcgcaccaggcc

SEQ ID NO: 1502580 - RNA, 22 nt, Pseudomonas aeruginosa PA01
ccggcaccuugcgaaaagcccg

SEQ ID NO: 1502581 - RNA, 15 nt, Pseudomonas aeruginosa PA01
ccggcaccgggguga

SEQ ID NO: 1502582 - RNA, 15 nt, Pseudomonas aeruginosa PA01
ccggcaccgaggaga

SEQ ID NO: 1502583 - RNA, 18 nt, Pseudomonas aeruginosa PA01
ccggcacccugaccgcga

SEQ ID NO: 1502584 - RNA, 20 nt, Pseudomonas aeruginosa PA01
ccggcacccugaccgcgagc

SEQ ID NO: 1502585 - RNA, 15 nt, Pseudomonas aeruginosa PA01
ccggcacgcuccagg

SEQ ID NO: 1502586 - RNA, 17 nt, Pseudomonas aeruginosa PA01
ccggcacgcuccagggc

SEQ ID NO: 1502587 - RNA, 17 nt, Pseudomonas aeruginosa PA01
ccggcacgcugccgccg

SEQ ID NO: 1502588 - RNA, 15 nt, Pseudomonas aeruginosa PA01
ccggcagaugccggg

SEQ ID NO: 1502589 - RNA, 14 nt, Pseudomonas aeruginosa PA01
ccggcacucgccgg

SEQ ID NO: 1502590 - RNA, 17 nt, Pseudomonas aeruginosa PA01
ccggcacucgccgggcg

SEQ ID NO: 1502591 - RNA, 22 nt, Pseudomonas aeruginosa PA01
ccggcagcgcguagaccaccuc

SEQ ID NO: 1502592 - RNA, 14 nt, Pseudomonas aeruginosa PA01
ccggcagccagccg

SEQ ID NO: 1502593 - RNA, 18 nt, Pseudomonas aeruginosa PA01
ccggcagccagccgccga

SEQ ID NO: 1502594 - RNA, 16 nt, Pseudomonas aeruginosa PA01
ccggcagcgccgccag

SEQ ID NO: 1502595 - RNA, 20 nt, Pseudomonas aeruginosa PA01
ccggcagcgccgccagcagg

SEQ ID NO: 1502596 - RNA, 16 nt, Pseudomonas aeruginosa PA01
ccggcagcgccgggca

SEQ ID NO: 1502597 - RNA, 20 nt, Pseudomonas aeruginosa PA01
ccggcagcgccgggcauucg

SEQ ID NO: 1502598 - RNA, 16 nt, Pseudomonas aeruginosa PA01
ccggcagcacggcgau

SEQ ID NO: 1502599 - RNA, 18 nt, Pseudomonas aeruginosa PA01
ccggcagcacccgcacca

SEQ ID NO: 1502600 - RNA, 14 nt, Pseudomonas aeruginosa PA01
ccggcagcagcgcc

SEQ ID NO: 1502601 - RNA, 17 nt, Pseudomonas aeruginosa PA01
ccggcagcagcgccagg

SEQ ID NO: 1502602 - RNA, 15 nt, Pseudomonas aeruginosa PA01
ccggcagcaucucgg

SEQ ID NO: 1502603 - RNA, 14 nt, Pseudomonas aeruginosa PA01
ccggcagcagcgga

SEQ ID NO: 1502604 - RNA, 23 nt, Pseudomonas aeruginosa PA01
ccggcagcagcggaucggcggug

SEQ ID NO: 1502605 - RNA, 14 nt, Pseudomonas aeruginosa PA01
ccggcagccaccag

SEQ ID NO: 1502606 - RNA, 16 nt, Pseudomonas aeruginosa PA01
ccggcagccaccaggu

SEQ ID NO: 1502607 - RNA, 18 nt, Pseudomonas aeruginosa PA01
ccggcagguagaccucga

SEQ ID NO: 1502608 - RNA, 20 nt, Pseudomonas aeruginosa PA01
ccggcagguagaccucgaug

SEQ ID NO: 1502609 - RNA, 18 nt, Pseudomonas aeruginosa PA01
ccggcaggucgaggacga

SEQ ID NO: 1502610 - RNA, 13 nt, Pseudomonas aeruginosa PA01
ccggcaggcgcuc

SEQ ID NO: 1502611 - RNA, 18 nt, Pseudomonas aeruginosa PA01
ccggcagggucacgccgg

SEQ ID NO: 1502612 - RNA, 21 nt, Pseudomonas aeruginosa PA01
ccggcagggucacgccgguga

SEQ ID NO: 1502613 - RNA, 14 nt, Pseudomonas aeruginosa PA01
ccggcagggccucg

SEQ ID NO: 1502614 - RNA, 19 nt, Pseudomonas aeruginosa PA01
ccggcagggccucgggcgg

SEQ ID NO: 1502615 - RNA, 22 nt, Pseudomonas aeruginosa PA01
ccggcagggcgauccgcccgca

SEQ ID NO: 1502616 - RNA, 18 nt, Pseudomonas aeruginosa PA01
ccggcagucccugccagg

SEQ ID NO: 1502617 - RNA, 16 nt, Pseudomonas aeruginosa PA01
ccggcagguggccgga

SEQ ID NO: 1502618 - RNA, 20 nt, Pseudomonas aeruginosa PA01
ccggcaggccuucgacgguu

SEQ ID NO: 1502619 - RNA, 21 nt, Pseudomonas aeruginosa PA01
ccggcaggccuucggcgccgg

SEQ ID NO: 1502620 - RNA, 14 nt, Pseudomonas aeruginosa PA01
ccggcaggcgcacg

SEQ ID NO: 1502621 - RNA, 16 nt, Pseudomonas aeruginosa PA01
ccggcaggcgcacgcg

SEQ ID NO: 1502622 - RNA, 19 nt, Pseudomonas aeruginosa PA01
ccggcaggcgcacgcgcag

SEQ ID NO: 1502623 - RNA, 22 nt, Pseudomonas aeruginosa PA01
ccggcaggcucagcgcaugcgg

SEQ ID NO: 1502624 - RNA, 14 nt, Pseudomonas aeruginosa PA01
ccggcaggcugugc

SEQ ID NO: 1502625 - RNA, 20 nt, Pseudomonas aeruginosa PA01
ccggcaggcugugccauucc

SEQ ID NO: 1502626 - RNA, 17 nt, Pseudomonas aeruginosa PA01
ccggcaggccgauggcc

SEQ ID NO: 1502627 - RNA, 19 nt, Pseudomonas aeruginosa PA01
ccggcaggccgauggcccc

SEQ ID NO: 1502628 - RNA, 18 nt, Pseudomonas aeruginosa PA01
ccggcaggcagugccggg

SEQ ID NO: 1502629 - RNA, 19 nt, Pseudomonas aeruginosa PA01
ccggcaggaggaucgcggc

SEQ ID NO: 1502630 - RNA, 16 nt, Pseudomonas aeruginosa PA01
ccggcaggaucggcgc

SEQ ID NO: 1502631 - RNA, 21 nt, Pseudomonas aeruginosa PA01
ccggcaggaacgcccgcggca

SEQ ID NO: 1502632 - RNA, 14 nt, Pseudomonas aeruginosa PA01
ccggcagcucggcc

SEQ ID NO: 1502633 - RNA, 15 nt, Pseudomonas aeruginosa PA01
ccggcagcucggccg

SEQ ID NO: 1502634 - RNA, 14 nt, Pseudomonas aeruginosa PA01
ccggcaagcgccgg

SEQ ID NO: 1502635 - RNA, 21 nt, Pseudomonas aeruginosa PA01
ccggcaagggccugcucagcg

SEQ ID NO: 1502636 - RNA, 20 nt, Pseudomonas aeruginosa PA01
ccggcaacgaacuucagggc

SEQ ID NO: 1502637 - RNA, 22 nt, Pseudomonas aeruginosa PA01
ccggcaacaguucugccgcaga

SEQ ID NO: 1502638 - RNA, 14 nt, Pseudomonas aeruginosa PA01
ccggcaaacgccgc

SEQ ID NO: 1502639 - RNA, 15 nt, Pseudomonas aeruginosa PA01
ccggcaaacgccgcc

SEQ ID NO: 1502640 - RNA, 13 nt, Pseudomonas aeruginosa PA01
ccggcaaaugccg

SEQ ID NO: 1502641 - RNA, 14 nt, Pseudomonas aeruginosa PA01
ccggcaaaugccgg

SEQ ID NO: 1502642 - RNA, 15 nt, Pseudomonas aeruginosa PA01
ccggcaaaugccggg

SEQ ID NO: 1502643 - RNA, 14 nt, Pseudomonas aeruginosa PA01
ccggcaauagccgg

SEQ ID NO: 1502644 - RNA, 16 nt, Pseudomonas aeruginosa PA01
ccggcaaucaggcgcg

SEQ ID NO: 1502645 - RNA, 13 nt, Pseudomonas aeruginosa PA01
ccggcaccaccac

SEQ ID NO: 1502646 - RNA, 18 nt, Pseudomonas aeruginosa PA01
ccggcaccaccagcgcgc

SEQ ID NO: 1502647 - RNA, 19 nt, Pseudomonas aeruginosa PA01
ccggcaccaccagcgcgcg

SEQ ID NO: 1502648 - RNA, 14 nt, Pseudomonas aeruginosa PA01
ccggcaccaccggu

SEQ ID NO: 1502649 - RNA, 13 nt, Pseudomonas aeruginosa PA01
ccggcaccaggcc

SEQ ID NO: 1502650 - RNA, 14 nt, Pseudomonas aeruginosa PA01
ccggcaccaggccg

SEQ ID NO: 1502651 - RNA, 13 nt, Pseudomonas aeruginosa PA01
ccggauggccgcc

SEQ ID NO: 1502652 - RNA, 14 nt, Pseudomonas aeruginosa PA01
ccggauggccgccg

SEQ ID NO: 1502653 - RNA, 13 nt, Pseudomonas aeruginosa PA01
ccggaugccaccg

SEQ ID NO: 1502654 - RNA, 15 nt, Pseudomonas aeruginosa PA01
ccggaugccaccgcu

SEQ ID NO: 1502655 - RNA, 19 nt, Pseudomonas aeruginosa PA01
ccggauugguggucaccag

SEQ ID NO: 1502656 - RNA, 17 nt, Pseudomonas aeruginosa PA01
ccggauucgcgcagcag

SEQ ID NO: 1502657 - RNA, 19 nt, Pseudomonas aeruginosa PA01
ccggauucgcgcagcaggc

SEQ ID NO: 1502658 - RNA, 19 nt, Pseudomonas aeruginosa PA01
ccggauggcugacccgcug

SEQ ID NO: 1502659 - RNA, 23 nt, Pseudomonas aeruginosa PA01
ccggauggcugacccgcugcugg

SEQ ID NO: 1502660 - RNA, 14 nt, Pseudomonas aeruginosa PA01
ccggaugggcgagc

SEQ ID NO: 1502661 - RNA, 16 nt, Pseudomonas aeruginosa PA01
ccgccguugccagcau

SEQ ID NO: 1502662 - RNA, 14 nt, Pseudomonas aeruginosa PA01
ccgccgucauggcg

SEQ ID NO: 1502663 - RNA, 15 nt, Pseudomonas aeruginosa PA01
ccgccgucauggcgg

SEQ ID NO: 1502664 - RNA, 13 nt, Pseudomonas aeruginosa PA01
ccgccguugagga

SEQ ID NO: 1502665 - RNA, 16 nt, Pseudomonas aeruginosa PA01
ccgccuggaaggcgcu

SEQ ID NO: 1502666 - RNA, 19 nt, Pseudomonas aeruginosa PA01
ccgccuggaaggcgcuggg

SEQ ID NO: 1502667 - RNA, 21 nt, Pseudomonas aeruginosa PA01
ccgccuggaaggcgcugggcg

SEQ ID NO: 1502668 - RNA, 22 nt, Pseudomonas aeruginosa PA01
ccgccugcgucagcgaggcggg

SEQ ID NO: 1502669 - RNA, 18 nt, Pseudomonas aeruginosa PA01
ccgccugcuggcugccca

SEQ ID NO: 1502670 - RNA, 19 nt, Pseudomonas aeruginosa PA01
ccgccugcggauagccaac

SEQ ID NO: 1502671 - RNA, 23 nt, Pseudomonas aeruginosa PA01
ccgccugcggauagccaaccaga

SEQ ID NO: 1502672 - RNA, 15 nt, Pseudomonas aeruginosa PA01
ccgccugcggcuugc

SEQ ID NO: 1502673 - RNA, 14 nt, Pseudomonas aeruginosa PA01
ccgccugcucgcgg

SEQ ID NO: 1502674 - RNA, 16 nt, Pseudomonas aeruginosa PA01
ccgccugcucggccug

SEQ ID NO: 1502675 - RNA, 17 nt, Pseudomonas aeruginosa PA01
ccgccugcucggccugc

SEQ ID NO: 1502676 - RNA, 22 nt, Pseudomonas aeruginosa PA01
ccgccuauccacgacgucggcg

SEQ ID NO: 1502677 - RNA, 23 nt, Pseudomonas aeruginosa PA01
ccgccuauccacgacgucggcgg

SEQ ID NO: 1502678 - RNA, 21 nt, Pseudomonas aeruginosa PA01
ccgccuauccgugacgucggc

SEQ ID NO: 1502679 - RNA, 22 nt, Pseudomonas aeruginosa PA01
ccgccuauccgugacgucggcg

SEQ ID NO: 1502680 - RNA, 20 nt, Pseudomonas aeruginosa PA01
ccgccuauggcggauagagc

SEQ ID NO: 1502681 - RNA, 15 nt, Pseudomonas aeruginosa PA01
ccgccuaccggggcg

SEQ ID NO: 1502682 - RNA, 19 nt, Pseudomonas aeruginosa PA01
ccgccucaccccacgggcg

SEQ ID NO: 1502683 - RNA, 20 nt, Pseudomonas aeruginosa PA01
ccgccuguccaccgguggcg

SEQ ID NO: 1502684 - RNA, 14 nt, Pseudomonas aeruginosa PA01
ccgccuuccagcuu

SEQ ID NO: 1502685 - RNA, 17 nt, Pseudomonas aeruginosa PA01
ccgccuuccucggccgc

SEQ ID NO: 1502686 - RNA, 19 nt, Pseudomonas aeruginosa PA01
ccgccuuccucggccgcca

SEQ ID NO: 1502687 - RNA, 20 nt, Pseudomonas aeruginosa PA01
ccgccuuccucggccgccag

SEQ ID NO: 1502688 - RNA, 22 nt, Pseudomonas aeruginosa PA01
ccgccuuccucggccgccaggc

SEQ ID NO: 1502689 - RNA, 23 nt, Pseudomonas aeruginosa PA01
ccgccuucgcguucgcuccgggc

SEQ ID NO: 1502690 - RNA, 21 nt, Pseudomonas aeruginosa PA01
ccgccuucuuuucuuccgccu

SEQ ID NO: 1502691 - RNA, 21 nt, Pseudomonas aeruginosa PA01
ccgccuugaccugcugggcca

SEQ ID NO: 1502692 - RNA, 20 nt, Pseudomonas aeruginosa PA01
ccgccugggcggucggcuca

SEQ ID NO: 1502693 - RNA, 16 nt, Pseudomonas aeruginosa PA01
ccgccuggccggccag

SEQ ID NO: 1502694 - RNA, 22 nt, Pseudomonas aeruginosa PA01
ccgccuggccggccagccaggc

SEQ ID NO: 1502695 - RNA, 14 nt, Pseudomonas aeruginosa PA01
ccgccuggcgcaag

SEQ ID NO: 1502696 - RNA, 22 nt, Pseudomonas aeruginosa PA01
ccgccuggucgaucucgucgaa

SEQ ID NO: 1502697 - RNA, 20 nt, Pseudomonas aeruginosa PA01
ccgccuggguggcgacgaag

SEQ ID NO: 1502698 - RNA, 19 nt, Pseudomonas aeruginosa PA01
ccgccuggcggauaucgcg

SEQ ID NO: 1502699 - RNA, 14 nt, Pseudomonas aeruginosa PA01
ccgccuuguucgcc

SEQ ID NO: 1502700 - RNA, 15 nt, Pseudomonas aeruginosa PA01
ccgccuuguucgcca

SEQ ID NO: 1502701 - RNA, 19 nt, Pseudomonas aeruginosa PA01
ccgccuuguucgccagcac

SEQ ID NO: 1502702 - RNA, 21 nt, Pseudomonas aeruginosa PA01
ccgccuuguucgccagcaccu

SEQ ID NO: 1502703 - RNA, 18 nt, Pseudomonas aeruginosa PA01
ccgccuugcguaccagcg

SEQ ID NO: 1502704 - RNA, 21 nt, Pseudomonas aeruginosa PA01
ccgccuuggcaucgccgccca

SEQ ID NO: 1502705 - RNA, 13 nt, Pseudomonas aeruginosa PA01
ccgccgggccgcc

SEQ ID NO: 1502706 - RNA, 15 nt, Pseudomonas aeruginosa PA01
ccgccgggcgcgcgc

SEQ ID NO: 1502707 - RNA, 16 nt, Pseudomonas aeruginosa PA01
ccgccgggcaucaugc

SEQ ID NO: 1502708 - RNA, 14 nt, Pseudomonas aeruginosa PA01
ccgccgggcgcccg

SEQ ID NO: 1502709 - RNA, 15 nt, Pseudomonas aeruginosa PA01
ccgccgggcguaacg

SEQ ID NO: 1502710 - RNA, 18 nt, Pseudomonas aeruginosa PA01
ccgccggguacagcgcca

SEQ ID NO: 1502711 - RNA, 18 nt, Pseudomonas aeruginosa PA01
ccgccggguccaccgcgg

SEQ ID NO: 1502712 - RNA, 19 nt, Pseudomonas aeruginosa PA01
ccgccgguagccguucgac

SEQ ID NO: 1502713 - RNA, 21 nt, Pseudomonas aeruginosa PA01
ccgccgguagccguucgacgc

SEQ ID NO: 1502714 - RNA, 15 nt, Pseudomonas aeruginosa PA01
ccgccggucaaccgc

SEQ ID NO: 1502715 - RNA, 13 nt, Pseudomonas aeruginosa PA01
ccgccggucacca

SEQ ID NO: 1502716 - RNA, 12 nt, Pseudomonas aeruginosa PA01
ccgccguagagu

SEQ ID NO: 1502717 - RNA, 23 nt, Pseudomonas aeruginosa PA01
ccgccgguucgcaggccaggcgc

SEQ ID NO: 1502718 - RNA, 23 nt, Pseudomonas aeruginosa PA01
ccgccguccuccagcaaggcguc

SEQ ID NO: 1502719 - RNA, 16 nt, Pseudomonas aeruginosa PA01
ccgccgcgagcgccgc

SEQ ID NO: 1502720 - RNA, 18 nt, Pseudomonas aeruginosa PA01
ccgccgcgagcgccgccg

SEQ ID NO: 1502721 - RNA, 16 nt, Pseudomonas aeruginosa PA01
ccgccgcgcagcacca

SEQ ID NO: 1502722 - RNA, 13 nt, Pseudomonas aeruginosa PA01
ccgccgcgccgcu

SEQ ID NO: 1502723 - RNA, 20 nt, Pseudomonas aeruginosa PA01
ccgccgcgccgcucaggcgu

SEQ ID NO: 1502724 - RNA, 16 nt, Pseudomonas aeruginosa PA01
ccgccgcgcccggcgc

SEQ ID NO: 1502725 - RNA, 17 nt, Pseudomonas aeruginosa PA01
ccgccgcgcccggcgcc

SEQ ID NO: 1502726 - RNA, 18 nt, Pseudomonas aeruginosa PA01
ccgccgcgccggcgaucg

SEQ ID NO: 1502727 - RNA, 21 nt, Pseudomonas aeruginosa PA01
ccgccgcgccucgucgcgcca

SEQ ID NO: 1502728 - RNA, 15 nt, Pseudomonas aeruginosa PA01
ccgccgcgcgcgcgg

SEQ ID NO: 1502729 - RNA, 16 nt, Pseudomonas aeruginosa PA01
ccgccgcgcgcgcggu

SEQ ID NO: 1502730 - RNA, 16 nt, Pseudomonas aeruginosa PA01
ccgccgcgcugcaggc

SEQ ID NO: 1502731 - RNA, 18 nt, Pseudomonas aeruginosa PA01
ccgccgcgcugcaggcgg

SEQ ID NO: 1502732 - RNA, 16 nt, Pseudomonas aeruginosa PA01
ccgccggcgccgccuc

SEQ ID NO: 1502733 - RNA, 16 nt, Pseudomonas aeruginosa PA01
ccgccggcgccgccgg

SEQ ID NO: 1502734 - RNA, 23 nt, Pseudomonas aeruginosa PA01
ccgccggcgcgcccaggcccagc

SEQ ID NO: 1502735 - RNA, 21 nt, Pseudomonas aeruginosa PA01
ccgccggcgcgucccugggcg

SEQ ID NO: 1502736 - RNA, 15 nt, Pseudomonas aeruginosa PA01
ccgccggcggccagg

SEQ ID NO: 1502737 - RNA, 19 nt, Pseudomonas aeruginosa PA01
ccgccgggaaucuggccga

SEQ ID NO: 1502738 - RNA, 16 nt, Pseudomonas aeruginosa PA01
ccgccgggagcggccg

SEQ ID NO: 1502739 - RNA, 16 nt, Pseudomonas aeruginosa PA01
ccgccggcgugccgac

SEQ ID NO: 1502740 - RNA, 19 nt, Pseudomonas aeruginosa PA01
ccgccggcguuauccgccg

SEQ ID NO: 1502741 - RNA, 17 nt, Pseudomonas aeruginosa PA01
ccgccggcguugcgcgc

SEQ ID NO: 1502742 - RNA, 12 nt, Pseudomonas aeruginosa PA01
ccgcgaggccgg

SEQ ID NO: 1502743 - RNA, 15 nt, Pseudomonas aeruginosa PA01
ccgcgaggccggccc

SEQ ID NO: 1502744 - RNA, 14 nt, Pseudomonas aeruginosa PA01
ccgcgaguucgccg

SEQ ID NO: 1502745 - RNA, 16 nt, Pseudomonas aeruginosa PA01
ccgcgaguucgccggc

SEQ ID NO: 1502746 - RNA, 18 nt, Pseudomonas aeruginosa PA01
ccgcgaguucgccggcca

SEQ ID NO: 1502747 - RNA, 19 nt, Pseudomonas aeruginosa PA01
ccgcgaguucgccggccag

SEQ ID NO: 1502748 - RNA, 20 nt, Pseudomonas aeruginosa PA01
ccgcgaguucgccggccagg

SEQ ID NO: 1502749 - RNA, 21 nt, Pseudomonas aeruginosa PA01
ccgcgaguucgccggccaggu

SEQ ID NO: 1502750 - RNA, 14 nt, Pseudomonas aeruginosa PA01
ccgcgauucgccgg

SEQ ID NO: 1502751 - RNA, 16 nt, Pseudomonas aeruginosa PA01
ccgcgagguccggcuc

SEQ ID NO: 1502752 - RNA, 14 nt, Pseudomonas aeruginosa PA01
ccgcgagcgcggcc

SEQ ID NO: 1502753 - RNA, 16 nt, Pseudomonas aeruginosa PA01
ccgcgagcgcggccgg

SEQ ID NO: 1502754 - RNA, 19 nt, Pseudomonas aeruginosa PA01
ccgcgagcgcggccggcca

SEQ ID NO: 1502755 - RNA, 14 nt, Pseudomonas aeruginosa PA01
ccgcgaggaucagc

SEQ ID NO: 1502756 - RNA, 18 nt, Pseudomonas aeruginosa PA01
ccgcgaggaucagccacg

SEQ ID NO: 1502757 - RNA, 13 nt, Pseudomonas aeruginosa PA01
ccgcgaagcccag

SEQ ID NO: 1502758 - RNA, 16 nt, Pseudomonas aeruginosa PA01
ccgcgaagcccagcgc

SEQ ID NO: 1502759 - RNA, 18 nt, Pseudomonas aeruginosa PA01
ccgcgaagcccagcgccg

SEQ ID NO: 1502760 - RNA, 20 nt, Pseudomonas aeruginosa PA01
ccgcgaagcgguuagccggc

SEQ ID NO: 1502761 - RNA, 21 nt, Pseudomonas aeruginosa PA01
ccgcgaagcgguuagccggcg

SEQ ID NO: 1502762 - RNA, 22 nt, Pseudomonas aeruginosa PA01
ccgcgaagcgguuagccggcga

SEQ ID NO: 1502763 - RNA, 12 nt, Pseudomonas aeruginosa PA01
ccgcgagcgccg

SEQ ID NO: 1502764 - RNA, 16 nt, Pseudomonas aeruginosa PA01
ccgcgagcgccgccgg

SEQ ID NO: 1502765 - RNA, 15 nt, Pseudomonas aeruginosa PA01
ccgcgagcgccgccu

SEQ ID NO: 1502766 - RNA, 17 nt, Pseudomonas aeruginosa PA01
ccgcgagcgccgccuug

SEQ ID NO: 1502767 - RNA, 23 nt, Pseudomonas aeruginosa PA01
ccgcgagcgccgccuugagcggc

SEQ ID NO: 1502768 - RNA, 13 nt, Pseudomonas aeruginosa PA01
ccgcgaagccugc

SEQ ID NO: 1502769 - RNA, 22 nt, Pseudomonas aeruginosa PA01
ccgcgcaccugggcguuggcca

SEQ ID NO: 1502770 - RNA, 23 nt, Pseudomonas aeruginosa PA01
ccgcgcaccuugcuggacaaggu

SEQ ID NO: 1502771 - RNA, 17 nt, Pseudomonas aeruginosa PA01
ccgcgcacggaucgcgc

SEQ ID NO: 1502772 - RNA, 23 nt, Pseudomonas aeruginosa PA01
ccgcgcacggaucgcgcugggcg

SEQ ID NO: 1502773 - RNA, 14 nt, Pseudomonas aeruginosa PA01
ccgcgauguccccg

SEQ ID NO: 1502774 - RNA, 16 nt, Pseudomonas aeruginosa PA01
ccgcgauguccccggc

SEQ ID NO: 1502775 - RNA, 19 nt, Pseudomonas aeruginosa PA01
ccgcgauguccccggccag

SEQ ID NO: 1502776 - RNA, 17 nt, Pseudomonas aeruginosa PA01
ccgcgcaaccguuccag

SEQ ID NO: 1502777 - RNA, 20 nt, Pseudomonas aeruginosa PA01
ccgcgcaaccguuccagcgc

SEQ ID NO: 1502778 - RNA, 23 nt, Pseudomonas aeruginosa PA01
ccgcgcaaggcagcguccgaacg

SEQ ID NO: 1502779 - RNA, 14 nt, Pseudomonas aeruginosa PA01
ccgcgcaaaccggc

SEQ ID NO: 1502780 - RNA, 19 nt, Pseudomonas aeruginosa PA01
ccgcgcacaaaaaagcccg

SEQ ID NO: 1502781 - RNA, 10 nt, Pseudomonas aeruginosa PA01
ccgcgcacca

SEQ ID NO: 1502782 - RNA, 13 nt, Pseudomonas aeruginosa PA01
ccgcgccaggcgc

SEQ ID NO: 1502783 - RNA, 23 nt, Pseudomonas aeruginosa PA01
ccgcgccaggcgcaguaggccug

SEQ ID NO: 1502784 - RNA, 12 nt, Pseudomonas aeruginosa PA01
ccgcgccagcgc

SEQ ID NO: 1502785 - RNA, 13 nt, Pseudomonas aeruginosa PA01
ccgcgccagcgcc

SEQ ID NO: 1502786 - RNA, 14 nt, Pseudomonas aeruginosa PA01
ccgcgccagcgccg

SEQ ID NO: 1502787 - RNA, 17 nt, Pseudomonas aeruginosa PA01
ccgcgccacgcgcaucg

SEQ ID NO: 1502788 - RNA, 17 nt, Pseudomonas aeruginosa PA01
ccgcgccacgcucuccg

SEQ ID NO: 1502789 - RNA, 16 nt, Pseudomonas aeruginosa PA01
ccgcgccacgggcaga

SEQ ID NO: 1502790 - RNA, 13 nt, Pseudomonas aeruginosa PA01
ccgcgccagcagg

SEQ ID NO: 1502791 - RNA, 15 nt, Pseudomonas aeruginosa PA01
ccgcgccagcaggcg

SEQ ID NO: 1502792 - RNA, 13 nt, Pseudomonas aeruginosa PA01
ccgcgccagccac

SEQ ID NO: 1502793 - RNA, 21 nt, Pseudomonas aeruginosa PA01
ccgcgcagaugaucgccaccg

SEQ ID NO: 1502794 - RNA, 14 nt, Pseudomonas aeruginosa PA01
ccgcgcagcaacgg

SEQ ID NO: 1502795 - RNA, 15 nt, Pseudomonas aeruginosa PA01
ccgcgcagaccauca

SEQ ID NO: 1502796 - RNA, 21 nt, Pseudomonas aeruginosa PA01
ccgcgccaacuggcgcaacug

SEQ ID NO: 1502797 - RNA, 15 nt, Pseudomonas aeruginosa PA01
ccgcgcagcgcggcg

SEQ ID NO: 1502798 - RNA, 17 nt, Pseudomonas aeruginosa PA01
ccgcgccuccaggcgcg

SEQ ID NO: 1502799 - RNA, 18 nt, Pseudomonas aeruginosa PA01
ccgcgccuccaggcgcgc

SEQ ID NO: 1502800 - RNA, 22 nt, Pseudomonas aeruginosa PA01
ccgcgccuccaggcgcgccugg

SEQ ID NO: 1502801 - RNA, 20 nt, Pseudomonas aeruginosa PA01
ccgcgccugcugcgggucgc

SEQ ID NO: 1502802 - RNA, 12 nt, Pseudomonas aeruginosa PA01
ccgcgccucgcg

SEQ ID NO: 1502803 - RNA, 15 nt, Pseudomonas aeruginosa PA01
ccgcgccucgcgcaa

SEQ ID NO: 1502804 - RNA, 14 nt, Pseudomonas aeruginosa PA01
ccgcgccuucgagc

SEQ ID NO: 1502805 - RNA, 18 nt, Pseudomonas aeruginosa PA01
ccgcgccugggccgcgag

SEQ ID NO: 1502806 - RNA, 19 nt, Pseudomonas aeruginosa PA01
ccgcgccugggccgcgagg

SEQ ID NO: 1502807 - RNA, 17 nt, Pseudomonas aeruginosa PA01
ccgcgcgaccgcggcgc

SEQ ID NO: 1502808 - RNA, 18 nt, Pseudomonas aeruginosa PA01
ccgcgccuucagcgccag

SEQ ID NO: 1502809 - RNA, 19 nt, Pseudomonas aeruginosa PA01
ccgcgccuucagcgccagc

SEQ ID NO: 1502810 - RNA, 12 nt, Pseudomonas aeruginosa PA01
ccgcgcgcgccu

SEQ ID NO: 1502811 - RNA, 13 nt, Pseudomonas aeruginosa PA01
ccgcgcgcgccug

SEQ ID NO: 1502812 - RNA, 13 nt, Pseudomonas aeruginosa PA01
ccgcgcgaucgag

SEQ ID NO: 1502813 - RNA, 14 nt, Pseudomonas aeruginosa PA01
ccgcgcgcgcaagg

SEQ ID NO: 1502814 - RNA, 23 nt, Pseudomonas aeruginosa PA01
ccgcgccugcaggucgaggcgcu

SEQ ID NO: 1502815 - RNA, 22 nt, Pseudomonas aeruginosa PA01
ccgcgcgacggaacaagccgcc

SEQ ID NO: 1502816 - RNA, 20 nt, Pseudomonas aeruginosa PA01
ccgcgcgauaaaaagccccg

SEQ ID NO: 1502817 - RNA, 16 nt, Pseudomonas aeruginosa PA01
ccgcgccgagccggcu

SEQ ID NO: 1502818 - RNA, 22 nt, Pseudomonas aeruginosa PA01
ccgcgccgagccggcugccgaa

SEQ ID NO: 1502819 - RNA, 18 nt, Pseudomonas aeruginosa PA01
ccgcgccgaccagccgca

SEQ ID NO: 1502820 - RNA, 13 nt, Pseudomonas aeruginosa PA01
ccgcgccgaugcc

SEQ ID NO: 1502821 - RNA, 14 nt, Pseudomonas aeruginosa PA01
ccgcgccgaagguc

SEQ ID NO: 1502822 - RNA, 13 nt, Pseudomonas aeruginosa PA01
ccgcgccaugccg

SEQ ID NO: 1502823 - RNA, 16 nt, Pseudomonas aeruginosa PA01
ccgcgccaugccggcg

SEQ ID NO: 1502824 - RNA, 19 nt, Pseudomonas aeruginosa PA01
ccgcgccaugccggcgccg

SEQ ID NO: 1502825 - RNA, 17 nt, Pseudomonas aeruginosa PA01
ccgcgcgcugugcacgg

SEQ ID NO: 1502826 - RNA, 21 nt, Pseudomonas aeruginosa PA01
ccgcgcggcacagcguggcca

SEQ ID NO: 1502827 - RNA, 18 nt, Pseudomonas aeruginosa PA01
ccgcgcggcacaggcggc

SEQ ID NO: 1502828 - RNA, 18 nt, Pseudomonas aeruginosa PA01
ccgcgcggcauagcgcag

SEQ ID NO: 1502829 - RNA, 22 nt, Pseudomonas aeruginosa PA01
ccgcgcggcauagcgcagccgc

SEQ ID NO: 1502830 - RNA, 16 nt, Pseudomonas aeruginosa PA01
ccgcgcggucgagcuc

SEQ ID NO: 1502831 - RNA, 21 nt, Pseudomonas aeruginosa PA01
ccgcgcgcuuuuccggcgccg

SEQ ID NO: 1502832 - RNA, 11 nt, Pseudomonas aeruginosa PA01
ccgcgcgcugg

SEQ ID NO: 1502833 - RNA, 22 nt, Pseudomonas aeruginosa PA01
ccgcgcgcgcggucgagcagcg

SEQ ID NO: 1502834 - RNA, 13 nt, Pseudomonas aeruginosa PA01
ccgcgcuccgcug

SEQ ID NO: 1502835 - RNA, 15 nt, Pseudomonas aeruginosa PA01
ccgcgcucggccagu

SEQ ID NO: 1502836 - RNA, 14 nt, Pseudomonas aeruginosa PA01
ccgcgcucgcggaa

SEQ ID NO: 1502837 - RNA, 17 nt, Pseudomonas aeruginosa PA01
ccgcgcucggccgccug

SEQ ID NO: 1502838 - RNA, 13 nt, Pseudomonas aeruginosa PA01
ccgcgcucggcgg

SEQ ID NO: 1502839 - RNA, 21 nt, Pseudomonas aeruginosa PA01
ccgcgcucgguccagaucgcc

SEQ ID NO: 1502840 - RNA, 15 nt, Pseudomonas aeruginosa PA01
ccgcgcugaccuggu

SEQ ID NO: 1502841 - RNA, 12 nt, Pseudomonas aeruginosa PA01
ccgcgcguggcu

SEQ ID NO: 1502842 - RNA, 21 nt, Pseudomonas aeruginosa PA01
ccgcgcguucgcgcgaggcgc

SEQ ID NO: 1502843 - RNA, 22 nt, Pseudomonas aeruginosa PA01
ccgcgcguucgcgcgaggcgcu

SEQ ID NO: 1502844 - RNA, 16 nt, Pseudomonas aeruginosa PA01
ccgcgcuccaacaggc

SEQ ID NO: 1502845 - RNA, 17 nt, Pseudomonas aeruginosa PA01
ccgccgccugcucgccg

SEQ ID NO: 1502846 - RNA, 18 nt, Pseudomonas aeruginosa PA01
ccgccgccugcucgccgc

SEQ ID NO: 1502847 - RNA, 20 nt, Pseudomonas aeruginosa PA01
ccgccgccugcucgccgcug

SEQ ID NO: 1502848 - RNA, 18 nt, Pseudomonas aeruginosa PA01
ccgccgccuggguggcga

SEQ ID NO: 1502849 - RNA, 11 nt, Pseudomonas aeruginosa PA01
ccgccgccggg

SEQ ID NO: 1502850 - RNA, 12 nt, Pseudomonas aeruginosa PA01
ccgccgccggga

SEQ ID NO: 1502851 - RNA, 13 nt, Pseudomonas aeruginosa PA01
ccgccgccgggcu

SEQ ID NO: 1502852 - RNA, 13 nt, Pseudomonas aeruginosa PA01
ccgccgccggggc

SEQ ID NO: 1502853 - RNA, 14 nt, Pseudomonas aeruginosa PA01
ccgccgccgcaacc

SEQ ID NO: 1502854 - RNA, 12 nt, Pseudomonas aeruginosa PA01
ccgccgccgacg

SEQ ID NO: 1502855 - RNA, 11 nt, Pseudomonas aeruginosa PA01
ccgccgccgac

SEQ ID NO: 1502856 - RNA, 17 nt, Pseudomonas aeruginosa PA01
ccgccgccgccgucgac

SEQ ID NO: 1502857 - RNA, 15 nt, Pseudomonas aeruginosa PA01
ccgccgccgcgccgg

SEQ ID NO: 1502858 - RNA, 14 nt, Pseudomonas aeruginosa PA01
ccgccgccgcgccu

SEQ ID NO: 1502859 - RNA, 12 nt, Pseudomonas aeruginosa PA01
ccgccgccggcc

SEQ ID NO: 1502860 - RNA, 13 nt, Pseudomonas aeruginosa PA01
ccgccgcagccgu

SEQ ID NO: 1502861 - RNA, 15 nt, Pseudomonas aeruginosa PA01
ccgccgccagcaacg

SEQ ID NO: 1502862 - RNA, 16 nt, Pseudomonas aeruginosa PA01
ccgccgccagcaacgg

SEQ ID NO: 1502863 - RNA, 12 nt, Pseudomonas aeruginosa PA01
ccgccgccaggc

SEQ ID NO: 1502864 - RNA, 15 nt, Pseudomonas aeruginosa PA01
ccgccgccaggcggc

SEQ ID NO: 1502865 - RNA, 13 nt, Pseudomonas aeruginosa PA01
ccgccgccagguc

SEQ ID NO: 1502866 - RNA, 15 nt, Pseudomonas aeruginosa PA01
ccgccgcccagcagc

SEQ ID NO: 1502867 - RNA, 16 nt, Pseudomonas aeruginosa PA01
ccgccgcccagcagca

SEQ ID NO: 1502868 - RNA, 18 nt, Pseudomonas aeruginosa PA01
ccgccgaggaagccgacc

SEQ ID NO: 1502869 - RNA, 19 nt, Pseudomonas aeruginosa PA01
ccgccgaggaagccgaccg

SEQ ID NO: 1502870 - RNA, 22 nt, Pseudomonas aeruginosa PA01
ccgccgaggaagccgaccggcg

SEQ ID NO: 1502871 - RNA, 21 nt, Pseudomonas aeruginosa PA01
ccgccgaggaggaucucgcgc

SEQ ID NO: 1502872 - RNA, 16 nt, Pseudomonas aeruginosa PA01
ccgccgaggugcugca

SEQ ID NO: 1502873 - RNA, 14 nt, Pseudomonas aeruginosa PA01
ccgccgagggcgaa

SEQ ID NO: 1502874 - RNA, 16 nt, Pseudomonas aeruginosa PA01
ccgccgagggcgaaga

SEQ ID NO: 1502875 - RNA, 17 nt, Pseudomonas aeruginosa PA01
ccgccgagggcgccagg

SEQ ID NO: 1502876 - RNA, 15 nt, Pseudomonas aeruginosa PA01
ccgccgaggcgcgcc

SEQ ID NO: 1502877 - RNA, 17 nt, Pseudomonas aeruginosa PA01
ccgccgaggcgcgccac

SEQ ID NO: 1502878 - RNA, 18 nt, Pseudomonas aeruginosa PA01
ccgccgagggcaccgacg

SEQ ID NO: 1502879 - RNA, 20 nt, Pseudomonas aeruginosa PA01
ccgccgagggcaccgacgau

SEQ ID NO: 1502880 - RNA, 14 nt, Pseudomonas aeruginosa PA01
ccgccgagcaggcc

SEQ ID NO: 1502881 - RNA, 13 nt, Pseudomonas aeruginosa PA01
ccgccgagcaacu

SEQ ID NO: 1502882 - RNA, 15 nt, Pseudomonas aeruginosa PA01
ccgccgagcaacugc

SEQ ID NO: 1502883 - RNA, 17 nt, Pseudomonas aeruginosa PA01
ccgccgagcgccuggca

SEQ ID NO: 1502884 - RNA, 20 nt, Pseudomonas aeruginosa PA01
ccgccgacugcaacuggccg

SEQ ID NO: 1502885 - RNA, 16 nt, Pseudomonas aeruginosa PA01
ccgccgacgucgugga

SEQ ID NO: 1502886 - RNA, 14 nt, Pseudomonas aeruginosa PA01
ccgccgcagagcca

SEQ ID NO: 1502887 - RNA, 15 nt, Pseudomonas aeruginosa PA01
ccgccgcagagccag

SEQ ID NO: 1502888 - RNA, 19 nt, Pseudomonas aeruginosa PA01
ccgccgcagagccagccgc

SEQ ID NO: 1502889 - RNA, 16 nt, Pseudomonas aeruginosa PA01
ccgccgcagaccagcg

SEQ ID NO: 1502890 - RNA, 17 nt, Pseudomonas aeruginosa PA01
ccgccgcagaccagcga

SEQ ID NO: 1502891 - RNA, 21 nt, Pseudomonas aeruginosa PA01
ccgccgauagggaaacacguc

SEQ ID NO: 1502892 - RNA, 16 nt, Pseudomonas aeruginosa PA01
ccgccgauccaggaac

SEQ ID NO: 1502893 - RNA, 12 nt, Pseudomonas aeruginosa PA01
ccgccgaucagc

SEQ ID NO: 1502894 - RNA, 16 nt, Pseudomonas aeruginosa PA01
ccgccgauacaccacc

SEQ ID NO: 1502895 - RNA, 22 nt, Pseudomonas aeruginosa PA01
ccgccgauacaccaccauaccg

SEQ ID NO: 1502896 - RNA, 16 nt, Pseudomonas aeruginosa PA01
ccgccgauacagcgcg

SEQ ID NO: 1502897 - RNA, 15 nt, Pseudomonas aeruginosa PA01
ccgccgaucugcugg

SEQ ID NO: 1502898 - RNA, 23 nt, Pseudomonas aeruginosa PA01
ccgccgaucugcugggucaucga

SEQ ID NO: 1502899 - RNA, 15 nt, Pseudomonas aeruginosa PA01
ccgccaucaccagcg

SEQ ID NO: 1502900 - RNA, 18 nt, Pseudomonas aeruginosa PA01
ccgccaucccucuaucac

SEQ ID NO: 1502901 - RNA, 21 nt, Pseudomonas aeruginosa PA01
ccgcccgaucgccucgucgag

SEQ ID NO: 1502902 - RNA, 22 nt, Pseudomonas aeruginosa PA01
ccgcccgaucgccucgucgagc

SEQ ID NO: 1502903 - RNA, 22 nt, Pseudomonas aeruginosa PA01
ccgccaucgauggucaggcugg

SEQ ID NO: 1502904 - RNA, 13 nt, Pseudomonas aeruginosa PA01
ccgcccgcgccuc

SEQ ID NO: 1502905 - RNA, 17 nt, Pseudomonas aeruginosa PA01
ccgcccgcgccuccagg

SEQ ID NO: 1502906 - RNA, 21 nt, Pseudomonas aeruginosa PA01
ccgcccgcgccuccaggcgcg

SEQ ID NO: 1502907 - RNA, 13 nt, Pseudomonas aeruginosa PA01
ccgcccgccgucc

SEQ ID NO: 1502908 - RNA, 16 nt, Pseudomonas aeruginosa PA01
ccgcccgcucaagggc

SEQ ID NO: 1502909 - RNA, 21 nt, Pseudomonas aeruginosa PA01
ccgcccgucaugaccagagcc

SEQ ID NO: 1502910 - RNA, 19 nt, Pseudomonas aeruginosa PA01
ccgcccggucucagccggc

SEQ ID NO: 1502911 - RNA, 21 nt, Pseudomonas aeruginosa PA01
ccgcccggucucagccggcgc

SEQ ID NO: 1502912 - RNA, 22 nt, Pseudomonas aeruginosa PA01
ccgcccggucucagccggcgcu

SEQ ID NO: 1502913 - RNA, 12 nt, Pseudomonas aeruginosa PA01
ccgcccugcgca

SEQ ID NO: 1502914 - RNA, 20 nt, Pseudomonas aeruginosa PA01
ccgcccugcggcaggcgcca

SEQ ID NO: 1502915 - RNA, 14 nt, Pseudomonas aeruginosa PA01
ccgcccucgggccg

SEQ ID NO: 1502916 - RNA, 15 nt, Pseudomonas aeruginosa PA01
ccgcccucgggccgc

SEQ ID NO: 1502917 - RNA, 18 nt, Pseudomonas aeruginosa PA01
ccgcccucgucgcaccug

SEQ ID NO: 1502918 - RNA, 23 nt, Pseudomonas aeruginosa PA01
ccgcccucgcaguacagcucggc

SEQ ID NO: 1502919 - RNA, 19 nt, Pseudomonas aeruginosa PA01
ccgcccuagcgguccggac

SEQ ID NO: 1502920 - RNA, 15 nt, Pseudomonas aeruginosa PA01
ccgcccgucgcgccg

SEQ ID NO: 1502921 - RNA, 16 nt, Pseudomonas aeruginosa PA01
ccgcccgucgcgccgg

SEQ ID NO: 1502922 - RNA, 18 nt, Pseudomonas aeruginosa PA01
ccgcccgucgcgccggcc

SEQ ID NO: 1502923 - RNA, 19 nt, Pseudomonas aeruginosa PA01
ccgcccgucgcgccggcca

SEQ ID NO: 1502924 - RNA, 21 nt, Pseudomonas aeruginosa PA01
ccgccgaacagcaacaccgcg

SEQ ID NO: 1502925 - RNA, 24 nt, Pseudomonas aeruginosa PA01
ccgccgaacagcaacaccgcgcag

SEQ ID NO: 1502926 - RNA, 15 nt, Pseudomonas aeruginosa PA01
ccgccgaaaugcugc

SEQ ID NO: 1502927 - RNA, 19 nt, Pseudomonas aeruginosa PA01
ccgccgaaaugcugcaggc

SEQ ID NO: 1502928 - RNA, 21 nt, Pseudomonas aeruginosa PA01
ccgccgaaaugcugcaggccg

SEQ ID NO: 1502929 - RNA, 22 nt, Pseudomonas aeruginosa PA01
ccgccgaaaugcugcaggccga

SEQ ID NO: 1502930 - RNA, 15 nt, Pseudomonas aeruginosa PA01
ccgcccuugucgaug

SEQ ID NO: 1502931 - RNA, 21 nt, Pseudomonas aeruginosa PA01
ccgcccuuuuucgucgccagc

SEQ ID NO: 1502932 - RNA, 22 nt, Pseudomonas aeruginosa PA01
ccgcccuuuuucgucgccagcc

SEQ ID NO: 1502933 - RNA, 14 nt, Pseudomonas aeruginosa PA01
ccgccgaacgccac

SEQ ID NO: 1502934 - RNA, 18 nt, Pseudomonas aeruginosa PA01
ccgccgaacgccaccagg

SEQ ID NO: 1502935 - RNA, 21 nt, Pseudomonas aeruginosa PA01
ccgccgaacaugccgaagagc

SEQ ID NO: 1502936 - RNA, 21 nt, Pseudomonas aeruginosa PA01
ccgcccugggguuucugcugg

SEQ ID NO: 1502937 - RNA, 20 nt, Pseudomonas aeruginosa PA01
ccgcccuggcucugggccau

SEQ ID NO: 1502938 - RNA, 21 nt, Pseudomonas aeruginosa PA01
ccgcccuggcucugggccaug

SEQ ID NO: 1502939 - RNA, 22 nt, Pseudomonas aeruginosa PA01
ccgcccuggcucugggccauga

SEQ ID NO: 1502940 - RNA, 14 nt, Pseudomonas aeruginosa PA01
ccgcccuggccgcc

SEQ ID NO: 1502941 - RNA, 22 nt, Pseudomonas aeruginosa PA01
ccgcccuggccgcccaguucgc

SEQ ID NO: 1502942 - RNA, 12 nt, Pseudomonas aeruginosa PA01
ccgcccuggccg

SEQ ID NO: 1502943 - RNA, 13 nt, Pseudomonas aeruginosa PA01
ccgcccuggccga

SEQ ID NO: 1502944 - RNA, 17 nt, Pseudomonas aeruginosa PA01
ccgcccuugcucgcggc

SEQ ID NO: 1502945 - RNA, 18 nt, Pseudomonas aeruginosa PA01
ccgcccuuggcggcgcca

SEQ ID NO: 1502946 - RNA, 18 nt, Pseudomonas aeruginosa PA01
ccgcccuugcucgcggcg

SEQ ID NO: 1502947 - RNA, 15 nt, Pseudomonas aeruginosa PA01
ccgccgaccagcacg

SEQ ID NO: 1502948 - RNA, 16 nt, Pseudomonas aeruginosa PA01
ccgccgaccagcacgg

SEQ ID NO: 1502949 - RNA, 17 nt, Pseudomonas aeruginosa PA01
ccgccgaccagcacggc

SEQ ID NO: 1502950 - RNA, 18 nt, Pseudomonas aeruginosa PA01
ccgccgaccagcacggcg

SEQ ID NO: 1502951 - RNA, 16 nt, Pseudomonas aeruginosa PA01
ccgccgaccucggccg

SEQ ID NO: 1502952 - RNA, 19 nt, Pseudomonas aeruginosa PA01
ccgccgacgccggacgagc

SEQ ID NO: 1502953 - RNA, 15 nt, Pseudomonas aeruginosa PA01
ccgccgacacccgcg

SEQ ID NO: 1502954 - RNA, 17 nt, Pseudomonas aeruginosa PA01
ccgccgacacccgcgcc

SEQ ID NO: 1502955 - RNA, 19 nt, Pseudomonas aeruginosa PA01
ccgccgacacccgcgccgc

SEQ ID NO: 1502956 - RNA, 20 nt, Pseudomonas aeruginosa PA01
ccgccgacacccgcgccgcc

SEQ ID NO: 1502957 - RNA, 20 nt, Pseudomonas aeruginosa PA01
ccgccgaagccgacgccgag

SEQ ID NO: 1502958 - RNA, 21 nt, Pseudomonas aeruginosa PA01
ccgccgaagccgacgccgagc

SEQ ID NO: 1502959 - RNA, 15 nt, Pseudomonas aeruginosa PA01
ccgccgaagcggggc

SEQ ID NO: 1502960 - RNA, 20 nt, Pseudomonas aeruginosa PA01
ccgccgaacggaucgcgucg

SEQ ID NO: 1502961 - RNA, 21 nt, Pseudomonas aeruginosa PA01
ccgccgaacggaucgcgucgc

SEQ ID NO: 1502962 - RNA, 18 nt, Pseudomonas aeruginosa PA01
ccgagcaggcacccgcgg

SEQ ID NO: 1502963 - RNA, 23 nt, Pseudomonas aeruginosa PA01
ccgagcaggccuugcagggccgc

SEQ ID NO: 1502964 - RNA, 18 nt, Pseudomonas aeruginosa PA01
ccgagcaggcgcgccagg

SEQ ID NO: 1502965 - RNA, 19 nt, Pseudomonas aeruginosa PA01
ccgagcagggucacgccga

SEQ ID NO: 1502966 - RNA, 22 nt, Pseudomonas aeruginosa PA01
ccgagcagggucacgccgauca

SEQ ID NO: 1502967 - RNA, 18 nt, Pseudomonas aeruginosa PA01
ccgagcagcaccaggcug

SEQ ID NO: 1502968 - RNA, 14 nt, Pseudomonas aeruginosa PA01
ccgagcagcgccag

SEQ ID NO: 1502969 - RNA, 15 nt, Pseudomonas aeruginosa PA01
ccgagcagcgccagc

SEQ ID NO: 1502970 - RNA, 16 nt, Pseudomonas aeruginosa PA01
ccgagcagcgccagcc

SEQ ID NO: 1502971 - RNA, 14 nt, Pseudomonas aeruginosa PA01
ccgagcagcggacg

SEQ ID NO: 1502972 - RNA, 14 nt, Pseudomonas aeruginosa PA01
ccgagcagcggcgc

SEQ ID NO: 1502973 - RNA, 13 nt, Pseudomonas aeruginosa PA01
ccgagcaccggcc

SEQ ID NO: 1502974 - RNA, 14 nt, Pseudomonas aeruginosa PA01
ccgagcaccggcag

SEQ ID NO: 1502975 - RNA, 18 nt, Pseudomonas aeruginosa PA01
ccgagcaugaugcaggca

SEQ ID NO: 1502976 - RNA, 20 nt, Pseudomonas aeruginosa PA01
ccgagcaugaugcaggcagu

SEQ ID NO: 1502977 - RNA, 17 nt, Pseudomonas aeruginosa PA01
ccgcagccguggcgcga

SEQ ID NO: 1502978 - RNA, 12 nt, Pseudomonas aeruginosa PA01
ccgcagccggcg

SEQ ID NO: 1502979 - RNA, 14 nt, Pseudomonas aeruginosa PA01
ccgcagccuuggca

SEQ ID NO: 1502980 - RNA, 19 nt, Pseudomonas aeruginosa PA01
ccgcagcgaucagcaccag

SEQ ID NO: 1502981 - RNA, 20 nt, Pseudomonas aeruginosa PA01
ccgcagcgaucagcaccagc

SEQ ID NO: 1502982 - RNA, 23 nt, Pseudomonas aeruginosa PA01
ccgcagcgaucagcaccagcgga

SEQ ID NO: 1502983 - RNA, 15 nt, Pseudomonas aeruginosa PA01
ccgcagcgcagccga

SEQ ID NO: 1502984 - RNA, 20 nt, Pseudomonas aeruginosa PA01
ccgcaguuguuccucgcggc

SEQ ID NO: 1502985 - RNA, 16 nt, Pseudomonas aeruginosa PA01
ccgcaguuccucgccg

SEQ ID NO: 1502986 - RNA, 19 nt, Pseudomonas aeruginosa PA01
ccgcaguuccucgccgcug

SEQ ID NO: 1502987 - RNA, 21 nt, Pseudomonas aeruginosa PA01
ccgcaguuccucgccgcugcu

SEQ ID NO: 1502988 - RNA, 16 nt, Pseudomonas aeruginosa PA01
ccgcaguucgccccgc

SEQ ID NO: 1502989 - RNA, 16 nt, Pseudomonas aeruginosa PA01
ccgcaguagcucgccg

SEQ ID NO: 1502990 - RNA, 17 nt, Pseudomonas aeruginosa PA01
ccgcaguagcucgccga

SEQ ID NO: 1502991 - RNA, 18 nt, Pseudomonas aeruginosa PA01
ccgcaguagcucgccgag

SEQ ID NO: 1502992 - RNA, 19 nt, Pseudomonas aeruginosa PA01
ccgcaguccagggcgaugg

SEQ ID NO: 1502993 - RNA, 20 nt, Pseudomonas aeruginosa PA01
ccgcaggcgcuucagcgccu

SEQ ID NO: 1502994 - RNA, 18 nt, Pseudomonas aeruginosa PA01
ccgcaggcguuauccgcc

SEQ ID NO: 1502995 - RNA, 16 nt, Pseudomonas aeruginosa PA01
ccgcaggaaggcgaag

SEQ ID NO: 1502996 - RNA, 17 nt, Pseudomonas aeruginosa PA01
ccgcaggaaggcgaagc

SEQ ID NO: 1502997 - RNA, 16 nt, Pseudomonas aeruginosa PA01
ccgcaggccgcggccg

SEQ ID NO: 1502998 - RNA, 17 nt, Pseudomonas aeruginosa PA01
ccgcaggccgcggccga

SEQ ID NO: 1502999 - RNA, 13 nt, Pseudomonas aeruginosa PA01
ccgcaggccggcc

SEQ ID NO: 1503000 - RNA, 14 nt, Pseudomonas aeruginosa PA01
ccgcaggccggcca

SEQ ID NO: 1503001 - RNA, 19 nt, Pseudomonas aeruginosa PA01
ccgcaggaaaccccucggc

SEQ ID NO: 1503002 - RNA, 18 nt, Pseudomonas aeruginosa PA01
ccgcaggaaccgacgcgc

SEQ ID NO: 1503003 - RNA, 13 nt, Pseudomonas aeruginosa PA01
ccgcaggaugccg

SEQ ID NO: 1503004 - RNA, 17 nt, Pseudomonas aeruginosa PA01
ccgcaggcaggucgcug

SEQ ID NO: 1503005 - RNA, 17 nt, Pseudomonas aeruginosa PA01
ccgcaggcaguggcgcc

SEQ ID NO: 1503006 - RNA, 21 nt, Pseudomonas aeruginosa PA01
ccgcaggcaguggcgccagcc

SEQ ID NO: 1503007 - RNA, 15 nt, Pseudomonas aeruginosa PA01
ccgcaggucggcguc

SEQ ID NO: 1503008 - RNA, 13 nt, Pseudomonas aeruginosa PA01
ccgcaggugaagc

SEQ ID NO: 1503009 - RNA, 20 nt, Pseudomonas aeruginosa PA01
ccgcagguuggccccgccga

SEQ ID NO: 1503010 - RNA, 21 nt, Pseudomonas aeruginosa PA01
ccgcagguuggccccgccgag

SEQ ID NO: 1503011 - RNA, 21 nt, Pseudomonas aeruginosa PA01
ccgcagggcucgugccaucag

SEQ ID NO: 1503012 - RNA, 20 nt, Pseudomonas aeruginosa PA01
ccgcagguagcugagcaggc

SEQ ID NO: 1503013 - RNA, 15 nt, Pseudomonas aeruginosa PA01
ccgccagguccaggc

SEQ ID NO: 1503014 - RNA, 23 nt, Pseudomonas aeruginosa PA01
ccgccaggucgauccccaacccg

SEQ ID NO: 1503015 - RNA, 20 nt, Pseudomonas aeruginosa PA01
ccgccaggguguuguucgcc

SEQ ID NO: 1503016 - RNA, 16 nt, Pseudomonas aeruginosa PA01
ccgccagcgcggcgcu

SEQ ID NO: 1503017 - RNA, 15 nt, Pseudomonas aeruginosa PA01
ccgccaggcuggcca

SEQ ID NO: 1503018 - RNA, 13 nt, Pseudomonas aeruginosa PA01
ccgccagggcgcu

SEQ ID NO: 1503019 - RNA, 19 nt, Pseudomonas aeruginosa PA01
ccgccagggcgcucaccga

SEQ ID NO: 1503020 - RNA, 14 nt, Pseudomonas aeruginosa PA01
ccgccagggcgucg

SEQ ID NO: 1503021 - RNA, 17 nt, Pseudomonas aeruginosa PA01
ccgccagggcgucggag

SEQ ID NO: 1503022 - RNA, 20 nt, Pseudomonas aeruginosa PA01
ccgccagggucagcucgaca

SEQ ID NO: 1503023 - RNA, 15 nt, Pseudomonas aeruginosa PA01
ccgccaguucggcca

SEQ ID NO: 1503024 - RNA, 15 nt, Pseudomonas aeruginosa PA01
ccgccaguucgcgca

SEQ ID NO: 1503025 - RNA, 16 nt, Pseudomonas aeruginosa PA01
ccgccaguucgcgcag

SEQ ID NO: 1503026 - RNA, 16 nt, Pseudomonas aeruginosa PA01
ccgccaguuccggcaa

SEQ ID NO: 1503027 - RNA, 17 nt, Pseudomonas aeruginosa PA01
ccgccaguuccggcaac

SEQ ID NO: 1503028 - RNA, 15 nt, Pseudomonas aeruginosa PA01
ccgccagucggccug

SEQ ID NO: 1503029 - RNA, 18 nt, Pseudomonas aeruginosa PA01
ccgccagucggccuggcu

SEQ ID NO: 1503030 - RNA, 16 nt, Pseudomonas aeruginosa PA01
ccgccagugcagccgu

SEQ ID NO: 1503031 - RNA, 20 nt, Pseudomonas aeruginosa PA01
ccgccauagagugcccaggc

SEQ ID NO: 1503032 - RNA, 22 nt, Pseudomonas aeruginosa PA01
ccgccauagagugcccaggcgc

SEQ ID NO: 1503033 - RNA, 12 nt, Pseudomonas aeruginosa PA01
ccgccaggcgcg

SEQ ID NO: 1503034 - RNA, 13 nt, Pseudomonas aeruginosa PA01
ccgccaggcgcgu

SEQ ID NO: 1503035 - RNA, 15 nt, Pseudomonas aeruginosa PA01
ccgccaggcgcgucg

SEQ ID NO: 1503036 - RNA, 21 nt, Pseudomonas aeruginosa PA01
ccgccaggcgcgucuccagcu

SEQ ID NO: 1503037 - RNA, 12 nt, Pseudomonas aeruginosa PA01
ccgccaggcgcu

SEQ ID NO: 1503038 - RNA, 14 nt, Pseudomonas aeruginosa PA01
ccgccaggcgcucc

SEQ ID NO: 1503039 - RNA, 21 nt, Pseudomonas aeruginosa PA01
ccgccaggcggagcauggugu

SEQ ID NO: 1503040 - RNA, 14 nt, Pseudomonas aeruginosa PA01
ccgccaggcggcaa

SEQ ID NO: 1503041 - RNA, 15 nt, Pseudomonas aeruginosa PA01
ccgccaggcggccgc

SEQ ID NO: 1503042 - RNA, 17 nt, Pseudomonas aeruginosa PA01
ccgccaggcggccgcug

SEQ ID NO: 1503043 - RNA, 20 nt, Pseudomonas aeruginosa PA01
ccgccaggcggccgcuggcg

SEQ ID NO: 1503044 - RNA, 14 nt, Pseudomonas aeruginosa PA01
ccgccagcgcggcg

SEQ ID NO: 1503045 - RNA, 16 nt, Pseudomonas aeruginosa PA01
ccgccagcgccggcca

SEQ ID NO: 1503046 - RNA, 11 nt, Pseudomonas aeruginosa PA01
ccgccagcgcg

SEQ ID NO: 1503047 - RNA, 13 nt, Pseudomonas aeruginosa PA01
ccgccagcgccgg

SEQ ID NO: 1503048 - RNA, 19 nt, Pseudomonas aeruginosa PA01
ccgccagaaagccucaggc

SEQ ID NO: 1503049 - RNA, 19 nt, Pseudomonas aeruginosa PA01
ccgccaccgccaccgccgg

SEQ ID NO: 1503050 - RNA, 18 nt, Pseudomonas aeruginosa PA01
ccgccagcaacaguugcc

SEQ ID NO: 1503051 - RNA, 18 nt, Pseudomonas aeruginosa PA01
ccgccagaugcgcgucgc

SEQ ID NO: 1503052 - RNA, 21 nt, Pseudomonas aeruginosa PA01
ccgccagaugcgcgucgccga

SEQ ID NO: 1503053 - RNA, 14 nt, Pseudomonas aeruginosa PA01
ccgccagcaccacc

SEQ ID NO: 1503054 - RNA, 20 nt, Pseudomonas aeruginosa PA01
ccgccagcaccacccggccg

SEQ ID NO: 1503055 - RNA, 21 nt, Pseudomonas aeruginosa PA01
ccgccagcaccacccggccgc

SEQ ID NO: 1503056 - RNA, 22 nt, Pseudomonas aeruginosa PA01
ccgccagcaccacccggccgcg

SEQ ID NO: 1503057 - RNA, 12 nt, Pseudomonas aeruginosa PA01
ccgccagcaaga

SEQ ID NO: 1503058 - RNA, 23 nt, Pseudomonas aeruginosa PA01
ccgccagcaagacgguccccagu

SEQ ID NO: 1503059 - RNA, 14 nt, Pseudomonas aeruginosa PA01
ccgccagacaggcc

SEQ ID NO: 1503060 - RNA, 17 nt, Pseudomonas aeruginosa PA01
ccgccagacaggccagc

SEQ ID NO: 1503061 - RNA, 17 nt, Pseudomonas aeruginosa PA01
ccgcaucgcgggcgugc

SEQ ID NO: 1503062 - RNA, 18 nt, Pseudomonas aeruginosa PA01
ccgcaucgcgggcgugcu

SEQ ID NO: 1503063 - RNA, 15 nt, Pseudomonas aeruginosa PA01
ccgcaucgcggggcu

SEQ ID NO: 1503064 - RNA, 20 nt, Pseudomonas aeruginosa PA01
ccgcaucgcgguuauccgcc

SEQ ID NO: 1503065 - RNA, 13 nt, Pseudomonas aeruginosa PA01
ccgcaucggccga

SEQ ID NO: 1503066 - RNA, 17 nt, Pseudomonas aeruginosa PA01
ccgccaccccgccggcg

SEQ ID NO: 1503067 - RNA, 22 nt, Pseudomonas aeruginosa PA01
ccgccaccacgaucaggcccuu

SEQ ID NO: 1503068 - RNA, 16 nt, Pseudomonas aeruginosa PA01
ccgcaucgaggccgcc

SEQ ID NO: 1503069 - RNA, 11 nt, Pseudomonas aeruginosa PA01
ccgcaucgcgg

SEQ ID NO: 1503070 - RNA, 19 nt, Pseudomonas aeruginosa PA01
ccgcaucgaagcgcaccag

SEQ ID NO: 1503071 - RNA, 21 nt, Pseudomonas aeruginosa PA01
ccgcaucgaaggcgccggcau

SEQ ID NO: 1503072 - RNA, 23 nt, Pseudomonas aeruginosa PA01
ccgcaucgaaggcgccggcauga

SEQ ID NO: 1503073 - RNA, 21 nt, Pseudomonas aeruginosa PA01
ccugcgaccgugaggcgcagg

SEQ ID NO: 1503074 - RNA, 17 nt, Pseudomonas aeruginosa PA01
ccugcgccagcaucgca

SEQ ID NO: 1503075 - RNA, 22 nt, Pseudomonas aeruginosa PA01
ccugcgccagcaucgcaucggc

SEQ ID NO: 1503076 - RNA, 13 nt, Pseudomonas aeruginosa PA01
ccugcgcggcgac

SEQ ID NO: 1503077 - RNA, 17 nt, Pseudomonas aeruginosa PA01
ccugcgcggcgacgauc

SEQ ID NO: 1503078 - RNA, 20 nt, Pseudomonas aeruginosa PA01
ccugcgcggcgacgaucagc

SEQ ID NO: 1503079 - RNA, 15 nt, Pseudomonas aeruginosa PA01
ccugcgcgccucuuc

SEQ ID NO: 1503080 - RNA, 14 nt, Pseudomonas aeruginosa PA01
ccugcgccgcagcg

SEQ ID NO: 1503081 - RNA, 18 nt, Pseudomonas aeruginosa PA01
ccugcgccgcagcggcca

SEQ ID NO: 1503082 - RNA, 22 nt, Pseudomonas aeruginosa PA01
ccugcgccucacggucgcaggg

SEQ ID NO: 1503083 - RNA, 16 nt, Pseudomonas aeruginosa PA01
ccugccggugcucggc

SEQ ID NO: 1503084 - RNA, 18 nt, Pseudomonas aeruginosa PA01
ccugccggugcucggccu

SEQ ID NO: 1503085 - RNA, 20 nt, Pseudomonas aeruginosa PA01
ccugccggugcucggccuga

SEQ ID NO: 1503086 - RNA, 18 nt, Pseudomonas aeruginosa PA01
ccugccguauccgcggca

SEQ ID NO: 1503087 - RNA, 22 nt, Pseudomonas aeruginosa PA01
ccugccguucgucaccggcgcc

SEQ ID NO: 1503088 - RNA, 20 nt, Pseudomonas aeruginosa PA01
ccugccggcgcagaucgcgg

SEQ ID NO: 1503089 - RNA, 15 nt, Pseudomonas aeruginosa PA01
ccugccgggcucuuc

SEQ ID NO: 1503090 - RNA, 12 nt, Pseudomonas aeruginosa PA01
ccugccggcggu

SEQ ID NO: 1503091 - RNA, 19 nt, Pseudomonas aeruginosa PA01
ccugccgggcaagcucgac

SEQ ID NO: 1503092 - RNA, 13 nt, Pseudomonas aeruginosa PA01
ccugcccuccugc

SEQ ID NO: 1503093 - RNA, 14 nt, Pseudomonas aeruginosa PA01
ccugccgcgccgga

SEQ ID NO: 1503094 - RNA, 15 nt, Pseudomonas aeruginosa PA01
ccugccgcgccggau

SEQ ID NO: 1503095 - RNA, 13 nt, Pseudomonas aeruginosa PA01
ccugccgcccggc

SEQ ID NO: 1503096 - RNA, 14 nt, Pseudomonas aeruginosa PA01
ccugccgcccggcc

SEQ ID NO: 1503097 - RNA, 13 nt, Pseudomonas aeruginosa PA01
ccugccgcaggcg

SEQ ID NO: 1503098 - RNA, 12 nt, Pseudomonas aeruginosa PA01
ccugccauccgg

SEQ ID NO: 1503099 - RNA, 24 nt, Pseudomonas aeruginosa PA01
ccugccagcgcgucggcacgccga

SEQ ID NO: 1503100 - RNA, 13 nt, Pseudomonas aeruginosa PA01
ccugccagcgggc

SEQ ID NO: 1503101 - RNA, 23 nt, Pseudomonas aeruginosa PA01
ccugccaggggcuagucgcgcag

SEQ ID NO: 1503102 - RNA, 21 nt, Pseudomonas aeruginosa PA01
ccugccccacuuccggcccgg

SEQ ID NO: 1503103 - RNA, 20 nt, Pseudomonas aeruginosa PA01
ccugccccgugcaccgaggc

SEQ ID NO: 1503104 - RNA, 15 nt, Pseudomonas aeruginosa PA01
ccugccccuucggcu

SEQ ID NO: 1503105 - RNA, 12 nt, Pseudomonas aeruginosa PA01
ccugcggcacga

SEQ ID NO: 1503106 - RNA, 16 nt, Pseudomonas aeruginosa PA01
ccugcggauggcgcgg

SEQ ID NO: 1503107 - RNA, 18 nt, Pseudomonas aeruginosa PA01
ccugcggauucaucggcg

SEQ ID NO: 1503108 - RNA, 20 nt, Pseudomonas aeruginosa PA01
ccugcggauucaucggcggc

SEQ ID NO: 1503109 - RNA, 21 nt, Pseudomonas aeruginosa PA01
ccugcggauucaucggcggca

SEQ ID NO: 1503110 - RNA, 19 nt, Pseudomonas aeruginosa PA01
ccugcggauagccaaccag

SEQ ID NO: 1503111 - RNA, 14 nt, Pseudomonas aeruginosa PA01
ccugcggaccgcag

SEQ ID NO: 1503112 - RNA, 15 nt, Pseudomonas aeruginosa PA01
ccugcggccagcgcc

SEQ ID NO: 1503113 - RNA, 18 nt, Pseudomonas aeruginosa PA01
ccugcggccgcaaccagc

SEQ ID NO: 1503114 - RNA, 18 nt, Pseudomonas aeruginosa PA01
ccugcggccguucgcccu

SEQ ID NO: 1503115 - RNA, 20 nt, Pseudomonas aeruginosa PA01
ccugcggccguucgcccuuc

SEQ ID NO: 1503116 - RNA, 21 nt, Pseudomonas aeruginosa PA01
ccugcggccguucgcccuuca

SEQ ID NO: 1503117 - RNA, 22 nt, Pseudomonas aeruginosa PA01
ccugcggcgccuagacccuggg

SEQ ID NO: 1503118 - RNA, 22 nt, Pseudomonas aeruginosa PA01
ccugcggggcggcgucccggcg

SEQ ID NO: 1503119 - RNA, 18 nt, Pseudomonas aeruginosa PA01
ccugcgggcugcgugcca

SEQ ID NO: 1503120 - RNA, 14 nt, Pseudomonas aeruginosa PA01
ccugcggcuugccc

SEQ ID NO: 1503121 - RNA, 20 nt, Pseudomonas aeruginosa PA01
ccugcgggacccagacaggc

SEQ ID NO: 1503122 - RNA, 13 nt, Pseudomonas aeruginosa PA01
ccugcggcuggcg

SEQ ID NO: 1503123 - RNA, 15 nt, Pseudomonas aeruginosa PA01
ccugcggcuggcgaa

SEQ ID NO: 1503124 - RNA, 21 nt, Pseudomonas aeruginosa PA01
ccugcgggucauagucgguga

SEQ ID NO: 1503125 - RNA, 20 nt, Pseudomonas aeruginosa PA01
ccugcggguuggucggcacc

SEQ ID NO: 1503126 - RNA, 16 nt, Pseudomonas aeruginosa PA01
ccugcggguucggcga

SEQ ID NO: 1503127 - RNA, 13 nt, Pseudomonas aeruginosa PA01
ccugcgucgcaga

SEQ ID NO: 1503128 - RNA, 22 nt, Pseudomonas aeruginosa PA01
ccugcgucgcagagacgcagcg

SEQ ID NO: 1503129 - RNA, 20 nt, Pseudomonas aeruginosa PA01
ccugcucacggccgaacaga

SEQ ID NO: 1503130 - RNA, 18 nt, Pseudomonas aeruginosa PA01
ccugcucagcggcccagc

SEQ ID NO: 1503131 - RNA, 19 nt, Pseudomonas aeruginosa PA01
ccugcucagcggcccagcg

SEQ ID NO: 1503132 - RNA, 20 nt, Pseudomonas aeruginosa PA01
ccugcucagcggcccagcgc

SEQ ID NO: 1503133 - RNA, 13 nt, Pseudomonas aeruginosa PA01
ccugcuccucggc

SEQ ID NO: 1503134 - RNA, 15 nt, Pseudomonas aeruginosa PA01
ccugcuccucggcag

SEQ ID NO: 1503135 - RNA, 16 nt, Pseudomonas aeruginosa PA01
ccugcuccucggcagc

SEQ ID NO: 1503136 - RNA, 14 nt, Pseudomonas aeruginosa PA01
ccugcuccagcagg

SEQ ID NO: 1503137 - RNA, 21 nt, Pseudomonas aeruginosa PA01
ccugcuccagcagggccagcg

SEQ ID NO: 1503138 - RNA, 22 nt, Pseudomonas aeruginosa PA01
ccugcuccagcagggccagcgc

SEQ ID NO: 1503139 - RNA, 19 nt, Pseudomonas aeruginosa PA01
ccugcguggaaccgcggcg

SEQ ID NO: 1503140 - RNA, 20 nt, Pseudomonas aeruginosa PA01
ccugcguggaaccgcggcgc

SEQ ID NO: 1503141 - RNA, 23 nt, Pseudomonas aeruginosa PA01
ccugcugcugcucagcgcgcucg

SEQ ID NO: 1503142 - RNA, 21 nt, Pseudomonas aeruginosa PA01
ccugcugcucgaccgccugcu

SEQ ID NO: 1503143 - RNA, 17 nt, Pseudomonas aeruginosa PA01
ccugcugcgggcgcugc

SEQ ID NO: 1503144 - RNA, 14 nt, Pseudomonas aeruginosa PA01
ccugcugcuggccu

SEQ ID NO: 1503145 - RNA, 20 nt, Pseudomonas aeruginosa PA01
ccugcuggccugggacggcg

SEQ ID NO: 1503146 - RNA, 21 nt, Pseudomonas aeruginosa PA01
ccugcuggccugggacggcgu

SEQ ID NO: 1503147 - RNA, 13 nt, Pseudomonas aeruginosa PA01
ccugcuggcgcag

SEQ ID NO: 1503148 - RNA, 18 nt, Pseudomonas aeruginosa PA01
ccugcuggcgcagccagg

SEQ ID NO: 1503149 - RNA, 20 nt, Pseudomonas aeruginosa PA01
ccugcugggcgucgaacacc

SEQ ID NO: 1503150 - RNA, 22 nt, Pseudomonas aeruginosa PA01
ccugcugggcgucgaacaccgg

SEQ ID NO: 1503151 - RNA, 15 nt, Pseudomonas aeruginosa PA01
ccugcugggccagcg

SEQ ID NO: 1503152 - RNA, 17 nt, Pseudomonas aeruginosa PA01
ccugcugggccagcgcc

SEQ ID NO: 1503153 - RNA, 18 nt, Pseudomonas aeruginosa PA01
ccugcugggccagcgccg

SEQ ID NO: 1503154 - RNA, 21 nt, Pseudomonas aeruginosa PA01
ccugcuucugguugcucacca

SEQ ID NO: 1503155 - RNA, 16 nt, Pseudomonas aeruginosa PA01
ccugcuucagcccggc

SEQ ID NO: 1503156 - RNA, 17 nt, Pseudomonas aeruginosa PA01
ccugcuucagcccggca

SEQ ID NO: 1503157 - RNA, 20 nt, Pseudomonas aeruginosa PA01
ccugcuucagguagugcaac

SEQ ID NO: 1503158 - RNA, 21 nt, Pseudomonas aeruginosa PA01
ccugcuucaggucgucgggca

SEQ ID NO: 1503159 - RNA, 22 nt, Pseudomonas aeruginosa PA01
ccugcuugggcgccucgccgcg

SEQ ID NO: 1503160 - RNA, 24 nt, Pseudomonas aeruginosa PA01
ccugcuugggcgccucgccgcggc

SEQ ID NO: 1503161 - RNA, 15 nt, Pseudomonas aeruginosa PA01
ccugcucuucggcgg

SEQ ID NO: 1503162 - RNA, 17 nt, Pseudomonas aeruginosa PA01
ccugcucuucggcggcc

SEQ ID NO: 1503163 - RNA, 18 nt, Pseudomonas aeruginosa PA01
ccugcucuucggcggcca

SEQ ID NO: 1503164 - RNA, 18 nt, Pseudomonas aeruginosa PA01
ccugcucuugccgacaag

SEQ ID NO: 1503165 - RNA, 18 nt, Pseudomonas aeruginosa PA01
ccugcucuuccagcgggc

SEQ ID NO: 1503166 - RNA, 19 nt, Pseudomonas aeruginosa PA01
ccugcugagcagucgccug

SEQ ID NO: 1503167 - RNA, 20 nt, Pseudomonas aeruginosa PA01
ccugcugagcagucgccugg

SEQ ID NO: 1503168 - RNA, 12 nt, Pseudomonas aeruginosa PA01
ccugcugcgcgg

SEQ ID NO: 1503169 - RNA, 22 nt, Pseudomonas aeruginosa PA01
ccugcugcgcgggugucgcgac

SEQ ID NO: 1503170 - RNA, 14 nt, Pseudomonas aeruginosa PA01
ccugcugcgccggc

SEQ ID NO: 1503171 - RNA, 16 nt, Pseudomonas aeruginosa PA01
ccugcugcgccggcac

SEQ ID NO: 1503172 - RNA, 23 nt, Pseudomonas aeruginosa PA01
ccugcugcgccggcacggcaucg

SEQ ID NO: 1503173 - RNA, 19 nt, Pseudomonas aeruginosa PA01
ccugcucggcucgcgguuc

SEQ ID NO: 1503174 - RNA, 14 nt, Pseudomonas aeruginosa PA01
ccugcucgcgcagc

SEQ ID NO: 1503175 - RNA, 15 nt, Pseudomonas aeruginosa PA01
ccugcucgcgcagcc

SEQ ID NO: 1503176 - RNA, 17 nt, Pseudomonas aeruginosa PA01
ccugcucgcgcaggguc

SEQ ID NO: 1503177 - RNA, 14 nt, Pseudomonas aeruginosa PA01
ccugcucgcggcug

SEQ ID NO: 1503178 - RNA, 13 nt, Pseudomonas aeruginosa PA01
ccugcucgcgggu

SEQ ID NO: 1503179 - RNA, 15 nt, Pseudomonas aeruginosa PA01
ccugcucgcggguca

SEQ ID NO: 1503180 - RNA, 18 nt, Pseudomonas aeruginosa PA01
ccugcucgauccagccgg

SEQ ID NO: 1503181 - RNA, 13 nt, Pseudomonas aeruginosa PA01
ccugcucgccgcu

SEQ ID NO: 1503182 - RNA, 15 nt, Pseudomonas aeruginosa PA01
ccugcucgccggcgc

SEQ ID NO: 1503183 - RNA, 18 nt, Pseudomonas aeruginosa PA01
ccugcucgcgcaccgcgg

SEQ ID NO: 1503184 - RNA, 20 nt, Pseudomonas aeruginosa PA01
ccugcucgcgcaccgcggcc

SEQ ID NO: 1503185 - RNA, 21 nt, Pseudomonas aeruginosa PA01
ccugcucgcgcaccgcggcca

SEQ ID NO: 1503186 - RNA, 17 nt, Pseudomonas aeruginosa PA01
ccugggguagccggccg

SEQ ID NO: 1503187 - RNA, 14 nt, Pseudomonas aeruginosa PA01
ccuggggcucggcu

SEQ ID NO: 1503188 - RNA, 23 nt, Pseudomonas aeruginosa PA01
ccugggguuucugcuggccaccg

SEQ ID NO: 1503189 - RNA, 17 nt, Pseudomonas aeruginosa PA01
ccuggguaccgacgguc

SEQ ID NO: 1503190 - RNA, 21 nt, Pseudomonas aeruginosa PA01
ccuggguaccgacggucggca

SEQ ID NO: 1503191 - RNA, 17 nt, Pseudomonas aeruginosa PA01
ccuggguacgcaccggc

SEQ ID NO: 1503192 - RNA, 21 nt, Pseudomonas aeruginosa PA01
ccuggguagauuuacaagccc

SEQ ID NO: 1503193 - RNA, 23 nt, Pseudomonas aeruginosa PA01
ccugggcggucggcucagccgac

SEQ ID NO: 1503194 - RNA, 22 nt, Pseudomonas aeruginosa PA01
ccuggggauggccggcgcggcg

SEQ ID NO: 1503195 - RNA, 15 nt, Pseudomonas aeruginosa PA01
ccugggcgucgacga

SEQ ID NO: 1503196 - RNA, 18 nt, Pseudomonas aeruginosa PA01
ccugggcgugcuuggcga

SEQ ID NO: 1503197 - RNA, 15 nt, Pseudomonas aeruginosa PA01
ccugggcguuggcca

SEQ ID NO: 1503198 - RNA, 14 nt, Pseudomonas aeruginosa PA01
ccugggcggcgggc

SEQ ID NO: 1503199 - RNA, 16 nt, Pseudomonas aeruginosa PA01
ccugggcgaagucgac

SEQ ID NO: 1503200 - RNA, 20 nt, Pseudomonas aeruginosa PA01
ccugggcgaagucgacgauc

SEQ ID NO: 1503201 - RNA, 13 nt, Pseudomonas aeruginosa PA01
ccugggcgcaggg

SEQ ID NO: 1503202 - RNA, 16 nt, Pseudomonas aeruginosa PA01
ccugggcgcaggggcg

SEQ ID NO: 1503203 - RNA, 15 nt, Pseudomonas aeruginosa PA01
ccugggcgccgccag

SEQ ID NO: 1503204 - RNA, 17 nt, Pseudomonas aeruginosa PA01
ccugggcgccgccagcc

SEQ ID NO: 1503205 - RNA, 18 nt, Pseudomonas aeruginosa PA01
ccugggcggcgaccugcg

SEQ ID NO: 1503206 - RNA, 12 nt, Pseudomonas aeruginosa PA01
ccugggccgcga

SEQ ID NO: 1503207 - RNA, 16 nt, Pseudomonas aeruginosa PA01
ccugggccgcgagguc

SEQ ID NO: 1503208 - RNA, 14 nt, Pseudomonas aeruginosa PA01
ccugggccgcgcug

SEQ ID NO: 1503209 - RNA, 20 nt, Pseudomonas aeruginosa PA01
ccugggccggcgccagcagg

SEQ ID NO: 1503210 - RNA, 13 nt, Pseudomonas aeruginosa PA01
ccugggccggcuu

SEQ ID NO: 1503211 - RNA, 20 nt, Pseudomonas aeruginosa PA01
ccuggcuacgcuccguaggg

SEQ ID NO: 1503212 - RNA, 16 nt, Pseudomonas aeruginosa PA01
ccuggcucgaucggca

SEQ ID NO: 1503213 - RNA, 23 nt, Pseudomonas aeruginosa PA01
ccuggcuccacugcuuggccagg

SEQ ID NO: 1503214 - RNA, 15 nt, Pseudomonas aeruginosa PA01
ccuggcucuugccgc

SEQ ID NO: 1503215 - RNA, 19 nt, Pseudomonas aeruginosa PA01
ccuggcucuugccgcgagc

SEQ ID NO: 1503216 - RNA, 20 nt, Pseudomonas aeruginosa PA01
ccuggcuuuccagggccugg

SEQ ID NO: 1503217 - RNA, 17 nt, Pseudomonas aeruginosa PA01
ccuggcuggccagcagg

SEQ ID NO: 1503218 - RNA, 19 nt, Pseudomonas aeruginosa PA01
ccuggcuggccagcaggcu

SEQ ID NO: 1503219 - RNA, 14 nt, Pseudomonas aeruginosa PA01
ccuggcuggaguag

SEQ ID NO: 1503220 - RNA, 14 nt, Pseudomonas aeruginosa PA01
ccugggaugccgcc

SEQ ID NO: 1503221 - RNA, 14 nt, Pseudomonas aeruginosa PA01
ccugggaugccggg

SEQ ID NO: 1503222 - RNA, 18 nt, Pseudomonas aeruginosa PA01
ccugggaugccgggccga

SEQ ID NO: 1503223 - RNA, 22 nt, Pseudomonas aeruginosa PA01
ccugggauggggcugccggccc

SEQ ID NO: 1503224 - RNA, 15 nt, Pseudomonas aeruginosa PA01
ccugggagccgccgg

SEQ ID NO: 1503225 - RNA, 22 nt, Pseudomonas aeruginosa PA01
ccugggaacccuugcgcaggua

SEQ ID NO: 1503226 - RNA, 16 nt, Pseudomonas aeruginosa PA01
ccugggaauggcggau

SEQ ID NO: 1503227 - RNA, 19 nt, Pseudomonas aeruginosa PA01
ccugggacaggcgucccug

SEQ ID NO: 1503228 - RNA, 15 nt, Pseudomonas aeruginosa PA01
ccugggccccggcca

SEQ ID NO: 1503229 - RNA, 17 nt, Pseudomonas aeruginosa PA01
ccugggccccggccagg

SEQ ID NO: 1503230 - RNA, 19 nt, Pseudomonas aeruginosa PA01
ccugggccccggccggcag

SEQ ID NO: 1503231 - RNA, 15 nt, Pseudomonas aeruginosa PA01
ccugggccgaaggcc

SEQ ID NO: 1503232 - RNA, 19 nt, Pseudomonas aeruginosa PA01
ccugggccgaaggccaggc

SEQ ID NO: 1503233 - RNA, 20 nt, Pseudomonas aeruginosa PA01
ccugggcaagcugcacggcg

SEQ ID NO: 1503234 - RNA, 21 nt, Pseudomonas aeruginosa PA01
ccugggcaagcugcacggcga

SEQ ID NO: 1503235 - RNA, 22 nt, Pseudomonas aeruginosa PA01
ccugggcaagcugcacggcgac

SEQ ID NO: 1503236 - RNA, 18 nt, Pseudomonas aeruginosa PA01
ccugguccagccagccgc

SEQ ID NO: 1503237 - RNA, 20 nt, Pseudomonas aeruginosa PA01
ccugguccuuauucggccca

SEQ ID NO: 1503238 - RNA, 23 nt, Pseudomonas aeruginosa PA01
ccugguccuuauucggcccaugc

SEQ ID NO: 1503239 - RNA, 15 nt, Pseudomonas aeruginosa PA01
ccugguagucgccgg

SEQ ID NO: 1503240 - RNA, 16 nt, Pseudomonas aeruginosa PA01
ccugguagucgccggu

SEQ ID NO: 1503241 - RNA, 18 nt, Pseudomonas aeruginosa PA01
ccugguaggcggcgacga

SEQ ID NO: 1503242 - RNA, 19 nt, Pseudomonas aeruginosa PA01
ccugguaggugcgcuggcg

SEQ ID NO: 1503243 - RNA, 23 nt, Pseudomonas aeruginosa PA01
ccugguaggugcgcuggcgccag

SEQ ID NO: 1503244 - RNA, 18 nt, Pseudomonas aeruginosa PA01
ccuggucauccuggcccu

SEQ ID NO: 1503245 - RNA, 17 nt, Pseudomonas aeruginosa PA01
ccuggggcggccucagg

SEQ ID NO: 1503246 - RNA, 14 nt, Pseudomonas aeruginosa PA01
ccuggguauugcgg

SEQ ID NO: 1503247 - RNA, 16 nt, Pseudomonas aeruginosa PA01
ccugguacagcaccca

SEQ ID NO: 1503248 - RNA, 19 nt, Pseudomonas aeruginosa PA01
ccugguacagcacccaggc

SEQ ID NO: 1503249 - RNA, 18 nt, Pseudomonas aeruginosa PA01
ccugggugcuuuccugcu

SEQ ID NO: 1503250 - RNA, 15 nt, Pseudomonas aeruginosa PA01
ccuggguggcgacga

SEQ ID NO: 1503251 - RNA, 20 nt, Pseudomonas aeruginosa PA01
ccuggguggucugcacggca

SEQ ID NO: 1503252 - RNA, 19 nt, Pseudomonas aeruginosa PA01
ccuggguugccgcgccgau

SEQ ID NO: 1503253 - RNA, 17 nt, Pseudomonas aeruginosa PA01
ccuggugaucaucgucc

SEQ ID NO: 1503254 - RNA, 13 nt, Pseudomonas aeruginosa PA01
ccuggugcacggc

SEQ ID NO: 1503255 - RNA, 16 nt, Pseudomonas aeruginosa PA01
ccuggugcacggcgac

SEQ ID NO: 1503256 - RNA, 19 nt, Pseudomonas aeruginosa PA01
ccuggugcaggucgcgcgg

SEQ ID NO: 1503257 - RNA, 20 nt, Pseudomonas aeruginosa PA01
ccuggugcaggucgcgcggc

SEQ ID NO: 1503258 - RNA, 15 nt, Pseudomonas aeruginosa PA01
ccugguggaacagcc

SEQ ID NO: 1503259 - RNA, 19 nt, Pseudomonas aeruginosa PA01
ccugguggaacagccgcag

SEQ ID NO: 1503260 - RNA, 23 nt, Pseudomonas aeruginosa PA01
ccugguggaacagccgcagcggc

SEQ ID NO: 1503261 - RNA, 24 nt, Pseudomonas aeruginosa PA01
ccugguggaacagccgcagcggca

SEQ ID NO: 1503262 - RNA, 20 nt, Pseudomonas aeruginosa PA01
ccugguggugaucagcggcc

SEQ ID NO: 1503263 - RNA, 23 nt, Pseudomonas aeruginosa PA01
ccuggugcccgaugccgcgccgg

SEQ ID NO: 1503264 - RNA, 21 nt, Pseudomonas aeruginosa PA01
ccuggugcggcaccagccagg

SEQ ID NO: 1503265 - RNA, 15 nt, Pseudomonas aeruginosa PA01
ccugguggcgccggc

SEQ ID NO: 1503266 - RNA, 17 nt, Pseudomonas aeruginosa PA01
ccugguggcgccggcug

SEQ ID NO: 1503267 - RNA, 19 nt, Pseudomonas aeruginosa PA01
ccugguggcgccggcugac

SEQ ID NO: 1503268 - RNA, 22 nt, Pseudomonas aeruginosa PA01
ccuggucgauauagcccugggc

SEQ ID NO: 1503269 - RNA, 18 nt, Pseudomonas aeruginosa PA01
ccuggucgaucucgucga

SEQ ID NO: 1503270 - RNA, 20 nt, Pseudomonas aeruginosa PA01
ccuggucgaucucgucgaag

SEQ ID NO: 1503271 - RNA, 13 nt, Pseudomonas aeruginosa PA01
ccuggucggcgcg

SEQ ID NO: 1503272 - RNA, 14 nt, Pseudomonas aeruginosa PA01
ccuggucggcgcgg

SEQ ID NO: 1503273 - RNA, 15 nt, Pseudomonas aeruginosa PA01
ccuggucggcgcggc

SEQ ID NO: 1503274 - RNA, 13 nt, Pseudomonas aeruginosa PA01
ccuggucggcggc

SEQ ID NO: 1503275 - RNA, 18 nt, Pseudomonas aeruginosa PA01
ccuggucggggccggcga

SEQ ID NO: 1503276 - RNA, 17 nt, Pseudomonas aeruginosa PA01
ccuggucgucguagugg

SEQ ID NO: 1503277 - RNA, 17 nt, Pseudomonas aeruginosa PA01
ccuggucguugcgcgca

SEQ ID NO: 1503278 - RNA, 22 nt, Pseudomonas aeruginosa PA01
ccuggccgggggucgcggcgac

SEQ ID NO: 1503279 - RNA, 20 nt, Pseudomonas aeruginosa PA01
ccuggccggucguucgcccu

SEQ ID NO: 1503280 - RNA, 22 nt, Pseudomonas aeruginosa PA01
ccuggccggucguucgcccuuc

SEQ ID NO: 1503281 - RNA, 14 nt, Pseudomonas aeruginosa PA01
ccuggccggugacg

SEQ ID NO: 1503282 - RNA, 23 nt, Pseudomonas aeruginosa PA01
ccuggccggugacgaaaccggcg

SEQ ID NO: 1503283 - RNA, 20 nt, Pseudomonas aeruginosa PA01
ccuggccguugaccagcgcg

SEQ ID NO: 1503284 - RNA, 22 nt, Pseudomonas aeruginosa PA01
ccuggccguugaccagcgcguc

SEQ ID NO: 1503285 - RNA, 18 nt, Pseudomonas aeruginosa PA01
ccuggccguugcgcaggc

SEQ ID NO: 1503286 - RNA, 19 nt, Pseudomonas aeruginosa PA01
ccuggccguugcgcaggcg

SEQ ID NO: 1503287 - RNA, 15 nt, Pseudomonas aeruginosa PA01
ccuggccguuggcga

SEQ ID NO: 1503288 - RNA, 23 nt, Pseudomonas aeruginosa PA01
ccuggccgugcucgaugaucgac

SEQ ID NO: 1503289 - RNA, 15 nt, Pseudomonas aeruginosa PA01
ccuggccuuggccac

SEQ ID NO: 1503290 - RNA, 22 nt, Pseudomonas aeruginosa PA01
ccuggccuuggccacgacccug

SEQ ID NO: 1503291 - RNA, 20 nt, Pseudomonas aeruginosa PA01
ccuggcgaugcccuggccgc

SEQ ID NO: 1503292 - RNA, 19 nt, Pseudomonas aeruginosa PA01
ccuggcgcaacgccggcag

SEQ ID NO: 1503293 - RNA, 20 nt, Pseudomonas aeruginosa PA01
ccuggcgcaacgccggcagg

SEQ ID NO: 1503294 - RNA, 14 nt, Pseudomonas aeruginosa PA01
ccuggcgcaaggug

SEQ ID NO: 1503295 - RNA, 12 nt, Pseudomonas aeruginosa PA01
ccuggccgccgu

SEQ ID NO: 1503296 - RNA, 19 nt, Pseudomonas aeruginosa PA01
ccuggccgcguucgccgag

SEQ ID NO: 1503297 - RNA, 23 nt, Pseudomonas aeruginosa PA01
ccuggccggcacccugaccgcga

SEQ ID NO: 1503298 - RNA, 13 nt, Pseudomonas aeruginosa PA01
ccuggccgcgcgg

SEQ ID NO: 1503299 - RNA, 15 nt, Pseudomonas aeruginosa PA01
ccuggccgcgcggcu

SEQ ID NO: 1503300 - RNA, 16 nt, Pseudomonas aeruginosa PA01
ccuggccggcgaaccg

SEQ ID NO: 1503301 - RNA, 13 nt, Pseudomonas aeruginosa PA01
ccuggccggcgac

SEQ ID NO: 1503302 - RNA, 14 nt, Pseudomonas aeruginosa PA01
ccuggccggcgacc

SEQ ID NO: 1503303 - RNA, 20 nt, Pseudomonas aeruginosa PA01
ccuggccggcgauggccgcc

SEQ ID NO: 1503304 - RNA, 14 nt, Pseudomonas aeruginosa PA01
ccuggccggccagc

SEQ ID NO: 1503305 - RNA, 12 nt, Pseudomonas aeruginosa PA01
ccuggccggccu

SEQ ID NO: 1503306 - RNA, 13 nt, Pseudomonas aeruginosa PA01
ccuggccgagcgg

SEQ ID NO: 1503307 - RNA, 15 nt, Pseudomonas aeruginosa PA01
ccuggcccuggcgca

SEQ ID NO: 1503308 - RNA, 17 nt, Pseudomonas aeruginosa PA01
ccuggcccuggcgcagg

SEQ ID NO: 1503309 - RNA, 18 nt, Pseudomonas aeruginosa PA01
ccuggcccugcaucgcga

SEQ ID NO: 1503310 - RNA, 15 nt, Pseudomonas aeruginosa PA01
ccuggcggcguggca

SEQ ID NO: 1503311 - RNA, 15 nt, Pseudomonas aeruginosa PA01
ccuggcggcugagcu

SEQ ID NO: 1503312 - RNA, 17 nt, Pseudomonas aeruginosa PA01
ccuggcggcuggcgugg

SEQ ID NO: 1503313 - RNA, 19 nt, Pseudomonas aeruginosa PA01
ccuggcgcucagcgccgcu

SEQ ID NO: 1503314 - RNA, 18 nt, Pseudomonas aeruginosa PA01
ccuggcggucgccgccgg

SEQ ID NO: 1503315 - RNA, 21 nt, Pseudomonas aeruginosa PA01
ccuggcggucgccgccggcga

SEQ ID NO: 1503316 - RNA, 23 nt, Pseudomonas aeruginosa PA01
ccuggcggucgccgccggcgaac

SEQ ID NO: 1503317 - RNA, 18 nt, Pseudomonas aeruginosa PA01
ccuggcgguagcccggca

SEQ ID NO: 1503318 - RNA, 19 nt, Pseudomonas aeruginosa PA01
ccuggcgguagcccggcag

SEQ ID NO: 1503319 - RNA, 20 nt, Pseudomonas aeruginosa PA01
ccuggcgguagcccggcagc

SEQ ID NO: 1503320 - RNA, 21 nt, Pseudomonas aeruginosa PA01
ccuggcgguugaugccgacgu

SEQ ID NO: 1503321 - RNA, 15 nt, Pseudomonas aeruginosa PA01
ccuggcguggccggc

SEQ ID NO: 1503322 - RNA, 18 nt, Pseudomonas aeruginosa PA01
ccuggcguggccggcgag

SEQ ID NO: 1503323 - RNA, 19 nt, Pseudomonas aeruginosa PA01
ccuggcguggccggcgagg

SEQ ID NO: 1503324 - RNA, 14 nt, Pseudomonas aeruginosa PA01
ccuggcgucccggg

SEQ ID NO: 1503325 - RNA, 15 nt, Pseudomonas aeruginosa PA01
ccuggcgucgcacug

SEQ ID NO: 1503326 - RNA, 16 nt, Pseudomonas aeruginosa PA01
ccuggcgucgcacugc

SEQ ID NO: 1503327 - RNA, 19 nt, Pseudomonas aeruginosa PA01
ccuggcgucgcacugcugc

SEQ ID NO: 1503328 - RNA, 13 nt, Pseudomonas aeruginosa PA01
ccuggcgugccgc

SEQ ID NO: 1503329 - RNA, 16 nt, Pseudomonas aeruginosa PA01
ccuggcgugccgccag

SEQ ID NO: 1503330 - RNA, 20 nt, Pseudomonas aeruginosa PA01
ccuggcgugccgccaggccu

SEQ ID NO: 1503331 - RNA, 20 nt, Pseudomonas aeruginosa PA01
ccuggcgcgacgaggcgcgg

SEQ ID NO: 1503332 - RNA, 19 nt, Pseudomonas aeruginosa PA01
ccuggcgcgagaagccagc

SEQ ID NO: 1503333 - RNA, 23 nt, Pseudomonas aeruginosa PA01
ccuggcgcgagaagccagccagg

SEQ ID NO: 1503334 - RNA, 12 nt, Pseudomonas aeruginosa PA01
ccuggcgccgac

SEQ ID NO: 1503335 - RNA, 13 nt, Pseudomonas aeruginosa PA01
ccuggcgccgacc

SEQ ID NO: 1503336 - RNA, 14 nt, Pseudomonas aeruginosa PA01
ccuggcgcagcggc

SEQ ID NO: 1503337 - RNA, 17 nt, Pseudomonas aeruginosa PA01
ccuggcgcagcggcagc

SEQ ID NO: 1503338 - RNA, 16 nt, Pseudomonas aeruginosa PA01
ccuggcgcaggcggcg

SEQ ID NO: 1503339 - RNA, 14 nt, Pseudomonas aeruginosa PA01
ccuggcgcauggcg

SEQ ID NO: 1503340 - RNA, 20 nt, Pseudomonas aeruginosa PA01
ccuggcgcauggcgcucuuc

SEQ ID NO: 1503341 - RNA, 16 nt, Pseudomonas aeruginosa PA01
ccuggcgcaugucgcg

SEQ ID NO: 1503342 - RNA, 17 nt, Pseudomonas aeruginosa PA01
ccuggcgcaugucgcga

SEQ ID NO: 1503343 - RNA, 19 nt, Pseudomonas aeruginosa PA01
ccuggcggauaucgcgccg

SEQ ID NO: 1503344 - RNA, 22 nt, Pseudomonas aeruginosa PA01
ccuggcgcugggccuugagcag

SEQ ID NO: 1503345 - RNA, 17 nt, Pseudomonas aeruginosa PA01
ccuggcgcugucgcccg

SEQ ID NO: 1503346 - RNA, 19 nt, Pseudomonas aeruginosa PA01
ccuggcgcguacgcccgca

SEQ ID NO: 1503347 - RNA, 18 nt, Pseudomonas aeruginosa PA01
ccuggcgcgucaugccgc

SEQ ID NO: 1503348 - RNA, 20 nt, Pseudomonas aeruginosa PA01
ccuggcgcgucaugccgccg

SEQ ID NO: 1503349 - RNA, 18 nt, Pseudomonas aeruginosa PA01
ccuggcgcgcgcgccagg

SEQ ID NO: 1503350 - RNA, 18 nt, Pseudomonas aeruginosa PA01
ccuggccaggcgcuccuc

SEQ ID NO: 1503351 - RNA, 21 nt, Pseudomonas aeruginosa PA01
ccuggccauucgcuucggcca

SEQ ID NO: 1503352 - RNA, 15 nt, Pseudomonas aeruginosa PA01
ccuggcagacgcugc

SEQ ID NO: 1503353 - RNA, 15 nt, Pseudomonas aeruginosa PA01
ccuggcaaccgucga

SEQ ID NO: 1503354 - RNA, 19 nt, Pseudomonas aeruginosa PA01
ccuggcagguaucgcuggg

SEQ ID NO: 1503355 - RNA, 23 nt, Pseudomonas aeruginosa PA01
ccuggcauggcuuuccaggcgcc

SEQ ID NO: 1503356 - RNA, 16 nt, Pseudomonas aeruginosa PA01
ccuggaucaccgcggc

SEQ ID NO: 1503357 - RNA, 18 nt, Pseudomonas aeruginosa PA01
ccuggaucaccgcggcgc

SEQ ID NO: 1503358 - RNA, 21 nt, Pseudomonas aeruginosa PA01
ccuggaucaccgcggcgcuga

SEQ ID NO: 1503359 - RNA, 22 nt, Pseudomonas aeruginosa PA01
ccuggaucacgcugaggaaggg

SEQ ID NO: 1503360 - RNA, 15 nt, Pseudomonas aeruginosa PA01
ccuggauacgcucgg

SEQ ID NO: 1503361 - RNA, 16 nt, Pseudomonas aeruginosa PA01
ccuggauacgcucggc

SEQ ID NO: 1503362 - RNA, 18 nt, Pseudomonas aeruginosa PA01
ccuggaucgccaggcuga

SEQ ID NO: 1503363 - RNA, 19 nt, Pseudomonas aeruginosa PA01
ccuggaucgccaggcugau

SEQ ID NO: 1503364 - RNA, 15 nt, Pseudomonas aeruginosa PA01
ccuggaucggcagcu

SEQ ID NO: 1503365 - RNA, 18 nt, Pseudomonas aeruginosa PA01
ccuggaucggcagcucgc

SEQ ID NO: 1503366 - RNA, 15 nt, Pseudomonas aeruginosa PA01
ccuggaucucggcgg

SEQ ID NO: 1503367 - RNA, 15 nt, Pseudomonas aeruginosa PA01
ccuggaucucugcga

SEQ ID NO: 1503368 - RNA, 19 nt, Pseudomonas aeruginosa PA01
ccuggaugucgaagcgcag

SEQ ID NO: 1503369 - RNA, 18 nt, Pseudomonas aeruginosa PA01
ccuggaugcuccgcgccu

SEQ ID NO: 1503370 - RNA, 12 nt, Pseudomonas aeruginosa PA01
ccuggaucgcca

SEQ ID NO: 1503371 - RNA, 17 nt, Pseudomonas aeruginosa PA01
ccuggaugaucgcgugg

SEQ ID NO: 1503372 - RNA, 21 nt, Pseudomonas aeruginosa PA01
ccuggaugaucgcgugggcca

SEQ ID NO: 1503373 - RNA, 18 nt, Pseudomonas aeruginosa PA01
ccuggaugaucucgcagu

SEQ ID NO: 1503374 - RNA, 16 nt, Pseudomonas aeruginosa PA01
ccuggaaugccggccg

SEQ ID NO: 1503375 - RNA, 20 nt, Pseudomonas aeruginosa PA01
ccuggaaugccggccggggc

SEQ ID NO: 1503376 - RNA, 17 nt, Pseudomonas aeruginosa PA01
ccuggaaguauucggcg

SEQ ID NO: 1503377 - RNA, 13 nt, Pseudomonas aeruginosa PA01
ccuggaagcgggu

SEQ ID NO: 1503378 - RNA, 14 nt, Pseudomonas aeruginosa PA01
ccuggaagcggguu

SEQ ID NO: 1503379 - RNA, 21 nt, Pseudomonas aeruginosa PA01
ccuggaacuagcccucgaccu

SEQ ID NO: 1503380 - RNA, 22 nt, Pseudomonas aeruginosa PA01
ccuggaacuagcccucgaccug

SEQ ID NO: 1503381 - RNA, 20 nt, Pseudomonas aeruginosa PA01
ccuggaacuggucggggcgc

SEQ ID NO: 1503382 - RNA, 18 nt, Pseudomonas aeruginosa PA01
ccuggaaaggccucggcg

SEQ ID NO: 1503383 - RNA, 19 nt, Pseudomonas aeruginosa PA01
ccuggaaaggccucggcga

SEQ ID NO: 1503384 - RNA, 22 nt, Pseudomonas aeruginosa PA01
ccuggaaaggccucggcgaugc

SEQ ID NO: 1503385 - RNA, 14 nt, Pseudomonas aeruginosa PA01
ccuggaacaccagg

SEQ ID NO: 1503386 - RNA, 19 nt, Pseudomonas aeruginosa PA01
ccuggaaagaccggcgccc

SEQ ID NO: 1503387 - RNA, 18 nt, Pseudomonas aeruginosa PA01
ccugcuuggccagcgcgg

SEQ ID NO: 1503388 - RNA, 17 nt, Pseudomonas aeruginosa PA01
ccugcuugucgaugguc

SEQ ID NO: 1503389 - RNA, 21 nt, Pseudomonas aeruginosa PA01
ccugcuuucccugcugcggca

SEQ ID NO: 1503390 - RNA, 22 nt, Pseudomonas aeruginosa PA01
ccuggacgugggaaaucaccgc

SEQ ID NO: 1503391 - RNA, 14 nt, Pseudomonas aeruginosa PA01
ccuggagcagggcg

SEQ ID NO: 1503392 - RNA, 18 nt, Pseudomonas aeruginosa PA01
ccuggagguagcugcgcc

SEQ ID NO: 1503393 - RNA, 19 nt, Pseudomonas aeruginosa PA01
ccuggagaaauccggcugg

SEQ ID NO: 1503394 - RNA, 15 nt, Pseudomonas aeruginosa PA01
ccuggauaagccgcg

SEQ ID NO: 1503395 - RNA, 15 nt, Pseudomonas aeruginosa PA01
ccuggacccgggccu

SEQ ID NO: 1503396 - RNA, 21 nt, Pseudomonas aeruginosa PA01
ccuggacccguugccgaccga

SEQ ID NO: 1503397 - RNA, 22 nt, Pseudomonas aeruginosa PA01
ccuggaccucggguuuggcgcc

SEQ ID NO: 1503398 - RNA, 17 nt, Pseudomonas aeruginosa PA01
ccugcaccacgucggaa

SEQ ID NO: 1503399 - RNA, 19 nt, Pseudomonas aeruginosa PA01
ccugcaccagccaguccgg

SEQ ID NO: 1503400 - RNA, 18 nt, Pseudomonas aeruginosa PA01
ccugcaauggggcggccg

SEQ ID NO: 1503401 - RNA, 19 nt, Pseudomonas aeruginosa PA01
ccugcaauggggcggccgg

SEQ ID NO: 1503402 - RNA, 19 nt, Pseudomonas aeruginosa PA01
ccugcaauuccaccggcug

SEQ ID NO: 1503403 - RNA, 16 nt, Pseudomonas aeruginosa PA01
ccugcaaggcggugac

SEQ ID NO: 1503404 - RNA, 15 nt, Pseudomonas aeruginosa PA01
ccugcacccuuggcg

SEQ ID NO: 1503405 - RNA, 22 nt, Pseudomonas aeruginosa PA01
ccugcaacgccuggugcagguc

SEQ ID NO: 1503406 - RNA, 14 nt, Pseudomonas aeruginosa PA01
ccugcaacucggcg

SEQ ID NO: 1503407 - RNA, 15 nt, Pseudomonas aeruginosa PA01
ccugcaacucggcgc

SEQ ID NO: 1503408 - RNA, 18 nt, Pseudomonas aeruginosa PA01
ccugcaacucgucgucca

SEQ ID NO: 1503409 - RNA, 19 nt, Pseudomonas aeruginosa PA01
ccugcaacucgucguccag

SEQ ID NO: 1503410 - RNA, 15 nt, Pseudomonas aeruginosa PA01
ccugcaacugcucga

SEQ ID NO: 1503411 - RNA, 22 nt, Pseudomonas aeruginosa PA01
ccugcaacuggaaggccgcgcc

SEQ ID NO: 1503412 - RNA, 13 nt, Pseudomonas aeruginosa PA01
ccugcaacgccgc

SEQ ID NO: 1503413 - RNA, 15 nt, Pseudomonas aeruginosa PA01
ccugcaacgccgcca

SEQ ID NO: 1503414 - RNA, 22 nt, Pseudomonas aeruginosa PA01
ccugcaacaguggguaggccag

SEQ ID NO: 1503415 - RNA, 13 nt, Pseudomonas aeruginosa PA01
ccugcaacgccag

SEQ ID NO: 1503416 - RNA, 23 nt, Pseudomonas aeruginosa PA01
ccugcaacgccagcaggcgcagg

SEQ ID NO: 1503417 - RNA, 14 nt, Pseudomonas aeruginosa PA01
ccugcaacgcccgc

SEQ ID NO: 1503418 - RNA, 16 nt, Pseudomonas aeruginosa PA01
ccugcaacgcccgcga

SEQ ID NO: 1503419 - RNA, 18 nt, Pseudomonas aeruginosa PA01
ccugcaacgcccgcgagc

SEQ ID NO: 1503420 - RNA, 23 nt, Pseudomonas aeruginosa PA01
ccugcaaacgggcaucgucgaag

SEQ ID NO: 1503421 - RNA, 23 nt, Pseudomonas aeruginosa PA01
ccugcaaagaggcgcucaacgcc

SEQ ID NO: 1503422 - RNA, 16 nt, Pseudomonas aeruginosa PA01
ccugcaaagcggcgac

SEQ ID NO: 1503423 - RNA, 21 nt, Pseudomonas aeruginosa PA01
ccugcaaagcggcgacgccac

SEQ ID NO: 1503424 - RNA, 17 nt, Pseudomonas aeruginosa PA01
ccugcaacacguagcgc

SEQ ID NO: 1503425 - RNA, 18 nt, Pseudomonas aeruginosa PA01
ccugcaacacgucggacu

SEQ ID NO: 1503426 - RNA, 22 nt, Pseudomonas aeruginosa PA01
ccugcaacagaaguugcuggcg

SEQ ID NO: 1503427 - RNA, 16 nt, Pseudomonas aeruginosa PA01
ccugcagcgacuccag

SEQ ID NO: 1503428 - RNA, 23 nt, Pseudomonas aeruginosa PA01
ccugcagcgcgcgcuggucguag

SEQ ID NO: 1503429 - RNA, 12 nt, Pseudomonas aeruginosa PA01
ccugcagcgccu

SEQ ID NO: 1503430 - RNA, 23 nt, Pseudomonas aeruginosa PA01
ccugcaggccgaauccgccggcg

SEQ ID NO: 1503431 - RNA, 18 nt, Pseudomonas aeruginosa PA01
ccugcaccugcucggggc

SEQ ID NO: 1503432 - RNA, 14 nt, Pseudomonas aeruginosa PA01
ccugcacgcugcgc

SEQ ID NO: 1503433 - RNA, 17 nt, Pseudomonas aeruginosa PA01
ccugcacggauaccacc

SEQ ID NO: 1503434 - RNA, 16 nt, Pseudomonas aeruginosa PA01
ccugcagccagcuuca

SEQ ID NO: 1503435 - RNA, 17 nt, Pseudomonas aeruginosa PA01
ccugcagcaggucgagc

SEQ ID NO: 1503436 - RNA, 19 nt, Pseudomonas aeruginosa PA01
ccugcagcaggucgagcag

SEQ ID NO: 1503437 - RNA, 19 nt, Pseudomonas aeruginosa PA01
ccugcagcaccaccucgcc

SEQ ID NO: 1503438 - RNA, 20 nt, Pseudomonas aeruginosa PA01
ccugcagcaccaccucgcca

SEQ ID NO: 1503439 - RNA, 20 nt, Pseudomonas aeruginosa PA01
ccugcagacgguucagcagc

SEQ ID NO: 1503440 - RNA, 21 nt, Pseudomonas aeruginosa PA01
ccugcagacgguucagcagcg

SEQ ID NO: 1503441 - RNA, 17 nt, Pseudomonas aeruginosa PA01
ccugcaucaccaggcug

SEQ ID NO: 1503442 - RNA, 22 nt, Pseudomonas aeruginosa PA01
ccugcagguagcgcugcgcccg

SEQ ID NO: 1503443 - RNA, 23 nt, Pseudomonas aeruginosa PA01
ccugcaugccggccgucgcgcac

SEQ ID NO: 1503444 - RNA, 20 nt, Pseudomonas aeruginosa PA01
ccugcaucacguacggcgcc

SEQ ID NO: 1503445 - RNA, 20 nt, Pseudomonas aeruginosa PA01
ccugcaugcuuuugaacacc

SEQ ID NO: 1503446 - RNA, 23 nt, Pseudomonas aeruginosa PA01
ccugccagaaaacccagcgaagc

SEQ ID NO: 1503447 - RNA, 15 nt, Pseudomonas aeruginosa PA01
ccugccagaccgaga

SEQ ID NO: 1503448 - RNA, 18 nt, Pseudomonas aeruginosa PA01
ccugccagaccguggcgc

SEQ ID NO: 1503449 - RNA, 19 nt, Pseudomonas aeruginosa PA01
ccugccagaggaucggcca

SEQ ID NO: 1503450 - RNA, 19 nt, Pseudomonas aeruginosa PA01
ccugacgcaagcgcucggc

SEQ ID NO: 1503451 - RNA, 15 nt, Pseudomonas aeruginosa PA01
ccugaccaucgucgc

SEQ ID NO: 1503452 - RNA, 14 nt, Pseudomonas aeruginosa PA01
ccugaccccggccu

SEQ ID NO: 1503453 - RNA, 19 nt, Pseudomonas aeruginosa PA01
ccugaccccggccuggcug

SEQ ID NO: 1503454 - RNA, 15 nt, Pseudomonas aeruginosa PA01
ccugacccgcuccuc

SEQ ID NO: 1503455 - RNA, 21 nt, Pseudomonas aeruginosa PA01
ccugacccgcuccucgucgag

SEQ ID NO: 1503456 - RNA, 19 nt, Pseudomonas aeruginosa PA01
ccugaccguccuggcccug

SEQ ID NO: 1503457 - RNA, 19 nt, Pseudomonas aeruginosa PA01
ccugagaucagcgcccggc

SEQ ID NO: 1503458 - RNA, 22 nt, Pseudomonas aeruginosa PA01
ccugagcugccgcuucggcugc

SEQ ID NO: 1503459 - RNA, 13 nt, Pseudomonas aeruginosa PA01
ccugagcuggcug

SEQ ID NO: 1503460 - RNA, 13 nt, Pseudomonas aeruginosa PA01
ccugagccggccg

SEQ ID NO: 1503461 - RNA, 16 nt, Pseudomonas aeruginosa PA01
ccugaaggcgcggggc

SEQ ID NO: 1503462 - RNA, 18 nt, Pseudomonas aeruginosa PA01
ccugaacgcgcccggcca

SEQ ID NO: 1503463 - RNA, 21 nt, Pseudomonas aeruginosa PA01
ccucuugaaaacugucggcgg

SEQ ID NO: 1503464 - RNA, 15 nt, Pseudomonas aeruginosa PA01
ccucuuccgcgcuga

SEQ ID NO: 1503465 - RNA, 18 nt, Pseudomonas aeruginosa PA01
ccucuucgccauccuuga

SEQ ID NO: 1503466 - RNA, 17 nt, Pseudomonas aeruginosa PA01
ccucuaugggacgaccu

SEQ ID NO: 1503467 - RNA, 21 nt, Pseudomonas aeruginosa PA01
ccucuaugaaccggggcggcc

SEQ ID NO: 1503468 - RNA, 22 nt, Pseudomonas aeruginosa PA01
ccucuaaggaaaaacccggccc

SEQ ID NO: 1503469 - RNA, 15 nt, Pseudomonas aeruginosa PA01
ccucguucagcagca

SEQ ID NO: 1503470 - RNA, 23 nt, Pseudomonas aeruginosa PA01
ccucguucagcagcaugccgcuc

SEQ ID NO: 1503471 - RNA, 18 nt, Pseudomonas aeruginosa PA01
ccucguuccacgggucgc

SEQ ID NO: 1503472 - RNA, 17 nt, Pseudomonas aeruginosa PA01
ccucguggaacagcgcg

SEQ ID NO: 1503473 - RNA, 19 nt, Pseudomonas aeruginosa PA01
ccucguggaacagcgcguc

SEQ ID NO: 1503474 - RNA, 18 nt, Pseudomonas aeruginosa PA01
ccucguucgucgccgacu

SEQ ID NO: 1503475 - RNA, 19 nt, Pseudomonas aeruginosa PA01
ccucgugggugccgggggc

SEQ ID NO: 1503476 - RNA, 17 nt, Pseudomonas aeruginosa PA01
ccucugaccgcgcccgg

SEQ ID NO: 1503477 - RNA, 18 nt, Pseudomonas aeruginosa PA01
ccucugaccgcgcccgga

SEQ ID NO: 1503478 - RNA, 17 nt, Pseudomonas aeruginosa PA01
ccucucucgccucggcg

SEQ ID NO: 1503479 - RNA, 14 nt, Pseudomonas aeruginosa PA01
ccucucucgcugcg

SEQ ID NO: 1503480 - RNA, 16 nt, Pseudomonas aeruginosa PA01
ccucucucgcugcgcg

SEQ ID NO: 1503481 - RNA, 16 nt, Pseudomonas aeruginosa PA01
ccucugcgcugagcag

SEQ ID NO: 1503482 - RNA, 12 nt, Pseudomonas aeruginosa PA01
ccuccagccgcg

SEQ ID NO: 1503483 - RNA, 13 nt, Pseudomonas aeruginosa PA01
ccuccagccggcg

SEQ ID NO: 1503484 - RNA, 14 nt, Pseudomonas aeruginosa PA01
ccuccagccggcga

SEQ ID NO: 1503485 - RNA, 15 nt, Pseudomonas aeruginosa PA01
ccuccaguuccucgc

SEQ ID NO: 1503486 - RNA, 16 nt, Pseudomonas aeruginosa PA01
ccucccaccgcgcggc

SEQ ID NO: 1503487 - RNA, 14 nt, Pseudomonas aeruginosa PA01
ccuccaggaccagg

SEQ ID NO: 1503488 - RNA, 19 nt, Pseudomonas aeruginosa PA01
ccuccaggccgaagccgcc

SEQ ID NO: 1503489 - RNA, 22 nt, Pseudomonas aeruginosa PA01
ccuccaggccgaagccgccggg

SEQ ID NO: 1503490 - RNA, 15 nt, Pseudomonas aeruginosa PA01
ccuccaggccgccgg

SEQ ID NO: 1503491 - RNA, 17 nt, Pseudomonas aeruginosa PA01
ccuccaggccgccggcg

SEQ ID NO: 1503492 - RNA, 18 nt, Pseudomonas aeruginosa PA01
ccuccaggccgccggcga

SEQ ID NO: 1503493 - RNA, 12 nt, Pseudomonas aeruginosa PA01
ccuccaggcgcg

SEQ ID NO: 1503494 - RNA, 14 nt, Pseudomonas aeruginosa PA01
ccuccaggcgcgcc

SEQ ID NO: 1503495 - RNA, 13 nt, Pseudomonas aeruginosa PA01
ccuccaggcucag

SEQ ID NO: 1503496 - RNA, 14 nt, Pseudomonas aeruginosa PA01
ccuccaggcuggcc

SEQ ID NO: 1503497 - RNA, 20 nt, Pseudomonas aeruginosa PA01
ccuccaggcuggccuuggcc

SEQ ID NO: 1503498 - RNA, 15 nt, Pseudomonas aeruginosa PA01
ccuccagggucgccc

SEQ ID NO: 1503499 - RNA, 21 nt, Pseudomonas aeruginosa PA01
ccuccagggucgcccgugccu

SEQ ID NO: 1503500 - RNA, 23 nt, Pseudomonas aeruginosa PA01
ccuccagguaggcgcccuugacg

SEQ ID NO: 1503501 - RNA, 14 nt, Pseudomonas aeruginosa PA01
ccuccagcgccgca

SEQ ID NO: 1503502 - RNA, 19 nt, Pseudomonas aeruginosa PA01
ccuccagcgccgccaggcg

SEQ ID NO: 1503503 - RNA, 13 nt, Pseudomonas aeruginosa PA01
ccuccagcggcgg

SEQ ID NO: 1503504 - RNA, 16 nt, Pseudomonas aeruginosa PA01
ccuccagcggcgggaa

SEQ ID NO: 1503505 - RNA, 12 nt, Pseudomonas aeruginosa PA01
ccuccagcggcu

SEQ ID NO: 1503506 - RNA, 22 nt, Pseudomonas aeruginosa PA01
ccuccagcgggccuucgccagc

SEQ ID NO: 1503507 - RNA, 22 nt, Pseudomonas aeruginosa PA01
ccuccagcgucugccgcuggcg

SEQ ID NO: 1503508 - RNA, 14 nt, Pseudomonas aeruginosa PA01
ccuccagcugcgcc

SEQ ID NO: 1503509 - RNA, 15 nt, Pseudomonas aeruginosa PA01
ccuccagcugcgccu

SEQ ID NO: 1503510 - RNA, 12 nt, Pseudomonas aeruginosa PA01
ccuccccggccc

SEQ ID NO: 1503511 - RNA, 13 nt, Pseudomonas aeruginosa PA01
ccuccccguccug

SEQ ID NO: 1503512 - RNA, 13 nt, Pseudomonas aeruginosa PA01
ccucccagccgug

SEQ ID NO: 1503513 - RNA, 12 nt, Pseudomonas aeruginosa PA01
ccucccgcgcca

SEQ ID NO: 1503514 - RNA, 17 nt, Pseudomonas aeruginosa PA01
ccucccgcgccagcgcc

SEQ ID NO: 1503515 - RNA, 15 nt, Pseudomonas aeruginosa PA01
ccuccaucgccucgc

SEQ ID NO: 1503516 - RNA, 17 nt, Pseudomonas aeruginosa PA01
ccucccugcccgcucgg

SEQ ID NO: 1503517 - RNA, 13 nt, Pseudomonas aeruginosa PA01
ccuccucggcggc

SEQ ID NO: 1503518 - RNA, 14 nt, Pseudomonas aeruginosa PA01
ccuccucggcggcu

SEQ ID NO: 1503519 - RNA, 20 nt, Pseudomonas aeruginosa PA01
ccuccucggcggcuuccucc

SEQ ID NO: 1503520 - RNA, 17 nt, Pseudomonas aeruginosa PA01
ccuccuggaaagaccgg

SEQ ID NO: 1503521 - RNA, 17 nt, Pseudomonas aeruginosa PA01
ccuccuggauacgcucg

SEQ ID NO: 1503522 - RNA, 20 nt, Pseudomonas aeruginosa PA01
ccuccuggcgcgucggccgc

SEQ ID NO: 1503523 - RNA, 12 nt, Pseudomonas aeruginosa PA01
ccuccuggcggc

SEQ ID NO: 1503524 - RNA, 16 nt, Pseudomonas aeruginosa PA01
ccuccuguucgcgcgc

SEQ ID NO: 1503525 - RNA, 17 nt, Pseudomonas aeruginosa PA01
ccuccuucgagccuggc

SEQ ID NO: 1503526 - RNA, 16 nt, Pseudomonas aeruginosa PA01
ccucgaaagccgccgc

SEQ ID NO: 1503527 - RNA, 17 nt, Pseudomonas aeruginosa PA01
ccucgaaccccuggcgc

SEQ ID NO: 1503528 - RNA, 20 nt, Pseudomonas aeruginosa PA01
ccucgaaccccuggcgcucg

SEQ ID NO: 1503529 - RNA, 13 nt, Pseudomonas aeruginosa PA01
ccucgacgccgag

SEQ ID NO: 1503530 - RNA, 13 nt, Pseudomonas aeruginosa PA01
ccucgacgcccgc

SEQ ID NO: 1503531 - RNA, 23 nt, Pseudomonas aeruginosa PA01
ccucgacgcccgcuugcgccgcc

SEQ ID NO: 1503532 - RNA, 18 nt, Pseudomonas aeruginosa PA01
ccucgacggcgaucucag

SEQ ID NO: 1503533 - RNA, 20 nt, Pseudomonas aeruginosa PA01
ccucgaacagcuugccgcug

SEQ ID NO: 1503534 - RNA, 18 nt, Pseudomonas aeruginosa PA01
ccucgaagaaaaggcccg

SEQ ID NO: 1503535 - RNA, 19 nt, Pseudomonas aeruginosa PA01
ccucgaagaaaaggcccgg

SEQ ID NO: 1503536 - RNA, 20 nt, Pseudomonas aeruginosa PA01
ccucgaagaaaaggcccggc

SEQ ID NO: 1503537 - RNA, 19 nt, Pseudomonas aeruginosa PA01
ccuccagcaggaccuggcc

SEQ ID NO: 1503538 - RNA, 12 nt, Pseudomonas aeruginosa PA01
ccuccagcacuc

SEQ ID NO: 1503539 - RNA, 19 nt, Pseudomonas aeruginosa PA01
ccuccagcacucgcuccuc

SEQ ID NO: 1503540 - RNA, 14 nt, Pseudomonas aeruginosa PA01
ccuccagccagcag

SEQ ID NO: 1503541 - RNA, 20 nt, Pseudomonas aeruginosa PA01
ccuccagccagcagcccggc

SEQ ID NO: 1503542 - RNA, 15 nt, Pseudomonas aeruginosa PA01
ccuccagcaccggga

SEQ ID NO: 1503543 - RNA, 18 nt, Pseudomonas aeruginosa PA01
ccuccagagugcgcagca

SEQ ID NO: 1503544 - RNA, 23 nt, Pseudomonas aeruginosa PA01
ccuccagagugcgcagcagcguc

SEQ ID NO: 1503545 - RNA, 17 nt, Pseudomonas aeruginosa PA01
ccuccaccucgacccug

SEQ ID NO: 1503546 - RNA, 13 nt, Pseudomonas aeruginosa PA01
ccuccaccuugcg

SEQ ID NO: 1503547 - RNA, 14 nt, Pseudomonas aeruginosa PA01
ccucagcagcgccg

SEQ ID NO: 1503548 - RNA, 21 nt, Pseudomonas aeruginosa PA01
ccucagcgccgguagcggcgc

SEQ ID NO: 1503549 - RNA, 19 nt, Pseudomonas aeruginosa PA01
ccucagccucacccugcug

SEQ ID NO: 1503550 - RNA, 15 nt, Pseudomonas aeruginosa PA01
ccucagcgacauccc

SEQ ID NO: 1503551 - RNA, 20 nt, Pseudomonas aeruginosa PA01
ccucagaggcgaccagccgg

SEQ ID NO: 1503552 - RNA, 19 nt, Pseudomonas aeruginosa PA01
ccucagagucgcaccggga

SEQ ID NO: 1503553 - RNA, 17 nt, Pseudomonas aeruginosa PA01
ccucacggcgcagccgc

SEQ ID NO: 1503554 - RNA, 18 nt, Pseudomonas aeruginosa PA01
ccucacggcgcagccgca

SEQ ID NO: 1503555 - RNA, 21 nt, Pseudomonas aeruginosa PA01
ccucacggguguuucggccgc

SEQ ID NO: 1503556 - RNA, 24 nt, Pseudomonas aeruginosa PA01
ccucacggguguuucggccgcugc

SEQ ID NO: 1503557 - RNA, 16 nt, Pseudomonas aeruginosa PA01
ccucacggucgcaggg

SEQ ID NO: 1503558 - RNA, 16 nt, Pseudomonas aeruginosa PA01
ccguggugcccgggug

SEQ ID NO: 1503559 - RNA, 15 nt, Pseudomonas aeruginosa PA01
ccgugguccgccagc

SEQ ID NO: 1503560 - RNA, 18 nt, Pseudomonas aeruginosa PA01
ccgugguccgccagcagg

SEQ ID NO: 1503561 - RNA, 13 nt, Pseudomonas aeruginosa PA01
ccguggucgccgc

SEQ ID NO: 1503562 - RNA, 13 nt, Pseudomonas aeruginosa PA01
ccgugggccgccg

SEQ ID NO: 1503563 - RNA, 14 nt, Pseudomonas aeruginosa PA01
ccgugggccgccga

SEQ ID NO: 1503564 - RNA, 16 nt, Pseudomonas aeruginosa PA01
ccgugggggggaaggg

SEQ ID NO: 1503565 - RNA, 18 nt, Pseudomonas aeruginosa PA01
ccgugggggggaagggcc

SEQ ID NO: 1503566 - RNA, 21 nt, Pseudomonas aeruginosa PA01
ccgugggucguugagggcacg

SEQ ID NO: 1503567 - RNA, 18 nt, Pseudomonas aeruginosa PA01
ccgugguagucgagccgg

SEQ ID NO: 1503568 - RNA, 22 nt, Pseudomonas aeruginosa PA01
ccguggucagcaccagggccag

SEQ ID NO: 1503569 - RNA, 16 nt, Pseudomonas aeruginosa PA01
ccucggcaucgaccag

SEQ ID NO: 1503570 - RNA, 23 nt, Pseudomonas aeruginosa PA01
ccucggcaucgaccagggccggg

SEQ ID NO: 1503571 - RNA, 18 nt, Pseudomonas aeruginosa PA01
ccucggcagggcgcccgc

SEQ ID NO: 1503572 - RNA, 22 nt, Pseudomonas aeruginosa PA01
ccucggcagggcgcccgcccgg

SEQ ID NO: 1503573 - RNA, 17 nt, Pseudomonas aeruginosa PA01
ccucggcauccucgccc

SEQ ID NO: 1503574 - RNA, 15 nt, Pseudomonas aeruginosa PA01
ccucggcagcgcugg

SEQ ID NO: 1503575 - RNA, 23 nt, Pseudomonas aeruginosa PA01
ccucggcagcgcuggcgaucacc

SEQ ID NO: 1503576 - RNA, 14 nt, Pseudomonas aeruginosa PA01
ccucggaugccgca

SEQ ID NO: 1503577 - RNA, 15 nt, Pseudomonas aeruginosa PA01
ccucggccagccagg

SEQ ID NO: 1503578 - RNA, 17 nt, Pseudomonas aeruginosa PA01
ccucggccagccagggc

SEQ ID NO: 1503579 - RNA, 16 nt, Pseudomonas aeruginosa PA01
ccucggccagcgccgc

SEQ ID NO: 1503580 - RNA, 18 nt, Pseudomonas aeruginosa PA01
ccucggccaggaccaggg

SEQ ID NO: 1503581 - RNA, 13 nt, Pseudomonas aeruginosa PA01
ccucggccaggca

SEQ ID NO: 1503582 - RNA, 13 nt, Pseudomonas aeruginosa PA01
ccucggccaggcg

SEQ ID NO: 1503583 - RNA, 23 nt, Pseudomonas aeruginosa PA01
ccucggccauaccuccagccagc

SEQ ID NO: 1503584 - RNA, 16 nt, Pseudomonas aeruginosa PA01
ccucggccaugccggc

SEQ ID NO: 1503585 - RNA, 18 nt, Pseudomonas aeruginosa PA01
ccucggccaugccggcca

SEQ ID NO: 1503586 - RNA, 18 nt, Pseudomonas aeruginosa PA01
ccucggcggacagcccgc

SEQ ID NO: 1503587 - RNA, 23 nt, Pseudomonas aeruginosa PA01
ccucggcggacagcccgcgcucg

SEQ ID NO: 1503588 - RNA, 16 nt, Pseudomonas aeruginosa PA01
ccucggcccuggcggc

SEQ ID NO: 1503589 - RNA, 12 nt, Pseudomonas aeruginosa PA01
ccucggccgcca

SEQ ID NO: 1503590 - RNA, 13 nt, Pseudomonas aeruginosa PA01
ccucggccgccag

SEQ ID NO: 1503591 - RNA, 15 nt, Pseudomonas aeruginosa PA01
ccucggccgccaggc

SEQ ID NO: 1503592 - RNA, 22 nt, Pseudomonas aeruginosa PA01
ccucggcggcggccugcucgcg

SEQ ID NO: 1503593 - RNA, 20 nt, Pseudomonas aeruginosa PA01
ccucggcgggagagggcggc

SEQ ID NO: 1503594 - RNA, 12 nt, Pseudomonas aeruginosa PA01
ccucggcggcgg

SEQ ID NO: 1503595 - RNA, 15 nt, Pseudomonas aeruginosa PA01
ccucguccgacagca

SEQ ID NO: 1503596 - RNA, 17 nt, Pseudomonas aeruginosa PA01
ccucguccgacagcagg

SEQ ID NO: 1503597 - RNA, 19 nt, Pseudomonas aeruginosa PA01
ccucguccgacagcagguc

SEQ ID NO: 1503598 - RNA, 16 nt, Pseudomonas aeruginosa PA01
ccucguacaugcgcga

SEQ ID NO: 1503599 - RNA, 20 nt, Pseudomonas aeruginosa PA01
ccucguaggccgacucgcga

SEQ ID NO: 1503600 - RNA, 13 nt, Pseudomonas aeruginosa PA01
ccucgugcucggg

SEQ ID NO: 1503601 - RNA, 16 nt, Pseudomonas aeruginosa PA01
ccucggugcgcacgca

SEQ ID NO: 1503602 - RNA, 22 nt, Pseudomonas aeruginosa PA01
ccucggugcgguuggagcggau

SEQ ID NO: 1503603 - RNA, 18 nt, Pseudomonas aeruginosa PA01
ccucgguuuccggccagg

SEQ ID NO: 1503604 - RNA, 15 nt, Pseudomonas aeruginosa PA01
ccucggcuucguccu

SEQ ID NO: 1503605 - RNA, 18 nt, Pseudomonas aeruginosa PA01
ccucggcuaaccgccuuc

SEQ ID NO: 1503606 - RNA, 15 nt, Pseudomonas aeruginosa PA01
ccucggcgucgcgca

SEQ ID NO: 1503607 - RNA, 18 nt, Pseudomonas aeruginosa PA01
ccucggcgucgcgcaggc

SEQ ID NO: 1503608 - RNA, 20 nt, Pseudomonas aeruginosa PA01
ccucggcguagccggccagg

SEQ ID NO: 1503609 - RNA, 14 nt, Pseudomonas aeruginosa PA01
ccucgauggcggca

SEQ ID NO: 1503610 - RNA, 13 nt, Pseudomonas aeruginosa PA01
ccucgaugcccgc

SEQ ID NO: 1503611 - RNA, 15 nt, Pseudomonas aeruginosa PA01
ccucgaugcccgccu

SEQ ID NO: 1503612 - RNA, 13 nt, Pseudomonas aeruginosa PA01
ccucgauggcgug

SEQ ID NO: 1503613 - RNA, 15 nt, Pseudomonas aeruginosa PA01
ccucgauguccggga

SEQ ID NO: 1503614 - RNA, 23 nt, Pseudomonas aeruginosa PA01
ccucgaugugcuugagucgcagg

SEQ ID NO: 1503615 - RNA, 15 nt, Pseudomonas aeruginosa PA01
ccucgagcaccgcgg

SEQ ID NO: 1503616 - RNA, 13 nt, Pseudomonas aeruginosa PA01
ccucgagcaggcc

SEQ ID NO: 1503617 - RNA, 16 nt, Pseudomonas aeruginosa PA01
ccucgagcaggccgag

SEQ ID NO: 1503618 - RNA, 20 nt, Pseudomonas aeruginosa PA01
ccucgaugagcaugccgcag

SEQ ID NO: 1503619 - RNA, 21 nt, Pseudomonas aeruginosa PA01
ccucgaugagcaugccgcaga

SEQ ID NO: 1503620 - RNA, 23 nt, Pseudomonas aeruginosa PA01
ccucgaugauccgcucgaucccg

SEQ ID NO: 1503621 - RNA, 13 nt, Pseudomonas aeruginosa PA01
ccucgaugaucgc

SEQ ID NO: 1503622 - RNA, 19 nt, Pseudomonas aeruginosa PA01
ccucgaugaucgccgggug

SEQ ID NO: 1503623 - RNA, 22 nt, Pseudomonas aeruginosa PA01
ccucgccggucgcgcucaggcg

SEQ ID NO: 1503624 - RNA, 20 nt, Pseudomonas aeruginosa PA01
ccucgcaguacagcucggcg

SEQ ID NO: 1503625 - RNA, 17 nt, Pseudomonas aeruginosa PA01
ccucgcaaaggucggcg

SEQ ID NO: 1503626 - RNA, 16 nt, Pseudomonas aeruginosa PA01
ccucgcagagcgccag

SEQ ID NO: 1503627 - RNA, 21 nt, Pseudomonas aeruginosa PA01
ccucgcagagcgccagccagc

SEQ ID NO: 1503628 - RNA, 16 nt, Pseudomonas aeruginosa PA01
ccucgcagccggcggc

SEQ ID NO: 1503629 - RNA, 18 nt, Pseudomonas aeruginosa PA01
ccucgcgcaacgccgacg

SEQ ID NO: 1503630 - RNA, 19 nt, Pseudomonas aeruginosa PA01
ccucgcgcaacgccgacgg

SEQ ID NO: 1503631 - RNA, 20 nt, Pseudomonas aeruginosa PA01
ccucgcgcaacgccgacggc

SEQ ID NO: 1503632 - RNA, 19 nt, Pseudomonas aeruginosa PA01
ccucgccgugacgaggggc

SEQ ID NO: 1503633 - RNA, 12 nt, Pseudomonas aeruginosa PA01
ccucgccucgcg

SEQ ID NO: 1503634 - RNA, 23 nt, Pseudomonas aeruginosa PA01
ccucgccuucguccaugcucgcc

SEQ ID NO: 1503635 - RNA, 13 nt, Pseudomonas aeruginosa PA01
ccucgcgcucggc

SEQ ID NO: 1503636 - RNA, 17 nt, Pseudomonas aeruginosa PA01
ccucgcgcucggcggcc

SEQ ID NO: 1503637 - RNA, 16 nt, Pseudomonas aeruginosa PA01
ccucgcgcugcccggc

SEQ ID NO: 1503638 - RNA, 15 nt, Pseudomonas aeruginosa PA01
ccucgcggaagucgg

SEQ ID NO: 1503639 - RNA, 17 nt, Pseudomonas aeruginosa PA01
ccucgcggaagucggcg

SEQ ID NO: 1503640 - RNA, 14 nt, Pseudomonas aeruginosa PA01
ccucggagucaggc

SEQ ID NO: 1503641 - RNA, 15 nt, Pseudomonas aeruginosa PA01
ccucgcgcaccgcgg

SEQ ID NO: 1503642 - RNA, 18 nt, Pseudomonas aeruginosa PA01
ccucgcgcaccgcggcga

SEQ ID NO: 1503643 - RNA, 14 nt, Pseudomonas aeruginosa PA01
ccucgcgcagcggc

SEQ ID NO: 1503644 - RNA, 19 nt, Pseudomonas aeruginosa PA01
ccucgcgccagagaucgcc

SEQ ID NO: 1503645 - RNA, 22 nt, Pseudomonas aeruginosa PA01
ccucgcgccgcuuugcaggguc

SEQ ID NO: 1503646 - RNA, 17 nt, Pseudomonas aeruginosa PA01
ccguauccuccgcgacg

SEQ ID NO: 1503647 - RNA, 19 nt, Pseudomonas aeruginosa PA01
ccguauucgaagcucggca

SEQ ID NO: 1503648 - RNA, 19 nt, Pseudomonas aeruginosa PA01
ccguagggcgaacaacgcc

SEQ ID NO: 1503649 - RNA, 23 nt, Pseudomonas aeruginosa PA01
ccguagggcgaacaacgccgccg

SEQ ID NO: 1503650 - RNA, 23 nt, Pseudomonas aeruginosa PA01
ccguagggcgaauaacgccaccg

SEQ ID NO: 1503651 - RNA, 13 nt, Pseudomonas aeruginosa PA01
ccguagggcgacg

SEQ ID NO: 1503652 - RNA, 17 nt, Pseudomonas aeruginosa PA01
ccguagggcgacgcccg

SEQ ID NO: 1503653 - RNA, 12 nt, Pseudomonas aeruginosa PA01
ccguagggcgca

SEQ ID NO: 1503654 - RNA, 22 nt, Pseudomonas aeruginosa PA01
ccguaggccacuucccggcgca

SEQ ID NO: 1503655 - RNA, 20 nt, Pseudomonas aeruginosa PA01
ccgguugccuucgucgcugg

SEQ ID NO: 1503656 - RNA, 21 nt, Pseudomonas aeruginosa PA01
ccgguugcagccaccagccga

SEQ ID NO: 1503657 - RNA, 15 nt, Pseudomonas aeruginosa PA01
ccgguugcugcugcg

SEQ ID NO: 1503658 - RNA, 22 nt, Pseudomonas aeruginosa PA01
ccgguugcugcuugcgcgcggc

SEQ ID NO: 1503659 - RNA, 23 nt, Pseudomonas aeruginosa PA01
ccgguugcugcuugcgcgcggcg

SEQ ID NO: 1503660 - RNA, 16 nt, Pseudomonas aeruginosa PA01
ccgguugcgaccggcc

SEQ ID NO: 1503661 - RNA, 17 nt, Pseudomonas aeruginosa PA01
ccguagaguucggcugc

SEQ ID NO: 1503662 - RNA, 15 nt, Pseudomonas aeruginosa PA01
ccgguuggcggauga

SEQ ID NO: 1503663 - RNA, 22 nt, Pseudomonas aeruginosa PA01
ccguagccaugcccggcuggcg

SEQ ID NO: 1503664 - RNA, 13 nt, Pseudomonas aeruginosa PA01
ccguagccggugc

SEQ ID NO: 1503665 - RNA, 21 nt, Pseudomonas aeruginosa PA01
ccguagccggugccgaucucg

SEQ ID NO: 1503666 - RNA, 17 nt, Pseudomonas aeruginosa PA01
ccguagcgcaguucgcc

SEQ ID NO: 1503667 - RNA, 13 nt, Pseudomonas aeruginosa PA01
ccgucagccaggc

SEQ ID NO: 1503668 - RNA, 15 nt, Pseudomonas aeruginosa PA01
ccgucagccaggcug

SEQ ID NO: 1503669 - RNA, 22 nt, Pseudomonas aeruginosa PA01
ccgucaucgagcaguuccaggc

SEQ ID NO: 1503670 - RNA, 21 nt, Pseudomonas aeruginosa PA01
ccgucaugaccagagccgccg

SEQ ID NO: 1503671 - RNA, 19 nt, Pseudomonas aeruginosa PA01
ccgucaugcacuucgacca

SEQ ID NO: 1503672 - RNA, 19 nt, Pseudomonas aeruginosa PA01
ccguccacggcgcgucggc

SEQ ID NO: 1503673 - RNA, 22 nt, Pseudomonas aeruginosa PA01
ccguccacggcgcgucggcggu

SEQ ID NO: 1503674 - RNA, 19 nt, Pseudomonas aeruginosa PA01
ccgucaacccuugcucccg

SEQ ID NO: 1503675 - RNA, 18 nt, Pseudomonas aeruginosa PA01
ccguaggcgauggccugg

SEQ ID NO: 1503676 - RNA, 16 nt, Pseudomonas aeruginosa PA01
ccgucacgcggaccca

SEQ ID NO: 1503677 - RNA, 17 nt, Pseudomonas aeruginosa PA01
ccgucacgcggacccag

SEQ ID NO: 1503678 - RNA, 21 nt, Pseudomonas aeruginosa PA01
ccgucacuucacgacaggcgg

SEQ ID NO: 1503679 - RNA, 22 nt, Pseudomonas aeruginosa PA01
ccgucacuucacgacaggcggc

SEQ ID NO: 1503680 - RNA, 13 nt, Pseudomonas aeruginosa PA01
ccggugaggcgca

SEQ ID NO: 1503681 - RNA, 21 nt, Pseudomonas aeruginosa PA01
ccggugaggcgcagcagcgcc

SEQ ID NO: 1503682 - RNA, 15 nt, Pseudomonas aeruginosa PA01
ccggugacgucgagg

SEQ ID NO: 1503683 - RNA, 17 nt, Pseudomonas aeruginosa PA01
ccggugaucucgcggcg

SEQ ID NO: 1503684 - RNA, 20 nt, Pseudomonas aeruginosa PA01
ccggugaucucgcggcgcgg

SEQ ID NO: 1503685 - RNA, 13 nt, Pseudomonas aeruginosa PA01
ccggugaucgagc

SEQ ID NO: 1503686 - RNA, 17 nt, Pseudomonas aeruginosa PA01
ccggugaucgagccgcc

SEQ ID NO: 1503687 - RNA, 15 nt, Pseudomonas aeruginosa PA01
ccggugccgcccugg

SEQ ID NO: 1503688 - RNA, 12 nt, Pseudomonas aeruginosa PA01
ccggugccgccg

SEQ ID NO: 1503689 - RNA, 15 nt, Pseudomonas aeruginosa PA01
ccggucaggcgcccg

SEQ ID NO: 1503690 - RNA, 19 nt, Pseudomonas aeruginosa PA01
ccggucauggugccgagca

SEQ ID NO: 1503691 - RNA, 16 nt, Pseudomonas aeruginosa PA01
ccggucccagguagcg

SEQ ID NO: 1503692 - RNA, 21 nt, Pseudomonas aeruginosa PA01
ccggucccagguagcgcugcg

SEQ ID NO: 1503693 - RNA, 24 nt, Pseudomonas aeruginosa PA01
ccggucccagguagcgcugcgcca

SEQ ID NO: 1503694 - RNA, 21 nt, Pseudomonas aeruginosa PA01
ccgguccgacaaucagcggcg

SEQ ID NO: 1503695 - RNA, 22 nt, Pseudomonas aeruginosa PA01
ccgguccgacaaucagcggcgg

SEQ ID NO: 1503696 - RNA, 17 nt, Pseudomonas aeruginosa PA01
ccggugccuucggcggc

SEQ ID NO: 1503697 - RNA, 18 nt, Pseudomonas aeruginosa PA01
ccggugccuucggcggcg

SEQ ID NO: 1503698 - RNA, 13 nt, Pseudomonas aeruginosa PA01
ccggugcgaaccg

SEQ ID NO: 1503699 - RNA, 15 nt, Pseudomonas aeruginosa PA01
ccggugcgaaccggc

SEQ ID NO: 1503700 - RNA, 16 nt, Pseudomonas aeruginosa PA01
ccggugccgccggcca

SEQ ID NO: 1503701 - RNA, 15 nt, Pseudomonas aeruginosa PA01
ccggugccggcggcg

SEQ ID NO: 1503702 - RNA, 19 nt, Pseudomonas aeruginosa PA01
ccggugccgggaagcgcag

SEQ ID NO: 1503703 - RNA, 16 nt, Pseudomonas aeruginosa PA01
ccggugcucggccuga

SEQ ID NO: 1503704 - RNA, 19 nt, Pseudomonas aeruginosa PA01
ccggugcggguggucgccg

SEQ ID NO: 1503705 - RNA, 22 nt, Pseudomonas aeruginosa PA01
ccggugcggguggucgccgccc

SEQ ID NO: 1503706 - RNA, 15 nt, Pseudomonas aeruginosa PA01
ccgguucguugaccg

SEQ ID NO: 1503707 - RNA, 16 nt, Pseudomonas aeruginosa PA01
ccgguucucgccccag

SEQ ID NO: 1503708 - RNA, 17 nt, Pseudomonas aeruginosa PA01
ccgguucucgccccagc

SEQ ID NO: 1503709 - RNA, 21 nt, Pseudomonas aeruginosa PA01
ccgguugagauccuggccggc

SEQ ID NO: 1503710 - RNA, 15 nt, Pseudomonas aeruginosa PA01
ccggugucgacgacg

SEQ ID NO: 1503711 - RNA, 15 nt, Pseudomonas aeruginosa PA01
ccgucucgucgagcg

SEQ ID NO: 1503712 - RNA, 15 nt, Pseudomonas aeruginosa PA01
ccgucuguucggcca

SEQ ID NO: 1503713 - RNA, 17 nt, Pseudomonas aeruginosa PA01
ccgucuguucggccagg

SEQ ID NO: 1503714 - RNA, 17 nt, Pseudomonas aeruginosa PA01
ccgucuuauucgacgcu

SEQ ID NO: 1503715 - RNA, 20 nt, Pseudomonas aeruginosa PA01
ccgucuucaguaggccagcg

SEQ ID NO: 1503716 - RNA, 22 nt, Pseudomonas aeruginosa PA01
ccgucuucaguaggccagcggc

SEQ ID NO: 1503717 - RNA, 20 nt, Pseudomonas aeruginosa PA01
ccgucguuuuguccggcggc

SEQ ID NO: 1503718 - RNA, 17 nt, Pseudomonas aeruginosa PA01
ccgucucaggcgccagg

SEQ ID NO: 1503719 - RNA, 21 nt, Pseudomonas aeruginosa PA01
ccgucucaggcgccaggccuc

SEQ ID NO: 1503720 - RNA, 23 nt, Pseudomonas aeruginosa PA01
ccgucuccagcaacccaugccgc

SEQ ID NO: 1503721 - RNA, 14 nt, Pseudomonas aeruginosa PA01
ccgucuccaggcgc

SEQ ID NO: 1503722 - RNA, 15 nt, Pseudomonas aeruginosa PA01
ccgucuccaggcgcg

SEQ ID NO: 1503723 - RNA, 16 nt, Pseudomonas aeruginosa PA01
ccgucuccaggcgcgc

SEQ ID NO: 1503724 - RNA, 16 nt, Pseudomonas aeruginosa PA01
ccgucgggcuucggug

SEQ ID NO: 1503725 - RNA, 23 nt, Pseudomonas aeruginosa PA01
ccgucgggcuucgguguaucggc

SEQ ID NO: 1503726 - RNA, 13 nt, Pseudomonas aeruginosa PA01
ccgucgcccuggu

SEQ ID NO: 1503727 - RNA, 16 nt, Pseudomonas aeruginosa PA01
ccgucgcccuggugca

SEQ ID NO: 1503728 - RNA, 22 nt, Pseudomonas aeruginosa PA01
ccgucgccgcugaugcgcuggu

SEQ ID NO: 1503729 - RNA, 17 nt, Pseudomonas aeruginosa PA01
ccgucgcggaagccgug

SEQ ID NO: 1503730 - RNA, 19 nt, Pseudomonas aeruginosa PA01
ccgucgcggaagccgugca

SEQ ID NO: 1503731 - RNA, 15 nt, Pseudomonas aeruginosa PA01
ccgucgcgcgcccgu

SEQ ID NO: 1503732 - RNA, 13 nt, Pseudomonas aeruginosa PA01
ccgucgcgcgccg

SEQ ID NO: 1503733 - RNA, 18 nt, Pseudomonas aeruginosa PA01
ccgucgcgcgccggagcc

SEQ ID NO: 1503734 - RNA, 13 nt, Pseudomonas aeruginosa PA01
ccgucgcgccgcg

SEQ ID NO: 1503735 - RNA, 12 nt, Pseudomonas aeruginosa PA01
ccgucgcgccgg

SEQ ID NO: 1503736 - RNA, 13 nt, Pseudomonas aeruginosa PA01
ccgucgcgccggc

SEQ ID NO: 1503737 - RNA, 14 nt, Pseudomonas aeruginosa PA01
ccgucgcgccggcc

SEQ ID NO: 1503738 - RNA, 15 nt, Pseudomonas aeruginosa PA01
ccgucgcgccggcca

SEQ ID NO: 1503739 - RNA, 12 nt, Pseudomonas aeruginosa PA01
ccgucgccggcg

SEQ ID NO: 1503740 - RNA, 15 nt, Pseudomonas aeruginosa PA01
ccgucgccggcgacg

SEQ ID NO: 1503741 - RNA, 19 nt, Pseudomonas aeruginosa PA01
ccgucgccauucggcgacg

SEQ ID NO: 1503742 - RNA, 22 nt, Pseudomonas aeruginosa PA01
ccgucgccauucggcgacgggc

SEQ ID NO: 1503743 - RNA, 22 nt, Pseudomonas aeruginosa PA01
ccgucgcgauagacgccggcga

SEQ ID NO: 1503744 - RNA, 22 nt, Pseudomonas aeruginosa PA01
ccgucgcgaagaccggccggcu

SEQ ID NO: 1503745 - RNA, 13 nt, Pseudomonas aeruginosa PA01
ccgucgcgcacca

SEQ ID NO: 1503746 - RNA, 15 nt, Pseudomonas aeruginosa PA01
ccguccgcgggcgau

SEQ ID NO: 1503747 - RNA, 14 nt, Pseudomonas aeruginosa PA01
ccguccgcgccgcg

SEQ ID NO: 1503748 - RNA, 16 nt, Pseudomonas aeruginosa PA01
ccguccgcgccgcgcg

SEQ ID NO: 1503749 - RNA, 12 nt, Pseudomonas aeruginosa PA01
ccguccgccagg

SEQ ID NO: 1503750 - RNA, 14 nt, Pseudomonas aeruginosa PA01
ccguccgccugcgg

SEQ ID NO: 1503751 - RNA, 21 nt, Pseudomonas aeruginosa PA01
ccguccgaggauaccgcacgg

SEQ ID NO: 1503752 - RNA, 23 nt, Pseudomonas aeruginosa PA01
ccguccgaggauaccgcacggcc

SEQ ID NO: 1503753 - RNA, 13 nt, Pseudomonas aeruginosa PA01
ccguccaccaagc

SEQ ID NO: 1503754 - RNA, 12 nt, Pseudomonas aeruginosa PA01
ccguccaccagc

SEQ ID NO: 1503755 - RNA, 17 nt, Pseudomonas aeruginosa PA01
ccgucccuaccagcgca

SEQ ID NO: 1503756 - RNA, 20 nt, Pseudomonas aeruginosa PA01
ccgugaucccgcgcgggccg

SEQ ID NO: 1503757 - RNA, 17 nt, Pseudomonas aeruginosa PA01
ccgugaucucgaacucg

SEQ ID NO: 1503758 - RNA, 23 nt, Pseudomonas aeruginosa PA01
ccgugaucaccuggaucgccagg

SEQ ID NO: 1503759 - RNA, 18 nt, Pseudomonas aeruginosa PA01
ccgucuuccagggcggcg

SEQ ID NO: 1503760 - RNA, 19 nt, Pseudomonas aeruginosa PA01
ccgugagcuuguccagggc

SEQ ID NO: 1503761 - RNA, 20 nt, Pseudomonas aeruginosa PA01
ccgugagcuuguccagggcg

SEQ ID NO: 1503762 - RNA, 14 nt, Pseudomonas aeruginosa PA01
ccgugaggcgcgcg

SEQ ID NO: 1503763 - RNA, 18 nt, Pseudomonas aeruginosa PA01
ccgugcggcguucgccgc

SEQ ID NO: 1503764 - RNA, 16 nt, Pseudomonas aeruginosa PA01
ccgugcgggucgaggc

SEQ ID NO: 1503765 - RNA, 16 nt, Pseudomonas aeruginosa PA01
ccgugcgcgcggccug

SEQ ID NO: 1503766 - RNA, 22 nt, Pseudomonas aeruginosa PA01
ccgugcgcuccgccaggccgcg

SEQ ID NO: 1503767 - RNA, 20 nt, Pseudomonas aeruginosa PA01
ccgugcggaaaccgcggccg

SEQ ID NO: 1503768 - RNA, 21 nt, Pseudomonas aeruginosa PA01
ccgugcggaaaccgcggccgg

SEQ ID NO: 1503769 - RNA, 22 nt, Pseudomonas aeruginosa PA01
ccgugcggaaaccgcggccggc

SEQ ID NO: 1503770 - RNA, 15 nt, Pseudomonas aeruginosa PA01
ccgugcgcaccucgc

SEQ ID NO: 1503771 - RNA, 14 nt, Pseudomonas aeruginosa PA01
ccgugcgccgcggg

SEQ ID NO: 1503772 - RNA, 14 nt, Pseudomonas aeruginosa PA01
ccgugcgccgggcu

SEQ ID NO: 1503773 - RNA, 20 nt, Pseudomonas aeruginosa PA01
ccgugcgaacacaccgaccg

SEQ ID NO: 1503774 - RNA, 16 nt, Pseudomonas aeruginosa PA01
ccgugccggucgcgca

SEQ ID NO: 1503775 - RNA, 18 nt, Pseudomonas aeruginosa PA01
ccgugccggucgcgcagc

SEQ ID NO: 1503776 - RNA, 13 nt, Pseudomonas aeruginosa PA01
ccguggcgggcca

SEQ ID NO: 1503777 - RNA, 20 nt, Pseudomonas aeruginosa PA01
ccguggcgggccaugcgcuc

SEQ ID NO: 1503778 - RNA, 12 nt, Pseudomonas aeruginosa PA01
ccguggcggccg

SEQ ID NO: 1503779 - RNA, 15 nt, Pseudomonas aeruginosa PA01
ccguggcggccgccg

SEQ ID NO: 1503780 - RNA, 18 nt, Pseudomonas aeruginosa PA01
ccguggcggccgccgcgc

SEQ ID NO: 1503781 - RNA, 14 nt, Pseudomonas aeruginosa PA01
ccguggcggcgcgc

SEQ ID NO: 1503782 - RNA, 13 nt, Pseudomonas aeruginosa PA01
ccguggcgccgca

SEQ ID NO: 1503783 - RNA, 20 nt, Pseudomonas aeruginosa PA01
ccguggcgcggacgggccgc

SEQ ID NO: 1503784 - RNA, 22 nt, Pseudomonas aeruginosa PA01
ccguggcgcggacgggccgcgc

SEQ ID NO: 1503785 - RNA, 19 nt, Pseudomonas aeruginosa PA01
ccguggcgcuacgcucgcc

SEQ ID NO: 1503786 - RNA, 13 nt, Pseudomonas aeruginosa PA01
ccgugggaucgcc

SEQ ID NO: 1503787 - RNA, 22 nt, Pseudomonas aeruginosa PA01
ccgugggaucgccacgccggcg

SEQ ID NO: 1503788 - RNA, 19 nt, Pseudomonas aeruginosa PA01
ccgugggcgccgccgguga

SEQ ID NO: 1503789 - RNA, 21 nt, Pseudomonas aeruginosa PA01
ccguggcuggggccggccugg

SEQ ID NO: 1503790 - RNA, 13 nt, Pseudomonas aeruginosa PA01
ccguggcucggcg

SEQ ID NO: 1503791 - RNA, 16 nt, Pseudomonas aeruginosa PA01
ccguggcucggcggca

SEQ ID NO: 1503792 - RNA, 21 nt, Pseudomonas aeruginosa PA01
ccguggcaggugacgcagggc

SEQ ID NO: 1503793 - RNA, 18 nt, Pseudomonas aeruginosa PA01
ccguggcgacgcagcacg

SEQ ID NO: 1503794 - RNA, 21 nt, Pseudomonas aeruginosa PA01
ccguggaugucgaggaacagg

SEQ ID NO: 1503795 - RNA, 21 nt, Pseudomonas aeruginosa PA01
ccguggcacccaggccacgcc

SEQ ID NO: 1503796 - RNA, 16 nt, Pseudomonas aeruginosa PA01
ccguggcaggcgcccg

SEQ ID NO: 1503797 - RNA, 12 nt, Pseudomonas aeruginosa PA01
ccguggaucgcc

SEQ ID NO: 1503798 - RNA, 22 nt, Pseudomonas aeruginosa PA01
ccguggaucgccauaggaugcc

SEQ ID NO: 1503799 - RNA, 15 nt, Pseudomonas aeruginosa PA01
ccguggaucgcccgg

SEQ ID NO: 1503800 - RNA, 16 nt, Pseudomonas aeruginosa PA01
ccguggaucgcccggc

SEQ ID NO: 1503801 - RNA, 18 nt, Pseudomonas aeruginosa PA01
ccguggaucgcccggcug

SEQ ID NO: 1503802 - RNA, 17 nt, Pseudomonas aeruginosa PA01
ccguggagaggucgccg

SEQ ID NO: 1503803 - RNA, 18 nt, Pseudomonas aeruginosa PA01
ccguggagaggucgccga

SEQ ID NO: 1503804 - RNA, 22 nt, Pseudomonas aeruginosa PA01
ccguggagaggucgccgacacg

SEQ ID NO: 1503805 - RNA, 17 nt, Pseudomonas aeruginosa PA01
ccguggaaaccucgccg

SEQ ID NO: 1503806 - RNA, 19 nt, Pseudomonas aeruginosa PA01
ccguggaaaccucgccgau

SEQ ID NO: 1503807 - RNA, 20 nt, Pseudomonas aeruginosa PA01
ccguggaaaccucgccgauc

SEQ ID NO: 1503808 - RNA, 22 nt, Pseudomonas aeruginosa PA01
ccguggaccaacagccggcggg

SEQ ID NO: 1503809 - RNA, 19 nt, Pseudomonas aeruginosa PA01
ccgugcuucaucggcccgg

SEQ ID NO: 1503810 - RNA, 12 nt, Pseudomonas aeruginosa PA01
ccgugcuggccg

SEQ ID NO: 1503811 - RNA, 20 nt, Pseudomonas aeruginosa PA01
ccgugcuggccggcagcagc

SEQ ID NO: 1503812 - RNA, 23 nt, Pseudomonas aeruginosa PA01
ccggucaccguggagaggucgcc

SEQ ID NO: 1503813 - RNA, 19 nt, Pseudomonas aeruginosa PA01
ccggucacgcaggcgcugg

SEQ ID NO: 1503814 - RNA, 20 nt, Pseudomonas aeruginosa PA01
ccggucacgcaggcgcuggc

SEQ ID NO: 1503815 - RNA, 21 nt, Pseudomonas aeruginosa PA01
ccggucacgcaggcgcuggcc

SEQ ID NO: 1503816 - RNA, 19 nt, Pseudomonas aeruginosa PA01
ccggucagagacagguacu

SEQ ID NO: 1503817 - RNA, 15 nt, Pseudomonas aeruginosa PA01
ccggucagcagcagg

SEQ ID NO: 1503818 - RNA, 18 nt, Pseudomonas aeruginosa PA01
ccggucagcuucgccgcc

SEQ ID NO: 1503819 - RNA, 19 nt, Pseudomonas aeruginosa PA01
ccggucagcuucgccgccc

SEQ ID NO: 1503820 - RNA, 23 nt, Pseudomonas aeruginosa PA01
ccggucagcuucgccgcccugga

SEQ ID NO: 1503821 - RNA, 14 nt, Pseudomonas aeruginosa PA01
ccggucaggccgau

SEQ ID NO: 1503822 - RNA, 17 nt, Pseudomonas aeruginosa PA01
ccggucaggcugcggcg

SEQ ID NO: 1503823 - RNA, 16 nt, Pseudomonas aeruginosa PA01
ccggucaggcuggugc

SEQ ID NO: 1503824 - RNA, 19 nt, Pseudomonas aeruginosa PA01
ccggucaggcuggugccgc

SEQ ID NO: 1503825 - RNA, 20 nt, Pseudomonas aeruginosa PA01
ccggucaggcuggugccgcu

SEQ ID NO: 1503826 - RNA, 18 nt, Pseudomonas aeruginosa PA01
ccggucagguaggcaucg

SEQ ID NO: 1503827 - RNA, 22 nt, Pseudomonas aeruginosa PA01
ccggucagguuggacagguccu

SEQ ID NO: 1503828 - RNA, 15 nt, Pseudomonas aeruginosa PA01
ccgguagucggggca

SEQ ID NO: 1503829 - RNA, 13 nt, Pseudomonas aeruginosa PA01
ccgguagggcgaa

SEQ ID NO: 1503830 - RNA, 15 nt, Pseudomonas aeruginosa PA01
ccgguaggggccgac

SEQ ID NO: 1503831 - RNA, 15 nt, Pseudomonas aeruginosa PA01
ccgguaucgcgcuug

SEQ ID NO: 1503832 - RNA, 16 nt, Pseudomonas aeruginosa PA01
ccgguaucccggcuga

SEQ ID NO: 1503833 - RNA, 21 nt, Pseudomonas aeruginosa PA01
ccgguaucccggcugagcgcc

SEQ ID NO: 1503834 - RNA, 15 nt, Pseudomonas aeruginosa PA01
ccggucaccacccag

SEQ ID NO: 1503835 - RNA, 16 nt, Pseudomonas aeruginosa PA01
ccgguacgcucaccac

SEQ ID NO: 1503836 - RNA, 17 nt, Pseudomonas aeruginosa PA01
ccgguacucgccgggcg

SEQ ID NO: 1503837 - RNA, 13 nt, Pseudomonas aeruginosa PA01
ccgguacugcugg

SEQ ID NO: 1503838 - RNA, 18 nt, Pseudomonas aeruginosa PA01
ccgguacgcaccagcggu

SEQ ID NO: 1503839 - RNA, 19 nt, Pseudomonas aeruginosa PA01
ccgguaggagcgagagcgc

SEQ ID NO: 1503840 - RNA, 13 nt, Pseudomonas aeruginosa PA01
ccgguagccggcg

SEQ ID NO: 1503841 - RNA, 14 nt, Pseudomonas aeruginosa PA01
ccgguagccggcga

SEQ ID NO: 1503842 - RNA, 15 nt, Pseudomonas aeruginosa PA01
ccgguagccggcgau

SEQ ID NO: 1503843 - RNA, 14 nt, Pseudomonas aeruginosa PA01
ccgguagcgcgccu

SEQ ID NO: 1503844 - RNA, 15 nt, Pseudomonas aeruginosa PA01
ccgguaccacgggca

SEQ ID NO: 1503845 - RNA, 22 nt, Pseudomonas aeruginosa PA01
ccgguacccguacgcugccagg

SEQ ID NO: 1503846 - RNA, 20 nt, Pseudomonas aeruginosa PA01
ccgguaaugacgaucucgau

SEQ ID NO: 1503847 - RNA, 22 nt, Pseudomonas aeruginosa PA01
ccgguaauuggccaggcucgcg

SEQ ID NO: 1503848 - RNA, 13 nt, Pseudomonas aeruginosa PA01
ccgguacagcgcc

SEQ ID NO: 1503849 - RNA, 16 nt, Pseudomonas aeruginosa PA01
ccgguacagcgccugg

SEQ ID NO: 1503850 - RNA, 17 nt, Pseudomonas aeruginosa PA01
ccgguacagcgccuggu

SEQ ID NO: 1503851 - RNA, 21 nt, Pseudomonas aeruginosa PA01
ccgguacagcuguccgcgccg

SEQ ID NO: 1503852 - RNA, 19 nt, Pseudomonas aeruginosa PA01
ccggguugguggccgcgcc

SEQ ID NO: 1503853 - RNA, 22 nt, Pseudomonas aeruginosa PA01
ccggguuuccgugugcagcagg

SEQ ID NO: 1503854 - RNA, 18 nt, Pseudomonas aeruginosa PA01
ccggguuuccugcccgac

SEQ ID NO: 1503855 - RNA, 20 nt, Pseudomonas aeruginosa PA01
ccggguuuccugcccgaccg

SEQ ID NO: 1503856 - RNA, 14 nt, Pseudomonas aeruginosa PA01
ccggguugcgccgc

SEQ ID NO: 1503857 - RNA, 17 nt, Pseudomonas aeruginosa PA01
ccggguuggcgcaggcc

SEQ ID NO: 1503858 - RNA, 20 nt, Pseudomonas aeruginosa PA01
ccggguuggcgcaggccggg

SEQ ID NO: 1503859 - RNA, 16 nt, Pseudomonas aeruginosa PA01
ccggguugaugccgag

SEQ ID NO: 1503860 - RNA, 17 nt, Pseudomonas aeruginosa PA01
ccggguugaaggcgcgg

SEQ ID NO: 1503861 - RNA, 21 nt, Pseudomonas aeruginosa PA01
ccggguugacccagagccgcu

SEQ ID NO: 1503862 - RNA, 14 nt, Pseudomonas aeruginosa PA01
ccggguucccaguu

SEQ ID NO: 1503863 - RNA, 23 nt, Pseudomonas aeruginosa PA01
ccggguucccaguugcugggcga

SEQ ID NO: 1503864 - RNA, 13 nt, Pseudomonas aeruginosa PA01
ccgggugacggcg

SEQ ID NO: 1503865 - RNA, 13 nt, Pseudomonas aeruginosa PA01
ccgggucugggga

SEQ ID NO: 1503866 - RNA, 23 nt, Pseudomonas aeruginosa PA01
ccgggugccuuccgcgcccaggc

SEQ ID NO: 1503867 - RNA, 15 nt, Pseudomonas aeruginosa PA01
ccggguggaacgagg

SEQ ID NO: 1503868 - RNA, 16 nt, Pseudomonas aeruginosa PA01
ccggguggaacgaggc

SEQ ID NO: 1503869 - RNA, 18 nt, Pseudomonas aeruginosa PA01
ccggguggauaucgucgg

SEQ ID NO: 1503870 - RNA, 16 nt, Pseudomonas aeruginosa PA01
ccgggucgaugggccg

SEQ ID NO: 1503871 - RNA, 21 nt, Pseudomonas aeruginosa PA01
ccggguccugcagauaaagcu

SEQ ID NO: 1503872 - RNA, 22 nt, Pseudomonas aeruginosa PA01
ccgggucgacuucgcaccagcc

SEQ ID NO: 1503873 - RNA, 18 nt, Pseudomonas aeruginosa PA01
ccgggucgcgcagcggcu

SEQ ID NO: 1503874 - RNA, 16 nt, Pseudomonas aeruginosa PA01
ccgggugaccgugcgg

SEQ ID NO: 1503875 - RNA, 19 nt, Pseudomonas aeruginosa PA01
ccgggugaccgugcggguc

SEQ ID NO: 1503876 - RNA, 18 nt, Pseudomonas aeruginosa PA01
ccgggucgugcccgagcg

SEQ ID NO: 1503877 - RNA, 18 nt, Pseudomonas aeruginosa PA01
ccgggucgucggucggcc

SEQ ID NO: 1503878 - RNA, 19 nt, Pseudomonas aeruginosa PA01
ccgggucgucggucggcca

SEQ ID NO: 1503879 - RNA, 20 nt, Pseudomonas aeruginosa PA01
ccgggucgucggucggccag

SEQ ID NO: 1503880 - RNA, 21 nt, Pseudomonas aeruginosa PA01
ccgggucgucggucggccagg

SEQ ID NO: 1503881 - RNA, 20 nt, Pseudomonas aeruginosa PA01
ccgggucacggucagcucgg

SEQ ID NO: 1503882 - RNA, 20 nt, Pseudomonas aeruginosa PA01
ccggggugauccagcuggcg

SEQ ID NO: 1503883 - RNA, 15 nt, Pseudomonas aeruginosa PA01
ccggguccaccgcgg

SEQ ID NO: 1503884 - RNA, 16 nt, Pseudomonas aeruginosa PA01
ccggguccagcggccg

SEQ ID NO: 1503885 - RNA, 13 nt, Pseudomonas aeruginosa PA01
ccggggucgaggu

SEQ ID NO: 1503886 - RNA, 15 nt, Pseudomonas aeruginosa PA01
ccgggggucgcggcg

SEQ ID NO: 1503887 - RNA, 16 nt, Pseudomonas aeruginosa PA01
ccgggggucgcggcga

SEQ ID NO: 1503888 - RNA, 21 nt, Pseudomonas aeruginosa PA01
ccggggucaggccgaggcgcu

SEQ ID NO: 1503889 - RNA, 18 nt, Pseudomonas aeruginosa PA01
ccgggcguagggcgaaua

SEQ ID NO: 1503890 - RNA, 13 nt, Pseudomonas aeruginosa PA01
ccgggcggcgcgg

SEQ ID NO: 1503891 - RNA, 15 nt, Pseudomonas aeruginosa PA01
ccgggcggcgcggcg

SEQ ID NO: 1503892 - RNA, 18 nt, Pseudomonas aeruginosa PA01
ccgggcggcgcggcgcaa

SEQ ID NO: 1503893 - RNA, 12 nt, Pseudomonas aeruginosa PA01
ccgggcggcggg

SEQ ID NO: 1503894 - RNA, 20 nt, Pseudomonas aeruginosa PA01
ccgggcggcgggcgcaagcc

SEQ ID NO: 1503895 - RNA, 16 nt, Pseudomonas aeruginosa PA01
ccgggcggcgucgcgg

SEQ ID NO: 1503896 - RNA, 13 nt, Pseudomonas aeruginosa PA01
ccgggcggcggcg

SEQ ID NO: 1503897 - RNA, 22 nt, Pseudomonas aeruginosa PA01
ccgggcggcggcgcuauccgcc

SEQ ID NO: 1503898 - RNA, 22 nt, Pseudomonas aeruginosa PA01
ccgggcgguacaggcgcaccug

SEQ ID NO: 1503899 - RNA, 13 nt, Pseudomonas aeruginosa PA01
ccgggaauggaga

SEQ ID NO: 1503900 - RNA, 16 nt, Pseudomonas aeruginosa PA01
ccgggaaucuggccga

SEQ ID NO: 1503901 - RNA, 22 nt, Pseudomonas aeruginosa PA01
ccgggaaucuggccgaugccga

SEQ ID NO: 1503902 - RNA, 21 nt, Pseudomonas aeruginosa PA01
ccgggaaugcucagcacggcg

SEQ ID NO: 1503903 - RNA, 19 nt, Pseudomonas aeruginosa PA01
ccgggaaggauuccacccg

SEQ ID NO: 1503904 - RNA, 15 nt, Pseudomonas aeruginosa PA01
ccgggaagcggucgu

SEQ ID NO: 1503905 - RNA, 22 nt, Pseudomonas aeruginosa PA01
ccgggaaguccgggcgcggcug

SEQ ID NO: 1503906 - RNA, 20 nt, Pseudomonas aeruginosa PA01
ccgggaagccgcucggcgua

SEQ ID NO: 1503907 - RNA, 18 nt, Pseudomonas aeruginosa PA01
ccgggaagcaccgacucg

SEQ ID NO: 1503908 - RNA, 15 nt, Pseudomonas aeruginosa PA01
ccgggaagcaggucu

SEQ ID NO: 1503909 - RNA, 17 nt, Pseudomonas aeruginosa PA01
ccgggcaccccgagcgg

SEQ ID NO: 1503910 - RNA, 19 nt, Pseudomonas aeruginosa PA01
ccgggcaccccgagcggcg

SEQ ID NO: 1503911 - RNA, 13 nt, Pseudomonas aeruginosa PA01
ccgggaccacgcu

SEQ ID NO: 1503912 - RNA, 21 nt, Pseudomonas aeruginosa PA01
ccgggcacgcauagcgcgcug

SEQ ID NO: 1503913 - RNA, 23 nt, Pseudomonas aeruginosa PA01
ccgggcacgcauagcgcgcugua

SEQ ID NO: 1503914 - RNA, 16 nt, Pseudomonas aeruginosa PA01
ccgggcauucgcagcg

SEQ ID NO: 1503915 - RNA, 18 nt, Pseudomonas aeruginosa PA01
ccgggcauuuccucgaug

SEQ ID NO: 1503916 - RNA, 15 nt, Pseudomonas aeruginosa PA01
ccgggcacuugucga

SEQ ID NO: 1503917 - RNA, 16 nt, Pseudomonas aeruginosa PA01
ccgggcagaccagcag

SEQ ID NO: 1503918 - RNA, 17 nt, Pseudomonas aeruginosa PA01
ccgggcagaccagcagc

SEQ ID NO: 1503919 - RNA, 18 nt, Pseudomonas aeruginosa PA01
ccgggcagaccagcagcg

SEQ ID NO: 1503920 - RNA, 19 nt, Pseudomonas aeruginosa PA01
ccgggcaugccgugggcgc

SEQ ID NO: 1503921 - RNA, 21 nt, Pseudomonas aeruginosa PA01
ccgggcaugccgugggcgccg

SEQ ID NO: 1503922 - RNA, 22 nt, Pseudomonas aeruginosa PA01
ccgggcgcgcgccucagcggcu

SEQ ID NO: 1503923 - RNA, 14 nt, Pseudomonas aeruginosa PA01
ccgggcgcggcugg

SEQ ID NO: 1503924 - RNA, 13 nt, Pseudomonas aeruginosa PA01
ccgggcgcgcugg

SEQ ID NO: 1503925 - RNA, 14 nt, Pseudomonas aeruginosa PA01
ccgggcgcgcuggu

SEQ ID NO: 1503926 - RNA, 20 nt, Pseudomonas aeruginosa PA01
ccgggcgcgcuggucguucu

SEQ ID NO: 1503927 - RNA, 13 nt, Pseudomonas aeruginosa PA01
ccgggcggaggcg

SEQ ID NO: 1503928 - RNA, 16 nt, Pseudomonas aeruginosa PA01
ccgggcggaggcgagg

SEQ ID NO: 1503929 - RNA, 16 nt, Pseudomonas aeruginosa PA01
ccgggcccaagccgag

SEQ ID NO: 1503930 - RNA, 14 nt, Pseudomonas aeruginosa PA01
ccgggcccaggcug

SEQ ID NO: 1503931 - RNA, 17 nt, Pseudomonas aeruginosa PA01
ccgggcccaggcuggcg

SEQ ID NO: 1503932 - RNA, 16 nt, Pseudomonas aeruginosa PA01
ccgggcccaguucgcg

SEQ ID NO: 1503933 - RNA, 22 nt, Pseudomonas aeruginosa PA01
ccgggcccaguucgcguagccc

SEQ ID NO: 1503934 - RNA, 23 nt, Pseudomonas aeruginosa PA01
ccgggccagcuccagcaccggcg

SEQ ID NO: 1503935 - RNA, 22 nt, Pseudomonas aeruginosa PA01
ccgggccgaugcgcgacucgaa

SEQ ID NO: 1503936 - RNA, 13 nt, Pseudomonas aeruginosa PA01
ccgggccgcagcg

SEQ ID NO: 1503937 - RNA, 19 nt, Pseudomonas aeruginosa PA01
ccgggccgcagcgcagccg

SEQ ID NO: 1503938 - RNA, 15 nt, Pseudomonas aeruginosa PA01
ccgggcgcccggccg

SEQ ID NO: 1503939 - RNA, 14 nt, Pseudomonas aeruginosa PA01
ccgggccgaccugc

SEQ ID NO: 1503940 - RNA, 20 nt, Pseudomonas aeruginosa PA01
ccgggccgaccugcccgcug

SEQ ID NO: 1503941 - RNA, 12 nt, Pseudomonas aeruginosa PA01
ccgggcccugcu

SEQ ID NO: 1503942 - RNA, 21 nt, Pseudomonas aeruginosa PA01
ccgggcccugggccccggccg

SEQ ID NO: 1503943 - RNA, 13 nt, Pseudomonas aeruginosa PA01
ccggcuggcccuc

SEQ ID NO: 1503944 - RNA, 14 nt, Pseudomonas aeruginosa PA01
ccggcuggccgcga

SEQ ID NO: 1503945 - RNA, 16 nt, Pseudomonas aeruginosa PA01
ccggcuggcggcucgg

SEQ ID NO: 1503946 - RNA, 17 nt, Pseudomonas aeruginosa PA01
ccggcuggcgccggugc

SEQ ID NO: 1503947 - RNA, 22 nt, Pseudomonas aeruginosa PA01
ccggcuggucagaaccaccggu

SEQ ID NO: 1503948 - RNA, 21 nt, Pseudomonas aeruginosa PA01
ccggcuucuacgccuugcggc

SEQ ID NO: 1503949 - RNA, 15 nt, Pseudomonas aeruginosa PA01
ccggcuugccgaugu

SEQ ID NO: 1503950 - RNA, 18 nt, Pseudomonas aeruginosa PA01
ccggcuugccgaugucgc

SEQ ID NO: 1503951 - RNA, 21 nt, Pseudomonas aeruginosa PA01
ccggcuugccgaugucgccgg

SEQ ID NO: 1503952 - RNA, 22 nt, Pseudomonas aeruginosa PA01
ccggcuugccgaugucgccggc

SEQ ID NO: 1503953 - RNA, 14 nt, Pseudomonas aeruginosa PA01
ccggcuugccggca

SEQ ID NO: 1503954 - RNA, 19 nt, Pseudomonas aeruginosa PA01
ccggcuugccggcagcgac

SEQ ID NO: 1503955 - RNA, 17 nt, Pseudomonas aeruginosa PA01
ccggcuugccgucggug

SEQ ID NO: 1503956 - RNA, 14 nt, Pseudomonas aeruginosa PA01
ccggcugcuuggcc

SEQ ID NO: 1503957 - RNA, 17 nt, Pseudomonas aeruginosa PA01
ccggcugcuuggccagg

SEQ ID NO: 1503958 - RNA, 19 nt, Pseudomonas aeruginosa PA01
ccggcugcuuggccagguc

SEQ ID NO: 1503959 - RNA, 24 nt, Pseudomonas aeruginosa PA01
ccggcugcuuggccaggucgcgca

SEQ ID NO: 1503960 - RNA, 20 nt, Pseudomonas aeruginosa PA01
ccggcuggacacgguccagg

SEQ ID NO: 1503961 - RNA, 17 nt, Pseudomonas aeruginosa PA01
ccggcugccgcgcgugg

SEQ ID NO: 1503962 - RNA, 17 nt, Pseudomonas aeruginosa PA01
ccggcugcuccgggcgg

SEQ ID NO: 1503963 - RNA, 22 nt, Pseudomonas aeruginosa PA01
ccggcuuggcgggcucgcccau

SEQ ID NO: 1503964 - RNA, 13 nt, Pseudomonas aeruginosa PA01
ccggcuuggucac

SEQ ID NO: 1503965 - RNA, 20 nt, Pseudomonas aeruginosa PA01
ccgggaaagucugugaucag

SEQ ID NO: 1503966 - RNA, 22 nt, Pseudomonas aeruginosa PA01
ccgggaaagucugugaucaggc

SEQ ID NO: 1503967 - RNA, 13 nt, Pseudomonas aeruginosa PA01
ccgggaacacguc

SEQ ID NO: 1503968 - RNA, 15 nt, Pseudomonas aeruginosa PA01
ccgggaaacagggcg

SEQ ID NO: 1503969 - RNA, 19 nt, Pseudomonas aeruginosa PA01
ccgggaaacagggcgacgc

SEQ ID NO: 1503970 - RNA, 21 nt, Pseudomonas aeruginosa PA01
ccgggaaacagggcgacgccg

SEQ ID NO: 1503971 - RNA, 20 nt, Pseudomonas aeruginosa PA01
ccgggaaaccaccaggaagg

SEQ ID NO: 1503972 - RNA, 20 nt, Pseudomonas aeruginosa PA01
ccggcuuuccucggccaugc

SEQ ID NO: 1503973 - RNA, 15 nt, Pseudomonas aeruginosa PA01
ccggcuuguugcgcu

SEQ ID NO: 1503974 - RNA, 14 nt, Pseudomonas aeruginosa PA01
ccggcgaucgccag

SEQ ID NO: 1503975 - RNA, 22 nt, Pseudomonas aeruginosa PA01
ccggcgaucgccaggcgaucca

SEQ ID NO: 1503976 - RNA, 14 nt, Pseudomonas aeruginosa PA01
ccggcgaucgccgg

SEQ ID NO: 1503977 - RNA, 15 nt, Pseudomonas aeruginosa PA01
ccggcgagccagguu

SEQ ID NO: 1503978 - RNA, 19 nt, Pseudomonas aeruginosa PA01
ccggcgaugcgcaggccgg

SEQ ID NO: 1503979 - RNA, 23 nt, Pseudomonas aeruginosa PA01
ccggcgaugcguuugucgaccug

SEQ ID NO: 1503980 - RNA, 16 nt, Pseudomonas aeruginosa PA01
ccggcgaugcucagcg

SEQ ID NO: 1503981 - RNA, 18 nt, Pseudomonas aeruginosa PA01
ccggcgaugcucagcgcc

SEQ ID NO: 1503982 - RNA, 20 nt, Pseudomonas aeruginosa PA01
ccggcgaugcucagcgccgg

SEQ ID NO: 1503983 - RNA, 21 nt, Pseudomonas aeruginosa PA01
ccggcgaugcucagcgccggc

SEQ ID NO: 1503984 - RNA, 12 nt, Pseudomonas aeruginosa PA01
ccggcgauggcc

SEQ ID NO: 1503985 - RNA, 14 nt, Pseudomonas aeruginosa PA01
ccggcgauggccca

SEQ ID NO: 1503986 - RNA, 15 nt, Pseudomonas aeruginosa PA01
ccggcgauggcccag

SEQ ID NO: 1503987 - RNA, 19 nt, Pseudomonas aeruginosa PA01
ccggcgaugccgcccagca

SEQ ID NO: 1503988 - RNA, 20 nt, Pseudomonas aeruginosa PA01
ccggcgaugcccaggccgcc

SEQ ID NO: 1503989 - RNA, 21 nt, Pseudomonas aeruginosa PA01
ccggcgaugcccaggccgccg

SEQ ID NO: 1503990 - RNA, 15 nt, Pseudomonas aeruginosa PA01
ccggcuacaggccgu

SEQ ID NO: 1503991 - RNA, 17 nt, Pseudomonas aeruginosa PA01
ccggcuaaccgcgaagc

SEQ ID NO: 1503992 - RNA, 14 nt, Pseudomonas aeruginosa PA01
ccggcgauggccgc

SEQ ID NO: 1503993 - RNA, 15 nt, Pseudomonas aeruginosa PA01
ccggcgauggccgcc

SEQ ID NO: 1503994 - RNA, 17 nt, Pseudomonas aeruginosa PA01
ccggcgauggccgccug

SEQ ID NO: 1503995 - RNA, 15 nt, Pseudomonas aeruginosa PA01
ccggcgauggccggc

SEQ ID NO: 1503996 - RNA, 17 nt, Pseudomonas aeruginosa PA01
ccggcgauggccggcac

SEQ ID NO: 1503997 - RNA, 19 nt, Pseudomonas aeruginosa PA01
ccggcgaugugcggcgugg

SEQ ID NO: 1503998 - RNA, 23 nt, Pseudomonas aeruginosa PA01
ccggcgaugugcggcguggcgau

SEQ ID NO: 1503999 - RNA, 19 nt, Pseudomonas aeruginosa PA01
ccggcuaucccccggccga

SEQ ID NO: 1504000 - RNA, 20 nt, Pseudomonas aeruginosa PA01
ccggcuaucccccggccgau

SEQ ID NO: 1504001 - RNA, 21 nt, Pseudomonas aeruginosa PA01
ccggcucgccgacuuccaggc

SEQ ID NO: 1504002 - RNA, 13 nt, Pseudomonas aeruginosa PA01
ccggcucgccgcg

SEQ ID NO: 1504003 - RNA, 18 nt, Pseudomonas aeruginosa PA01
ccggcucgccgcgcugca

SEQ ID NO: 1504004 - RNA, 13 nt, Pseudomonas aeruginosa PA01
ccggcucaacugc

SEQ ID NO: 1504005 - RNA, 15 nt, Pseudomonas aeruginosa PA01
ccggcucucuucggc

SEQ ID NO: 1504006 - RNA, 17 nt, Pseudomonas aeruginosa PA01
ccggcucucuucggccg

SEQ ID NO: 1504007 - RNA, 18 nt, Pseudomonas aeruginosa PA01
ccggcucgguguaggcga

SEQ ID NO: 1504008 - RNA, 12 nt, Pseudomonas aeruginosa PA01
ccggcucggccg

SEQ ID NO: 1504009 - RNA, 21 nt, Pseudomonas aeruginosa PA01
ccggcucggcacgcguggcga

SEQ ID NO: 1504010 - RNA, 15 nt, Pseudomonas aeruginosa PA01
ccggcucgcugacgc

SEQ ID NO: 1504011 - RNA, 14 nt, Pseudomonas aeruginosa PA01
cgagcaugccgagg

SEQ ID NO: 1504012 - RNA, 19 nt, Pseudomonas aeruginosa PA01
cgagcauuccucagcgccg

SEQ ID NO: 1504013 - RNA, 21 nt, Pseudomonas aeruginosa PA01
cgagcauuccucagcgccggu

SEQ ID NO: 1504014 - RNA, 22 nt, Pseudomonas aeruginosa PA01
cgagcaucuucuucaaccgcug

SEQ ID NO: 1504015 - RNA, 23 nt, Pseudomonas aeruginosa PA01
cgagcaucuucuucaaccgcugg

SEQ ID NO: 1504016 - RNA, 19 nt, Pseudomonas aeruginosa PA01
cgagcaucugccgggcgcg

SEQ ID NO: 1504017 - RNA, 15 nt, Pseudomonas aeruginosa PA01
cgagcaucucggcca

SEQ ID NO: 1504018 - RNA, 16 nt, Pseudomonas aeruginosa PA01
cgagcaucucggccag

SEQ ID NO: 1504019 - RNA, 17 nt, Pseudomonas aeruginosa PA01
cgagcaucucggccagg

SEQ ID NO: 1504020 - RNA, 19 nt, Pseudomonas aeruginosa PA01
cgagcaucucggccaggcc

SEQ ID NO: 1504021 - RNA, 22 nt, Pseudomonas aeruginosa PA01
cgagcaucuccggcaccguggu

SEQ ID NO: 1504022 - RNA, 18 nt, Pseudomonas aeruginosa PA01
cgagcagcucgccggcgu

SEQ ID NO: 1504023 - RNA, 17 nt, Pseudomonas aeruginosa PA01
cgagcaggaugaucacg

SEQ ID NO: 1504024 - RNA, 18 nt, Pseudomonas aeruginosa PA01
cgagcagcucguucgccc

SEQ ID NO: 1504025 - RNA, 15 nt, Pseudomonas aeruginosa PA01
cgagcaggcacccgc

SEQ ID NO: 1504026 - RNA, 17 nt, Pseudomonas aeruginosa PA01
cgagcaggcacccgcgg

SEQ ID NO: 1504027 - RNA, 19 nt, Pseudomonas aeruginosa PA01
cgagcaggcacccgcggua

SEQ ID NO: 1504028 - RNA, 13 nt, Pseudomonas aeruginosa PA01
cgagcaggcccau

SEQ ID NO: 1504029 - RNA, 13 nt, Pseudomonas aeruginosa PA01
cgagcaggccgag

SEQ ID NO: 1504030 - RNA, 17 nt, Pseudomonas aeruginosa PA01
cgagcagggcacagcca

SEQ ID NO: 1504031 - RNA, 19 nt, Pseudomonas aeruginosa PA01
cgagcagggcgaugccgau

SEQ ID NO: 1504032 - RNA, 23 nt, Pseudomonas aeruginosa PA01
cgagcagggcgaugccgauggcg

SEQ ID NO: 1504033 - RNA, 13 nt, Pseudomonas aeruginosa PA01
cgagcagggcgcu

SEQ ID NO: 1504034 - RNA, 15 nt, Pseudomonas aeruginosa PA01
cgagcagggcgcuga

SEQ ID NO: 1504035 - RNA, 20 nt, Pseudomonas aeruginosa PA01
cgagcagggcgcugagcgcg

SEQ ID NO: 1504036 - RNA, 17 nt, Pseudomonas aeruginosa PA01
cgagcagggucacgccg

SEQ ID NO: 1504037 - RNA, 21 nt, Pseudomonas aeruginosa PA01
cgagcagggucacgccgauca

SEQ ID NO: 1504038 - RNA, 20 nt, Pseudomonas aeruginosa PA01
cgagcagggucaugaugccu

SEQ ID NO: 1504039 - RNA, 15 nt, Pseudomonas aeruginosa PA01
cgagcagggucgcga

SEQ ID NO: 1504040 - RNA, 17 nt, Pseudomonas aeruginosa PA01
cgagcagggucgcgagc

SEQ ID NO: 1504041 - RNA, 21 nt, Pseudomonas aeruginosa PA01
cgagcagguagaccgccucgg

SEQ ID NO: 1504042 - RNA, 18 nt, Pseudomonas aeruginosa PA01
cgagcaggucgcggaacu

SEQ ID NO: 1504043 - RNA, 22 nt, Pseudomonas aeruginosa PA01
cgagcaucagcaauuccgcagc

SEQ ID NO: 1504044 - RNA, 13 nt, Pseudomonas aeruginosa PA01
cgagcaucagcga

SEQ ID NO: 1504045 - RNA, 14 nt, Pseudomonas aeruginosa PA01
cgagcccuggucga

SEQ ID NO: 1504046 - RNA, 17 nt, Pseudomonas aeruginosa PA01
cgagcccuugcgcggcg

SEQ ID NO: 1504047 - RNA, 15 nt, Pseudomonas aeruginosa PA01
cgagccgagcaggcc

SEQ ID NO: 1504048 - RNA, 16 nt, Pseudomonas aeruginosa PA01
cgagccgaucaccagc

SEQ ID NO: 1504049 - RNA, 17 nt, Pseudomonas aeruginosa PA01
cgagccgaucaccagca

SEQ ID NO: 1504050 - RNA, 21 nt, Pseudomonas aeruginosa PA01
cgagcccccauaccgccucgg

SEQ ID NO: 1504051 - RNA, 16 nt, Pseudomonas aeruginosa PA01
cgagcccgagugcgcc

SEQ ID NO: 1504052 - RNA, 20 nt, Pseudomonas aeruginosa PA01
cgagcccgagugcgcccagc

SEQ ID NO: 1504053 - RNA, 22 nt, Pseudomonas aeruginosa PA01
cgagcccgagugcgcccagcag

SEQ ID NO: 1504054 - RNA, 13 nt, Pseudomonas aeruginosa PA01
cgagcccaggcag

SEQ ID NO: 1504055 - RNA, 13 nt, Pseudomonas aeruginosa PA01
cgagcccagcggc

SEQ ID NO: 1504056 - RNA, 20 nt, Pseudomonas aeruginosa PA01
cgagcccagcggcagggcgg

SEQ ID NO: 1504057 - RNA, 21 nt, Pseudomonas aeruginosa PA01
cgagcccagcggcagggcggc

SEQ ID NO: 1504058 - RNA, 20 nt, Pseudomonas aeruginosa PA01
cgagccacggauaugcgccg

SEQ ID NO: 1504059 - RNA, 23 nt, Pseudomonas aeruginosa PA01
cgagccacggauaugcgccgcca

SEQ ID NO: 1504060 - RNA, 18 nt, Pseudomonas aeruginosa PA01
cgagccacucgugcaacg

SEQ ID NO: 1504061 - RNA, 21 nt, Pseudomonas aeruginosa PA01
cgagccacucgugcaacggca

SEQ ID NO: 1504062 - RNA, 15 nt, Pseudomonas aeruginosa PA01
cgagccagcccagcg

SEQ ID NO: 1504063 - RNA, 19 nt, Pseudomonas aeruginosa PA01
cgagccagcccagcggcgc

SEQ ID NO: 1504064 - RNA, 22 nt, Pseudomonas aeruginosa PA01
cgagccagcccagcggcgcggc

SEQ ID NO: 1504065 - RNA, 14 nt, Pseudomonas aeruginosa PA01
cgagccagccgcgg

SEQ ID NO: 1504066 - RNA, 21 nt, Pseudomonas aeruginosa PA01
cgagccagccguggcaggcgc

SEQ ID NO: 1504067 - RNA, 21 nt, Pseudomonas aeruginosa PA01
cgagccagguacggaugccgc

SEQ ID NO: 1504068 - RNA, 21 nt, Pseudomonas aeruginosa PA01
cgagccagguuuccggcagca

SEQ ID NO: 1504069 - RNA, 21 nt, Pseudomonas aeruginosa PA01
cgagccagcgcucgaacgccg

SEQ ID NO: 1504070 - RNA, 22 nt, Pseudomonas aeruginosa PA01
cgagccagcgcucgaacgccgc

SEQ ID NO: 1504071 - RNA, 18 nt, Pseudomonas aeruginosa PA01
cgagcaggaagaagccga

SEQ ID NO: 1504072 - RNA, 13 nt, Pseudomonas aeruginosa PA01
cgagcaggacagc

SEQ ID NO: 1504073 - RNA, 16 nt, Pseudomonas aeruginosa PA01
cgagcaggacagcagg

SEQ ID NO: 1504074 - RNA, 22 nt, Pseudomonas aeruginosa PA01
cgagcaggacagcagggucgcg

SEQ ID NO: 1504075 - RNA, 15 nt, Pseudomonas aeruginosa PA01
cgagcaggacugccc

SEQ ID NO: 1504076 - RNA, 23 nt, Pseudomonas aeruginosa PA01
cgagcaggaggauacggcgcagc

SEQ ID NO: 1504077 - RNA, 15 nt, Pseudomonas aeruginosa PA01
cgagcagcgccagcc

SEQ ID NO: 1504078 - RNA, 13 nt, Pseudomonas aeruginosa PA01
cgagcagcgccgc

SEQ ID NO: 1504079 - RNA, 14 nt, Pseudomonas aeruginosa PA01
cgagcagcgcgcgg

SEQ ID NO: 1504080 - RNA, 14 nt, Pseudomonas aeruginosa PA01
cgagcagcggcgcu

SEQ ID NO: 1504081 - RNA, 14 nt, Pseudomonas aeruginosa PA01
cgagcagccgacga

SEQ ID NO: 1504082 - RNA, 21 nt, Pseudomonas aeruginosa PA01
aacaccaggagcgccagcacc

SEQ ID NO: 1504083 - RNA, 13 nt, Pseudomonas aeruginosa PA01
aacaccaggcgcc

SEQ ID NO: 1504084 - RNA, 16 nt, Pseudomonas aeruginosa PA01
aacaccaucggcccca

SEQ ID NO: 1504085 - RNA, 17 nt, Pseudomonas aeruginosa PA01
aacaccagcgccgccag

SEQ ID NO: 1504086 - RNA, 19 nt, Pseudomonas aeruginosa PA01
cgagcagaguuuagccgcc

SEQ ID NO: 1504087 - RNA, 22 nt, Pseudomonas aeruginosa PA01
cgagcagaguuuagccgccagu

SEQ ID NO: 1504088 - RNA, 15 nt, Pseudomonas aeruginosa PA01
cgagcacggcgcugg

SEQ ID NO: 1504089 - RNA, 23 nt, Pseudomonas aeruginosa PA01
cgagcaagccuuccagguagucc

SEQ ID NO: 1504090 - RNA, 18 nt, Pseudomonas aeruginosa PA01
cgagcaaccgcgauggcg

SEQ ID NO: 1504091 - RNA, 18 nt, Pseudomonas aeruginosa PA01
cgagauucugcaggcgcu

SEQ ID NO: 1504092 - RNA, 19 nt, Pseudomonas aeruginosa PA01
cgagauugaugaagcgcug

SEQ ID NO: 1504093 - RNA, 14 nt, Pseudomonas aeruginosa PA01
cgagcaacucggcg

SEQ ID NO: 1504094 - RNA, 15 nt, Pseudomonas aeruginosa PA01
cgagcaacucggcgg

SEQ ID NO: 1504095 - RNA, 17 nt, Pseudomonas aeruginosa PA01
cgagcaacucggcggcg

SEQ ID NO: 1504096 - RNA, 19 nt, Pseudomonas aeruginosa PA01
cgagcaacucggcggcgag

SEQ ID NO: 1504097 - RNA, 20 nt, Pseudomonas aeruginosa PA01
cgagcaacucggcggcgagc

SEQ ID NO: 1504098 - RNA, 20 nt, Pseudomonas aeruginosa PA01
cgagaugcugcgggcgccgc

SEQ ID NO: 1504099 - RNA, 17 nt, Pseudomonas aeruginosa PA01
cgagauuggccgccugc

SEQ ID NO: 1504100 - RNA, 20 nt, Pseudomonas aeruginosa PA01
cgagauuggccgccugcucg

SEQ ID NO: 1504101 - RNA, 12 nt, Pseudomonas aeruginosa PA01
cgagagcugcaa

SEQ ID NO: 1504102 - RNA, 20 nt, Pseudomonas aeruginosa PA01
cgagagugguauuggucgcg

SEQ ID NO: 1504103 - RNA, 15 nt, Pseudomonas aeruginosa PA01
cgagauagcggcaac

SEQ ID NO: 1504104 - RNA, 18 nt, Pseudomonas aeruginosa PA01
cgagaugcucgcgcagcg

SEQ ID NO: 1504105 - RNA, 18 nt, Pseudomonas aeruginosa PA01
cgagaucuucaggccgaa

SEQ ID NO: 1504106 - RNA, 19 nt, Pseudomonas aeruginosa PA01
cgagaucuucaggccgaag

SEQ ID NO: 1504107 - RNA, 18 nt, Pseudomonas aeruginosa PA01
cgagaccaucuggaucag

SEQ ID NO: 1504108 - RNA, 18 nt, Pseudomonas aeruginosa PA01
cgagacccuggcgcuguc

SEQ ID NO: 1504109 - RNA, 19 nt, Pseudomonas aeruginosa PA01
cgagaccucgcccaucgcc

SEQ ID NO: 1504110 - RNA, 21 nt, Pseudomonas aeruginosa PA01
cgagaccucgcccaucgccag

SEQ ID NO: 1504111 - RNA, 23 nt, Pseudomonas aeruginosa PA01
cgagaccucgcccaucgccaggg

SEQ ID NO: 1504112 - RNA, 14 nt, Pseudomonas aeruginosa PA01
cgagaccgacgcuc

SEQ ID NO: 1504113 - RNA, 17 nt, Pseudomonas aeruginosa PA01
cgagaccggggaucagc

SEQ ID NO: 1504114 - RNA, 14 nt, Pseudomonas aeruginosa PA01
cgagagcggcgcca

SEQ ID NO: 1504115 - RNA, 16 nt, Pseudomonas aeruginosa PA01
cgagagcggcgccagg

SEQ ID NO: 1504116 - RNA, 15 nt, Pseudomonas aeruginosa PA01
cgagagcguccggca

SEQ ID NO: 1504117 - RNA, 18 nt, Pseudomonas aeruginosa PA01
cgagagcuguccggcgcu

SEQ ID NO: 1504118 - RNA, 22 nt, Pseudomonas aeruginosa PA01
cgagagcuguccggcgcugagc

SEQ ID NO: 1504119 - RNA, 14 nt, Pseudomonas aeruginosa PA01
cgagaggggcgcuc

SEQ ID NO: 1504120 - RNA, 17 nt, Pseudomonas aeruginosa PA01
cgagaggguggucgcgc

SEQ ID NO: 1504121 - RNA, 20 nt, Pseudomonas aeruginosa PA01
cgagaggucggcgcgcccgg

SEQ ID NO: 1504122 - RNA, 18 nt, Pseudomonas aeruginosa PA01
cgagagcgccgaccagca

SEQ ID NO: 1504123 - RNA, 14 nt, Pseudomonas aeruginosa PA01
cgagacgggcgagg

SEQ ID NO: 1504124 - RNA, 18 nt, Pseudomonas aeruginosa PA01
cgagacgccaucaacgga

SEQ ID NO: 1504125 - RNA, 19 nt, Pseudomonas aeruginosa PA01
cgagacgcccuggaugauc

SEQ ID NO: 1504126 - RNA, 13 nt, Pseudomonas aeruginosa PA01
cgagacgccguag

SEQ ID NO: 1504127 - RNA, 17 nt, Pseudomonas aeruginosa PA01
cgacuccagccaggcga

SEQ ID NO: 1504128 - RNA, 14 nt, Pseudomonas aeruginosa PA01
cgacuugaacaggg

SEQ ID NO: 1504129 - RNA, 17 nt, Pseudomonas aeruginosa PA01
cgacuuccgccuugucc

SEQ ID NO: 1504130 - RNA, 15 nt, Pseudomonas aeruginosa PA01
cgacuucgcaccagc

SEQ ID NO: 1504131 - RNA, 17 nt, Pseudomonas aeruginosa PA01
cgacuucggcaagcacc

SEQ ID NO: 1504132 - RNA, 15 nt, Pseudomonas aeruginosa PA01
cgacuucgacgaacu

SEQ ID NO: 1504133 - RNA, 16 nt, Pseudomonas aeruginosa PA01
cgagaaaguucccgca

SEQ ID NO: 1504134 - RNA, 17 nt, Pseudomonas aeruginosa PA01
cgagaaauaggcgcugc

SEQ ID NO: 1504135 - RNA, 14 nt, Pseudomonas aeruginosa PA01
cgagaacgcggcga

SEQ ID NO: 1504136 - RNA, 14 nt, Pseudomonas aeruginosa PA01
cgagaaacugcagg

SEQ ID NO: 1504137 - RNA, 17 nt, Pseudomonas aeruginosa PA01
cgagaaaccgccaucga

SEQ ID NO: 1504138 - RNA, 16 nt, Pseudomonas aeruginosa PA01
cgacuuggcagucgcc

SEQ ID NO: 1504139 - RNA, 20 nt, Pseudomonas aeruginosa PA01
cgacgugcaaaugcgcaacg

SEQ ID NO: 1504140 - RNA, 13 nt, Pseudomonas aeruginosa PA01
cgacgugcacccg

SEQ ID NO: 1504141 - RNA, 17 nt, Pseudomonas aeruginosa PA01
cgacgucguggauaggc

SEQ ID NO: 1504142 - RNA, 22 nt, Pseudomonas aeruginosa PA01
cgacgucguggauaggcggcgg

SEQ ID NO: 1504143 - RNA, 15 nt, Pseudomonas aeruginosa PA01
cgacguucugcucgc

SEQ ID NO: 1504144 - RNA, 21 nt, Pseudomonas aeruginosa PA01
cgacguucugcucgcugcccg

SEQ ID NO: 1504145 - RNA, 15 nt, Pseudomonas aeruginosa PA01
cgacucacccgcugc

SEQ ID NO: 1504146 - RNA, 14 nt, Pseudomonas aeruginosa PA01
cgacgugggccugc

SEQ ID NO: 1504147 - RNA, 17 nt, Pseudomonas aeruginosa PA01
cgacgcucagcacccug

SEQ ID NO: 1504148 - RNA, 14 nt, Pseudomonas aeruginosa PA01
cgacgcuccagcgg

SEQ ID NO: 1504149 - RNA, 17 nt, Pseudomonas aeruginosa PA01
cgacgcuccagcggcag

SEQ ID NO: 1504150 - RNA, 20 nt, Pseudomonas aeruginosa PA01
cgacgcuccaggugcacggc

SEQ ID NO: 1504151 - RNA, 22 nt, Pseudomonas aeruginosa PA01
cgacgcguugcuuguguccgcc

SEQ ID NO: 1504152 - RNA, 21 nt, Pseudomonas aeruginosa PA01
cgacgcucuccgucagggcgu

SEQ ID NO: 1504153 - RNA, 23 nt, Pseudomonas aeruginosa PA01
cgacgcucugcucggccagcgcc

SEQ ID NO: 1504154 - RNA, 20 nt, Pseudomonas aeruginosa PA01
cgacgcucuucagcgguccg

SEQ ID NO: 1504155 - RNA, 20 nt, Pseudomonas aeruginosa PA01
cgacgcgucguccgaggcgg

SEQ ID NO: 1504156 - RNA, 12 nt, Pseudomonas aeruginosa PA01
cgacgcguccgg

SEQ ID NO: 1504157 - RNA, 14 nt, Pseudomonas aeruginosa PA01
cgacgucggcggcg

SEQ ID NO: 1504158 - RNA, 19 nt, Pseudomonas aeruginosa PA01
cgacgucgaucuugaggaa

SEQ ID NO: 1504159 - RNA, 14 nt, Pseudomonas aeruginosa PA01
cgacgucgacuucg

SEQ ID NO: 1504160 - RNA, 17 nt, Pseudomonas aeruginosa PA01
cgagcgcgaucagccgc

SEQ ID NO: 1504161 - RNA, 18 nt, Pseudomonas aeruginosa PA01
cgagcgcggcuucagagc

SEQ ID NO: 1504162 - RNA, 16 nt, Pseudomonas aeruginosa PA01
cgagcgcggccggcca

SEQ ID NO: 1504163 - RNA, 23 nt, Pseudomonas aeruginosa PA01
cgagcgcucgccgucaucgagca

SEQ ID NO: 1504164 - RNA, 17 nt, Pseudomonas aeruginosa PA01
cgagcgcuucauccugc

SEQ ID NO: 1504165 - RNA, 19 nt, Pseudomonas aeruginosa PA01
cgagcguuuuuggcaaacc

SEQ ID NO: 1504166 - RNA, 20 nt, Pseudomonas aeruginosa PA01
cgagcguucggaucggcccg

SEQ ID NO: 1504167 - RNA, 13 nt, Pseudomonas aeruginosa PA01
cgagcggcccgcg

SEQ ID NO: 1504168 - RNA, 13 nt, Pseudomonas aeruginosa PA01
cgagcggcggccg

SEQ ID NO: 1504169 - RNA, 16 nt, Pseudomonas aeruginosa PA01
cgagcggcgcgaaguc

SEQ ID NO: 1504170 - RNA, 12 nt, Pseudomonas aeruginosa PA01
cgagcugcgagg

SEQ ID NO: 1504171 - RNA, 15 nt, Pseudomonas aeruginosa PA01
cgagcugccgggcga

SEQ ID NO: 1504172 - RNA, 17 nt, Pseudomonas aeruginosa PA01
cgagcugcucggcggug

SEQ ID NO: 1504173 - RNA, 16 nt, Pseudomonas aeruginosa PA01
cgagcuggacgcgcuu

SEQ ID NO: 1504174 - RNA, 12 nt, Pseudomonas aeruginosa PA01
cgagcugcucga

SEQ ID NO: 1504175 - RNA, 14 nt, Pseudomonas aeruginosa PA01
cgagcuggcgcagg

SEQ ID NO: 1504176 - RNA, 21 nt, Pseudomonas aeruginosa PA01
cgagcuggcgcaggccuucga

SEQ ID NO: 1504177 - RNA, 18 nt, Pseudomonas aeruginosa PA01
cgagcugggcguugccca

SEQ ID NO: 1504178 - RNA, 12 nt, Pseudomonas aeruginosa PA01
cgaggauggccg

SEQ ID NO: 1504179 - RNA, 20 nt, Pseudomonas aeruginosa PA01
cgaggauggucaggccggcg

SEQ ID NO: 1504180 - RNA, 22 nt, Pseudomonas aeruginosa PA01
cgaggauggucaggccggcgcg

SEQ ID NO: 1504181 - RNA, 16 nt, Pseudomonas aeruginosa PA01
cgaggaugcucgccug

SEQ ID NO: 1504182 - RNA, 13 nt, Pseudomonas aeruginosa PA01
cgaggacgccggg

SEQ ID NO: 1504183 - RNA, 15 nt, Pseudomonas aeruginosa PA01
cgaggacgccgggcu

SEQ ID NO: 1504184 - RNA, 14 nt, Pseudomonas aeruginosa PA01
cgaggacgccgccg

SEQ ID NO: 1504185 - RNA, 22 nt, Pseudomonas aeruginosa PA01
cgaggacaacacuuccucgugg

SEQ ID NO: 1504186 - RNA, 18 nt, Pseudomonas aeruginosa PA01
cgaggaauuccggcagcg

SEQ ID NO: 1504187 - RNA, 20 nt, Pseudomonas aeruginosa PA01
cgaggaauuccggcagcgac

SEQ ID NO: 1504188 - RNA, 16 nt, Pseudomonas aeruginosa PA01
cgaggaaggccagguc

SEQ ID NO: 1504189 - RNA, 18 nt, Pseudomonas aeruginosa PA01
cgaggaaggcgcuggcgc

SEQ ID NO: 1504190 - RNA, 17 nt, Pseudomonas aeruginosa PA01
cgaggaagucggcggcc

SEQ ID NO: 1504191 - RNA, 14 nt, Pseudomonas aeruginosa PA01
cgaggaagccgacc

SEQ ID NO: 1504192 - RNA, 19 nt, Pseudomonas aeruginosa PA01
cgaggaagccgaccggcgc

SEQ ID NO: 1504193 - RNA, 21 nt, Pseudomonas aeruginosa PA01
cgaggaacaggucgacgccau

SEQ ID NO: 1504194 - RNA, 16 nt, Pseudomonas aeruginosa PA01
cgaggaacauccgcgg

SEQ ID NO: 1504195 - RNA, 15 nt, Pseudomonas aeruginosa PA01
cgaggaacgccgaca

SEQ ID NO: 1504196 - RNA, 18 nt, Pseudomonas aeruginosa PA01
cgagccguuccaggcggg

SEQ ID NO: 1504197 - RNA, 17 nt, Pseudomonas aeruginosa PA01
cgagccggcugaugccc

SEQ ID NO: 1504198 - RNA, 19 nt, Pseudomonas aeruginosa PA01
cgagccggcugaugcccgg

SEQ ID NO: 1504199 - RNA, 20 nt, Pseudomonas aeruginosa PA01
cgagccggcugaugcccggg

SEQ ID NO: 1504200 - RNA, 19 nt, Pseudomonas aeruginosa PA01
cgagccggcgcaucagcgc

SEQ ID NO: 1504201 - RNA, 20 nt, Pseudomonas aeruginosa PA01
cgagccggcgcaucagcgcc

SEQ ID NO: 1504202 - RNA, 14 nt, Pseudomonas aeruginosa PA01
cgagccgcugcggc

SEQ ID NO: 1504203 - RNA, 13 nt, Pseudomonas aeruginosa PA01
cgagccgcuggca

SEQ ID NO: 1504204 - RNA, 19 nt, Pseudomonas aeruginosa PA01
cgagccgcuuggagcgggc

SEQ ID NO: 1504205 - RNA, 17 nt, Pseudomonas aeruginosa PA01
cgagccggacggcggcg

SEQ ID NO: 1504206 - RNA, 19 nt, Pseudomonas aeruginosa PA01
cgagccggcauccuguggc

SEQ ID NO: 1504207 - RNA, 13 nt, Pseudomonas aeruginosa PA01
cgagccgcgcugc

SEQ ID NO: 1504208 - RNA, 15 nt, Pseudomonas aeruginosa PA01
cgagccgcgcugcug

SEQ ID NO: 1504209 - RNA, 15 nt, Pseudomonas aeruginosa PA01
cgagccgccgggcgg

SEQ ID NO: 1504210 - RNA, 22 nt, Pseudomonas aeruginosa PA01
cgagccgccggggaagcugccu

SEQ ID NO: 1504211 - RNA, 16 nt, Pseudomonas aeruginosa PA01
cgagccgcgacgcgac

SEQ ID NO: 1504212 - RNA, 14 nt, Pseudomonas aeruginosa PA01
cgagccgcgacggc

SEQ ID NO: 1504213 - RNA, 15 nt, Pseudomonas aeruginosa PA01
cgagccgcgacggcu

SEQ ID NO: 1504214 - RNA, 11 nt, Pseudomonas aeruginosa PA01
cgagccgcgca

SEQ ID NO: 1504215 - RNA, 14 nt, Pseudomonas aeruginosa PA01
cgagccgcgcagca

SEQ ID NO: 1504216 - RNA, 16 nt, Pseudomonas aeruginosa PA01
cgagcgcacaacgccu

SEQ ID NO: 1504217 - RNA, 19 nt, Pseudomonas aeruginosa PA01
cgagcgcacaacgccuucc

SEQ ID NO: 1504218 - RNA, 16 nt, Pseudomonas aeruginosa PA01
cgagcgaaaucggcag

SEQ ID NO: 1504219 - RNA, 13 nt, Pseudomonas aeruginosa PA01
cgagcgcacgugg

SEQ ID NO: 1504220 - RNA, 16 nt, Pseudomonas aeruginosa PA01
cgagccuugcggcgcu

SEQ ID NO: 1504221 - RNA, 23 nt, Pseudomonas aeruginosa PA01
cgagcgacggugauagagcacgc

SEQ ID NO: 1504222 - RNA, 22 nt, Pseudomonas aeruginosa PA01
cgagccuucagcacggcgcggg

SEQ ID NO: 1504223 - RNA, 18 nt, Pseudomonas aeruginosa PA01
cgagccuggccaggcgcu

SEQ ID NO: 1504224 - RNA, 14 nt, Pseudomonas aeruginosa PA01
cgagcgagcuugca

SEQ ID NO: 1504225 - RNA, 15 nt, Pseudomonas aeruginosa PA01
cgagcgagggcgucg

SEQ ID NO: 1504226 - RNA, 16 nt, Pseudomonas aeruginosa PA01
cgagcgagggcgucga

SEQ ID NO: 1504227 - RNA, 18 nt, Pseudomonas aeruginosa PA01
cgagcgagggcgucgaug

SEQ ID NO: 1504228 - RNA, 17 nt, Pseudomonas aeruginosa PA01
cgagcgccgccaggcag

SEQ ID NO: 1504229 - RNA, 15 nt, Pseudomonas aeruginosa PA01
cgagcgccgccuggg

SEQ ID NO: 1504230 - RNA, 13 nt, Pseudomonas aeruginosa PA01
cgagcgccgccuu

SEQ ID NO: 1504231 - RNA, 22 nt, Pseudomonas aeruginosa PA01
cgagcgccgccuugagcggcgc

SEQ ID NO: 1504232 - RNA, 12 nt, Pseudomonas aeruginosa PA01
cgagcgccuggc

SEQ ID NO: 1504233 - RNA, 14 nt, Pseudomonas aeruginosa PA01
cgagcgcgccgccg

SEQ ID NO: 1504234 - RNA, 15 nt, Pseudomonas aeruginosa PA01
cgagcgcgccgccga

SEQ ID NO: 1504235 - RNA, 14 nt, Pseudomonas aeruginosa PA01
cgagcgcagcgcca

SEQ ID NO: 1504236 - RNA, 17 nt, Pseudomonas aeruginosa PA01
cgagcgcagcgccacca

SEQ ID NO: 1504237 - RNA, 19 nt, Pseudomonas aeruginosa PA01
cgagcgcagcgccaccagg

SEQ ID NO: 1504238 - RNA, 12 nt, Pseudomonas aeruginosa PA01
cgagcgcagcgc

SEQ ID NO: 1504239 - RNA, 13 nt, Pseudomonas aeruginosa PA01
cgagcgcagcgcc

SEQ ID NO: 1504240 - RNA, 15 nt, Pseudomonas aeruginosa PA01
cgagcgcccgccguc

SEQ ID NO: 1504241 - RNA, 23 nt, Pseudomonas aeruginosa PA01
cgaguggccgcgccccacggcgc

SEQ ID NO: 1504242 - RNA, 11 nt, Pseudomonas aeruginosa PA01
cgagucgccgg

SEQ ID NO: 1504243 - RNA, 23 nt, Pseudomonas aeruginosa PA01
cgagugcgcccagcagcaggccg

SEQ ID NO: 1504244 - RNA, 13 nt, Pseudomonas aeruginosa PA01
cgaguggggcgga

SEQ ID NO: 1504245 - RNA, 14 nt, Pseudomonas aeruginosa PA01
cgaguggcgcagcg

SEQ ID NO: 1504246 - RNA, 12 nt, Pseudomonas aeruginosa PA01
cgaguucggcga

SEQ ID NO: 1504247 - RNA, 17 nt, Pseudomonas aeruginosa PA01
cgaguucgcgcaggcgc

SEQ ID NO: 1504248 - RNA, 18 nt, Pseudomonas aeruginosa PA01
cgaguucgcgcaggcgcu

SEQ ID NO: 1504249 - RNA, 17 nt, Pseudomonas aeruginosa PA01
cgaguucgccggccagg

SEQ ID NO: 1504250 - RNA, 19 nt, Pseudomonas aeruginosa PA01
cgaguucgccggccaggug

SEQ ID NO: 1504251 - RNA, 17 nt, Pseudomonas aeruginosa PA01
cgaguugggcgaccugc

SEQ ID NO: 1504252 - RNA, 18 nt, Pseudomonas aeruginosa PA01
cgaguugggcgaccugcu

SEQ ID NO: 1504253 - RNA, 20 nt, Pseudomonas aeruginosa PA01
cgaguugggcgaccugcucg

SEQ ID NO: 1504254 - RNA, 13 nt, Pseudomonas aeruginosa PA01
cgaguugcgcgag

SEQ ID NO: 1504255 - RNA, 16 nt, Pseudomonas aeruginosa PA01
cgaguugcgcgaggcg

SEQ ID NO: 1504256 - RNA, 14 nt, Pseudomonas aeruginosa PA01
cgaguugaccagca

SEQ ID NO: 1504257 - RNA, 18 nt, Pseudomonas aeruginosa PA01
cgaguuucccggcgcggc

SEQ ID NO: 1504258 - RNA, 22 nt, Pseudomonas aeruginosa PA01
cgaguuugacggaacgcauggg

SEQ ID NO: 1504259 - RNA, 14 nt, Pseudomonas aeruginosa PA01
cgauaccgccgccg

SEQ ID NO: 1504260 - RNA, 16 nt, Pseudomonas aeruginosa PA01
cgauaccgccgccggc

SEQ ID NO: 1504261 - RNA, 21 nt, Pseudomonas aeruginosa PA01
cgauacccugggagccgccgg

SEQ ID NO: 1504262 - RNA, 22 nt, Pseudomonas aeruginosa PA01
cgauacccugggagccgccgga

SEQ ID NO: 1504263 - RNA, 23 nt, Pseudomonas aeruginosa PA01
cgauacgcaucugcucgaggaug

SEQ ID NO: 1504264 - RNA, 18 nt, Pseudomonas aeruginosa PA01
cgauacccaggccgucga

SEQ ID NO: 1504265 - RNA, 16 nt, Pseudomonas aeruginosa PA01
cgauaccagcgccgcu

SEQ ID NO: 1504266 - RNA, 19 nt, Pseudomonas aeruginosa PA01
cgauauaggcgacgaucag

SEQ ID NO: 1504267 - RNA, 19 nt, Pseudomonas aeruginosa PA01
cgauauagcccugggcgcc

SEQ ID NO: 1504268 - RNA, 12 nt, Pseudomonas aeruginosa PA01
cgauaucacgcc

SEQ ID NO: 1504269 - RNA, 17 nt, Pseudomonas aeruginosa PA01
cgauauccacgccgucg

SEQ ID NO: 1504270 - RNA, 16 nt, Pseudomonas aeruginosa PA01
cgauaucggcgccggc

SEQ ID NO: 1504271 - RNA, 15 nt, Pseudomonas aeruginosa PA01
cgaggcuuuccagca

SEQ ID NO: 1504272 - RNA, 16 nt, Pseudomonas aeruginosa PA01
cgaggcuuuccagcag

SEQ ID NO: 1504273 - RNA, 18 nt, Pseudomonas aeruginosa PA01
cgaggcuuuccagcaggc

SEQ ID NO: 1504274 - RNA, 15 nt, Pseudomonas aeruginosa PA01
cgagggacugaagag

SEQ ID NO: 1504275 - RNA, 22 nt, Pseudomonas aeruginosa PA01
cgaggguggcgcccaugccgcc

SEQ ID NO: 1504276 - RNA, 18 nt, Pseudomonas aeruginosa PA01
cgaggguggucagccagc

SEQ ID NO: 1504277 - RNA, 19 nt, Pseudomonas aeruginosa PA01
cgaggguggucagccagcc

SEQ ID NO: 1504278 - RNA, 21 nt, Pseudomonas aeruginosa PA01
cgagggaggucgcacgcagcg

SEQ ID NO: 1504279 - RNA, 23 nt, Pseudomonas aeruginosa PA01
cgagggaggucgcacgcagcgcc

SEQ ID NO: 1504280 - RNA, 17 nt, Pseudomonas aeruginosa PA01
cgagggauguuccaggc

SEQ ID NO: 1504281 - RNA, 21 nt, Pseudomonas aeruginosa PA01
cgagggcaaaggcgcgcaggg

SEQ ID NO: 1504282 - RNA, 13 nt, Pseudomonas aeruginosa PA01
cgagggcaccacg

SEQ ID NO: 1504283 - RNA, 23 nt, Pseudomonas aeruginosa PA01
cgagguccaucuugaugccgaag

SEQ ID NO: 1504284 - RNA, 15 nt, Pseudomonas aeruginosa PA01
cgaggauuuccgcgc

SEQ ID NO: 1504285 - RNA, 19 nt, Pseudomonas aeruginosa PA01
cgaggauuuccgcgcccgg

SEQ ID NO: 1504286 - RNA, 21 nt, Pseudomonas aeruginosa PA01
cgaggauuuccggcuugccga

SEQ ID NO: 1504287 - RNA, 15 nt, Pseudomonas aeruginosa PA01
cgaggauuuccucgc

SEQ ID NO: 1504288 - RNA, 17 nt, Pseudomonas aeruginosa PA01
cgaggauuuccucgcgc

SEQ ID NO: 1504289 - RNA, 20 nt, Pseudomonas aeruginosa PA01
cgaggauuuccucgcgcacc

SEQ ID NO: 1504290 - RNA, 23 nt, Pseudomonas aeruginosa PA01
cgaggauuuccucgcgcaccgcg

SEQ ID NO: 1504291 - RNA, 14 nt, Pseudomonas aeruginosa PA01
cgaggcgucggcgg

SEQ ID NO: 1504292 - RNA, 17 nt, Pseudomonas aeruginosa PA01
cgaggcagccgucggug

SEQ ID NO: 1504293 - RNA, 18 nt, Pseudomonas aeruginosa PA01
cgaggcagccgucgguga

SEQ ID NO: 1504294 - RNA, 23 nt, Pseudomonas aeruginosa PA01
cgaggcugcgauauggccgauca

SEQ ID NO: 1504295 - RNA, 17 nt, Pseudomonas aeruginosa PA01
cgaggcugcgggcgaug

SEQ ID NO: 1504296 - RNA, 21 nt, Pseudomonas aeruginosa PA01
cgaggcugucgcggacccgcg

SEQ ID NO: 1504297 - RNA, 15 nt, Pseudomonas aeruginosa PA01
cgaggcugugggucg

SEQ ID NO: 1504298 - RNA, 14 nt, Pseudomonas aeruginosa PA01
cgaggcuaacgccg

SEQ ID NO: 1504299 - RNA, 16 nt, Pseudomonas aeruginosa PA01
cgaggcuaacgccgag

SEQ ID NO: 1504300 - RNA, 19 nt, Pseudomonas aeruginosa PA01
cgagucgacccaggcccag

SEQ ID NO: 1504301 - RNA, 13 nt, Pseudomonas aeruginosa PA01
cgagucgaucagg

SEQ ID NO: 1504302 - RNA, 16 nt, Pseudomonas aeruginosa PA01
cgaguccuucggcgca

SEQ ID NO: 1504303 - RNA, 13 nt, Pseudomonas aeruginosa PA01
cgagguugcgcag

SEQ ID NO: 1504304 - RNA, 13 nt, Pseudomonas aeruginosa PA01
cgagguugcgcgg

SEQ ID NO: 1504305 - RNA, 15 nt, Pseudomonas aeruginosa PA01
cgagguugcgcggca

SEQ ID NO: 1504306 - RNA, 16 nt, Pseudomonas aeruginosa PA01
cgagguugcgcggcag

SEQ ID NO: 1504307 - RNA, 16 nt, Pseudomonas aeruginosa PA01
cgagguucucgacccg

SEQ ID NO: 1504308 - RNA, 23 nt, Pseudomonas aeruginosa PA01
cgagguucuugucuucgauccgg

SEQ ID NO: 1504309 - RNA, 22 nt, Pseudomonas aeruginosa PA01
cgagguugcccacggccaggcc

SEQ ID NO: 1504310 - RNA, 19 nt, Pseudomonas aeruginosa PA01
cgagguuguagcccugggc

SEQ ID NO: 1504311 - RNA, 14 nt, Pseudomonas aeruginosa PA01
cgaguaagcgcggu

SEQ ID NO: 1504312 - RNA, 16 nt, Pseudomonas aeruginosa PA01
cgagucccuugcggca

SEQ ID NO: 1504313 - RNA, 19 nt, Pseudomonas aeruginosa PA01
cgagucccuugcggcagac

SEQ ID NO: 1504314 - RNA, 16 nt, Pseudomonas aeruginosa PA01
cgaguccgacccgcuc

SEQ ID NO: 1504315 - RNA, 18 nt, Pseudomonas aeruginosa PA01
cgaguccgacccgcuccg

SEQ ID NO: 1504316 - RNA, 14 nt, Pseudomonas aeruginosa PA01
cgaggucgaccagc

SEQ ID NO: 1504317 - RNA, 17 nt, Pseudomonas aeruginosa PA01
cgaggucgaccagccag

SEQ ID NO: 1504318 - RNA, 16 nt, Pseudomonas aeruginosa PA01
cgaggucgacggcggc

SEQ ID NO: 1504319 - RNA, 12 nt, Pseudomonas aeruginosa PA01
cgaggucgccgc

SEQ ID NO: 1504320 - RNA, 16 nt, Pseudomonas aeruginosa PA01
cgaggucgccgccagc

SEQ ID NO: 1504321 - RNA, 13 nt, Pseudomonas aeruginosa PA01
cgaggucgccggg

SEQ ID NO: 1504322 - RNA, 13 nt, Pseudomonas aeruginosa PA01
cgaggucgcgggc

SEQ ID NO: 1504323 - RNA, 11 nt, Pseudomonas aeruginosa PA01
cgaggucggcc

SEQ ID NO: 1504324 - RNA, 14 nt, Pseudomonas aeruginosa PA01
cgaggucggccugc

SEQ ID NO: 1504325 - RNA, 20 nt, Pseudomonas aeruginosa PA01
cgagguguucccggaucagc

SEQ ID NO: 1504326 - RNA, 16 nt, Pseudomonas aeruginosa PA01
cgaggugucguccauc

SEQ ID NO: 1504327 - RNA, 18 nt, Pseudomonas aeruginosa PA01
cgaggugucguccaucga

SEQ ID NO: 1504328 - RNA, 13 nt, Pseudomonas aeruginosa PA01
cgacacccgcgcc

SEQ ID NO: 1504329 - RNA, 17 nt, Pseudomonas aeruginosa PA01
cgacacccgcgccgccg

SEQ ID NO: 1504330 - RNA, 23 nt, Pseudomonas aeruginosa PA01
cgacacccgcgccgccgcggcca

SEQ ID NO: 1504331 - RNA, 18 nt, Pseudomonas aeruginosa PA01
cgacaccccggucaggcc

SEQ ID NO: 1504332 - RNA, 13 nt, Pseudomonas aeruginosa PA01
cgacaccgggccu

SEQ ID NO: 1504333 - RNA, 21 nt, Pseudomonas aeruginosa PA01
cgacaccugcaacgcccgcga

SEQ ID NO: 1504334 - RNA, 20 nt, Pseudomonas aeruginosa PA01
cgacaccgaucaccuggccg

SEQ ID NO: 1504335 - RNA, 14 nt, Pseudomonas aeruginosa PA01
cgacaccgccagca

SEQ ID NO: 1504336 - RNA, 15 nt, Pseudomonas aeruginosa PA01
cgacaccgccagcac

SEQ ID NO: 1504337 - RNA, 17 nt, Pseudomonas aeruginosa PA01
cgacaaggcugaggccg

SEQ ID NO: 1504338 - RNA, 21 nt, Pseudomonas aeruginosa PA01
cgacaaggcugaggccgacga

SEQ ID NO: 1504339 - RNA, 13 nt, Pseudomonas aeruginosa PA01
cgacaaggagcgc

SEQ ID NO: 1504340 - RNA, 18 nt, Pseudomonas aeruginosa PA01
cgacaaggagcgcgagcg

SEQ ID NO: 1504341 - RNA, 19 nt, Pseudomonas aeruginosa PA01
cgacaaggagcgcgagcgg

SEQ ID NO: 1504342 - RNA, 20 nt, Pseudomonas aeruginosa PA01
cgacaaggagcgcgagcggc

SEQ ID NO: 1504343 - RNA, 23 nt, Pseudomonas aeruginosa PA01
cgacaaggagcgcgagcggcaga

SEQ ID NO: 1504344 - RNA, 16 nt, Pseudomonas aeruginosa PA01
cgacaagccuccagcg

SEQ ID NO: 1504345 - RNA, 17 nt, Pseudomonas aeruginosa PA01
cgacaagcauucagcgc

SEQ ID NO: 1504346 - RNA, 21 nt, Pseudomonas aeruginosa PA01
cgacaacgaaaagagccgcgc

SEQ ID NO: 1504347 - RNA, 23 nt, Pseudomonas aeruginosa PA01
cgacaacgaaaagagccgcgccu

SEQ ID NO: 1504348 - RNA, 22 nt, Pseudomonas aeruginosa PA01
cgacacaccgacaaucgccgag

SEQ ID NO: 1504349 - RNA, 17 nt, Pseudomonas aeruginosa PA01
cgacacagacgcagccg

SEQ ID NO: 1504350 - RNA, 14 nt, Pseudomonas aeruginosa PA01
cgacaaucgccgag

SEQ ID NO: 1504351 - RNA, 22 nt, Pseudomonas aeruginosa PA01
cgacaaucuugucguucggccc

SEQ ID NO: 1504352 - RNA, 17 nt, Pseudomonas aeruginosa PA01
cgacacauggucggcca

SEQ ID NO: 1504353 - RNA, 18 nt, Pseudomonas aeruginosa PA01
cgacacauggucggccag

SEQ ID NO: 1504354 - RNA, 19 nt, Pseudomonas aeruginosa PA01
cgacacauggucggccagg

SEQ ID NO: 1504355 - RNA, 20 nt, Pseudomonas aeruginosa PA01
cgacaccaugcuccgccugg

SEQ ID NO: 1504356 - RNA, 21 nt, Pseudomonas aeruginosa PA01
cgacaccaugcuccgccuggc

SEQ ID NO: 1504357 - RNA, 20 nt, Pseudomonas aeruginosa PA01
cgacagcucuggggucaguu

SEQ ID NO: 1504358 - RNA, 15 nt, Pseudomonas aeruginosa PA01
cgacaggcagcgccg

SEQ ID NO: 1504359 - RNA, 17 nt, Pseudomonas aeruginosa PA01
cgacaggcagcgccgcc

SEQ ID NO: 1504360 - RNA, 19 nt, Pseudomonas aeruginosa PA01
cgacaggcagcgccgccca

SEQ ID NO: 1504361 - RNA, 12 nt, Pseudomonas aeruginosa PA01
cgacaggccggu

SEQ ID NO: 1504362 - RNA, 14 nt, Pseudomonas aeruginosa PA01
cgacaggccggugc

SEQ ID NO: 1504363 - RNA, 18 nt, Pseudomonas aeruginosa PA01
cgacaggccggugccgcc

SEQ ID NO: 1504364 - RNA, 15 nt, Pseudomonas aeruginosa PA01
cgacaggccgaccag

SEQ ID NO: 1504365 - RNA, 18 nt, Pseudomonas aeruginosa PA01
cgacaggccgaccagcag

SEQ ID NO: 1504366 - RNA, 19 nt, Pseudomonas aeruginosa PA01
cgacaggccgaccagcagg

SEQ ID NO: 1504367 - RNA, 13 nt, Pseudomonas aeruginosa PA01
cgacaggccgccg

SEQ ID NO: 1504368 - RNA, 20 nt, Pseudomonas aeruginosa PA01
cgacaggcggcgggccggcg

SEQ ID NO: 1504369 - RNA, 14 nt, Pseudomonas aeruginosa PA01
cgacaggcgaucga

SEQ ID NO: 1504370 - RNA, 18 nt, Pseudomonas aeruginosa PA01
cgacaggcgucuucggcg

SEQ ID NO: 1504371 - RNA, 23 nt, Pseudomonas aeruginosa PA01
cgacagguucaggacgcuccugc

SEQ ID NO: 1504372 - RNA, 20 nt, Pseudomonas aeruginosa PA01
cgacaggucgcuuucgcgca

SEQ ID NO: 1504373 - RNA, 22 nt, Pseudomonas aeruginosa PA01
cgacaggucgcuuucgcgcaga

SEQ ID NO: 1504374 - RNA, 22 nt, Pseudomonas aeruginosa PA01
cgacaggucggccggcagcucc

SEQ ID NO: 1504375 - RNA, 14 nt, Pseudomonas aeruginosa PA01
cgacagcaucugcu

SEQ ID NO: 1504376 - RNA, 13 nt, Pseudomonas aeruginosa PA01
cgacagcagcgcc

SEQ ID NO: 1504377 - RNA, 14 nt, Pseudomonas aeruginosa PA01
cgacagcagcgcca

SEQ ID NO: 1504378 - RNA, 12 nt, Pseudomonas aeruginosa PA01
cgacagcagcgc

SEQ ID NO: 1504379 - RNA, 14 nt, Pseudomonas aeruginosa PA01
cgacagcaggucgu

SEQ ID NO: 1504380 - RNA, 15 nt, Pseudomonas aeruginosa PA01
cgacagcaggucgug

SEQ ID NO: 1504381 - RNA, 19 nt, Pseudomonas aeruginosa PA01
cgacagcagguggcugguc

SEQ ID NO: 1504382 - RNA, 15 nt, Pseudomonas aeruginosa PA01
cgacagcaccaugcc

SEQ ID NO: 1504383 - RNA, 15 nt, Pseudomonas aeruginosa PA01
cgacacgcucagccc

SEQ ID NO: 1504384 - RNA, 23 nt, Pseudomonas aeruginosa PA01
cgacagauagcaggucacgcccu

SEQ ID NO: 1504385 - RNA, 15 nt, Pseudomonas aeruginosa PA01
cgacagagcggccgg

SEQ ID NO: 1504386 - RNA, 16 nt, Pseudomonas aeruginosa PA01
cgacagagcggccggc

SEQ ID NO: 1504387 - RNA, 21 nt, Pseudomonas aeruginosa PA01
cgacacucugguagcugcggc

SEQ ID NO: 1504388 - RNA, 22 nt, Pseudomonas aeruginosa PA01
cgacacucugguagcugcggcc

SEQ ID NO: 1504389 - RNA, 18 nt, Pseudomonas aeruginosa PA01
cgaagugaagcgauccag

SEQ ID NO: 1504390 - RNA, 13 nt, Pseudomonas aeruginosa PA01
cgaagugaccgcg

SEQ ID NO: 1504391 - RNA, 18 nt, Pseudomonas aeruginosa PA01
cgaagugaccgcgcgcca

SEQ ID NO: 1504392 - RNA, 21 nt, Pseudomonas aeruginosa PA01
cgaagucugccuguccgcugc

SEQ ID NO: 1504393 - RNA, 15 nt, Pseudomonas aeruginosa PA01
cgaagucgccauccu

SEQ ID NO: 1504394 - RNA, 19 nt, Pseudomonas aeruginosa PA01
cgaagucgcccgccggcgu

SEQ ID NO: 1504395 - RNA, 20 nt, Pseudomonas aeruginosa PA01
cgaagucgccgucguccggg

SEQ ID NO: 1504396 - RNA, 16 nt, Pseudomonas aeruginosa PA01
cgaagucggcgcgcca

SEQ ID NO: 1504397 - RNA, 13 nt, Pseudomonas aeruginosa PA01
cgaagucgaucac

SEQ ID NO: 1504398 - RNA, 13 nt, Pseudomonas aeruginosa PA01
cgaagucgaagca

SEQ ID NO: 1504399 - RNA, 17 nt, Pseudomonas aeruginosa PA01
cgaagucgaagcagccc

SEQ ID NO: 1504400 - RNA, 16 nt, Pseudomonas aeruginosa PA01
cgaaguccaccaggcg

SEQ ID NO: 1504401 - RNA, 21 nt, Pseudomonas aeruginosa PA01
cgaaguccaccaggcgccggg

SEQ ID NO: 1504402 - RNA, 17 nt, Pseudomonas aeruginosa PA01
cgaaguagucgccccgg

SEQ ID NO: 1504403 - RNA, 21 nt, Pseudomonas aeruginosa PA01
cgaaguccggguugagcaccc

SEQ ID NO: 1504404 - RNA, 20 nt, Pseudomonas aeruginosa PA01
cgaauggagggaucgcgcgg

SEQ ID NO: 1504405 - RNA, 13 nt, Pseudomonas aeruginosa PA01
cgaauggcagcag

SEQ ID NO: 1504406 - RNA, 19 nt, Pseudomonas aeruginosa PA01
cgaauggcauucagcucga

SEQ ID NO: 1504407 - RNA, 17 nt, Pseudomonas aeruginosa PA01
cgaauggcgccggccag

SEQ ID NO: 1504408 - RNA, 17 nt, Pseudomonas aeruginosa PA01
cgaauccuccagccggc

SEQ ID NO: 1504409 - RNA, 20 nt, Pseudomonas aeruginosa PA01
cgaauccgcggcccugcucg

SEQ ID NO: 1504410 - RNA, 21 nt, Pseudomonas aeruginosa PA01
cgaauccgcggcccugcucgc

SEQ ID NO: 1504411 - RNA, 22 nt, Pseudomonas aeruginosa PA01
cgaauccgcggcccugcucgcc

SEQ ID NO: 1504412 - RNA, 14 nt, Pseudomonas aeruginosa PA01
cgaauccgccggcg

SEQ ID NO: 1504413 - RNA, 14 nt, Pseudomonas aeruginosa PA01
cgaaucgccuacca

SEQ ID NO: 1504414 - RNA, 22 nt, Pseudomonas aeruginosa PA01
cgaaggcuccgcugcucagggc

SEQ ID NO: 1504415 - RNA, 16 nt, Pseudomonas aeruginosa PA01
cgaaggcgucgggcag

SEQ ID NO: 1504416 - RNA, 14 nt, Pseudomonas aeruginosa PA01
cgaaggcgugccgc

SEQ ID NO: 1504417 - RNA, 19 nt, Pseudomonas aeruginosa PA01
cgaaggcgugccgcuggcc

SEQ ID NO: 1504418 - RNA, 16 nt, Pseudomonas aeruginosa PA01
cgaaggcgugggcgcc

SEQ ID NO: 1504419 - RNA, 19 nt, Pseudomonas aeruginosa PA01
cgaaggcgugggcgccggc

SEQ ID NO: 1504420 - RNA, 17 nt, Pseudomonas aeruginosa PA01
cgaaggcgauauggccg

SEQ ID NO: 1504421 - RNA, 13 nt, Pseudomonas aeruginosa PA01
cgaaggcgaucac

SEQ ID NO: 1504422 - RNA, 20 nt, Pseudomonas aeruginosa PA01
cgaaggcgaucacgguggua

SEQ ID NO: 1504423 - RNA, 18 nt, Pseudomonas aeruginosa PA01
cgaaggucgaaggcgcgg

SEQ ID NO: 1504424 - RNA, 12 nt, Pseudomonas aeruginosa PA01
cgaaggguuggc

SEQ ID NO: 1504425 - RNA, 20 nt, Pseudomonas aeruginosa PA01
cgaaggguuggccgcagcag

SEQ ID NO: 1504426 - RNA, 19 nt, Pseudomonas aeruginosa PA01
cgaagguacugccgcuauc

SEQ ID NO: 1504427 - RNA, 19 nt, Pseudomonas aeruginosa PA01
cgaaggucugccccggcuu

SEQ ID NO: 1504428 - RNA, 21 nt, Pseudomonas aeruginosa PA01
cgaaggucugccccggcuugg

SEQ ID NO: 1504429 - RNA, 15 nt, Pseudomonas aeruginosa PA01
cgaaguagccggcgu

SEQ ID NO: 1504430 - RNA, 14 nt, Pseudomonas aeruginosa PA01
cgaagggcaggccg

SEQ ID NO: 1504431 - RNA, 22 nt, Pseudomonas aeruginosa PA01
cgaagggcucagcccaggcgcc

SEQ ID NO: 1504432 - RNA, 14 nt, Pseudomonas aeruginosa PA01
cgaagggccgcagg

SEQ ID NO: 1504433 - RNA, 19 nt, Pseudomonas aeruginosa PA01
cgaagggccgcagguuggc

SEQ ID NO: 1504434 - RNA, 13 nt, Pseudomonas aeruginosa PA01
cgaaggacaggcc

SEQ ID NO: 1504435 - RNA, 17 nt, Pseudomonas aeruginosa PA01
cgaagcggcuggccgcg

SEQ ID NO: 1504436 - RNA, 18 nt, Pseudomonas aeruginosa PA01
cgaagcggcuggccgcgg

SEQ ID NO: 1504437 - RNA, 19 nt, Pseudomonas aeruginosa PA01
cgaagcggcuggccgcggu

SEQ ID NO: 1504438 - RNA, 20 nt, Pseudomonas aeruginosa PA01
cgaagcggcuggccgcggug

SEQ ID NO: 1504439 - RNA, 16 nt, Pseudomonas aeruginosa PA01
cgaagcggcucggcca

SEQ ID NO: 1504440 - RNA, 12 nt, Pseudomonas aeruginosa PA01
cgaagcggcccu

SEQ ID NO: 1504441 - RNA, 22 nt, Pseudomonas aeruginosa PA01
cgaagcggcccuugucgccgcu

SEQ ID NO: 1504442 - RNA, 14 nt, Pseudomonas aeruginosa PA01
cgaagcgcucgaca

SEQ ID NO: 1504443 - RNA, 16 nt, Pseudomonas aeruginosa PA01
cgaagcgcucgacaua

SEQ ID NO: 1504444 - RNA, 18 nt, Pseudomonas aeruginosa PA01
cgaagcggaucucgucgc

SEQ ID NO: 1504445 - RNA, 19 nt, Pseudomonas aeruginosa PA01
cgaagcggaucucgucgcc

SEQ ID NO: 1504446 - RNA, 22 nt, Pseudomonas aeruginosa PA01
cgaagcggaucucgucgccgac

SEQ ID NO: 1504447 - RNA, 23 nt, Pseudomonas aeruginosa PA01
cgaagcggaucucgucgccgacc

SEQ ID NO: 1504448 - RNA, 16 nt, Pseudomonas aeruginosa PA01
cgaagcggaagccggg

SEQ ID NO: 1504449 - RNA, 19 nt, Pseudomonas aeruginosa PA01
cgaagcggaagccgggaag

SEQ ID NO: 1504450 - RNA, 22 nt, Pseudomonas aeruginosa PA01
cgaaggcaacagcccgcgccgc

SEQ ID NO: 1504451 - RNA, 21 nt, Pseudomonas aeruginosa PA01
cgaaggcaaugccgcccucca

SEQ ID NO: 1504452 - RNA, 18 nt, Pseudomonas aeruginosa PA01
cgaaggccaguccggcac

SEQ ID NO: 1504453 - RNA, 22 nt, Pseudomonas aeruginosa PA01
cgaaggccaguccggcaccgcu

SEQ ID NO: 1504454 - RNA, 19 nt, Pseudomonas aeruginosa PA01
cgaaggccagcucgucgcc

SEQ ID NO: 1504455 - RNA, 15 nt, Pseudomonas aeruginosa PA01
cgaaggccaggaccg

SEQ ID NO: 1504456 - RNA, 23 nt, Pseudomonas aeruginosa PA01
cgaaggccaggaccgcgauggua

SEQ ID NO: 1504457 - RNA, 18 nt, Pseudomonas aeruginosa PA01
cgaaggccaggccggcgc

SEQ ID NO: 1504458 - RNA, 19 nt, Pseudomonas aeruginosa PA01
cgaaggccaggccggcgcc

SEQ ID NO: 1504459 - RNA, 20 nt, Pseudomonas aeruginosa PA01
cgaaggccaggccggcgccu

SEQ ID NO: 1504460 - RNA, 14 nt, Pseudomonas aeruginosa PA01
cgaaggaucgccuu

SEQ ID NO: 1504461 - RNA, 16 nt, Pseudomonas aeruginosa PA01
cgaaggccuccucgua

SEQ ID NO: 1504462 - RNA, 22 nt, Pseudomonas aeruginosa PA01
cgaaggccuccucguaggcguc

SEQ ID NO: 1504463 - RNA, 17 nt, Pseudomonas aeruginosa PA01
cgaaggccucgucgauc

SEQ ID NO: 1504464 - RNA, 19 nt, Pseudomonas aeruginosa PA01
cgaaggccucgucgcccgg

SEQ ID NO: 1504465 - RNA, 14 nt, Pseudomonas aeruginosa PA01
cgaaggccuggccg

SEQ ID NO: 1504466 - RNA, 15 nt, Pseudomonas aeruginosa PA01
cgaaggccuggccgu

SEQ ID NO: 1504467 - RNA, 20 nt, Pseudomonas aeruginosa PA01
cgaaggccuggccguugcgc

SEQ ID NO: 1504468 - RNA, 22 nt, Pseudomonas aeruginosa PA01
cgaagaucacauacaccuugcg

SEQ ID NO: 1504469 - RNA, 15 nt, Pseudomonas aeruginosa PA01
cgaagauacccagcg

SEQ ID NO: 1504470 - RNA, 18 nt, Pseudomonas aeruginosa PA01
cgaagauacccagcgggc

SEQ ID NO: 1504471 - RNA, 20 nt, Pseudomonas aeruginosa PA01
cgaagaggcccucggcgccg

SEQ ID NO: 1504472 - RNA, 20 nt, Pseudomonas aeruginosa PA01
cgaagagcuggcggccgcgu

SEQ ID NO: 1504473 - RNA, 22 nt, Pseudomonas aeruginosa PA01
cgaagaaaaggcccggcguccu

SEQ ID NO: 1504474 - RNA, 21 nt, Pseudomonas aeruginosa PA01
cgaagaccuguugcagagcgg

SEQ ID NO: 1504475 - RNA, 17 nt, Pseudomonas aeruginosa PA01
cgaagaccuugaacucg

SEQ ID NO: 1504476 - RNA, 21 nt, Pseudomonas aeruginosa PA01
cgaagaccuugaacucgcccg

SEQ ID NO: 1504477 - RNA, 20 nt, Pseudomonas aeruginosa PA01
cgaagaucgacaggccgccg

SEQ ID NO: 1504478 - RNA, 20 nt, Pseudomonas aeruginosa PA01
cgaagaucucgccauggcgg

SEQ ID NO: 1504479 - RNA, 17 nt, Pseudomonas aeruginosa PA01
cgaagcagcccagcgcu

SEQ ID NO: 1504480 - RNA, 20 nt, Pseudomonas aeruginosa PA01
cgaagcagagggcguccugc

SEQ ID NO: 1504481 - RNA, 23 nt, Pseudomonas aeruginosa PA01
cgaagcgcagcuccggcagcagg

SEQ ID NO: 1504482 - RNA, 14 nt, Pseudomonas aeruginosa PA01
cgaagcgcagcacg

SEQ ID NO: 1504483 - RNA, 21 nt, Pseudomonas aeruginosa PA01
cgaagcagccguauggccccu

SEQ ID NO: 1504484 - RNA, 21 nt, Pseudomonas aeruginosa PA01
cgaagcgcaggugcaccgcgc

SEQ ID NO: 1504485 - RNA, 13 nt, Pseudomonas aeruginosa PA01
cgaagcgccaggc

SEQ ID NO: 1504486 - RNA, 14 nt, Pseudomonas aeruginosa PA01
cgaagcgccaggcg

SEQ ID NO: 1504487 - RNA, 18 nt, Pseudomonas aeruginosa PA01
cgaagcgccggcggccug

SEQ ID NO: 1504488 - RNA, 13 nt, Pseudomonas aeruginosa PA01
cgaagcgcgccug

SEQ ID NO: 1504489 - RNA, 17 nt, Pseudomonas aeruginosa PA01
cgaagcgcgccugcucu

SEQ ID NO: 1504490 - RNA, 18 nt, Pseudomonas aeruginosa PA01
cgaacgugcgcgcaacug

SEQ ID NO: 1504491 - RNA, 21 nt, Pseudomonas aeruginosa PA01
ccugguugcggaacggcucgc

SEQ ID NO: 1504492 - RNA, 17 nt, Pseudomonas aeruginosa PA01
ccuguacauagcggguc

SEQ ID NO: 1504493 - RNA, 14 nt, Pseudomonas aeruginosa PA01
cgaacugccgacgg

SEQ ID NO: 1504494 - RNA, 16 nt, Pseudomonas aeruginosa PA01
cgaacugccgacggcg

SEQ ID NO: 1504495 - RNA, 21 nt, Pseudomonas aeruginosa PA01
cgaacugcucgaaagccucca

SEQ ID NO: 1504496 - RNA, 15 nt, Pseudomonas aeruginosa PA01
cgaacuucaggccgg

SEQ ID NO: 1504497 - RNA, 20 nt, Pseudomonas aeruginosa PA01
cgaacuucaggccggcgccg

SEQ ID NO: 1504498 - RNA, 15 nt, Pseudomonas aeruginosa PA01
cgaacuccgagcagg

SEQ ID NO: 1504499 - RNA, 15 nt, Pseudomonas aeruginosa PA01
cgaacuccgccagca

SEQ ID NO: 1504500 - RNA, 20 nt, Pseudomonas aeruginosa PA01
cgaacuccgccagcaccacc

SEQ ID NO: 1504501 - RNA, 16 nt, Pseudomonas aeruginosa PA01
cgaacuccgccagcuu

SEQ ID NO: 1504502 - RNA, 16 nt, Pseudomonas aeruginosa PA01
cgaacugcagggcguc

SEQ ID NO: 1504503 - RNA, 22 nt, Pseudomonas aeruginosa PA01
cgaacugcagggcgucgccggg

SEQ ID NO: 1504504 - RNA, 23 nt, Pseudomonas aeruginosa PA01
cgaacugcagggcgucgccggga

SEQ ID NO: 1504505 - RNA, 17 nt, Pseudomonas aeruginosa PA01
cgaacugcauggccuug

SEQ ID NO: 1504506 - RNA, 17 nt, Pseudomonas aeruginosa PA01
cgacgccauggguggaa

SEQ ID NO: 1504507 - RNA, 14 nt, Pseudomonas aeruginosa PA01
cgacgcauggauca

SEQ ID NO: 1504508 - RNA, 17 nt, Pseudomonas aeruginosa PA01
cgacgcauggaucaugg

SEQ ID NO: 1504509 - RNA, 13 nt, Pseudomonas aeruginosa PA01
cgacgcagggcgg

SEQ ID NO: 1504510 - RNA, 14 nt, Pseudomonas aeruginosa PA01
cgacgcccgaggcg

SEQ ID NO: 1504511 - RNA, 19 nt, Pseudomonas aeruginosa PA01
cgacgcccgcuugcgccgc

SEQ ID NO: 1504512 - RNA, 15 nt, Pseudomonas aeruginosa PA01
cgacgcccugggcga

SEQ ID NO: 1504513 - RNA, 14 nt, Pseudomonas aeruginosa PA01
cgacgcccuccagc

SEQ ID NO: 1504514 - RNA, 20 nt, Pseudomonas aeruginosa PA01
cgacgcccuccagcaccgcc

SEQ ID NO: 1504515 - RNA, 23 nt, Pseudomonas aeruginosa PA01
cgacgcccuccagcaccgccugg

SEQ ID NO: 1504516 - RNA, 14 nt, Pseudomonas aeruginosa PA01
cgacgcccucggcg

SEQ ID NO: 1504517 - RNA, 11 nt, Pseudomonas aeruginosa PA01
cgacgccgaug

SEQ ID NO: 1504518 - RNA, 12 nt, Pseudomonas aeruginosa PA01
cgacgccgaugc

SEQ ID NO: 1504519 - RNA, 16 nt, Pseudomonas aeruginosa PA01
cgacgccgaguuggaa

SEQ ID NO: 1504520 - RNA, 13 nt, Pseudomonas aeruginosa PA01
cgacgccgagcag

SEQ ID NO: 1504521 - RNA, 14 nt, Pseudomonas aeruginosa PA01
cgacgccgagcagc

SEQ ID NO: 1504522 - RNA, 14 nt, Pseudomonas aeruginosa PA01
cgacgccgagccag

SEQ ID NO: 1504523 - RNA, 17 nt, Pseudomonas aeruginosa PA01
cgacgccgagcugacca

SEQ ID NO: 1504524 - RNA, 13 nt, Pseudomonas aeruginosa PA01
cgacgccgaagcc

SEQ ID NO: 1504525 - RNA, 13 nt, Pseudomonas aeruginosa PA01
cgacgccgccugc

SEQ ID NO: 1504526 - RNA, 16 nt, Pseudomonas aeruginosa PA01
cgacgccgccugcgcc

SEQ ID NO: 1504527 - RNA, 19 nt, Pseudomonas aeruginosa PA01
cgacgccgcccggcaccgg

SEQ ID NO: 1504528 - RNA, 20 nt, Pseudomonas aeruginosa PA01
cgacgccgcccggcaccggg

SEQ ID NO: 1504529 - RNA, 12 nt, Pseudomonas aeruginosa PA01
cgacgccgccga

SEQ ID NO: 1504530 - RNA, 22 nt, Pseudomonas aeruginosa PA01
cgacgccgcgucccugcacagg

SEQ ID NO: 1504531 - RNA, 16 nt, Pseudomonas aeruginosa PA01
cgacgccgcggccggc

SEQ ID NO: 1504532 - RNA, 17 nt, Pseudomonas aeruginosa PA01
cgacgccgcuggcggcg

SEQ ID NO: 1504533 - RNA, 20 nt, Pseudomonas aeruginosa PA01
cgacgccgcuggcggcgcuc

SEQ ID NO: 1504534 - RNA, 19 nt, Pseudomonas aeruginosa PA01
cgacgccggacgcaccagc

SEQ ID NO: 1504535 - RNA, 22 nt, Pseudomonas aeruginosa PA01
cgacgccggacgcaccagcagg

SEQ ID NO: 1504536 - RNA, 12 nt, Pseudomonas aeruginosa PA01
cgacgccgcugg

SEQ ID NO: 1504537 - RNA, 22 nt, Pseudomonas aeruginosa PA01
cgacgccgcuggaaccggccgg

SEQ ID NO: 1504538 - RNA, 13 nt, Pseudomonas aeruginosa PA01
cgacgccggucgg

SEQ ID NO: 1504539 - RNA, 16 nt, Pseudomonas aeruginosa PA01
cgacgcgacauccucc

SEQ ID NO: 1504540 - RNA, 15 nt, Pseudomonas aeruginosa PA01
cgacgcgaccuccgg

SEQ ID NO: 1504541 - RNA, 17 nt, Pseudomonas aeruginosa PA01
cgacgcgaccuccggcg

SEQ ID NO: 1504542 - RNA, 22 nt, Pseudomonas aeruginosa PA01
cgacgcgaccuccggcgccagg

SEQ ID NO: 1504543 - RNA, 17 nt, Pseudomonas aeruginosa PA01
cgacgccuugcccggcg

SEQ ID NO: 1504544 - RNA, 20 nt, Pseudomonas aeruginosa PA01
cgacgccuugcccggcgcgu

SEQ ID NO: 1504545 - RNA, 23 nt, Pseudomonas aeruginosa PA01
cgacgccuugcccggcgcguaga

SEQ ID NO: 1504546 - RNA, 16 nt, Pseudomonas aeruginosa PA01
cgacgccuucagcaug

SEQ ID NO: 1504547 - RNA, 16 nt, Pseudomonas aeruginosa PA01
cgacgccucggcgcga

SEQ ID NO: 1504548 - RNA, 14 nt, Pseudomonas aeruginosa PA01
cgacgccgucccau

SEQ ID NO: 1504549 - RNA, 14 nt, Pseudomonas aeruginosa PA01
cgacgccggcuucc

SEQ ID NO: 1504550 - RNA, 14 nt, Pseudomonas aeruginosa PA01
cgacgcgcggcugc

SEQ ID NO: 1504551 - RNA, 12 nt, Pseudomonas aeruginosa PA01
cgacgcgccagg

SEQ ID NO: 1504552 - RNA, 14 nt, Pseudomonas aeruginosa PA01
cgacgcgcagcggu

SEQ ID NO: 1504553 - RNA, 16 nt, Pseudomonas aeruginosa PA01
cgacgcgcaggccggu

SEQ ID NO: 1504554 - RNA, 18 nt, Pseudomonas aeruginosa PA01
cgacgcgcaugucgaggu

SEQ ID NO: 1504555 - RNA, 13 nt, Pseudomonas aeruginosa PA01
cgacgagcagcuc

SEQ ID NO: 1504556 - RNA, 18 nt, Pseudomonas aeruginosa PA01
cgacgagcagcucgccgg

SEQ ID NO: 1504557 - RNA, 20 nt, Pseudomonas aeruginosa PA01
cgacgagccggacggcggcg

SEQ ID NO: 1504558 - RNA, 13 nt, Pseudomonas aeruginosa PA01
cgacgagccgcga

SEQ ID NO: 1504559 - RNA, 15 nt, Pseudomonas aeruginosa PA01
cgacgagccgcgacg

SEQ ID NO: 1504560 - RNA, 18 nt, Pseudomonas aeruginosa PA01
cgacgagccgcgacgcga

SEQ ID NO: 1504561 - RNA, 13 nt, Pseudomonas aeruginosa PA01
cgacgaggcgcgg

SEQ ID NO: 1504562 - RNA, 14 nt, Pseudomonas aeruginosa PA01
cgacgaggcgcggc

SEQ ID NO: 1504563 - RNA, 15 nt, Pseudomonas aeruginosa PA01
cgacgaggcgcggcg

SEQ ID NO: 1504564 - RNA, 16 nt, Pseudomonas aeruginosa PA01
cgacgaggcgcggcgg

SEQ ID NO: 1504565 - RNA, 21 nt, Pseudomonas aeruginosa PA01
cgacgaucucaucgcccauga

SEQ ID NO: 1504566 - RNA, 13 nt, Pseudomonas aeruginosa PA01
cgacgaugccgcc

SEQ ID NO: 1504567 - RNA, 15 nt, Pseudomonas aeruginosa PA01
cgacgaugccgccgc

SEQ ID NO: 1504568 - RNA, 22 nt, Pseudomonas aeruginosa PA01
cgacgcacucauagcucagcug

SEQ ID NO: 1504569 - RNA, 14 nt, Pseudomonas aeruginosa PA01
cgacgcagagcgcc

SEQ ID NO: 1504570 - RNA, 16 nt, Pseudomonas aeruginosa PA01
cgacgcagagcgccau

SEQ ID NO: 1504571 - RNA, 15 nt, Pseudomonas aeruginosa PA01
cgacgcagcacggcg

SEQ ID NO: 1504572 - RNA, 12 nt, Pseudomonas aeruginosa PA01
cgacgcagcgcg

SEQ ID NO: 1504573 - RNA, 19 nt, Pseudomonas aeruginosa PA01
cgacgcagcgcgcgccgag

SEQ ID NO: 1504574 - RNA, 15 nt, Pseudomonas aeruginosa PA01
cgacgaagcgccggc

SEQ ID NO: 1504575 - RNA, 16 nt, Pseudomonas aeruginosa PA01
cgacgaagcgccggcg

SEQ ID NO: 1504576 - RNA, 14 nt, Pseudomonas aeruginosa PA01
cgacgaaggcgcgc

SEQ ID NO: 1504577 - RNA, 18 nt, Pseudomonas aeruginosa PA01
cgacgaaggcgcgcucga

SEQ ID NO: 1504578 - RNA, 15 nt, Pseudomonas aeruginosa PA01
cgacgaaggucggcg

SEQ ID NO: 1504579 - RNA, 12 nt, Pseudomonas aeruginosa PA01
cgacgaaggcga

SEQ ID NO: 1504580 - RNA, 14 nt, Pseudomonas aeruginosa PA01
cgacgacgaucccg

SEQ ID NO: 1504581 - RNA, 15 nt, Pseudomonas aeruginosa PA01
cgacgacgaucccgg

SEQ ID NO: 1504582 - RNA, 16 nt, Pseudomonas aeruginosa PA01
cgacgacgaucccggc

SEQ ID NO: 1504583 - RNA, 18 nt, Pseudomonas aeruginosa PA01
cgacgacgaaaggccgcg

SEQ ID NO: 1504584 - RNA, 19 nt, Pseudomonas aeruginosa PA01
cgacgacgaaaggccgcgc

SEQ ID NO: 1504585 - RNA, 21 nt, Pseudomonas aeruginosa PA01
cgacgacgaaaggccgcgccg

SEQ ID NO: 1504586 - RNA, 22 nt, Pseudomonas aeruginosa PA01
cgacgacgaaaggccgcgccgg

SEQ ID NO: 1504587 - RNA, 23 nt, Pseudomonas aeruginosa PA01
cgacgacgaaaggccgcgccgga

SEQ ID NO: 1504588 - RNA, 18 nt, Pseudomonas aeruginosa PA01
cgacgaagcccucgcgac

SEQ ID NO: 1504589 - RNA, 15 nt, Pseudomonas aeruginosa PA01
cgaccuccgccgcuu

SEQ ID NO: 1504590 - RNA, 15 nt, Pseudomonas aeruginosa PA01
cgacgaacucgacgc

SEQ ID NO: 1504591 - RNA, 20 nt, Pseudomonas aeruginosa PA01
cgacgaagaccuugaacucg

SEQ ID NO: 1504592 - RNA, 15 nt, Pseudomonas aeruginosa PA01
cgacgaacggaucgc

SEQ ID NO: 1504593 - RNA, 14 nt, Pseudomonas aeruginosa PA01
cgaccgaucaugcc

SEQ ID NO: 1504594 - RNA, 16 nt, Pseudomonas aeruginosa PA01
cgaccgaucaugcccu

SEQ ID NO: 1504595 - RNA, 15 nt, Pseudomonas aeruginosa PA01
cgaccgcaccgccag

SEQ ID NO: 1504596 - RNA, 16 nt, Pseudomonas aeruginosa PA01
cgaccgcaccgccagc

SEQ ID NO: 1504597 - RNA, 18 nt, Pseudomonas aeruginosa PA01
cgaccgacuuggcagucg

SEQ ID NO: 1504598 - RNA, 23 nt, Pseudomonas aeruginosa PA01
cgaccgacuuggcagucgccgcc

SEQ ID NO: 1504599 - RNA, 18 nt, Pseudomonas aeruginosa PA01
cgaccgagaugcucgcgc

SEQ ID NO: 1504600 - RNA, 21 nt, Pseudomonas aeruginosa PA01
cgaccgagaugcucgcgcagc

SEQ ID NO: 1504601 - RNA, 16 nt, Pseudomonas aeruginosa PA01
cgaccgagaugcugcc

SEQ ID NO: 1504602 - RNA, 18 nt, Pseudomonas aeruginosa PA01
cgaccgagaugcugccga

SEQ ID NO: 1504603 - RNA, 14 nt, Pseudomonas aeruginosa PA01
cgaccgagcagcgg

SEQ ID NO: 1504604 - RNA, 19 nt, Pseudomonas aeruginosa PA01
cgaccgaagccgcgcagca

SEQ ID NO: 1504605 - RNA, 19 nt, Pseudomonas aeruginosa PA01
cgacccuucaacggcgacc

SEQ ID NO: 1504606 - RNA, 14 nt, Pseudomonas aeruginosa PA01
cgaccgaacagcgc

SEQ ID NO: 1504607 - RNA, 16 nt, Pseudomonas aeruginosa PA01
cgaccgaacagcgcgc

SEQ ID NO: 1504608 - RNA, 17 nt, Pseudomonas aeruginosa PA01
cgaccgaacagcgcgcc

SEQ ID NO: 1504609 - RNA, 12 nt, Pseudomonas aeruginosa PA01
cgaccgcccagg

SEQ ID NO: 1504610 - RNA, 13 nt, Pseudomonas aeruginosa PA01
cgaccgcccaggc

SEQ ID NO: 1504611 - RNA, 14 nt, Pseudomonas aeruginosa PA01
cgaccgcccaggcu

SEQ ID NO: 1504612 - RNA, 18 nt, Pseudomonas aeruginosa PA01
cgaccgcccaggcugccg

SEQ ID NO: 1504613 - RNA, 21 nt, Pseudomonas aeruginosa PA01
cgaccgcccaggcugccgccg

SEQ ID NO: 1504614 - RNA, 22 nt, Pseudomonas aeruginosa PA01
cgaccgcccaggcugccgccgc

SEQ ID NO: 1504615 - RNA, 15 nt, Pseudomonas aeruginosa PA01
cgaccgccaggcggc

SEQ ID NO: 1504616 - RNA, 21 nt, Pseudomonas aeruginosa PA01
cgaccgccaggcggccgcugg

SEQ ID NO: 1504617 - RNA, 20 nt, Pseudomonas aeruginosa PA01
cgaccgcaucguuggcgccg

SEQ ID NO: 1504618 - RNA, 11 nt, Pseudomonas aeruginosa PA01
cgaccgcggcg

SEQ ID NO: 1504619 - RNA, 20 nt, Pseudomonas aeruginosa PA01
cgaccgcggcgcucggcauc

SEQ ID NO: 1504620 - RNA, 20 nt, Pseudomonas aeruginosa PA01
cgaccggccuuuuucauggg

SEQ ID NO: 1504621 - RNA, 13 nt, Pseudomonas aeruginosa PA01
cgaccggcgcgcc

SEQ ID NO: 1504622 - RNA, 18 nt, Pseudomonas aeruginosa PA01
cgaccgggcaugccgugg

SEQ ID NO: 1504623 - RNA, 13 nt, Pseudomonas aeruginosa PA01
cgaccgguagcca

SEQ ID NO: 1504624 - RNA, 18 nt, Pseudomonas aeruginosa PA01
cgaccgguaacuggccag

SEQ ID NO: 1504625 - RNA, 17 nt, Pseudomonas aeruginosa PA01
cgaccggguugaugccg

SEQ ID NO: 1504626 - RNA, 19 nt, Pseudomonas aeruginosa PA01
cgaccggggaguucgaccc

SEQ ID NO: 1504627 - RNA, 14 nt, Pseudomonas aeruginosa PA01
cgaccgugaggcgc

SEQ ID NO: 1504628 - RNA, 17 nt, Pseudomonas aeruginosa PA01
cgaccgugaggcgcagg

SEQ ID NO: 1504629 - RNA, 18 nt, Pseudomonas aeruginosa PA01
cgaccgugaggcgcaggg

SEQ ID NO: 1504630 - RNA, 20 nt, Pseudomonas aeruginosa PA01
cgaccucagaccacgcccug

SEQ ID NO: 1504631 - RNA, 20 nt, Pseudomonas aeruginosa PA01
cgaccuccaggccgaagccg

SEQ ID NO: 1504632 - RNA, 23 nt, Pseudomonas aeruginosa PA01
cgaccuccaggccgaagccgccg

SEQ ID NO: 1504633 - RNA, 23 nt, Pseudomonas aeruginosa PA01
cgacccgccguucgcccgccaug

SEQ ID NO: 1504634 - RNA, 19 nt, Pseudomonas aeruginosa PA01
cgacccgcuccggacucgc

SEQ ID NO: 1504635 - RNA, 13 nt, Pseudomonas aeruginosa PA01
cgacccgcugaag

SEQ ID NO: 1504636 - RNA, 15 nt, Pseudomonas aeruginosa PA01
cgacccugcuggccg

SEQ ID NO: 1504637 - RNA, 18 nt, Pseudomonas aeruginosa PA01
cgacccugcuggccggug

SEQ ID NO: 1504638 - RNA, 12 nt, Pseudomonas aeruginosa PA01
cgacccuggccg

SEQ ID NO: 1504639 - RNA, 14 nt, Pseudomonas aeruginosa PA01
cgacccuggccgcg

SEQ ID NO: 1504640 - RNA, 17 nt, Pseudomonas aeruginosa PA01
cgacccuggccgcgcgg

SEQ ID NO: 1504641 - RNA, 18 nt, Pseudomonas aeruginosa PA01
cgacccuggccgcgcggc

SEQ ID NO: 1504642 - RNA, 19 nt, Pseudomonas aeruginosa PA01
cgacccuggccgcgcggcu

SEQ ID NO: 1504643 - RNA, 14 nt, Pseudomonas aeruginosa PA01
cgacccuggcgccg

SEQ ID NO: 1504644 - RNA, 15 nt, Pseudomonas aeruginosa PA01
cgacccggccgacca

SEQ ID NO: 1504645 - RNA, 16 nt, Pseudomonas aeruginosa PA01
cgacccggccgaccag

SEQ ID NO: 1504646 - RNA, 14 nt, Pseudomonas aeruginosa PA01
cgacccggaucaug

SEQ ID NO: 1504647 - RNA, 17 nt, Pseudomonas aeruginosa PA01
cgaccccgaucaccgga

SEQ ID NO: 1504648 - RNA, 16 nt, Pseudomonas aeruginosa PA01
cgacccaucgccgaag

SEQ ID NO: 1504649 - RNA, 13 nt, Pseudomonas aeruginosa PA01
cgaccccacgccg

SEQ ID NO: 1504650 - RNA, 14 nt, Pseudomonas aeruginosa PA01
cgaccccacgccgg

SEQ ID NO: 1504651 - RNA, 14 nt, Pseudomonas aeruginosa PA01
cgacccaggccgac

SEQ ID NO: 1504652 - RNA, 15 nt, Pseudomonas aeruginosa PA01
cgacccaggccgaca

SEQ ID NO: 1504653 - RNA, 14 nt, Pseudomonas aeruginosa PA01
cgaccaucauccgc

SEQ ID NO: 1504654 - RNA, 15 nt, Pseudomonas aeruginosa PA01
cgaccaucauccgcg

SEQ ID NO: 1504655 - RNA, 16 nt, Pseudomonas aeruginosa PA01
cgaccaucauccgcgu

SEQ ID NO: 1504656 - RNA, 14 nt, Pseudomonas aeruginosa PA01
cgaccaucaccagc

SEQ ID NO: 1504657 - RNA, 15 nt, Pseudomonas aeruginosa PA01
cgaccaucaccagcg

SEQ ID NO: 1504658 - RNA, 22 nt, Pseudomonas aeruginosa PA01
cgaccagucguugaagacgcuc

SEQ ID NO: 1504659 - RNA, 15 nt, Pseudomonas aeruginosa PA01
cgaccaguaccagca

SEQ ID NO: 1504660 - RNA, 17 nt, Pseudomonas aeruginosa PA01
cgaccaguaccagcaau

SEQ ID NO: 1504661 - RNA, 20 nt, Pseudomonas aeruginosa PA01
cgaccaguugcucgcuccga

SEQ ID NO: 1504662 - RNA, 23 nt, Pseudomonas aeruginosa PA01
cgaccagggggcgacauagcggc

SEQ ID NO: 1504663 - RNA, 15 nt, Pseudomonas aeruginosa PA01
cgaccagggccgggu

SEQ ID NO: 1504664 - RNA, 22 nt, Pseudomonas aeruginosa PA01
cgaccagguagagcagcccggg

SEQ ID NO: 1504665 - RNA, 20 nt, Pseudomonas aeruginosa PA01
cgaccaggcguuccaccagg

SEQ ID NO: 1504666 - RNA, 13 nt, Pseudomonas aeruginosa PA01
cgaccaggucgcc

SEQ ID NO: 1504667 - RNA, 22 nt, Pseudomonas aeruginosa PA01
cgaccagguccggagggcccgg

SEQ ID NO: 1504668 - RNA, 20 nt, Pseudomonas aeruginosa PA01
cgaccagguccggcagcgcc

SEQ ID NO: 1504669 - RNA, 13 nt, Pseudomonas aeruginosa PA01
cgaccaggugcug

SEQ ID NO: 1504670 - RNA, 16 nt, Pseudomonas aeruginosa PA01
cgaccagcgccaggcg

SEQ ID NO: 1504671 - RNA, 13 nt, Pseudomonas aeruginosa PA01
cgaccaggccgau

SEQ ID NO: 1504672 - RNA, 19 nt, Pseudomonas aeruginosa PA01
cgaccaggcggccgucggc

SEQ ID NO: 1504673 - RNA, 17 nt, Pseudomonas aeruginosa PA01
cgaccaggccguaggcg

SEQ ID NO: 1504674 - RNA, 19 nt, Pseudomonas aeruginosa PA01
cgaccaggccguaggcgau

SEQ ID NO: 1504675 - RNA, 14 nt, Pseudomonas aeruginosa PA01
cgacaguucgccgc

SEQ ID NO: 1504676 - RNA, 15 nt, Pseudomonas aeruginosa PA01
cgacaguucgccgcc

SEQ ID NO: 1504677 - RNA, 16 nt, Pseudomonas aeruginosa PA01
cgacaguucgccgccc

SEQ ID NO: 1504678 - RNA, 21 nt, Pseudomonas aeruginosa PA01
cgaccagcagcggcucacgcc

SEQ ID NO: 1504679 - RNA, 12 nt, Pseudomonas aeruginosa PA01
cgaccagcacgg

SEQ ID NO: 1504680 - RNA, 13 nt, Pseudomonas aeruginosa PA01
cgaccagcacggc

SEQ ID NO: 1504681 - RNA, 14 nt, Pseudomonas aeruginosa PA01
cgaccagcacggcg

SEQ ID NO: 1504682 - RNA, 13 nt, Pseudomonas aeruginosa PA01
cgaccagcccgcg

SEQ ID NO: 1504683 - RNA, 14 nt, Pseudomonas aeruginosa PA01
cgaccagcccgcgc

SEQ ID NO: 1504684 - RNA, 18 nt, Pseudomonas aeruginosa PA01
cgaccagcagggccagca

SEQ ID NO: 1504685 - RNA, 21 nt, Pseudomonas aeruginosa PA01
cgaccagcagggccagcagcg

SEQ ID NO: 1504686 - RNA, 22 nt, Pseudomonas aeruginosa PA01
cgaccagcagggccagcagcgc

SEQ ID NO: 1504687 - RNA, 14 nt, Pseudomonas aeruginosa PA01
cgaccagccgcagg

SEQ ID NO: 1504688 - RNA, 18 nt, Pseudomonas aeruginosa PA01
cgaccagccgcaggcugc

SEQ ID NO: 1504689 - RNA, 22 nt, Pseudomonas aeruginosa PA01
cgaccaggaauuccuggccggu

SEQ ID NO: 1504690 - RNA, 19 nt, Pseudomonas aeruginosa PA01
cgccauugugcgcgcgcag

SEQ ID NO: 1504691 - RNA, 20 nt, Pseudomonas aeruginosa PA01
cgccauugugcgcgcgcaga

SEQ ID NO: 1504692 - RNA, 18 nt, Pseudomonas aeruginosa PA01
cgcccaacgucuucaggc

SEQ ID NO: 1504693 - RNA, 18 nt, Pseudomonas aeruginosa PA01
cgccauuucaaggcgacg

SEQ ID NO: 1504694 - RNA, 14 nt, Pseudomonas aeruginosa PA01
cgcccaaggccagg

SEQ ID NO: 1504695 - RNA, 17 nt, Pseudomonas aeruginosa PA01
cgcccaaggccaggucg

SEQ ID NO: 1504696 - RNA, 12 nt, Pseudomonas aeruginosa PA01
cgcccaccgcgg

SEQ ID NO: 1504697 - RNA, 13 nt, Pseudomonas aeruginosa PA01
cgcccaccuugcg

SEQ ID NO: 1504698 - RNA, 16 nt, Pseudomonas aeruginosa PA01
cgcccaccaggucgcc

SEQ ID NO: 1504699 - RNA, 15 nt, Pseudomonas aeruginosa PA01
cgcccacccugcgcg

SEQ ID NO: 1504700 - RNA, 16 nt, Pseudomonas aeruginosa PA01
cgcccacccugcgcga

SEQ ID NO: 1504701 - RNA, 17 nt, Pseudomonas aeruginosa PA01
cgccauggggaucaccg

SEQ ID NO: 1504702 - RNA, 23 nt, Pseudomonas aeruginosa PA01
cgccauggguggaacccgcuucg

SEQ ID NO: 1504703 - RNA, 14 nt, Pseudomonas aeruginosa PA01
cgccauucaggcgg

SEQ ID NO: 1504704 - RNA, 23 nt, Pseudomonas aeruginosa PA01
cgccauguuccacaugcgcucgu

SEQ ID NO: 1504705 - RNA, 21 nt, Pseudomonas aeruginosa PA01
cgccauguuggccuugagcag

SEQ ID NO: 1504706 - RNA, 14 nt, Pseudomonas aeruginosa PA01
cgccauucggcgac

SEQ ID NO: 1504707 - RNA, 17 nt, Pseudomonas aeruginosa PA01
cgccauucggcgacggg

SEQ ID NO: 1504708 - RNA, 14 nt, Pseudomonas aeruginosa PA01
cgccauucucgcca

SEQ ID NO: 1504709 - RNA, 13 nt, Pseudomonas aeruginosa PA01
cgccauuccgcgg

SEQ ID NO: 1504710 - RNA, 18 nt, Pseudomonas aeruginosa PA01
cgccauucgaauggcgcc

SEQ ID NO: 1504711 - RNA, 16 nt, Pseudomonas aeruginosa PA01
cgccauugccgccagg

SEQ ID NO: 1504712 - RNA, 15 nt, Pseudomonas aeruginosa PA01
cgccauggccgcuga

SEQ ID NO: 1504713 - RNA, 19 nt, Pseudomonas aeruginosa PA01
cgccauggcgguuccucca

SEQ ID NO: 1504714 - RNA, 14 nt, Pseudomonas aeruginosa PA01
cgccauggcgcuga

SEQ ID NO: 1504715 - RNA, 14 nt, Pseudomonas aeruginosa PA01
cgccauggcgcugc

SEQ ID NO: 1504716 - RNA, 20 nt, Pseudomonas aeruginosa PA01
cgccaugcucggccagcucg

SEQ ID NO: 1504717 - RNA, 21 nt, Pseudomonas aeruginosa PA01
cgccaugcucggccagcucgc

SEQ ID NO: 1504718 - RNA, 22 nt, Pseudomonas aeruginosa PA01
cgccaugcucggccagcucgcc

SEQ ID NO: 1504719 - RNA, 15 nt, Pseudomonas aeruginosa PA01
cgccaugcggcaggc

SEQ ID NO: 1504720 - RNA, 16 nt, Pseudomonas aeruginosa PA01
cgccaugcggcaggcc

SEQ ID NO: 1504721 - RNA, 18 nt, Pseudomonas aeruginosa PA01
cgccaugcggcaggccuu

SEQ ID NO: 1504722 - RNA, 12 nt, Pseudomonas aeruginosa PA01
cgccaugccggc

SEQ ID NO: 1504723 - RNA, 15 nt, Pseudomonas aeruginosa PA01
cgccaugccguucag

SEQ ID NO: 1504724 - RNA, 22 nt, Pseudomonas aeruginosa PA01
cgccaugccguucaggccggcg

SEQ ID NO: 1504725 - RNA, 23 nt, Pseudomonas aeruginosa PA01
cgccaugccguucaggccggcgc

SEQ ID NO: 1504726 - RNA, 17 nt, Pseudomonas aeruginosa PA01
cgccaugccggcgccga

SEQ ID NO: 1504727 - RNA, 14 nt, Pseudomonas aeruginosa PA01
cgccaucaggcccu

SEQ ID NO: 1504728 - RNA, 15 nt, Pseudomonas aeruginosa PA01
cgccaucaggcccuu

SEQ ID NO: 1504729 - RNA, 17 nt, Pseudomonas aeruginosa PA01
cgccaucaccagcggcg

SEQ ID NO: 1504730 - RNA, 19 nt, Pseudomonas aeruginosa PA01
cgccauaggccagcaccuc

SEQ ID NO: 1504731 - RNA, 15 nt, Pseudomonas aeruginosa PA01
cgccauaggcggcgc

SEQ ID NO: 1504732 - RNA, 22 nt, Pseudomonas aeruginosa PA01
cgccaguugcuugaucgccagc

SEQ ID NO: 1504733 - RNA, 15 nt, Pseudomonas aeruginosa PA01
cgccaguuggacgcg

SEQ ID NO: 1504734 - RNA, 21 nt, Pseudomonas aeruginosa PA01
cgccaguuggacgcggccugg

SEQ ID NO: 1504735 - RNA, 15 nt, Pseudomonas aeruginosa PA01
cgccauaccccacgg

SEQ ID NO: 1504736 - RNA, 16 nt, Pseudomonas aeruginosa PA01
cgccauacugggcggc

SEQ ID NO: 1504737 - RNA, 14 nt, Pseudomonas aeruginosa PA01
cgccauagagugcc

SEQ ID NO: 1504738 - RNA, 23 nt, Pseudomonas aeruginosa PA01
cgccauagagugcccaggcgcug

SEQ ID NO: 1504739 - RNA, 12 nt, Pseudomonas aeruginosa PA01
cgccauccgccu

SEQ ID NO: 1504740 - RNA, 14 nt, Pseudomonas aeruginosa PA01
cgccauccgccuuc

SEQ ID NO: 1504741 - RNA, 16 nt, Pseudomonas aeruginosa PA01
cgccauccuucggcgu

SEQ ID NO: 1504742 - RNA, 15 nt, Pseudomonas aeruginosa PA01
cgccauccuggucgc

SEQ ID NO: 1504743 - RNA, 16 nt, Pseudomonas aeruginosa PA01
cgccauccuggucgcg

SEQ ID NO: 1504744 - RNA, 17 nt, Pseudomonas aeruginosa PA01
cgccaucgccucgccgg

SEQ ID NO: 1504745 - RNA, 16 nt, Pseudomonas aeruginosa PA01
cgccaucgcccgguug

SEQ ID NO: 1504746 - RNA, 19 nt, Pseudomonas aeruginosa PA01
cgccaucgcccgguugccu

SEQ ID NO: 1504747 - RNA, 17 nt, Pseudomonas aeruginosa PA01
cgccaucgaucagcagc

SEQ ID NO: 1504748 - RNA, 19 nt, Pseudomonas aeruginosa PA01
cgccaucggccuggggcuc

SEQ ID NO: 1504749 - RNA, 15 nt, Pseudomonas aeruginosa PA01
cgccaucgcucaccg

SEQ ID NO: 1504750 - RNA, 20 nt, Pseudomonas aeruginosa PA01
cgccaucgcuuuccuggccg

SEQ ID NO: 1504751 - RNA, 13 nt, Pseudomonas aeruginosa PA01
cgccaucuccucg

SEQ ID NO: 1504752 - RNA, 13 nt, Pseudomonas aeruginosa PA01
cgccaucggucgc

SEQ ID NO: 1504753 - RNA, 15 nt, Pseudomonas aeruginosa PA01
cgccaucggucgcgc

SEQ ID NO: 1504754 - RNA, 20 nt, Pseudomonas aeruginosa PA01
cgccaugcaagaacgccgac

SEQ ID NO: 1504755 - RNA, 18 nt, Pseudomonas aeruginosa PA01
cgccaugacccgcggcag

SEQ ID NO: 1504756 - RNA, 21 nt, Pseudomonas aeruginosa PA01
cgccaugacccgcggcagguc

SEQ ID NO: 1504757 - RNA, 16 nt, Pseudomonas aeruginosa PA01
cgccaggcccacgccc

SEQ ID NO: 1504758 - RNA, 17 nt, Pseudomonas aeruginosa PA01
cgccaggcccacgccca

SEQ ID NO: 1504759 - RNA, 19 nt, Pseudomonas aeruginosa PA01
cgccaggccgaucagcgcc

SEQ ID NO: 1504760 - RNA, 20 nt, Pseudomonas aeruginosa PA01
cgccaggccgaucagcgccu

SEQ ID NO: 1504761 - RNA, 22 nt, Pseudomonas aeruginosa PA01
cgccaggccgaucagcgccucg

SEQ ID NO: 1504762 - RNA, 14 nt, Pseudomonas aeruginosa PA01
cgccaggcccggcg

SEQ ID NO: 1504763 - RNA, 20 nt, Pseudomonas aeruginosa PA01
cgccaggcccggcgcugcuu

SEQ ID NO: 1504764 - RNA, 19 nt, Pseudomonas aeruginosa PA01
cgccaggcccugggcggcg

SEQ ID NO: 1504765 - RNA, 21 nt, Pseudomonas aeruginosa PA01
cgccaggcaggcggucagcgc

SEQ ID NO: 1504766 - RNA, 23 nt, Pseudomonas aeruginosa PA01
cgccaggcaggcggucagcgcgu

SEQ ID NO: 1504767 - RNA, 13 nt, Pseudomonas aeruginosa PA01
cgccaggcagucg

SEQ ID NO: 1504768 - RNA, 13 nt, Pseudomonas aeruginosa PA01
cgccaggcaggcc

SEQ ID NO: 1504769 - RNA, 14 nt, Pseudomonas aeruginosa PA01
cgccaggcaggccg

SEQ ID NO: 1504770 - RNA, 19 nt, Pseudomonas aeruginosa PA01
cgccaggaccuccugcaca

SEQ ID NO: 1504771 - RNA, 22 nt, Pseudomonas aeruginosa PA01
cgccaggaccucgaagcuggcc

SEQ ID NO: 1504772 - RNA, 18 nt, Pseudomonas aeruginosa PA01
cgccaggacggcaggguc

SEQ ID NO: 1504773 - RNA, 20 nt, Pseudomonas aeruginosa PA01
cgccaggacggcagggucag

SEQ ID NO: 1504774 - RNA, 13 nt, Pseudomonas aeruginosa PA01
cgccaggacucgc

SEQ ID NO: 1504775 - RNA, 17 nt, Pseudomonas aeruginosa PA01
cgccaggacucgccauc

SEQ ID NO: 1504776 - RNA, 23 nt, Pseudomonas aeruginosa PA01
cgccaggacucgccaucggccug

SEQ ID NO: 1504777 - RNA, 15 nt, Pseudomonas aeruginosa PA01
cgccaggagcagggc

SEQ ID NO: 1504778 - RNA, 17 nt, Pseudomonas aeruginosa PA01
cgccaggagcagggcgc

SEQ ID NO: 1504779 - RNA, 20 nt, Pseudomonas aeruginosa PA01
cgccaggagcagggcgccga

SEQ ID NO: 1504780 - RNA, 17 nt, Pseudomonas aeruginosa PA01
cgccagcuuguccgccg

SEQ ID NO: 1504781 - RNA, 21 nt, Pseudomonas aeruginosa PA01
cgccaggaagccgcgccccag

SEQ ID NO: 1504782 - RNA, 13 nt, Pseudomonas aeruginosa PA01
cgccagcucaugg

SEQ ID NO: 1504783 - RNA, 22 nt, Pseudomonas aeruginosa PA01
cgccagcucauggagcaacagc

SEQ ID NO: 1504784 - RNA, 17 nt, Pseudomonas aeruginosa PA01
cgccagcguugcagguc

SEQ ID NO: 1504785 - RNA, 22 nt, Pseudomonas aeruginosa PA01
cgccagcguuucgaagccgccg

SEQ ID NO: 1504786 - RNA, 23 nt, Pseudomonas aeruginosa PA01
cgccagcguuucgaagccgccgc

SEQ ID NO: 1504787 - RNA, 18 nt, Pseudomonas aeruginosa PA01
cgccagcuaccggcaggg

SEQ ID NO: 1504788 - RNA, 20 nt, Pseudomonas aeruginosa PA01
cgccagcucgaacagcaccg

SEQ ID NO: 1504789 - RNA, 22 nt, Pseudomonas aeruginosa PA01
cgccagcucgaacagcaccgag

SEQ ID NO: 1504790 - RNA, 16 nt, Pseudomonas aeruginosa PA01
cgccagcucgccgcgc

SEQ ID NO: 1504791 - RNA, 18 nt, Pseudomonas aeruginosa PA01
cgccagcuccagcgccca

SEQ ID NO: 1504792 - RNA, 22 nt, Pseudomonas aeruginosa PA01
cgccagcuccagcgcccaggug

SEQ ID NO: 1504793 - RNA, 14 nt, Pseudomonas aeruginosa PA01
cgccagcucggccg

SEQ ID NO: 1504794 - RNA, 16 nt, Pseudomonas aeruginosa PA01
cgccagcucggccggc

SEQ ID NO: 1504795 - RNA, 17 nt, Pseudomonas aeruginosa PA01
cgccagcucggccggca

SEQ ID NO: 1504796 - RNA, 13 nt, Pseudomonas aeruginosa PA01
cgccagcgggacg

SEQ ID NO: 1504797 - RNA, 19 nt, Pseudomonas aeruginosa PA01
cgccagcgggacgaugccg

SEQ ID NO: 1504798 - RNA, 13 nt, Pseudomonas aeruginosa PA01
cgccagcgucgcc

SEQ ID NO: 1504799 - RNA, 17 nt, Pseudomonas aeruginosa PA01
cgccagcgguacccgcc

SEQ ID NO: 1504800 - RNA, 18 nt, Pseudomonas aeruginosa PA01
cgccagcgguacccgccg

SEQ ID NO: 1504801 - RNA, 20 nt, Pseudomonas aeruginosa PA01
cgccagcgguacccgccggc

SEQ ID NO: 1504802 - RNA, 21 nt, Pseudomonas aeruginosa PA01
cgccagcgguacccgccggcc

SEQ ID NO: 1504803 - RNA, 23 nt, Pseudomonas aeruginosa PA01
cgccagcgguacccgccggccau

SEQ ID NO: 1504804 - RNA, 13 nt, Pseudomonas aeruginosa PA01
cgccagcggccag

SEQ ID NO: 1504805 - RNA, 14 nt, Pseudomonas aeruginosa PA01
cgccagcggccagg

SEQ ID NO: 1504806 - RNA, 14 nt, Pseudomonas aeruginosa PA01
cgccagcggcccgg

SEQ ID NO: 1504807 - RNA, 15 nt, Pseudomonas aeruginosa PA01
cgccagcggcccggc

SEQ ID NO: 1504808 - RNA, 13 nt, Pseudomonas aeruginosa PA01
cgccagcggcgau

SEQ ID NO: 1504809 - RNA, 14 nt, Pseudomonas aeruginosa PA01
cgccagcggcgauc

SEQ ID NO: 1504810 - RNA, 16 nt, Pseudomonas aeruginosa PA01
cgccagcggcgaucgc

SEQ ID NO: 1504811 - RNA, 17 nt, Pseudomonas aeruginosa PA01
cgccagcggcgaucgcc

SEQ ID NO: 1504812 - RNA, 13 nt, Pseudomonas aeruginosa PA01
cgccagcgcgcgc

SEQ ID NO: 1504813 - RNA, 16 nt, Pseudomonas aeruginosa PA01
cgccagcgcgcgccga

SEQ ID NO: 1504814 - RNA, 18 nt, Pseudomonas aeruginosa PA01
cgccagcgcgcgccgaca

SEQ ID NO: 1504815 - RNA, 21 nt, Pseudomonas aeruginosa PA01
cgccagcgcggcgcuuggcga

SEQ ID NO: 1504816 - RNA, 13 nt, Pseudomonas aeruginosa PA01
cgccagcgccggc

SEQ ID NO: 1504817 - RNA, 14 nt, Pseudomonas aeruginosa PA01
cgccagcgccacgg

SEQ ID NO: 1504818 - RNA, 16 nt, Pseudomonas aeruginosa PA01
cgccagcgccacggcg

SEQ ID NO: 1504819 - RNA, 14 nt, Pseudomonas aeruginosa PA01
cgccagggccgggu

SEQ ID NO: 1504820 - RNA, 14 nt, Pseudomonas aeruginosa PA01
cgccagggacgcgc

SEQ ID NO: 1504821 - RNA, 16 nt, Pseudomonas aeruginosa PA01
cgccagggacgcgcag

SEQ ID NO: 1504822 - RNA, 13 nt, Pseudomonas aeruginosa PA01
cgccagggaggcg

SEQ ID NO: 1504823 - RNA, 22 nt, Pseudomonas aeruginosa PA01
cgccagggcccacagugccagg

SEQ ID NO: 1504824 - RNA, 20 nt, Pseudomonas aeruginosa PA01
cgccagggccagggaaauca

SEQ ID NO: 1504825 - RNA, 22 nt, Pseudomonas aeruginosa PA01
cgccagggggaucgcgaagaac

SEQ ID NO: 1504826 - RNA, 21 nt, Pseudomonas aeruginosa PA01
cgccaggcgcagccagcacau

SEQ ID NO: 1504827 - RNA, 16 nt, Pseudomonas aeruginosa PA01
cgccagggucagcucg

SEQ ID NO: 1504828 - RNA, 20 nt, Pseudomonas aeruginosa PA01
cgccagggucagcucgacag

SEQ ID NO: 1504829 - RNA, 23 nt, Pseudomonas aeruginosa PA01
cgccagggugcugcccagggccc

SEQ ID NO: 1504830 - RNA, 23 nt, Pseudomonas aeruginosa PA01
cgccaggguguuguucgccagca

SEQ ID NO: 1504831 - RNA, 15 nt, Pseudomonas aeruginosa PA01
cgccaggucgagggc

SEQ ID NO: 1504832 - RNA, 16 nt, Pseudomonas aeruginosa PA01
cgccagguagugccgc

SEQ ID NO: 1504833 - RNA, 16 nt, Pseudomonas aeruginosa PA01
cgccagggucuugccg

SEQ ID NO: 1504834 - RNA, 19 nt, Pseudomonas aeruginosa PA01
cgccagggucuugccgacc

SEQ ID NO: 1504835 - RNA, 14 nt, Pseudomonas aeruginosa PA01
cgccaggccgccga

SEQ ID NO: 1504836 - RNA, 13 nt, Pseudomonas aeruginosa PA01
cgccaggccgcgc

SEQ ID NO: 1504837 - RNA, 14 nt, Pseudomonas aeruginosa PA01
cgccaggccgcgca

SEQ ID NO: 1504838 - RNA, 15 nt, Pseudomonas aeruginosa PA01
cgccaggccgcgcag

SEQ ID NO: 1504839 - RNA, 16 nt, Pseudomonas aeruginosa PA01
cgccaggccgcgcagu

SEQ ID NO: 1504840 - RNA, 18 nt, Pseudomonas aeruginosa PA01
cgccaggccgcgcagucc

SEQ ID NO: 1504841 - RNA, 18 nt, Pseudomonas aeruginosa PA01
cgccaggccggcgagggc

SEQ ID NO: 1504842 - RNA, 19 nt, Pseudomonas aeruginosa PA01
cgccaggccggcgagggcg

SEQ ID NO: 1504843 - RNA, 23 nt, Pseudomonas aeruginosa PA01
cgccaggccggcgagggcggcga

SEQ ID NO: 1504844 - RNA, 13 nt, Pseudomonas aeruginosa PA01
cgccaggccgcgu

SEQ ID NO: 1504845 - RNA, 14 nt, Pseudomonas aeruginosa PA01
cgccaggccgcguc

SEQ ID NO: 1504846 - RNA, 13 nt, Pseudomonas aeruginosa PA01
cgccaggccgcuu

SEQ ID NO: 1504847 - RNA, 22 nt, Pseudomonas aeruginosa PA01
cgccaggccgcuuuccacccga

SEQ ID NO: 1504848 - RNA, 12 nt, Pseudomonas aeruginosa PA01
cgccaggccgga

SEQ ID NO: 1504849 - RNA, 18 nt, Pseudomonas aeruginosa PA01
cgccaggccggagccgcg

SEQ ID NO: 1504850 - RNA, 17 nt, Pseudomonas aeruginosa PA01
cgccaggccuugcagca

SEQ ID NO: 1504851 - RNA, 12 nt, Pseudomonas aeruginosa PA01
cgccaggcgaag

SEQ ID NO: 1504852 - RNA, 23 nt, Pseudomonas aeruginosa PA01
cgccaggcgaagaaagccccugc

SEQ ID NO: 1504853 - RNA, 23 nt, Pseudomonas aeruginosa PA01
cgccaggccucagaacugcucgg

SEQ ID NO: 1504854 - RNA, 16 nt, Pseudomonas aeruginosa PA01
cgccaggccucggcgc

SEQ ID NO: 1504855 - RNA, 17 nt, Pseudomonas aeruginosa PA01
cgccaggccucggcgcg

SEQ ID NO: 1504856 - RNA, 18 nt, Pseudomonas aeruginosa PA01
cgccaggccucggcgcgg

SEQ ID NO: 1504857 - RNA, 14 nt, Pseudomonas aeruginosa PA01
cgccaggccggugc

SEQ ID NO: 1504858 - RNA, 16 nt, Pseudomonas aeruginosa PA01
cgccaggccggugcag

SEQ ID NO: 1504859 - RNA, 17 nt, Pseudomonas aeruginosa PA01
cgccaggccggugcaga

SEQ ID NO: 1504860 - RNA, 21 nt, Pseudomonas aeruginosa PA01
cgccaggccguagaccaccag

SEQ ID NO: 1504861 - RNA, 14 nt, Pseudomonas aeruginosa PA01
cgccaggcggaacg

SEQ ID NO: 1504862 - RNA, 18 nt, Pseudomonas aeruginosa PA01
cgccaggcgauccagcgg

SEQ ID NO: 1504863 - RNA, 18 nt, Pseudomonas aeruginosa PA01
cgccaggcgcgguugccg

SEQ ID NO: 1504864 - RNA, 22 nt, Pseudomonas aeruginosa PA01
cgccaggcgcgguugccgcugc

SEQ ID NO: 1504865 - RNA, 23 nt, Pseudomonas aeruginosa PA01
cgccaggcgcgguugccgcugcg

SEQ ID NO: 1504866 - RNA, 13 nt, Pseudomonas aeruginosa PA01
cgccaggcgcguc

SEQ ID NO: 1504867 - RNA, 17 nt, Pseudomonas aeruginosa PA01
cgccaggcgcgucgcgg

SEQ ID NO: 1504868 - RNA, 18 nt, Pseudomonas aeruginosa PA01
cgccaggcgcgucgcggc

SEQ ID NO: 1504869 - RNA, 11 nt, Pseudomonas aeruginosa PA01
cgccaggcgcu

SEQ ID NO: 1504870 - RNA, 12 nt, Pseudomonas aeruginosa PA01
cgccaggcgcuc

SEQ ID NO: 1504871 - RNA, 14 nt, Pseudomonas aeruginosa PA01
cgccaggcggccga

SEQ ID NO: 1504872 - RNA, 20 nt, Pseudomonas aeruginosa PA01
cgccaggcggccgcuggcga

SEQ ID NO: 1504873 - RNA, 15 nt, Pseudomonas aeruginosa PA01
cgccaggcgugcaga

SEQ ID NO: 1504874 - RNA, 20 nt, Pseudomonas aeruginosa PA01
cgccaggcuggguuggcgcg

SEQ ID NO: 1504875 - RNA, 16 nt, Pseudomonas aeruginosa PA01
cgccaggcugaccgcg

SEQ ID NO: 1504876 - RNA, 17 nt, Pseudomonas aeruginosa PA01
cgccaggcugauccgcg

SEQ ID NO: 1504877 - RNA, 16 nt, Pseudomonas aeruginosa PA01
cgccagucggccuggc

SEQ ID NO: 1504878 - RNA, 17 nt, Pseudomonas aeruginosa PA01
cgccagucggccuggcu

SEQ ID NO: 1504879 - RNA, 15 nt, Pseudomonas aeruginosa PA01
cgccaguacuccgag

SEQ ID NO: 1504880 - RNA, 22 nt, Pseudomonas aeruginosa PA01
cgccaguacuccgagggccgcg

SEQ ID NO: 1504881 - RNA, 22 nt, Pseudomonas aeruginosa PA01
cgccaguccacgacgaacggcg

SEQ ID NO: 1504882 - RNA, 20 nt, Pseudomonas aeruginosa PA01
cgccagguggaagcgcgcgu

SEQ ID NO: 1504883 - RNA, 19 nt, Pseudomonas aeruginosa PA01
cgccagguuggccuggccc

SEQ ID NO: 1504884 - RNA, 20 nt, Pseudomonas aeruginosa PA01
cgccagguuggccuggcccg

SEQ ID NO: 1504885 - RNA, 17 nt, Pseudomonas aeruginosa PA01
cgccagguugcgcaacc

SEQ ID NO: 1504886 - RNA, 22 nt, Pseudomonas aeruginosa PA01
cgccaggugcaggaagcgccgg

SEQ ID NO: 1504887 - RNA, 15 nt, Pseudomonas aeruginosa PA01
cgccagguggaagcg

SEQ ID NO: 1504888 - RNA, 17 nt, Pseudomonas aeruginosa PA01
cgccagguguacaucgg

SEQ ID NO: 1504889 - RNA, 21 nt, Pseudomonas aeruginosa PA01
cgccagguguacaucgggaua

SEQ ID NO: 1504890 - RNA, 17 nt, Pseudomonas aeruginosa PA01
cgccaguucggccauca

SEQ ID NO: 1504891 - RNA, 20 nt, Pseudomonas aeruginosa PA01
cgccaguucggccaucagca

SEQ ID NO: 1504892 - RNA, 21 nt, Pseudomonas aeruginosa PA01
cgccaguucggccaucagcac

SEQ ID NO: 1504893 - RNA, 13 nt, Pseudomonas aeruginosa PA01
cgccaguucucgc

SEQ ID NO: 1504894 - RNA, 16 nt, Pseudomonas aeruginosa PA01
cgccaguucucgcagc

SEQ ID NO: 1504895 - RNA, 18 nt, Pseudomonas aeruginosa PA01
cgccaguucucgcagcag

SEQ ID NO: 1504896 - RNA, 21 nt, Pseudomonas aeruginosa PA01
cgccaguucucgcagcaggcg

SEQ ID NO: 1504897 - RNA, 21 nt, Pseudomonas aeruginosa PA01
cgccaguuccgugucgagggc

SEQ ID NO: 1504898 - RNA, 23 nt, Pseudomonas aeruginosa PA01
cgccaguucgccggugacgcugc

SEQ ID NO: 1504899 - RNA, 23 nt, Pseudomonas aeruginosa PA01
cgccagugcaugcguucgccgaa

SEQ ID NO: 1504900 - RNA, 17 nt, Pseudomonas aeruginosa PA01
cgccagugccugcacca

SEQ ID NO: 1504901 - RNA, 21 nt, Pseudomonas aeruginosa PA01
cgccagugccugcaccacgca

SEQ ID NO: 1504902 - RNA, 15 nt, Pseudomonas aeruginosa PA01
cgccacguacagcgc

SEQ ID NO: 1504903 - RNA, 14 nt, Pseudomonas aeruginosa PA01
cgccacucgcgacg

SEQ ID NO: 1504904 - RNA, 12 nt, Pseudomonas aeruginosa PA01
cgccacucggcg

SEQ ID NO: 1504905 - RNA, 16 nt, Pseudomonas aeruginosa PA01
cgccacucggcgugcc

SEQ ID NO: 1504906 - RNA, 18 nt, Pseudomonas aeruginosa PA01
cgccacucggcgugccgg

SEQ ID NO: 1504907 - RNA, 17 nt, Pseudomonas aeruginosa PA01
cgccacuaccaccacca

SEQ ID NO: 1504908 - RNA, 20 nt, Pseudomonas aeruginosa PA01
cgccacgugcacgccgugca

SEQ ID NO: 1504909 - RNA, 17 nt, Pseudomonas aeruginosa PA01
cgccacuuccagcacgc

SEQ ID NO: 1504910 - RNA, 17 nt, Pseudomonas aeruginosa PA01
cgccacuuccagcuugc

SEQ ID NO: 1504911 - RNA, 16 nt, Pseudomonas aeruginosa PA01
cgccagaagcggccga

SEQ ID NO: 1504912 - RNA, 17 nt, Pseudomonas aeruginosa PA01
cgccagaagcggccgac

SEQ ID NO: 1504913 - RNA, 20 nt, Pseudomonas aeruginosa PA01
cgccagaaagccucaggcgc

SEQ ID NO: 1504914 - RNA, 21 nt, Pseudomonas aeruginosa PA01
cgccagaaagccucaggcgcu

SEQ ID NO: 1504915 - RNA, 22 nt, Pseudomonas aeruginosa PA01
cgccacuucaagcuggcgcaca

SEQ ID NO: 1504916 - RNA, 22 nt, Pseudomonas aeruginosa PA01
cgccacugcucccaugagcgac

SEQ ID NO: 1504917 - RNA, 19 nt, Pseudomonas aeruginosa PA01
cgccagcaauugccgcugc

SEQ ID NO: 1504918 - RNA, 11 nt, Pseudomonas aeruginosa PA01
cgccagcacca

SEQ ID NO: 1504919 - RNA, 16 nt, Pseudomonas aeruginosa PA01
cgccagcaccacccgg

SEQ ID NO: 1504920 - RNA, 20 nt, Pseudomonas aeruginosa PA01
cgccagcaccacccggccgc

SEQ ID NO: 1504921 - RNA, 21 nt, Pseudomonas aeruginosa PA01
cgccagcaccacccggccgcg

SEQ ID NO: 1504922 - RNA, 23 nt, Pseudomonas aeruginosa PA01
cgccagcaccacccggccgcgcu

SEQ ID NO: 1504923 - RNA, 13 nt, Pseudomonas aeruginosa PA01
cgccagcaccagc

SEQ ID NO: 1504924 - RNA, 15 nt, Pseudomonas aeruginosa PA01
cgccagcaacgccuu

SEQ ID NO: 1504925 - RNA, 16 nt, Pseudomonas aeruginosa PA01
cgccagcaacggcucc

SEQ ID NO: 1504926 - RNA, 18 nt, Pseudomonas aeruginosa PA01
cgccagaugcgcgucgcc

SEQ ID NO: 1504927 - RNA, 22 nt, Pseudomonas aeruginosa PA01
cgccagaugcgcgucgccgaac

SEQ ID NO: 1504928 - RNA, 23 nt, Pseudomonas aeruginosa PA01
cgccagaugcgcgucgccgaacg

SEQ ID NO: 1504929 - RNA, 13 nt, Pseudomonas aeruginosa PA01
cgccagcaacagu

SEQ ID NO: 1504930 - RNA, 20 nt, Pseudomonas aeruginosa PA01
cgccagcaacaguugccgca

SEQ ID NO: 1504931 - RNA, 22 nt, Pseudomonas aeruginosa PA01
cgccagcaacaguugccgcagc

SEQ ID NO: 1504932 - RNA, 23 nt, Pseudomonas aeruginosa PA01
cgccagcaacaguugccgcagca

SEQ ID NO: 1504933 - RNA, 13 nt, Pseudomonas aeruginosa PA01
cgccagacaggcc

SEQ ID NO: 1504934 - RNA, 18 nt, Pseudomonas aeruginosa PA01
cgccagacaggccagcuc

SEQ ID NO: 1504935 - RNA, 20 nt, Pseudomonas aeruginosa PA01
cgccagacaggccagcucgc

SEQ ID NO: 1504936 - RNA, 22 nt, Pseudomonas aeruginosa PA01
cgccagacaggccagcucgccc

SEQ ID NO: 1504937 - RNA, 14 nt, Pseudomonas aeruginosa PA01
cgccagaccagccc

SEQ ID NO: 1504938 - RNA, 13 nt, Pseudomonas aeruginosa PA01
cgccagagcaggc

SEQ ID NO: 1504939 - RNA, 17 nt, Pseudomonas aeruginosa PA01
cgccagagcaggcggau

SEQ ID NO: 1504940 - RNA, 21 nt, Pseudomonas aeruginosa PA01
cgccagagcaggcggaucgcc

SEQ ID NO: 1504941 - RNA, 22 nt, Pseudomonas aeruginosa PA01
cgccagagcaggcggaucgccg

SEQ ID NO: 1504942 - RNA, 14 nt, Pseudomonas aeruginosa PA01
cgccagcauggcga

SEQ ID NO: 1504943 - RNA, 16 nt, Pseudomonas aeruginosa PA01
cgccagccacucccgg

SEQ ID NO: 1504944 - RNA, 21 nt, Pseudomonas aeruginosa PA01
cgccagcaucgcaucggcgac

SEQ ID NO: 1504945 - RNA, 22 nt, Pseudomonas aeruginosa PA01
cgccagcaucgcaucggcgacc

SEQ ID NO: 1504946 - RNA, 15 nt, Pseudomonas aeruginosa PA01
cgccagcaggcgcag

SEQ ID NO: 1504947 - RNA, 19 nt, Pseudomonas aeruginosa PA01
cgccagcaggcgcagcagc

SEQ ID NO: 1504948 - RNA, 18 nt, Pseudomonas aeruginosa PA01
cgccagcaggcgcagguc

SEQ ID NO: 1504949 - RNA, 15 nt, Pseudomonas aeruginosa PA01
cgccagcaggcgccg

SEQ ID NO: 1504950 - RNA, 19 nt, Pseudomonas aeruginosa PA01
cgccagcaggcgccggcgg

SEQ ID NO: 1504951 - RNA, 15 nt, Pseudomonas aeruginosa PA01
cgccagcaggcgcgg

SEQ ID NO: 1504952 - RNA, 13 nt, Pseudomonas aeruginosa PA01
cgccagcaggccg

SEQ ID NO: 1504953 - RNA, 15 nt, Pseudomonas aeruginosa PA01
cgccagcaggccgaa

SEQ ID NO: 1504954 - RNA, 22 nt, Pseudomonas aeruginosa PA01
cgccagcaggccgaaggccagg

SEQ ID NO: 1504955 - RNA, 23 nt, Pseudomonas aeruginosa PA01
cgccagcaggcguugcagugcgc

SEQ ID NO: 1504956 - RNA, 15 nt, Pseudomonas aeruginosa PA01
cgccagcaggcucau

SEQ ID NO: 1504957 - RNA, 18 nt, Pseudomonas aeruginosa PA01
cgccagcaggcucaugcc

SEQ ID NO: 1504958 - RNA, 13 nt, Pseudomonas aeruginosa PA01
cgccagcaggcug

SEQ ID NO: 1504959 - RNA, 16 nt, Pseudomonas aeruginosa PA01
cgccagcaggucgcgc

SEQ ID NO: 1504960 - RNA, 16 nt, Pseudomonas aeruginosa PA01
cgccagcaggucggcc

SEQ ID NO: 1504961 - RNA, 18 nt, Pseudomonas aeruginosa PA01
cgccagcaggucggccug

SEQ ID NO: 1504962 - RNA, 19 nt, Pseudomonas aeruginosa PA01
cgccagcaggucggccugc

SEQ ID NO: 1504963 - RNA, 21 nt, Pseudomonas aeruginosa PA01
cgccagcagguggucgauggg

SEQ ID NO: 1504964 - RNA, 22 nt, Pseudomonas aeruginosa PA01
cgccagcagguggucgaugggc

SEQ ID NO: 1504965 - RNA, 22 nt, Pseudomonas aeruginosa PA01
cgccagcaguugcaacagcgcg

SEQ ID NO: 1504966 - RNA, 14 nt, Pseudomonas aeruginosa PA01
cgccagcacccagu

SEQ ID NO: 1504967 - RNA, 22 nt, Pseudomonas aeruginosa PA01
cgccagcacccagucuucgcug

SEQ ID NO: 1504968 - RNA, 22 nt, Pseudomonas aeruginosa PA01
cgccagcaccguggucagcacc

SEQ ID NO: 1504969 - RNA, 15 nt, Pseudomonas aeruginosa PA01
cgccagcagacggca

SEQ ID NO: 1504970 - RNA, 16 nt, Pseudomonas aeruginosa PA01
cgccagcaccagcagg

SEQ ID NO: 1504971 - RNA, 12 nt, Pseudomonas aeruginosa PA01
cgccagcacggc

SEQ ID NO: 1504972 - RNA, 15 nt, Pseudomonas aeruginosa PA01
cgccagccagcccgg

SEQ ID NO: 1504973 - RNA, 22 nt, Pseudomonas aeruginosa PA01
cgccagccagcccggcggugau

SEQ ID NO: 1504974 - RNA, 17 nt, Pseudomonas aeruginosa PA01
cgccagccagccgcgcg

SEQ ID NO: 1504975 - RNA, 20 nt, Pseudomonas aeruginosa PA01
cgccagccagccgcgcgccg

SEQ ID NO: 1504976 - RNA, 23 nt, Pseudomonas aeruginosa PA01
cgccagccagccgcgcgccgcau

SEQ ID NO: 1504977 - RNA, 17 nt, Pseudomonas aeruginosa PA01
cgccagccaggaagagc

SEQ ID NO: 1504978 - RNA, 22 nt, Pseudomonas aeruginosa PA01
cgccagccaggaagagcccgcc

SEQ ID NO: 1504979 - RNA, 15 nt, Pseudomonas aeruginosa PA01
cgccagcccgccacc

SEQ ID NO: 1504980 - RNA, 20 nt, Pseudomonas aeruginosa PA01
cgccagccccaggccgcccu

SEQ ID NO: 1504981 - RNA, 21 nt, Pseudomonas aeruginosa PA01
cgccagccccaggccgcccuu

SEQ ID NO: 1504982 - RNA, 16 nt, Pseudomonas aeruginosa PA01
cgccagccccaggcgc

SEQ ID NO: 1504983 - RNA, 20 nt, Pseudomonas aeruginosa PA01
cgccagcccagugcuggcgu

SEQ ID NO: 1504984 - RNA, 15 nt, Pseudomonas aeruginosa PA01
cgccagcccucgccc

SEQ ID NO: 1504985 - RNA, 18 nt, Pseudomonas aeruginosa PA01
cgccagcccucgcccagg

SEQ ID NO: 1504986 - RNA, 19 nt, Pseudomonas aeruginosa PA01
cgccagcccucgcccaggu

SEQ ID NO: 1504987 - RNA, 13 nt, Pseudomonas aeruginosa PA01
cgccagcccggca

SEQ ID NO: 1504988 - RNA, 20 nt, Pseudomonas aeruginosa PA01
cgccagcccggcaggucgag

SEQ ID NO: 1504989 - RNA, 14 nt, Pseudomonas aeruginosa PA01
cgccagccgccauc

SEQ ID NO: 1504990 - RNA, 17 nt, Pseudomonas aeruginosa PA01
cgccagccggcugugac

SEQ ID NO: 1504991 - RNA, 14 nt, Pseudomonas aeruginosa PA01
cgccagccgcccug

SEQ ID NO: 1504992 - RNA, 15 nt, Pseudomonas aeruginosa PA01
cgccagccgcccugg

SEQ ID NO: 1504993 - RNA, 22 nt, Pseudomonas aeruginosa PA01
cgccagccgcccuggcucuggg

SEQ ID NO: 1504994 - RNA, 17 nt, Pseudomonas aeruginosa PA01
cgccagccuacugggcg

SEQ ID NO: 1504995 - RNA, 22 nt, Pseudomonas aeruginosa PA01
cgccagccuacugggcguggcg

SEQ ID NO: 1504996 - RNA, 17 nt, Pseudomonas aeruginosa PA01
cgccagccucggcgaag

SEQ ID NO: 1504997 - RNA, 19 nt, Pseudomonas aeruginosa PA01
cgccagccucggcgaaguc

SEQ ID NO: 1504998 - RNA, 20 nt, Pseudomonas aeruginosa PA01
cgccagccucggcgaagucg

SEQ ID NO: 1504999 - RNA, 22 nt, Pseudomonas aeruginosa PA01
cgccagccucggcgaagucguu

SEQ ID NO: 1505000 - RNA, 19 nt, Pseudomonas aeruginosa PA01
cgccaccaccgucacggcg

SEQ ID NO: 1505001 - RNA, 16 nt, Pseudomonas aeruginosa PA01
cgccaagggcgccgcc

SEQ ID NO: 1505002 - RNA, 17 nt, Pseudomonas aeruginosa PA01
cgccaagggcgccgccg

SEQ ID NO: 1505003 - RNA, 14 nt, Pseudomonas aeruginosa PA01
cgccaaggcccugc

SEQ ID NO: 1505004 - RNA, 12 nt, Pseudomonas aeruginosa PA01
cgccaaggccgc

SEQ ID NO: 1505005 - RNA, 13 nt, Pseudomonas aeruginosa PA01
cgccaaggccgcc

SEQ ID NO: 1505006 - RNA, 16 nt, Pseudomonas aeruginosa PA01
cgccaaggccgccagg

SEQ ID NO: 1505007 - RNA, 14 nt, Pseudomonas aeruginosa PA01
cgccaagcccggcg

SEQ ID NO: 1505008 - RNA, 15 nt, Pseudomonas aeruginosa PA01
cgccaacucggccug

SEQ ID NO: 1505009 - RNA, 15 nt, Pseudomonas aeruginosa PA01
cgccaacugcuugcc

SEQ ID NO: 1505010 - RNA, 19 nt, Pseudomonas aeruginosa PA01
cgccaacuggcugucgagc

SEQ ID NO: 1505011 - RNA, 16 nt, Pseudomonas aeruginosa PA01
cgcagguagcggcgaa

SEQ ID NO: 1505012 - RNA, 22 nt, Pseudomonas aeruginosa PA01
cgcagguagcggcgaagcgcag

SEQ ID NO: 1505013 - RNA, 21 nt, Pseudomonas aeruginosa PA01
cgcagguagcugagcaggccg

SEQ ID NO: 1505014 - RNA, 20 nt, Pseudomonas aeruginosa PA01
cgcagguagucgcucauggc

SEQ ID NO: 1505015 - RNA, 16 nt, Pseudomonas aeruginosa PA01
cgcagguacucgccgg

SEQ ID NO: 1505016 - RNA, 18 nt, Pseudomonas aeruginosa PA01
cgcagguacucgccggcg

SEQ ID NO: 1505017 - RNA, 20 nt, Pseudomonas aeruginosa PA01
cgcagguagaaggugcccag

SEQ ID NO: 1505018 - RNA, 15 nt, Pseudomonas aeruginosa PA01
cgcagguaacccgcg

SEQ ID NO: 1505019 - RNA, 20 nt, Pseudomonas aeruginosa PA01
cgcagguaacccgcggcgag

SEQ ID NO: 1505020 - RNA, 21 nt, Pseudomonas aeruginosa PA01
cgcagguaacccgcggcgagg

SEQ ID NO: 1505021 - RNA, 16 nt, Pseudomonas aeruginosa PA01
cgcaggguccauggac

SEQ ID NO: 1505022 - RNA, 21 nt, Pseudomonas aeruginosa PA01
cgcaggguucggggaacagcg

SEQ ID NO: 1505023 - RNA, 22 nt, Pseudomonas aeruginosa PA01
cgcaggguucggggaacagcgc

SEQ ID NO: 1505024 - RNA, 15 nt, Pseudomonas aeruginosa PA01
cgcauuuugccggag

SEQ ID NO: 1505025 - RNA, 17 nt, Pseudomonas aeruginosa PA01
cgccaaaaaaagccccg

SEQ ID NO: 1505026 - RNA, 14 nt, Pseudomonas aeruginosa PA01
cgcauuggccaggc

SEQ ID NO: 1505027 - RNA, 19 nt, Pseudomonas aeruginosa PA01
cgcauuggccaggccccag

SEQ ID NO: 1505028 - RNA, 20 nt, Pseudomonas aeruginosa PA01
cgccaccgguacgcucacca

SEQ ID NO: 1505029 - RNA, 22 nt, Pseudomonas aeruginosa PA01
cgccaccgguacgcucaccacc

SEQ ID NO: 1505030 - RNA, 21 nt, Pseudomonas aeruginosa PA01
cgccaccggcguuauccgccg

SEQ ID NO: 1505031 - RNA, 19 nt, Pseudomonas aeruginosa PA01
cgccaccugagcgacgugg

SEQ ID NO: 1505032 - RNA, 16 nt, Pseudomonas aeruginosa PA01
cgccaccuguagcagg

SEQ ID NO: 1505033 - RNA, 23 nt, Pseudomonas aeruginosa PA01
cgccaccaggaaaucgccguugc

SEQ ID NO: 1505034 - RNA, 17 nt, Pseudomonas aeruginosa PA01
cgccaccagcguggcgc

SEQ ID NO: 1505035 - RNA, 24 nt, Pseudomonas aeruginosa PA01
cgccaccagggccuugccgcgacc

SEQ ID NO: 1505036 - RNA, 17 nt, Pseudomonas aeruginosa PA01
cgccaccaggccgcugc

SEQ ID NO: 1505037 - RNA, 19 nt, Pseudomonas aeruginosa PA01
cgccaccaggccgcugccg

SEQ ID NO: 1505038 - RNA, 19 nt, Pseudomonas aeruginosa PA01
cgccaccacgaucaggccc

SEQ ID NO: 1505039 - RNA, 13 nt, Pseudomonas aeruginosa PA01
cgccaccagcagg

SEQ ID NO: 1505040 - RNA, 22 nt, Pseudomonas aeruginosa PA01
cgccaccagcaggaagccgacc

SEQ ID NO: 1505041 - RNA, 13 nt, Pseudomonas aeruginosa PA01
cgccaccagccag

SEQ ID NO: 1505042 - RNA, 15 nt, Pseudomonas aeruginosa PA01
cgccaccagcgaguc

SEQ ID NO: 1505043 - RNA, 15 nt, Pseudomonas aeruginosa PA01
cgccaccagcagggc

SEQ ID NO: 1505044 - RNA, 13 nt, Pseudomonas aeruginosa PA01
cgccaccagcaug

SEQ ID NO: 1505045 - RNA, 20 nt, Pseudomonas aeruginosa PA01
cgccaccagcaugcccagcg

SEQ ID NO: 1505046 - RNA, 21 nt, Pseudomonas aeruginosa PA01
cgccacggaugcagucccgcc

SEQ ID NO: 1505047 - RNA, 23 nt, Pseudomonas aeruginosa PA01
cgccacggaugcagucccgccag

SEQ ID NO: 1505048 - RNA, 20 nt, Pseudomonas aeruginosa PA01
cgccacgcugaucaucagca

SEQ ID NO: 1505049 - RNA, 14 nt, Pseudomonas aeruginosa PA01
cgccacgcugcugc

SEQ ID NO: 1505050 - RNA, 19 nt, Pseudomonas aeruginosa PA01
cgccacggaaggccacgcc

SEQ ID NO: 1505051 - RNA, 14 nt, Pseudomonas aeruginosa PA01
cgccacgcuugucg

SEQ ID NO: 1505052 - RNA, 20 nt, Pseudomonas aeruginosa PA01
cgccacgcuugucguggcgg

SEQ ID NO: 1505053 - RNA, 15 nt, Pseudomonas aeruginosa PA01
cgccacgcgcaucgu

SEQ ID NO: 1505054 - RNA, 21 nt, Pseudomonas aeruginosa PA01
cgccacgcgagaagccgccca

SEQ ID NO: 1505055 - RNA, 13 nt, Pseudomonas aeruginosa PA01
cgccacgccggcg

SEQ ID NO: 1505056 - RNA, 12 nt, Pseudomonas aeruginosa PA01
cgccacggcgcg

SEQ ID NO: 1505057 - RNA, 16 nt, Pseudomonas aeruginosa PA01
cgccacggcgcgcucc

SEQ ID NO: 1505058 - RNA, 22 nt, Pseudomonas aeruginosa PA01
cgccacggcgcgcuccggcgcg

SEQ ID NO: 1505059 - RNA, 23 nt, Pseudomonas aeruginosa PA01
cgccacggcgcgcuccggcgcgc

SEQ ID NO: 1505060 - RNA, 22 nt, Pseudomonas aeruginosa PA01
cgccacggcgcggaacaucgcc

SEQ ID NO: 1505061 - RNA, 14 nt, Pseudomonas aeruginosa PA01
cgccacgaucaugg

SEQ ID NO: 1505062 - RNA, 19 nt, Pseudomonas aeruginosa PA01
cgccacgcaggaacagcuc

SEQ ID NO: 1505063 - RNA, 12 nt, Pseudomonas aeruginosa PA01
cgccacgccggc

SEQ ID NO: 1505064 - RNA, 22 nt, Pseudomonas aeruginosa PA01
cgcacgucgcggcggauaacgc

SEQ ID NO: 1505065 - RNA, 20 nt, Pseudomonas aeruginosa PA01
cgcacugcguggguagccau

SEQ ID NO: 1505066 - RNA, 17 nt, Pseudomonas aeruginosa PA01
cgcacuucguccgccac

SEQ ID NO: 1505067 - RNA, 19 nt, Pseudomonas aeruginosa PA01
cgcacuucguccgccacca

SEQ ID NO: 1505068 - RNA, 20 nt, Pseudomonas aeruginosa PA01
cgcacuucguccgccaccac

SEQ ID NO: 1505069 - RNA, 22 nt, Pseudomonas aeruginosa PA01
cgcacuuccggacugcccagcg

SEQ ID NO: 1505070 - RNA, 16 nt, Pseudomonas aeruginosa PA01
cgcacuuccucggcga

SEQ ID NO: 1505071 - RNA, 21 nt, Pseudomonas aeruginosa PA01
cgcacuuccucggcgaccacc

SEQ ID NO: 1505072 - RNA, 14 nt, Pseudomonas aeruginosa PA01
cgcacgcuggugcc

SEQ ID NO: 1505073 - RNA, 15 nt, Pseudomonas aeruginosa PA01
cgcacgcuggugccg

SEQ ID NO: 1505074 - RNA, 17 nt, Pseudomonas aeruginosa PA01
cgcacgcuucuccucgg

SEQ ID NO: 1505075 - RNA, 14 nt, Pseudomonas aeruginosa PA01
cgcacgcgccugcu

SEQ ID NO: 1505076 - RNA, 12 nt, Pseudomonas aeruginosa PA01
cgcacggccguc

SEQ ID NO: 1505077 - RNA, 13 nt, Pseudomonas aeruginosa PA01
cgcacggccguca

SEQ ID NO: 1505078 - RNA, 22 nt, Pseudomonas aeruginosa PA01
cgcacgucaccguccuucggcc

SEQ ID NO: 1505079 - RNA, 23 nt, Pseudomonas aeruginosa PA01
cgcacgucaccguccuucggccg

SEQ ID NO: 1505080 - RNA, 15 nt, Pseudomonas aeruginosa PA01
cgcacgcaauggcgc

SEQ ID NO: 1505081 - RNA, 16 nt, Pseudomonas aeruginosa PA01
cgcacgcaauggcgca

SEQ ID NO: 1505082 - RNA, 18 nt, Pseudomonas aeruginosa PA01
cgcacgcaauggcgcagc

SEQ ID NO: 1505083 - RNA, 22 nt, Pseudomonas aeruginosa PA01
cgcacgcaauggcgcagccgcu

SEQ ID NO: 1505084 - RNA, 13 nt, Pseudomonas aeruginosa PA01
cgcacgccggccu

SEQ ID NO: 1505085 - RNA, 14 nt, Pseudomonas aeruginosa PA01
cgcacgccgcggaa

SEQ ID NO: 1505086 - RNA, 15 nt, Pseudomonas aeruginosa PA01
cgcacgccgcggaag

SEQ ID NO: 1505087 - RNA, 14 nt, Pseudomonas aeruginosa PA01
cgcaccgcggccag

SEQ ID NO: 1505088 - RNA, 13 nt, Pseudomonas aeruginosa PA01
cgcaccgcggcga

SEQ ID NO: 1505089 - RNA, 16 nt, Pseudomonas aeruginosa PA01
cgcaccgcggcgagcc

SEQ ID NO: 1505090 - RNA, 12 nt, Pseudomonas aeruginosa PA01
cgcaccgcgccg

SEQ ID NO: 1505091 - RNA, 14 nt, Pseudomonas aeruginosa PA01
cgcaccgcgccggg

SEQ ID NO: 1505092 - RNA, 15 nt, Pseudomonas aeruginosa PA01
cgcaccgcgccggga

SEQ ID NO: 1505093 - RNA, 15 nt, Pseudomonas aeruginosa PA01
cgcaccaggucgcgc

SEQ ID NO: 1505094 - RNA, 16 nt, Pseudomonas aeruginosa PA01
cgcaccaggucgcgcu

SEQ ID NO: 1505095 - RNA, 18 nt, Pseudomonas aeruginosa PA01
cgcaccauagcgagccgc

SEQ ID NO: 1505096 - RNA, 21 nt, Pseudomonas aeruginosa PA01
cgcaccauagcgagccgcgcu

SEQ ID NO: 1505097 - RNA, 17 nt, Pseudomonas aeruginosa PA01
cgcaccauccgccgcag

SEQ ID NO: 1505098 - RNA, 18 nt, Pseudomonas aeruginosa PA01
cgcaccauccgccgcagg

SEQ ID NO: 1505099 - RNA, 19 nt, Pseudomonas aeruginosa PA01
cgcaccacccaucugccgg

SEQ ID NO: 1505100 - RNA, 20 nt, Pseudomonas aeruginosa PA01
cgcaccacccaucugccggc

SEQ ID NO: 1505101 - RNA, 13 nt, Pseudomonas aeruginosa PA01
cgcaacgccgacg

SEQ ID NO: 1505102 - RNA, 15 nt, Pseudomonas aeruginosa PA01
cgcaacgccgacggc

SEQ ID NO: 1505103 - RNA, 12 nt, Pseudomonas aeruginosa PA01
cgcaacgccggc

SEQ ID NO: 1505104 - RNA, 15 nt, Pseudomonas aeruginosa PA01
cgcaacgccggcagg

SEQ ID NO: 1505105 - RNA, 18 nt, Pseudomonas aeruginosa PA01
cgcaaccgcugccgccgu

SEQ ID NO: 1505106 - RNA, 23 nt, Pseudomonas aeruginosa PA01
cgcaaccgguuucccucgagcac

SEQ ID NO: 1505107 - RNA, 18 nt, Pseudomonas aeruginosa PA01
cgcaaccccuucggucgc

SEQ ID NO: 1505108 - RNA, 20 nt, Pseudomonas aeruginosa PA01
cgcaaccccuucggucgcgc

SEQ ID NO: 1505109 - RNA, 14 nt, Pseudomonas aeruginosa PA01
cgcaacccugccca

SEQ ID NO: 1505110 - RNA, 14 nt, Pseudomonas aeruginosa PA01
cgcaaccgcccgag

SEQ ID NO: 1505111 - RNA, 13 nt, Pseudomonas aeruginosa PA01
cgcaccgcccugc

SEQ ID NO: 1505112 - RNA, 22 nt, Pseudomonas aeruginosa PA01
cgcaccgccucgugcagcaagc

SEQ ID NO: 1505113 - RNA, 15 nt, Pseudomonas aeruginosa PA01
cgcaccgccugcagc

SEQ ID NO: 1505114 - RNA, 12 nt, Pseudomonas aeruginosa PA01
cgcaccgccaag

SEQ ID NO: 1505115 - RNA, 15 nt, Pseudomonas aeruginosa PA01
cgcaccgccagcagu

SEQ ID NO: 1505116 - RNA, 16 nt, Pseudomonas aeruginosa PA01
cgcaccgagguagucc

SEQ ID NO: 1505117 - RNA, 13 nt, Pseudomonas aeruginosa PA01
cgcaccgacgccg

SEQ ID NO: 1505118 - RNA, 18 nt, Pseudomonas aeruginosa PA01
cgcaccgacgccgccugc

SEQ ID NO: 1505119 - RNA, 16 nt, Pseudomonas aeruginosa PA01
cgcacccgcucggccu

SEQ ID NO: 1505120 - RNA, 21 nt, Pseudomonas aeruginosa PA01
cgcagaacugccgggccagcu

SEQ ID NO: 1505121 - RNA, 17 nt, Pseudomonas aeruginosa PA01
cgcagaaccagacgcuc

SEQ ID NO: 1505122 - RNA, 22 nt, Pseudomonas aeruginosa PA01
cgcagacaggccuccagcaacg

SEQ ID NO: 1505123 - RNA, 20 nt, Pseudomonas aeruginosa PA01
cgcagacaucgccgagggcg

SEQ ID NO: 1505124 - RNA, 15 nt, Pseudomonas aeruginosa PA01
cgcagcaucaucucc

SEQ ID NO: 1505125 - RNA, 16 nt, Pseudomonas aeruginosa PA01
cgcagaccagcgaacc

SEQ ID NO: 1505126 - RNA, 16 nt, Pseudomonas aeruginosa PA01
cgcagcaucuucucgg

SEQ ID NO: 1505127 - RNA, 18 nt, Pseudomonas aeruginosa PA01
cgcagcaucuucucggcg

SEQ ID NO: 1505128 - RNA, 20 nt, Pseudomonas aeruginosa PA01
cgcagcaucuucucggcgau

SEQ ID NO: 1505129 - RNA, 17 nt, Pseudomonas aeruginosa PA01
cgcagccgcgcucggcc

SEQ ID NO: 1505130 - RNA, 19 nt, Pseudomonas aeruginosa PA01
cgcagccgcgcucggccag

SEQ ID NO: 1505131 - RNA, 15 nt, Pseudomonas aeruginosa PA01
cgcagccgcggggcu

SEQ ID NO: 1505132 - RNA, 20 nt, Pseudomonas aeruginosa PA01
cgcagccgcgugcgcgccgc

SEQ ID NO: 1505133 - RNA, 22 nt, Pseudomonas aeruginosa PA01
cgcagccgcgugcgcgccgccg

SEQ ID NO: 1505134 - RNA, 12 nt, Pseudomonas aeruginosa PA01
cgcagccgcgca

SEQ ID NO: 1505135 - RNA, 15 nt, Pseudomonas aeruginosa PA01
cgcagccgcgcaacc

SEQ ID NO: 1505136 - RNA, 18 nt, Pseudomonas aeruginosa PA01
cgcagccgcaaggccagg

SEQ ID NO: 1505137 - RNA, 16 nt, Pseudomonas aeruginosa PA01
cgcagcaugucgucga

SEQ ID NO: 1505138 - RNA, 15 nt, Pseudomonas aeruginosa PA01
cgcagccacaggcgc

SEQ ID NO: 1505139 - RNA, 16 nt, Pseudomonas aeruginosa PA01
cgcagccacaggcgcc

SEQ ID NO: 1505140 - RNA, 19 nt, Pseudomonas aeruginosa PA01
cgcagccacuggcggaccg

SEQ ID NO: 1505141 - RNA, 20 nt, Pseudomonas aeruginosa PA01
cgcagccagagcuccagggc

SEQ ID NO: 1505142 - RNA, 12 nt, Pseudomonas aeruginosa PA01
cgcagccacccg

SEQ ID NO: 1505143 - RNA, 14 nt, Pseudomonas aeruginosa PA01
cgcagccacccgcg

SEQ ID NO: 1505144 - RNA, 15 nt, Pseudomonas aeruginosa PA01
cgcagccacggcaca

SEQ ID NO: 1505145 - RNA, 17 nt, Pseudomonas aeruginosa PA01
cgcagcggcaggccacg

SEQ ID NO: 1505146 - RNA, 22 nt, Pseudomonas aeruginosa PA01
cgcagcggcaggccacggccgc

SEQ ID NO: 1505147 - RNA, 23 nt, Pseudomonas aeruginosa PA01
cgcagcggcaggccacggccgcu

SEQ ID NO: 1505148 - RNA, 16 nt, Pseudomonas aeruginosa PA01
cgcagcggccccgagc

SEQ ID NO: 1505149 - RNA, 21 nt, Pseudomonas aeruginosa PA01
cgcagcggaggauucagcagg

SEQ ID NO: 1505150 - RNA, 13 nt, Pseudomonas aeruginosa PA01
cgcagcggcgccg

SEQ ID NO: 1505151 - RNA, 14 nt, Pseudomonas aeruginosa PA01
cgcagcggcgccga

SEQ ID NO: 1505152 - RNA, 13 nt, Pseudomonas aeruginosa PA01
cgcagcggcgcgu

SEQ ID NO: 1505153 - RNA, 18 nt, Pseudomonas aeruginosa PA01
cgcagcggcgcgucgcuc

SEQ ID NO: 1505154 - RNA, 13 nt, Pseudomonas aeruginosa PA01
cgcagcggcgcua

SEQ ID NO: 1505155 - RNA, 14 nt, Pseudomonas aeruginosa PA01
cgcagcgcgcgccg

SEQ ID NO: 1505156 - RNA, 18 nt, Pseudomonas aeruginosa PA01
cgcagcgcgcgccgagca

SEQ ID NO: 1505157 - RNA, 19 nt, Pseudomonas aeruginosa PA01
cgcagcgcgcgucggcgaa

SEQ ID NO: 1505158 - RNA, 13 nt, Pseudomonas aeruginosa PA01
cgcagcgcggggg

SEQ ID NO: 1505159 - RNA, 21 nt, Pseudomonas aeruginosa PA01
cgcagcgcuccuuucccagcg

SEQ ID NO: 1505160 - RNA, 12 nt, Pseudomonas aeruginosa PA01
cgcagcggcagc

SEQ ID NO: 1505161 - RNA, 15 nt, Pseudomonas aeruginosa PA01
cgcagcggcagcgcc

SEQ ID NO: 1505162 - RNA, 16 nt, Pseudomonas aeruginosa PA01
cgcagcggcagcgcca

SEQ ID NO: 1505163 - RNA, 18 nt, Pseudomonas aeruginosa PA01
cgcagcggcagcgccagg

SEQ ID NO: 1505164 - RNA, 15 nt, Pseudomonas aeruginosa PA01
cgcagcgcaagucgg

SEQ ID NO: 1505165 - RNA, 15 nt, Pseudomonas aeruginosa PA01
cgcagcgccaccagg

SEQ ID NO: 1505166 - RNA, 18 nt, Pseudomonas aeruginosa PA01
cgcagcgcccgauaggcg

SEQ ID NO: 1505167 - RNA, 21 nt, Pseudomonas aeruginosa PA01
cgcagcgcccgauaggcgccg

SEQ ID NO: 1505168 - RNA, 13 nt, Pseudomonas aeruginosa PA01
cgcagcgccgccg

SEQ ID NO: 1505169 - RNA, 14 nt, Pseudomonas aeruginosa PA01
cgcagcgccgccgc

SEQ ID NO: 1505170 - RNA, 16 nt, Pseudomonas aeruginosa PA01
cgcagcgccgccgcgu

SEQ ID NO: 1505171 - RNA, 13 nt, Pseudomonas aeruginosa PA01
cgcagccgcugcu

SEQ ID NO: 1505172 - RNA, 15 nt, Pseudomonas aeruginosa PA01
cgcagccgcugcugc

SEQ ID NO: 1505173 - RNA, 13 nt, Pseudomonas aeruginosa PA01
cgcagccgcucgg

SEQ ID NO: 1505174 - RNA, 19 nt, Pseudomonas aeruginosa PA01
cgcagccgcucggccgcca

SEQ ID NO: 1505175 - RNA, 21 nt, Pseudomonas aeruginosa PA01
cgcagccgcucggccgccagc

SEQ ID NO: 1505176 - RNA, 12 nt, Pseudomonas aeruginosa PA01
cgcagccgcugc

SEQ ID NO: 1505177 - RNA, 22 nt, Pseudomonas aeruginosa PA01
cgcagcgaucagcaccagcgga

SEQ ID NO: 1505178 - RNA, 12 nt, Pseudomonas aeruginosa PA01
cgcaggcggucg

SEQ ID NO: 1505179 - RNA, 18 nt, Pseudomonas aeruginosa PA01
cgcaggcggucgccgaac

SEQ ID NO: 1505180 - RNA, 21 nt, Pseudomonas aeruginosa PA01
cgcaggcggucgccgaacagc

SEQ ID NO: 1505181 - RNA, 20 nt, Pseudomonas aeruginosa PA01
cgcaggcggucggaaagcag

SEQ ID NO: 1505182 - RNA, 21 nt, Pseudomonas aeruginosa PA01
cgcaggcggucggccaucugg

SEQ ID NO: 1505183 - RNA, 22 nt, Pseudomonas aeruginosa PA01
cgcaggcgguggagcacgucga

SEQ ID NO: 1505184 - RNA, 16 nt, Pseudomonas aeruginosa PA01
cgcaggcucaguucgg

SEQ ID NO: 1505185 - RNA, 18 nt, Pseudomonas aeruginosa PA01
cgcaggcucaguucggcc

SEQ ID NO: 1505186 - RNA, 19 nt, Pseudomonas aeruginosa PA01
cgcaggcucaguucggcca

SEQ ID NO: 1505187 - RNA, 21 nt, Pseudomonas aeruginosa PA01
cgcaggcucaguucggccagc

SEQ ID NO: 1505188 - RNA, 20 nt, Pseudomonas aeruginosa PA01
cgcaggcuggccgagcgccg

SEQ ID NO: 1505189 - RNA, 17 nt, Pseudomonas aeruginosa PA01
cgcaggcugccguccag

SEQ ID NO: 1505190 - RNA, 19 nt, Pseudomonas aeruginosa PA01
cgcagggucaggcccuuga

SEQ ID NO: 1505191 - RNA, 15 nt, Pseudomonas aeruginosa PA01
cgcaggggcgcggcg

SEQ ID NO: 1505192 - RNA, 15 nt, Pseudomonas aeruginosa PA01
cgcaggcgcauggcg

SEQ ID NO: 1505193 - RNA, 21 nt, Pseudomonas aeruginosa PA01
cgcaggcgcuucagcgccucg

SEQ ID NO: 1505194 - RNA, 23 nt, Pseudomonas aeruginosa PA01
cgcaggcggaaauacggcuccgg

SEQ ID NO: 1505195 - RNA, 23 nt, Pseudomonas aeruginosa PA01
cgcaggcggacacgcaggcgccg

SEQ ID NO: 1505196 - RNA, 18 nt, Pseudomonas aeruginosa PA01
cgcaggcggaucgcccgg

SEQ ID NO: 1505197 - RNA, 20 nt, Pseudomonas aeruginosa PA01
cgcaggcggaucgcccggcg

SEQ ID NO: 1505198 - RNA, 12 nt, Pseudomonas aeruginosa PA01
cgcaggcggcgc

SEQ ID NO: 1505199 - RNA, 13 nt, Pseudomonas aeruginosa PA01
cgcaggcggcgcu

SEQ ID NO: 1505200 - RNA, 19 nt, Pseudomonas aeruginosa PA01
cgcaggcgcucgcgggccg

SEQ ID NO: 1505201 - RNA, 20 nt, Pseudomonas aeruginosa PA01
cgcaggcgcucgcgggccgc

SEQ ID NO: 1505202 - RNA, 15 nt, Pseudomonas aeruginosa PA01
cgcaggcggcuggcg

SEQ ID NO: 1505203 - RNA, 16 nt, Pseudomonas aeruginosa PA01
cgcaggcggcuggcgc

SEQ ID NO: 1505204 - RNA, 16 nt, Pseudomonas aeruginosa PA01
cgcaggcgggcggcgu

SEQ ID NO: 1505205 - RNA, 13 nt, Pseudomonas aeruginosa PA01
cgcaggcgggcgc

SEQ ID NO: 1505206 - RNA, 12 nt, Pseudomonas aeruginosa PA01
cgcaggccggcc

SEQ ID NO: 1505207 - RNA, 11 nt, Pseudomonas aeruginosa PA01
cgcaggccggg

SEQ ID NO: 1505208 - RNA, 21 nt, Pseudomonas aeruginosa PA01
cgcaggccuucgacuucgacg

SEQ ID NO: 1505209 - RNA, 22 nt, Pseudomonas aeruginosa PA01
cgcaggccuucgacuucgacga

SEQ ID NO: 1505210 - RNA, 17 nt, Pseudomonas aeruginosa PA01
cgcaggcgaugaucagc

SEQ ID NO: 1505211 - RNA, 13 nt, Pseudomonas aeruginosa PA01
cgcaggcgaugcc

SEQ ID NO: 1505212 - RNA, 18 nt, Pseudomonas aeruginosa PA01
cgcaggcgaugccgacgc

SEQ ID NO: 1505213 - RNA, 20 nt, Pseudomonas aeruginosa PA01
cgcaggcgaacugccgacgg

SEQ ID NO: 1505214 - RNA, 23 nt, Pseudomonas aeruginosa PA01
cgcaggccggugaucucgcggcg

SEQ ID NO: 1505215 - RNA, 20 nt, Pseudomonas aeruginosa PA01
cgcagcuguucacaaaggcg

SEQ ID NO: 1505216 - RNA, 16 nt, Pseudomonas aeruginosa PA01
cgcaggaacagcuccu

SEQ ID NO: 1505217 - RNA, 23 nt, Pseudomonas aeruginosa PA01
cgcaggaacagcuccuccagcgu

SEQ ID NO: 1505218 - RNA, 15 nt, Pseudomonas aeruginosa PA01
cgcaggaaccgacgc

SEQ ID NO: 1505219 - RNA, 23 nt, Pseudomonas aeruginosa PA01
cgcaggaagaaggcguccagggc

SEQ ID NO: 1505220 - RNA, 15 nt, Pseudomonas aeruginosa PA01
cgcaggccgcggccg

SEQ ID NO: 1505221 - RNA, 12 nt, Pseudomonas aeruginosa PA01
cgcaggccgcug

SEQ ID NO: 1505222 - RNA, 23 nt, Pseudomonas aeruginosa PA01
cgcagcgggcauauggaucggcc

SEQ ID NO: 1505223 - RNA, 22 nt, Pseudomonas aeruginosa PA01
cgcagcggguccuggguggcga

SEQ ID NO: 1505224 - RNA, 13 nt, Pseudomonas aeruginosa PA01
cgcagcgggucga

SEQ ID NO: 1505225 - RNA, 16 nt, Pseudomonas aeruginosa PA01
cgcagcgggucgauca

SEQ ID NO: 1505226 - RNA, 20 nt, Pseudomonas aeruginosa PA01
cgcagcgggucgaucaggcg

SEQ ID NO: 1505227 - RNA, 18 nt, Pseudomonas aeruginosa PA01
cgcagcggcucgugucga

SEQ ID NO: 1505228 - RNA, 23 nt, Pseudomonas aeruginosa PA01
cgcagcggcuguugccggaauca

SEQ ID NO: 1505229 - RNA, 20 nt, Pseudomonas aeruginosa PA01
cgcagcgucaccgcgucggg

SEQ ID NO: 1505230 - RNA, 13 nt, Pseudomonas aeruginosa PA01
cgcagcgggcuga

SEQ ID NO: 1505231 - RNA, 16 nt, Pseudomonas aeruginosa PA01
cgcagcgguacaggcg

SEQ ID NO: 1505232 - RNA, 17 nt, Pseudomonas aeruginosa PA01
cgcagcgguacaggcgg

SEQ ID NO: 1505233 - RNA, 18 nt, Pseudomonas aeruginosa PA01
cgcagcgguaguucaguc

SEQ ID NO: 1505234 - RNA, 20 nt, Pseudomonas aeruginosa PA01
cgcagcgguaguucagucgg

SEQ ID NO: 1505235 - RNA, 12 nt, Pseudomonas aeruginosa PA01
cgcagcguccug

SEQ ID NO: 1505236 - RNA, 13 nt, Pseudomonas aeruginosa PA01
cgcagcguccugc

SEQ ID NO: 1505237 - RNA, 15 nt, Pseudomonas aeruginosa PA01
cgcagcguccugccc

SEQ ID NO: 1505238 - RNA, 21 nt, Pseudomonas aeruginosa PA01
cgcagcuaggcgaggaucgcu

SEQ ID NO: 1505239 - RNA, 17 nt, Pseudomonas aeruginosa PA01
cgcagcguuccagcgcu

SEQ ID NO: 1505240 - RNA, 18 nt, Pseudomonas aeruginosa PA01
cgcagcguuccagcgcug

SEQ ID NO: 1505241 - RNA, 13 nt, Pseudomonas aeruginosa PA01
cgcagcuccggca

SEQ ID NO: 1505242 - RNA, 14 nt, Pseudomonas aeruginosa PA01
cgcagcuccggcag

SEQ ID NO: 1505243 - RNA, 17 nt, Pseudomonas aeruginosa PA01
cgcagcuccucggcgug

SEQ ID NO: 1505244 - RNA, 15 nt, Pseudomonas aeruginosa PA01
cgcagcuccagcgga

SEQ ID NO: 1505245 - RNA, 15 nt, Pseudomonas aeruginosa PA01
cgcagcucggccaac

SEQ ID NO: 1505246 - RNA, 15 nt, Pseudomonas aeruginosa PA01
cgcagcucggccucg

SEQ ID NO: 1505247 - RNA, 20 nt, Pseudomonas aeruginosa PA01
cgcagcucggugagcaggcg

SEQ ID NO: 1505248 - RNA, 21 nt, Pseudomonas aeruginosa PA01
cgcagcucggugagcaggcgc

SEQ ID NO: 1505249 - RNA, 14 nt, Pseudomonas aeruginosa PA01
cgaugcgccgacgc

SEQ ID NO: 1505250 - RNA, 18 nt, Pseudomonas aeruginosa PA01
cgaugcgccggaucggcu

SEQ ID NO: 1505251 - RNA, 13 nt, Pseudomonas aeruginosa PA01
cgaugcgcaggcc

SEQ ID NO: 1505252 - RNA, 14 nt, Pseudomonas aeruginosa PA01
cgaugcgcaggccg

SEQ ID NO: 1505253 - RNA, 15 nt, Pseudomonas aeruginosa PA01
cgaugcgcaggccgg

SEQ ID NO: 1505254 - RNA, 12 nt, Pseudomonas aeruginosa PA01
cgaugcgcaugc

SEQ ID NO: 1505255 - RNA, 17 nt, Pseudomonas aeruginosa PA01
cgaugcgccccagcgcc

SEQ ID NO: 1505256 - RNA, 13 nt, Pseudomonas aeruginosa PA01
cgaugccgcccgg

SEQ ID NO: 1505257 - RNA, 15 nt, Pseudomonas aeruginosa PA01
cgaugccgccgaccu

SEQ ID NO: 1505258 - RNA, 18 nt, Pseudomonas aeruginosa PA01
cgaugccgccgaccucgg

SEQ ID NO: 1505259 - RNA, 21 nt, Pseudomonas aeruginosa PA01
cgaugccgccgaccucggccg

SEQ ID NO: 1505260 - RNA, 23 nt, Pseudomonas aeruginosa PA01
cgaugccgccgaccucggccgcc

SEQ ID NO: 1505261 - RNA, 13 nt, Pseudomonas aeruginosa PA01
cgaugccgccgcc

SEQ ID NO: 1505262 - RNA, 14 nt, Pseudomonas aeruginosa PA01
cgaugccgcaggca

SEQ ID NO: 1505263 - RNA, 15 nt, Pseudomonas aeruginosa PA01
cgaugccgcaggcau

SEQ ID NO: 1505264 - RNA, 16 nt, Pseudomonas aeruginosa PA01
cgaugccgcccagcac

SEQ ID NO: 1505265 - RNA, 16 nt, Pseudomonas aeruginosa PA01
cgaugcccuuggccag

SEQ ID NO: 1505266 - RNA, 18 nt, Pseudomonas aeruginosa PA01
cgaugcccuuggccagcg

SEQ ID NO: 1505267 - RNA, 14 nt, Pseudomonas aeruginosa PA01
cgaugcccuggccg

SEQ ID NO: 1505268 - RNA, 18 nt, Pseudomonas aeruginosa PA01
cgaugcccuggccgcugc

SEQ ID NO: 1505269 - RNA, 23 nt, Pseudomonas aeruginosa PA01
cgaugcccuggcuuuccagggcc

SEQ ID NO: 1505270 - RNA, 20 nt, Pseudomonas aeruginosa PA01
cgaugccgaggaggaugccg

SEQ ID NO: 1505271 - RNA, 22 nt, Pseudomonas aeruginosa PA01
cgaugccgaggaggaugccgau

SEQ ID NO: 1505272 - RNA, 15 nt, Pseudomonas aeruginosa PA01
cgaugccgaucucgc

SEQ ID NO: 1505273 - RNA, 16 nt, Pseudomonas aeruginosa PA01
cgaugccgaucucgcc

SEQ ID NO: 1505274 - RNA, 19 nt, Pseudomonas aeruginosa PA01
cgaugccgaucucgcccag

SEQ ID NO: 1505275 - RNA, 19 nt, Pseudomonas aeruginosa PA01
cgaugccgaugccgccgac

SEQ ID NO: 1505276 - RNA, 22 nt, Pseudomonas aeruginosa PA01
cgaugccgauggcgccgccgag

SEQ ID NO: 1505277 - RNA, 23 nt, Pseudomonas aeruginosa PA01
cgaugcuguaguugacgucgccg

SEQ ID NO: 1505278 - RNA, 18 nt, Pseudomonas aeruginosa PA01
cgaugcugugcagggagg

SEQ ID NO: 1505279 - RNA, 16 nt, Pseudomonas aeruginosa PA01
cgaugcuuagcccggg

SEQ ID NO: 1505280 - RNA, 20 nt, Pseudomonas aeruginosa PA01
cgauggaacgaagaaccccg

SEQ ID NO: 1505281 - RNA, 20 nt, Pseudomonas aeruginosa PA01
cgauggaaguugcgcacccg

SEQ ID NO: 1505282 - RNA, 14 nt, Pseudomonas aeruginosa PA01
cgaugcgcgcggcg

SEQ ID NO: 1505283 - RNA, 23 nt, Pseudomonas aeruginosa PA01
cgaugcgcgcccugacgaugcag

SEQ ID NO: 1505284 - RNA, 13 nt, Pseudomonas aeruginosa PA01
cgauggcgcgcuu

SEQ ID NO: 1505285 - RNA, 21 nt, Pseudomonas aeruginosa PA01
cgauggcgcgcuuuccggcgc

SEQ ID NO: 1505286 - RNA, 13 nt, Pseudomonas aeruginosa PA01
cgauggcgcggug

SEQ ID NO: 1505287 - RNA, 12 nt, Pseudomonas aeruginosa PA01
cgauggcgaagc

SEQ ID NO: 1505288 - RNA, 13 nt, Pseudomonas aeruginosa PA01
cgauggcggccgc

SEQ ID NO: 1505289 - RNA, 17 nt, Pseudomonas aeruginosa PA01
cgauggcggccgccauu

SEQ ID NO: 1505290 - RNA, 21 nt, Pseudomonas aeruginosa PA01
cgauggcgugaaguagccgcc

SEQ ID NO: 1505291 - RNA, 23 nt, Pseudomonas aeruginosa PA01
cgauggcgugaaguagccgccgg

SEQ ID NO: 1505292 - RNA, 20 nt, Pseudomonas aeruginosa PA01
cgauggacucgaucacaucg

SEQ ID NO: 1505293 - RNA, 22 nt, Pseudomonas aeruginosa PA01
cgauggagauguagucgacgcc

SEQ ID NO: 1505294 - RNA, 12 nt, Pseudomonas aeruginosa PA01
cgauggaugacc

SEQ ID NO: 1505295 - RNA, 21 nt, Pseudomonas aeruginosa PA01
cgauggaugacccgcucgccg

SEQ ID NO: 1505296 - RNA, 14 nt, Pseudomonas aeruginosa PA01
cgauggccuggucg

SEQ ID NO: 1505297 - RNA, 19 nt, Pseudomonas aeruginosa PA01
cgauggccuggucggcgcg

SEQ ID NO: 1505298 - RNA, 22 nt, Pseudomonas aeruginosa PA01
cgauggccuggucggcgcggcg

SEQ ID NO: 1505299 - RNA, 23 nt, Pseudomonas aeruginosa PA01
cgauggccuggucggcgcggcgc

SEQ ID NO: 1505300 - RNA, 14 nt, Pseudomonas aeruginosa PA01
cgauggccgccgcc

SEQ ID NO: 1505301 - RNA, 19 nt, Pseudomonas aeruginosa PA01
cgauggccggcaccagcag

SEQ ID NO: 1505302 - RNA, 23 nt, Pseudomonas aeruginosa PA01
cgauggccggcagcagcgccagg

SEQ ID NO: 1505303 - RNA, 21 nt, Pseudomonas aeruginosa PA01
cgauggccgccagcaggccga

SEQ ID NO: 1505304 - RNA, 23 nt, Pseudomonas aeruginosa PA01
cgauggcgccgccgagguugcgc

SEQ ID NO: 1505305 - RNA, 14 nt, Pseudomonas aeruginosa PA01
cgauggcgaggaug

SEQ ID NO: 1505306 - RNA, 22 nt, Pseudomonas aeruginosa PA01
cgauauugaacgacucgucgcc

SEQ ID NO: 1505307 - RNA, 19 nt, Pseudomonas aeruginosa PA01
cgauauggccgaucaccug

SEQ ID NO: 1505308 - RNA, 15 nt, Pseudomonas aeruginosa PA01
cgaucuggcugccca

SEQ ID NO: 1505309 - RNA, 18 nt, Pseudomonas aeruginosa PA01
cgaucuggcugcccaggc

SEQ ID NO: 1505310 - RNA, 21 nt, Pseudomonas aeruginosa PA01
cgaucuggcagucgucgcagc

SEQ ID NO: 1505311 - RNA, 20 nt, Pseudomonas aeruginosa PA01
cgaucugcugguugaggccg

SEQ ID NO: 1505312 - RNA, 23 nt, Pseudomonas aeruginosa PA01
cgaucugcugguugaggccgucc

SEQ ID NO: 1505313 - RNA, 14 nt, Pseudomonas aeruginosa PA01
cgaucugcuugcgc

SEQ ID NO: 1505314 - RNA, 17 nt, Pseudomonas aeruginosa PA01
cgaucugcuugcgcgcc

SEQ ID NO: 1505315 - RNA, 20 nt, Pseudomonas aeruginosa PA01
cgaucugucgauaccagcgc

SEQ ID NO: 1505316 - RNA, 21 nt, Pseudomonas aeruginosa PA01
cgaucugucgauaccagcgcc

SEQ ID NO: 1505317 - RNA, 14 nt, Pseudomonas aeruginosa PA01
cgaucugucgcagc

SEQ ID NO: 1505318 - RNA, 14 nt, Pseudomonas aeruginosa PA01
cgaugaacgcccug

SEQ ID NO: 1505319 - RNA, 18 nt, Pseudomonas aeruginosa PA01
cgaugaacagugcgcccg

SEQ ID NO: 1505320 - RNA, 21 nt, Pseudomonas aeruginosa PA01
cgaugaacagugcgcccgugg

SEQ ID NO: 1505321 - RNA, 22 nt, Pseudomonas aeruginosa PA01
cgaugaacaccgcuucgagcac

SEQ ID NO: 1505322 - RNA, 23 nt, Pseudomonas aeruginosa PA01
cgaugaacaccgcuucgagcacc

SEQ ID NO: 1505323 - RNA, 23 nt, Pseudomonas aeruginosa PA01
cgaugaaauagccggcgaugccg

SEQ ID NO: 1505324 - RNA, 16 nt, Pseudomonas aeruginosa PA01
cgaucuucuccgccgc

SEQ ID NO: 1505325 - RNA, 17 nt, Pseudomonas aeruginosa PA01
cgaucuucuccgccgcg

SEQ ID NO: 1505326 - RNA, 23 nt, Pseudomonas aeruginosa PA01
cgaucuugaggaaguggaucggc

SEQ ID NO: 1505327 - RNA, 16 nt, Pseudomonas aeruginosa PA01
cgaucuugaucgccag

SEQ ID NO: 1505328 - RNA, 17 nt, Pseudomonas aeruginosa PA01
cgaucuucuuccccgcc

SEQ ID NO: 1505329 - RNA, 14 nt, Pseudomonas aeruginosa PA01
cgaucuucgaguag

SEQ ID NO: 1505330 - RNA, 14 nt, Pseudomonas aeruginosa PA01
cgaucuucgccgac

SEQ ID NO: 1505331 - RNA, 13 nt, Pseudomonas aeruginosa PA01
cgaucuucagcag

SEQ ID NO: 1505332 - RNA, 22 nt, Pseudomonas aeruginosa PA01
cgaucuucagcagcaggcgcuc

SEQ ID NO: 1505333 - RNA, 14 nt, Pseudomonas aeruginosa PA01
cgaugcacaggcgu

SEQ ID NO: 1505334 - RNA, 15 nt, Pseudomonas aeruginosa PA01
cgaugaucgagcgca

SEQ ID NO: 1505335 - RNA, 15 nt, Pseudomonas aeruginosa PA01
cgaugaucgccgggu

SEQ ID NO: 1505336 - RNA, 21 nt, Pseudomonas aeruginosa PA01
cgaugauccacuugccgccgc

SEQ ID NO: 1505337 - RNA, 13 nt, Pseudomonas aeruginosa PA01
cgaugaucccgau

SEQ ID NO: 1505338 - RNA, 18 nt, Pseudomonas aeruginosa PA01
cgaugaucgguucccgcc

SEQ ID NO: 1505339 - RNA, 14 nt, Pseudomonas aeruginosa PA01
cgaugaucggcagc

SEQ ID NO: 1505340 - RNA, 15 nt, Pseudomonas aeruginosa PA01
cgaugaucggcagcc

SEQ ID NO: 1505341 - RNA, 17 nt, Pseudomonas aeruginosa PA01
cgaugaccuugccgcga

SEQ ID NO: 1505342 - RNA, 16 nt, Pseudomonas aeruginosa PA01
cgaugagcuucgccgg

SEQ ID NO: 1505343 - RNA, 18 nt, Pseudomonas aeruginosa PA01
cgaugaucagcccuucgc

SEQ ID NO: 1505344 - RNA, 15 nt, Pseudomonas aeruginosa PA01
cgaugaggucgcagc

SEQ ID NO: 1505345 - RNA, 18 nt, Pseudomonas aeruginosa PA01
cgauguucgaggcgccga

SEQ ID NO: 1505346 - RNA, 19 nt, Pseudomonas aeruginosa PA01
cgauguucgaggcgccgac

SEQ ID NO: 1505347 - RNA, 20 nt, Pseudomonas aeruginosa PA01
cgauguucgaggcgccgacc

SEQ ID NO: 1505348 - RNA, 21 nt, Pseudomonas aeruginosa PA01
cgauguucgaggcgccgacca

SEQ ID NO: 1505349 - RNA, 19 nt, Pseudomonas aeruginosa PA01
cgauguucaccgcggccuu

SEQ ID NO: 1505350 - RNA, 14 nt, Pseudomonas aeruginosa PA01
cgaugugcacgcug

SEQ ID NO: 1505351 - RNA, 17 nt, Pseudomonas aeruginosa PA01
cgauguccucgaacagc

SEQ ID NO: 1505352 - RNA, 16 nt, Pseudomonas aeruginosa PA01
cgauguccaggccgau

SEQ ID NO: 1505353 - RNA, 18 nt, Pseudomonas aeruginosa PA01
cgauguccccggccagca

SEQ ID NO: 1505354 - RNA, 23 nt, Pseudomonas aeruginosa PA01
cgauguccccggccagcagcgcc

SEQ ID NO: 1505355 - RNA, 23 nt, Pseudomonas aeruginosa PA01
cgauguccuggaucggcagcucg

SEQ ID NO: 1505356 - RNA, 14 nt, Pseudomonas aeruginosa PA01
cgaugucgaccugg

SEQ ID NO: 1505357 - RNA, 15 nt, Pseudomonas aeruginosa PA01
cgaugucgaccuggg

SEQ ID NO: 1505358 - RNA, 22 nt, Pseudomonas aeruginosa PA01
cgaugucgcggcugaaggccga

SEQ ID NO: 1505359 - RNA, 17 nt, Pseudomonas aeruginosa PA01
cgaugucgcgggcaugc

SEQ ID NO: 1505360 - RNA, 23 nt, Pseudomonas aeruginosa PA01
cgaugucgcggguuacuucgccg

SEQ ID NO: 1505361 - RNA, 17 nt, Pseudomonas aeruginosa PA01
cgauggugacguugcgc

SEQ ID NO: 1505362 - RNA, 21 nt, Pseudomonas aeruginosa PA01
cgauggugacguugcgccgca

SEQ ID NO: 1505363 - RNA, 18 nt, Pseudomonas aeruginosa PA01
cgauggugaucacgucgg

SEQ ID NO: 1505364 - RNA, 22 nt, Pseudomonas aeruginosa PA01
cgauggugaucacgucggcguc

SEQ ID NO: 1505365 - RNA, 18 nt, Pseudomonas aeruginosa PA01
cgauguaggucaccgcgc

SEQ ID NO: 1505366 - RNA, 19 nt, Pseudomonas aeruginosa PA01
cgauguaggucaccgcgcc

SEQ ID NO: 1505367 - RNA, 16 nt, Pseudomonas aeruginosa PA01
cgauguacggcaccac

SEQ ID NO: 1505368 - RNA, 15 nt, Pseudomonas aeruginosa PA01
cgauguacugcucgg

SEQ ID NO: 1505369 - RNA, 16 nt, Pseudomonas aeruginosa PA01
cgaugggugccgcgca

SEQ ID NO: 1505370 - RNA, 15 nt, Pseudomonas aeruginosa PA01
cgauggucgccgcga

SEQ ID NO: 1505371 - RNA, 16 nt, Pseudomonas aeruginosa PA01
cgauggucaggaucac

SEQ ID NO: 1505372 - RNA, 21 nt, Pseudomonas aeruginosa PA01
cgauggucaggcuggccccgg

SEQ ID NO: 1505373 - RNA, 23 nt, Pseudomonas aeruginosa PA01
cgauggucagguaggagaugcag

SEQ ID NO: 1505374 - RNA, 21 nt, Pseudomonas aeruginosa PA01
cgaugguccccggccccgcgg

SEQ ID NO: 1505375 - RNA, 23 nt, Pseudomonas aeruginosa PA01
cgaugguccccggccccgcggua

SEQ ID NO: 1505376 - RNA, 17 nt, Pseudomonas aeruginosa PA01
cgauggcugucggcgcc

SEQ ID NO: 1505377 - RNA, 21 nt, Pseudomonas aeruginosa PA01
cgauggcugucggcgcccaau

SEQ ID NO: 1505378 - RNA, 17 nt, Pseudomonas aeruginosa PA01
cgaugggccguagguga

SEQ ID NO: 1505379 - RNA, 19 nt, Pseudomonas aeruginosa PA01
cgaugggcgagcgacggug

SEQ ID NO: 1505380 - RNA, 15 nt, Pseudomonas aeruginosa PA01
cgauugcugggugcg

SEQ ID NO: 1505381 - RNA, 19 nt, Pseudomonas aeruginosa PA01
cgauuggagaugcucaggc

SEQ ID NO: 1505382 - RNA, 22 nt, Pseudomonas aeruginosa PA01
cgauuggagaugcucaggcgcu

SEQ ID NO: 1505383 - RNA, 17 nt, Pseudomonas aeruginosa PA01
cgauugcgcccucccgc

SEQ ID NO: 1505384 - RNA, 20 nt, Pseudomonas aeruginosa PA01
cgauuguccaccggcccgga

SEQ ID NO: 1505385 - RNA, 22 nt, Pseudomonas aeruginosa PA01
cgauugugcagggccgcggcgg

SEQ ID NO: 1505386 - RNA, 17 nt, Pseudomonas aeruginosa PA01
cgcaaacccccugcgcg

SEQ ID NO: 1505387 - RNA, 18 nt, Pseudomonas aeruginosa PA01
cgcaaaccggcagcaucu

SEQ ID NO: 1505388 - RNA, 13 nt, Pseudomonas aeruginosa PA01
cgcaacaggcgca

SEQ ID NO: 1505389 - RNA, 16 nt, Pseudomonas aeruginosa PA01
cgcaaccagaccagca

SEQ ID NO: 1505390 - RNA, 18 nt, Pseudomonas aeruginosa PA01
cgcaaccagaccagcagg

SEQ ID NO: 1505391 - RNA, 19 nt, Pseudomonas aeruginosa PA01
cgcaaccagcccuggcgca

SEQ ID NO: 1505392 - RNA, 14 nt, Pseudomonas aeruginosa PA01
cgcaaccagcgcuc

SEQ ID NO: 1505393 - RNA, 21 nt, Pseudomonas aeruginosa PA01
cgcaaccagcgcucguagccg

SEQ ID NO: 1505394 - RNA, 23 nt, Pseudomonas aeruginosa PA01
cgcaaccagcgcucguagccggc

SEQ ID NO: 1505395 - RNA, 15 nt, Pseudomonas aeruginosa PA01
cgauugaccucccgc

SEQ ID NO: 1505396 - RNA, 22 nt, Pseudomonas aeruginosa PA01
cgauugaccucccgcgccagcu

SEQ ID NO: 1505397 - RNA, 16 nt, Pseudomonas aeruginosa PA01
cgauucguucgagcag

SEQ ID NO: 1505398 - RNA, 17 nt, Pseudomonas aeruginosa PA01
cgauucguucgagcagc

SEQ ID NO: 1505399 - RNA, 14 nt, Pseudomonas aeruginosa PA01
cgauuccugcggcu

SEQ ID NO: 1505400 - RNA, 18 nt, Pseudomonas aeruginosa PA01
cgauuccugcggcuugcc

SEQ ID NO: 1505401 - RNA, 23 nt, Pseudomonas aeruginosa PA01
cgauuccugucuccgcaccuacc

SEQ ID NO: 1505402 - RNA, 13 nt, Pseudomonas aeruginosa PA01
cgauucgcggcga

SEQ ID NO: 1505403 - RNA, 14 nt, Pseudomonas aeruginosa PA01
cgauucgacgcagc

SEQ ID NO: 1505404 - RNA, 20 nt, Pseudomonas aeruginosa PA01
cgauguugaacagcgccgga

SEQ ID NO: 1505405 - RNA, 16 nt, Pseudomonas aeruginosa PA01
cgauguuuccgacccg

SEQ ID NO: 1505406 - RNA, 15 nt, Pseudomonas aeruginosa PA01
ccaaugcaccugcgc

SEQ ID NO: 1505407 - RNA, 16 nt, Pseudomonas aeruginosa PA01
ccaaugcaccugcgcc

SEQ ID NO: 1505408 - RNA, 16 nt, Pseudomonas aeruginosa PA01
ccaaugccagugccuc

SEQ ID NO: 1505409 - RNA, 17 nt, Pseudomonas aeruginosa PA01
ccaaugcccggaccugg

SEQ ID NO: 1505410 - RNA, 14 nt, Pseudomonas aeruginosa PA01
ccaaugcaucggcc

SEQ ID NO: 1505411 - RNA, 16 nt, Pseudomonas aeruginosa PA01
ccaaugcaucggccgg

SEQ ID NO: 1505412 - RNA, 15 nt, Pseudomonas aeruginosa PA01
aaagcgauagccggg

SEQ ID NO: 1505413 - RNA, 22 nt, Pseudomonas aeruginosa PA01
ccaaugccuuccgacgccgcgu

SEQ ID NO: 1505414 - RNA, 22 nt, Pseudomonas aeruginosa PA01
ccacaaccugccgaucgccgcg

SEQ ID NO: 1505415 - RNA, 24 nt, Pseudomonas aeruginosa PA01
ccacaaggugggcagcagcgaacg

SEQ ID NO: 1505416 - RNA, 14 nt, Pseudomonas aeruginosa PA01
ccaaggccgccagg

SEQ ID NO: 1505417 - RNA, 16 nt, Pseudomonas aeruginosa PA01
ccaaggccgccaggcc

SEQ ID NO: 1505418 - RNA, 15 nt, Pseudomonas aeruginosa PA01
ccaagggccugggcg

SEQ ID NO: 1505419 - RNA, 18 nt, Pseudomonas aeruginosa PA01
ccaagggccugggcgccg

SEQ ID NO: 1505420 - RNA, 21 nt, Pseudomonas aeruginosa PA01
ccaagggccugggcgccgcca

SEQ ID NO: 1505421 - RNA, 23 nt, Pseudomonas aeruginosa PA01
ccaagggccugggcgccgccagc

SEQ ID NO: 1505422 - RNA, 16 nt, Pseudomonas aeruginosa PA01
ccaagggcgccgccga

SEQ ID NO: 1505423 - RNA, 22 nt, Pseudomonas aeruginosa PA01
ccaaggguauugguauccaggu

SEQ ID NO: 1505424 - RNA, 22 nt, Pseudomonas aeruginosa PA01
ccaagguuccagccccgccgga

SEQ ID NO: 1505425 - RNA, 15 nt, Pseudomonas aeruginosa PA01
ccaagucggccgccc

SEQ ID NO: 1505426 - RNA, 16 nt, Pseudomonas aeruginosa PA01
ccaagucggccgccca

SEQ ID NO: 1505427 - RNA, 14 nt, Pseudomonas aeruginosa PA01
ccaauccgcgccgg

SEQ ID NO: 1505428 - RNA, 16 nt, Pseudomonas aeruginosa PA01
ccaauccgcgccggug

SEQ ID NO: 1505429 - RNA, 12 nt, Pseudomonas aeruginosa PA01
ccaacagccggc

SEQ ID NO: 1505430 - RNA, 15 nt, Pseudomonas aeruginosa PA01
ccaacagccggcggg

SEQ ID NO: 1505431 - RNA, 20 nt, Pseudomonas aeruginosa PA01
ccaacaggcauugccguccg

SEQ ID NO: 1505432 - RNA, 20 nt, Pseudomonas aeruginosa PA01
ccaacagggcgucgucgagg

SEQ ID NO: 1505433 - RNA, 20 nt, Pseudomonas aeruginosa PA01
ccaaccaugguuuccgccgg

SEQ ID NO: 1505434 - RNA, 16 nt, Pseudomonas aeruginosa PA01
caugccguucagcguc

SEQ ID NO: 1505435 - RNA, 17 nt, Pseudomonas aeruginosa PA01
caugccguucaggccgg

SEQ ID NO: 1505436 - RNA, 22 nt, Pseudomonas aeruginosa PA01
caugccguacaggucggcgccg

SEQ ID NO: 1505437 - RNA, 17 nt, Pseudomonas aeruginosa PA01
caugccguagaucagga

SEQ ID NO: 1505438 - RNA, 19 nt, Pseudomonas aeruginosa PA01
caugccgggguccgccggu

SEQ ID NO: 1505439 - RNA, 22 nt, Pseudomonas aeruginosa PA01
caugccgggguggaguaccagg

SEQ ID NO: 1505440 - RNA, 19 nt, Pseudomonas aeruginosa PA01
caugccgugggcgccgccg

SEQ ID NO: 1505441 - RNA, 20 nt, Pseudomonas aeruginosa PA01
caugccgugggcgccgccgg

SEQ ID NO: 1505442 - RNA, 15 nt, Pseudomonas aeruginosa PA01
ccaacgccaccgcgc

SEQ ID NO: 1505443 - RNA, 16 nt, Pseudomonas aeruginosa PA01
ccaacgccaccgcgcg

SEQ ID NO: 1505444 - RNA, 20 nt, Pseudomonas aeruginosa PA01
ccaacuuguuggcauccggc

SEQ ID NO: 1505445 - RNA, 14 nt, Pseudomonas aeruginosa PA01
ccaacuuucccucu

SEQ ID NO: 1505446 - RNA, 20 nt, Pseudomonas aeruginosa PA01
ccaagagagcgccagcgaga

SEQ ID NO: 1505447 - RNA, 16 nt, Pseudomonas aeruginosa PA01
ccaacgcgcgaagcac

SEQ ID NO: 1505448 - RNA, 16 nt, Pseudomonas aeruginosa PA01
ccaacggcguguccag

SEQ ID NO: 1505449 - RNA, 23 nt, Pseudomonas aeruginosa PA01
ccaacggcguuauccgccgcuca

SEQ ID NO: 1505450 - RNA, 12 nt, Pseudomonas aeruginosa PA01
ccaacggccgcu

SEQ ID NO: 1505451 - RNA, 17 nt, Pseudomonas aeruginosa PA01
ccaacgucuucaggcgc

SEQ ID NO: 1505452 - RNA, 23 nt, Pseudomonas aeruginosa PA01
aaagcucgcgcaagcgcccggcg

SEQ ID NO: 1505453 - RNA, 18 nt, Pseudomonas aeruginosa PA01
ccaccgccaggaccucga

SEQ ID NO: 1505454 - RNA, 14 nt, Pseudomonas aeruginosa PA01
aaagcgucagcgcg

SEQ ID NO: 1505455 - RNA, 13 nt, Pseudomonas aeruginosa PA01
ccaccgacggcuc

SEQ ID NO: 1505456 - RNA, 18 nt, Pseudomonas aeruginosa PA01
ccaccgacgggucgccau

SEQ ID NO: 1505457 - RNA, 20 nt, Pseudomonas aeruginosa PA01
ccaccgagagcggcgccagg

SEQ ID NO: 1505458 - RNA, 17 nt, Pseudomonas aeruginosa PA01
ccaccgaguggcgcagc

SEQ ID NO: 1505459 - RNA, 18 nt, Pseudomonas aeruginosa PA01
ccaccgaguggcgcagcg

SEQ ID NO: 1505460 - RNA, 21 nt, Pseudomonas aeruginosa PA01
ccaccgagggcaggaaccaga

SEQ ID NO: 1505461 - RNA, 20 nt, Pseudomonas aeruginosa PA01
ccacccguuccuugcgcggc

SEQ ID NO: 1505462 - RNA, 16 nt, Pseudomonas aeruginosa PA01
ccacccguucgccggc

SEQ ID NO: 1505463 - RNA, 13 nt, Pseudomonas aeruginosa PA01
ccacccgucccgc

SEQ ID NO: 1505464 - RNA, 15 nt, Pseudomonas aeruginosa PA01
ccacccgucccgcgc

SEQ ID NO: 1505465 - RNA, 14 nt, Pseudomonas aeruginosa PA01
ccaccgauggcgcg

SEQ ID NO: 1505466 - RNA, 15 nt, Pseudomonas aeruginosa PA01
ccaccgauucgccgg

SEQ ID NO: 1505467 - RNA, 22 nt, Pseudomonas aeruginosa PA01
ccaccgauucgccggccaccag

SEQ ID NO: 1505468 - RNA, 23 nt, Pseudomonas aeruginosa PA01
ccaccgcacugguggcgaacagc

SEQ ID NO: 1505469 - RNA, 16 nt, Pseudomonas aeruginosa PA01
ccaccgccaccgccgg

SEQ ID NO: 1505470 - RNA, 23 nt, Pseudomonas aeruginosa PA01
ccaccgccaccugccccgggcgc

SEQ ID NO: 1505471 - RNA, 12 nt, Pseudomonas aeruginosa PA01
ccaccgccagca

SEQ ID NO: 1505472 - RNA, 16 nt, Pseudomonas aeruginosa PA01
ccaccgcccccggcgc

SEQ ID NO: 1505473 - RNA, 17 nt, Pseudomonas aeruginosa PA01
ccaccgccgacaucgga

SEQ ID NO: 1505474 - RNA, 12 nt, Pseudomonas aeruginosa PA01
ccaccgccgcca

SEQ ID NO: 1505475 - RNA, 14 nt, Pseudomonas aeruginosa PA01
ccaccgccgccagc

SEQ ID NO: 1505476 - RNA, 22 nt, Pseudomonas aeruginosa PA01
ccaccgccuggucgccgggauu

SEQ ID NO: 1505477 - RNA, 14 nt, Pseudomonas aeruginosa PA01
ccaccgccuggacc

SEQ ID NO: 1505478 - RNA, 18 nt, Pseudomonas aeruginosa PA01
ccaccgccgccagcaacg

SEQ ID NO: 1505479 - RNA, 24 nt, Pseudomonas aeruginosa PA01
ccaccgcgucgaguaccgcugcgg

SEQ ID NO: 1505480 - RNA, 22 nt, Pseudomonas aeruginosa PA01
ccaccgcuucgcggaucaacgc

SEQ ID NO: 1505481 - RNA, 19 nt, Pseudomonas aeruginosa PA01
ccaccgcuuucagcgccgc

SEQ ID NO: 1505482 - RNA, 21 nt, Pseudomonas aeruginosa PA01
ccaccgcuuucagcgccgcuc

SEQ ID NO: 1505483 - RNA, 22 nt, Pseudomonas aeruginosa PA01
ccaccgcgcggcacaggcggcu

SEQ ID NO: 1505484 - RNA, 14 nt, Pseudomonas aeruginosa PA01
ccaccgcggccucg

SEQ ID NO: 1505485 - RNA, 19 nt, Pseudomonas aeruginosa PA01
ccacccggcgguccgccgc

SEQ ID NO: 1505486 - RNA, 12 nt, Pseudomonas aeruginosa PA01
ccacccggcgcc

SEQ ID NO: 1505487 - RNA, 13 nt, Pseudomonas aeruginosa PA01
ccacccgcugcaa

SEQ ID NO: 1505488 - RNA, 23 nt, Pseudomonas aeruginosa PA01
ccacccggagaauucgcguccac

SEQ ID NO: 1505489 - RNA, 12 nt, Pseudomonas aeruginosa PA01
ccaccaggucgg

SEQ ID NO: 1505490 - RNA, 15 nt, Pseudomonas aeruginosa PA01
ccaccaggucggcgc

SEQ ID NO: 1505491 - RNA, 14 nt, Pseudomonas aeruginosa PA01
ccaccagcgcgcgc

SEQ ID NO: 1505492 - RNA, 21 nt, Pseudomonas aeruginosa PA01
ccaccagcgcgcgcuggcgca

SEQ ID NO: 1505493 - RNA, 14 nt, Pseudomonas aeruginosa PA01
ccaccaggucgccg

SEQ ID NO: 1505494 - RNA, 20 nt, Pseudomonas aeruginosa PA01
ccaccagcgaaagcgucagc

SEQ ID NO: 1505495 - RNA, 13 nt, Pseudomonas aeruginosa PA01
ccaccagcgccgc

SEQ ID NO: 1505496 - RNA, 15 nt, Pseudomonas aeruginosa PA01
ccaccagcgccgcca

SEQ ID NO: 1505497 - RNA, 17 nt, Pseudomonas aeruginosa PA01
ccaccagcgccggcggc

SEQ ID NO: 1505498 - RNA, 20 nt, Pseudomonas aeruginosa PA01
ccaccagcgccggcggcgcg

SEQ ID NO: 1505499 - RNA, 19 nt, Pseudomonas aeruginosa PA01
ccaccacgccgucgccgcu

SEQ ID NO: 1505500 - RNA, 21 nt, Pseudomonas aeruginosa PA01
ccaccacgaucugcuugcgcg

SEQ ID NO: 1505501 - RNA, 15 nt, Pseudomonas aeruginosa PA01
ccaccacucgcgagc

SEQ ID NO: 1505502 - RNA, 20 nt, Pseudomonas aeruginosa PA01
ccaccacucgcgagcuggcg

SEQ ID NO: 1505503 - RNA, 15 nt, Pseudomonas aeruginosa PA01
ccaccagcccgcagg

SEQ ID NO: 1505504 - RNA, 16 nt, Pseudomonas aeruginosa PA01
ccaccagcccgcaggg

SEQ ID NO: 1505505 - RNA, 12 nt, Pseudomonas aeruginosa PA01
ccacagaggucg

SEQ ID NO: 1505506 - RNA, 23 nt, Pseudomonas aeruginosa PA01
ccagacgaucagcggcccgagca

SEQ ID NO: 1505507 - RNA, 14 nt, Pseudomonas aeruginosa PA01
ccagacgcucggcu

SEQ ID NO: 1505508 - RNA, 15 nt, Pseudomonas aeruginosa PA01
ccagaacgccgcgca

SEQ ID NO: 1505509 - RNA, 16 nt, Pseudomonas aeruginosa PA01
ccagaagaucagcgcg

SEQ ID NO: 1505510 - RNA, 14 nt, Pseudomonas aeruginosa PA01
ccagaagccggccg

SEQ ID NO: 1505511 - RNA, 17 nt, Pseudomonas aeruginosa PA01
ccagaagcgcucguaga

SEQ ID NO: 1505512 - RNA, 13 nt, Pseudomonas aeruginosa PA01
ccagaccugccgc

SEQ ID NO: 1505513 - RNA, 16 nt, Pseudomonas aeruginosa PA01
ccagaccugccgcccg

SEQ ID NO: 1505514 - RNA, 17 nt, Pseudomonas aeruginosa PA01
ccagaccugccgcccgg

SEQ ID NO: 1505515 - RNA, 22 nt, Pseudomonas aeruginosa PA01
ccagaccugccgcccggccagg

SEQ ID NO: 1505516 - RNA, 20 nt, Pseudomonas aeruginosa PA01
ccagaccuuccagccgcgcg

SEQ ID NO: 1505517 - RNA, 21 nt, Pseudomonas aeruginosa PA01
ccagaccuuccagccgcgcgc

SEQ ID NO: 1505518 - RNA, 23 nt, Pseudomonas aeruginosa PA01
ccagaucggcauggccgaccgcc

SEQ ID NO: 1505519 - RNA, 13 nt, Pseudomonas aeruginosa PA01
ccagacguugcgc

SEQ ID NO: 1505520 - RNA, 13 nt, Pseudomonas aeruginosa PA01
ccagaucgccagc

SEQ ID NO: 1505521 - RNA, 14 nt, Pseudomonas aeruginosa PA01
ccagaucgccagcg

SEQ ID NO: 1505522 - RNA, 16 nt, Pseudomonas aeruginosa PA01
ccagcaaacccgggcc

SEQ ID NO: 1505523 - RNA, 17 nt, Pseudomonas aeruginosa PA01
ccagaugcgcgucgccg

SEQ ID NO: 1505524 - RNA, 23 nt, Pseudomonas aeruginosa PA01
ccagaugcgcgucgccgaacggc

SEQ ID NO: 1505525 - RNA, 12 nt, Pseudomonas aeruginosa PA01
ccagaugaucag

SEQ ID NO: 1505526 - RNA, 20 nt, Pseudomonas aeruginosa PA01
ccagaugaucaggccgagca

SEQ ID NO: 1505527 - RNA, 20 nt, Pseudomonas aeruginosa PA01
ccagaugaucuucaucccgg

SEQ ID NO: 1505528 - RNA, 15 nt, Pseudomonas aeruginosa PA01
ccagaugaaacugcc

SEQ ID NO: 1505529 - RNA, 20 nt, Pseudomonas aeruginosa PA01
ccagaugacgauggccgccg

SEQ ID NO: 1505530 - RNA, 21 nt, Pseudomonas aeruginosa PA01
ccagaugacgauggccgccgc

SEQ ID NO: 1505531 - RNA, 15 nt, Pseudomonas aeruginosa PA01
ccagcaccguggcgc

SEQ ID NO: 1505532 - RNA, 17 nt, Pseudomonas aeruginosa PA01
ccagcaccguggcgcca

SEQ ID NO: 1505533 - RNA, 16 nt, Pseudomonas aeruginosa PA01
ccagcaccagcacgcc

SEQ ID NO: 1505534 - RNA, 14 nt, Pseudomonas aeruginosa PA01
ccagcaccagcagg

SEQ ID NO: 1505535 - RNA, 18 nt, Pseudomonas aeruginosa PA01
ccagcaccagcaggagca

SEQ ID NO: 1505536 - RNA, 21 nt, Pseudomonas aeruginosa PA01
ccagcaacccaugccgcaagc

SEQ ID NO: 1505537 - RNA, 23 nt, Pseudomonas aeruginosa PA01
ccagcaacccgcccuugcucgcg

SEQ ID NO: 1505538 - RNA, 17 nt, Pseudomonas aeruginosa PA01
ccacggcgcgcuccggc

SEQ ID NO: 1505539 - RNA, 21 nt, Pseudomonas aeruginosa PA01
ccacggcgcgcuccggcgcgc

SEQ ID NO: 1505540 - RNA, 15 nt, Pseudomonas aeruginosa PA01
ccacggcgcggccgu

SEQ ID NO: 1505541 - RNA, 13 nt, Pseudomonas aeruginosa PA01
ccacggcgcgucg

SEQ ID NO: 1505542 - RNA, 16 nt, Pseudomonas aeruginosa PA01
ccacggcgaucgccgg

SEQ ID NO: 1505543 - RNA, 20 nt, Pseudomonas aeruginosa PA01
ccacggcgauggucaggacg

SEQ ID NO: 1505544 - RNA, 13 nt, Pseudomonas aeruginosa PA01
ccacggccaggcc

SEQ ID NO: 1505545 - RNA, 15 nt, Pseudomonas aeruginosa PA01
ccacggcgaagccgc

SEQ ID NO: 1505546 - RNA, 11 nt, Pseudomonas aeruginosa PA01
ccacgucgccg

SEQ ID NO: 1505547 - RNA, 14 nt, Pseudomonas aeruginosa PA01
ccacgucgccgacc

SEQ ID NO: 1505548 - RNA, 17 nt, Pseudomonas aeruginosa PA01
ccacgggucgcagccga

SEQ ID NO: 1505549 - RNA, 16 nt, Pseudomonas aeruginosa PA01
ccacgggucgucgccc

SEQ ID NO: 1505550 - RNA, 18 nt, Pseudomonas aeruginosa PA01
ccacgggucgucgcccug

SEQ ID NO: 1505551 - RNA, 22 nt, Pseudomonas aeruginosa PA01
ccacgucguuucucggcgaugg

SEQ ID NO: 1505552 - RNA, 13 nt, Pseudomonas aeruginosa PA01
ccacgugcagcag

SEQ ID NO: 1505553 - RNA, 15 nt, Pseudomonas aeruginosa PA01
ccacgugcggggugc

SEQ ID NO: 1505554 - RNA, 13 nt, Pseudomonas aeruginosa PA01
ccacgugcucgcg

SEQ ID NO: 1505555 - RNA, 16 nt, Pseudomonas aeruginosa PA01
ccacgucguccggcgc

SEQ ID NO: 1505556 - RNA, 22 nt, Pseudomonas aeruginosa PA01
ccacgucugugccgaggccgcc

SEQ ID NO: 1505557 - RNA, 20 nt, Pseudomonas aeruginosa PA01
ccacuccgccacccgcuccg

SEQ ID NO: 1505558 - RNA, 13 nt, Pseudomonas aeruginosa PA01
ccacuccggcagg

SEQ ID NO: 1505559 - RNA, 14 nt, Pseudomonas aeruginosa PA01
ccacuccaggcggc

SEQ ID NO: 1505560 - RNA, 16 nt, Pseudomonas aeruginosa PA01
ccacuccccagcaggc

SEQ ID NO: 1505561 - RNA, 21 nt, Pseudomonas aeruginosa PA01
ccacucccggcccuugagcau

SEQ ID NO: 1505562 - RNA, 14 nt, Pseudomonas aeruginosa PA01
ccacguggccggcg

SEQ ID NO: 1505563 - RNA, 15 nt, Pseudomonas aeruginosa PA01
ccacguggccggcgc

SEQ ID NO: 1505564 - RNA, 16 nt, Pseudomonas aeruginosa PA01
ccacguggccggcgcg

SEQ ID NO: 1505565 - RNA, 13 nt, Pseudomonas aeruginosa PA01
ccacuccagcgcg

SEQ ID NO: 1505566 - RNA, 16 nt, Pseudomonas aeruginosa PA01
ccacucggccaggcgc

SEQ ID NO: 1505567 - RNA, 17 nt, Pseudomonas aeruginosa PA01
ccacucggccaggcgcc

SEQ ID NO: 1505568 - RNA, 18 nt, Pseudomonas aeruginosa PA01
ccacucggccaggcgcca

SEQ ID NO: 1505569 - RNA, 20 nt, Pseudomonas aeruginosa PA01
ccacucgcguagcugggcga

SEQ ID NO: 1505570 - RNA, 20 nt, Pseudomonas aeruginosa PA01
ccacucgcgacugccgucgg

SEQ ID NO: 1505571 - RNA, 21 nt, Pseudomonas aeruginosa PA01
ccacucgcgagcuggcgccgu

SEQ ID NO: 1505572 - RNA, 22 nt, Pseudomonas aeruginosa PA01
ccacucgcgagcuggcgccguc

SEQ ID NO: 1505573 - RNA, 16 nt, Pseudomonas aeruginosa PA01
ccacucgccgaccagc

SEQ ID NO: 1505574 - RNA, 14 nt, Pseudomonas aeruginosa PA01
ccacuccuccgccu

SEQ ID NO: 1505575 - RNA, 20 nt, Pseudomonas aeruginosa PA01
ccacucgcagccgcgcucgg

SEQ ID NO: 1505576 - RNA, 22 nt, Pseudomonas aeruginosa PA01
ccacucgcagccgcgcucggcc

SEQ ID NO: 1505577 - RNA, 21 nt, Pseudomonas aeruginosa PA01
ccacucgccagcgcgcgccga

SEQ ID NO: 1505578 - RNA, 23 nt, Pseudomonas aeruginosa PA01
ccagaacgaaaaaggcgcgccgg

SEQ ID NO: 1505579 - RNA, 18 nt, Pseudomonas aeruginosa PA01
ccacugcguccuggucgc

SEQ ID NO: 1505580 - RNA, 13 nt, Pseudomonas aeruginosa PA01
ccacugcgcgcca

SEQ ID NO: 1505581 - RNA, 20 nt, Pseudomonas aeruginosa PA01
ccacuggcggaucuucgccu

SEQ ID NO: 1505582 - RNA, 18 nt, Pseudomonas aeruginosa PA01
ccacugcuuggcgaacuc

SEQ ID NO: 1505583 - RNA, 20 nt, Pseudomonas aeruginosa PA01
ccacuggaagaaggcgauca

SEQ ID NO: 1505584 - RNA, 17 nt, Pseudomonas aeruginosa PA01
ccacugucucgccgaug

SEQ ID NO: 1505585 - RNA, 18 nt, Pseudomonas aeruginosa PA01
aaagggagccaggcggcu

SEQ ID NO: 1505586 - RNA, 16 nt, Pseudomonas aeruginosa PA01
aaagggaugccgccgg

SEQ ID NO: 1505587 - RNA, 12 nt, Pseudomonas aeruginosa PA01
ccaccggcgucc

SEQ ID NO: 1505588 - RNA, 18 nt, Pseudomonas aeruginosa PA01
ccaccgucgcggucaucg

SEQ ID NO: 1505589 - RNA, 23 nt, Pseudomonas aeruginosa PA01
ccaccgucgcggucaucgccggc

SEQ ID NO: 1505590 - RNA, 22 nt, Pseudomonas aeruginosa PA01
ccaccggcccggagaucgccgc

SEQ ID NO: 1505591 - RNA, 23 nt, Pseudomonas aeruginosa PA01
ccaccggauugucgauguauccg

SEQ ID NO: 1505592 - RNA, 20 nt, Pseudomonas aeruginosa PA01
ccaccggacccggcugcacg

SEQ ID NO: 1505593 - RNA, 17 nt, Pseudomonas aeruginosa PA01
ccaccggaucgcccugg

SEQ ID NO: 1505594 - RNA, 20 nt, Pseudomonas aeruginosa PA01
ccaccggaucgcccuggcgc

SEQ ID NO: 1505595 - RNA, 21 nt, Pseudomonas aeruginosa PA01
ccaccggaucgcccuggcgcc

SEQ ID NO: 1505596 - RNA, 20 nt, Pseudomonas aeruginosa PA01
ccaccugaacgcgcccggcc

SEQ ID NO: 1505597 - RNA, 21 nt, Pseudomonas aeruginosa PA01
ccaccugaacgcgcccggcca

SEQ ID NO: 1505598 - RNA, 23 nt, Pseudomonas aeruginosa PA01
ccaccugaacgcgcccggccagg

SEQ ID NO: 1505599 - RNA, 23 nt, Pseudomonas aeruginosa PA01
ccaccugcaucacguacggcgcc

SEQ ID NO: 1505600 - RNA, 21 nt, Pseudomonas aeruginosa PA01
ccaccugcaugcuuuugaaca

SEQ ID NO: 1505601 - RNA, 18 nt, Pseudomonas aeruginosa PA01
ccaccucggcgucggcau

SEQ ID NO: 1505602 - RNA, 12 nt, Pseudomonas aeruginosa PA01
ccaccgucggau

SEQ ID NO: 1505603 - RNA, 16 nt, Pseudomonas aeruginosa PA01
ccaccgucggauggcc

SEQ ID NO: 1505604 - RNA, 14 nt, Pseudomonas aeruginosa PA01
ccaccgucuggcgc

SEQ ID NO: 1505605 - RNA, 18 nt, Pseudomonas aeruginosa PA01
ccaccgucuggcgcaucc

SEQ ID NO: 1505606 - RNA, 19 nt, Pseudomonas aeruginosa PA01
ccaccucgccaagcuggcg

SEQ ID NO: 1505607 - RNA, 23 nt, Pseudomonas aeruginosa PA01
ccaccucgccaagcuggcgaucg

SEQ ID NO: 1505608 - RNA, 16 nt, Pseudomonas aeruginosa PA01
ccaccgugcccgccgg

SEQ ID NO: 1505609 - RNA, 18 nt, Pseudomonas aeruginosa PA01
ccaccgugcccgccggcg

SEQ ID NO: 1505610 - RNA, 22 nt, Pseudomonas aeruginosa PA01
ccacgaacaggcugugcgccag

SEQ ID NO: 1505611 - RNA, 23 nt, Pseudomonas aeruginosa PA01
ccacgaacaggcugugcgccagg

SEQ ID NO: 1505612 - RNA, 21 nt, Pseudomonas aeruginosa PA01
ccaccugcucgcugaaccgcg

SEQ ID NO: 1505613 - RNA, 22 nt, Pseudomonas aeruginosa PA01
ccaccugcucgcugaaccgcgu

SEQ ID NO: 1505614 - RNA, 19 nt, Pseudomonas aeruginosa PA01
ccacgacucacccgcugcg

SEQ ID NO: 1505615 - RNA, 19 nt, Pseudomonas aeruginosa PA01
ccacgaaaaagcccggcau

SEQ ID NO: 1505616 - RNA, 18 nt, Pseudomonas aeruginosa PA01
ccacgaacugcauggccu

SEQ ID NO: 1505617 - RNA, 19 nt, Pseudomonas aeruginosa PA01
ccacgaagaacgccagccc

SEQ ID NO: 1505618 - RNA, 19 nt, Pseudomonas aeruginosa PA01
ccacgccauaggcggcgca

SEQ ID NO: 1505619 - RNA, 18 nt, Pseudomonas aeruginosa PA01
ccacgcccaucggcgucg

SEQ ID NO: 1505620 - RNA, 23 nt, Pseudomonas aeruginosa PA01
ccacgccauucgaauggcgccgg

SEQ ID NO: 1505621 - RNA, 19 nt, Pseudomonas aeruginosa PA01
ccacgcagaaggcgcuuuc

SEQ ID NO: 1505622 - RNA, 20 nt, Pseudomonas aeruginosa PA01
ccacgcagagcggcaggccg

SEQ ID NO: 1505623 - RNA, 16 nt, Pseudomonas aeruginosa PA01
ccacgcagccacccgc

SEQ ID NO: 1505624 - RNA, 13 nt, Pseudomonas aeruginosa PA01
ccacgcaggccag

SEQ ID NO: 1505625 - RNA, 14 nt, Pseudomonas aeruginosa PA01
ccacgcaggccagc

SEQ ID NO: 1505626 - RNA, 17 nt, Pseudomonas aeruginosa PA01
ccacgcaggccagcgcc

SEQ ID NO: 1505627 - RNA, 18 nt, Pseudomonas aeruginosa PA01
ccacgcaguucgcgggcc

SEQ ID NO: 1505628 - RNA, 20 nt, Pseudomonas aeruginosa PA01
ccacgcaauccucggugcgc

SEQ ID NO: 1505629 - RNA, 22 nt, Pseudomonas aeruginosa PA01
ccacgaucucggugguguagcg

SEQ ID NO: 1505630 - RNA, 22 nt, Pseudomonas aeruginosa PA01
ccacgcuccuggaagaacaggc

SEQ ID NO: 1505631 - RNA, 13 nt, Pseudomonas aeruginosa PA01
ccacgcucagccg

SEQ ID NO: 1505632 - RNA, 15 nt, Pseudomonas aeruginosa PA01
ccacgcucaggucgg

SEQ ID NO: 1505633 - RNA, 13 nt, Pseudomonas aeruginosa PA01
ccacgcucagugc

SEQ ID NO: 1505634 - RNA, 22 nt, Pseudomonas aeruginosa PA01
ccacgcucagugcgccgggugc

SEQ ID NO: 1505635 - RNA, 21 nt, Pseudomonas aeruginosa PA01
ccacgcucucgaacagcagca

SEQ ID NO: 1505636 - RNA, 16 nt, Pseudomonas aeruginosa PA01
ccacgcgccgauccag

SEQ ID NO: 1505637 - RNA, 14 nt, Pseudomonas aeruginosa PA01
ccacgcgccuggcc

SEQ ID NO: 1505638 - RNA, 15 nt, Pseudomonas aeruginosa PA01
ccacgcgccuggccg

SEQ ID NO: 1505639 - RNA, 16 nt, Pseudomonas aeruginosa PA01
ccacgcgcaucgugca

SEQ ID NO: 1505640 - RNA, 22 nt, Pseudomonas aeruginosa PA01
ccacggaugcagucccgccagg

SEQ ID NO: 1505641 - RNA, 23 nt, Pseudomonas aeruginosa PA01
ccacggaugcagucccgccaggc

SEQ ID NO: 1505642 - RNA, 14 nt, Pseudomonas aeruginosa PA01
ccacggacgcgcag

SEQ ID NO: 1505643 - RNA, 18 nt, Pseudomonas aeruginosa PA01
ccacggacgcgcaggguc

SEQ ID NO: 1505644 - RNA, 20 nt, Pseudomonas aeruginosa PA01
ccacggaggccuucgccgac

SEQ ID NO: 1505645 - RNA, 18 nt, Pseudomonas aeruginosa PA01
ccacggauaugcgccgcc

SEQ ID NO: 1505646 - RNA, 16 nt, Pseudomonas aeruginosa PA01
ccacggaaggccacgc

SEQ ID NO: 1505647 - RNA, 19 nt, Pseudomonas aeruginosa PA01
ccacggaaggccacgccgc

SEQ ID NO: 1505648 - RNA, 20 nt, Pseudomonas aeruginosa PA01
ccacgcugugcggcagcagg

SEQ ID NO: 1505649 - RNA, 20 nt, Pseudomonas aeruginosa PA01
ccacgcugaggcucagcgcg

SEQ ID NO: 1505650 - RNA, 21 nt, Pseudomonas aeruginosa PA01
ccacgcugaggcucagcgcgc

SEQ ID NO: 1505651 - RNA, 20 nt, Pseudomonas aeruginosa PA01
ccacgcugaucaucagcagg

SEQ ID NO: 1505652 - RNA, 17 nt, Pseudomonas aeruginosa PA01
ccacgcucuugaucguc

SEQ ID NO: 1505653 - RNA, 13 nt, Pseudomonas aeruginosa PA01
aaaucauccacag

SEQ ID NO: 1505654 - RNA, 17 nt, Pseudomonas aeruginosa PA01
ccagcgucgccaggccg

SEQ ID NO: 1505655 - RNA, 17 nt, Pseudomonas aeruginosa PA01
ccagcgucugccgcugg

SEQ ID NO: 1505656 - RNA, 14 nt, Pseudomonas aeruginosa PA01
ccagcguguggcga

SEQ ID NO: 1505657 - RNA, 15 nt, Pseudomonas aeruginosa PA01
ccagcguggccagcg

SEQ ID NO: 1505658 - RNA, 16 nt, Pseudomonas aeruginosa PA01
ccagcguggccagcga

SEQ ID NO: 1505659 - RNA, 20 nt, Pseudomonas aeruginosa PA01
ccagcguggccagcgaaccc

SEQ ID NO: 1505660 - RNA, 17 nt, Pseudomonas aeruginosa PA01
ccagcgugggcaacagg

SEQ ID NO: 1505661 - RNA, 20 nt, Pseudomonas aeruginosa PA01
ccagcgugggcaacaggccg

SEQ ID NO: 1505662 - RNA, 17 nt, Pseudomonas aeruginosa PA01
ccagcguggcgcgcauc

SEQ ID NO: 1505663 - RNA, 23 nt, Pseudomonas aeruginosa PA01
ccagcgggucgucgaagcgcagc

SEQ ID NO: 1505664 - RNA, 18 nt, Pseudomonas aeruginosa PA01
ccagcggguagaugccac

SEQ ID NO: 1505665 - RNA, 20 nt, Pseudomonas aeruginosa PA01
ccagcggguaguagaucagc

SEQ ID NO: 1505666 - RNA, 21 nt, Pseudomonas aeruginosa PA01
ccagcggguaguagaucagcu

SEQ ID NO: 1505667 - RNA, 18 nt, Pseudomonas aeruginosa PA01
ccagcgguaccagcagcg

SEQ ID NO: 1505668 - RNA, 22 nt, Pseudomonas aeruginosa PA01
ccagcgguacccgccggccaug

SEQ ID NO: 1505669 - RNA, 17 nt, Pseudomonas aeruginosa PA01
ccagcgguacguagcgc

SEQ ID NO: 1505670 - RNA, 23 nt, Pseudomonas aeruginosa PA01
ccagcgguacguagcgcgguucg

SEQ ID NO: 1505671 - RNA, 16 nt, Pseudomonas aeruginosa PA01
ccagcgggaaggucgg

SEQ ID NO: 1505672 - RNA, 18 nt, Pseudomonas aeruginosa PA01
ccagcgggaaggucggca

SEQ ID NO: 1505673 - RNA, 19 nt, Pseudomonas aeruginosa PA01
ccagcggcuuguccuggcg

SEQ ID NO: 1505674 - RNA, 16 nt, Pseudomonas aeruginosa PA01
ccagcgggcgccgccg

SEQ ID NO: 1505675 - RNA, 14 nt, Pseudomonas aeruginosa PA01
ccagcgggcggucg

SEQ ID NO: 1505676 - RNA, 20 nt, Pseudomonas aeruginosa PA01
ccagcgggcugucguccugg

SEQ ID NO: 1505677 - RNA, 14 nt, Pseudomonas aeruginosa PA01
ccagcgucgccgcc

SEQ ID NO: 1505678 - RNA, 13 nt, Pseudomonas aeruginosa PA01
ccagcgucgcgcg

SEQ ID NO: 1505679 - RNA, 22 nt, Pseudomonas aeruginosa PA01
ccagcgguugagcagggcgucg

SEQ ID NO: 1505680 - RNA, 22 nt, Pseudomonas aeruginosa PA01
ccagcgcggcucgggcggcaag

SEQ ID NO: 1505681 - RNA, 23 nt, Pseudomonas aeruginosa PA01
ccagcgcggcucgggcggcaagg

SEQ ID NO: 1505682 - RNA, 12 nt, Pseudomonas aeruginosa PA01
ccagcgcgggca

SEQ ID NO: 1505683 - RNA, 23 nt, Pseudomonas aeruginosa PA01
ccagcgcgggcaccgagucggca

SEQ ID NO: 1505684 - RNA, 14 nt, Pseudomonas aeruginosa PA01
ccagcgcgccgccg

SEQ ID NO: 1505685 - RNA, 15 nt, Pseudomonas aeruginosa PA01
ccagcgcggcgcgga

SEQ ID NO: 1505686 - RNA, 17 nt, Pseudomonas aeruginosa PA01
ccagcgcggcggacagg

SEQ ID NO: 1505687 - RNA, 15 nt, Pseudomonas aeruginosa PA01
ccagcgcgccgccga

SEQ ID NO: 1505688 - RNA, 16 nt, Pseudomonas aeruginosa PA01
ccagcgcgccgccgag

SEQ ID NO: 1505689 - RNA, 17 nt, Pseudomonas aeruginosa PA01
ccagcgcgccgccgagg

SEQ ID NO: 1505690 - RNA, 14 nt, Pseudomonas aeruginosa PA01
ccagcgcaucgagg

SEQ ID NO: 1505691 - RNA, 22 nt, Pseudomonas aeruginosa PA01
ccagcgcaucgaggccggcaug

SEQ ID NO: 1505692 - RNA, 22 nt, Pseudomonas aeruginosa PA01
ccagcgccagggguaggaggaa

SEQ ID NO: 1505693 - RNA, 17 nt, Pseudomonas aeruginosa PA01
ccagcgcccaggccggg

SEQ ID NO: 1505694 - RNA, 23 nt, Pseudomonas aeruginosa PA01
ccagcgccgacuugcucaucgcg

SEQ ID NO: 1505695 - RNA, 20 nt, Pseudomonas aeruginosa PA01
ccagcgccccaccaggcucg

SEQ ID NO: 1505696 - RNA, 13 nt, Pseudomonas aeruginosa PA01
ccagcgccgccag

SEQ ID NO: 1505697 - RNA, 14 nt, Pseudomonas aeruginosa PA01
ccagcgccgccagg

SEQ ID NO: 1505698 - RNA, 17 nt, Pseudomonas aeruginosa PA01
ccagcgccgccaggcgc

SEQ ID NO: 1505699 - RNA, 18 nt, Pseudomonas aeruginosa PA01
ccagcgccgccaggcgcg

SEQ ID NO: 1505700 - RNA, 16 nt, Pseudomonas aeruginosa PA01
ccagcgcgcccggcgc

SEQ ID NO: 1505701 - RNA, 11 nt, Pseudomonas aeruginosa PA01
ccagcgcgccg

SEQ ID NO: 1505702 - RNA, 13 nt, Pseudomonas aeruginosa PA01
ccagcggcgccag

SEQ ID NO: 1505703 - RNA, 12 nt, Pseudomonas aeruginosa PA01
ccagcggccgcg

SEQ ID NO: 1505704 - RNA, 15 nt, Pseudomonas aeruginosa PA01
ccagcggccgcgagc

SEQ ID NO: 1505705 - RNA, 17 nt, Pseudomonas aeruginosa PA01
ccagcggccgcgagcgc

SEQ ID NO: 1505706 - RNA, 14 nt, Pseudomonas aeruginosa PA01
ccagcggccgcgcc

SEQ ID NO: 1505707 - RNA, 12 nt, Pseudomonas aeruginosa PA01
ccagcggcccgg

SEQ ID NO: 1505708 - RNA, 15 nt, Pseudomonas aeruginosa PA01
ccagcggcccggcag

SEQ ID NO: 1505709 - RNA, 21 nt, Pseudomonas aeruginosa PA01
ccagcggcgggaaacgcagcg

SEQ ID NO: 1505710 - RNA, 14 nt, Pseudomonas aeruginosa PA01
ccagcggcugcggg

SEQ ID NO: 1505711 - RNA, 17 nt, Pseudomonas aeruginosa PA01
ccagcggcuggcgggcg

SEQ ID NO: 1505712 - RNA, 13 nt, Pseudomonas aeruginosa PA01
ccagcggcuggcg

SEQ ID NO: 1505713 - RNA, 20 nt, Pseudomonas aeruginosa PA01
ccagcggcgcuugcgggcgc

SEQ ID NO: 1505714 - RNA, 14 nt, Pseudomonas aeruginosa PA01
ccagcggcgccagc

SEQ ID NO: 1505715 - RNA, 16 nt, Pseudomonas aeruginosa PA01
ccagcggcgccagcuc

SEQ ID NO: 1505716 - RNA, 22 nt, Pseudomonas aeruginosa PA01
ccagcggcgccagcuccagcgc

SEQ ID NO: 1505717 - RNA, 22 nt, Pseudomonas aeruginosa PA01
ccagcggcagcgguucgcccgc

SEQ ID NO: 1505718 - RNA, 15 nt, Pseudomonas aeruginosa PA01
ccagcggcaggcacg

SEQ ID NO: 1505719 - RNA, 18 nt, Pseudomonas aeruginosa PA01
ccagcggcagcucggcga

SEQ ID NO: 1505720 - RNA, 19 nt, Pseudomonas aeruginosa PA01
ccagcggcagggcggcgau

SEQ ID NO: 1505721 - RNA, 21 nt, Pseudomonas aeruginosa PA01
ccagcggcagggcggcgauga

SEQ ID NO: 1505722 - RNA, 15 nt, Pseudomonas aeruginosa PA01
ccagcggcaugccgu

SEQ ID NO: 1505723 - RNA, 16 nt, Pseudomonas aeruginosa PA01
ccagcgcgucgaccac

SEQ ID NO: 1505724 - RNA, 19 nt, Pseudomonas aeruginosa PA01
ccagcgcgucgaccaccgc

SEQ ID NO: 1505725 - RNA, 15 nt, Pseudomonas aeruginosa PA01
ccagcggaaucgcgc

SEQ ID NO: 1505726 - RNA, 17 nt, Pseudomonas aeruginosa PA01
ccagcggaaucgcgccc

SEQ ID NO: 1505727 - RNA, 18 nt, Pseudomonas aeruginosa PA01
ccagcggaugcuggcgga

SEQ ID NO: 1505728 - RNA, 14 nt, Pseudomonas aeruginosa PA01
ccagcccagggcga

SEQ ID NO: 1505729 - RNA, 17 nt, Pseudomonas aeruginosa PA01
ccagcccagggcgaucg

SEQ ID NO: 1505730 - RNA, 13 nt, Pseudomonas aeruginosa PA01
ccagcccagcggc

SEQ ID NO: 1505731 - RNA, 21 nt, Pseudomonas aeruginosa PA01
ccagcccagcggcgcggcgua

SEQ ID NO: 1505732 - RNA, 21 nt, Pseudomonas aeruginosa PA01
ccagccagucgagacgccagc

SEQ ID NO: 1505733 - RNA, 22 nt, Pseudomonas aeruginosa PA01
ccagccagucgagacgccagcc

SEQ ID NO: 1505734 - RNA, 15 nt, Pseudomonas aeruginosa PA01
ccagccagucggcgg

SEQ ID NO: 1505735 - RNA, 15 nt, Pseudomonas aeruginosa PA01
ccagccaguggcugg

SEQ ID NO: 1505736 - RNA, 16 nt, Pseudomonas aeruginosa PA01
ccagccaugcaggcug

SEQ ID NO: 1505737 - RNA, 16 nt, Pseudomonas aeruginosa PA01
ccagccauugagcgcg

SEQ ID NO: 1505738 - RNA, 19 nt, Pseudomonas aeruginosa PA01
ccagccauugagcgcgccc

SEQ ID NO: 1505739 - RNA, 20 nt, Pseudomonas aeruginosa PA01
ccagccauugagcgcgccca

SEQ ID NO: 1505740 - RNA, 13 nt, Pseudomonas aeruginosa PA01
ccagcaucgccgg

SEQ ID NO: 1505741 - RNA, 16 nt, Pseudomonas aeruginosa PA01
ccagcaucgccggcag

SEQ ID NO: 1505742 - RNA, 17 nt, Pseudomonas aeruginosa PA01
ccagcaucgccggcagc

SEQ ID NO: 1505743 - RNA, 21 nt, Pseudomonas aeruginosa PA01
ccagcaucgccggcagcgccg

SEQ ID NO: 1505744 - RNA, 18 nt, Pseudomonas aeruginosa PA01
ccagcaucaccuugcgga

SEQ ID NO: 1505745 - RNA, 13 nt, Pseudomonas aeruginosa PA01
ccagcaucgcauc

SEQ ID NO: 1505746 - RNA, 18 nt, Pseudomonas aeruginosa PA01
ccagcaucgcaucggcga

SEQ ID NO: 1505747 - RNA, 20 nt, Pseudomonas aeruginosa PA01
ccagcaucgcaucggcgacc

SEQ ID NO: 1505748 - RNA, 23 nt, Pseudomonas aeruginosa PA01
ccagccacagaggucgcugacca

SEQ ID NO: 1505749 - RNA, 13 nt, Pseudomonas aeruginosa PA01
ccagccacucccg

SEQ ID NO: 1505750 - RNA, 17 nt, Pseudomonas aeruginosa PA01
ccagcaggucgcgcugg

SEQ ID NO: 1505751 - RNA, 14 nt, Pseudomonas aeruginosa PA01
ccagcaggucggca

SEQ ID NO: 1505752 - RNA, 16 nt, Pseudomonas aeruginosa PA01
ccagcaggucggcagc

SEQ ID NO: 1505753 - RNA, 17 nt, Pseudomonas aeruginosa PA01
ccagcaggucggcagcg

SEQ ID NO: 1505754 - RNA, 16 nt, Pseudomonas aeruginosa PA01
ccagcaggucggcgcg

SEQ ID NO: 1505755 - RNA, 15 nt, Pseudomonas aeruginosa PA01
ccagcaggucgaggg

SEQ ID NO: 1505756 - RNA, 21 nt, Pseudomonas aeruginosa PA01
ccagcaccucccccagcgggc

SEQ ID NO: 1505757 - RNA, 14 nt, Pseudomonas aeruginosa PA01
ccagcaccucgacg

SEQ ID NO: 1505758 - RNA, 15 nt, Pseudomonas aeruginosa PA01
ccagcaccucgacgc

SEQ ID NO: 1505759 - RNA, 17 nt, Pseudomonas aeruginosa PA01
ccagcaccucgacgccc

SEQ ID NO: 1505760 - RNA, 19 nt, Pseudomonas aeruginosa PA01
ccagcaccucgacgcccgc

SEQ ID NO: 1505761 - RNA, 15 nt, Pseudomonas aeruginosa PA01
ccagcaccucgccgu

SEQ ID NO: 1505762 - RNA, 13 nt, Pseudomonas aeruginosa PA01
ccagcaccucgcg

SEQ ID NO: 1505763 - RNA, 17 nt, Pseudomonas aeruginosa PA01
ccagcaccucgcgggaa

SEQ ID NO: 1505764 - RNA, 20 nt, Pseudomonas aeruginosa PA01
ccagcaccucguaggccgac

SEQ ID NO: 1505765 - RNA, 21 nt, Pseudomonas aeruginosa PA01
ccagcaccucguaggccgacu

SEQ ID NO: 1505766 - RNA, 23 nt, Pseudomonas aeruginosa PA01
ccagcaccucguaggccgacucg

SEQ ID NO: 1505767 - RNA, 12 nt, Pseudomonas aeruginosa PA01
ccagcaccugga

SEQ ID NO: 1505768 - RNA, 19 nt, Pseudomonas aeruginosa PA01
ccagcaccuggacgaaugc

SEQ ID NO: 1505769 - RNA, 22 nt, Pseudomonas aeruginosa PA01
ccagcaccugcgggcugcgugc

SEQ ID NO: 1505770 - RNA, 16 nt, Pseudomonas aeruginosa PA01
ccagcaguagugcgac

SEQ ID NO: 1505771 - RNA, 16 nt, Pseudomonas aeruginosa PA01
ccagcagucgcacagc

SEQ ID NO: 1505772 - RNA, 19 nt, Pseudomonas aeruginosa PA01
ccagcagucgcggcccugg

SEQ ID NO: 1505773 - RNA, 16 nt, Pseudomonas aeruginosa PA01
ccagcagguggcgcac

SEQ ID NO: 1505774 - RNA, 23 nt, Pseudomonas aeruginosa PA01
ccagcagguggcgcacugccagg

SEQ ID NO: 1505775 - RNA, 20 nt, Pseudomonas aeruginosa PA01
ccagcagguggucgaugggc

SEQ ID NO: 1505776 - RNA, 17 nt, Pseudomonas aeruginosa PA01
ccagcaguugcaacagc

SEQ ID NO: 1505777 - RNA, 18 nt, Pseudomonas aeruginosa PA01
ccagcaguugcaacagcg

SEQ ID NO: 1505778 - RNA, 21 nt, Pseudomonas aeruginosa PA01
ccagcaguugcaacagcgcgg

SEQ ID NO: 1505779 - RNA, 23 nt, Pseudomonas aeruginosa PA01
ccagcaguugcaacagcgcggcg

SEQ ID NO: 1505780 - RNA, 21 nt, Pseudomonas aeruginosa PA01
ccagccccugcggaccgcaga

SEQ ID NO: 1505781 - RNA, 14 nt, Pseudomonas aeruginosa PA01
ccagccccaggcgc

SEQ ID NO: 1505782 - RNA, 15 nt, Pseudomonas aeruginosa PA01
ccagccccaggcgcg

SEQ ID NO: 1505783 - RNA, 22 nt, Pseudomonas aeruginosa PA01
ccagccccagucccuucagcgc

SEQ ID NO: 1505784 - RNA, 13 nt, Pseudomonas aeruginosa PA01
ccagcccggccau

SEQ ID NO: 1505785 - RNA, 15 nt, Pseudomonas aeruginosa PA01
ccagcccggccaucc

SEQ ID NO: 1505786 - RNA, 13 nt, Pseudomonas aeruginosa PA01
ccagcccggcagg

SEQ ID NO: 1505787 - RNA, 12 nt, Pseudomonas aeruginosa PA01
ccagcccggcca

SEQ ID NO: 1505788 - RNA, 14 nt, Pseudomonas aeruginosa PA01
ccagcccgccuucc

SEQ ID NO: 1505789 - RNA, 19 nt, Pseudomonas aeruginosa PA01
ccagcccgccuuccagcuu

SEQ ID NO: 1505790 - RNA, 14 nt, Pseudomonas aeruginosa PA01
ccagcccggcggug

SEQ ID NO: 1505791 - RNA, 14 nt, Pseudomonas aeruginosa PA01
ccagcccggcgugg

SEQ ID NO: 1505792 - RNA, 21 nt, Pseudomonas aeruginosa PA01
ccagcccggcgugggcggucg

SEQ ID NO: 1505793 - RNA, 14 nt, Pseudomonas aeruginosa PA01
ccagcccggcucgg

SEQ ID NO: 1505794 - RNA, 18 nt, Pseudomonas aeruginosa PA01
ccagcccggccucgccgg

SEQ ID NO: 1505795 - RNA, 22 nt, Pseudomonas aeruginosa PA01
ccagcccggccucgccggucgc

SEQ ID NO: 1505796 - RNA, 14 nt, Pseudomonas aeruginosa PA01
ccagcccggcggcg

SEQ ID NO: 1505797 - RNA, 12 nt, Pseudomonas aeruginosa PA01
ccagccggccgc

SEQ ID NO: 1505798 - RNA, 22 nt, Pseudomonas aeruginosa PA01
ccagccgcccuugucgaugagc

SEQ ID NO: 1505799 - RNA, 16 nt, Pseudomonas aeruginosa PA01
ccagccgccgaagggc

SEQ ID NO: 1505800 - RNA, 22 nt, Pseudomonas aeruginosa PA01
ccagccgccgaagggccgcagg

SEQ ID NO: 1505801 - RNA, 20 nt, Pseudomonas aeruginosa PA01
ccagccgccaggacggcagg

SEQ ID NO: 1505802 - RNA, 22 nt, Pseudomonas aeruginosa PA01
ccagcgcaccuacuaccgcugg

SEQ ID NO: 1505803 - RNA, 23 nt, Pseudomonas aeruginosa PA01
ccagcgcaccuacuaccgcuggg

SEQ ID NO: 1505804 - RNA, 16 nt, Pseudomonas aeruginosa PA01
ccagcgcaccgccaag

SEQ ID NO: 1505805 - RNA, 22 nt, Pseudomonas aeruginosa PA01
ccagcgcaccgccaaggauggg

SEQ ID NO: 1505806 - RNA, 15 nt, Pseudomonas aeruginosa PA01
ccagcgcacgccgug

SEQ ID NO: 1505807 - RNA, 23 nt, Pseudomonas aeruginosa PA01
ccagcgcacgccguggaccagga

SEQ ID NO: 1505808 - RNA, 22 nt, Pseudomonas aeruginosa PA01
ccagcgcagccugcuggccugg

SEQ ID NO: 1505809 - RNA, 13 nt, Pseudomonas aeruginosa PA01
ccagcgcaggccg

SEQ ID NO: 1505810 - RNA, 20 nt, Pseudomonas aeruginosa PA01
ccagcgcaccagggucgggc

SEQ ID NO: 1505811 - RNA, 17 nt, Pseudomonas aeruginosa PA01
ccagcgcaagcggcggc

SEQ ID NO: 1505812 - RNA, 19 nt, Pseudomonas aeruginosa PA01
ccagcgagacgggcgaggc

SEQ ID NO: 1505813 - RNA, 16 nt, Pseudomonas aeruginosa PA01
ccagcgacuccgccag

SEQ ID NO: 1505814 - RNA, 17 nt, Pseudomonas aeruginosa PA01
ccagcgacuccgccagu

SEQ ID NO: 1505815 - RNA, 17 nt, Pseudomonas aeruginosa PA01
ccagcgacucgcucgcu

SEQ ID NO: 1505816 - RNA, 23 nt, Pseudomonas aeruginosa PA01
ccagcgacucgcucgcuucagcg

SEQ ID NO: 1505817 - RNA, 15 nt, Pseudomonas aeruginosa PA01
ccagcgagaacuugc

SEQ ID NO: 1505818 - RNA, 20 nt, Pseudomonas aeruginosa PA01
ccagcgagaacuugccggcg

SEQ ID NO: 1505819 - RNA, 22 nt, Pseudomonas aeruginosa PA01
ccagcgagaacuugccggcgcc

SEQ ID NO: 1505820 - RNA, 16 nt, Pseudomonas aeruginosa PA01
ccagcgaaccgccggc

SEQ ID NO: 1505821 - RNA, 18 nt, Pseudomonas aeruginosa PA01
ccagcgaaccgccggccu

SEQ ID NO: 1505822 - RNA, 22 nt, Pseudomonas aeruginosa PA01
ccagcgaaccgccggccucgcu

SEQ ID NO: 1505823 - RNA, 15 nt, Pseudomonas aeruginosa PA01
ccagcgaagugcgcu

SEQ ID NO: 1505824 - RNA, 18 nt, Pseudomonas aeruginosa PA01
ccagccggucccgggcuc

SEQ ID NO: 1505825 - RNA, 16 nt, Pseudomonas aeruginosa PA01
ccagcgaauggacagg

SEQ ID NO: 1505826 - RNA, 18 nt, Pseudomonas aeruginosa PA01
ccagccggcgcucggcca

SEQ ID NO: 1505827 - RNA, 18 nt, Pseudomonas aeruginosa PA01
ccagccgggcuccgccgc

SEQ ID NO: 1505828 - RNA, 19 nt, Pseudomonas aeruginosa PA01
ccagccgggcuccgccgcg

SEQ ID NO: 1505829 - RNA, 14 nt, Pseudomonas aeruginosa PA01
ccagccggcgccgc

SEQ ID NO: 1505830 - RNA, 17 nt, Pseudomonas aeruginosa PA01
ccagccggcgccgcagg

SEQ ID NO: 1505831 - RNA, 14 nt, Pseudomonas aeruginosa PA01
ccagccggccgcgu

SEQ ID NO: 1505832 - RNA, 22 nt, Pseudomonas aeruginosa PA01
ccagccggcgaagggcaggccg

SEQ ID NO: 1505833 - RNA, 16 nt, Pseudomonas aeruginosa PA01
ccaggacaacgacagc

SEQ ID NO: 1505834 - RNA, 12 nt, Pseudomonas aeruginosa PA01
ccaggacagcac

SEQ ID NO: 1505835 - RNA, 13 nt, Pseudomonas aeruginosa PA01
ccaggacagcacg

SEQ ID NO: 1505836 - RNA, 17 nt, Pseudomonas aeruginosa PA01
ccaggacagcacgcuca

SEQ ID NO: 1505837 - RNA, 18 nt, Pseudomonas aeruginosa PA01
ccaggacagcacgcucag

SEQ ID NO: 1505838 - RNA, 17 nt, Pseudomonas aeruginosa PA01
ccaggaccaggaucgac

SEQ ID NO: 1505839 - RNA, 12 nt, Pseudomonas aeruginosa PA01
ccaggaccgcga

SEQ ID NO: 1505840 - RNA, 14 nt, Pseudomonas aeruginosa PA01
ccaggaccgcgaug

SEQ ID NO: 1505841 - RNA, 14 nt, Pseudomonas aeruginosa PA01
ccaggaccagcccg

SEQ ID NO: 1505842 - RNA, 13 nt, Pseudomonas aeruginosa PA01
ccaggaccagcgc

SEQ ID NO: 1505843 - RNA, 13 nt, Pseudomonas aeruginosa PA01
ccaggaaggcguc

SEQ ID NO: 1505844 - RNA, 21 nt, Pseudomonas aeruginosa PA01
ccaggaaggaaugcugccacc

SEQ ID NO: 1505845 - RNA, 20 nt, Pseudomonas aeruginosa PA01
ccaggaaggccgggcccugg

SEQ ID NO: 1505846 - RNA, 14 nt, Pseudomonas aeruginosa PA01
ccaggaagcgucgu

SEQ ID NO: 1505847 - RNA, 14 nt, Pseudomonas aeruginosa PA01
ccaggaagcggcgg

SEQ ID NO: 1505848 - RNA, 17 nt, Pseudomonas aeruginosa PA01
ccaggaagcgggccucg

SEQ ID NO: 1505849 - RNA, 23 nt, Pseudomonas aeruginosa PA01
ccaggaagccgcgccccagcggc

SEQ ID NO: 1505850 - RNA, 20 nt, Pseudomonas aeruginosa PA01
ccaggaagagcccgccacgc

SEQ ID NO: 1505851 - RNA, 21 nt, Pseudomonas aeruginosa PA01
ccaggaagagcccgccacgcu

SEQ ID NO: 1505852 - RNA, 23 nt, Pseudomonas aeruginosa PA01
ccaggaagccccagaagaucgcc

SEQ ID NO: 1505853 - RNA, 23 nt, Pseudomonas aeruginosa PA01
ccagcuugcgucccuuggcgucg

SEQ ID NO: 1505854 - RNA, 15 nt, Pseudomonas aeruginosa PA01
ccagcuuccaggcgc

SEQ ID NO: 1505855 - RNA, 17 nt, Pseudomonas aeruginosa PA01
ccagcuuccaggcgcgc

SEQ ID NO: 1505856 - RNA, 14 nt, Pseudomonas aeruginosa PA01
ccaggaaccggcca

SEQ ID NO: 1505857 - RNA, 17 nt, Pseudomonas aeruginosa PA01
ccagcuuguccacgcca

SEQ ID NO: 1505858 - RNA, 17 nt, Pseudomonas aeruginosa PA01
ccagcuugucgucggcc

SEQ ID NO: 1505859 - RNA, 18 nt, Pseudomonas aeruginosa PA01
ccagcuugucgucggccu

SEQ ID NO: 1505860 - RNA, 14 nt, Pseudomonas aeruginosa PA01
ccagcuugggcacg

SEQ ID NO: 1505861 - RNA, 20 nt, Pseudomonas aeruginosa PA01
ccagcuugcgccagagcagg

SEQ ID NO: 1505862 - RNA, 21 nt, Pseudomonas aeruginosa PA01
ccagcuugucgccuuccucgg

SEQ ID NO: 1505863 - RNA, 14 nt, Pseudomonas aeruginosa PA01
ccagcuugucggcc

SEQ ID NO: 1505864 - RNA, 17 nt, Pseudomonas aeruginosa PA01
ccaggauguucgccgag

SEQ ID NO: 1505865 - RNA, 18 nt, Pseudomonas aeruginosa PA01
ccaggauguucgccgagg

SEQ ID NO: 1505866 - RNA, 20 nt, Pseudomonas aeruginosa PA01
ccaggcaagcgcaugaggcu

SEQ ID NO: 1505867 - RNA, 22 nt, Pseudomonas aeruginosa PA01
ccaggcaagcgcaugaggcugg

SEQ ID NO: 1505868 - RNA, 19 nt, Pseudomonas aeruginosa PA01
ccaggcaauggccggcggg

SEQ ID NO: 1505869 - RNA, 12 nt, Pseudomonas aeruginosa PA01
ccaggaucggca

SEQ ID NO: 1505870 - RNA, 23 nt, Pseudomonas aeruginosa PA01
ccaggaucauccgcaccauccgc

SEQ ID NO: 1505871 - RNA, 17 nt, Pseudomonas aeruginosa PA01
ccaggaucgucggcccg

SEQ ID NO: 1505872 - RNA, 13 nt, Pseudomonas aeruginosa PA01
ccaggaucgccuc

SEQ ID NO: 1505873 - RNA, 22 nt, Pseudomonas aeruginosa PA01
ccaggaucgccuccaccagcgc

SEQ ID NO: 1505874 - RNA, 23 nt, Pseudomonas aeruginosa PA01
ccaggaucgccuccaccagcgcc

SEQ ID NO: 1505875 - RNA, 17 nt, Pseudomonas aeruginosa PA01
ccaggaugcaaccgccc

SEQ ID NO: 1505876 - RNA, 23 nt, Pseudomonas aeruginosa PA01
ccaggaugaccaggcugaucagc

SEQ ID NO: 1505877 - RNA, 15 nt, Pseudomonas aeruginosa PA01
ccaggacgcuggcga

SEQ ID NO: 1505878 - RNA, 19 nt, Pseudomonas aeruginosa PA01
ccaggacgccaccaggccg

SEQ ID NO: 1505879 - RNA, 16 nt, Pseudomonas aeruginosa PA01
ccaggaccuugucgcg

SEQ ID NO: 1505880 - RNA, 14 nt, Pseudomonas aeruginosa PA01
ccaggagcagggcg

SEQ ID NO: 1505881 - RNA, 18 nt, Pseudomonas aeruginosa PA01
ccaggagcagggcgccga

SEQ ID NO: 1505882 - RNA, 15 nt, Pseudomonas aeruginosa PA01
ccaggagcaucggcg

SEQ ID NO: 1505883 - RNA, 17 nt, Pseudomonas aeruginosa PA01
ccaggagcaucggcgcg

SEQ ID NO: 1505884 - RNA, 18 nt, Pseudomonas aeruginosa PA01
ccaggagcaucggcgcgg

SEQ ID NO: 1505885 - RNA, 15 nt, Pseudomonas aeruginosa PA01
ccaggacucgccauc

SEQ ID NO: 1505886 - RNA, 22 nt, Pseudomonas aeruginosa PA01
ccaggacucgccaucggccugg

SEQ ID NO: 1505887 - RNA, 24 nt, Pseudomonas aeruginosa PA01
ccaggacguuauccguccuacgcg

SEQ ID NO: 1505888 - RNA, 21 nt, Pseudomonas aeruginosa PA01
ccaggaggauucgccagccuc

SEQ ID NO: 1505889 - RNA, 16 nt, Pseudomonas aeruginosa PA01
ccaggagggcugcugu

SEQ ID NO: 1505890 - RNA, 21 nt, Pseudomonas aeruginosa PA01
ccaggagggcugcuguccagc

SEQ ID NO: 1505891 - RNA, 20 nt, Pseudomonas aeruginosa PA01
ccaggaucgaacuggccagc

SEQ ID NO: 1505892 - RNA, 13 nt, Pseudomonas aeruginosa PA01
ccagcuguacgcg

SEQ ID NO: 1505893 - RNA, 20 nt, Pseudomonas aeruginosa PA01
ccagcuucaccggugccggg

SEQ ID NO: 1505894 - RNA, 15 nt, Pseudomonas aeruginosa PA01
ccagcuucagccgac

SEQ ID NO: 1505895 - RNA, 20 nt, Pseudomonas aeruginosa PA01
ccagcucuugcccugccagc

SEQ ID NO: 1505896 - RNA, 21 nt, Pseudomonas aeruginosa PA01
ccagcucgucgagcugcucgg

SEQ ID NO: 1505897 - RNA, 15 nt, Pseudomonas aeruginosa PA01
ccagcucggucagcg

SEQ ID NO: 1505898 - RNA, 22 nt, Pseudomonas aeruginosa PA01
ccagcucggucagcggcgcagc

SEQ ID NO: 1505899 - RNA, 14 nt, Pseudomonas aeruginosa PA01
ccagcucggccugu

SEQ ID NO: 1505900 - RNA, 14 nt, Pseudomonas aeruginosa PA01
ccagcucggcgagu

SEQ ID NO: 1505901 - RNA, 13 nt, Pseudomonas aeruginosa PA01
ccagcucggcggg

SEQ ID NO: 1505902 - RNA, 18 nt, Pseudomonas aeruginosa PA01
ccagcucguccaggcaag

SEQ ID NO: 1505903 - RNA, 15 nt, Pseudomonas aeruginosa PA01
ccagcuccgaaggga

SEQ ID NO: 1505904 - RNA, 21 nt, Pseudomonas aeruginosa PA01
ccagcuccgucuguucggcca

SEQ ID NO: 1505905 - RNA, 23 nt, Pseudomonas aeruginosa PA01
ccagcuccgucuguucggccagg

SEQ ID NO: 1505906 - RNA, 18 nt, Pseudomonas aeruginosa PA01
ccagcucgaacagcaccg

SEQ ID NO: 1505907 - RNA, 13 nt, Pseudomonas aeruginosa PA01
ccagcucgcccgc

SEQ ID NO: 1505908 - RNA, 18 nt, Pseudomonas aeruginosa PA01
ccagcucgccgaacagga

SEQ ID NO: 1505909 - RNA, 15 nt, Pseudomonas aeruginosa PA01
ccagcucgcugucca

SEQ ID NO: 1505910 - RNA, 22 nt, Pseudomonas aeruginosa PA01
ccagcucggacaagggccagag

SEQ ID NO: 1505911 - RNA, 18 nt, Pseudomonas aeruginosa PA01
ccagcucggccaucagcg

SEQ ID NO: 1505912 - RNA, 23 nt, Pseudomonas aeruginosa PA01
ccagcucggccaucagcgccagg

SEQ ID NO: 1505913 - RNA, 23 nt, Pseudomonas aeruginosa PA01
ccagcucauggagcaacagcguc

SEQ ID NO: 1505914 - RNA, 14 nt, Pseudomonas aeruginosa PA01
ccagcuccuccagc

SEQ ID NO: 1505915 - RNA, 17 nt, Pseudomonas aeruginosa PA01
ccagcucgccgcgcucc

SEQ ID NO: 1505916 - RNA, 17 nt, Pseudomonas aeruginosa PA01
ccagcucgaagccgccg

SEQ ID NO: 1505917 - RNA, 20 nt, Pseudomonas aeruginosa PA01
ccagcucgacccgcccgccg

SEQ ID NO: 1505918 - RNA, 12 nt, Pseudomonas aeruginosa PA01
ccagcucgcccg

SEQ ID NO: 1505919 - RNA, 14 nt, Pseudomonas aeruginosa PA01
ccagcuccagcgcc

SEQ ID NO: 1505920 - RNA, 13 nt, Pseudomonas aeruginosa PA01
ccagcuccagcac

SEQ ID NO: 1505921 - RNA, 15 nt, Pseudomonas aeruginosa PA01
ccagcuccccguccc

SEQ ID NO: 1505922 - RNA, 20 nt, Pseudomonas aeruginosa PA01
ccagcguuucgaagccgccg

SEQ ID NO: 1505923 - RNA, 14 nt, Pseudomonas aeruginosa PA01
ccagcguucggcgc

SEQ ID NO: 1505924 - RNA, 20 nt, Pseudomonas aeruginosa PA01
ccagcguucggcgcuggcgc

SEQ ID NO: 1505925 - RNA, 13 nt, Pseudomonas aeruginosa PA01
ccaggcgcuccag

SEQ ID NO: 1505926 - RNA, 14 nt, Pseudomonas aeruginosa PA01
ccaggcgcuccucc

SEQ ID NO: 1505927 - RNA, 19 nt, Pseudomonas aeruginosa PA01
ccaggcgcgucuccagcuc

SEQ ID NO: 1505928 - RNA, 21 nt, Pseudomonas aeruginosa PA01
ccaggcgcgucuccagcucgg

SEQ ID NO: 1505929 - RNA, 19 nt, Pseudomonas aeruginosa PA01
ccaggcgcucucgccgccu

SEQ ID NO: 1505930 - RNA, 20 nt, Pseudomonas aeruginosa PA01
ccaggcgcucucgccgccuu

SEQ ID NO: 1505931 - RNA, 23 nt, Pseudomonas aeruginosa PA01
ccaggcgcugcucgauggccuug

SEQ ID NO: 1505932 - RNA, 14 nt, Pseudomonas aeruginosa PA01
ccaggcgcuggcgc

SEQ ID NO: 1505933 - RNA, 15 nt, Pseudomonas aeruginosa PA01
ccaggcgcuggcgcc

SEQ ID NO: 1505934 - RNA, 19 nt, Pseudomonas aeruginosa PA01
ccaggcgcuggcgccgaug

SEQ ID NO: 1505935 - RNA, 20 nt, Pseudomonas aeruginosa PA01
ccaggcgcugguccagcacg

SEQ ID NO: 1505936 - RNA, 21 nt, Pseudomonas aeruginosa PA01
ccaggcgcugguccagcacgc

SEQ ID NO: 1505937 - RNA, 16 nt, Pseudomonas aeruginosa PA01
ccaggcgcuuguccga

SEQ ID NO: 1505938 - RNA, 23 nt, Pseudomonas aeruginosa PA01
ccaggcggaacggcucgcgaccg

SEQ ID NO: 1505939 - RNA, 22 nt, Pseudomonas aeruginosa PA01
ccaggcgcgggucuucaggccg

SEQ ID NO: 1505940 - RNA, 15 nt, Pseudomonas aeruginosa PA01
ccaggcgcucggcga

SEQ ID NO: 1505941 - RNA, 16 nt, Pseudomonas aeruginosa PA01
ccaggcgcucggcggc

SEQ ID NO: 1505942 - RNA, 18 nt, Pseudomonas aeruginosa PA01
ccaggcgcucggcggcgc

SEQ ID NO: 1505943 - RNA, 16 nt, Pseudomonas aeruginosa PA01
ccaggcgcgccgugcg

SEQ ID NO: 1505944 - RNA, 17 nt, Pseudomonas aeruginosa PA01
ccaggcgccgcucgaug

SEQ ID NO: 1505945 - RNA, 19 nt, Pseudomonas aeruginosa PA01
ccaggcgaaagucggcgcg

SEQ ID NO: 1505946 - RNA, 20 nt, Pseudomonas aeruginosa PA01
ccaggcgaaagucggcgcga

SEQ ID NO: 1505947 - RNA, 20 nt, Pseudomonas aeruginosa PA01
ccaggcgaagcggcuggccg

SEQ ID NO: 1505948 - RNA, 20 nt, Pseudomonas aeruginosa PA01
ccaggcgaauggagggaucg

SEQ ID NO: 1505949 - RNA, 22 nt, Pseudomonas aeruginosa PA01
ccaggcgacgaaacggcucugc

SEQ ID NO: 1505950 - RNA, 16 nt, Pseudomonas aeruginosa PA01
ccaggcgccgggucga

SEQ ID NO: 1505951 - RNA, 13 nt, Pseudomonas aeruginosa PA01
ccagggcagcagg

SEQ ID NO: 1505952 - RNA, 21 nt, Pseudomonas aeruginosa PA01
ccagggcagcaggucgcgcag

SEQ ID NO: 1505953 - RNA, 15 nt, Pseudomonas aeruginosa PA01
ccagggcaacgccag

SEQ ID NO: 1505954 - RNA, 16 nt, Pseudomonas aeruginosa PA01
ccagggcaacgccagg

SEQ ID NO: 1505955 - RNA, 17 nt, Pseudomonas aeruginosa PA01
ccagggcaacgccaggc

SEQ ID NO: 1505956 - RNA, 19 nt, Pseudomonas aeruginosa PA01
ccagggcaacgccaggcug

SEQ ID NO: 1505957 - RNA, 18 nt, Pseudomonas aeruginosa PA01
ccaggcugccggccaggu

SEQ ID NO: 1505958 - RNA, 14 nt, Pseudomonas aeruginosa PA01
ccaggcugccgccg

SEQ ID NO: 1505959 - RNA, 15 nt, Pseudomonas aeruginosa PA01
ccaggcugccgccgc

SEQ ID NO: 1505960 - RNA, 18 nt, Pseudomonas aeruginosa PA01
ccaggcugaguucgucga

SEQ ID NO: 1505961 - RNA, 19 nt, Pseudomonas aeruginosa PA01
ccaggcugaguucgucgag

SEQ ID NO: 1505962 - RNA, 20 nt, Pseudomonas aeruginosa PA01
ccaggcugacccggucgcug

SEQ ID NO: 1505963 - RNA, 15 nt, Pseudomonas aeruginosa PA01
ccaggcugaccgcgu

SEQ ID NO: 1505964 - RNA, 14 nt, Pseudomonas aeruginosa PA01
ccaggcucgccccg

SEQ ID NO: 1505965 - RNA, 20 nt, Pseudomonas aeruginosa PA01
ccaggcucgccccggcggcg

SEQ ID NO: 1505966 - RNA, 21 nt, Pseudomonas aeruginosa PA01
ccaggcucgccccggcggcga

SEQ ID NO: 1505967 - RNA, 15 nt, Pseudomonas aeruginosa PA01
ccaggcucaccucga

SEQ ID NO: 1505968 - RNA, 16 nt, Pseudomonas aeruginosa PA01
ccaggcucaccucgaa

SEQ ID NO: 1505969 - RNA, 20 nt, Pseudomonas aeruginosa PA01
ccaggcucgccgccagcagg

SEQ ID NO: 1505970 - RNA, 14 nt, Pseudomonas aeruginosa PA01
ccaggcucgcgaug

SEQ ID NO: 1505971 - RNA, 20 nt, Pseudomonas aeruginosa PA01
ccaggcucgcgaugcugugc

SEQ ID NO: 1505972 - RNA, 17 nt, Pseudomonas aeruginosa PA01
ccaggcucuucagcacg

SEQ ID NO: 1505973 - RNA, 19 nt, Pseudomonas aeruginosa PA01
ccaggcucuucagcacgcg

SEQ ID NO: 1505974 - RNA, 17 nt, Pseudomonas aeruginosa PA01
ccaggcucagcucuccc

SEQ ID NO: 1505975 - RNA, 14 nt, Pseudomonas aeruginosa PA01
ccaggccgggucgc

SEQ ID NO: 1505976 - RNA, 18 nt, Pseudomonas aeruginosa PA01
ccaggccgggucgcagcc

SEQ ID NO: 1505977 - RNA, 13 nt, Pseudomonas aeruginosa PA01
ccaggccggcgcc

SEQ ID NO: 1505978 - RNA, 15 nt, Pseudomonas aeruginosa PA01
ccaggccgcugccgc

SEQ ID NO: 1505979 - RNA, 17 nt, Pseudomonas aeruginosa PA01
ccaggccgcugccgccg

SEQ ID NO: 1505980 - RNA, 19 nt, Pseudomonas aeruginosa PA01
ccaggccgcugccgccgcg

SEQ ID NO: 1505981 - RNA, 18 nt, Pseudomonas aeruginosa PA01
ccaggccgcuggcggcga

SEQ ID NO: 1505982 - RNA, 12 nt, Pseudomonas aeruginosa PA01
ccaggccggcgc

SEQ ID NO: 1505983 - RNA, 16 nt, Pseudomonas aeruginosa PA01
ccaggccggcgcaucg

SEQ ID NO: 1505984 - RNA, 22 nt, Pseudomonas aeruginosa PA01
ccaggccguagaccaccagcag

SEQ ID NO: 1505985 - RNA, 23 nt, Pseudomonas aeruginosa PA01
ccaggccguagaccaccagcagc

SEQ ID NO: 1505986 - RNA, 14 nt, Pseudomonas aeruginosa PA01
ccaggccuuccaga

SEQ ID NO: 1505987 - RNA, 13 nt, Pseudomonas aeruginosa PA01
ccaggccucccag

SEQ ID NO: 1505988 - RNA, 17 nt, Pseudomonas aeruginosa PA01
ccaggccguagcugcgc

SEQ ID NO: 1505989 - RNA, 18 nt, Pseudomonas aeruginosa PA01
ccaggccguagcugcgcg

SEQ ID NO: 1505990 - RNA, 17 nt, Pseudomonas aeruginosa PA01
ccaggccgucgagggca

SEQ ID NO: 1505991 - RNA, 16 nt, Pseudomonas aeruginosa PA01
ccaggcauuccuccag

SEQ ID NO: 1505992 - RNA, 23 nt, Pseudomonas aeruginosa PA01
ccaggcauuccuccagggucgcc

SEQ ID NO: 1505993 - RNA, 14 nt, Pseudomonas aeruginosa PA01
ccaggccgccgauc

SEQ ID NO: 1505994 - RNA, 13 nt, Pseudomonas aeruginosa PA01
ccaggccgccgcc

SEQ ID NO: 1505995 - RNA, 13 nt, Pseudomonas aeruginosa PA01
ccaggccgcccag

SEQ ID NO: 1505996 - RNA, 19 nt, Pseudomonas aeruginosa PA01
ccaggccgcaggugaagcu

SEQ ID NO: 1505997 - RNA, 12 nt, Pseudomonas aeruginosa PA01
ccaggccgccgg

SEQ ID NO: 1505998 - RNA, 16 nt, Pseudomonas aeruginosa PA01
ccaggccgccggcgac

SEQ ID NO: 1505999 - RNA, 14 nt, Pseudomonas aeruginosa PA01
ccaggccgcgcagc

SEQ ID NO: 1506000 - RNA, 16 nt, Pseudomonas aeruginosa PA01
ccaggccgcgcagcaa

SEQ ID NO: 1506001 - RNA, 18 nt, Pseudomonas aeruginosa PA01
ccaggccgcgcagcaacg

SEQ ID NO: 1506002 - RNA, 15 nt, Pseudomonas aeruginosa PA01
ccaggccgcgcaguc

SEQ ID NO: 1506003 - RNA, 16 nt, Pseudomonas aeruginosa PA01
ccaggccgcgcagucc

SEQ ID NO: 1506004 - RNA, 21 nt, Pseudomonas aeruginosa PA01
ccaggcagaccugcagcagga

SEQ ID NO: 1506005 - RNA, 18 nt, Pseudomonas aeruginosa PA01
ccaggcagaucgcgccga

SEQ ID NO: 1506006 - RNA, 20 nt, Pseudomonas aeruginosa PA01
ccaggcagaucgcgccgagc

SEQ ID NO: 1506007 - RNA, 13 nt, Pseudomonas aeruginosa PA01
ccaggcagcagag

SEQ ID NO: 1506008 - RNA, 19 nt, Pseudomonas aeruginosa PA01
ccaggcagcagagcgccac

SEQ ID NO: 1506009 - RNA, 12 nt, Pseudomonas aeruginosa PA01
ccaggcaggccg

SEQ ID NO: 1506010 - RNA, 18 nt, Pseudomonas aeruginosa PA01
ccaggcaggccgggcugg

SEQ ID NO: 1506011 - RNA, 17 nt, Pseudomonas aeruginosa PA01
ccaggcagaccagcgca

SEQ ID NO: 1506012 - RNA, 18 nt, Pseudomonas aeruginosa PA01
ccaggcagaccagcgcaa

SEQ ID NO: 1506013 - RNA, 23 nt, Pseudomonas aeruginosa PA01
ccaggcacggcuucagcgccagg

SEQ ID NO: 1506014 - RNA, 12 nt, Pseudomonas aeruginosa PA01
ccaggcauccag

SEQ ID NO: 1506015 - RNA, 15 nt, Pseudomonas aeruginosa PA01
ccaggcauccagcac

SEQ ID NO: 1506016 - RNA, 21 nt, Pseudomonas aeruginosa PA01
ccaggcaggcggucagcgcgu

SEQ ID NO: 1506017 - RNA, 22 nt, Pseudomonas aeruginosa PA01
ccaggucgcgacugaccacgca

SEQ ID NO: 1506018 - RNA, 16 nt, Pseudomonas aeruginosa PA01
ccaggucgcccaccuu

SEQ ID NO: 1506019 - RNA, 18 nt, Pseudomonas aeruginosa PA01
ccaggucgcccugcagcg

SEQ ID NO: 1506020 - RNA, 16 nt, Pseudomonas aeruginosa PA01
ccaggucgcgcagggc

SEQ ID NO: 1506021 - RNA, 14 nt, Pseudomonas aeruginosa PA01
ccaggucgcgcuug

SEQ ID NO: 1506022 - RNA, 23 nt, Pseudomonas aeruginosa PA01
ccaggucgccguagaacagcacg

SEQ ID NO: 1506023 - RNA, 12 nt, Pseudomonas aeruginosa PA01
ccaggucgcugc

SEQ ID NO: 1506024 - RNA, 12 nt, Pseudomonas aeruginosa PA01
ccaggucgcugg

SEQ ID NO: 1506025 - RNA, 14 nt, Pseudomonas aeruginosa PA01
ccaggucgcuggca

SEQ ID NO: 1506026 - RNA, 12 nt, Pseudomonas aeruginosa PA01
ccaggucgcugu

SEQ ID NO: 1506027 - RNA, 19 nt, Pseudomonas aeruginosa PA01
ccaggucgcuguccuccag

SEQ ID NO: 1506028 - RNA, 23 nt, Pseudomonas aeruginosa PA01
ccaggucgcuguccuccagcggc

SEQ ID NO: 1506029 - RNA, 22 nt, Pseudomonas aeruginosa PA01
ccaggucggcgggcaccgccag

SEQ ID NO: 1506030 - RNA, 23 nt, Pseudomonas aeruginosa PA01
ccaggucggcgggcaccgccagc

SEQ ID NO: 1506031 - RNA, 12 nt, Pseudomonas aeruginosa PA01
ccaggucggcgc

SEQ ID NO: 1506032 - RNA, 13 nt, Pseudomonas aeruginosa PA01
ccaggucggcgcg

SEQ ID NO: 1506033 - RNA, 14 nt, Pseudomonas aeruginosa PA01
ccaggucggcgcgc

SEQ ID NO: 1506034 - RNA, 16 nt, Pseudomonas aeruginosa PA01
ccaggucggucggcgg

SEQ ID NO: 1506035 - RNA, 18 nt, Pseudomonas aeruginosa PA01
ccaggucggucggcggcg

SEQ ID NO: 1506036 - RNA, 15 nt, Pseudomonas aeruginosa PA01
ccagguggcaggccu

SEQ ID NO: 1506037 - RNA, 16 nt, Pseudomonas aeruginosa PA01
ccagguggcaggccug

SEQ ID NO: 1506038 - RNA, 17 nt, Pseudomonas aeruginosa PA01
ccagguggcaggccugg

SEQ ID NO: 1506039 - RNA, 16 nt, Pseudomonas aeruginosa PA01
ccagguguacaucggg

SEQ ID NO: 1506040 - RNA, 17 nt, Pseudomonas aeruginosa PA01
ccagguucuggucgccg

SEQ ID NO: 1506041 - RNA, 20 nt, Pseudomonas aeruginosa PA01
ccagguucgcguggcccggc

SEQ ID NO: 1506042 - RNA, 22 nt, Pseudomonas aeruginosa PA01
ccagguucgcguggcccggcgc

SEQ ID NO: 1506043 - RNA, 14 nt, Pseudomonas aeruginosa PA01
ccagguucggcgcc

SEQ ID NO: 1506044 - RNA, 18 nt, Pseudomonas aeruginosa PA01
ccagguggucgaccaggc

SEQ ID NO: 1506045 - RNA, 18 nt, Pseudomonas aeruginosa PA01
ccagguggucguagcagg

SEQ ID NO: 1506046 - RNA, 19 nt, Pseudomonas aeruginosa PA01
ccagguguucggccccggc

SEQ ID NO: 1506047 - RNA, 21 nt, Pseudomonas aeruginosa PA01
ccagguguucggccccggcca

SEQ ID NO: 1506048 - RNA, 22 nt, Pseudomonas aeruginosa PA01
ccagguguucggccccggccag

SEQ ID NO: 1506049 - RNA, 16 nt, Pseudomonas aeruginosa PA01
ccagguguucguccag

SEQ ID NO: 1506050 - RNA, 18 nt, Pseudomonas aeruginosa PA01
ccaguaauggggaucgcg

SEQ ID NO: 1506051 - RNA, 14 nt, Pseudomonas aeruginosa PA01
ccaguaccgccacg

SEQ ID NO: 1506052 - RNA, 17 nt, Pseudomonas aeruginosa PA01
ccagggcuucccaggcc

SEQ ID NO: 1506053 - RNA, 19 nt, Pseudomonas aeruginosa PA01
ccagggcuucccaggccag

SEQ ID NO: 1506054 - RNA, 14 nt, Pseudomonas aeruginosa PA01
ccagguaagcggcg

SEQ ID NO: 1506055 - RNA, 12 nt, Pseudomonas aeruginosa PA01
ccagguaccggc

SEQ ID NO: 1506056 - RNA, 16 nt, Pseudomonas aeruginosa PA01
ccagguaccggccagg

SEQ ID NO: 1506057 - RNA, 18 nt, Pseudomonas aeruginosa PA01
ccagguacuuggccacgc

SEQ ID NO: 1506058 - RNA, 16 nt, Pseudomonas aeruginosa PA01
ccagguagagaagcgu

SEQ ID NO: 1506059 - RNA, 23 nt, Pseudomonas aeruginosa PA01
ccagguagagaagcguucgccga

SEQ ID NO: 1506060 - RNA, 20 nt, Pseudomonas aeruginosa PA01
ccagguagagcagcccgggc

SEQ ID NO: 1506061 - RNA, 20 nt, Pseudomonas aeruginosa PA01
ccagggcgguuaccaggucu

SEQ ID NO: 1506062 - RNA, 14 nt, Pseudomonas aeruginosa PA01
ccagggcggcgccg

SEQ ID NO: 1506063 - RNA, 15 nt, Pseudomonas aeruginosa PA01
ccagggcggcgccga

SEQ ID NO: 1506064 - RNA, 13 nt, Pseudomonas aeruginosa PA01
ccagggcgggccg

SEQ ID NO: 1506065 - RNA, 20 nt, Pseudomonas aeruginosa PA01
ccagggcgggccgcucgcgc

SEQ ID NO: 1506066 - RNA, 21 nt, Pseudomonas aeruginosa PA01
ccagggcgggccgcucgcgcg

SEQ ID NO: 1506067 - RNA, 16 nt, Pseudomonas aeruginosa PA01
ccagguagugccgccc

SEQ ID NO: 1506068 - RNA, 16 nt, Pseudomonas aeruginosa PA01
ccagguauucgcgcuc

SEQ ID NO: 1506069 - RNA, 15 nt, Pseudomonas aeruginosa PA01
ccagguagcccaccu

SEQ ID NO: 1506070 - RNA, 13 nt, Pseudomonas aeruginosa PA01
ccagguagccugg

SEQ ID NO: 1506071 - RNA, 23 nt, Pseudomonas aeruginosa PA01
ccagguagccuggauacgggcgc

SEQ ID NO: 1506072 - RNA, 17 nt, Pseudomonas aeruginosa PA01
ccagguagcgcugcgcc

SEQ ID NO: 1506073 - RNA, 21 nt, Pseudomonas aeruginosa PA01
ccagguagcgcugcgccaggc

SEQ ID NO: 1506074 - RNA, 21 nt, Pseudomonas aeruginosa PA01
ccagguaggcgaaggcgaugu

SEQ ID NO: 1506075 - RNA, 13 nt, Pseudomonas aeruginosa PA01
ccagguaggcgac

SEQ ID NO: 1506076 - RNA, 18 nt, Pseudomonas aeruginosa PA01
ccagguaggcgacgaagc

SEQ ID NO: 1506077 - RNA, 18 nt, Pseudomonas aeruginosa PA01
ccagguaguccagcuccu

SEQ ID NO: 1506078 - RNA, 19 nt, Pseudomonas aeruginosa PA01
ccagguagucgcccagcgc

SEQ ID NO: 1506079 - RNA, 21 nt, Pseudomonas aeruginosa PA01
ccagggcaguacguggcgcuu

SEQ ID NO: 1506080 - RNA, 23 nt, Pseudomonas aeruginosa PA01
ccagggcaugucgaucuucgagu

SEQ ID NO: 1506081 - RNA, 22 nt, Pseudomonas aeruginosa PA01
ccagggcagggaguccgccagc

SEQ ID NO: 1506082 - RNA, 18 nt, Pseudomonas aeruginosa PA01
ccagggccgcucgagggc

SEQ ID NO: 1506083 - RNA, 12 nt, Pseudomonas aeruginosa PA01
ccagggccggcg

SEQ ID NO: 1506084 - RNA, 13 nt, Pseudomonas aeruginosa PA01
ccagggccggcgc

SEQ ID NO: 1506085 - RNA, 15 nt, Pseudomonas aeruginosa PA01
ccagggccggcgccc

SEQ ID NO: 1506086 - RNA, 15 nt, Pseudomonas aeruginosa PA01
ccagggcccagagca

SEQ ID NO: 1506087 - RNA, 23 nt, Pseudomonas aeruginosa PA01
ccagggcccagagcagcaccagc

SEQ ID NO: 1506088 - RNA, 13 nt, Pseudomonas aeruginosa PA01
ccagggccagcag

SEQ ID NO: 1506089 - RNA, 15 nt, Pseudomonas aeruginosa PA01
ccagggccagcagcg

SEQ ID NO: 1506090 - RNA, 18 nt, Pseudomonas aeruginosa PA01
ccagggccagcagcggcg

SEQ ID NO: 1506091 - RNA, 13 nt, Pseudomonas aeruginosa PA01
ccagggccagcgg

SEQ ID NO: 1506092 - RNA, 18 nt, Pseudomonas aeruginosa PA01
ccagggccaggagcaucg

SEQ ID NO: 1506093 - RNA, 15 nt, Pseudomonas aeruginosa PA01
ccagggccuggcgca

SEQ ID NO: 1506094 - RNA, 16 nt, Pseudomonas aeruginosa PA01
ccagggcgaggaucac

SEQ ID NO: 1506095 - RNA, 13 nt, Pseudomonas aeruginosa PA01
ccagggcgaggcc

SEQ ID NO: 1506096 - RNA, 14 nt, Pseudomonas aeruginosa PA01
ccagggcgauggcg

SEQ ID NO: 1506097 - RNA, 18 nt, Pseudomonas aeruginosa PA01
ccagggccgagcacaggg

SEQ ID NO: 1506098 - RNA, 20 nt, Pseudomonas aeruginosa PA01
ccagggccucggggccgucc

SEQ ID NO: 1506099 - RNA, 21 nt, Pseudomonas aeruginosa PA01
ccagggccucggggccguccg

SEQ ID NO: 1506100 - RNA, 22 nt, Pseudomonas aeruginosa PA01
ccagggcgaacagcgccgcggc

SEQ ID NO: 1506101 - RNA, 15 nt, Pseudomonas aeruginosa PA01
ccagggcgcugccga

SEQ ID NO: 1506102 - RNA, 13 nt, Pseudomonas aeruginosa PA01
cccggaaccaccg

SEQ ID NO: 1506103 - RNA, 16 nt, Pseudomonas aeruginosa PA01
cccgcucgaggguguc

SEQ ID NO: 1506104 - RNA, 23 nt, Pseudomonas aeruginosa PA01
cccgcucgccgggaaucgccagc

SEQ ID NO: 1506105 - RNA, 22 nt, Pseudomonas aeruginosa PA01
cccgcucggccuuguccggcac

SEQ ID NO: 1506106 - RNA, 21 nt, Pseudomonas aeruginosa PA01
cccgcugaaggacugugccug

SEQ ID NO: 1506107 - RNA, 15 nt, Pseudomonas aeruginosa PA01
cccggaucagcucgc

SEQ ID NO: 1506108 - RNA, 16 nt, Pseudomonas aeruginosa PA01
cccggaucagcucgcg

SEQ ID NO: 1506109 - RNA, 19 nt, Pseudomonas aeruginosa PA01
cccggaucagcucgcguag

SEQ ID NO: 1506110 - RNA, 14 nt, Pseudomonas aeruginosa PA01
cccggaccagggcg

SEQ ID NO: 1506111 - RNA, 20 nt, Pseudomonas aeruginosa PA01
cccggaccagggcgccgggc

SEQ ID NO: 1506112 - RNA, 19 nt, Pseudomonas aeruginosa PA01
cccgcggaccgggcggcgc

SEQ ID NO: 1506113 - RNA, 18 nt, Pseudomonas aeruginosa PA01
cccgcggcaucggccugg

SEQ ID NO: 1506114 - RNA, 14 nt, Pseudomonas aeruginosa PA01
cccgcggcggcgac

SEQ ID NO: 1506115 - RNA, 16 nt, Pseudomonas aeruginosa PA01
cccgcggucacucggc

SEQ ID NO: 1506116 - RNA, 17 nt, Pseudomonas aeruginosa PA01
cccgcgguacccggcag

SEQ ID NO: 1506117 - RNA, 12 nt, Pseudomonas aeruginosa PA01
cccgcggccgag

SEQ ID NO: 1506118 - RNA, 14 nt, Pseudomonas aeruginosa PA01
cccgcgacaacggc

SEQ ID NO: 1506119 - RNA, 16 nt, Pseudomonas aeruginosa PA01
cccgcgacucguaggg

SEQ ID NO: 1506120 - RNA, 14 nt, Pseudomonas aeruginosa PA01
cccgcgagcagccg

SEQ ID NO: 1506121 - RNA, 15 nt, Pseudomonas aeruginosa PA01
cccgcgagcagccga

SEQ ID NO: 1506122 - RNA, 17 nt, Pseudomonas aeruginosa PA01
cccgcgagccgcgcagc

SEQ ID NO: 1506123 - RNA, 19 nt, Pseudomonas aeruginosa PA01
cccgcgaggccggccccac

SEQ ID NO: 1506124 - RNA, 13 nt, Pseudomonas aeruginosa PA01
cccgcgcucggcc

SEQ ID NO: 1506125 - RNA, 12 nt, Pseudomonas aeruginosa PA01
cccgcgcucggc

SEQ ID NO: 1506126 - RNA, 13 nt, Pseudomonas aeruginosa PA01
cccgcgccagcgc

SEQ ID NO: 1506127 - RNA, 14 nt, Pseudomonas aeruginosa PA01
cccgcgcgcugugc

SEQ ID NO: 1506128 - RNA, 22 nt, Pseudomonas aeruginosa PA01
cccgccaagggcgccgccgagg

SEQ ID NO: 1506129 - RNA, 16 nt, Pseudomonas aeruginosa PA01
cccgccacagaucgcc

SEQ ID NO: 1506130 - RNA, 21 nt, Pseudomonas aeruginosa PA01
cccgccaccgacccucggcga

SEQ ID NO: 1506131 - RNA, 23 nt, Pseudomonas aeruginosa PA01
cccgccaccgacccucggcgagg

SEQ ID NO: 1506132 - RNA, 14 nt, Pseudomonas aeruginosa PA01
cccgccaccuggcg

SEQ ID NO: 1506133 - RNA, 14 nt, Pseudomonas aeruginosa PA01
cccgccccuuuccg

SEQ ID NO: 1506134 - RNA, 14 nt, Pseudomonas aeruginosa PA01
cccgccccgcacca

SEQ ID NO: 1506135 - RNA, 14 nt, Pseudomonas aeruginosa PA01
cccgcccaguucgu

SEQ ID NO: 1506136 - RNA, 18 nt, Pseudomonas aeruginosa PA01
cccgccggcgcgcccagg

SEQ ID NO: 1506137 - RNA, 16 nt, Pseudomonas aeruginosa PA01
cccgccggcgugccga

SEQ ID NO: 1506138 - RNA, 13 nt, Pseudomonas aeruginosa PA01
cccgccggccaug

SEQ ID NO: 1506139 - RNA, 15 nt, Pseudomonas aeruginosa PA01
cccgccggccaugcc

SEQ ID NO: 1506140 - RNA, 12 nt, Pseudomonas aeruginosa PA01
cccgccgcuggc

SEQ ID NO: 1506141 - RNA, 14 nt, Pseudomonas aeruginosa PA01
cccgccgcggcgag

SEQ ID NO: 1506142 - RNA, 18 nt, Pseudomonas aeruginosa PA01
cccgcccuuggcggcgcc

SEQ ID NO: 1506143 - RNA, 14 nt, Pseudomonas aeruginosa PA01
cccgccgcgcauca

SEQ ID NO: 1506144 - RNA, 13 nt, Pseudomonas aeruginosa PA01
cccgccgcggcga

SEQ ID NO: 1506145 - RNA, 13 nt, Pseudomonas aeruginosa PA01
cccgaggcgacgc

SEQ ID NO: 1506146 - RNA, 19 nt, Pseudomonas aeruginosa PA01
cccgcaccacccgcugcaa

SEQ ID NO: 1506147 - RNA, 13 nt, Pseudomonas aeruginosa PA01
cccgcaccagcca

SEQ ID NO: 1506148 - RNA, 15 nt, Pseudomonas aeruginosa PA01
cccgcaccagccagc

SEQ ID NO: 1506149 - RNA, 16 nt, Pseudomonas aeruginosa PA01
cccgcaccagccggcg

SEQ ID NO: 1506150 - RNA, 16 nt, Pseudomonas aeruginosa PA01
cccgaugccgcgccgg

SEQ ID NO: 1506151 - RNA, 18 nt, Pseudomonas aeruginosa PA01
cccgcaccggcgcgccgg

SEQ ID NO: 1506152 - RNA, 13 nt, Pseudomonas aeruginosa PA01
cccgcaccugccg

SEQ ID NO: 1506153 - RNA, 23 nt, Pseudomonas aeruginosa PA01
cccgcaugaacgccucgccaacc

SEQ ID NO: 1506154 - RNA, 21 nt, Pseudomonas aeruginosa PA01
cccgcacuuuaccccgauugc

SEQ ID NO: 1506155 - RNA, 12 nt, Pseudomonas aeruginosa PA01
cccgcaucgcgg

SEQ ID NO: 1506156 - RNA, 18 nt, Pseudomonas aeruginosa PA01
cccgacaggcagcgccgc

SEQ ID NO: 1506157 - RNA, 18 nt, Pseudomonas aeruginosa PA01
cccgagaaaacccuggga

SEQ ID NO: 1506158 - RNA, 22 nt, Pseudomonas aeruginosa PA01
cccgagaaaacccugggaaugg

SEQ ID NO: 1506159 - RNA, 16 nt, Pseudomonas aeruginosa PA01
cccgagcaacugcucg

SEQ ID NO: 1506160 - RNA, 18 nt, Pseudomonas aeruginosa PA01
cccgagcaacugcucggg

SEQ ID NO: 1506161 - RNA, 18 nt, Pseudomonas aeruginosa PA01
cccgaccccacgccggcc

SEQ ID NO: 1506162 - RNA, 23 nt, Pseudomonas aeruginosa PA01
cccgaccccacgccggccggcuc

SEQ ID NO: 1506163 - RNA, 18 nt, Pseudomonas aeruginosa PA01
cccgaccaggucgcuggc

SEQ ID NO: 1506164 - RNA, 19 nt, Pseudomonas aeruginosa PA01
cccgaccaggucgcuggca

SEQ ID NO: 1506165 - RNA, 13 nt, Pseudomonas aeruginosa PA01
cccgaccagcgcg

SEQ ID NO: 1506166 - RNA, 19 nt, Pseudomonas aeruginosa PA01
cccgaccagcgcgcucuuc

SEQ ID NO: 1506167 - RNA, 12 nt, Pseudomonas aeruginosa PA01
cccgagcaccgg

SEQ ID NO: 1506168 - RNA, 21 nt, Pseudomonas aeruginosa PA01
cccgagcaccggccucaagca

SEQ ID NO: 1506169 - RNA, 16 nt, Pseudomonas aeruginosa PA01
cccgagcgggccgagg

SEQ ID NO: 1506170 - RNA, 13 nt, Pseudomonas aeruginosa PA01
cccgagcggcgcg

SEQ ID NO: 1506171 - RNA, 15 nt, Pseudomonas aeruginosa PA01
cccgagugcgcccag

SEQ ID NO: 1506172 - RNA, 17 nt, Pseudomonas aeruginosa PA01
cccgagugcgcccagca

SEQ ID NO: 1506173 - RNA, 20 nt, Pseudomonas aeruginosa PA01
cccgagugcgcccagcagca

SEQ ID NO: 1506174 - RNA, 21 nt, Pseudomonas aeruginosa PA01
cccgagucccuugcggcagac

SEQ ID NO: 1506175 - RNA, 22 nt, Pseudomonas aeruginosa PA01
cccgagucccuugcggcagacg

SEQ ID NO: 1506176 - RNA, 14 nt, Pseudomonas aeruginosa PA01
cccgaggugucgcc

SEQ ID NO: 1506177 - RNA, 16 nt, Pseudomonas aeruginosa PA01
cccgaguaggcgcugc

SEQ ID NO: 1506178 - RNA, 13 nt, Pseudomonas aeruginosa PA01
cccgagggcggca

SEQ ID NO: 1506179 - RNA, 19 nt, Pseudomonas aeruginosa PA01
cccgaaaaaaaaggccgca

SEQ ID NO: 1506180 - RNA, 22 nt, Pseudomonas aeruginosa PA01
cccgaaaccggcgaugcucagc

SEQ ID NO: 1506181 - RNA, 23 nt, Pseudomonas aeruginosa PA01
ccccuguuucgaugagcuucgcc

SEQ ID NO: 1506182 - RNA, 19 nt, Pseudomonas aeruginosa PA01
ccccuggaaugccggccgg

SEQ ID NO: 1506183 - RNA, 13 nt, Pseudomonas aeruginosa PA01
ccccuucggucgc

SEQ ID NO: 1506184 - RNA, 18 nt, Pseudomonas aeruginosa PA01
ccccuucggucgcgcccc

SEQ ID NO: 1506185 - RNA, 22 nt, Pseudomonas aeruginosa PA01
ccccuggccguugaccagcgcg

SEQ ID NO: 1506186 - RNA, 13 nt, Pseudomonas aeruginosa PA01
ccccuggcgcucg

SEQ ID NO: 1506187 - RNA, 13 nt, Pseudomonas aeruginosa PA01
ccccuggcgcugg

SEQ ID NO: 1506188 - RNA, 17 nt, Pseudomonas aeruginosa PA01
ccccuggcgcugggccu

SEQ ID NO: 1506189 - RNA, 16 nt, Pseudomonas aeruginosa PA01
ccccugcaugccggcc

SEQ ID NO: 1506190 - RNA, 13 nt, Pseudomonas aeruginosa PA01
ccccugcgcggac

SEQ ID NO: 1506191 - RNA, 14 nt, Pseudomonas aeruginosa PA01
ccccugcggcccga

SEQ ID NO: 1506192 - RNA, 13 nt, Pseudomonas aeruginosa PA01
ccccugcggcgcc

SEQ ID NO: 1506193 - RNA, 13 nt, Pseudomonas aeruginosa PA01
ccccguggcgacg

SEQ ID NO: 1506194 - RNA, 15 nt, Pseudomonas aeruginosa PA01
ccccguggcgccgca

SEQ ID NO: 1506195 - RNA, 19 nt, Pseudomonas aeruginosa PA01
ccccguggcgccgcagggc

SEQ ID NO: 1506196 - RNA, 18 nt, Pseudomonas aeruginosa PA01
ccccguggcgggccagca

SEQ ID NO: 1506197 - RNA, 18 nt, Pseudomonas aeruginosa PA01
ccccguauccuccgcgac

SEQ ID NO: 1506198 - RNA, 13 nt, Pseudomonas aeruginosa PA01
ccccguagcgcuc

SEQ ID NO: 1506199 - RNA, 14 nt, Pseudomonas aeruginosa PA01
ccccguagcgcucg

SEQ ID NO: 1506200 - RNA, 17 nt, Pseudomonas aeruginosa PA01
ccccgggucgcgcagcg

SEQ ID NO: 1506201 - RNA, 12 nt, Pseudomonas aeruginosa PA01
ccccggucaggc

SEQ ID NO: 1506202 - RNA, 16 nt, Pseudomonas aeruginosa PA01
ccccggucaggccgau

SEQ ID NO: 1506203 - RNA, 18 nt, Pseudomonas aeruginosa PA01
ccccgguuacucgccggc

SEQ ID NO: 1506204 - RNA, 20 nt, Pseudomonas aeruginosa PA01
cccccaauugcccguagggc

SEQ ID NO: 1506205 - RNA, 19 nt, Pseudomonas aeruginosa PA01
cccccaauugccguagggc

SEQ ID NO: 1506206 - RNA, 19 nt, Pseudomonas aeruginosa PA01
ccccauguaccucuggcug

SEQ ID NO: 1506207 - RNA, 21 nt, Pseudomonas aeruginosa PA01
ccccaggcaccguaggccagg

SEQ ID NO: 1506208 - RNA, 16 nt, Pseudomonas aeruginosa PA01
ccccauccgcaguacg

SEQ ID NO: 1506209 - RNA, 20 nt, Pseudomonas aeruginosa PA01
ccccaugaaaaaggcgcccg

SEQ ID NO: 1506210 - RNA, 14 nt, Pseudomonas aeruginosa PA01
ccccagcggcaggc

SEQ ID NO: 1506211 - RNA, 17 nt, Pseudomonas aeruginosa PA01
ccccagcucagcagguc

SEQ ID NO: 1506212 - RNA, 11 nt, Pseudomonas aeruginosa PA01
ccccagcgccu

SEQ ID NO: 1506213 - RNA, 21 nt, Pseudomonas aeruginosa PA01
ccccaauugcccguagggcga

SEQ ID NO: 1506214 - RNA, 22 nt, Pseudomonas aeruginosa PA01
ccccaauugcccguagggcgaa

SEQ ID NO: 1506215 - RNA, 16 nt, Pseudomonas aeruginosa PA01
ccccaauugccguagg

SEQ ID NO: 1506216 - RNA, 20 nt, Pseudomonas aeruginosa PA01
ccccaauugccguagggcga

SEQ ID NO: 1506217 - RNA, 21 nt, Pseudomonas aeruginosa PA01
ccccggcggguucagcccgcc

SEQ ID NO: 1506218 - RNA, 16 nt, Pseudomonas aeruginosa PA01
ccccggaccagggcgc

SEQ ID NO: 1506219 - RNA, 13 nt, Pseudomonas aeruginosa PA01
ccccggaccggcu

SEQ ID NO: 1506220 - RNA, 17 nt, Pseudomonas aeruginosa PA01
ccccgcuugccgucgac

SEQ ID NO: 1506221 - RNA, 23 nt, Pseudomonas aeruginosa PA01
ccccgcucccgcggcccaagggc

SEQ ID NO: 1506222 - RNA, 23 nt, Pseudomonas aeruginosa PA01
ccccgccacuuccagcacgccga

SEQ ID NO: 1506223 - RNA, 12 nt, Pseudomonas aeruginosa PA01
ccccgccgccag

SEQ ID NO: 1506224 - RNA, 20 nt, Pseudomonas aeruginosa PA01
ccccgcgguacccggcaggg

SEQ ID NO: 1506225 - RNA, 18 nt, Pseudomonas aeruginosa PA01
ccccgcaaggugcgggcc

SEQ ID NO: 1506226 - RNA, 19 nt, Pseudomonas aeruginosa PA01
ccccgcaaggugcgggccg

SEQ ID NO: 1506227 - RNA, 14 nt, Pseudomonas aeruginosa PA01
ccccgcaccugccg

SEQ ID NO: 1506228 - RNA, 19 nt, Pseudomonas aeruginosa PA01
ccccgcaaccgcugccgcc

SEQ ID NO: 1506229 - RNA, 12 nt, Pseudomonas aeruginosa PA01
cccccagcaccu

SEQ ID NO: 1506230 - RNA, 18 nt, Pseudomonas aeruginosa PA01
cccccagcaccuggacga

SEQ ID NO: 1506231 - RNA, 13 nt, Pseudomonas aeruginosa PA01
cccccagcgcgcc

SEQ ID NO: 1506232 - RNA, 16 nt, Pseudomonas aeruginosa PA01
cccccagcaggccagc

SEQ ID NO: 1506233 - RNA, 21 nt, Pseudomonas aeruginosa PA01
ccaguacuccgagggccgcgc

SEQ ID NO: 1506234 - RNA, 13 nt, Pseudomonas aeruginosa PA01
ccaguagcgccug

SEQ ID NO: 1506235 - RNA, 15 nt, Pseudomonas aeruginosa PA01
ccaguagcgccuggu

SEQ ID NO: 1506236 - RNA, 19 nt, Pseudomonas aeruginosa PA01
ccaguagcgcuucgcgcag

SEQ ID NO: 1506237 - RNA, 20 nt, Pseudomonas aeruginosa PA01
ccaguccggucagcagcagg

SEQ ID NO: 1506238 - RNA, 16 nt, Pseudomonas aeruginosa PA01
ccaguccggcagcacg

SEQ ID NO: 1506239 - RNA, 22 nt, Pseudomonas aeruginosa PA01
ccagucgagacgccagccgccc

SEQ ID NO: 1506240 - RNA, 18 nt, Pseudomonas aeruginosa PA01
ccaugcguugcggcauga

SEQ ID NO: 1506241 - RNA, 15 nt, Pseudomonas aeruginosa PA01
ccaugcucaggucga

SEQ ID NO: 1506242 - RNA, 17 nt, Pseudomonas aeruginosa PA01
ccaugcucggccagcuc

SEQ ID NO: 1506243 - RNA, 20 nt, Pseudomonas aeruginosa PA01
ccaugcucggccagcucgcc

SEQ ID NO: 1506244 - RNA, 23 nt, Pseudomonas aeruginosa PA01
ccaugcucggccagcucgccgaa

SEQ ID NO: 1506245 - RNA, 16 nt, Pseudomonas aeruginosa PA01
ccauguccaccacgcg

SEQ ID NO: 1506246 - RNA, 13 nt, Pseudomonas aeruginosa PA01
ccaugcggcaggc

SEQ ID NO: 1506247 - RNA, 19 nt, Pseudomonas aeruginosa PA01
ccaugcgggagagcgccgu

SEQ ID NO: 1506248 - RNA, 19 nt, Pseudomonas aeruginosa PA01
ccaugcggcuacucgcccg

SEQ ID NO: 1506249 - RNA, 20 nt, Pseudomonas aeruginosa PA01
ccaugcggcuacucgcccga

SEQ ID NO: 1506250 - RNA, 23 nt, Pseudomonas aeruginosa PA01
ccaugcgcggcaggaaauccgcc

SEQ ID NO: 1506251 - RNA, 22 nt, Pseudomonas aeruginosa PA01
ccauuccugggccccggccagg

SEQ ID NO: 1506252 - RNA, 18 nt, Pseudomonas aeruginosa PA01
ccauucgaugccgcgcgc

SEQ ID NO: 1506253 - RNA, 14 nt, Pseudomonas aeruginosa PA01
ccauugagcgcgcc

SEQ ID NO: 1506254 - RNA, 15 nt, Pseudomonas aeruginosa PA01
ccauugagcgcgccc

SEQ ID NO: 1506255 - RNA, 17 nt, Pseudomonas aeruginosa PA01
ccauugagcgcgcccag

SEQ ID NO: 1506256 - RNA, 16 nt, Pseudomonas aeruginosa PA01
ccauucaggcggauca

SEQ ID NO: 1506257 - RNA, 16 nt, Pseudomonas aeruginosa PA01
ccauucggcuuccugg

SEQ ID NO: 1506258 - RNA, 21 nt, Pseudomonas aeruginosa PA01
ccauucgcugucgagcaggga

SEQ ID NO: 1506259 - RNA, 20 nt, Pseudomonas aeruginosa PA01
ccauucgcugucgucggcgc

SEQ ID NO: 1506260 - RNA, 15 nt, Pseudomonas aeruginosa PA01
ccauucggccuggca

SEQ ID NO: 1506261 - RNA, 16 nt, Pseudomonas aeruginosa PA01
ccauugcguagggcgg

SEQ ID NO: 1506262 - RNA, 18 nt, Pseudomonas aeruginosa PA01
ccauugcccggccaggcg

SEQ ID NO: 1506263 - RNA, 22 nt, Pseudomonas aeruginosa PA01
ccauugcccgguggccuccugc

SEQ ID NO: 1506264 - RNA, 14 nt, Pseudomonas aeruginosa PA01
ccauugccgccagg

SEQ ID NO: 1506265 - RNA, 12 nt, Pseudomonas aeruginosa PA01
ccauuggccgac

SEQ ID NO: 1506266 - RNA, 12 nt, Pseudomonas aeruginosa PA01
cccagaccaccc

SEQ ID NO: 1506267 - RNA, 17 nt, Pseudomonas aeruginosa PA01
cccagaccagcagcggc

SEQ ID NO: 1506268 - RNA, 21 nt, Pseudomonas aeruginosa PA01
cccagaaguaguacugguccg

SEQ ID NO: 1506269 - RNA, 18 nt, Pseudomonas aeruginosa PA01
cccacguacuccagcaac

SEQ ID NO: 1506270 - RNA, 20 nt, Pseudomonas aeruginosa PA01
cccacguacuccagcaacgg

SEQ ID NO: 1506271 - RNA, 21 nt, Pseudomonas aeruginosa PA01
cccacgggcgacccaggccga

SEQ ID NO: 1506272 - RNA, 20 nt, Pseudomonas aeruginosa PA01
cccacgggcggccgacgugc

SEQ ID NO: 1506273 - RNA, 15 nt, Pseudomonas aeruginosa PA01
cccacggcgcggccg

SEQ ID NO: 1506274 - RNA, 18 nt, Pseudomonas aeruginosa PA01
cccacggcgcggccgugc

SEQ ID NO: 1506275 - RNA, 21 nt, Pseudomonas aeruginosa PA01
cccaccgggccaucgcggaaa

SEQ ID NO: 1506276 - RNA, 14 nt, Pseudomonas aeruginosa PA01
cccacccgucccgc

SEQ ID NO: 1506277 - RNA, 18 nt, Pseudomonas aeruginosa PA01
cccacccgucccgcgcgc

SEQ ID NO: 1506278 - RNA, 15 nt, Pseudomonas aeruginosa PA01
cccacccugcgcgag

SEQ ID NO: 1506279 - RNA, 14 nt, Pseudomonas aeruginosa PA01
cccaccgaccacca

SEQ ID NO: 1506280 - RNA, 13 nt, Pseudomonas aeruginosa PA01
cccaccgcgcggc

SEQ ID NO: 1506281 - RNA, 14 nt, Pseudomonas aeruginosa PA01
cccaccgcgcggca

SEQ ID NO: 1506282 - RNA, 18 nt, Pseudomonas aeruginosa PA01
cccaccggcucgcucucg

SEQ ID NO: 1506283 - RNA, 20 nt, Pseudomonas aeruginosa PA01
cccaacagucgucgcgcagc

SEQ ID NO: 1506284 - RNA, 14 nt, Pseudomonas aeruginosa PA01
cccaacagcggugu

SEQ ID NO: 1506285 - RNA, 16 nt, Pseudomonas aeruginosa PA01
ccauuucguagcccag

SEQ ID NO: 1506286 - RNA, 15 nt, Pseudomonas aeruginosa PA01
ccauuucccgcgagc

SEQ ID NO: 1506287 - RNA, 20 nt, Pseudomonas aeruginosa PA01
cccaacuggcggaugcguug

SEQ ID NO: 1506288 - RNA, 20 nt, Pseudomonas aeruginosa PA01
cccaaccguucugccgcagc

SEQ ID NO: 1506289 - RNA, 19 nt, Pseudomonas aeruginosa PA01
cccauucgaugccgcgcgc

SEQ ID NO: 1506290 - RNA, 21 nt, Pseudomonas aeruginosa PA01
cccauugcaucugcgccggga

SEQ ID NO: 1506291 - RNA, 18 nt, Pseudomonas aeruginosa PA01
cccauugcccggccaggc

SEQ ID NO: 1506292 - RNA, 22 nt, Pseudomonas aeruginosa PA01
cccauggagaauaccgugucga

SEQ ID NO: 1506293 - RNA, 15 nt, Pseudomonas aeruginosa PA01
cccaugccgcccggc

SEQ ID NO: 1506294 - RNA, 18 nt, Pseudomonas aeruginosa PA01
cccaugccuugcagcgcc

SEQ ID NO: 1506295 - RNA, 12 nt, Pseudomonas aeruginosa PA01
cccaugaucgcc

SEQ ID NO: 1506296 - RNA, 16 nt, Pseudomonas aeruginosa PA01
cccaucuucaggccgu

SEQ ID NO: 1506297 - RNA, 16 nt, Pseudomonas aeruginosa PA01
cccaugauggucggca

SEQ ID NO: 1506298 - RNA, 20 nt, Pseudomonas aeruginosa PA01
cccaugaccgucagccaggc

SEQ ID NO: 1506299 - RNA, 22 nt, Pseudomonas aeruginosa PA01
cccaugaaaaagcccggccugg

SEQ ID NO: 1506300 - RNA, 16 nt, Pseudomonas aeruginosa PA01
cccaucgccaccagca

SEQ ID NO: 1506301 - RNA, 17 nt, Pseudomonas aeruginosa PA01
cccaucgccaccagcag

SEQ ID NO: 1506302 - RNA, 14 nt, Pseudomonas aeruginosa PA01
cccaucugccggcc

SEQ ID NO: 1506303 - RNA, 16 nt, Pseudomonas aeruginosa PA01
cccaucugccggccac

SEQ ID NO: 1506304 - RNA, 18 nt, Pseudomonas aeruginosa PA01
cccaucgacugcaacaga

SEQ ID NO: 1506305 - RNA, 15 nt, Pseudomonas aeruginosa PA01
cccaucgcccgcagc

SEQ ID NO: 1506306 - RNA, 14 nt, Pseudomonas aeruginosa PA01
cccaucgccuccac

SEQ ID NO: 1506307 - RNA, 16 nt, Pseudomonas aeruginosa PA01
cccauccgacgccggc

SEQ ID NO: 1506308 - RNA, 14 nt, Pseudomonas aeruginosa PA01
cccauccgggcggc

SEQ ID NO: 1506309 - RNA, 24 nt, Pseudomonas aeruginosa PA01
cccauccgggcggcgggcgcaagc

SEQ ID NO: 1506310 - RNA, 12 nt, Pseudomonas aeruginosa PA01
cccaucaggcuc

SEQ ID NO: 1506311 - RNA, 15 nt, Pseudomonas aeruginosa PA01
cccauccgcucggcg

SEQ ID NO: 1506312 - RNA, 12 nt, Pseudomonas aeruginosa PA01
cccaucagcagu

SEQ ID NO: 1506313 - RNA, 15 nt, Pseudomonas aeruginosa PA01
cccaucagcaguccg

SEQ ID NO: 1506314 - RNA, 14 nt, Pseudomonas aeruginosa PA01
cccaguugcccggc

SEQ ID NO: 1506315 - RNA, 16 nt, Pseudomonas aeruginosa PA01
cccaguugcgccgccu

SEQ ID NO: 1506316 - RNA, 16 nt, Pseudomonas aeruginosa PA01
cccaguucgccggcca

SEQ ID NO: 1506317 - RNA, 20 nt, Pseudomonas aeruginosa PA01
cccaguucuucgccgcccgc

SEQ ID NO: 1506318 - RNA, 21 nt, Pseudomonas aeruginosa PA01
cccaguucuucgccgcccgcg

SEQ ID NO: 1506319 - RNA, 22 nt, Pseudomonas aeruginosa PA01
cccaguucuucgccgcccgcgc

SEQ ID NO: 1506320 - RNA, 14 nt, Pseudomonas aeruginosa PA01
cccaguucgcguag

SEQ ID NO: 1506321 - RNA, 15 nt, Pseudomonas aeruginosa PA01
cccaguucgcguagc

SEQ ID NO: 1506322 - RNA, 23 nt, Pseudomonas aeruginosa PA01
cccagugguuccaggagggcugc

SEQ ID NO: 1506323 - RNA, 15 nt, Pseudomonas aeruginosa PA01
cccaguagccgguca

SEQ ID NO: 1506324 - RNA, 21 nt, Pseudomonas aeruginosa PA01
cccaguagcgcuucgcgcagc

SEQ ID NO: 1506325 - RNA, 16 nt, Pseudomonas aeruginosa PA01
cccagucggcguccgc

SEQ ID NO: 1506326 - RNA, 21 nt, Pseudomonas aeruginosa PA01
cccagucccuucagcgcaccg

SEQ ID NO: 1506327 - RNA, 19 nt, Pseudomonas aeruginosa PA01
cccagcgggcggucgcgga

SEQ ID NO: 1506328 - RNA, 19 nt, Pseudomonas aeruginosa PA01
cccagcggcagggcggcga

SEQ ID NO: 1506329 - RNA, 20 nt, Pseudomonas aeruginosa PA01
cccagcggcagggcggcgau

SEQ ID NO: 1506330 - RNA, 16 nt, Pseudomonas aeruginosa PA01
cccagcggcaggucgu

SEQ ID NO: 1506331 - RNA, 16 nt, Pseudomonas aeruginosa PA01
cccagcggaugcgcga

SEQ ID NO: 1506332 - RNA, 21 nt, Pseudomonas aeruginosa PA01
cccagcgcuuccucgggcagc

SEQ ID NO: 1506333 - RNA, 11 nt, Pseudomonas aeruginosa PA01
cccagcaggcc

SEQ ID NO: 1506334 - RNA, 13 nt, Pseudomonas aeruginosa PA01
cccagcgcgccgc

SEQ ID NO: 1506335 - RNA, 19 nt, Pseudomonas aeruginosa PA01
cccagcaucgccggcagcg

SEQ ID NO: 1506336 - RNA, 23 nt, Pseudomonas aeruginosa PA01
cccagcaucgccggcagcgccgc

SEQ ID NO: 1506337 - RNA, 13 nt, Pseudomonas aeruginosa PA01
cccagcagcgccu

SEQ ID NO: 1506338 - RNA, 14 nt, Pseudomonas aeruginosa PA01
cccagcagcgccuc

SEQ ID NO: 1506339 - RNA, 18 nt, Pseudomonas aeruginosa PA01
cccagcagcgccucggca

SEQ ID NO: 1506340 - RNA, 21 nt, Pseudomonas aeruginosa PA01
cccagcagcgccucggcaucg

SEQ ID NO: 1506341 - RNA, 19 nt, Pseudomonas aeruginosa PA01
cccagcacggaugcccagc

SEQ ID NO: 1506342 - RNA, 19 nt, Pseudomonas aeruginosa PA01
cccagcagcaacagcgccg

SEQ ID NO: 1506343 - RNA, 21 nt, Pseudomonas aeruginosa PA01
cccagcagcaacagcgccgcg

SEQ ID NO: 1506344 - RNA, 18 nt, Pseudomonas aeruginosa PA01
cccagaccuuccagccgc

SEQ ID NO: 1506345 - RNA, 20 nt, Pseudomonas aeruginosa PA01
cccagaccguggauuucagc

SEQ ID NO: 1506346 - RNA, 12 nt, Pseudomonas aeruginosa PA01
cccagaccugcc

SEQ ID NO: 1506347 - RNA, 17 nt, Pseudomonas aeruginosa PA01
cccagaccugccgcccg

SEQ ID NO: 1506348 - RNA, 15 nt, Pseudomonas aeruginosa PA01
cccagacguccagcg

SEQ ID NO: 1506349 - RNA, 17 nt, Pseudomonas aeruginosa PA01
cccagacguccagcgcc

SEQ ID NO: 1506350 - RNA, 18 nt, Pseudomonas aeruginosa PA01
cccagacguccagcgcca

SEQ ID NO: 1506351 - RNA, 13 nt, Pseudomonas aeruginosa PA01
cccagagcaccag

SEQ ID NO: 1506352 - RNA, 12 nt, Pseudomonas aeruginosa PA01
cccagagcagca

SEQ ID NO: 1506353 - RNA, 15 nt, Pseudomonas aeruginosa PA01
cccagagcccgccga

SEQ ID NO: 1506354 - RNA, 19 nt, Pseudomonas aeruginosa PA01
cccagagccgcucggcggg

SEQ ID NO: 1506355 - RNA, 20 nt, Pseudomonas aeruginosa PA01
cccaggcugccgccgccguc

SEQ ID NO: 1506356 - RNA, 20 nt, Pseudomonas aeruginosa PA01
cccaggcugccggccaggua

SEQ ID NO: 1506357 - RNA, 15 nt, Pseudomonas aeruginosa PA01
cccaggcuggcggca

SEQ ID NO: 1506358 - RNA, 21 nt, Pseudomonas aeruginosa PA01
cccagcuugauguaggacagg

SEQ ID NO: 1506359 - RNA, 13 nt, Pseudomonas aeruginosa PA01
cccagggcgcugc

SEQ ID NO: 1506360 - RNA, 21 nt, Pseudomonas aeruginosa PA01
cccagggcgcugccgaucagc

SEQ ID NO: 1506361 - RNA, 23 nt, Pseudomonas aeruginosa PA01
cccagggcccagagcagcaccag

SEQ ID NO: 1506362 - RNA, 18 nt, Pseudomonas aeruginosa PA01
cccagcguucggcgcugg

SEQ ID NO: 1506363 - RNA, 20 nt, Pseudomonas aeruginosa PA01
cccagcguucggcgcuggcg

SEQ ID NO: 1506364 - RNA, 23 nt, Pseudomonas aeruginosa PA01
cccagcguucggcgcuggcgcgg

SEQ ID NO: 1506365 - RNA, 13 nt, Pseudomonas aeruginosa PA01
cccagcguggcca

SEQ ID NO: 1506366 - RNA, 19 nt, Pseudomonas aeruginosa PA01
cccaggguuggcggcaucg

SEQ ID NO: 1506367 - RNA, 13 nt, Pseudomonas aeruginosa PA01
cccaggucggcgg

SEQ ID NO: 1506368 - RNA, 14 nt, Pseudomonas aeruginosa PA01
cccaggucggcggg

SEQ ID NO: 1506369 - RNA, 22 nt, Pseudomonas aeruginosa PA01
cccaggucggcgggcaccgcca

SEQ ID NO: 1506370 - RNA, 23 nt, Pseudomonas aeruginosa PA01
cccagggugcgccggggaucagg

SEQ ID NO: 1506371 - RNA, 18 nt, Pseudomonas aeruginosa PA01
cccagggggccgggccga

SEQ ID NO: 1506372 - RNA, 22 nt, Pseudomonas aeruginosa PA01
cccagguacugggcgauguccu

SEQ ID NO: 1506373 - RNA, 19 nt, Pseudomonas aeruginosa PA01
cccagguagccggcgagcg

SEQ ID NO: 1506374 - RNA, 14 nt, Pseudomonas aeruginosa PA01
cccagguagcgcug

SEQ ID NO: 1506375 - RNA, 15 nt, Pseudomonas aeruginosa PA01
cccagguagcgcugc

SEQ ID NO: 1506376 - RNA, 22 nt, Pseudomonas aeruginosa PA01
cccagguagcgcugcgccaggc

SEQ ID NO: 1506377 - RNA, 22 nt, Pseudomonas aeruginosa PA01
cccagguagucgcccagcgccu

SEQ ID NO: 1506378 - RNA, 16 nt, Pseudomonas aeruginosa PA01
cccaggcuucggcgcg

SEQ ID NO: 1506379 - RNA, 16 nt, Pseudomonas aeruginosa PA01
cccaggggucggcauc

SEQ ID NO: 1506380 - RNA, 17 nt, Pseudomonas aeruginosa PA01
cccaggggucggcaucg

SEQ ID NO: 1506381 - RNA, 19 nt, Pseudomonas aeruginosa PA01
cccaggggucggcaucgcg

SEQ ID NO: 1506382 - RNA, 16 nt, Pseudomonas aeruginosa PA01
cccagguggucgacca

SEQ ID NO: 1506383 - RNA, 19 nt, Pseudomonas aeruginosa PA01
cccagguucuggucgccga

SEQ ID NO: 1506384 - RNA, 16 nt, Pseudomonas aeruginosa PA01
cccagguuggcgaaca

SEQ ID NO: 1506385 - RNA, 14 nt, Pseudomonas aeruginosa PA01
cccaggugcagcga

SEQ ID NO: 1506386 - RNA, 17 nt, Pseudomonas aeruginosa PA01
cccaggugcccuggaag

SEQ ID NO: 1506387 - RNA, 15 nt, Pseudomonas aeruginosa PA01
cccagguggcaggcc

SEQ ID NO: 1506388 - RNA, 21 nt, Pseudomonas aeruginosa PA01
cccaggugcgagucaccccga

SEQ ID NO: 1506389 - RNA, 17 nt, Pseudomonas aeruginosa PA01
cccaggugcgcaggcgc

SEQ ID NO: 1506390 - RNA, 18 nt, Pseudomonas aeruginosa PA01
ccgacguccaucagcguc

SEQ ID NO: 1506391 - RNA, 22 nt, Pseudomonas aeruginosa PA01
ccgacgucguggauaggcggcg

SEQ ID NO: 1506392 - RNA, 23 nt, Pseudomonas aeruginosa PA01
ccgacgucgaugacgauggcgcc

SEQ ID NO: 1506393 - RNA, 17 nt, Pseudomonas aeruginosa PA01
ccgacgugcacccgcug

SEQ ID NO: 1506394 - RNA, 22 nt, Pseudomonas aeruginosa PA01
ccgacguugagaaggcgccuga

SEQ ID NO: 1506395 - RNA, 17 nt, Pseudomonas aeruginosa PA01
ccgacugcaacuggccg

SEQ ID NO: 1506396 - RNA, 21 nt, Pseudomonas aeruginosa PA01
ccgacuggccguuggcgaacu

SEQ ID NO: 1506397 - RNA, 16 nt, Pseudomonas aeruginosa PA01
ccgacuggugggcacg

SEQ ID NO: 1506398 - RNA, 15 nt, Pseudomonas aeruginosa PA01
ccgacuucggcaagc

SEQ ID NO: 1506399 - RNA, 16 nt, Pseudomonas aeruginosa PA01
ccgacuuccaggcgca

SEQ ID NO: 1506400 - RNA, 20 nt, Pseudomonas aeruginosa PA01
ccgacuuggcagucgccgcc

SEQ ID NO: 1506401 - RNA, 22 nt, Pseudomonas aeruginosa PA01
ccgagaaaguucccgcauggcu

SEQ ID NO: 1506402 - RNA, 13 nt, Pseudomonas aeruginosa PA01
ccgagaugcugcc

SEQ ID NO: 1506403 - RNA, 20 nt, Pseudomonas aeruginosa PA01
ccgagaucggucaccguggu

SEQ ID NO: 1506404 - RNA, 16 nt, Pseudomonas aeruginosa PA01
ccgagcaacggcagca

SEQ ID NO: 1506405 - RNA, 17 nt, Pseudomonas aeruginosa PA01
ccgagcaccacgcgcaa

SEQ ID NO: 1506406 - RNA, 17 nt, Pseudomonas aeruginosa PA01
ccgagcaacucggcggc

SEQ ID NO: 1506407 - RNA, 20 nt, Pseudomonas aeruginosa PA01
ccgagcaacucggcggcgag

SEQ ID NO: 1506408 - RNA, 21 nt, Pseudomonas aeruginosa PA01
ccgagcaacucggcggcgagc

SEQ ID NO: 1506409 - RNA, 22 nt, Pseudomonas aeruginosa PA01
ccgagcaacucggcggcgagcg

SEQ ID NO: 1506410 - RNA, 22 nt, Pseudomonas aeruginosa PA01
ccgagcaacugcauguugccgu

SEQ ID NO: 1506411 - RNA, 20 nt, Pseudomonas aeruginosa PA01
ccgagcaagccuuccaggua

SEQ ID NO: 1506412 - RNA, 14 nt, Pseudomonas aeruginosa PA01
ccgagauuggccgc

SEQ ID NO: 1506413 - RNA, 23 nt, Pseudomonas aeruginosa PA01
ccgagauuggccgccugcucggc

SEQ ID NO: 1506414 - RNA, 16 nt, Pseudomonas aeruginosa PA01
ccgagacuugaucgca

SEQ ID NO: 1506415 - RNA, 17 nt, Pseudomonas aeruginosa PA01
ccgagacgaucagcagg

SEQ ID NO: 1506416 - RNA, 21 nt, Pseudomonas aeruginosa PA01
ccgagacgaucagcaggaugc

SEQ ID NO: 1506417 - RNA, 22 nt, Pseudomonas aeruginosa PA01
ccgagacgcugcaccgcggcgc

SEQ ID NO: 1506418 - RNA, 17 nt, Pseudomonas aeruginosa PA01
ccgagagcggcgccagg

SEQ ID NO: 1506419 - RNA, 16 nt, Pseudomonas aeruginosa PA01
ccgagagcugcaaggc

SEQ ID NO: 1506420 - RNA, 22 nt, Pseudomonas aeruginosa PA01
ccgagagugguauuggucgcga

SEQ ID NO: 1506421 - RNA, 14 nt, Pseudomonas aeruginosa PA01
ccgagaacccggcc

SEQ ID NO: 1506422 - RNA, 12 nt, Pseudomonas aeruginosa PA01
ccgagaccggca

SEQ ID NO: 1506423 - RNA, 17 nt, Pseudomonas aeruginosa PA01
ccgagaccggcagccgg

SEQ ID NO: 1506424 - RNA, 17 nt, Pseudomonas aeruginosa PA01
ccgagacccuggcgcug

SEQ ID NO: 1506425 - RNA, 20 nt, Pseudomonas aeruginosa PA01
ccgacgauguucgaggcgcc

SEQ ID NO: 1506426 - RNA, 23 nt, Pseudomonas aeruginosa PA01
ccgacgauguucgaggcgccgac

SEQ ID NO: 1506427 - RNA, 23 nt, Pseudomonas aeruginosa PA01
ccgacgauguuguugcccaccag

SEQ ID NO: 1506428 - RNA, 19 nt, Pseudomonas aeruginosa PA01
ccgacgaucucaucgccca

SEQ ID NO: 1506429 - RNA, 12 nt, Pseudomonas aeruginosa PA01
ccgacgccgccu

SEQ ID NO: 1506430 - RNA, 17 nt, Pseudomonas aeruginosa PA01
ccgacgccgccugcgcc

SEQ ID NO: 1506431 - RNA, 13 nt, Pseudomonas aeruginosa PA01
ccgacgccgcccg

SEQ ID NO: 1506432 - RNA, 16 nt, Pseudomonas aeruginosa PA01
ccgacgccgcccggca

SEQ ID NO: 1506433 - RNA, 20 nt, Pseudomonas aeruginosa PA01
ccgacgccgagcagcaccag

SEQ ID NO: 1506434 - RNA, 14 nt, Pseudomonas aeruginosa PA01
ccgacgccgcggcc

SEQ ID NO: 1506435 - RNA, 18 nt, Pseudomonas aeruginosa PA01
ccgacgccgcggccggcg

SEQ ID NO: 1506436 - RNA, 12 nt, Pseudomonas aeruginosa PA01
ccgacgccgcgu

SEQ ID NO: 1506437 - RNA, 14 nt, Pseudomonas aeruginosa PA01
ccgacgccgcgucc

SEQ ID NO: 1506438 - RNA, 13 nt, Pseudomonas aeruginosa PA01
ccgacgccgcugg

SEQ ID NO: 1506439 - RNA, 14 nt, Pseudomonas aeruginosa PA01
ccgacgccaccagc

SEQ ID NO: 1506440 - RNA, 18 nt, Pseudomonas aeruginosa PA01
ccgacgccaccagccagg

SEQ ID NO: 1506441 - RNA, 14 nt, Pseudomonas aeruginosa PA01
ccgacgccaugggu

SEQ ID NO: 1506442 - RNA, 18 nt, Pseudomonas aeruginosa PA01
ccgacgcccuccagcacc

SEQ ID NO: 1506443 - RNA, 20 nt, Pseudomonas aeruginosa PA01
ccgacgcccuccagcaccgc

SEQ ID NO: 1506444 - RNA, 21 nt, Pseudomonas aeruginosa PA01
ccgacgcccuccagcaccgcc

SEQ ID NO: 1506445 - RNA, 13 nt, Pseudomonas aeruginosa PA01
ccgacgcccccca

SEQ ID NO: 1506446 - RNA, 21 nt, Pseudomonas aeruginosa PA01
ccgacgcgcgcugccugcgau

SEQ ID NO: 1506447 - RNA, 18 nt, Pseudomonas aeruginosa PA01
ccgacggcccuccggcgc

SEQ ID NO: 1506448 - RNA, 16 nt, Pseudomonas aeruginosa PA01
ccgacgcgucguccga

SEQ ID NO: 1506449 - RNA, 14 nt, Pseudomonas aeruginosa PA01
ccgacgggucgcca

SEQ ID NO: 1506450 - RNA, 22 nt, Pseudomonas aeruginosa PA01
ccgacggguucuucucgucgaa

SEQ ID NO: 1506451 - RNA, 22 nt, Pseudomonas aeruginosa PA01
ccgacgguaguaccucgaagcc

SEQ ID NO: 1506452 - RNA, 21 nt, Pseudomonas aeruginosa PA01
ccgacguagggcaucgccgac

SEQ ID NO: 1506453 - RNA, 22 nt, Pseudomonas aeruginosa PA01
ccgacgucacggauaggcggcg

SEQ ID NO: 1506454 - RNA, 23 nt, Pseudomonas aeruginosa PA01
ccgacgucacggauaggcggcgg

SEQ ID NO: 1506455 - RNA, 15 nt, Pseudomonas aeruginosa PA01
ccgacggcgugccgu

SEQ ID NO: 1506456 - RNA, 16 nt, Pseudomonas aeruginosa PA01
ccgacggcuucgacca

SEQ ID NO: 1506457 - RNA, 16 nt, Pseudomonas aeruginosa PA01
ccgacggcuugaucac

SEQ ID NO: 1506458 - RNA, 20 nt, Pseudomonas aeruginosa PA01
ccgacggcuugaucacgccg

SEQ ID NO: 1506459 - RNA, 21 nt, Pseudomonas aeruginosa PA01
ccgacggcuugaucacgccga

SEQ ID NO: 1506460 - RNA, 15 nt, Pseudomonas aeruginosa PA01
ccgacggcgcgcugc

SEQ ID NO: 1506461 - RNA, 16 nt, Pseudomonas aeruginosa PA01
ccgacggcgcgcugcg

SEQ ID NO: 1506462 - RNA, 22 nt, Pseudomonas aeruginosa PA01
ccgaccagcagggccagcagcg

SEQ ID NO: 1506463 - RNA, 12 nt, Pseudomonas aeruginosa PA01
ccgaccagccgc

SEQ ID NO: 1506464 - RNA, 18 nt, Pseudomonas aeruginosa PA01
ccgaccagccgcaggcug

SEQ ID NO: 1506465 - RNA, 12 nt, Pseudomonas aeruginosa PA01
ccgaccagcgcg

SEQ ID NO: 1506466 - RNA, 14 nt, Pseudomonas aeruginosa PA01
ccgaccagcgcgcu

SEQ ID NO: 1506467 - RNA, 18 nt, Pseudomonas aeruginosa PA01
ccgaccaccaucaccgcc

SEQ ID NO: 1506468 - RNA, 21 nt, Pseudomonas aeruginosa PA01
ccgaccacgaccgcguccaug

SEQ ID NO: 1506469 - RNA, 22 nt, Pseudomonas aeruginosa PA01
ccgaccacguaguaggcgcggg

SEQ ID NO: 1506470 - RNA, 16 nt, Pseudomonas aeruginosa PA01
ccgaccacuuccaggu

SEQ ID NO: 1506471 - RNA, 22 nt, Pseudomonas aeruginosa PA01
ccgaccacuuccagguagccca

SEQ ID NO: 1506472 - RNA, 22 nt, Pseudomonas aeruginosa PA01
ccgaccaggucgcuggcaccgg

SEQ ID NO: 1506473 - RNA, 16 nt, Pseudomonas aeruginosa PA01
ccgaccaguaccagca

SEQ ID NO: 1506474 - RNA, 18 nt, Pseudomonas aeruginosa PA01
ccgaccaguaccagcaau

SEQ ID NO: 1506475 - RNA, 14 nt, Pseudomonas aeruginosa PA01
ccgaccaggccgau

SEQ ID NO: 1506476 - RNA, 13 nt, Pseudomonas aeruginosa PA01
ccgaccaggccgu

SEQ ID NO: 1506477 - RNA, 20 nt, Pseudomonas aeruginosa PA01
ccgaccaggccguaggcgau

SEQ ID NO: 1506478 - RNA, 15 nt, Pseudomonas aeruginosa PA01
ccgaccaggcggccg

SEQ ID NO: 1506479 - RNA, 19 nt, Pseudomonas aeruginosa PA01
ccgaccaggcggccgucgg

SEQ ID NO: 1506480 - RNA, 21 nt, Pseudomonas aeruginosa PA01
ccgacccagagcgcgcccugc

SEQ ID NO: 1506481 - RNA, 16 nt, Pseudomonas aeruginosa PA01
ccgaccccacgccggc

SEQ ID NO: 1506482 - RNA, 17 nt, Pseudomonas aeruginosa PA01
ccgaccccacgccggcc

SEQ ID NO: 1506483 - RNA, 19 nt, Pseudomonas aeruginosa PA01
ccgaccccacgccggccgg

SEQ ID NO: 1506484 - RNA, 17 nt, Pseudomonas aeruginosa PA01
ccgacccgcaggccggc

SEQ ID NO: 1506485 - RNA, 21 nt, Pseudomonas aeruginosa PA01
ccgacccgcaggccggccagg

SEQ ID NO: 1506486 - RNA, 18 nt, Pseudomonas aeruginosa PA01
ccgacccgugcgccgcgg

SEQ ID NO: 1506487 - RNA, 16 nt, Pseudomonas aeruginosa PA01
ccgacccuagggucgg

SEQ ID NO: 1506488 - RNA, 22 nt, Pseudomonas aeruginosa PA01
ccgacccucauggaaaccccgg

SEQ ID NO: 1506489 - RNA, 15 nt, Pseudomonas aeruginosa PA01
ccgaccgagcagcgg

SEQ ID NO: 1506490 - RNA, 20 nt, Pseudomonas aeruginosa PA01
ccgaccgcgaguucgccggc

SEQ ID NO: 1506491 - RNA, 21 nt, Pseudomonas aeruginosa PA01
ccgaccgcgaguucgccggcc

SEQ ID NO: 1506492 - RNA, 22 nt, Pseudomonas aeruginosa PA01
ccgaccgcgaguucgccggcca

SEQ ID NO: 1506493 - RNA, 12 nt, Pseudomonas aeruginosa PA01
ccgaccggcgcc

SEQ ID NO: 1506494 - RNA, 17 nt, Pseudomonas aeruginosa PA01
ccgaccgguuccagcgg

SEQ ID NO: 1506495 - RNA, 18 nt, Pseudomonas aeruginosa PA01
ccgaccgguuccagcggc

SEQ ID NO: 1506496 - RNA, 21 nt, Pseudomonas aeruginosa PA01
ccgaccgguuccagcggccgc

SEQ ID NO: 1506497 - RNA, 23 nt, Pseudomonas aeruginosa PA01
ccgaccguccgccugcggauagc

SEQ ID NO: 1506498 - RNA, 12 nt, Pseudomonas aeruginosa PA01
ccgaccgccagg

SEQ ID NO: 1506499 - RNA, 20 nt, Pseudomonas aeruginosa PA01
ccgaccuucaucaggcggca

SEQ ID NO: 1506500 - RNA, 14 nt, Pseudomonas aeruginosa PA01
ccgaccucggccgc

SEQ ID NO: 1506501 - RNA, 22 nt, Pseudomonas aeruginosa PA01
ccgaccucggccgccagggcgu

SEQ ID NO: 1506502 - RNA, 17 nt, Pseudomonas aeruginosa PA01
ccgaccuucaccaccag

SEQ ID NO: 1506503 - RNA, 13 nt, Pseudomonas aeruginosa PA01
ccgaccuugccgg

SEQ ID NO: 1506504 - RNA, 24 nt, Pseudomonas aeruginosa PA01
ccgaccuuugagggucagaccagc

SEQ ID NO: 1506505 - RNA, 21 nt, Pseudomonas aeruginosa PA01
ccgacgaaguugcaggccagc

SEQ ID NO: 1506506 - RNA, 17 nt, Pseudomonas aeruginosa PA01
ccgacaaucgccgagaa

SEQ ID NO: 1506507 - RNA, 15 nt, Pseudomonas aeruginosa PA01
ccgacaaggagcgcg

SEQ ID NO: 1506508 - RNA, 18 nt, Pseudomonas aeruginosa PA01
ccgacaagccuccagcgc

SEQ ID NO: 1506509 - RNA, 22 nt, Pseudomonas aeruginosa PA01
ccgacacgggugccggagaacg

SEQ ID NO: 1506510 - RNA, 20 nt, Pseudomonas aeruginosa PA01
ccgacacguucaggcguacg

SEQ ID NO: 1506511 - RNA, 18 nt, Pseudomonas aeruginosa PA01
ccgaauacugcacgccca

SEQ ID NO: 1506512 - RNA, 19 nt, Pseudomonas aeruginosa PA01
ccgaaucccuuggcugcuc

SEQ ID NO: 1506513 - RNA, 14 nt, Pseudomonas aeruginosa PA01
ccgaauccgccggc

SEQ ID NO: 1506514 - RNA, 17 nt, Pseudomonas aeruginosa PA01
ccgaauccgccggcgau

SEQ ID NO: 1506515 - RNA, 19 nt, Pseudomonas aeruginosa PA01
ccgaauccgccggcgaugc

SEQ ID NO: 1506516 - RNA, 21 nt, Pseudomonas aeruginosa PA01
ccgaaucgccuaccagaccgc

SEQ ID NO: 1506517 - RNA, 16 nt, Pseudomonas aeruginosa PA01
ccgaauccuugaucac

SEQ ID NO: 1506518 - RNA, 21 nt, Pseudomonas aeruginosa PA01
ccgaaucgaacagggcgaagg

SEQ ID NO: 1506519 - RNA, 19 nt, Pseudomonas aeruginosa PA01
ccgaauagaucugcaccag

SEQ ID NO: 1506520 - RNA, 21 nt, Pseudomonas aeruginosa PA01
ccgaauagaucugcaccaggc

SEQ ID NO: 1506521 - RNA, 15 nt, Pseudomonas aeruginosa PA01
ccgacagcaggucgu

SEQ ID NO: 1506522 - RNA, 15 nt, Pseudomonas aeruginosa PA01
ccgacagagcggccg

SEQ ID NO: 1506523 - RNA, 16 nt, Pseudomonas aeruginosa PA01
ccgacagagcggccgg

SEQ ID NO: 1506524 - RNA, 13 nt, Pseudomonas aeruginosa PA01
ccgacagcggcug

SEQ ID NO: 1506525 - RNA, 21 nt, Pseudomonas aeruginosa PA01
ccgacaggccggugccgccgg

SEQ ID NO: 1506526 - RNA, 18 nt, Pseudomonas aeruginosa PA01
ccgacaggcagcgccgcc

SEQ ID NO: 1506527 - RNA, 22 nt, Pseudomonas aeruginosa PA01
ccgacaggcagcgccgcccaca

SEQ ID NO: 1506528 - RNA, 21 nt, Pseudomonas aeruginosa PA01
ccgacaggucgcuuucgcgca

SEQ ID NO: 1506529 - RNA, 22 nt, Pseudomonas aeruginosa PA01
ccgacaggucgcuuucgcgcag

SEQ ID NO: 1506530 - RNA, 15 nt, Pseudomonas aeruginosa PA01
ccgacaggucggccg

SEQ ID NO: 1506531 - RNA, 16 nt, Pseudomonas aeruginosa PA01
ccgacaggucggccgg

SEQ ID NO: 1506532 - RNA, 15 nt, Pseudomonas aeruginosa PA01
ccgacagucccaggc

SEQ ID NO: 1506533 - RNA, 16 nt, Pseudomonas aeruginosa PA01
ccgacagucccaggcc

SEQ ID NO: 1506534 - RNA, 12 nt, Pseudomonas aeruginosa PA01
ccgacaugcccc

SEQ ID NO: 1506535 - RNA, 15 nt, Pseudomonas aeruginosa PA01
ccgacaugccccgcc

SEQ ID NO: 1506536 - RNA, 17 nt, Pseudomonas aeruginosa PA01
ccgacaugccccgccga

SEQ ID NO: 1506537 - RNA, 14 nt, Pseudomonas aeruginosa PA01
cccguuuugccgac

SEQ ID NO: 1506538 - RNA, 17 nt, Pseudomonas aeruginosa PA01
cccuaccguccgcagca

SEQ ID NO: 1506539 - RNA, 19 nt, Pseudomonas aeruginosa PA01
cccuaccguccgcagcaca

SEQ ID NO: 1506540 - RNA, 15 nt, Pseudomonas aeruginosa PA01
cccuaccugucccgg

SEQ ID NO: 1506541 - RNA, 21 nt, Pseudomonas aeruginosa PA01
cccuaccugucccggacgacg

SEQ ID NO: 1506542 - RNA, 11 nt, Pseudomonas aeruginosa PA01
cccuacgaaag

SEQ ID NO: 1506543 - RNA, 12 nt, Pseudomonas aeruginosa PA01
cccuacgccagu

SEQ ID NO: 1506544 - RNA, 22 nt, Pseudomonas aeruginosa PA01
cccguuuuuccucuaugggacg

SEQ ID NO: 1506545 - RNA, 20 nt, Pseudomonas aeruginosa PA01
cccguucugcacaugcacca

SEQ ID NO: 1506546 - RNA, 13 nt, Pseudomonas aeruginosa PA01
cccguucgccggc

SEQ ID NO: 1506547 - RNA, 21 nt, Pseudomonas aeruginosa PA01
cccguucgaucaauugccggu

SEQ ID NO: 1506548 - RNA, 22 nt, Pseudomonas aeruginosa PA01
cccguucgaucaauugccggua

SEQ ID NO: 1506549 - RNA, 23 nt, Pseudomonas aeruginosa PA01
cccguucgaucaauugccgguag

SEQ ID NO: 1506550 - RNA, 16 nt, Pseudomonas aeruginosa PA01
cccguuccggcgcagc

SEQ ID NO: 1506551 - RNA, 18 nt, Pseudomonas aeruginosa PA01
cccguuccuugcgcggca

SEQ ID NO: 1506552 - RNA, 19 nt, Pseudomonas aeruginosa PA01
cccgucgccauucggcgac

SEQ ID NO: 1506553 - RNA, 13 nt, Pseudomonas aeruginosa PA01
cccgugucgccuu

SEQ ID NO: 1506554 - RNA, 19 nt, Pseudomonas aeruginosa PA01
cccguguucggccagccgg

SEQ ID NO: 1506555 - RNA, 18 nt, Pseudomonas aeruginosa PA01
cccgucgacgcccugggc

SEQ ID NO: 1506556 - RNA, 17 nt, Pseudomonas aeruginosa PA01
cccgucgaccaucacca

SEQ ID NO: 1506557 - RNA, 21 nt, Pseudomonas aeruginosa PA01
cccgucaugaccagagccgcc

SEQ ID NO: 1506558 - RNA, 23 nt, Pseudomonas aeruginosa PA01
cccgucaugaccagagccgccga

SEQ ID NO: 1506559 - RNA, 13 nt, Pseudomonas aeruginosa PA01
cccguccagcgcu

SEQ ID NO: 1506560 - RNA, 13 nt, Pseudomonas aeruginosa PA01
cccguccgcugcg

SEQ ID NO: 1506561 - RNA, 13 nt, Pseudomonas aeruginosa PA01
cccguccuggcgg

SEQ ID NO: 1506562 - RNA, 23 nt, Pseudomonas aeruginosa PA01
cccgucccuaccagcgcaaccgg

SEQ ID NO: 1506563 - RNA, 23 nt, Pseudomonas aeruginosa PA01
cccgucccucagguagucggcga

SEQ ID NO: 1506564 - RNA, 22 nt, Pseudomonas aeruginosa PA01
cccggugugcgcugcaucggcg

SEQ ID NO: 1506565 - RNA, 18 nt, Pseudomonas aeruginosa PA01
cccgguuaccggcgacca

SEQ ID NO: 1506566 - RNA, 21 nt, Pseudomonas aeruginosa PA01
cccgguuaccggcgaccaccg

SEQ ID NO: 1506567 - RNA, 17 nt, Pseudomonas aeruginosa PA01
cccgguuacucgccggc

SEQ ID NO: 1506568 - RNA, 18 nt, Pseudomonas aeruginosa PA01
cccguagccaugcccggc

SEQ ID NO: 1506569 - RNA, 17 nt, Pseudomonas aeruginosa PA01
cccggugucgacgacga

SEQ ID NO: 1506570 - RNA, 21 nt, Pseudomonas aeruginosa PA01
cccgucaggccuugcgcggcg

SEQ ID NO: 1506571 - RNA, 23 nt, Pseudomonas aeruginosa PA01
cccgucaggccuugcgcggcgcc

SEQ ID NO: 1506572 - RNA, 18 nt, Pseudomonas aeruginosa PA01
cccggcuugccggcagcg

SEQ ID NO: 1506573 - RNA, 14 nt, Pseudomonas aeruginosa PA01
cccggcuugccguc

SEQ ID NO: 1506574 - RNA, 18 nt, Pseudomonas aeruginosa PA01
cccggcuugcugacgaug

SEQ ID NO: 1506575 - RNA, 21 nt, Pseudomonas aeruginosa PA01
cccggcuuggcgggcucgccc

SEQ ID NO: 1506576 - RNA, 16 nt, Pseudomonas aeruginosa PA01
cccgggaaaccaccag

SEQ ID NO: 1506577 - RNA, 20 nt, Pseudomonas aeruginosa PA01
cccgggaaaccaccaggaag

SEQ ID NO: 1506578 - RNA, 15 nt, Pseudomonas aeruginosa PA01
cccgggcgccaccgc

SEQ ID NO: 1506579 - RNA, 17 nt, Pseudomonas aeruginosa PA01
cccgggccuccuggcgg

SEQ ID NO: 1506580 - RNA, 18 nt, Pseudomonas aeruginosa PA01
cccgggccuccuggcggc

SEQ ID NO: 1506581 - RNA, 14 nt, Pseudomonas aeruginosa PA01
cccgggcgaccugc

SEQ ID NO: 1506582 - RNA, 15 nt, Pseudomonas aeruginosa PA01
cccgggcgaccugcu

SEQ ID NO: 1506583 - RNA, 20 nt, Pseudomonas aeruginosa PA01
cccggcugguugccagcagc

SEQ ID NO: 1506584 - RNA, 22 nt, Pseudomonas aeruginosa PA01
cccggcugguugccagcagcgc

SEQ ID NO: 1506585 - RNA, 22 nt, Pseudomonas aeruginosa PA01
cccggcugugcucgacgggcgc

SEQ ID NO: 1506586 - RNA, 22 nt, Pseudomonas aeruginosa PA01
cccggcuucggcggcgcgcugc

SEQ ID NO: 1506587 - RNA, 20 nt, Pseudomonas aeruginosa PA01
cccggcugagcgccaggcgc

SEQ ID NO: 1506588 - RNA, 23 nt, Pseudomonas aeruginosa PA01
cccggcgguccgccgcgggacgc

SEQ ID NO: 1506589 - RNA, 17 nt, Pseudomonas aeruginosa PA01
cccggcgguuucgccga

SEQ ID NO: 1506590 - RNA, 19 nt, Pseudomonas aeruginosa PA01
cccggcgguuucgccgagg

SEQ ID NO: 1506591 - RNA, 20 nt, Pseudomonas aeruginosa PA01
cccggauuuugggcagcgug

SEQ ID NO: 1506592 - RNA, 14 nt, Pseudomonas aeruginosa PA01
cccggcgugagcag

SEQ ID NO: 1506593 - RNA, 16 nt, Pseudomonas aeruginosa PA01
cccggcgugagcaggg

SEQ ID NO: 1506594 - RNA, 20 nt, Pseudomonas aeruginosa PA01
cccggcgugagcagggccga

SEQ ID NO: 1506595 - RNA, 16 nt, Pseudomonas aeruginosa PA01
cccggcgucggcgcgg

SEQ ID NO: 1506596 - RNA, 19 nt, Pseudomonas aeruginosa PA01
cccggcgucggcgcgggcg

SEQ ID NO: 1506597 - RNA, 13 nt, Pseudomonas aeruginosa PA01
cccggcggcgauc

SEQ ID NO: 1506598 - RNA, 19 nt, Pseudomonas aeruginosa PA01
cccggcggcggcaccgacg

SEQ ID NO: 1506599 - RNA, 23 nt, Pseudomonas aeruginosa PA01
cccggcggcggcaccgacgccga

SEQ ID NO: 1506600 - RNA, 14 nt, Pseudomonas aeruginosa PA01
cccggauucgccga

SEQ ID NO: 1506601 - RNA, 19 nt, Pseudomonas aeruginosa PA01
cccggcaagcgccggcaac

SEQ ID NO: 1506602 - RNA, 16 nt, Pseudomonas aeruginosa PA01
cccggcaaaugccggg

SEQ ID NO: 1506603 - RNA, 16 nt, Pseudomonas aeruginosa PA01
cccggggagggugccg

SEQ ID NO: 1506604 - RNA, 22 nt, Pseudomonas aeruginosa PA01
cccggguauagaaaucgaucga

SEQ ID NO: 1506605 - RNA, 13 nt, Pseudomonas aeruginosa PA01
cccggggcucugc

SEQ ID NO: 1506606 - RNA, 16 nt, Pseudomonas aeruginosa PA01
cccggggcucugccgg

SEQ ID NO: 1506607 - RNA, 17 nt, Pseudomonas aeruginosa PA01
cccgggucaggccgaga

SEQ ID NO: 1506608 - RNA, 18 nt, Pseudomonas aeruginosa PA01
cccgggguugcccagcag

SEQ ID NO: 1506609 - RNA, 21 nt, Pseudomonas aeruginosa PA01
cccggguggauaucgucggga

SEQ ID NO: 1506610 - RNA, 19 nt, Pseudomonas aeruginosa PA01
cccggucagcuucgccgcc

SEQ ID NO: 1506611 - RNA, 23 nt, Pseudomonas aeruginosa PA01
cccggucagcuucgccgcccugg

SEQ ID NO: 1506612 - RNA, 15 nt, Pseudomonas aeruginosa PA01
cccggucaggccgau

SEQ ID NO: 1506613 - RNA, 16 nt, Pseudomonas aeruginosa PA01
cccggucacgccggga

SEQ ID NO: 1506614 - RNA, 16 nt, Pseudomonas aeruginosa PA01
cccggucauggugccg

SEQ ID NO: 1506615 - RNA, 17 nt, Pseudomonas aeruginosa PA01
cccggucauggugccga

SEQ ID NO: 1506616 - RNA, 13 nt, Pseudomonas aeruginosa PA01
cccgguccgguga

SEQ ID NO: 1506617 - RNA, 17 nt, Pseudomonas aeruginosa PA01
cccgguccguccagcgc

SEQ ID NO: 1506618 - RNA, 15 nt, Pseudomonas aeruginosa PA01
cccggugcaggaaca

SEQ ID NO: 1506619 - RNA, 11 nt, Pseudomonas aeruginosa PA01
cccuucgcccu

SEQ ID NO: 1506620 - RNA, 21 nt, Pseudomonas aeruginosa PA01
cccuucgacaugggccgcgca

SEQ ID NO: 1506621 - RNA, 15 nt, Pseudomonas aeruginosa PA01
cccuucgaacccgcc

SEQ ID NO: 1506622 - RNA, 12 nt, Pseudomonas aeruginosa PA01
cccuggccggca

SEQ ID NO: 1506623 - RNA, 13 nt, Pseudomonas aeruginosa PA01
cccuggccggcga

SEQ ID NO: 1506624 - RNA, 19 nt, Pseudomonas aeruginosa PA01
cccuugaggaaguugcgca

SEQ ID NO: 1506625 - RNA, 20 nt, Pseudomonas aeruginosa PA01
cccuucuuuuauacccggcg

SEQ ID NO: 1506626 - RNA, 15 nt, Pseudomonas aeruginosa PA01
cccuugaagcgcuuc

SEQ ID NO: 1506627 - RNA, 16 nt, Pseudomonas aeruginosa PA01
cccuugaagcgcuucu

SEQ ID NO: 1506628 - RNA, 22 nt, Pseudomonas aeruginosa PA01
cccuucguccucguggcgcgcc

SEQ ID NO: 1506629 - RNA, 15 nt, Pseudomonas aeruginosa PA01
cccuucgugcuggcg

SEQ ID NO: 1506630 - RNA, 16 nt, Pseudomonas aeruginosa PA01
cccuucuccgccagcc

SEQ ID NO: 1506631 - RNA, 19 nt, Pseudomonas aeruginosa PA01
cccuggcagacgcugcucg

SEQ ID NO: 1506632 - RNA, 20 nt, Pseudomonas aeruginosa PA01
cccuggaucuccugggucga

SEQ ID NO: 1506633 - RNA, 21 nt, Pseudomonas aeruginosa PA01
cccuggaucugcgggaacuug

SEQ ID NO: 1506634 - RNA, 16 nt, Pseudomonas aeruginosa PA01
cccuggaucaccgcgg

SEQ ID NO: 1506635 - RNA, 18 nt, Pseudomonas aeruginosa PA01
cccuggaucaccgcggcg

SEQ ID NO: 1506636 - RNA, 23 nt, Pseudomonas aeruginosa PA01
cccuggccgaucagcuuggccuu

SEQ ID NO: 1506637 - RNA, 16 nt, Pseudomonas aeruginosa PA01
cccuggccuuggccac

SEQ ID NO: 1506638 - RNA, 19 nt, Pseudomonas aeruginosa PA01
cccuggcgcagacaggccu

SEQ ID NO: 1506639 - RNA, 14 nt, Pseudomonas aeruginosa PA01
cccuuggcggcgcc

SEQ ID NO: 1506640 - RNA, 15 nt, Pseudomonas aeruginosa PA01
cccuugcucgcggcg

SEQ ID NO: 1506641 - RNA, 23 nt, Pseudomonas aeruginosa PA01
cccuugcucgcggcguaggccuc

SEQ ID NO: 1506642 - RNA, 16 nt, Pseudomonas aeruginosa PA01
cccuugaucagcgcgc

SEQ ID NO: 1506643 - RNA, 17 nt, Pseudomonas aeruginosa PA01
cccuugaugaucagguc

SEQ ID NO: 1506644 - RNA, 23 nt, Pseudomonas aeruginosa PA01
cccuugaugaucaggucggccgc

SEQ ID NO: 1506645 - RNA, 19 nt, Pseudomonas aeruginosa PA01
cccuugcaaccgccgccgc

SEQ ID NO: 1506646 - RNA, 20 nt, Pseudomonas aeruginosa PA01
cccuugccauccuccagcac

SEQ ID NO: 1506647 - RNA, 12 nt, Pseudomonas aeruginosa PA01
cccuugcgccgc

SEQ ID NO: 1506648 - RNA, 13 nt, Pseudomonas aeruginosa PA01
cccuugcgcggcg

SEQ ID NO: 1506649 - RNA, 15 nt, Pseudomonas aeruginosa PA01
cccuugcgcggcgca

SEQ ID NO: 1506650 - RNA, 18 nt, Pseudomonas aeruginosa PA01
cccuugcgcucuggcgca

SEQ ID NO: 1506651 - RNA, 14 nt, Pseudomonas aeruginosa PA01
cccuugcggcccgc

SEQ ID NO: 1506652 - RNA, 21 nt, Pseudomonas aeruginosa PA01
cccuugcggcccgccucggcg

SEQ ID NO: 1506653 - RNA, 14 nt, Pseudomonas aeruginosa PA01
cccuuugccgagcg

SEQ ID NO: 1506654 - RNA, 17 nt, Pseudomonas aeruginosa PA01
cccuuuuccaccggccg

SEQ ID NO: 1506655 - RNA, 18 nt, Pseudomonas aeruginosa PA01
cccuuuuucaugcgcggg

SEQ ID NO: 1506656 - RNA, 15 nt, Pseudomonas aeruginosa PA01
cccuuuuucggcgcg

SEQ ID NO: 1506657 - RNA, 22 nt, Pseudomonas aeruginosa PA01
cccuuuuucgucgccagcccgg

SEQ ID NO: 1506658 - RNA, 16 nt, Pseudomonas aeruginosa PA01
cccuuuuuucagccug

SEQ ID NO: 1506659 - RNA, 23 nt, Pseudomonas aeruginosa PA01
cccuuggucaggccgaccagcgc

SEQ ID NO: 1506660 - RNA, 21 nt, Pseudomonas aeruginosa PA01
cccuuguacagcuucaggcgc

SEQ ID NO: 1506661 - RNA, 15 nt, Pseudomonas aeruginosa PA01
cccuuguagaucgac

SEQ ID NO: 1506662 - RNA, 18 nt, Pseudomonas aeruginosa PA01
cccugcuuggccagcgcg

SEQ ID NO: 1506663 - RNA, 19 nt, Pseudomonas aeruginosa PA01
cccugcuuggccagcgcgg

SEQ ID NO: 1506664 - RNA, 19 nt, Pseudomonas aeruginosa PA01
cccuggaaaggccucggcg

SEQ ID NO: 1506665 - RNA, 21 nt, Pseudomonas aeruginosa PA01
cccuggaaaggccucggcgau

SEQ ID NO: 1506666 - RNA, 22 nt, Pseudomonas aeruginosa PA01
cccuggaaaggccucggcgaug

SEQ ID NO: 1506667 - RNA, 18 nt, Pseudomonas aeruginosa PA01
cccugcuucgaacgugcg

SEQ ID NO: 1506668 - RNA, 13 nt, Pseudomonas aeruginosa PA01
cccugcuggcgca

SEQ ID NO: 1506669 - RNA, 20 nt, Pseudomonas aeruginosa PA01
cccugcuggcgcagccaggc

SEQ ID NO: 1506670 - RNA, 19 nt, Pseudomonas aeruginosa PA01
cccugcggaccgcagaacc

SEQ ID NO: 1506671 - RNA, 12 nt, Pseudomonas aeruginosa PA01
cccugcgcaagg

SEQ ID NO: 1506672 - RNA, 12 nt, Pseudomonas aeruginosa PA01
cccugcgcgcgc

SEQ ID NO: 1506673 - RNA, 20 nt, Pseudomonas aeruginosa PA01
cccugcgcgaucccccgccc

SEQ ID NO: 1506674 - RNA, 17 nt, Pseudomonas aeruginosa PA01
cccugcgccgcagcggc

SEQ ID NO: 1506675 - RNA, 12 nt, Pseudomonas aeruginosa PA01
cccugcgccuca

SEQ ID NO: 1506676 - RNA, 13 nt, Pseudomonas aeruginosa PA01
cccugccggcgca

SEQ ID NO: 1506677 - RNA, 22 nt, Pseudomonas aeruginosa PA01
cccugcgaccgugaggcgcagg

SEQ ID NO: 1506678 - RNA, 22 nt, Pseudomonas aeruginosa PA01
cccucgcggacgcuggcgauca

SEQ ID NO: 1506679 - RNA, 14 nt, Pseudomonas aeruginosa PA01
cccucgcggcggca

SEQ ID NO: 1506680 - RNA, 21 nt, Pseudomonas aeruginosa PA01
cccucgcuccaacgcaggcgc

SEQ ID NO: 1506681 - RNA, 13 nt, Pseudomonas aeruginosa PA01
cccucgcugagca

SEQ ID NO: 1506682 - RNA, 16 nt, Pseudomonas aeruginosa PA01
cccucgagcaccgcgg

SEQ ID NO: 1506683 - RNA, 15 nt, Pseudomonas aeruginosa PA01
cccucgcagccggcg

SEQ ID NO: 1506684 - RNA, 23 nt, Pseudomonas aeruginosa PA01
cccucgcaguacagcucggcgcc

SEQ ID NO: 1506685 - RNA, 18 nt, Pseudomonas aeruginosa PA01
cccucgccgaccgccaag

SEQ ID NO: 1506686 - RNA, 12 nt, Pseudomonas aeruginosa PA01
cccucgccguga

SEQ ID NO: 1506687 - RNA, 23 nt, Pseudomonas aeruginosa PA01
cccuacccgacaggcagcgccgc

SEQ ID NO: 1506688 - RNA, 14 nt, Pseudomonas aeruginosa PA01
cccuaccgcccacc

SEQ ID NO: 1506689 - RNA, 21 nt, Pseudomonas aeruginosa PA01
cccuacggggcgugucgaggg

SEQ ID NO: 1506690 - RNA, 20 nt, Pseudomonas aeruginosa PA01
cccuccuggaaagaccggcg

SEQ ID NO: 1506691 - RNA, 15 nt, Pseudomonas aeruginosa PA01
cccucgaagcccugc

SEQ ID NO: 1506692 - RNA, 21 nt, Pseudomonas aeruginosa PA01
cccucgacgauauccacgccg

SEQ ID NO: 1506693 - RNA, 13 nt, Pseudomonas aeruginosa PA01
cccucgaccuggc

SEQ ID NO: 1506694 - RNA, 22 nt, Pseudomonas aeruginosa PA01
ccgaacccgccucaaggugaag

SEQ ID NO: 1506695 - RNA, 17 nt, Pseudomonas aeruginosa PA01
ccgaacaggcgacggua

SEQ ID NO: 1506696 - RNA, 14 nt, Pseudomonas aeruginosa PA01
ccgaacagggcgaa

SEQ ID NO: 1506697 - RNA, 16 nt, Pseudomonas aeruginosa PA01
ccgaacagggcgaagg

SEQ ID NO: 1506698 - RNA, 19 nt, Pseudomonas aeruginosa PA01
ccgaacagggcgaaggcca

SEQ ID NO: 1506699 - RNA, 22 nt, Pseudomonas aeruginosa PA01
ccgaacagggcgagcagggcgc

SEQ ID NO: 1506700 - RNA, 23 nt, Pseudomonas aeruginosa PA01
ccgaacaggcgucccauggcgcc

SEQ ID NO: 1506701 - RNA, 13 nt, Pseudomonas aeruginosa PA01
ccgaacaugccga

SEQ ID NO: 1506702 - RNA, 16 nt, Pseudomonas aeruginosa PA01
ccgaacaguucggcgg

SEQ ID NO: 1506703 - RNA, 16 nt, Pseudomonas aeruginosa PA01
ccgaacaucagcagca

SEQ ID NO: 1506704 - RNA, 21 nt, Pseudomonas aeruginosa PA01
ccgaacgggaaguaggccugg

SEQ ID NO: 1506705 - RNA, 15 nt, Pseudomonas aeruginosa PA01
ccgaacuccgccagc

SEQ ID NO: 1506706 - RNA, 18 nt, Pseudomonas aeruginosa PA01
ccgaacuccgccagcacc

SEQ ID NO: 1506707 - RNA, 18 nt, Pseudomonas aeruginosa PA01
ccgaacgccaccagggcc

SEQ ID NO: 1506708 - RNA, 13 nt, Pseudomonas aeruginosa PA01
ccgaacgccgacc

SEQ ID NO: 1506709 - RNA, 17 nt, Pseudomonas aeruginosa PA01
ccgaacggaucgcgucg

SEQ ID NO: 1506710 - RNA, 18 nt, Pseudomonas aeruginosa PA01
ccgaacggaucgcgucgc

SEQ ID NO: 1506711 - RNA, 22 nt, Pseudomonas aeruginosa PA01
ccgaacggaucgcgucgcaggc

SEQ ID NO: 1506712 - RNA, 12 nt, Pseudomonas aeruginosa PA01
ccgaagccccgg

SEQ ID NO: 1506713 - RNA, 13 nt, Pseudomonas aeruginosa PA01
ccgaagccgcgca

SEQ ID NO: 1506714 - RNA, 17 nt, Pseudomonas aeruginosa PA01
ccgaagccgacgccgag

SEQ ID NO: 1506715 - RNA, 18 nt, Pseudomonas aeruginosa PA01
ccgaagccgacgccgagc

SEQ ID NO: 1506716 - RNA, 13 nt, Pseudomonas aeruginosa PA01
ccgaagccgccgg

SEQ ID NO: 1506717 - RNA, 16 nt, Pseudomonas aeruginosa PA01
ccgaagaacucggcgc

SEQ ID NO: 1506718 - RNA, 16 nt, Pseudomonas aeruginosa PA01
ccgaacucgaacgcgu

SEQ ID NO: 1506719 - RNA, 12 nt, Pseudomonas aeruginosa PA01
ccgaacucgccg

SEQ ID NO: 1506720 - RNA, 15 nt, Pseudomonas aeruginosa PA01
ccgaacuuccgccga

SEQ ID NO: 1506721 - RNA, 17 nt, Pseudomonas aeruginosa PA01
ccgaacuuccgccgaau

SEQ ID NO: 1506722 - RNA, 20 nt, Pseudomonas aeruginosa PA01
ccgaagacgccugucggcac

SEQ ID NO: 1506723 - RNA, 16 nt, Pseudomonas aeruginosa PA01
ccgaagaccaccaugg

SEQ ID NO: 1506724 - RNA, 21 nt, Pseudomonas aeruginosa PA01
ccgaagaucgacaggccgccg

SEQ ID NO: 1506725 - RNA, 19 nt, Pseudomonas aeruginosa PA01
ccgaagaggcccucggcgc

SEQ ID NO: 1506726 - RNA, 20 nt, Pseudomonas aeruginosa PA01
ccgaagcugucgagcacggc

SEQ ID NO: 1506727 - RNA, 20 nt, Pseudomonas aeruginosa PA01
ccgaaggcaacagcccgcgc

SEQ ID NO: 1506728 - RNA, 22 nt, Pseudomonas aeruginosa PA01
ccgaaggcaacagcccgcgccg

SEQ ID NO: 1506729 - RNA, 21 nt, Pseudomonas aeruginosa PA01
ccgaaggccaggccggcgccu

SEQ ID NO: 1506730 - RNA, 24 nt, Pseudomonas aeruginosa PA01
ccgaaggccaggccggcgccuugc

SEQ ID NO: 1506731 - RNA, 16 nt, Pseudomonas aeruginosa PA01
ccgaaggccuggccgu

SEQ ID NO: 1506732 - RNA, 19 nt, Pseudomonas aeruginosa PA01
ccgaaggcgauauggccga

SEQ ID NO: 1506733 - RNA, 17 nt, Pseudomonas aeruginosa PA01
ccgaagggaacccgcgg

SEQ ID NO: 1506734 - RNA, 17 nt, Pseudomonas aeruginosa PA01
ccgaagguacugccgcu

SEQ ID NO: 1506735 - RNA, 19 nt, Pseudomonas aeruginosa PA01
ccgaagguacugccgcuau

SEQ ID NO: 1506736 - RNA, 23 nt, Pseudomonas aeruginosa PA01
ccgaagguacugccgcuaucgcu

SEQ ID NO: 1506737 - RNA, 18 nt, Pseudomonas aeruginosa PA01
ccgaaggucgccguccug

SEQ ID NO: 1506738 - RNA, 17 nt, Pseudomonas aeruginosa PA01
ccgaaggugcaggccgc

SEQ ID NO: 1506739 - RNA, 18 nt, Pseudomonas aeruginosa PA01
ccgaaggcgucauccgcc

SEQ ID NO: 1506740 - RNA, 16 nt, Pseudomonas aeruginosa PA01
ccgaaggcgucgggca

SEQ ID NO: 1506741 - RNA, 20 nt, Pseudomonas aeruginosa PA01
ccgaaggcgugggcgccggc

SEQ ID NO: 1506742 - RNA, 23 nt, Pseudomonas aeruginosa PA01
ccgaaggcgugggcgccggcgcg

SEQ ID NO: 1506743 - RNA, 16 nt, Pseudomonas aeruginosa PA01
ccgaagucgcccgccg

SEQ ID NO: 1506744 - RNA, 17 nt, Pseudomonas aeruginosa PA01
ccgaagucgcccgccgg

SEQ ID NO: 1506745 - RNA, 18 nt, Pseudomonas aeruginosa PA01
ccgaagucgcccgccggc

SEQ ID NO: 1506746 - RNA, 14 nt, Pseudomonas aeruginosa PA01
caggucgacgccau

SEQ ID NO: 1506747 - RNA, 16 nt, Pseudomonas aeruginosa PA01
caggucgacgccgccg

SEQ ID NO: 1506748 - RNA, 20 nt, Pseudomonas aeruginosa PA01
caggucgaggcgcuccaccg

SEQ ID NO: 1506749 - RNA, 15 nt, Pseudomonas aeruginosa PA01
caggucgaggccgcg

SEQ ID NO: 1506750 - RNA, 17 nt, Pseudomonas aeruginosa PA01
cagguccugucccagcg

SEQ ID NO: 1506751 - RNA, 20 nt, Pseudomonas aeruginosa PA01
caggucgaacugcacccgcc

SEQ ID NO: 1506752 - RNA, 13 nt, Pseudomonas aeruginosa PA01
caggucggccgcc

SEQ ID NO: 1506753 - RNA, 15 nt, Pseudomonas aeruginosa PA01
caggucggccgccuc

SEQ ID NO: 1506754 - RNA, 12 nt, Pseudomonas aeruginosa PA01
caggucggccgc

SEQ ID NO: 1506755 - RNA, 15 nt, Pseudomonas aeruginosa PA01
caggucgaugcccag

SEQ ID NO: 1506756 - RNA, 17 nt, Pseudomonas aeruginosa PA01
caggucgauguggcugg

SEQ ID NO: 1506757 - RNA, 20 nt, Pseudomonas aeruginosa PA01
caggucgagguucuccaggc

SEQ ID NO: 1506758 - RNA, 15 nt, Pseudomonas aeruginosa PA01
caggucgagggugau

SEQ ID NO: 1506759 - RNA, 20 nt, Pseudomonas aeruginosa PA01
caggucgaucagcagcagcg

SEQ ID NO: 1506760 - RNA, 21 nt, Pseudomonas aeruginosa PA01
caggucgaucagcagcagcgc

SEQ ID NO: 1506761 - RNA, 14 nt, Pseudomonas aeruginosa PA01
cagguccggcagcg

SEQ ID NO: 1506762 - RNA, 17 nt, Pseudomonas aeruginosa PA01
cagguccggcagcgccu

SEQ ID NO: 1506763 - RNA, 16 nt, Pseudomonas aeruginosa PA01
cagguccgcgccucgc

SEQ ID NO: 1506764 - RNA, 17 nt, Pseudomonas aeruginosa PA01
cagguccgcgccucgcg

SEQ ID NO: 1506765 - RNA, 18 nt, Pseudomonas aeruginosa PA01
cagguccgcgccucgcgc

SEQ ID NO: 1506766 - RNA, 14 nt, Pseudomonas aeruginosa PA01
cagguccuggaaca

SEQ ID NO: 1506767 - RNA, 15 nt, Pseudomonas aeruginosa PA01
caggucgaacagcgg

SEQ ID NO: 1506768 - RNA, 16 nt, Pseudomonas aeruginosa PA01
caggucgaacagcggc

SEQ ID NO: 1506769 - RNA, 23 nt, Pseudomonas aeruginosa PA01
cagguagccaggggucaggccga

SEQ ID NO: 1506770 - RNA, 22 nt, Pseudomonas aeruginosa PA01
cagguagacgcaggugcccugg

SEQ ID NO: 1506771 - RNA, 16 nt, Pseudomonas aeruginosa PA01
cagguagagcagcccg

SEQ ID NO: 1506772 - RNA, 20 nt, Pseudomonas aeruginosa PA01
cagguagaccacgcaggcca

SEQ ID NO: 1506773 - RNA, 15 nt, Pseudomonas aeruginosa PA01
cagguagccgcgccg

SEQ ID NO: 1506774 - RNA, 17 nt, Pseudomonas aeruginosa PA01
cagguagccgcgccggc

SEQ ID NO: 1506775 - RNA, 14 nt, Pseudomonas aeruginosa PA01
cagguagccggcga

SEQ ID NO: 1506776 - RNA, 16 nt, Pseudomonas aeruginosa PA01
cagguagccggcgagc

SEQ ID NO: 1506777 - RNA, 18 nt, Pseudomonas aeruginosa PA01
cagguagccugcggccag

SEQ ID NO: 1506778 - RNA, 21 nt, Pseudomonas aeruginosa PA01
caggguggugaacaggcggau

SEQ ID NO: 1506779 - RNA, 19 nt, Pseudomonas aeruginosa PA01
caggguggggaugcgcgag

SEQ ID NO: 1506780 - RNA, 24 nt, Pseudomonas aeruginosa PA01
caggguggcgcgcaccaccuggca

SEQ ID NO: 1506781 - RNA, 14 nt, Pseudomonas aeruginosa PA01
caggguggcggcgg

SEQ ID NO: 1506782 - RNA, 17 nt, Pseudomonas aeruginosa PA01
caggguggcggcggcga

SEQ ID NO: 1506783 - RNA, 19 nt, Pseudomonas aeruginosa PA01
caggguggcggcggcgagu

SEQ ID NO: 1506784 - RNA, 15 nt, Pseudomonas aeruginosa PA01
caggguggcgggcgg

SEQ ID NO: 1506785 - RNA, 19 nt, Pseudomonas aeruginosa PA01
caggguguuguucgccagc

SEQ ID NO: 1506786 - RNA, 22 nt, Pseudomonas aeruginosa PA01
cagguacggaagcggccgagca

SEQ ID NO: 1506787 - RNA, 14 nt, Pseudomonas aeruginosa PA01
cagguacggcgccg

SEQ ID NO: 1506788 - RNA, 15 nt, Pseudomonas aeruginosa PA01
cagguacggcgccgc

SEQ ID NO: 1506789 - RNA, 14 nt, Pseudomonas aeruginosa PA01
cagguacucgccgg

SEQ ID NO: 1506790 - RNA, 16 nt, Pseudomonas aeruginosa PA01
cagguacucgccggcg

SEQ ID NO: 1506791 - RNA, 15 nt, Pseudomonas aeruginosa PA01
cagguacucggcccg

SEQ ID NO: 1506792 - RNA, 18 nt, Pseudomonas aeruginosa PA01
cagguacucggcccgggc

SEQ ID NO: 1506793 - RNA, 14 nt, Pseudomonas aeruginosa PA01
cagguacugggcga

SEQ ID NO: 1506794 - RNA, 18 nt, Pseudomonas aeruginosa PA01
cagguacuuggccacgcc

SEQ ID NO: 1506795 - RNA, 20 nt, Pseudomonas aeruginosa PA01
cagguagaagaacaucggcg

SEQ ID NO: 1506796 - RNA, 16 nt, Pseudomonas aeruginosa PA01
caggguggcgaucacg

SEQ ID NO: 1506797 - RNA, 17 nt, Pseudomonas aeruginosa PA01
cagggucuucaggccga

SEQ ID NO: 1506798 - RNA, 16 nt, Pseudomonas aeruginosa PA01
cagggucuucaggcgc

SEQ ID NO: 1506799 - RNA, 17 nt, Pseudomonas aeruginosa PA01
cagggucuucaggcgcc

SEQ ID NO: 1506800 - RNA, 14 nt, Pseudomonas aeruginosa PA01
cagggucuugccga

SEQ ID NO: 1506801 - RNA, 17 nt, Pseudomonas aeruginosa PA01
cagggucuugccgaccu

SEQ ID NO: 1506802 - RNA, 20 nt, Pseudomonas aeruginosa PA01
cagggucuugccgaccuuca

SEQ ID NO: 1506803 - RNA, 20 nt, Pseudomonas aeruginosa PA01
cagggucgguucgcggcgca

SEQ ID NO: 1506804 - RNA, 17 nt, Pseudomonas aeruginosa PA01
cagggucagucgagcag

SEQ ID NO: 1506805 - RNA, 14 nt, Pseudomonas aeruginosa PA01
cagggucuccagga

SEQ ID NO: 1506806 - RNA, 15 nt, Pseudomonas aeruginosa PA01
cagggucucgcgggc

SEQ ID NO: 1506807 - RNA, 12 nt, Pseudomonas aeruginosa PA01
cagggucgccag

SEQ ID NO: 1506808 - RNA, 16 nt, Pseudomonas aeruginosa PA01
cagggucgccagcagg

SEQ ID NO: 1506809 - RNA, 22 nt, Pseudomonas aeruginosa PA01
cagggucgcccgugccucggcg

SEQ ID NO: 1506810 - RNA, 22 nt, Pseudomonas aeruginosa PA01
caggguccgcuucagcgcgccg

SEQ ID NO: 1506811 - RNA, 22 nt, Pseudomonas aeruginosa PA01
cagggucgcguagaccaucgcc

SEQ ID NO: 1506812 - RNA, 19 nt, Pseudomonas aeruginosa PA01
cagggucgcuuccucggca

SEQ ID NO: 1506813 - RNA, 14 nt, Pseudomonas aeruginosa PA01
cagggucggcaccg

SEQ ID NO: 1506814 - RNA, 19 nt, Pseudomonas aeruginosa PA01
cagggucggcaccgagccg

SEQ ID NO: 1506815 - RNA, 17 nt, Pseudomonas aeruginosa PA01
cagggucggcaccugca

SEQ ID NO: 1506816 - RNA, 22 nt, Pseudomonas aeruginosa PA01
cagggucggcaccugcagacgg

SEQ ID NO: 1506817 - RNA, 18 nt, Pseudomonas aeruginosa PA01
cagggucggcaggaccga

SEQ ID NO: 1506818 - RNA, 17 nt, Pseudomonas aeruginosa PA01
cagggucagcuggcgcg

SEQ ID NO: 1506819 - RNA, 14 nt, Pseudomonas aeruginosa PA01
cagggucagcagcg

SEQ ID NO: 1506820 - RNA, 16 nt, Pseudomonas aeruginosa PA01
cagggucagcagcgcc

SEQ ID NO: 1506821 - RNA, 17 nt, Pseudomonas aeruginosa PA01
cagggucagcagcgcca

SEQ ID NO: 1506822 - RNA, 17 nt, Pseudomonas aeruginosa PA01
cagggcucgugccauca

SEQ ID NO: 1506823 - RNA, 19 nt, Pseudomonas aeruginosa PA01
cagggcucgugccaucagg

SEQ ID NO: 1506824 - RNA, 23 nt, Pseudomonas aeruginosa PA01
cagggcucgugccaucaggccgc

SEQ ID NO: 1506825 - RNA, 23 nt, Pseudomonas aeruginosa PA01
cagggcguucuucacccgcagcg

SEQ ID NO: 1506826 - RNA, 17 nt, Pseudomonas aeruginosa PA01
cagggcguggucggcgg

SEQ ID NO: 1506827 - RNA, 19 nt, Pseudomonas aeruginosa PA01
cagggcguggucggcggcc

SEQ ID NO: 1506828 - RNA, 21 nt, Pseudomonas aeruginosa PA01
cagggcguggucggcggccuc

SEQ ID NO: 1506829 - RNA, 17 nt, Pseudomonas aeruginosa PA01
cagggcgucgucgaggc

SEQ ID NO: 1506830 - RNA, 20 nt, Pseudomonas aeruginosa PA01
cagggcgucgcccucggcgc

SEQ ID NO: 1506831 - RNA, 16 nt, Pseudomonas aeruginosa PA01
cagggcgucgccggga

SEQ ID NO: 1506832 - RNA, 17 nt, Pseudomonas aeruginosa PA01
caggggcacgcuggcga

SEQ ID NO: 1506833 - RNA, 20 nt, Pseudomonas aeruginosa PA01
caggggcacgcuggcgagaa

SEQ ID NO: 1506834 - RNA, 14 nt, Pseudomonas aeruginosa PA01
caggggagcgccgg

SEQ ID NO: 1506835 - RNA, 21 nt, Pseudomonas aeruginosa PA01
cagggcugggcgcccuucagc

SEQ ID NO: 1506836 - RNA, 15 nt, Pseudomonas aeruginosa PA01
cagggcuucccaggc

SEQ ID NO: 1506837 - RNA, 17 nt, Pseudomonas aeruginosa PA01
cagggcuucccaggcca

SEQ ID NO: 1506838 - RNA, 21 nt, Pseudomonas aeruginosa PA01
cagggcuucccaggccagcgg

SEQ ID NO: 1506839 - RNA, 13 nt, Pseudomonas aeruginosa PA01
cagggcuucgcgg

SEQ ID NO: 1506840 - RNA, 15 nt, Pseudomonas aeruginosa PA01
cagggcuugugcaga

SEQ ID NO: 1506841 - RNA, 20 nt, Pseudomonas aeruginosa PA01
caggggcauguccaccgccg

SEQ ID NO: 1506842 - RNA, 19 nt, Pseudomonas aeruginosa PA01
caggggccgaugccgggca

SEQ ID NO: 1506843 - RNA, 15 nt, Pseudomonas aeruginosa PA01
caggggcgcgccggc

SEQ ID NO: 1506844 - RNA, 14 nt, Pseudomonas aeruginosa PA01
caggggcgcggcgc

SEQ ID NO: 1506845 - RNA, 16 nt, Pseudomonas aeruginosa PA01
caggggcgcggcgcgg

SEQ ID NO: 1506846 - RNA, 16 nt, Pseudomonas aeruginosa PA01
caggggcuagucgcgc

SEQ ID NO: 1506847 - RNA, 19 nt, Pseudomonas aeruginosa PA01
caggggcuagucgcgcagc

SEQ ID NO: 1506848 - RNA, 17 nt, Pseudomonas aeruginosa PA01
caggggguagggcgaau

SEQ ID NO: 1506849 - RNA, 17 nt, Pseudomonas aeruginosa PA01
caggggauggucgguga

SEQ ID NO: 1506850 - RNA, 18 nt, Pseudomonas aeruginosa PA01
caggggcugaacagcgcc

SEQ ID NO: 1506851 - RNA, 14 nt, Pseudomonas aeruginosa PA01
cagggucacgccag

SEQ ID NO: 1506852 - RNA, 15 nt, Pseudomonas aeruginosa PA01
cagggucacgccaga

SEQ ID NO: 1506853 - RNA, 14 nt, Pseudomonas aeruginosa PA01
cagggucacgccga

SEQ ID NO: 1506854 - RNA, 15 nt, Pseudomonas aeruginosa PA01
cagggucacgccgau

SEQ ID NO: 1506855 - RNA, 19 nt, Pseudomonas aeruginosa PA01
cagggucacgccgcggcug

SEQ ID NO: 1506856 - RNA, 14 nt, Pseudomonas aeruginosa PA01
caggguaccgcugg

SEQ ID NO: 1506857 - RNA, 20 nt, Pseudomonas aeruginosa PA01
caggguaccgcuggcgcugg

SEQ ID NO: 1506858 - RNA, 16 nt, Pseudomonas aeruginosa PA01
caggggucaggccgau

SEQ ID NO: 1506859 - RNA, 14 nt, Pseudomonas aeruginosa PA01
caggggucggcauc

SEQ ID NO: 1506860 - RNA, 16 nt, Pseudomonas aeruginosa PA01
cagggcggcgccugga

SEQ ID NO: 1506861 - RNA, 14 nt, Pseudomonas aeruginosa PA01
cagggcguagcgga

SEQ ID NO: 1506862 - RNA, 18 nt, Pseudomonas aeruginosa PA01
cagggcguagcggaagcc

SEQ ID NO: 1506863 - RNA, 21 nt, Pseudomonas aeruginosa PA01
cagggcguccaguagcgccug

SEQ ID NO: 1506864 - RNA, 21 nt, Pseudomonas aeruginosa PA01
cagggcgucccguuccggcgc

SEQ ID NO: 1506865 - RNA, 17 nt, Pseudomonas aeruginosa PA01
cagggcgucgaaggcgg

SEQ ID NO: 1506866 - RNA, 20 nt, Pseudomonas aeruginosa PA01
cagggcgucgaaggcggcgc

SEQ ID NO: 1506867 - RNA, 13 nt, Pseudomonas aeruginosa PA01
cagggcggcgagc

SEQ ID NO: 1506868 - RNA, 16 nt, Pseudomonas aeruginosa PA01
cagggcggcgagcugg

SEQ ID NO: 1506869 - RNA, 23 nt, Pseudomonas aeruginosa PA01
cagggcggcgccgaacagggcga

SEQ ID NO: 1506870 - RNA, 18 nt, Pseudomonas aeruginosa PA01
cagggcgggccgcucgcg

SEQ ID NO: 1506871 - RNA, 21 nt, Pseudomonas aeruginosa PA01
cagggcgggccgcucgcgcgg

SEQ ID NO: 1506872 - RNA, 17 nt, Pseudomonas aeruginosa PA01
cagggcgguacgccgcg

SEQ ID NO: 1506873 - RNA, 15 nt, Pseudomonas aeruginosa PA01
cagggcggucggcca

SEQ ID NO: 1506874 - RNA, 17 nt, Pseudomonas aeruginosa PA01
cagggcggucggccagg

SEQ ID NO: 1506875 - RNA, 22 nt, Pseudomonas aeruginosa PA01
cagggcggugagguugccgccg

SEQ ID NO: 1506876 - RNA, 14 nt, Pseudomonas aeruginosa PA01
cagggcgcucaccg

SEQ ID NO: 1506877 - RNA, 18 nt, Pseudomonas aeruginosa PA01
cagggcgcucaccgaggc

SEQ ID NO: 1506878 - RNA, 23 nt, Pseudomonas aeruginosa PA01
cagggcgcugaccaggucgugga

SEQ ID NO: 1506879 - RNA, 13 nt, Pseudomonas aeruginosa PA01
cagggcgcugagc

SEQ ID NO: 1506880 - RNA, 19 nt, Pseudomonas aeruginosa PA01
cagggcgcugccgaucagc

SEQ ID NO: 1506881 - RNA, 17 nt, Pseudomonas aeruginosa PA01
cagggcgcguccagcuc

SEQ ID NO: 1506882 - RNA, 17 nt, Pseudomonas aeruginosa PA01
cagggccucgggcggga

SEQ ID NO: 1506883 - RNA, 18 nt, Pseudomonas aeruginosa PA01
cagggccucgggcgggau

SEQ ID NO: 1506884 - RNA, 20 nt, Pseudomonas aeruginosa PA01
cagggccucggggccguccg

SEQ ID NO: 1506885 - RNA, 14 nt, Pseudomonas aeruginosa PA01
cagggccuugcuga

SEQ ID NO: 1506886 - RNA, 17 nt, Pseudomonas aeruginosa PA01
cagggcgaacagcgccg

SEQ ID NO: 1506887 - RNA, 19 nt, Pseudomonas aeruginosa PA01
cagggcgaacagcgccgcg

SEQ ID NO: 1506888 - RNA, 13 nt, Pseudomonas aeruginosa PA01
cagggcgaaccac

SEQ ID NO: 1506889 - RNA, 11 nt, Pseudomonas aeruginosa PA01
cagggccggcg

SEQ ID NO: 1506890 - RNA, 16 nt, Pseudomonas aeruginosa PA01
cagggccugcuccagc

SEQ ID NO: 1506891 - RNA, 14 nt, Pseudomonas aeruginosa PA01
cagggccuggcgca

SEQ ID NO: 1506892 - RNA, 19 nt, Pseudomonas aeruginosa PA01
cagggccuggcgcacggcc

SEQ ID NO: 1506893 - RNA, 20 nt, Pseudomonas aeruginosa PA01
cagggccuggcgcacggccu

SEQ ID NO: 1506894 - RNA, 14 nt, Pseudomonas aeruginosa PA01
cagggccugguaga

SEQ ID NO: 1506895 - RNA, 21 nt, Pseudomonas aeruginosa PA01
cagggcgaggaucacgcagca

SEQ ID NO: 1506896 - RNA, 14 nt, Pseudomonas aeruginosa PA01
cagggcgagcaggg

SEQ ID NO: 1506897 - RNA, 15 nt, Pseudomonas aeruginosa PA01
cagggcgacgccgau

SEQ ID NO: 1506898 - RNA, 17 nt, Pseudomonas aeruginosa PA01
cagggcgacgccgaugc

SEQ ID NO: 1506899 - RNA, 15 nt, Pseudomonas aeruginosa PA01
cagggcgaccagaag

SEQ ID NO: 1506900 - RNA, 17 nt, Pseudomonas aeruginosa PA01
cagggcgaagucggcgc

SEQ ID NO: 1506901 - RNA, 18 nt, Pseudomonas aeruginosa PA01
cagggcgaagucggcgcg

SEQ ID NO: 1506902 - RNA, 19 nt, Pseudomonas aeruginosa PA01
cagggcgaagucggcgcgc

SEQ ID NO: 1506903 - RNA, 20 nt, Pseudomonas aeruginosa PA01
cagggcgaaggccaccaucg

SEQ ID NO: 1506904 - RNA, 19 nt, Pseudomonas aeruginosa PA01
cagggcgaugccgauggcg

SEQ ID NO: 1506905 - RNA, 18 nt, Pseudomonas aeruginosa PA01
cagggcgauccgcccgca

SEQ ID NO: 1506906 - RNA, 18 nt, Pseudomonas aeruginosa PA01
cagggcgaucgucgagau

SEQ ID NO: 1506907 - RNA, 17 nt, Pseudomonas aeruginosa PA01
cagucccaggccaacca

SEQ ID NO: 1506908 - RNA, 18 nt, Pseudomonas aeruginosa PA01
cagucaccaggucgcgga

SEQ ID NO: 1506909 - RNA, 20 nt, Pseudomonas aeruginosa PA01
caguauuucucgacuuccgc

SEQ ID NO: 1506910 - RNA, 21 nt, Pseudomonas aeruginosa PA01
cagucagaacacacgaauggc

SEQ ID NO: 1506911 - RNA, 15 nt, Pseudomonas aeruginosa PA01
cagucaggaucggcg

SEQ ID NO: 1506912 - RNA, 12 nt, Pseudomonas aeruginosa PA01
cagucccgccag

SEQ ID NO: 1506913 - RNA, 16 nt, Pseudomonas aeruginosa PA01
cagucccgccaggcgc

SEQ ID NO: 1506914 - RNA, 15 nt, Pseudomonas aeruginosa PA01
cagucccgcgcggcc

SEQ ID NO: 1506915 - RNA, 16 nt, Pseudomonas aeruginosa PA01
cagucccgcgcggccc

SEQ ID NO: 1506916 - RNA, 16 nt, Pseudomonas aeruginosa PA01
cagucccgcggcgcgu

SEQ ID NO: 1506917 - RNA, 19 nt, Pseudomonas aeruginosa PA01
cagucgaaaaccggcgggc

SEQ ID NO: 1506918 - RNA, 22 nt, Pseudomonas aeruginosa PA01
cagucgagguagaucauuuucc

SEQ ID NO: 1506919 - RNA, 19 nt, Pseudomonas aeruginosa PA01
cagucgaccgucgccacgc

SEQ ID NO: 1506920 - RNA, 16 nt, Pseudomonas aeruginosa PA01
cagucgagacgccagc

SEQ ID NO: 1506921 - RNA, 13 nt, Pseudomonas aeruginosa PA01
cagucgaugacga

SEQ ID NO: 1506922 - RNA, 18 nt, Pseudomonas aeruginosa PA01
cagucgcccgcuucgcca

SEQ ID NO: 1506923 - RNA, 17 nt, Pseudomonas aeruginosa PA01
cagucgcccccaccgcc

SEQ ID NO: 1506924 - RNA, 19 nt, Pseudomonas aeruginosa PA01
cagucgguuagaauaccgg

SEQ ID NO: 1506925 - RNA, 23 nt, Pseudomonas aeruginosa PA01
cagucgguuagaauaccggccug

SEQ ID NO: 1506926 - RNA, 13 nt, Pseudomonas aeruginosa PA01
cagucggggcagg

SEQ ID NO: 1506927 - RNA, 15 nt, Pseudomonas aeruginosa PA01
cagucggggcaggcg

SEQ ID NO: 1506928 - RNA, 17 nt, Pseudomonas aeruginosa PA01
cagucggggcaggcgca

SEQ ID NO: 1506929 - RNA, 23 nt, Pseudomonas aeruginosa PA01
cagucgccgcaccggcgauggcc

SEQ ID NO: 1506930 - RNA, 14 nt, Pseudomonas aeruginosa PA01
cagucgccgccagu

SEQ ID NO: 1506931 - RNA, 16 nt, Pseudomonas aeruginosa PA01
cagucgcacagccagg

SEQ ID NO: 1506932 - RNA, 15 nt, Pseudomonas aeruginosa PA01
cagucuucgccggcc

SEQ ID NO: 1506933 - RNA, 15 nt, Pseudomonas aeruginosa PA01
cagugcggcagucgg

SEQ ID NO: 1506934 - RNA, 20 nt, Pseudomonas aeruginosa PA01
cagugcgcgguccgcguggu

SEQ ID NO: 1506935 - RNA, 15 nt, Pseudomonas aeruginosa PA01
cagugcgccgcagcg

SEQ ID NO: 1506936 - RNA, 17 nt, Pseudomonas aeruginosa PA01
cagugcgccgcagcgca

SEQ ID NO: 1506937 - RNA, 20 nt, Pseudomonas aeruginosa PA01
cagugcacguuccagcucgg

SEQ ID NO: 1506938 - RNA, 15 nt, Pseudomonas aeruginosa PA01
cagguuggccccgcc

SEQ ID NO: 1506939 - RNA, 16 nt, Pseudomonas aeruginosa PA01
cagguuggcgccgggc

SEQ ID NO: 1506940 - RNA, 19 nt, Pseudomonas aeruginosa PA01
cagguuggcgccgggcgcg

SEQ ID NO: 1506941 - RNA, 20 nt, Pseudomonas aeruginosa PA01
cagguuggcgccgggcgcga

SEQ ID NO: 1506942 - RNA, 17 nt, Pseudomonas aeruginosa PA01
caguaccggcagcgccg

SEQ ID NO: 1506943 - RNA, 19 nt, Pseudomonas aeruginosa PA01
caguaccggcagcgccgag

SEQ ID NO: 1506944 - RNA, 18 nt, Pseudomonas aeruginosa PA01
cagguugugcucgaucac

SEQ ID NO: 1506945 - RNA, 15 nt, Pseudomonas aeruginosa PA01
cagguuguucggcga

SEQ ID NO: 1506946 - RNA, 17 nt, Pseudomonas aeruginosa PA01
caguacgaucagccagg

SEQ ID NO: 1506947 - RNA, 15 nt, Pseudomonas aeruginosa PA01
caguaggcgcugccg

SEQ ID NO: 1506948 - RNA, 22 nt, Pseudomonas aeruginosa PA01
caguagguagagaugcagcagg

SEQ ID NO: 1506949 - RNA, 23 nt, Pseudomonas aeruginosa PA01
caguagguagagaugcagcaggu

SEQ ID NO: 1506950 - RNA, 16 nt, Pseudomonas aeruginosa PA01
caguagcucgccgagg

SEQ ID NO: 1506951 - RNA, 19 nt, Pseudomonas aeruginosa PA01
caguagcggaagcacggcu

SEQ ID NO: 1506952 - RNA, 16 nt, Pseudomonas aeruginosa PA01
caguaguucuccaccg

SEQ ID NO: 1506953 - RNA, 19 nt, Pseudomonas aeruginosa PA01
caguaguucuccaccgcca

SEQ ID NO: 1506954 - RNA, 17 nt, Pseudomonas aeruginosa PA01
caguagaugccgcgucg

SEQ ID NO: 1506955 - RNA, 16 nt, Pseudomonas aeruginosa PA01
caguacgucgagaccg

SEQ ID NO: 1506956 - RNA, 17 nt, Pseudomonas aeruginosa PA01
caguacgucgagaccga

SEQ ID NO: 1506957 - RNA, 21 nt, Pseudomonas aeruginosa PA01
caguacguggcgcuugagcag

SEQ ID NO: 1506958 - RNA, 16 nt, Pseudomonas aeruginosa PA01
caguacuccgagggcc

SEQ ID NO: 1506959 - RNA, 17 nt, Pseudomonas aeruginosa PA01
caguacuugaacagcag

SEQ ID NO: 1506960 - RNA, 18 nt, Pseudomonas aeruginosa PA01
caguacuuggccagcagc

SEQ ID NO: 1506961 - RNA, 22 nt, Pseudomonas aeruginosa PA01
cagguucgcguggcccggcgcg

SEQ ID NO: 1506962 - RNA, 23 nt, Pseudomonas aeruginosa PA01
cagguucgcguggcccggcgcgg

SEQ ID NO: 1506963 - RNA, 14 nt, Pseudomonas aeruginosa PA01
cagguucggcagcg

SEQ ID NO: 1506964 - RNA, 21 nt, Pseudomonas aeruginosa PA01
cagguucggcgguagcgcgaa

SEQ ID NO: 1506965 - RNA, 20 nt, Pseudomonas aeruginosa PA01
cagguugaccccgcggccga

SEQ ID NO: 1506966 - RNA, 21 nt, Pseudomonas aeruginosa PA01
cagguugaccccgcggccgag

SEQ ID NO: 1506967 - RNA, 17 nt, Pseudomonas aeruginosa PA01
cagguugaccuucuguc

SEQ ID NO: 1506968 - RNA, 19 nt, Pseudomonas aeruginosa PA01
cagguugacgaugcggccc

SEQ ID NO: 1506969 - RNA, 23 nt, Pseudomonas aeruginosa PA01
cagguugacgaugcggcccgccg

SEQ ID NO: 1506970 - RNA, 12 nt, Pseudomonas aeruginosa PA01
cagguugcgcug

SEQ ID NO: 1506971 - RNA, 17 nt, Pseudomonas aeruginosa PA01
cagguugcgcuggcgca

SEQ ID NO: 1506972 - RNA, 19 nt, Pseudomonas aeruginosa PA01
cagguugcgcuggcgcagc

SEQ ID NO: 1506973 - RNA, 14 nt, Pseudomonas aeruginosa PA01
cagguugcucgccu

SEQ ID NO: 1506974 - RNA, 14 nt, Pseudomonas aeruginosa PA01
cagguugcuggcga

SEQ ID NO: 1506975 - RNA, 16 nt, Pseudomonas aeruginosa PA01
cagguugccggcgugc

SEQ ID NO: 1506976 - RNA, 15 nt, Pseudomonas aeruginosa PA01
cagguugagggccgc

SEQ ID NO: 1506977 - RNA, 16 nt, Pseudomonas aeruginosa PA01
cagguugagggccgcg

SEQ ID NO: 1506978 - RNA, 22 nt, Pseudomonas aeruginosa PA01
caggucggcgaaauccucgcgc

SEQ ID NO: 1506979 - RNA, 12 nt, Pseudomonas aeruginosa PA01
caggucggccuc

SEQ ID NO: 1506980 - RNA, 17 nt, Pseudomonas aeruginosa PA01
caggucggccucggcga

SEQ ID NO: 1506981 - RNA, 11 nt, Pseudomonas aeruginosa PA01
caggucggcgc

SEQ ID NO: 1506982 - RNA, 13 nt, Pseudomonas aeruginosa PA01
caggucggcggca

SEQ ID NO: 1506983 - RNA, 15 nt, Pseudomonas aeruginosa PA01
caggucggcggcacg

SEQ ID NO: 1506984 - RNA, 14 nt, Pseudomonas aeruginosa PA01
caggucggcgcgac

SEQ ID NO: 1506985 - RNA, 15 nt, Pseudomonas aeruginosa PA01
caggucggcgcgacg

SEQ ID NO: 1506986 - RNA, 17 nt, Pseudomonas aeruginosa PA01
caggucggcgcgcaccu

SEQ ID NO: 1506987 - RNA, 17 nt, Pseudomonas aeruginosa PA01
caggucggcgcgcgaca

SEQ ID NO: 1506988 - RNA, 19 nt, Pseudomonas aeruginosa PA01
caggucggcgucuuccggc

SEQ ID NO: 1506989 - RNA, 18 nt, Pseudomonas aeruginosa PA01
caggugcuuggcaccgcg

SEQ ID NO: 1506990 - RNA, 19 nt, Pseudomonas aeruginosa PA01
caggugcuuggcaccgcgc

SEQ ID NO: 1506991 - RNA, 20 nt, Pseudomonas aeruginosa PA01
caggugcuuggcaccgcgca

SEQ ID NO: 1506992 - RNA, 23 nt, Pseudomonas aeruginosa PA01
caggucggcgggcaccgccagcc

SEQ ID NO: 1506993 - RNA, 17 nt, Pseudomonas aeruginosa PA01
caggugcuuggcuucga

SEQ ID NO: 1506994 - RNA, 17 nt, Pseudomonas aeruginosa PA01
cagguggaagcgcgcgu

SEQ ID NO: 1506995 - RNA, 13 nt, Pseudomonas aeruginosa PA01
cagguggacggca

SEQ ID NO: 1506996 - RNA, 23 nt, Pseudomonas aeruginosa PA01
cagguggaucgcggcguaggcgc

SEQ ID NO: 1506997 - RNA, 15 nt, Pseudomonas aeruginosa PA01
cagguggcgcagccg

SEQ ID NO: 1506998 - RNA, 17 nt, Pseudomonas aeruginosa PA01
cagguggcgggucggcg

SEQ ID NO: 1506999 - RNA, 19 nt, Pseudomonas aeruginosa PA01
cagguggcgggucggcgga

SEQ ID NO: 1507000 - RNA, 20 nt, Pseudomonas aeruginosa PA01
cagguggcgggucggcggau

SEQ ID NO: 1507001 - RNA, 20 nt, Pseudomonas aeruginosa PA01
caggcggcgcuguuugcggc

SEQ ID NO: 1507002 - RNA, 21 nt, Pseudomonas aeruginosa PA01
caggcggcgggccggcgucca

SEQ ID NO: 1507003 - RNA, 24 nt, Pseudomonas aeruginosa PA01
caggcggcgggccggcguccagga

SEQ ID NO: 1507004 - RNA, 22 nt, Pseudomonas aeruginosa PA01
caggcggcgguagccgaggcgg

SEQ ID NO: 1507005 - RNA, 14 nt, Pseudomonas aeruginosa PA01
caggcggccgcugg

SEQ ID NO: 1507006 - RNA, 17 nt, Pseudomonas aeruginosa PA01
caggcggccgcuggcga

SEQ ID NO: 1507007 - RNA, 15 nt, Pseudomonas aeruginosa PA01
caggcggccgucggc

SEQ ID NO: 1507008 - RNA, 16 nt, Pseudomonas aeruginosa PA01
caggcggccgucggcc

SEQ ID NO: 1507009 - RNA, 21 nt, Pseudomonas aeruginosa PA01
caggcggccgucggccuggcg

SEQ ID NO: 1507010 - RNA, 13 nt, Pseudomonas aeruginosa PA01
caggcggccgacg

SEQ ID NO: 1507011 - RNA, 14 nt, Pseudomonas aeruginosa PA01
caggcggccgacga

SEQ ID NO: 1507012 - RNA, 19 nt, Pseudomonas aeruginosa PA01
caggcggagauugcggcga

SEQ ID NO: 1507013 - RNA, 13 nt, Pseudomonas aeruginosa PA01
caggcggaucgcc

SEQ ID NO: 1507014 - RNA, 19 nt, Pseudomonas aeruginosa PA01
caggcggaucgcccggcgc

SEQ ID NO: 1507015 - RNA, 15 nt, Pseudomonas aeruginosa PA01
caggcggaucgccgc

SEQ ID NO: 1507016 - RNA, 20 nt, Pseudomonas aeruginosa PA01
caggcggcacucggcgacca

SEQ ID NO: 1507017 - RNA, 13 nt, Pseudomonas aeruginosa PA01
caggcggcagccg

SEQ ID NO: 1507018 - RNA, 16 nt, Pseudomonas aeruginosa PA01
caggcggcagccgcgg

SEQ ID NO: 1507019 - RNA, 15 nt, Pseudomonas aeruginosa PA01
caggcgccggccggg

SEQ ID NO: 1507020 - RNA, 17 nt, Pseudomonas aeruginosa PA01
caggcgccggccgggcu

SEQ ID NO: 1507021 - RNA, 13 nt, Pseudomonas aeruginosa PA01
caggcgccggccu

SEQ ID NO: 1507022 - RNA, 22 nt, Pseudomonas aeruginosa PA01
caggcgccggcggaucagcccg

SEQ ID NO: 1507023 - RNA, 22 nt, Pseudomonas aeruginosa PA01
caggcgcgacagcucguggcug

SEQ ID NO: 1507024 - RNA, 19 nt, Pseudomonas aeruginosa PA01
caggcggacacgcaggcgc

SEQ ID NO: 1507025 - RNA, 20 nt, Pseudomonas aeruginosa PA01
caggcggacacgcaggcgcc

SEQ ID NO: 1507026 - RNA, 22 nt, Pseudomonas aeruginosa PA01
caggcggaaauacggcuccggc

SEQ ID NO: 1507027 - RNA, 14 nt, Pseudomonas aeruginosa PA01
caggcggaaggccu

SEQ ID NO: 1507028 - RNA, 15 nt, Pseudomonas aeruginosa PA01
caggcgcccggugga

SEQ ID NO: 1507029 - RNA, 19 nt, Pseudomonas aeruginosa PA01
caggcgccgcucgaugccc

SEQ ID NO: 1507030 - RNA, 11 nt, Pseudomonas aeruginosa PA01
caggcgccggc

SEQ ID NO: 1507031 - RNA, 12 nt, Pseudomonas aeruginosa PA01
caggcgccagga

SEQ ID NO: 1507032 - RNA, 13 nt, Pseudomonas aeruginosa PA01
caggcgccaggac

SEQ ID NO: 1507033 - RNA, 12 nt, Pseudomonas aeruginosa PA01
caggcgccaggg

SEQ ID NO: 1507034 - RNA, 16 nt, Pseudomonas aeruginosa PA01
caggcgccagggccgg

SEQ ID NO: 1507035 - RNA, 23 nt, Pseudomonas aeruginosa PA01
caggcgccagucauugcgcuccg

SEQ ID NO: 1507036 - RNA, 22 nt, Pseudomonas aeruginosa PA01
caggcgccaaccgggcagcagc

SEQ ID NO: 1507037 - RNA, 15 nt, Pseudomonas aeruginosa PA01
caggcgccaauccgg

SEQ ID NO: 1507038 - RNA, 18 nt, Pseudomonas aeruginosa PA01
caggcgccaauccgggcg

SEQ ID NO: 1507039 - RNA, 17 nt, Pseudomonas aeruginosa PA01
caggcgcaugcccaggg

SEQ ID NO: 1507040 - RNA, 18 nt, Pseudomonas aeruginosa PA01
caggcgcauguccagcca

SEQ ID NO: 1507041 - RNA, 17 nt, Pseudomonas aeruginosa PA01
caggcgcaggggcgaga

SEQ ID NO: 1507042 - RNA, 23 nt, Pseudomonas aeruginosa PA01
caggcgcaggucggccucggcga

SEQ ID NO: 1507043 - RNA, 22 nt, Pseudomonas aeruginosa PA01
caggcgcaccuccucgggcgga

SEQ ID NO: 1507044 - RNA, 16 nt, Pseudomonas aeruginosa PA01
caggcgcaccuggcgg

SEQ ID NO: 1507045 - RNA, 17 nt, Pseudomonas aeruginosa PA01
caggcgcacgcgcagua

SEQ ID NO: 1507046 - RNA, 14 nt, Pseudomonas aeruginosa PA01
caggcgcagcagcg

SEQ ID NO: 1507047 - RNA, 24 nt, Pseudomonas aeruginosa PA01
caggcgcagcagcgacucgcuggg

SEQ ID NO: 1507048 - RNA, 15 nt, Pseudomonas aeruginosa PA01
caggcgcagccagca

SEQ ID NO: 1507049 - RNA, 20 nt, Pseudomonas aeruginosa PA01
caggcgcagccagcacaugc

SEQ ID NO: 1507050 - RNA, 19 nt, Pseudomonas aeruginosa PA01
caggcgcagcguccugccc

SEQ ID NO: 1507051 - RNA, 21 nt, Pseudomonas aeruginosa PA01
caggcgcaggcgaacugccga

SEQ ID NO: 1507052 - RNA, 15 nt, Pseudomonas aeruginosa PA01
caggcgcaggcgagg

SEQ ID NO: 1507053 - RNA, 16 nt, Pseudomonas aeruginosa PA01
caggcgcaggcgagga

SEQ ID NO: 1507054 - RNA, 14 nt, Pseudomonas aeruginosa PA01
caggcgcaccagca

SEQ ID NO: 1507055 - RNA, 14 nt, Pseudomonas aeruginosa PA01
caggcgcaaccaga

SEQ ID NO: 1507056 - RNA, 12 nt, Pseudomonas aeruginosa PA01
caggccucggcg

SEQ ID NO: 1507057 - RNA, 13 nt, Pseudomonas aeruginosa PA01
caggccucggcgc

SEQ ID NO: 1507058 - RNA, 15 nt, Pseudomonas aeruginosa PA01
caggccucggcgcgg

SEQ ID NO: 1507059 - RNA, 16 nt, Pseudomonas aeruginosa PA01
caggccucggcgcggg

SEQ ID NO: 1507060 - RNA, 13 nt, Pseudomonas aeruginosa PA01
caggccgcggccc

SEQ ID NO: 1507061 - RNA, 21 nt, Pseudomonas aeruginosa PA01
caggccgcggcccugcgccgc

SEQ ID NO: 1507062 - RNA, 17 nt, Pseudomonas aeruginosa PA01
caggccgcugccgccgc

SEQ ID NO: 1507063 - RNA, 13 nt, Pseudomonas aeruginosa PA01
caggccgcugccu

SEQ ID NO: 1507064 - RNA, 19 nt, Pseudomonas aeruginosa PA01
caggccgcugccugucgca

SEQ ID NO: 1507065 - RNA, 14 nt, Pseudomonas aeruginosa PA01
caggccgcuggcgg

SEQ ID NO: 1507066 - RNA, 16 nt, Pseudomonas aeruginosa PA01
caggccgcuggcggcg

SEQ ID NO: 1507067 - RNA, 23 nt, Pseudomonas aeruginosa PA01
caggccgcuuuccacccgaaagc

SEQ ID NO: 1507068 - RNA, 14 nt, Pseudomonas aeruginosa PA01
caggccggagccgc

SEQ ID NO: 1507069 - RNA, 21 nt, Pseudomonas aeruginosa PA01
caggccuccagcaacgccgcc

SEQ ID NO: 1507070 - RNA, 19 nt, Pseudomonas aeruginosa PA01
caggccucccagccguggg

SEQ ID NO: 1507071 - RNA, 14 nt, Pseudomonas aeruginosa PA01
caggccgugccaga

SEQ ID NO: 1507072 - RNA, 22 nt, Pseudomonas aeruginosa PA01
caggccgugggccggcgcgccg

SEQ ID NO: 1507073 - RNA, 16 nt, Pseudomonas aeruginosa PA01
caggcuguugcccugg

SEQ ID NO: 1507074 - RNA, 16 nt, Pseudomonas aeruginosa PA01
cagggaguccgccagc

SEQ ID NO: 1507075 - RNA, 17 nt, Pseudomonas aeruginosa PA01
cagggaguccgccagcc

SEQ ID NO: 1507076 - RNA, 19 nt, Pseudomonas aeruginosa PA01
cagggaguccgccagccgg

SEQ ID NO: 1507077 - RNA, 19 nt, Pseudomonas aeruginosa PA01
cagggauacucaugcaggc

SEQ ID NO: 1507078 - RNA, 21 nt, Pseudomonas aeruginosa PA01
caggcuguccacgccgaaguc

SEQ ID NO: 1507079 - RNA, 17 nt, Pseudomonas aeruginosa PA01
caggcuguggcgcggcu

SEQ ID NO: 1507080 - RNA, 13 nt, Pseudomonas aeruginosa PA01
caggcugucggcc

SEQ ID NO: 1507081 - RNA, 14 nt, Pseudomonas aeruginosa PA01
caggcugucggcca

SEQ ID NO: 1507082 - RNA, 17 nt, Pseudomonas aeruginosa PA01
caggcugucggccagcc

SEQ ID NO: 1507083 - RNA, 18 nt, Pseudomonas aeruginosa PA01
caggcugucggccagccc

SEQ ID NO: 1507084 - RNA, 23 nt, Pseudomonas aeruginosa PA01
caggcugugcaggaaggcgacga

SEQ ID NO: 1507085 - RNA, 23 nt, Pseudomonas aeruginosa PA01
caggcugugcaucugcgacaugc

SEQ ID NO: 1507086 - RNA, 16 nt, Pseudomonas aeruginosa PA01
caggcugugcgccagg

SEQ ID NO: 1507087 - RNA, 19 nt, Pseudomonas aeruginosa PA01
caggcugugcgccaggccg

SEQ ID NO: 1507088 - RNA, 20 nt, Pseudomonas aeruginosa PA01
caggcugugcgccaggccgg

SEQ ID NO: 1507089 - RNA, 20 nt, Pseudomonas aeruginosa PA01
caggcugguggucaccgcca

SEQ ID NO: 1507090 - RNA, 22 nt, Pseudomonas aeruginosa PA01
caggcugguggucaccgccagc

SEQ ID NO: 1507091 - RNA, 22 nt, Pseudomonas aeruginosa PA01
caggcuguagccucccgccgcg

SEQ ID NO: 1507092 - RNA, 18 nt, Pseudomonas aeruginosa PA01
caggcugccgccgccguc

SEQ ID NO: 1507093 - RNA, 19 nt, Pseudomonas aeruginosa PA01
caggcugguaugcagcaac

SEQ ID NO: 1507094 - RNA, 20 nt, Pseudomonas aeruginosa PA01
caggcugggguugcggcgcc

SEQ ID NO: 1507095 - RNA, 17 nt, Pseudomonas aeruginosa PA01
cagggcaaacagcuccg

SEQ ID NO: 1507096 - RNA, 18 nt, Pseudomonas aeruginosa PA01
cagggcaaacagcuccgg

SEQ ID NO: 1507097 - RNA, 13 nt, Pseudomonas aeruginosa PA01
cagggcaccgccg

SEQ ID NO: 1507098 - RNA, 17 nt, Pseudomonas aeruginosa PA01
cagggcaccgccgagga

SEQ ID NO: 1507099 - RNA, 15 nt, Pseudomonas aeruginosa PA01
cagggauuccggguc

SEQ ID NO: 1507100 - RNA, 12 nt, Pseudomonas aeruginosa PA01
cagggcagcagg

SEQ ID NO: 1507101 - RNA, 15 nt, Pseudomonas aeruginosa PA01
cagggcagccgccgc

SEQ ID NO: 1507102 - RNA, 16 nt, Pseudomonas aeruginosa PA01
cagggcagccgccgcg

SEQ ID NO: 1507103 - RNA, 20 nt, Pseudomonas aeruginosa PA01
cagggcagcggcccuugccc

SEQ ID NO: 1507104 - RNA, 21 nt, Pseudomonas aeruginosa PA01
cagggcagggaguccgccagc

SEQ ID NO: 1507105 - RNA, 22 nt, Pseudomonas aeruginosa PA01
cagggcagggaguccgccagcc

SEQ ID NO: 1507106 - RNA, 23 nt, Pseudomonas aeruginosa PA01
cagggcagggaguccgccagccg

SEQ ID NO: 1507107 - RNA, 24 nt, Pseudomonas aeruginosa PA01
cagggcagggaguccgccagccgg

SEQ ID NO: 1507108 - RNA, 23 nt, Pseudomonas aeruginosa PA01
cagggccggaucggccuuggcga

SEQ ID NO: 1507109 - RNA, 20 nt, Pseudomonas aeruginosa PA01
cagggccggaugccaccgcu

SEQ ID NO: 1507110 - RNA, 14 nt, Pseudomonas aeruginosa PA01
cagggccgcggcgg

SEQ ID NO: 1507111 - RNA, 14 nt, Pseudomonas aeruginosa PA01
cagggccgcggcgu

SEQ ID NO: 1507112 - RNA, 22 nt, Pseudomonas aeruginosa PA01
cagggccgcucgagggcgaccg

SEQ ID NO: 1507113 - RNA, 17 nt, Pseudomonas aeruginosa PA01
cagggccgccagccgcc

SEQ ID NO: 1507114 - RNA, 20 nt, Pseudomonas aeruginosa PA01
cagggcccauuccacgugcu

SEQ ID NO: 1507115 - RNA, 23 nt, Pseudomonas aeruginosa PA01
cagggcaugggucagcgccagca

SEQ ID NO: 1507116 - RNA, 20 nt, Pseudomonas aeruginosa PA01
cagggcccagagcagcacca

SEQ ID NO: 1507117 - RNA, 12 nt, Pseudomonas aeruginosa PA01
cagggcagcgcg

SEQ ID NO: 1507118 - RNA, 19 nt, Pseudomonas aeruginosa PA01
cagggccgagcgcagcgcc

SEQ ID NO: 1507119 - RNA, 20 nt, Pseudomonas aeruginosa PA01
cagggccgagcgcagcgcca

SEQ ID NO: 1507120 - RNA, 22 nt, Pseudomonas aeruginosa PA01
cagggccgagcgcagcgccacc

SEQ ID NO: 1507121 - RNA, 15 nt, Pseudomonas aeruginosa PA01
caggcggcuggcgcg

SEQ ID NO: 1507122 - RNA, 16 nt, Pseudomonas aeruginosa PA01
caggcggcuggcgcga

SEQ ID NO: 1507123 - RNA, 17 nt, Pseudomonas aeruginosa PA01
caggcggucgccgaaca

SEQ ID NO: 1507124 - RNA, 19 nt, Pseudomonas aeruginosa PA01
caggcggucgccgaacagc

SEQ ID NO: 1507125 - RNA, 18 nt, Pseudomonas aeruginosa PA01
caggcgguagcgccgcgc

SEQ ID NO: 1507126 - RNA, 15 nt, Pseudomonas aeruginosa PA01
caggcggucagcgcg

SEQ ID NO: 1507127 - RNA, 12 nt, Pseudomonas aeruginosa PA01
caggcgguccag

SEQ ID NO: 1507128 - RNA, 22 nt, Pseudomonas aeruginosa PA01
caggcgucccgcuccagccggc

SEQ ID NO: 1507129 - RNA, 18 nt, Pseudomonas aeruginosa PA01
caggcgucccuggagcag

SEQ ID NO: 1507130 - RNA, 20 nt, Pseudomonas aeruginosa PA01
caggcgucccuggagcaggg

SEQ ID NO: 1507131 - RNA, 22 nt, Pseudomonas aeruginosa PA01
caggcgucccuggagcagggcg

SEQ ID NO: 1507132 - RNA, 14 nt, Pseudomonas aeruginosa PA01
caggcguccgcugg

SEQ ID NO: 1507133 - RNA, 17 nt, Pseudomonas aeruginosa PA01
caggcguccgcuggccu

SEQ ID NO: 1507134 - RNA, 16 nt, Pseudomonas aeruginosa PA01
caggcgguuggcccgc

SEQ ID NO: 1507135 - RNA, 22 nt, Pseudomonas aeruginosa PA01
caggcgguuggcccgcgccgug

SEQ ID NO: 1507136 - RNA, 24 nt, Pseudomonas aeruginosa PA01
caggcguaggccgucgcugccgag

SEQ ID NO: 1507137 - RNA, 20 nt, Pseudomonas aeruginosa PA01
caggcguaccagcuugucgc

SEQ ID NO: 1507138 - RNA, 16 nt, Pseudomonas aeruginosa PA01
caggcgucggcgccuu

SEQ ID NO: 1507139 - RNA, 21 nt, Pseudomonas aeruginosa PA01
caggcugaccgcgugggccgg

SEQ ID NO: 1507140 - RNA, 22 nt, Pseudomonas aeruginosa PA01
caggcugaccgcgugggccggc

SEQ ID NO: 1507141 - RNA, 22 nt, Pseudomonas aeruginosa PA01
caggcugacgucgacgcagcgc

SEQ ID NO: 1507142 - RNA, 18 nt, Pseudomonas aeruginosa PA01
caggcugaggucgcgggc

SEQ ID NO: 1507143 - RNA, 17 nt, Pseudomonas aeruginosa PA01
caggcgucgcaccuggg

SEQ ID NO: 1507144 - RNA, 14 nt, Pseudomonas aeruginosa PA01
caggcgucgccgac

SEQ ID NO: 1507145 - RNA, 23 nt, Pseudomonas aeruginosa PA01
caggcgucgccgacuucggcaag

SEQ ID NO: 1507146 - RNA, 16 nt, Pseudomonas aeruginosa PA01
caggcgucgcgccagc

SEQ ID NO: 1507147 - RNA, 17 nt, Pseudomonas aeruginosa PA01
caggcgucgcgccagca

SEQ ID NO: 1507148 - RNA, 20 nt, Pseudomonas aeruginosa PA01
caggcgucgcgccagcaccg

SEQ ID NO: 1507149 - RNA, 17 nt, Pseudomonas aeruginosa PA01
caggcugaagcggccgc

SEQ ID NO: 1507150 - RNA, 18 nt, Pseudomonas aeruginosa PA01
caggcugaagcggccgcc

SEQ ID NO: 1507151 - RNA, 20 nt, Pseudomonas aeruginosa PA01
caggcugaagcggccgccga

SEQ ID NO: 1507152 - RNA, 22 nt, Pseudomonas aeruginosa PA01
caggcugcccagguagccggcg

SEQ ID NO: 1507153 - RNA, 17 nt, Pseudomonas aeruginosa PA01
caggcugccgccguaga

SEQ ID NO: 1507154 - RNA, 13 nt, Pseudomonas aeruginosa PA01
caggcugccggcc

SEQ ID NO: 1507155 - RNA, 14 nt, Pseudomonas aeruginosa PA01
caggcugccggcca

SEQ ID NO: 1507156 - RNA, 17 nt, Pseudomonas aeruginosa PA01
caggcugccguccaggc

SEQ ID NO: 1507157 - RNA, 22 nt, Pseudomonas aeruginosa PA01
caggcugcgcaccucggccagg

SEQ ID NO: 1507158 - RNA, 13 nt, Pseudomonas aeruginosa PA01
caggcugcgcuug

SEQ ID NO: 1507159 - RNA, 15 nt, Pseudomonas aeruginosa PA01
caggcugggccgaac

SEQ ID NO: 1507160 - RNA, 21 nt, Pseudomonas aeruginosa PA01
caggcugggccgaaccggggc

SEQ ID NO: 1507161 - RNA, 22 nt, Pseudomonas aeruginosa PA01
caggcugggccgaaccggggcg

SEQ ID NO: 1507162 - RNA, 13 nt, Pseudomonas aeruginosa PA01
caggcugcgccgc

SEQ ID NO: 1507163 - RNA, 16 nt, Pseudomonas aeruginosa PA01
caggcugcgccgcugc

SEQ ID NO: 1507164 - RNA, 18 nt, Pseudomonas aeruginosa PA01
caggcugcgccgcugcgg

SEQ ID NO: 1507165 - RNA, 16 nt, Pseudomonas aeruginosa PA01
caggcugcgcgcaucg

SEQ ID NO: 1507166 - RNA, 21 nt, Pseudomonas aeruginosa PA01
caggcugaucuugccgcuggu

SEQ ID NO: 1507167 - RNA, 23 nt, Pseudomonas aeruginosa PA01
caggcugaucuugccgcugguga

SEQ ID NO: 1507168 - RNA, 14 nt, Pseudomonas aeruginosa PA01
caggcugaucagcc

SEQ ID NO: 1507169 - RNA, 14 nt, Pseudomonas aeruginosa PA01
caggcugaucggcg

SEQ ID NO: 1507170 - RNA, 16 nt, Pseudomonas aeruginosa PA01
caggcugaucggcgcg

SEQ ID NO: 1507171 - RNA, 17 nt, Pseudomonas aeruginosa PA01
caggcugaucggcgcgc

SEQ ID NO: 1507172 - RNA, 20 nt, Pseudomonas aeruginosa PA01
caggcugaucggcgcgccgg

SEQ ID NO: 1507173 - RNA, 21 nt, Pseudomonas aeruginosa PA01
caggcugaucggcgcgccggc

SEQ ID NO: 1507174 - RNA, 14 nt, Pseudomonas aeruginosa PA01
caggcugccgagaa

SEQ ID NO: 1507175 - RNA, 13 nt, Pseudomonas aeruginosa PA01
caggcugccgagc

SEQ ID NO: 1507176 - RNA, 14 nt, Pseudomonas aeruginosa PA01
caggcugccgagca

SEQ ID NO: 1507177 - RNA, 12 nt, Pseudomonas aeruginosa PA01
caggcugccgca

SEQ ID NO: 1507178 - RNA, 13 nt, Pseudomonas aeruginosa PA01
caggcugccgccg

SEQ ID NO: 1507179 - RNA, 20 nt, Pseudomonas aeruginosa PA01
caggcacgcugccagcaggc

SEQ ID NO: 1507180 - RNA, 22 nt, Pseudomonas aeruginosa PA01
caggcacgcugccagcaggccg

SEQ ID NO: 1507181 - RNA, 16 nt, Pseudomonas aeruginosa PA01
caggcacggaagcgcu

SEQ ID NO: 1507182 - RNA, 19 nt, Pseudomonas aeruginosa PA01
caggcacggcuucagcgcc

SEQ ID NO: 1507183 - RNA, 22 nt, Pseudomonas aeruginosa PA01
caggcacggcuucagcgccagg

SEQ ID NO: 1507184 - RNA, 19 nt, Pseudomonas aeruginosa PA01
caggcacgaauuuccuggc

SEQ ID NO: 1507185 - RNA, 18 nt, Pseudomonas aeruginosa PA01
caggcacucgaugaacag

SEQ ID NO: 1507186 - RNA, 23 nt, Pseudomonas aeruginosa PA01
caggcacucgaugaacagcgcga

SEQ ID NO: 1507187 - RNA, 16 nt, Pseudomonas aeruginosa PA01
caggcagaccagcgca

SEQ ID NO: 1507188 - RNA, 17 nt, Pseudomonas aeruginosa PA01
caggcagaccaggccga

SEQ ID NO: 1507189 - RNA, 21 nt, Pseudomonas aeruginosa PA01
caggcagaccaggccgagcag

SEQ ID NO: 1507190 - RNA, 16 nt, Pseudomonas aeruginosa PA01
caggcagaucgcgccg

SEQ ID NO: 1507191 - RNA, 18 nt, Pseudomonas aeruginosa PA01
caggcagaucgcgccgag

SEQ ID NO: 1507192 - RNA, 19 nt, Pseudomonas aeruginosa PA01
caggcagaucgcgccgagc

SEQ ID NO: 1507193 - RNA, 17 nt, Pseudomonas aeruginosa PA01
caggcagaccugcagca

SEQ ID NO: 1507194 - RNA, 22 nt, Pseudomonas aeruginosa PA01
caggauguccuuguucggcugg

SEQ ID NO: 1507195 - RNA, 19 nt, Pseudomonas aeruginosa PA01
caggauguggccgucgcgc

SEQ ID NO: 1507196 - RNA, 19 nt, Pseudomonas aeruginosa PA01
caggauguugacgauggcc

SEQ ID NO: 1507197 - RNA, 14 nt, Pseudomonas aeruginosa PA01
caggaucgccgggc

SEQ ID NO: 1507198 - RNA, 13 nt, Pseudomonas aeruginosa PA01
caggaugggcgaa

SEQ ID NO: 1507199 - RNA, 23 nt, Pseudomonas aeruginosa PA01
caggaugggcgaagccggcggcg

SEQ ID NO: 1507200 - RNA, 16 nt, Pseudomonas aeruginosa PA01
caggaugcugcacagc

SEQ ID NO: 1507201 - RNA, 18 nt, Pseudomonas aeruginosa PA01
caggaucgaacuggccag

SEQ ID NO: 1507202 - RNA, 20 nt, Pseudomonas aeruginosa PA01
caggaucgaccccgccgggg

SEQ ID NO: 1507203 - RNA, 17 nt, Pseudomonas aeruginosa PA01
caggaucgagcccuggu

SEQ ID NO: 1507204 - RNA, 18 nt, Pseudomonas aeruginosa PA01
caggauccaggugcgcgg

SEQ ID NO: 1507205 - RNA, 21 nt, Pseudomonas aeruginosa PA01
caggaguggugaagcgcuccg

SEQ ID NO: 1507206 - RNA, 20 nt, Pseudomonas aeruginosa PA01
caggaguuucaucucggcgc

SEQ ID NO: 1507207 - RNA, 21 nt, Pseudomonas aeruginosa PA01
caggaguuucaucucggcgca

SEQ ID NO: 1507208 - RNA, 23 nt, Pseudomonas aeruginosa PA01
cagcguggcggacaacccggcgc

SEQ ID NO: 1507209 - RNA, 21 nt, Pseudomonas aeruginosa PA01
cagcguggccagcgcccaggc

SEQ ID NO: 1507210 - RNA, 16 nt, Pseudomonas aeruginosa PA01
cagcgugcggcccuug

SEQ ID NO: 1507211 - RNA, 17 nt, Pseudomonas aeruginosa PA01
caggacgaagucgccgg

SEQ ID NO: 1507212 - RNA, 18 nt, Pseudomonas aeruginosa PA01
caggacgaagucgccggc

SEQ ID NO: 1507213 - RNA, 19 nt, Pseudomonas aeruginosa PA01
caggacgaagucgccggca

SEQ ID NO: 1507214 - RNA, 19 nt, Pseudomonas aeruginosa PA01
caggacgaugaucaccagg

SEQ ID NO: 1507215 - RNA, 16 nt, Pseudomonas aeruginosa PA01
caggacgccaccaggc

SEQ ID NO: 1507216 - RNA, 14 nt, Pseudomonas aeruginosa PA01
caggacgagacgcc

SEQ ID NO: 1507217 - RNA, 21 nt, Pseudomonas aeruginosa PA01
caggacgagcguccgccgccg

SEQ ID NO: 1507218 - RNA, 22 nt, Pseudomonas aeruginosa PA01
caggacgagcguccgccgccgu

SEQ ID NO: 1507219 - RNA, 13 nt, Pseudomonas aeruginosa PA01
caggaccuccugc

SEQ ID NO: 1507220 - RNA, 21 nt, Pseudomonas aeruginosa PA01
caggaccucgaagcuggccag

SEQ ID NO: 1507221 - RNA, 16 nt, Pseudomonas aeruginosa PA01
caggaccuuccgccag

SEQ ID NO: 1507222 - RNA, 17 nt, Pseudomonas aeruginosa PA01
caggaccuuccgccagc

SEQ ID NO: 1507223 - RNA, 18 nt, Pseudomonas aeruginosa PA01
caggaccuuccgccagca

SEQ ID NO: 1507224 - RNA, 16 nt, Pseudomonas aeruginosa PA01
caggaccggcaggucg

SEQ ID NO: 1507225 - RNA, 17 nt, Pseudomonas aeruginosa PA01
caggaccggcaggucgg

SEQ ID NO: 1507226 - RNA, 14 nt, Pseudomonas aeruginosa PA01
caggacgcuacgcu

SEQ ID NO: 1507227 - RNA, 19 nt, Pseudomonas aeruginosa PA01
caggacgcuccugcgccgg

SEQ ID NO: 1507228 - RNA, 20 nt, Pseudomonas aeruginosa PA01
caggacgcuccugcgccggc

SEQ ID NO: 1507229 - RNA, 21 nt, Pseudomonas aeruginosa PA01
caggacgcuccugcgccggcu

SEQ ID NO: 1507230 - RNA, 16 nt, Pseudomonas aeruginosa PA01
caggagcguugcgggc

SEQ ID NO: 1507231 - RNA, 22 nt, Pseudomonas aeruginosa PA01
caggagcguugcgggcaggucg

SEQ ID NO: 1507232 - RNA, 19 nt, Pseudomonas aeruginosa PA01
caggaggauacggcgcagc

SEQ ID NO: 1507233 - RNA, 22 nt, Pseudomonas aeruginosa PA01
caggaggauacggcgcagcagg

SEQ ID NO: 1507234 - RNA, 14 nt, Pseudomonas aeruginosa PA01
caggaggaucgcca

SEQ ID NO: 1507235 - RNA, 14 nt, Pseudomonas aeruginosa PA01
caggaggauucgcc

SEQ ID NO: 1507236 - RNA, 17 nt, Pseudomonas aeruginosa PA01
caggaggauucgccagc

SEQ ID NO: 1507237 - RNA, 18 nt, Pseudomonas aeruginosa PA01
caggaggauucgccagcc

SEQ ID NO: 1507238 - RNA, 22 nt, Pseudomonas aeruginosa PA01
caggaggcccacgggcggccga

SEQ ID NO: 1507239 - RNA, 21 nt, Pseudomonas aeruginosa PA01
caggagggcugcuguccagcg

SEQ ID NO: 1507240 - RNA, 15 nt, Pseudomonas aeruginosa PA01
caggccccaggccgc

SEQ ID NO: 1507241 - RNA, 18 nt, Pseudomonas aeruginosa PA01
caggccccaggccgccgc

SEQ ID NO: 1507242 - RNA, 14 nt, Pseudomonas aeruginosa PA01
caggccccaggcga

SEQ ID NO: 1507243 - RNA, 14 nt, Pseudomonas aeruginosa PA01
caggcccgccgguc

SEQ ID NO: 1507244 - RNA, 23 nt, Pseudomonas aeruginosa PA01
caggccgaacucacggaugccgg

SEQ ID NO: 1507245 - RNA, 14 nt, Pseudomonas aeruginosa PA01
caggcccggccgcc

SEQ ID NO: 1507246 - RNA, 19 nt, Pseudomonas aeruginosa PA01
caggcccuuuuccaccggc

SEQ ID NO: 1507247 - RNA, 20 nt, Pseudomonas aeruginosa PA01
caggcccuuuuccaccggcc

SEQ ID NO: 1507248 - RNA, 23 nt, Pseudomonas aeruginosa PA01
caggcccuuuuccaccggccgcg

SEQ ID NO: 1507249 - RNA, 17 nt, Pseudomonas aeruginosa PA01
caggccgacagcggcug

SEQ ID NO: 1507250 - RNA, 16 nt, Pseudomonas aeruginosa PA01
caggccgaccagcagg

SEQ ID NO: 1507251 - RNA, 20 nt, Pseudomonas aeruginosa PA01
caggccgaccagcagggcca

SEQ ID NO: 1507252 - RNA, 17 nt, Pseudomonas aeruginosa PA01
caggccgaccagcgccg

SEQ ID NO: 1507253 - RNA, 17 nt, Pseudomonas aeruginosa PA01
caggccgagaaaccgcc

SEQ ID NO: 1507254 - RNA, 20 nt, Pseudomonas aeruginosa PA01
caggccgagaaaccgccauc

SEQ ID NO: 1507255 - RNA, 23 nt, Pseudomonas aeruginosa PA01
caggccgagaagguucucggcca

SEQ ID NO: 1507256 - RNA, 21 nt, Pseudomonas aeruginosa PA01
caggccgagaccgcagcccag

SEQ ID NO: 1507257 - RNA, 14 nt, Pseudomonas aeruginosa PA01
caggccgacggcgc

SEQ ID NO: 1507258 - RNA, 15 nt, Pseudomonas aeruginosa PA01
caggccgacggcgcg

SEQ ID NO: 1507259 - RNA, 16 nt, Pseudomonas aeruginosa PA01
caggccgacggcgcgc

SEQ ID NO: 1507260 - RNA, 21 nt, Pseudomonas aeruginosa PA01
caggccgacguccaucagcgu

SEQ ID NO: 1507261 - RNA, 16 nt, Pseudomonas aeruginosa PA01
caggccgaagccgccg

SEQ ID NO: 1507262 - RNA, 17 nt, Pseudomonas aeruginosa PA01
caggccgaagccgccgg

SEQ ID NO: 1507263 - RNA, 18 nt, Pseudomonas aeruginosa PA01
caggccgaagccgccggg

SEQ ID NO: 1507264 - RNA, 19 nt, Pseudomonas aeruginosa PA01
caggccgaagccgccggga

SEQ ID NO: 1507265 - RNA, 17 nt, Pseudomonas aeruginosa PA01
caggccgaaggccagga

SEQ ID NO: 1507266 - RNA, 19 nt, Pseudomonas aeruginosa PA01
caggccgaaggccuggccg

SEQ ID NO: 1507267 - RNA, 20 nt, Pseudomonas aeruginosa PA01
caggccgaaggccuggccgu

SEQ ID NO: 1507268 - RNA, 19 nt, Pseudomonas aeruginosa PA01
caggccgaaguagccggcg

SEQ ID NO: 1507269 - RNA, 16 nt, Pseudomonas aeruginosa PA01
caggccgaauccgccg

SEQ ID NO: 1507270 - RNA, 20 nt, Pseudomonas aeruginosa PA01
caggccgaauccgccggcga

SEQ ID NO: 1507271 - RNA, 22 nt, Pseudomonas aeruginosa PA01
caggccgaauccgccggcgaug

SEQ ID NO: 1507272 - RNA, 21 nt, Pseudomonas aeruginosa PA01
caggccgcgcgauggccggcg

SEQ ID NO: 1507273 - RNA, 22 nt, Pseudomonas aeruginosa PA01
caggccgcgcagucccgcgcgg

SEQ ID NO: 1507274 - RNA, 12 nt, Pseudomonas aeruginosa PA01
caggccgcggcc

SEQ ID NO: 1507275 - RNA, 16 nt, Pseudomonas aeruginosa PA01
caggccgcgcagcaac

SEQ ID NO: 1507276 - RNA, 17 nt, Pseudomonas aeruginosa PA01
caggccgcgcagcaacg

SEQ ID NO: 1507277 - RNA, 21 nt, Pseudomonas aeruginosa PA01
caggccgcgcagcaacggcgc

SEQ ID NO: 1507278 - RNA, 19 nt, Pseudomonas aeruginosa PA01
caggccgccuauggcggau

SEQ ID NO: 1507279 - RNA, 16 nt, Pseudomonas aeruginosa PA01
caggccgccggcggcc

SEQ ID NO: 1507280 - RNA, 18 nt, Pseudomonas aeruginosa PA01
caggccgccggcggccag

SEQ ID NO: 1507281 - RNA, 23 nt, Pseudomonas aeruginosa PA01
caggccgagcaauccggcgcugc

SEQ ID NO: 1507282 - RNA, 20 nt, Pseudomonas aeruginosa PA01
caggccgagcaccggcagga

SEQ ID NO: 1507283 - RNA, 16 nt, Pseudomonas aeruginosa PA01
caggccgagcagcgcc

SEQ ID NO: 1507284 - RNA, 17 nt, Pseudomonas aeruginosa PA01
caggccgagcagcgcca

SEQ ID NO: 1507285 - RNA, 18 nt, Pseudomonas aeruginosa PA01
caggccgagcagcgccag

SEQ ID NO: 1507286 - RNA, 23 nt, Pseudomonas aeruginosa PA01
caggccgagcagcgccagccagg

SEQ ID NO: 1507287 - RNA, 20 nt, Pseudomonas aeruginosa PA01
caggccgccaugcucggcca

SEQ ID NO: 1507288 - RNA, 21 nt, Pseudomonas aeruginosa PA01
caggccgccaugcucggccag

SEQ ID NO: 1507289 - RNA, 14 nt, Pseudomonas aeruginosa PA01
caggccgcccagga

SEQ ID NO: 1507290 - RNA, 16 nt, Pseudomonas aeruginosa PA01
caggccgccgcgucga

SEQ ID NO: 1507291 - RNA, 22 nt, Pseudomonas aeruginosa PA01
caggccgccgcgugccgccgga

SEQ ID NO: 1507292 - RNA, 13 nt, Pseudomonas aeruginosa PA01
caggccgccgagu

SEQ ID NO: 1507293 - RNA, 13 nt, Pseudomonas aeruginosa PA01
caggccgccggcg

SEQ ID NO: 1507294 - RNA, 14 nt, Pseudomonas aeruginosa PA01
caggccgccggcga

SEQ ID NO: 1507295 - RNA, 19 nt, Pseudomonas aeruginosa PA01
caggccgccggcgaccgcg

SEQ ID NO: 1507296 - RNA, 13 nt, Pseudomonas aeruginosa PA01
caggcagcgccgc

SEQ ID NO: 1507297 - RNA, 16 nt, Pseudomonas aeruginosa PA01
caggcagcgccgccca

SEQ ID NO: 1507298 - RNA, 13 nt, Pseudomonas aeruginosa PA01
caggcagcgaucg

SEQ ID NO: 1507299 - RNA, 21 nt, Pseudomonas aeruginosa PA01
caggcagcgcgcgucggucag

SEQ ID NO: 1507300 - RNA, 14 nt, Pseudomonas aeruginosa PA01
caggcaggcgguca

SEQ ID NO: 1507301 - RNA, 13 nt, Pseudomonas aeruginosa PA01
caggcaggcgcgg

SEQ ID NO: 1507302 - RNA, 12 nt, Pseudomonas aeruginosa PA01
caggcaggccgg

SEQ ID NO: 1507303 - RNA, 15 nt, Pseudomonas aeruginosa PA01
caggcaggccgggcu

SEQ ID NO: 1507304 - RNA, 18 nt, Pseudomonas aeruginosa PA01
caggcaggcgaugaccgc

SEQ ID NO: 1507305 - RNA, 18 nt, Pseudomonas aeruginosa PA01
caggcauccagcaccgcu

SEQ ID NO: 1507306 - RNA, 23 nt, Pseudomonas aeruginosa PA01
caggcauccccggaccagggcgc

SEQ ID NO: 1507307 - RNA, 18 nt, Pseudomonas aeruginosa PA01
caggccauagcgcgccgg

SEQ ID NO: 1507308 - RNA, 19 nt, Pseudomonas aeruginosa PA01
caggccauagcgcgccggg

SEQ ID NO: 1507309 - RNA, 20 nt, Pseudomonas aeruginosa PA01
caggccauagcgcgccgggu

SEQ ID NO: 1507310 - RNA, 16 nt, Pseudomonas aeruginosa PA01
caggcagugugcaccg

SEQ ID NO: 1507311 - RNA, 22 nt, Pseudomonas aeruginosa PA01
caggcagucccagaaggccagg

SEQ ID NO: 1507312 - RNA, 23 nt, Pseudomonas aeruginosa PA01
caggcaguccuugagcgccagca

SEQ ID NO: 1507313 - RNA, 14 nt, Pseudomonas aeruginosa PA01
caggcagugccggg

SEQ ID NO: 1507314 - RNA, 16 nt, Pseudomonas aeruginosa PA01
caggcagugccgggcg

SEQ ID NO: 1507315 - RNA, 15 nt, Pseudomonas aeruginosa PA01
caggcaguggcgcca

SEQ ID NO: 1507316 - RNA, 13 nt, Pseudomonas aeruginosa PA01
caggcccagcuuc

SEQ ID NO: 1507317 - RNA, 20 nt, Pseudomonas aeruginosa PA01
caggcccaugauggucggca

SEQ ID NO: 1507318 - RNA, 23 nt, Pseudomonas aeruginosa PA01
caggcccaguucgcugccgccgc

SEQ ID NO: 1507319 - RNA, 19 nt, Pseudomonas aeruginosa PA01
caggccauucuucuccaga

SEQ ID NO: 1507320 - RNA, 13 nt, Pseudomonas aeruginosa PA01
caggcccacgccc

SEQ ID NO: 1507321 - RNA, 23 nt, Pseudomonas aeruginosa PA01
caggccaugggugucggcgauca

SEQ ID NO: 1507322 - RNA, 18 nt, Pseudomonas aeruginosa PA01
caucgcgggcgugcucca

SEQ ID NO: 1507323 - RNA, 23 nt, Pseudomonas aeruginosa PA01
caucgcgggcgugcuccagcacc

SEQ ID NO: 1507324 - RNA, 23 nt, Pseudomonas aeruginosa PA01
caucgcggcgauggccgccagca

SEQ ID NO: 1507325 - RNA, 21 nt, Pseudomonas aeruginosa PA01
caucgcggaaacccuuccagc

SEQ ID NO: 1507326 - RNA, 24 nt, Pseudomonas aeruginosa PA01
caucgcggaaacccuuccagccgc

SEQ ID NO: 1507327 - RNA, 19 nt, Pseudomonas aeruginosa PA01
caucgcucaccggaccgug

SEQ ID NO: 1507328 - RNA, 14 nt, Pseudomonas aeruginosa PA01
caucgcugaccugg

SEQ ID NO: 1507329 - RNA, 15 nt, Pseudomonas aeruginosa PA01
caucgcugaccugga

SEQ ID NO: 1507330 - RNA, 21 nt, Pseudomonas aeruginosa PA01
caucgcguagggcgacggcgc

SEQ ID NO: 1507331 - RNA, 22 nt, Pseudomonas aeruginosa PA01
caucgcguagguggcgccgccg

SEQ ID NO: 1507332 - RNA, 19 nt, Pseudomonas aeruginosa PA01
caucgcgguuauccgccga

SEQ ID NO: 1507333 - RNA, 19 nt, Pseudomonas aeruginosa PA01
caucgcgguuauccgccgg

SEQ ID NO: 1507334 - RNA, 20 nt, Pseudomonas aeruginosa PA01
caucgcgguuauccgccggc

SEQ ID NO: 1507335 - RNA, 16 nt, Pseudomonas aeruginosa PA01
caucgccucgccggcc

SEQ ID NO: 1507336 - RNA, 15 nt, Pseudomonas aeruginosa PA01
caucgccugggccgg

SEQ ID NO: 1507337 - RNA, 18 nt, Pseudomonas aeruginosa PA01
caucgccugggccggcgu

SEQ ID NO: 1507338 - RNA, 14 nt, Pseudomonas aeruginosa PA01
caucgccugcuggu

SEQ ID NO: 1507339 - RNA, 16 nt, Pseudomonas aeruginosa PA01
caucgccugcuggugg

SEQ ID NO: 1507340 - RNA, 22 nt, Pseudomonas aeruginosa PA01
caucgccugcuuggcggcggug

SEQ ID NO: 1507341 - RNA, 14 nt, Pseudomonas aeruginosa PA01
caucgcgcacaugc

SEQ ID NO: 1507342 - RNA, 12 nt, Pseudomonas aeruginosa PA01
caucgcgccgcc

SEQ ID NO: 1507343 - RNA, 14 nt, Pseudomonas aeruginosa PA01
caucgcgccgccga

SEQ ID NO: 1507344 - RNA, 17 nt, Pseudomonas aeruginosa PA01
caucgcgccgccgaagc

SEQ ID NO: 1507345 - RNA, 13 nt, Pseudomonas aeruginosa PA01
caucgccagcgcc

SEQ ID NO: 1507346 - RNA, 14 nt, Pseudomonas aeruginosa PA01
caucgccagcgcca

SEQ ID NO: 1507347 - RNA, 15 nt, Pseudomonas aeruginosa PA01
caucgccagcgccac

SEQ ID NO: 1507348 - RNA, 20 nt, Pseudomonas aeruginosa PA01
caucgccagcgccacgguga

SEQ ID NO: 1507349 - RNA, 12 nt, Pseudomonas aeruginosa PA01
caucgccagcgc

SEQ ID NO: 1507350 - RNA, 17 nt, Pseudomonas aeruginosa PA01
caucgccaggccauuga

SEQ ID NO: 1507351 - RNA, 15 nt, Pseudomonas aeruginosa PA01
caucgccggcgccga

SEQ ID NO: 1507352 - RNA, 14 nt, Pseudomonas aeruginosa PA01
caucgccggcgagc

SEQ ID NO: 1507353 - RNA, 18 nt, Pseudomonas aeruginosa PA01
caucgccggcgagccgcu

SEQ ID NO: 1507354 - RNA, 14 nt, Pseudomonas aeruginosa PA01
caucgccggcagcg

SEQ ID NO: 1507355 - RNA, 18 nt, Pseudomonas aeruginosa PA01
caucgccggcagcgccgc

SEQ ID NO: 1507356 - RNA, 18 nt, Pseudomonas aeruginosa PA01
caucgagcaguuccaggc

SEQ ID NO: 1507357 - RNA, 16 nt, Pseudomonas aeruginosa PA01
cauccucccugcccgc

SEQ ID NO: 1507358 - RNA, 13 nt, Pseudomonas aeruginosa PA01
cauccuccagcac

SEQ ID NO: 1507359 - RNA, 14 nt, Pseudomonas aeruginosa PA01
cauccuccagcgcc

SEQ ID NO: 1507360 - RNA, 16 nt, Pseudomonas aeruginosa PA01
cauccuccagcgccgc

SEQ ID NO: 1507361 - RNA, 18 nt, Pseudomonas aeruginosa PA01
caucgaccuugcccucgg

SEQ ID NO: 1507362 - RNA, 16 nt, Pseudomonas aeruginosa PA01
caucgacgccagcggc

SEQ ID NO: 1507363 - RNA, 17 nt, Pseudomonas aeruginosa PA01
caucgacgcccucggcg

SEQ ID NO: 1507364 - RNA, 21 nt, Pseudomonas aeruginosa PA01
caucgacgcccucggcgacga

SEQ ID NO: 1507365 - RNA, 15 nt, Pseudomonas aeruginosa PA01
caucagggucggccc

SEQ ID NO: 1507366 - RNA, 17 nt, Pseudomonas aeruginosa PA01
caucagggucggcccgg

SEQ ID NO: 1507367 - RNA, 15 nt, Pseudomonas aeruginosa PA01
caucaggcucaggcg

SEQ ID NO: 1507368 - RNA, 15 nt, Pseudomonas aeruginosa PA01
caucaggcugccgag

SEQ ID NO: 1507369 - RNA, 21 nt, Pseudomonas aeruginosa PA01
caucaggccgcggcccugcgc

SEQ ID NO: 1507370 - RNA, 14 nt, Pseudomonas aeruginosa PA01
caucaggcccuuga

SEQ ID NO: 1507371 - RNA, 21 nt, Pseudomonas aeruginosa PA01
caucaggcggcacucggcgac

SEQ ID NO: 1507372 - RNA, 16 nt, Pseudomonas aeruginosa PA01
caucagccuggccagc

SEQ ID NO: 1507373 - RNA, 18 nt, Pseudomonas aeruginosa PA01
caucagccgcgcgcugga

SEQ ID NO: 1507374 - RNA, 14 nt, Pseudomonas aeruginosa PA01
caucagcgccgccu

SEQ ID NO: 1507375 - RNA, 15 nt, Pseudomonas aeruginosa PA01
caucagcgccgccuc

SEQ ID NO: 1507376 - RNA, 16 nt, Pseudomonas aeruginosa PA01
caucagguccaccagc

SEQ ID NO: 1507377 - RNA, 14 nt, Pseudomonas aeruginosa PA01
cauccaguuccugc

SEQ ID NO: 1507378 - RNA, 19 nt, Pseudomonas aeruginosa PA01
cauccagucuucgccggcc

SEQ ID NO: 1507379 - RNA, 20 nt, Pseudomonas aeruginosa PA01
cauccaggcuuuccaccgcc

SEQ ID NO: 1507380 - RNA, 21 nt, Pseudomonas aeruginosa PA01
cauccaggcuuuccaccgcca

SEQ ID NO: 1507381 - RNA, 21 nt, Pseudomonas aeruginosa PA01
cauccggguccagcggccgcg

SEQ ID NO: 1507382 - RNA, 19 nt, Pseudomonas aeruginosa PA01
cauccgggcggcgggcgca

SEQ ID NO: 1507383 - RNA, 21 nt, Pseudomonas aeruginosa PA01
cauccggccaugucccgggug

SEQ ID NO: 1507384 - RNA, 20 nt, Pseudomonas aeruginosa PA01
cauccgcaccauccgccgca

SEQ ID NO: 1507385 - RNA, 22 nt, Pseudomonas aeruginosa PA01
caucccgggguugcccagcagg

SEQ ID NO: 1507386 - RNA, 18 nt, Pseudomonas aeruginosa PA01
caucccgguuuccgcagc

SEQ ID NO: 1507387 - RNA, 22 nt, Pseudomonas aeruginosa PA01
caucccuuuuucauucuccagc

SEQ ID NO: 1507388 - RNA, 16 nt, Pseudomonas aeruginosa PA01
cauauggaaguucaca

SEQ ID NO: 1507389 - RNA, 17 nt, Pseudomonas aeruginosa PA01
cauagccaccgccgaca

SEQ ID NO: 1507390 - RNA, 20 nt, Pseudomonas aeruginosa PA01
cauagccgaacuccgccagc

SEQ ID NO: 1507391 - RNA, 22 nt, Pseudomonas aeruginosa PA01
cauagccgaacuccgccagcac

SEQ ID NO: 1507392 - RNA, 19 nt, Pseudomonas aeruginosa PA01
cauagccguugucggugau

SEQ ID NO: 1507393 - RNA, 14 nt, Pseudomonas aeruginosa PA01
cauagccggcgaac

SEQ ID NO: 1507394 - RNA, 17 nt, Pseudomonas aeruginosa PA01
cauagaugccgcccugc

SEQ ID NO: 1507395 - RNA, 23 nt, Pseudomonas aeruginosa PA01
cauagaugccgcccugcggcagg

SEQ ID NO: 1507396 - RNA, 17 nt, Pseudomonas aeruginosa PA01
cauagcagcgccgcgcc

SEQ ID NO: 1507397 - RNA, 23 nt, Pseudomonas aeruginosa PA01
cauagaguugcuuggcgcgcugg

SEQ ID NO: 1507398 - RNA, 16 nt, Pseudomonas aeruginosa PA01
caucaccacgaucagc

SEQ ID NO: 1507399 - RNA, 17 nt, Pseudomonas aeruginosa PA01
caucaccagcgccguca

SEQ ID NO: 1507400 - RNA, 19 nt, Pseudomonas aeruginosa PA01
caucacggccccgagaaaa

SEQ ID NO: 1507401 - RNA, 21 nt, Pseudomonas aeruginosa PA01
caucaccuugucgcaccagcc

SEQ ID NO: 1507402 - RNA, 16 nt, Pseudomonas aeruginosa PA01
caucagaggcaacacc

SEQ ID NO: 1507403 - RNA, 16 nt, Pseudomonas aeruginosa PA01
cauacgaaaaaaaggc

SEQ ID NO: 1507404 - RNA, 19 nt, Pseudomonas aeruginosa PA01
cauacgaaaacggcccuca

SEQ ID NO: 1507405 - RNA, 20 nt, Pseudomonas aeruginosa PA01
cauacucggacggcucgcgc

SEQ ID NO: 1507406 - RNA, 15 nt, Pseudomonas aeruginosa PA01
cagugcuugagcgga

SEQ ID NO: 1507407 - RNA, 18 nt, Pseudomonas aeruginosa PA01
cagugcuugagcggaucg

SEQ ID NO: 1507408 - RNA, 19 nt, Pseudomonas aeruginosa PA01
cagugucgcgaacucggcg

SEQ ID NO: 1507409 - RNA, 17 nt, Pseudomonas aeruginosa PA01
caugaagccgcgcgccg

SEQ ID NO: 1507410 - RNA, 20 nt, Pseudomonas aeruginosa PA01
caugaagccgcgcgccgagu

SEQ ID NO: 1507411 - RNA, 23 nt, Pseudomonas aeruginosa PA01
caugaagcuuuuccagcgcaccg

SEQ ID NO: 1507412 - RNA, 20 nt, Pseudomonas aeruginosa PA01
caugaaggaaaccggccagc

SEQ ID NO: 1507413 - RNA, 17 nt, Pseudomonas aeruginosa PA01
caugaccagagccgccg

SEQ ID NO: 1507414 - RNA, 22 nt, Pseudomonas aeruginosa PA01
caugaccgauggcgccgcgaug

SEQ ID NO: 1507415 - RNA, 24 nt, Pseudomonas aeruginosa PA01
caugaccgccgcucaucugcacca

SEQ ID NO: 1507416 - RNA, 14 nt, Pseudomonas aeruginosa PA01
caugacccgcggca

SEQ ID NO: 1507417 - RNA, 16 nt, Pseudomonas aeruginosa PA01
caugacccgcggcagg

SEQ ID NO: 1507418 - RNA, 19 nt, Pseudomonas aeruginosa PA01
caugacccgcggcaggucc

SEQ ID NO: 1507419 - RNA, 22 nt, Pseudomonas aeruginosa PA01
caugacgauaucggcgccggcc

SEQ ID NO: 1507420 - RNA, 23 nt, Pseudomonas aeruginosa PA01
caugacgauaucggcgccggccu

SEQ ID NO: 1507421 - RNA, 15 nt, Pseudomonas aeruginosa PA01
caugaccuucagcac

SEQ ID NO: 1507422 - RNA, 17 nt, Pseudomonas aeruginosa PA01
caugaccgucagccagg

SEQ ID NO: 1507423 - RNA, 17 nt, Pseudomonas aeruginosa PA01
caugaccuccagggcca

SEQ ID NO: 1507424 - RNA, 17 nt, Pseudomonas aeruginosa PA01
caugaccucggccagcc

SEQ ID NO: 1507425 - RNA, 14 nt, Pseudomonas aeruginosa PA01
caugagcgcccggc

SEQ ID NO: 1507426 - RNA, 16 nt, Pseudomonas aeruginosa PA01
caugaggcuggccagc

SEQ ID NO: 1507427 - RNA, 19 nt, Pseudomonas aeruginosa PA01
caugaggcuggccagcaau

SEQ ID NO: 1507428 - RNA, 16 nt, Pseudomonas aeruginosa PA01
caugagauccgccagc

SEQ ID NO: 1507429 - RNA, 15 nt, Pseudomonas aeruginosa PA01
caugagcagggcgga

SEQ ID NO: 1507430 - RNA, 19 nt, Pseudomonas aeruginosa PA01
caucuuuuccugcuggcga

SEQ ID NO: 1507431 - RNA, 13 nt, Pseudomonas aeruginosa PA01
caugaaccaaccg

SEQ ID NO: 1507432 - RNA, 16 nt, Pseudomonas aeruginosa PA01
caugaaaaagcccggc

SEQ ID NO: 1507433 - RNA, 22 nt, Pseudomonas aeruginosa PA01
caugaaaaagcccggccuggug

SEQ ID NO: 1507434 - RNA, 20 nt, Pseudomonas aeruginosa PA01
caugaaaaaggccggucgca

SEQ ID NO: 1507435 - RNA, 20 nt, Pseudomonas aeruginosa PA01
caucuuggcaaucaucgcgu

SEQ ID NO: 1507436 - RNA, 12 nt, Pseudomonas aeruginosa PA01
caucuucuccca

SEQ ID NO: 1507437 - RNA, 19 nt, Pseudomonas aeruginosa PA01
caucuucucgaagcgcgcc

SEQ ID NO: 1507438 - RNA, 22 nt, Pseudomonas aeruginosa PA01
caucuucagcaucaggucggcg

SEQ ID NO: 1507439 - RNA, 17 nt, Pseudomonas aeruginosa PA01
caucuguaccaccgcca

SEQ ID NO: 1507440 - RNA, 14 nt, Pseudomonas aeruginosa PA01
caucugggucuuca

SEQ ID NO: 1507441 - RNA, 14 nt, Pseudomonas aeruginosa PA01
caucugggccaucg

SEQ ID NO: 1507442 - RNA, 16 nt, Pseudomonas aeruginosa PA01
caucuggaucaggaag

SEQ ID NO: 1507443 - RNA, 14 nt, Pseudomonas aeruginosa PA01
caugccgcuagccc

SEQ ID NO: 1507444 - RNA, 17 nt, Pseudomonas aeruginosa PA01
caugccgcuagcccugc

SEQ ID NO: 1507445 - RNA, 20 nt, Pseudomonas aeruginosa PA01
caugccgcuagcccugcugc

SEQ ID NO: 1507446 - RNA, 16 nt, Pseudomonas aeruginosa PA01
caugccggccaggaag

SEQ ID NO: 1507447 - RNA, 17 nt, Pseudomonas aeruginosa PA01
caugccggccaggaagg

SEQ ID NO: 1507448 - RNA, 11 nt, Pseudomonas aeruginosa PA01
caugccgcccg

SEQ ID NO: 1507449 - RNA, 17 nt, Pseudomonas aeruginosa PA01
caugccgccgacgccgg

SEQ ID NO: 1507450 - RNA, 12 nt, Pseudomonas aeruginosa PA01
caugccgcccgg

SEQ ID NO: 1507451 - RNA, 17 nt, Pseudomonas aeruginosa PA01
caugccgcccggccgcu

SEQ ID NO: 1507452 - RNA, 20 nt, Pseudomonas aeruginosa PA01
caugccgcaagcuccccgcc

SEQ ID NO: 1507453 - RNA, 22 nt, Pseudomonas aeruginosa PA01
caugccgcaagcuccccgccgc

SEQ ID NO: 1507454 - RNA, 23 nt, Pseudomonas aeruginosa PA01
caugccgcaagcuccccgccgcc

SEQ ID NO: 1507455 - RNA, 20 nt, Pseudomonas aeruginosa PA01
caugcccagggccagcagcg

SEQ ID NO: 1507456 - RNA, 21 nt, Pseudomonas aeruginosa PA01
caugcccagggccagcagcgg

SEQ ID NO: 1507457 - RNA, 22 nt, Pseudomonas aeruginosa PA01
caugcccagggccagcagcggc

SEQ ID NO: 1507458 - RNA, 23 nt, Pseudomonas aeruginosa PA01
caugcccagcguggccagcgaac

SEQ ID NO: 1507459 - RNA, 16 nt, Pseudomonas aeruginosa PA01
caugcccagcuucacc

SEQ ID NO: 1507460 - RNA, 22 nt, Pseudomonas aeruginosa PA01
caugcccgcgucgcgcgcggca

SEQ ID NO: 1507461 - RNA, 13 nt, Pseudomonas aeruginosa PA01
caugccgaggaac

SEQ ID NO: 1507462 - RNA, 13 nt, Pseudomonas aeruginosa PA01
caugcccuggccg

SEQ ID NO: 1507463 - RNA, 19 nt, Pseudomonas aeruginosa PA01
caugccgaacuucuccgcc

SEQ ID NO: 1507464 - RNA, 20 nt, Pseudomonas aeruginosa PA01
caugccgaacuucuccgcca

SEQ ID NO: 1507465 - RNA, 22 nt, Pseudomonas aeruginosa PA01
caugcagcggcauggucagccc

SEQ ID NO: 1507466 - RNA, 23 nt, Pseudomonas aeruginosa PA01
caugcagcggcauggucagccca

SEQ ID NO: 1507467 - RNA, 16 nt, Pseudomonas aeruginosa PA01
caugcacuucgaccag

SEQ ID NO: 1507468 - RNA, 18 nt, Pseudomonas aeruginosa PA01
caugcacuucgaccagua

SEQ ID NO: 1507469 - RNA, 11 nt, Pseudomonas aeruginosa PA01
caugcacgccc

SEQ ID NO: 1507470 - RNA, 16 nt, Pseudomonas aeruginosa PA01
caugaucgccucggcg

SEQ ID NO: 1507471 - RNA, 17 nt, Pseudomonas aeruginosa PA01
caugaucgccucggcgc

SEQ ID NO: 1507472 - RNA, 18 nt, Pseudomonas aeruginosa PA01
caugaucgccucggcgcg

SEQ ID NO: 1507473 - RNA, 17 nt, Pseudomonas aeruginosa PA01
caugauggugccgccgg

SEQ ID NO: 1507474 - RNA, 19 nt, Pseudomonas aeruginosa PA01
caugaugccgaggcggccg

SEQ ID NO: 1507475 - RNA, 23 nt, Pseudomonas aeruginosa PA01
caugaucuggcugucgccgaucu

SEQ ID NO: 1507476 - RNA, 23 nt, Pseudomonas aeruginosa PA01
caucggcgaagcggaagcgcagc

SEQ ID NO: 1507477 - RNA, 15 nt, Pseudomonas aeruginosa PA01
caucggcgcuccgcc

SEQ ID NO: 1507478 - RNA, 17 nt, Pseudomonas aeruginosa PA01
caucggcggcaggccga

SEQ ID NO: 1507479 - RNA, 17 nt, Pseudomonas aeruginosa PA01
caucggcggcaggcgca

SEQ ID NO: 1507480 - RNA, 22 nt, Pseudomonas aeruginosa PA01
caucggcggauaacgccgcugg

SEQ ID NO: 1507481 - RNA, 15 nt, Pseudomonas aeruginosa PA01
caucggcgccgcgca

SEQ ID NO: 1507482 - RNA, 23 nt, Pseudomonas aeruginosa PA01
caucggcgccgcgcaccugggcg

SEQ ID NO: 1507483 - RNA, 19 nt, Pseudomonas aeruginosa PA01
caucggccaccuucgcccg

SEQ ID NO: 1507484 - RNA, 22 nt, Pseudomonas aeruginosa PA01
caucggccaccuucgcccgcug

SEQ ID NO: 1507485 - RNA, 22 nt, Pseudomonas aeruginosa PA01
caucggccuggggcucggcuuc

SEQ ID NO: 1507486 - RNA, 23 nt, Pseudomonas aeruginosa PA01
caucggcccggcuucgcggguga

SEQ ID NO: 1507487 - RNA, 13 nt, Pseudomonas aeruginosa PA01
caucggcccuggg

SEQ ID NO: 1507488 - RNA, 20 nt, Pseudomonas aeruginosa PA01
caucggcccugggcguggca

SEQ ID NO: 1507489 - RNA, 14 nt, Pseudomonas aeruginosa PA01
caucggccgccagg

SEQ ID NO: 1507490 - RNA, 18 nt, Pseudomonas aeruginosa PA01
caucggccauucggccug

SEQ ID NO: 1507491 - RNA, 19 nt, Pseudomonas aeruginosa PA01
caucggccauucggccugg

SEQ ID NO: 1507492 - RNA, 16 nt, Pseudomonas aeruginosa PA01
caucggcccgacgccg

SEQ ID NO: 1507493 - RNA, 21 nt, Pseudomonas aeruginosa PA01
caucggcccgacgccgcccgg

SEQ ID NO: 1507494 - RNA, 23 nt, Pseudomonas aeruginosa PA01
caucggcccgacgccgcccggca

SEQ ID NO: 1507495 - RNA, 18 nt, Pseudomonas aeruginosa PA01
caucgcuuuccuggccga

SEQ ID NO: 1507496 - RNA, 21 nt, Pseudomonas aeruginosa PA01
caucgcuuuccuggccgaccc

SEQ ID NO: 1507497 - RNA, 15 nt, Pseudomonas aeruginosa PA01
caucggagugcaugc

SEQ ID NO: 1507498 - RNA, 14 nt, Pseudomonas aeruginosa PA01
caucgcucugcuga

SEQ ID NO: 1507499 - RNA, 13 nt, Pseudomonas aeruginosa PA01
caucggucgcgcc

SEQ ID NO: 1507500 - RNA, 23 nt, Pseudomonas aeruginosa PA01
caucggugaccugguagucgcgg

SEQ ID NO: 1507501 - RNA, 17 nt, Pseudomonas aeruginosa PA01
caucgggauaccggcca

SEQ ID NO: 1507502 - RNA, 15 nt, Pseudomonas aeruginosa PA01
caucggcggcggccc

SEQ ID NO: 1507503 - RNA, 22 nt, Pseudomonas aeruginosa PA01
caucggcgguacgcccuccagc

SEQ ID NO: 1507504 - RNA, 13 nt, Pseudomonas aeruginosa PA01
caucggcucggca

SEQ ID NO: 1507505 - RNA, 14 nt, Pseudomonas aeruginosa PA01
caucggcuggucgu

SEQ ID NO: 1507506 - RNA, 20 nt, Pseudomonas aeruginosa PA01
caucucgccgcgcacgucga

SEQ ID NO: 1507507 - RNA, 12 nt, Pseudomonas aeruginosa PA01
caucucgccggc

SEQ ID NO: 1507508 - RNA, 14 nt, Pseudomonas aeruginosa PA01
caucucgccggcac

SEQ ID NO: 1507509 - RNA, 14 nt, Pseudomonas aeruginosa PA01
caucucgccgucgg

SEQ ID NO: 1507510 - RNA, 22 nt, Pseudomonas aeruginosa PA01
caucucgauggugaacgccagg

SEQ ID NO: 1507511 - RNA, 23 nt, Pseudomonas aeruginosa PA01
caucucgauggugaacgccaggc

SEQ ID NO: 1507512 - RNA, 14 nt, Pseudomonas aeruginosa PA01
caucuccugcugga

SEQ ID NO: 1507513 - RNA, 14 nt, Pseudomonas aeruginosa PA01
caucuccucgcuga

SEQ ID NO: 1507514 - RNA, 15 nt, Pseudomonas aeruginosa PA01
caucuccccaccaac

SEQ ID NO: 1507515 - RNA, 17 nt, Pseudomonas aeruginosa PA01
caucuccaggccgcuca

SEQ ID NO: 1507516 - RNA, 20 nt, Pseudomonas aeruginosa PA01
caucuccaggccgcucaccg

SEQ ID NO: 1507517 - RNA, 23 nt, Pseudomonas aeruginosa PA01
caucuccaggccgcucaccgcca

SEQ ID NO: 1507518 - RNA, 20 nt, Pseudomonas aeruginosa PA01
caucucagcaacccgcuccg

SEQ ID NO: 1507519 - RNA, 20 nt, Pseudomonas aeruginosa PA01
caucucgugguugaggcgcu

SEQ ID NO: 1507520 - RNA, 22 nt, Pseudomonas aeruginosa PA01
caucucgugguugaggcgcucg

SEQ ID NO: 1507521 - RNA, 20 nt, Pseudomonas aeruginosa PA01
caucucggccaggcccuuga

SEQ ID NO: 1507522 - RNA, 17 nt, Pseudomonas aeruginosa PA01
caucugcugcagcauca

SEQ ID NO: 1507523 - RNA, 21 nt, Pseudomonas aeruginosa PA01
caucugcugguccuggcgcga

SEQ ID NO: 1507524 - RNA, 13 nt, Pseudomonas aeruginosa PA01
caucugccgggcg

SEQ ID NO: 1507525 - RNA, 14 nt, Pseudomonas aeruginosa PA01
caucugccgggcgc

SEQ ID NO: 1507526 - RNA, 13 nt, Pseudomonas aeruginosa PA01
caucugcucgagg

SEQ ID NO: 1507527 - RNA, 19 nt, Pseudomonas aeruginosa PA01
caucugcucgaggauggca

SEQ ID NO: 1507528 - RNA, 12 nt, Pseudomonas aeruginosa PA01
caucguggggcg

SEQ ID NO: 1507529 - RNA, 15 nt, Pseudomonas aeruginosa PA01
caucgucucgcgaca

SEQ ID NO: 1507530 - RNA, 15 nt, Pseudomonas aeruginosa PA01
caucgucugcgcggc

SEQ ID NO: 1507531 - RNA, 16 nt, Pseudomonas aeruginosa PA01
caucguccagcucggc

SEQ ID NO: 1507532 - RNA, 17 nt, Pseudomonas aeruginosa PA01
caucguccagcucggcc

SEQ ID NO: 1507533 - RNA, 18 nt, Pseudomonas aeruginosa PA01
caucguccagcucggcca

SEQ ID NO: 1507534 - RNA, 23 nt, Pseudomonas aeruginosa PA01
caucgucgaugcguccgcgcagg

SEQ ID NO: 1507535 - RNA, 14 nt, Pseudomonas aeruginosa PA01
caucgucgaagggc

SEQ ID NO: 1507536 - RNA, 19 nt, Pseudomonas aeruginosa PA01
caucgucgcuuccggcgcc

SEQ ID NO: 1507537 - RNA, 20 nt, Pseudomonas aeruginosa PA01
caucgucgcuuccggcgcca

SEQ ID NO: 1507538 - RNA, 14 nt, Pseudomonas aeruginosa PA01
caucgucggcagcc

SEQ ID NO: 1507539 - RNA, 15 nt, Pseudomonas aeruginosa PA01
cagcaagccgcagcg

SEQ ID NO: 1507540 - RNA, 22 nt, Pseudomonas aeruginosa PA01
cagcaagccguagaacgccagg

SEQ ID NO: 1507541 - RNA, 19 nt, Pseudomonas aeruginosa PA01
cagcaagucgaacaggccc

SEQ ID NO: 1507542 - RNA, 14 nt, Pseudomonas aeruginosa PA01
cagcaaugccagcg

SEQ ID NO: 1507543 - RNA, 17 nt, Pseudomonas aeruginosa PA01
cagcaaugccagcgcca

SEQ ID NO: 1507544 - RNA, 15 nt, Pseudomonas aeruginosa PA01
cagcaacaccgcgca

SEQ ID NO: 1507545 - RNA, 23 nt, Pseudomonas aeruginosa PA01
cagcaacugaccuggccgucccu

SEQ ID NO: 1507546 - RNA, 16 nt, Pseudomonas aeruginosa PA01
cagcaacuggucgccg

SEQ ID NO: 1507547 - RNA, 21 nt, Pseudomonas aeruginosa PA01
cagcaacuggucgccgcaggu

SEQ ID NO: 1507548 - RNA, 20 nt, Pseudomonas aeruginosa PA01
cagauggcuggucaggcuga

SEQ ID NO: 1507549 - RNA, 16 nt, Pseudomonas aeruginosa PA01
cagauguccaggcagg

SEQ ID NO: 1507550 - RNA, 16 nt, Pseudomonas aeruginosa PA01
cagaugcgcgucgccg

SEQ ID NO: 1507551 - RNA, 16 nt, Pseudomonas aeruginosa PA01
cagaugaucaggccga

SEQ ID NO: 1507552 - RNA, 17 nt, Pseudomonas aeruginosa PA01
cagaugaucaggccgag

SEQ ID NO: 1507553 - RNA, 16 nt, Pseudomonas aeruginosa PA01
cagaugaucgccaccg

SEQ ID NO: 1507554 - RNA, 18 nt, Pseudomonas aeruginosa PA01
cagaugacgauggccgcc

SEQ ID NO: 1507555 - RNA, 20 nt, Pseudomonas aeruginosa PA01
cagaugacgauggccgccgc

SEQ ID NO: 1507556 - RNA, 13 nt, Pseudomonas aeruginosa PA01
cagcacgccuucc

SEQ ID NO: 1507557 - RNA, 17 nt, Pseudomonas aeruginosa PA01
cagcacgagcuuggcca

SEQ ID NO: 1507558 - RNA, 19 nt, Pseudomonas aeruginosa PA01
cagcacgcugacgccggca

SEQ ID NO: 1507559 - RNA, 22 nt, Pseudomonas aeruginosa PA01
cagcacugguggacggucucgc

SEQ ID NO: 1507560 - RNA, 19 nt, Pseudomonas aeruginosa PA01
cagcaccuucaucaccagg

SEQ ID NO: 1507561 - RNA, 14 nt, Pseudomonas aeruginosa PA01
cagcaccugcgccg

SEQ ID NO: 1507562 - RNA, 19 nt, Pseudomonas aeruginosa PA01
cagcaccugcgccgaaggc

SEQ ID NO: 1507563 - RNA, 21 nt, Pseudomonas aeruginosa PA01
cagcaccuggcagugcgccgg

SEQ ID NO: 1507564 - RNA, 22 nt, Pseudomonas aeruginosa PA01
cagcaccuggcagugcgccggc

SEQ ID NO: 1507565 - RNA, 23 nt, Pseudomonas aeruginosa PA01
cagcaccuggcagugcgccggca

SEQ ID NO: 1507566 - RNA, 20 nt, Pseudomonas aeruginosa PA01
cagcaccucguaggccgacu

SEQ ID NO: 1507567 - RNA, 11 nt, Pseudomonas aeruginosa PA01
cagcaccggcu

SEQ ID NO: 1507568 - RNA, 18 nt, Pseudomonas aeruginosa PA01
cagcaccgccugcaacuc

SEQ ID NO: 1507569 - RNA, 16 nt, Pseudomonas aeruginosa PA01
cagcaccgccuggucg

SEQ ID NO: 1507570 - RNA, 13 nt, Pseudomonas aeruginosa PA01
cagcacccggucg

SEQ ID NO: 1507571 - RNA, 20 nt, Pseudomonas aeruginosa PA01
cagcaccgagacgcccugga

SEQ ID NO: 1507572 - RNA, 16 nt, Pseudomonas aeruginosa PA01
cagcaccgccaccagc

SEQ ID NO: 1507573 - RNA, 17 nt, Pseudomonas aeruginosa PA01
cagcacccgcaccagcc

SEQ ID NO: 1507574 - RNA, 14 nt, Pseudomonas aeruginosa PA01
cagcaauugccggc

SEQ ID NO: 1507575 - RNA, 16 nt, Pseudomonas aeruginosa PA01
cagcacccccagcagg

SEQ ID NO: 1507576 - RNA, 17 nt, Pseudomonas aeruginosa PA01
cagcaucgcaucggcga

SEQ ID NO: 1507577 - RNA, 17 nt, Pseudomonas aeruginosa PA01
cagcaucgccggcagcg

SEQ ID NO: 1507578 - RNA, 18 nt, Pseudomonas aeruginosa PA01
cagcaucgccggcagcgc

SEQ ID NO: 1507579 - RNA, 19 nt, Pseudomonas aeruginosa PA01
cagcaucgccggcagcgcc

SEQ ID NO: 1507580 - RNA, 21 nt, Pseudomonas aeruginosa PA01
cagcaucgccggcagcgccgc

SEQ ID NO: 1507581 - RNA, 18 nt, Pseudomonas aeruginosa PA01
cagcauccgugcgaacac

SEQ ID NO: 1507582 - RNA, 12 nt, Pseudomonas aeruginosa PA01
cagcaugccgcu

SEQ ID NO: 1507583 - RNA, 22 nt, Pseudomonas aeruginosa PA01
cagcauggcgaagcucggccgc

SEQ ID NO: 1507584 - RNA, 19 nt, Pseudomonas aeruginosa PA01
cagcaugcucgggcugccg

SEQ ID NO: 1507585 - RNA, 22 nt, Pseudomonas aeruginosa PA01
cagcauuaccccgaccaggucg

SEQ ID NO: 1507586 - RNA, 20 nt, Pseudomonas aeruginosa PA01
cagcauguuguuauggccga

SEQ ID NO: 1507587 - RNA, 18 nt, Pseudomonas aeruginosa PA01
cagcagggucagcagcgc

SEQ ID NO: 1507588 - RNA, 20 nt, Pseudomonas aeruginosa PA01
cagcagggucagcagcgcca

SEQ ID NO: 1507589 - RNA, 20 nt, Pseudomonas aeruginosa PA01
cagcagggucuucaggcgcc

SEQ ID NO: 1507590 - RNA, 15 nt, Pseudomonas aeruginosa PA01
cagcagggucgcgcc

SEQ ID NO: 1507591 - RNA, 17 nt, Pseudomonas aeruginosa PA01
cagcagggucgcgccgu

SEQ ID NO: 1507592 - RNA, 22 nt, Pseudomonas aeruginosa PA01
cagcagggccaggccgagcgcg

SEQ ID NO: 1507593 - RNA, 16 nt, Pseudomonas aeruginosa PA01
cagcagggccgccgag

SEQ ID NO: 1507594 - RNA, 17 nt, Pseudomonas aeruginosa PA01
cagcagggccgccgagg

SEQ ID NO: 1507595 - RNA, 14 nt, Pseudomonas aeruginosa PA01
cagcaggccgccgc

SEQ ID NO: 1507596 - RNA, 21 nt, Pseudomonas aeruginosa PA01
cagcaggccgccgcgugccgc

SEQ ID NO: 1507597 - RNA, 13 nt, Pseudomonas aeruginosa PA01
cagcagggccagc

SEQ ID NO: 1507598 - RNA, 18 nt, Pseudomonas aeruginosa PA01
cagcagggccagcagcgc

SEQ ID NO: 1507599 - RNA, 19 nt, Pseudomonas aeruginosa PA01
cagcagggccagcagcgcu

SEQ ID NO: 1507600 - RNA, 14 nt, Pseudomonas aeruginosa PA01
cagcagggccagcg

SEQ ID NO: 1507601 - RNA, 16 nt, Pseudomonas aeruginosa PA01
cagcagggccagcgcc

SEQ ID NO: 1507602 - RNA, 12 nt, Pseudomonas aeruginosa PA01
cagcaggccgcu

SEQ ID NO: 1507603 - RNA, 15 nt, Pseudomonas aeruginosa PA01
cagcaggccgaaggc

SEQ ID NO: 1507604 - RNA, 13 nt, Pseudomonas aeruginosa PA01
cagcaggccgagc

SEQ ID NO: 1507605 - RNA, 18 nt, Pseudomonas aeruginosa PA01
cagcaggccgaggucggc

SEQ ID NO: 1507606 - RNA, 21 nt, Pseudomonas aeruginosa PA01
cagcaggccgaggucggcggc

SEQ ID NO: 1507607 - RNA, 22 nt, Pseudomonas aeruginosa PA01
cagcaggccgaggucggcggcg

SEQ ID NO: 1507608 - RNA, 18 nt, Pseudomonas aeruginosa PA01
cagcaggccgaucagcgg

SEQ ID NO: 1507609 - RNA, 19 nt, Pseudomonas aeruginosa PA01
cagcaggccgaucagcggc

SEQ ID NO: 1507610 - RNA, 21 nt, Pseudomonas aeruginosa PA01
cagcaggccgaucagcggcgg

SEQ ID NO: 1507611 - RNA, 13 nt, Pseudomonas aeruginosa PA01
cagcaggccgccg

SEQ ID NO: 1507612 - RNA, 23 nt, Pseudomonas aeruginosa PA01
cagcaguucgucgccacgcccgc

SEQ ID NO: 1507613 - RNA, 18 nt, Pseudomonas aeruginosa PA01
cagcaguugcaacagcgc

SEQ ID NO: 1507614 - RNA, 19 nt, Pseudomonas aeruginosa PA01
cagcaguugcaacagcgcg

SEQ ID NO: 1507615 - RNA, 16 nt, Pseudomonas aeruginosa PA01
cagcagugcggggcgc

SEQ ID NO: 1507616 - RNA, 23 nt, Pseudomonas aeruginosa PA01
cagcagugcggggcgcucgcccu

SEQ ID NO: 1507617 - RNA, 18 nt, Pseudomonas aeruginosa PA01
cagcaguggcuccgcgcg

SEQ ID NO: 1507618 - RNA, 15 nt, Pseudomonas aeruginosa PA01
cagcacuuccggcgc

SEQ ID NO: 1507619 - RNA, 22 nt, Pseudomonas aeruginosa PA01
cagcacuuccugaaggcgcggg

SEQ ID NO: 1507620 - RNA, 16 nt, Pseudomonas aeruginosa PA01
cagcacuucggcgcgc

SEQ ID NO: 1507621 - RNA, 14 nt, Pseudomonas aeruginosa PA01
cagcagcacgcccu

SEQ ID NO: 1507622 - RNA, 14 nt, Pseudomonas aeruginosa PA01
cagcagcaccgcgc

SEQ ID NO: 1507623 - RNA, 17 nt, Pseudomonas aeruginosa PA01
cagcagcacggcgacga

SEQ ID NO: 1507624 - RNA, 13 nt, Pseudomonas aeruginosa PA01
cagcagcggcagg

SEQ ID NO: 1507625 - RNA, 18 nt, Pseudomonas aeruginosa PA01
cagcagcggcggcgccgg

SEQ ID NO: 1507626 - RNA, 18 nt, Pseudomonas aeruginosa PA01
cagcagcggcucacgccc

SEQ ID NO: 1507627 - RNA, 14 nt, Pseudomonas aeruginosa PA01
cagcagcggcggcg

SEQ ID NO: 1507628 - RNA, 13 nt, Pseudomonas aeruginosa PA01
cagcagcggcggc

SEQ ID NO: 1507629 - RNA, 13 nt, Pseudomonas aeruginosa PA01
cagcagcggcacc

SEQ ID NO: 1507630 - RNA, 16 nt, Pseudomonas aeruginosa PA01
cagcagcggcaccagc

SEQ ID NO: 1507631 - RNA, 15 nt, Pseudomonas aeruginosa PA01
cagcagcggcagcca

SEQ ID NO: 1507632 - RNA, 21 nt, Pseudomonas aeruginosa PA01
cagcagcggauauucgacgcg

SEQ ID NO: 1507633 - RNA, 19 nt, Pseudomonas aeruginosa PA01
cagcagcggaucggcggug

SEQ ID NO: 1507634 - RNA, 20 nt, Pseudomonas aeruginosa PA01
cagcagcggcaaaggcccgg

SEQ ID NO: 1507635 - RNA, 21 nt, Pseudomonas aeruginosa PA01
cagcagcggcaaaggcccggc

SEQ ID NO: 1507636 - RNA, 15 nt, Pseudomonas aeruginosa PA01
cagcagcgcugauca

SEQ ID NO: 1507637 - RNA, 12 nt, Pseudomonas aeruginosa PA01
cagcagcgccuu

SEQ ID NO: 1507638 - RNA, 17 nt, Pseudomonas aeruginosa PA01
cagcagcuucggcgcga

SEQ ID NO: 1507639 - RNA, 20 nt, Pseudomonas aeruginosa PA01
cagcagcgucgcgucggccu

SEQ ID NO: 1507640 - RNA, 14 nt, Pseudomonas aeruginosa PA01
cagcagcgggcguc

SEQ ID NO: 1507641 - RNA, 16 nt, Pseudomonas aeruginosa PA01
cagcagcgggcguccg

SEQ ID NO: 1507642 - RNA, 18 nt, Pseudomonas aeruginosa PA01
cagcagcgggcguccggc

SEQ ID NO: 1507643 - RNA, 22 nt, Pseudomonas aeruginosa PA01
cagcagcgguacggucgaggcg

SEQ ID NO: 1507644 - RNA, 14 nt, Pseudomonas aeruginosa PA01
cagcagcucgccgc

SEQ ID NO: 1507645 - RNA, 22 nt, Pseudomonas aeruginosa PA01
cagcagcuccauguccgaacgc

SEQ ID NO: 1507646 - RNA, 16 nt, Pseudomonas aeruginosa PA01
cagcaggaccuggccg

SEQ ID NO: 1507647 - RNA, 16 nt, Pseudomonas aeruginosa PA01
cagcaggcaggcgcgg

SEQ ID NO: 1507648 - RNA, 17 nt, Pseudomonas aeruginosa PA01
cagcaggaugcagucgg

SEQ ID NO: 1507649 - RNA, 16 nt, Pseudomonas aeruginosa PA01
cagcaggcacagggcg

SEQ ID NO: 1507650 - RNA, 17 nt, Pseudomonas aeruginosa PA01
cagcaggcacagggcga

SEQ ID NO: 1507651 - RNA, 18 nt, Pseudomonas aeruginosa PA01
cagcaggcacagggcgac

SEQ ID NO: 1507652 - RNA, 12 nt, Pseudomonas aeruginosa PA01
cagcaggccgaa

SEQ ID NO: 1507653 - RNA, 19 nt, Pseudomonas aeruginosa PA01
cagcaggcccgagccggac

SEQ ID NO: 1507654 - RNA, 15 nt, Pseudomonas aeruginosa PA01
cagcagcuugccggc

SEQ ID NO: 1507655 - RNA, 21 nt, Pseudomonas aeruginosa PA01
cagcaggaaaacgcucaggcc

SEQ ID NO: 1507656 - RNA, 22 nt, Pseudomonas aeruginosa PA01
cagcaggaaaacgcucaggcca

SEQ ID NO: 1507657 - RNA, 14 nt, Pseudomonas aeruginosa PA01
cagcaggaagccga

SEQ ID NO: 1507658 - RNA, 18 nt, Pseudomonas aeruginosa PA01
cagcaggaagccgaccac

SEQ ID NO: 1507659 - RNA, 14 nt, Pseudomonas aeruginosa PA01
cagcaggacgucga

SEQ ID NO: 1507660 - RNA, 16 nt, Pseudomonas aeruginosa PA01
cagcaggacgucgagg

SEQ ID NO: 1507661 - RNA, 19 nt, Pseudomonas aeruginosa PA01
cagcaggagaagcgccucg

SEQ ID NO: 1507662 - RNA, 22 nt, Pseudomonas aeruginosa PA01
cagcaggagaagcgccucgccu

SEQ ID NO: 1507663 - RNA, 14 nt, Pseudomonas aeruginosa PA01
cagcaggagcaugu

SEQ ID NO: 1507664 - RNA, 15 nt, Pseudomonas aeruginosa PA01
cagcaggagcgccau

SEQ ID NO: 1507665 - RNA, 15 nt, Pseudomonas aeruginosa PA01
cagcaggaucagcgc

SEQ ID NO: 1507666 - RNA, 17 nt, Pseudomonas aeruginosa PA01
cagcaggaucagcgcau

SEQ ID NO: 1507667 - RNA, 23 nt, Pseudomonas aeruginosa PA01
cagcaggauccaggugcgcggca

SEQ ID NO: 1507668 - RNA, 20 nt, Pseudomonas aeruginosa PA01
cagcaggaucgacagcagcg

SEQ ID NO: 1507669 - RNA, 21 nt, Pseudomonas aeruginosa PA01
cagcaggaucgacagcagcgc

SEQ ID NO: 1507670 - RNA, 23 nt, Pseudomonas aeruginosa PA01
cagcaggaucggagagacccgcc

SEQ ID NO: 1507671 - RNA, 19 nt, Pseudomonas aeruginosa PA01
cagaacgaaaaaggcgcgc

SEQ ID NO: 1507672 - RNA, 16 nt, Pseudomonas aeruginosa PA01
cagaacgccgcgcacc

SEQ ID NO: 1507673 - RNA, 17 nt, Pseudomonas aeruginosa PA01
cagaacgccgcgcaccu

SEQ ID NO: 1507674 - RNA, 16 nt, Pseudomonas aeruginosa PA01
cagaacuugcgcaccg

SEQ ID NO: 1507675 - RNA, 22 nt, Pseudomonas aeruginosa PA01
cagaacuugcgcaccgcgccgg

SEQ ID NO: 1507676 - RNA, 16 nt, Pseudomonas aeruginosa PA01
cagaacugcucggcgu

SEQ ID NO: 1507677 - RNA, 19 nt, Pseudomonas aeruginosa PA01
cagaacugcucggcgucca

SEQ ID NO: 1507678 - RNA, 19 nt, Pseudomonas aeruginosa PA01
cagaagacgauggugaucu

SEQ ID NO: 1507679 - RNA, 16 nt, Pseudomonas aeruginosa PA01
cagaaccgccagcagu

SEQ ID NO: 1507680 - RNA, 14 nt, Pseudomonas aeruginosa PA01
cacuucggcgcgcg

SEQ ID NO: 1507681 - RNA, 20 nt, Pseudomonas aeruginosa PA01
cacuucggcgcgcggcagca

SEQ ID NO: 1507682 - RNA, 22 nt, Pseudomonas aeruginosa PA01
cacuucgaccaguacgucgaga

SEQ ID NO: 1507683 - RNA, 17 nt, Pseudomonas aeruginosa PA01
cacuucguccaggccgc

SEQ ID NO: 1507684 - RNA, 18 nt, Pseudomonas aeruginosa PA01
cacuucguccaggccgcc

SEQ ID NO: 1507685 - RNA, 16 nt, Pseudomonas aeruginosa PA01
cacuucguccggccgc

SEQ ID NO: 1507686 - RNA, 18 nt, Pseudomonas aeruginosa PA01
cacuucucgaacagcucc

SEQ ID NO: 1507687 - RNA, 20 nt, Pseudomonas aeruginosa PA01
cacuugaccgucggcaagca

SEQ ID NO: 1507688 - RNA, 22 nt, Pseudomonas aeruginosa PA01
cacuugaggaagugcagggcgu

SEQ ID NO: 1507689 - RNA, 18 nt, Pseudomonas aeruginosa PA01
cacuugcgccggcugccg

SEQ ID NO: 1507690 - RNA, 17 nt, Pseudomonas aeruginosa PA01
cacuuccggcccggcca

SEQ ID NO: 1507691 - RNA, 21 nt, Pseudomonas aeruginosa PA01
cacuuccggcccggccaggcg

SEQ ID NO: 1507692 - RNA, 13 nt, Pseudomonas aeruginosa PA01
cacuucccggcgc

SEQ ID NO: 1507693 - RNA, 14 nt, Pseudomonas aeruginosa PA01
cacuucccggcgca

SEQ ID NO: 1507694 - RNA, 18 nt, Pseudomonas aeruginosa PA01
cacuuccugaaggcgcgg

SEQ ID NO: 1507695 - RNA, 19 nt, Pseudomonas aeruginosa PA01
cacuuccaccggcuugccg

SEQ ID NO: 1507696 - RNA, 16 nt, Pseudomonas aeruginosa PA01
cacuuccacuccaggc

SEQ ID NO: 1507697 - RNA, 17 nt, Pseudomonas aeruginosa PA01
cacuuccagcacgccga

SEQ ID NO: 1507698 - RNA, 23 nt, Pseudomonas aeruginosa PA01
cacuggauggucacgccgaggcu

SEQ ID NO: 1507699 - RNA, 20 nt, Pseudomonas aeruginosa PA01
cacuucacgacaggcggcgg

SEQ ID NO: 1507700 - RNA, 21 nt, Pseudomonas aeruginosa PA01
cacucaggcaugcgggcgcga

SEQ ID NO: 1507701 - RNA, 23 nt, Pseudomonas aeruginosa PA01
cacucagccagcggcgcuugcgg

SEQ ID NO: 1507702 - RNA, 22 nt, Pseudomonas aeruginosa PA01
cacguugcugugcugcaccagc

SEQ ID NO: 1507703 - RNA, 17 nt, Pseudomonas aeruginosa PA01
cacguugaggucgaaga

SEQ ID NO: 1507704 - RNA, 18 nt, Pseudomonas aeruginosa PA01
cacguugaggucgaagac

SEQ ID NO: 1507705 - RNA, 13 nt, Pseudomonas aeruginosa PA01
cacgcgcaguacg

SEQ ID NO: 1507706 - RNA, 15 nt, Pseudomonas aeruginosa PA01
cacgcgauauccgcc

SEQ ID NO: 1507707 - RNA, 20 nt, Pseudomonas aeruginosa PA01
cacgcgauauccgccaggcg

SEQ ID NO: 1507708 - RNA, 23 nt, Pseudomonas aeruginosa PA01
cacgcgauauccgccaggcggag

SEQ ID NO: 1507709 - RNA, 19 nt, Pseudomonas aeruginosa PA01
cacgcgaccagcgccaggc

SEQ ID NO: 1507710 - RNA, 18 nt, Pseudomonas aeruginosa PA01
cacgcgagaagccgccca

SEQ ID NO: 1507711 - RNA, 12 nt, Pseudomonas aeruginosa PA01
cacuccagcgcg

SEQ ID NO: 1507712 - RNA, 18 nt, Pseudomonas aeruginosa PA01
cacuccccagcaggcagg

SEQ ID NO: 1507713 - RNA, 22 nt, Pseudomonas aeruginosa PA01
cacuccgggcagaccagcagcg

SEQ ID NO: 1507714 - RNA, 13 nt, Pseudomonas aeruginosa PA01
cacuccggcagca

SEQ ID NO: 1507715 - RNA, 15 nt, Pseudomonas aeruginosa PA01
cacuccggcaggcgc

SEQ ID NO: 1507716 - RNA, 17 nt, Pseudomonas aeruginosa PA01
cacuccggcaggcgcuc

SEQ ID NO: 1507717 - RNA, 15 nt, Pseudomonas aeruginosa PA01
cacuccgucuccagc

SEQ ID NO: 1507718 - RNA, 18 nt, Pseudomonas aeruginosa PA01
cacuccgucuccagcaac

SEQ ID NO: 1507719 - RNA, 14 nt, Pseudomonas aeruginosa PA01
cacucgacaggcca

SEQ ID NO: 1507720 - RNA, 14 nt, Pseudomonas aeruginosa PA01
cacugcggcggucc

SEQ ID NO: 1507721 - RNA, 15 nt, Pseudomonas aeruginosa PA01
cacuggaacagcgcg

SEQ ID NO: 1507722 - RNA, 17 nt, Pseudomonas aeruginosa PA01
cacugcuuggccaggcg

SEQ ID NO: 1507723 - RNA, 18 nt, Pseudomonas aeruginosa PA01
cacugcuuggccaggcgc

SEQ ID NO: 1507724 - RNA, 20 nt, Pseudomonas aeruginosa PA01
cacugcuuggccaggcgcuu

SEQ ID NO: 1507725 - RNA, 19 nt, Pseudomonas aeruginosa PA01
cacugccaggagcacgccg

SEQ ID NO: 1507726 - RNA, 14 nt, Pseudomonas aeruginosa PA01
cagagacgcagcgc

SEQ ID NO: 1507727 - RNA, 17 nt, Pseudomonas aeruginosa PA01
cagagaggcuggcgcuc

SEQ ID NO: 1507728 - RNA, 16 nt, Pseudomonas aeruginosa PA01
cagagcgccagccagc

SEQ ID NO: 1507729 - RNA, 19 nt, Pseudomonas aeruginosa PA01
cagagcgccagccagcgcg

SEQ ID NO: 1507730 - RNA, 19 nt, Pseudomonas aeruginosa PA01
cagagcgccaugacccgcg

SEQ ID NO: 1507731 - RNA, 22 nt, Pseudomonas aeruginosa PA01
cagagcgcgcccugcaggccga

SEQ ID NO: 1507732 - RNA, 23 nt, Pseudomonas aeruginosa PA01
cagagcgcgcccugcaggccgaa

SEQ ID NO: 1507733 - RNA, 13 nt, Pseudomonas aeruginosa PA01
cagagcgcgcuac

SEQ ID NO: 1507734 - RNA, 20 nt, Pseudomonas aeruginosa PA01
cagagcgcugccugcaccgg

SEQ ID NO: 1507735 - RNA, 13 nt, Pseudomonas aeruginosa PA01
cagagcggccagg

SEQ ID NO: 1507736 - RNA, 13 nt, Pseudomonas aeruginosa PA01
cagagcggccggc

SEQ ID NO: 1507737 - RNA, 14 nt, Pseudomonas aeruginosa PA01
cagagcggccggcg

SEQ ID NO: 1507738 - RNA, 16 nt, Pseudomonas aeruginosa PA01
cagagcggccggcgcg

SEQ ID NO: 1507739 - RNA, 17 nt, Pseudomonas aeruginosa PA01
cagagcggccggcgcgg

SEQ ID NO: 1507740 - RNA, 19 nt, Pseudomonas aeruginosa PA01
cagagcggccggcgcggcg

SEQ ID NO: 1507741 - RNA, 20 nt, Pseudomonas aeruginosa PA01
cagagcggugaaaccggcaa

SEQ ID NO: 1507742 - RNA, 21 nt, Pseudomonas aeruginosa PA01
cagagcggugaaaccggcaag

SEQ ID NO: 1507743 - RNA, 19 nt, Pseudomonas aeruginosa PA01
cagacguggcauucgucgc

SEQ ID NO: 1507744 - RNA, 21 nt, Pseudomonas aeruginosa PA01
cagacguggcauucgucgccg

SEQ ID NO: 1507745 - RNA, 22 nt, Pseudomonas aeruginosa PA01
cagacguggcauucgucgccgc

SEQ ID NO: 1507746 - RNA, 14 nt, Pseudomonas aeruginosa PA01
cagacgcagcagcu

SEQ ID NO: 1507747 - RNA, 17 nt, Pseudomonas aeruginosa PA01
cagacucuccaggucgg

SEQ ID NO: 1507748 - RNA, 22 nt, Pseudomonas aeruginosa PA01
cagacucuccaggucggucggc

SEQ ID NO: 1507749 - RNA, 23 nt, Pseudomonas aeruginosa PA01
cagacucuccaggucggucggcg

SEQ ID NO: 1507750 - RNA, 19 nt, Pseudomonas aeruginosa PA01
cagacuccggcgcagccca

SEQ ID NO: 1507751 - RNA, 16 nt, Pseudomonas aeruginosa PA01
cagacguccagcgcca

SEQ ID NO: 1507752 - RNA, 14 nt, Pseudomonas aeruginosa PA01
cagacaucgccgag

SEQ ID NO: 1507753 - RNA, 21 nt, Pseudomonas aeruginosa PA01
cagacaucgccgagggcgaag

SEQ ID NO: 1507754 - RNA, 21 nt, Pseudomonas aeruginosa PA01
cagacaggccagcucgcccgc

SEQ ID NO: 1507755 - RNA, 14 nt, Pseudomonas aeruginosa PA01
cagacagcccucca

SEQ ID NO: 1507756 - RNA, 21 nt, Pseudomonas aeruginosa PA01
cagacgauugaccucccgcgc

SEQ ID NO: 1507757 - RNA, 21 nt, Pseudomonas aeruginosa PA01
cagacacaaaaaacccggcga

SEQ ID NO: 1507758 - RNA, 22 nt, Pseudomonas aeruginosa PA01
cagacacgccucaaggcaucgc

SEQ ID NO: 1507759 - RNA, 13 nt, Pseudomonas aeruginosa PA01
cagacaccaccag

SEQ ID NO: 1507760 - RNA, 19 nt, Pseudomonas aeruginosa PA01
cagaggcgcuccaccaggg

SEQ ID NO: 1507761 - RNA, 12 nt, Pseudomonas aeruginosa PA01
cagagggcgaug

SEQ ID NO: 1507762 - RNA, 21 nt, Pseudomonas aeruginosa PA01
cagaggaacaguucggcgagu

SEQ ID NO: 1507763 - RNA, 17 nt, Pseudomonas aeruginosa PA01
cagaggcaacaccaucg

SEQ ID NO: 1507764 - RNA, 15 nt, Pseudomonas aeruginosa PA01
cagaggcgaccagcc

SEQ ID NO: 1507765 - RNA, 23 nt, Pseudomonas aeruginosa PA01
cagaggcgaccagccggggcgua

SEQ ID NO: 1507766 - RNA, 23 nt, Pseudomonas aeruginosa PA01
cagagcuggaagucguccagcag

SEQ ID NO: 1507767 - RNA, 22 nt, Pseudomonas aeruginosa PA01
cagagcuggacgacgcuggccu

SEQ ID NO: 1507768 - RNA, 19 nt, Pseudomonas aeruginosa PA01
cagaggcugacccgcuguc

SEQ ID NO: 1507769 - RNA, 14 nt, Pseudomonas aeruginosa PA01
cagagggucgccag

SEQ ID NO: 1507770 - RNA, 15 nt, Pseudomonas aeruginosa PA01
cagagggucgccagc

SEQ ID NO: 1507771 - RNA, 14 nt, Pseudomonas aeruginosa PA01
cagagucgcaccgg

SEQ ID NO: 1507772 - RNA, 16 nt, Pseudomonas aeruginosa PA01
cagagucgcaccggga

SEQ ID NO: 1507773 - RNA, 15 nt, Pseudomonas aeruginosa PA01
cagaguggcgcggcu

SEQ ID NO: 1507774 - RNA, 20 nt, Pseudomonas aeruginosa PA01
cagaguuucucggucgccgc

SEQ ID NO: 1507775 - RNA, 23 nt, Pseudomonas aeruginosa PA01
cagaguuucucggucgccgccag

SEQ ID NO: 1507776 - RNA, 19 nt, Pseudomonas aeruginosa PA01
cagaguugccuguccagcu

SEQ ID NO: 1507777 - RNA, 17 nt, Pseudomonas aeruginosa PA01
cagauagugcggccagg

SEQ ID NO: 1507778 - RNA, 18 nt, Pseudomonas aeruginosa PA01
cagauagugcggccaggc

SEQ ID NO: 1507779 - RNA, 17 nt, Pseudomonas aeruginosa PA01
cagaucaccaccaccgu

SEQ ID NO: 1507780 - RNA, 23 nt, Pseudomonas aeruginosa PA01
cagaucaccaccaccgucuggcg

SEQ ID NO: 1507781 - RNA, 21 nt, Pseudomonas aeruginosa PA01
cagaucgaggaccgacggcaa

SEQ ID NO: 1507782 - RNA, 22 nt, Pseudomonas aeruginosa PA01
cagaucgcauuguugcggucgc

SEQ ID NO: 1507783 - RNA, 22 nt, Pseudomonas aeruginosa PA01
cagaucgccgcguagcgccagg

SEQ ID NO: 1507784 - RNA, 19 nt, Pseudomonas aeruginosa PA01
cagaucgccagcucgccgc

SEQ ID NO: 1507785 - RNA, 20 nt, Pseudomonas aeruginosa PA01
cagaucauguagagcaggcu

SEQ ID NO: 1507786 - RNA, 22 nt, Pseudomonas aeruginosa PA01
cagaucauguagagcaggcugc

SEQ ID NO: 1507787 - RNA, 23 nt, Pseudomonas aeruginosa PA01
cagauccgggaaggccugacgca

SEQ ID NO: 1507788 - RNA, 14 nt, Pseudomonas aeruginosa PA01
cagaugaaacugcc

SEQ ID NO: 1507789 - RNA, 20 nt, Pseudomonas aeruginosa PA01
cagaucuuccccguugccga

SEQ ID NO: 1507790 - RNA, 14 nt, Pseudomonas aeruginosa PA01
cagaucggcgcgca

SEQ ID NO: 1507791 - RNA, 17 nt, Pseudomonas aeruginosa PA01
cagaucggcgcgcaggg

SEQ ID NO: 1507792 - RNA, 13 nt, Pseudomonas aeruginosa PA01
cagcgcgcgccga

SEQ ID NO: 1507793 - RNA, 15 nt, Pseudomonas aeruginosa PA01
cagcgcgcgccgagc

SEQ ID NO: 1507794 - RNA, 16 nt, Pseudomonas aeruginosa PA01
cagcgcgcgccgagca

SEQ ID NO: 1507795 - RNA, 17 nt, Pseudomonas aeruginosa PA01
cagcgcgcgccgagcaa

SEQ ID NO: 1507796 - RNA, 18 nt, Pseudomonas aeruginosa PA01
cagcgcgcgccgagcaac

SEQ ID NO: 1507797 - RNA, 21 nt, Pseudomonas aeruginosa PA01
cagcgcgcgccgagcaaccgc

SEQ ID NO: 1507798 - RNA, 23 nt, Pseudomonas aeruginosa PA01
cagcgcgcgccgagcaaccgcga

SEQ ID NO: 1507799 - RNA, 17 nt, Pseudomonas aeruginosa PA01
cagcgcgcccggcgcca

SEQ ID NO: 1507800 - RNA, 19 nt, Pseudomonas aeruginosa PA01
cagcgcgcccggcgccacc

SEQ ID NO: 1507801 - RNA, 22 nt, Pseudomonas aeruginosa PA01
cagcgcgcccggcgccaccccg

SEQ ID NO: 1507802 - RNA, 15 nt, Pseudomonas aeruginosa PA01
cagcgcgccgagcca

SEQ ID NO: 1507803 - RNA, 17 nt, Pseudomonas aeruginosa PA01
cagcgcgccgagccagg

SEQ ID NO: 1507804 - RNA, 13 nt, Pseudomonas aeruginosa PA01
cagcgcgcggacc

SEQ ID NO: 1507805 - RNA, 13 nt, Pseudomonas aeruginosa PA01
cagcgcgcggcca

SEQ ID NO: 1507806 - RNA, 14 nt, Pseudomonas aeruginosa PA01
cagcgcgcggccag

SEQ ID NO: 1507807 - RNA, 13 nt, Pseudomonas aeruginosa PA01
cagcgcgcggcuc

SEQ ID NO: 1507808 - RNA, 14 nt, Pseudomonas aeruginosa PA01
cagcgcgcggcucg

SEQ ID NO: 1507809 - RNA, 18 nt, Pseudomonas aeruginosa PA01
cagcgcgcggcucggcgg

SEQ ID NO: 1507810 - RNA, 17 nt, Pseudomonas aeruginosa PA01
cagcgcgcgcuggcgca

SEQ ID NO: 1507811 - RNA, 16 nt, Pseudomonas aeruginosa PA01
cagcgcgcgcuggucg

SEQ ID NO: 1507812 - RNA, 17 nt, Pseudomonas aeruginosa PA01
cagcgcgcgucggcgaa

SEQ ID NO: 1507813 - RNA, 19 nt, Pseudomonas aeruginosa PA01
cagcgcgcgucggcgaacc

SEQ ID NO: 1507814 - RNA, 19 nt, Pseudomonas aeruginosa PA01
cagcgcgcucggccuggug

SEQ ID NO: 1507815 - RNA, 20 nt, Pseudomonas aeruginosa PA01
cagcgcgcucggccuggugc

SEQ ID NO: 1507816 - RNA, 18 nt, Pseudomonas aeruginosa PA01
cagcgcgcucuucgccgc

SEQ ID NO: 1507817 - RNA, 22 nt, Pseudomonas aeruginosa PA01
cagcgcgcucuucgccgcggcg

SEQ ID NO: 1507818 - RNA, 12 nt, Pseudomonas aeruginosa PA01
cagcgcggccac

SEQ ID NO: 1507819 - RNA, 22 nt, Pseudomonas aeruginosa PA01
cagcgcggagcguccaccagcg

SEQ ID NO: 1507820 - RNA, 23 nt, Pseudomonas aeruginosa PA01
cagcgcggaucagucaggaucgg

SEQ ID NO: 1507821 - RNA, 20 nt, Pseudomonas aeruginosa PA01
cagcgccuuuuccgcaucuc

SEQ ID NO: 1507822 - RNA, 22 nt, Pseudomonas aeruginosa PA01
cagcgccuuuuccgcaucuccc

SEQ ID NO: 1507823 - RNA, 16 nt, Pseudomonas aeruginosa PA01
cagcgcgacaucggcg

SEQ ID NO: 1507824 - RNA, 22 nt, Pseudomonas aeruginosa PA01
cagcgcgaaggccacgccgacg

SEQ ID NO: 1507825 - RNA, 12 nt, Pseudomonas aeruginosa PA01
cagcgcgccagc

SEQ ID NO: 1507826 - RNA, 17 nt, Pseudomonas aeruginosa PA01
cagcgcgccagcacggc

SEQ ID NO: 1507827 - RNA, 13 nt, Pseudomonas aeruginosa PA01
cagcgcgcagcgg

SEQ ID NO: 1507828 - RNA, 16 nt, Pseudomonas aeruginosa PA01
cagcgcgccaucggcg

SEQ ID NO: 1507829 - RNA, 13 nt, Pseudomonas aeruginosa PA01
cagcgcgccccgg

SEQ ID NO: 1507830 - RNA, 20 nt, Pseudomonas aeruginosa PA01
cagcgcgauaucgcaggcca

SEQ ID NO: 1507831 - RNA, 22 nt, Pseudomonas aeruginosa PA01
cagcgcgauaucgcaggccagg

SEQ ID NO: 1507832 - RNA, 20 nt, Pseudomonas aeruginosa PA01
cagcgcgauacccuggccgg

SEQ ID NO: 1507833 - RNA, 23 nt, Pseudomonas aeruginosa PA01
cagcgcgauacccuggccggccu

SEQ ID NO: 1507834 - RNA, 17 nt, Pseudomonas aeruginosa PA01
cagcgcggugagcaggg

SEQ ID NO: 1507835 - RNA, 22 nt, Pseudomonas aeruginosa PA01
cagcgcgucacucgacaggcca

SEQ ID NO: 1507836 - RNA, 21 nt, Pseudomonas aeruginosa PA01
cagcgcguagaccaccucgac

SEQ ID NO: 1507837 - RNA, 15 nt, Pseudomonas aeruginosa PA01
cagcgcgucgaccac

SEQ ID NO: 1507838 - RNA, 19 nt, Pseudomonas aeruginosa PA01
cagcgcgucgaccaccgcg

SEQ ID NO: 1507839 - RNA, 20 nt, Pseudomonas aeruginosa PA01
cagcgcgucgaccaccgcgu

SEQ ID NO: 1507840 - RNA, 13 nt, Pseudomonas aeruginosa PA01
cagcgcgucgcgg

SEQ ID NO: 1507841 - RNA, 13 nt, Pseudomonas aeruginosa PA01
cagcgcggcggcg

SEQ ID NO: 1507842 - RNA, 12 nt, Pseudomonas aeruginosa PA01
cagcgcggcggc

SEQ ID NO: 1507843 - RNA, 14 nt, Pseudomonas aeruginosa PA01
cagcgcggcggcgg

SEQ ID NO: 1507844 - RNA, 17 nt, Pseudomonas aeruginosa PA01
cagcgcggcggcggcca

SEQ ID NO: 1507845 - RNA, 23 nt, Pseudomonas aeruginosa PA01
cagcgcggcggcggccagcagca

SEQ ID NO: 1507846 - RNA, 17 nt, Pseudomonas aeruginosa PA01
cagcgcggcggcggccg

SEQ ID NO: 1507847 - RNA, 15 nt, Pseudomonas aeruginosa PA01
cagcgcgggcaccga

SEQ ID NO: 1507848 - RNA, 16 nt, Pseudomonas aeruginosa PA01
cagcgcgggcaccgag

SEQ ID NO: 1507849 - RNA, 16 nt, Pseudomonas aeruginosa PA01
cagcgcggcucgggcg

SEQ ID NO: 1507850 - RNA, 15 nt, Pseudomonas aeruginosa PA01
cagcgcggccgccgc

SEQ ID NO: 1507851 - RNA, 16 nt, Pseudomonas aeruginosa PA01
cagcgcggcgcgcuga

SEQ ID NO: 1507852 - RNA, 16 nt, Pseudomonas aeruginosa PA01
cagcgcggcgcggaca

SEQ ID NO: 1507853 - RNA, 19 nt, Pseudomonas aeruginosa PA01
cagcgcggcgcuuggcgaa

SEQ ID NO: 1507854 - RNA, 21 nt, Pseudomonas aeruginosa PA01
cagcgcggcgcuuggcgaaau

SEQ ID NO: 1507855 - RNA, 13 nt, Pseudomonas aeruginosa PA01
cagcgcggcgccc

SEQ ID NO: 1507856 - RNA, 20 nt, Pseudomonas aeruginosa PA01
cagcgcggcgccccaggcgc

SEQ ID NO: 1507857 - RNA, 23 nt, Pseudomonas aeruginosa PA01
cagcgcggcgccccaggcgccca

SEQ ID NO: 1507858 - RNA, 12 nt, Pseudomonas aeruginosa PA01
cagcgcuggcga

SEQ ID NO: 1507859 - RNA, 17 nt, Pseudomonas aeruginosa PA01
cagcgcuggcgaucacc

SEQ ID NO: 1507860 - RNA, 24 nt, Pseudomonas aeruginosa PA01
cagcgcuggcagguugcacggccg

SEQ ID NO: 1507861 - RNA, 23 nt, Pseudomonas aeruginosa PA01
cagcgcuucguugcuccugcggc

SEQ ID NO: 1507862 - RNA, 16 nt, Pseudomonas aeruginosa PA01
cagcgcuugcuggcgc

SEQ ID NO: 1507863 - RNA, 17 nt, Pseudomonas aeruginosa PA01
cagcgcuugcuggcgcg

SEQ ID NO: 1507864 - RNA, 19 nt, Pseudomonas aeruginosa PA01
cagcgcuuguagcagccgc

SEQ ID NO: 1507865 - RNA, 22 nt, Pseudomonas aeruginosa PA01
cagcgcuuguagcagccgcagg

SEQ ID NO: 1507866 - RNA, 15 nt, Pseudomonas aeruginosa PA01
cagcgcuucggcggc

SEQ ID NO: 1507867 - RNA, 17 nt, Pseudomonas aeruginosa PA01
cagcgcuuccaccgccu

SEQ ID NO: 1507868 - RNA, 23 nt, Pseudomonas aeruginosa PA01
cagcgcuuccaccgccugcccca

SEQ ID NO: 1507869 - RNA, 15 nt, Pseudomonas aeruginosa PA01
cagcgcuuccucggg

SEQ ID NO: 1507870 - RNA, 19 nt, Pseudomonas aeruginosa PA01
cagcgcuuccucgggcagc

SEQ ID NO: 1507871 - RNA, 22 nt, Pseudomonas aeruginosa PA01
cagcgcuuccuugcccugggcg

SEQ ID NO: 1507872 - RNA, 22 nt, Pseudomonas aeruginosa PA01
cagcgcuccuugcgccaggccc

SEQ ID NO: 1507873 - RNA, 16 nt, Pseudomonas aeruginosa PA01
cagcgcuacgcaggcc

SEQ ID NO: 1507874 - RNA, 17 nt, Pseudomonas aeruginosa PA01
cagcgcuacgcaggccc

SEQ ID NO: 1507875 - RNA, 18 nt, Pseudomonas aeruginosa PA01
cagcgcucacgcaccucg

SEQ ID NO: 1507876 - RNA, 22 nt, Pseudomonas aeruginosa PA01
cagcgcucacgcaccucgucga

SEQ ID NO: 1507877 - RNA, 13 nt, Pseudomonas aeruginosa PA01
cagcgcugaucac

SEQ ID NO: 1507878 - RNA, 20 nt, Pseudomonas aeruginosa PA01
cagcgcugaucacgaucggc

SEQ ID NO: 1507879 - RNA, 18 nt, Pseudomonas aeruginosa PA01
cagcgcucguagccggcg

SEQ ID NO: 1507880 - RNA, 21 nt, Pseudomonas aeruginosa PA01
cagcgcucguagccggcgcgg

SEQ ID NO: 1507881 - RNA, 16 nt, Pseudomonas aeruginosa PA01
cagcgcgugcaggcgc

SEQ ID NO: 1507882 - RNA, 19 nt, Pseudomonas aeruginosa PA01
cagcgcgugcaggcgcccu

SEQ ID NO: 1507883 - RNA, 16 nt, Pseudomonas aeruginosa PA01
cagcgcguucaccccg

SEQ ID NO: 1507884 - RNA, 19 nt, Pseudomonas aeruginosa PA01
cagcgcguucaccccgccc

SEQ ID NO: 1507885 - RNA, 16 nt, Pseudomonas aeruginosa PA01
cagcgcgucggcacgc

SEQ ID NO: 1507886 - RNA, 17 nt, Pseudomonas aeruginosa PA01
cagcggcgacaccgcca

SEQ ID NO: 1507887 - RNA, 19 nt, Pseudomonas aeruginosa PA01
cagcggcgacaccgccagc

SEQ ID NO: 1507888 - RNA, 20 nt, Pseudomonas aeruginosa PA01
cagcggcgacaccgccagca

SEQ ID NO: 1507889 - RNA, 14 nt, Pseudomonas aeruginosa PA01
cagcggcgccgagg

SEQ ID NO: 1507890 - RNA, 12 nt, Pseudomonas aeruginosa PA01
cagcggccccga

SEQ ID NO: 1507891 - RNA, 21 nt, Pseudomonas aeruginosa PA01
cagcggccccgagcgggccga

SEQ ID NO: 1507892 - RNA, 13 nt, Pseudomonas aeruginosa PA01
cagcggcccggcg

SEQ ID NO: 1507893 - RNA, 17 nt, Pseudomonas aeruginosa PA01
cagcggcccgagcaggc

SEQ ID NO: 1507894 - RNA, 19 nt, Pseudomonas aeruginosa PA01
cagcggcccgagcaggcug

SEQ ID NO: 1507895 - RNA, 16 nt, Pseudomonas aeruginosa PA01
cagcggccgagcaggc

SEQ ID NO: 1507896 - RNA, 19 nt, Pseudomonas aeruginosa PA01
cagcggccgagcaggcgcg

SEQ ID NO: 1507897 - RNA, 20 nt, Pseudomonas aeruginosa PA01
cagcggccgcgagcgcggcc

SEQ ID NO: 1507898 - RNA, 13 nt, Pseudomonas aeruginosa PA01
cagcggccgcgcc

SEQ ID NO: 1507899 - RNA, 14 nt, Pseudomonas aeruginosa PA01
cagcggcccagcgc

SEQ ID NO: 1507900 - RNA, 16 nt, Pseudomonas aeruginosa PA01
cagcggcccagcgccc

SEQ ID NO: 1507901 - RNA, 18 nt, Pseudomonas aeruginosa PA01
cagcggcccagcgccccg

SEQ ID NO: 1507902 - RNA, 17 nt, Pseudomonas aeruginosa PA01
cagcggccacggcggau

SEQ ID NO: 1507903 - RNA, 22 nt, Pseudomonas aeruginosa PA01
cagcggcaggagcguugcgggc

SEQ ID NO: 1507904 - RNA, 15 nt, Pseudomonas aeruginosa PA01
cagcggcaggcacgc

SEQ ID NO: 1507905 - RNA, 22 nt, Pseudomonas aeruginosa PA01
cagcggcaggccacggccgcug

SEQ ID NO: 1507906 - RNA, 17 nt, Pseudomonas aeruginosa PA01
cagcggcagggcggcga

SEQ ID NO: 1507907 - RNA, 18 nt, Pseudomonas aeruginosa PA01
cagcggcagggcggcgau

SEQ ID NO: 1507908 - RNA, 17 nt, Pseudomonas aeruginosa PA01
cagcggcagcgccaggu

SEQ ID NO: 1507909 - RNA, 13 nt, Pseudomonas aeruginosa PA01
cagcggcagcggu

SEQ ID NO: 1507910 - RNA, 18 nt, Pseudomonas aeruginosa PA01
cagcggcaugcccugccg

SEQ ID NO: 1507911 - RNA, 21 nt, Pseudomonas aeruginosa PA01
cagcggcaugcccugccggcg

SEQ ID NO: 1507912 - RNA, 11 nt, Pseudomonas aeruginosa PA01
cagcggcacgc

SEQ ID NO: 1507913 - RNA, 20 nt, Pseudomonas aeruginosa PA01
cagcggcacggucauggcca

SEQ ID NO: 1507914 - RNA, 22 nt, Pseudomonas aeruginosa PA01
cagcggcacggucauggccagc

SEQ ID NO: 1507915 - RNA, 15 nt, Pseudomonas aeruginosa PA01
cagcggcaccagcac

SEQ ID NO: 1507916 - RNA, 22 nt, Pseudomonas aeruginosa PA01
cagcggcaccagcacguugcca

SEQ ID NO: 1507917 - RNA, 23 nt, Pseudomonas aeruginosa PA01
cagcggcaccagcacguugccau

SEQ ID NO: 1507918 - RNA, 12 nt, Pseudomonas aeruginosa PA01
cagcggcacccg

SEQ ID NO: 1507919 - RNA, 16 nt, Pseudomonas aeruginosa PA01
cagcggcacccggcug

SEQ ID NO: 1507920 - RNA, 17 nt, Pseudomonas aeruginosa PA01
cagcggaugcuggcgga

SEQ ID NO: 1507921 - RNA, 19 nt, Pseudomonas aeruginosa PA01
cagcggcaaaggcccggcg

SEQ ID NO: 1507922 - RNA, 21 nt, Pseudomonas aeruginosa PA01
cagcggaacuugcgccgaccg

SEQ ID NO: 1507923 - RNA, 17 nt, Pseudomonas aeruginosa PA01
cagcggaagcccugcug

SEQ ID NO: 1507924 - RNA, 21 nt, Pseudomonas aeruginosa PA01
cagcggaagcccugcuggcgc

SEQ ID NO: 1507925 - RNA, 17 nt, Pseudomonas aeruginosa PA01
cagcggaccgucgggca

SEQ ID NO: 1507926 - RNA, 16 nt, Pseudomonas aeruginosa PA01
cagcggacgcagcggg

SEQ ID NO: 1507927 - RNA, 22 nt, Pseudomonas aeruginosa PA01
cagcggaaugcuuccguaggug

SEQ ID NO: 1507928 - RNA, 17 nt, Pseudomonas aeruginosa PA01
cagcggacaaccgccgu

SEQ ID NO: 1507929 - RNA, 19 nt, Pseudomonas aeruginosa PA01
cagcggacaaccgccguag

SEQ ID NO: 1507930 - RNA, 18 nt, Pseudomonas aeruginosa PA01
cagcggaaaugcucgccg

SEQ ID NO: 1507931 - RNA, 18 nt, Pseudomonas aeruginosa PA01
cagcggauaguucuucgg

SEQ ID NO: 1507932 - RNA, 16 nt, Pseudomonas aeruginosa PA01
cagcgguucaggucga

SEQ ID NO: 1507933 - RNA, 16 nt, Pseudomonas aeruginosa PA01
cagcgguugagcaggg

SEQ ID NO: 1507934 - RNA, 18 nt, Pseudomonas aeruginosa PA01
cagcgguugagcagggcg

SEQ ID NO: 1507935 - RNA, 15 nt, Pseudomonas aeruginosa PA01
cagcgguucgcccgc

SEQ ID NO: 1507936 - RNA, 16 nt, Pseudomonas aeruginosa PA01
cagcgguucgcccgcg

SEQ ID NO: 1507937 - RNA, 16 nt, Pseudomonas aeruginosa PA01
cagcgguucggcacgg

SEQ ID NO: 1507938 - RNA, 14 nt, Pseudomonas aeruginosa PA01
cagcggucgccggu

SEQ ID NO: 1507939 - RNA, 13 nt, Pseudomonas aeruginosa PA01
cagcgguccgcuc

SEQ ID NO: 1507940 - RNA, 20 nt, Pseudomonas aeruginosa PA01
cagcgucucagcccucggcc

SEQ ID NO: 1507941 - RNA, 16 nt, Pseudomonas aeruginosa PA01
cagcgugcagaccagg

SEQ ID NO: 1507942 - RNA, 14 nt, Pseudomonas aeruginosa PA01
cagcgugcccgcug

SEQ ID NO: 1507943 - RNA, 20 nt, Pseudomonas aeruginosa PA01
cagcgucgcgucggccuggc

SEQ ID NO: 1507944 - RNA, 22 nt, Pseudomonas aeruginosa PA01
cagcgucgcgucggccuggcgc

SEQ ID NO: 1507945 - RNA, 13 nt, Pseudomonas aeruginosa PA01
cagcgucgcgcgu

SEQ ID NO: 1507946 - RNA, 20 nt, Pseudomonas aeruginosa PA01
cagcgucgccgccgcgggcg

SEQ ID NO: 1507947 - RNA, 17 nt, Pseudomonas aeruginosa PA01
cagcgucgccugccagg

SEQ ID NO: 1507948 - RNA, 12 nt, Pseudomonas aeruginosa PA01
cagcgucgccgc

SEQ ID NO: 1507949 - RNA, 13 nt, Pseudomonas aeruginosa PA01
cagcgucgccagg

SEQ ID NO: 1507950 - RNA, 14 nt, Pseudomonas aeruginosa PA01
cagcgucgccaggc

SEQ ID NO: 1507951 - RNA, 15 nt, Pseudomonas aeruginosa PA01
cagcgucgccaggcc

SEQ ID NO: 1507952 - RNA, 17 nt, Pseudomonas aeruginosa PA01
cagcgucgccaggccgu

SEQ ID NO: 1507953 - RNA, 23 nt, Pseudomonas aeruginosa PA01
cagcggcuggcugaagccgggca

SEQ ID NO: 1507954 - RNA, 13 nt, Pseudomonas aeruginosa PA01
cagcggcuggcgg

SEQ ID NO: 1507955 - RNA, 13 nt, Pseudomonas aeruginosa PA01
cagcggcugcccg

SEQ ID NO: 1507956 - RNA, 14 nt, Pseudomonas aeruginosa PA01
cagcggcuggcgcu

SEQ ID NO: 1507957 - RNA, 13 nt, Pseudomonas aeruginosa PA01
cagcggcuggccc

SEQ ID NO: 1507958 - RNA, 19 nt, Pseudomonas aeruginosa PA01
cagcggcuggcccucggcg

SEQ ID NO: 1507959 - RNA, 22 nt, Pseudomonas aeruginosa PA01
cagcggcuggcgaugcugaccc

SEQ ID NO: 1507960 - RNA, 18 nt, Pseudomonas aeruginosa PA01
cagcggcgcuugcgggcg

SEQ ID NO: 1507961 - RNA, 17 nt, Pseudomonas aeruginosa PA01
cagcggcgcgucgcuca

SEQ ID NO: 1507962 - RNA, 19 nt, Pseudomonas aeruginosa PA01
cagcgggaugugcaccagc

SEQ ID NO: 1507963 - RNA, 21 nt, Pseudomonas aeruginosa PA01
cagcgggaugugcaccagcaa

SEQ ID NO: 1507964 - RNA, 22 nt, Pseudomonas aeruginosa PA01
cagcgggaugugcaccagcaac

SEQ ID NO: 1507965 - RNA, 20 nt, Pseudomonas aeruginosa PA01
cagcgggacgaugccgaucu

SEQ ID NO: 1507966 - RNA, 22 nt, Pseudomonas aeruginosa PA01
cagcgggacagcuugccgucca

SEQ ID NO: 1507967 - RNA, 19 nt, Pseudomonas aeruginosa PA01
cagcggcuuguccuggcgc

SEQ ID NO: 1507968 - RNA, 22 nt, Pseudomonas aeruginosa PA01
cagcgggcgcuugaagccggcg

SEQ ID NO: 1507969 - RNA, 14 nt, Pseudomonas aeruginosa PA01
cagcgggcggauca

SEQ ID NO: 1507970 - RNA, 16 nt, Pseudomonas aeruginosa PA01
cagcgggccuucgcca

SEQ ID NO: 1507971 - RNA, 21 nt, Pseudomonas aeruginosa PA01
cagcgggccuucgccagcggc

SEQ ID NO: 1507972 - RNA, 13 nt, Pseudomonas aeruginosa PA01
cagcgggccgggg

SEQ ID NO: 1507973 - RNA, 18 nt, Pseudomonas aeruginosa PA01
cagcgggccaggcgguau

SEQ ID NO: 1507974 - RNA, 19 nt, Pseudomonas aeruginosa PA01
cagcgggcccauggcggua

SEQ ID NO: 1507975 - RNA, 20 nt, Pseudomonas aeruginosa PA01
cagcggguuggcuuccagcc

SEQ ID NO: 1507976 - RNA, 15 nt, Pseudomonas aeruginosa PA01
cagcgguaugccgca

SEQ ID NO: 1507977 - RNA, 19 nt, Pseudomonas aeruginosa PA01
cagcgguaugccgcaggca

SEQ ID NO: 1507978 - RNA, 17 nt, Pseudomonas aeruginosa PA01
cagcgguaccagcagcg

SEQ ID NO: 1507979 - RNA, 18 nt, Pseudomonas aeruginosa PA01
cagcgguaccagcagcgc

SEQ ID NO: 1507980 - RNA, 20 nt, Pseudomonas aeruginosa PA01
cagcgguaccagcagcgccg

SEQ ID NO: 1507981 - RNA, 21 nt, Pseudomonas aeruginosa PA01
cagcgguaccagcagcgccga

SEQ ID NO: 1507982 - RNA, 17 nt, Pseudomonas aeruginosa PA01
cagcgguacccgccggc

SEQ ID NO: 1507983 - RNA, 20 nt, Pseudomonas aeruginosa PA01
cagcgguacccgccggccau

SEQ ID NO: 1507984 - RNA, 18 nt, Pseudomonas aeruginosa PA01
cagcgguacggucgaggc

SEQ ID NO: 1507985 - RNA, 17 nt, Pseudomonas aeruginosa PA01
cagcgguacguagcgcg

SEQ ID NO: 1507986 - RNA, 18 nt, Pseudomonas aeruginosa PA01
cagcgguacguagcgcgg

SEQ ID NO: 1507987 - RNA, 23 nt, Pseudomonas aeruginosa PA01
cagcgguacuaucccggucgggu

SEQ ID NO: 1507988 - RNA, 16 nt, Pseudomonas aeruginosa PA01
cagcgguagaacaggc

SEQ ID NO: 1507989 - RNA, 18 nt, Pseudomonas aeruginosa PA01
cagcgguagaacaggcga

SEQ ID NO: 1507990 - RNA, 20 nt, Pseudomonas aeruginosa PA01
cagcgggcggucgcggaccu

SEQ ID NO: 1507991 - RNA, 23 nt, Pseudomonas aeruginosa PA01
cagcgggcggucgcggaccucca

SEQ ID NO: 1507992 - RNA, 19 nt, Pseudomonas aeruginosa PA01
cagcgccucgggccggagc

SEQ ID NO: 1507993 - RNA, 19 nt, Pseudomonas aeruginosa PA01
cagcgccuguuccagggcc

SEQ ID NO: 1507994 - RNA, 16 nt, Pseudomonas aeruginosa PA01
cagcgccuugaccucg

SEQ ID NO: 1507995 - RNA, 14 nt, Pseudomonas aeruginosa PA01
cagcgccugcugcg

SEQ ID NO: 1507996 - RNA, 23 nt, Pseudomonas aeruginosa PA01
cagcgccugcaaagaggcgcuca

SEQ ID NO: 1507997 - RNA, 15 nt, Pseudomonas aeruginosa PA01
cagcgccuggucggc

SEQ ID NO: 1507998 - RNA, 16 nt, Pseudomonas aeruginosa PA01
cagcgccuggucggcg

SEQ ID NO: 1507999 - RNA, 14 nt, Pseudomonas aeruginosa PA01
cagcgccugggccg

SEQ ID NO: 1508000 - RNA, 15 nt, Pseudomonas aeruginosa PA01
cagcgccugggccgc

SEQ ID NO: 1508001 - RNA, 16 nt, Pseudomonas aeruginosa PA01
cagcgccugggccgcg

SEQ ID NO: 1508002 - RNA, 13 nt, Pseudomonas aeruginosa PA01
cagcgccuggcgc

SEQ ID NO: 1508003 - RNA, 18 nt, Pseudomonas aeruginosa PA01
cagcgccuggcgcaacgc

SEQ ID NO: 1508004 - RNA, 23 nt, Pseudomonas aeruginosa PA01
cagcgccuggcgcaacgccggca

SEQ ID NO: 1508005 - RNA, 14 nt, Pseudomonas aeruginosa PA01
cagcgccucgccga

SEQ ID NO: 1508006 - RNA, 20 nt, Pseudomonas aeruginosa PA01
cagcgccucggcaucgacca

SEQ ID NO: 1508007 - RNA, 14 nt, Pseudomonas aeruginosa PA01
cagcgccucggcgc

SEQ ID NO: 1508008 - RNA, 14 nt, Pseudomonas aeruginosa PA01
cagcgccgagacga

SEQ ID NO: 1508009 - RNA, 22 nt, Pseudomonas aeruginosa PA01
cagcgcccgauaggcgccggcg

SEQ ID NO: 1508010 - RNA, 23 nt, Pseudomonas aeruginosa PA01
cagcgcccgauaggcgccggcgc

SEQ ID NO: 1508011 - RNA, 20 nt, Pseudomonas aeruginosa PA01
cagcgccccucccagccaca

SEQ ID NO: 1508012 - RNA, 20 nt, Pseudomonas aeruginosa PA01
cagcgccaggaagccgcgcc

SEQ ID NO: 1508013 - RNA, 12 nt, Pseudomonas aeruginosa PA01
cagcgccaggag

SEQ ID NO: 1508014 - RNA, 17 nt, Pseudomonas aeruginosa PA01
cagcgccaggagcaggg

SEQ ID NO: 1508015 - RNA, 13 nt, Pseudomonas aeruginosa PA01
cagcgccagcggc

SEQ ID NO: 1508016 - RNA, 12 nt, Pseudomonas aeruginosa PA01
cagcgcccaggc

SEQ ID NO: 1508017 - RNA, 17 nt, Pseudomonas aeruginosa PA01
cagcgcccaggccgggu

SEQ ID NO: 1508018 - RNA, 19 nt, Pseudomonas aeruginosa PA01
cagcgcccaggccgggucg

SEQ ID NO: 1508019 - RNA, 21 nt, Pseudomonas aeruginosa PA01
cagcgcccaggccgggucgca

SEQ ID NO: 1508020 - RNA, 14 nt, Pseudomonas aeruginosa PA01
cagcgccaggccga

SEQ ID NO: 1508021 - RNA, 23 nt, Pseudomonas aeruginosa PA01
cagcgccaggccgaucagcgccu

SEQ ID NO: 1508022 - RNA, 19 nt, Pseudomonas aeruginosa PA01
cagcgccaggccgccgaag

SEQ ID NO: 1508023 - RNA, 15 nt, Pseudomonas aeruginosa PA01
cagcgccccaccagg

SEQ ID NO: 1508024 - RNA, 16 nt, Pseudomonas aeruginosa PA01
cagcgccccaccaggc

SEQ ID NO: 1508025 - RNA, 19 nt, Pseudomonas aeruginosa PA01
cagcgccccaccaggcucg

SEQ ID NO: 1508026 - RNA, 15 nt, Pseudomonas aeruginosa PA01
cagcgccccagcacc

SEQ ID NO: 1508027 - RNA, 18 nt, Pseudomonas aeruginosa PA01
cagcgccccagcaccucg

SEQ ID NO: 1508028 - RNA, 20 nt, Pseudomonas aeruginosa PA01
cagcgcagccugcuggccug

SEQ ID NO: 1508029 - RNA, 12 nt, Pseudomonas aeruginosa PA01
cagcgcagcgaa

SEQ ID NO: 1508030 - RNA, 13 nt, Pseudomonas aeruginosa PA01
cagcgcaggccga

SEQ ID NO: 1508031 - RNA, 14 nt, Pseudomonas aeruginosa PA01
cagcgcaggccgau

SEQ ID NO: 1508032 - RNA, 21 nt, Pseudomonas aeruginosa PA01
cagcgccagccaggguacuuc

SEQ ID NO: 1508033 - RNA, 13 nt, Pseudomonas aeruginosa PA01
cagcgccagcagg

SEQ ID NO: 1508034 - RNA, 16 nt, Pseudomonas aeruginosa PA01
cagcgccagcaggcga

SEQ ID NO: 1508035 - RNA, 17 nt, Pseudomonas aeruginosa PA01
cagcgccagcaggucgc

SEQ ID NO: 1508036 - RNA, 13 nt, Pseudomonas aeruginosa PA01
cagcgccacuucc

SEQ ID NO: 1508037 - RNA, 17 nt, Pseudomonas aeruginosa PA01
cagcgccacuuccagcu

SEQ ID NO: 1508038 - RNA, 23 nt, Pseudomonas aeruginosa PA01
cagcgccacuuccagcuugcgcu

SEQ ID NO: 1508039 - RNA, 22 nt, Pseudomonas aeruginosa PA01
cagcgccacggcgaucgccggg

SEQ ID NO: 1508040 - RNA, 14 nt, Pseudomonas aeruginosa PA01
cagcgccagcaacc

SEQ ID NO: 1508041 - RNA, 13 nt, Pseudomonas aeruginosa PA01
cagcgccagcaac

SEQ ID NO: 1508042 - RNA, 16 nt, Pseudomonas aeruginosa PA01
cagcgcacgccgugga

SEQ ID NO: 1508043 - RNA, 17 nt, Pseudomonas aeruginosa PA01
cagcgcaccgccaagga

SEQ ID NO: 1508044 - RNA, 13 nt, Pseudomonas aeruginosa PA01
cagcgcaagucgg

SEQ ID NO: 1508045 - RNA, 17 nt, Pseudomonas aeruginosa PA01
cagcgcaagucggccug

SEQ ID NO: 1508046 - RNA, 20 nt, Pseudomonas aeruginosa PA01
cagcgagucgacccaggccc

SEQ ID NO: 1508047 - RNA, 22 nt, Pseudomonas aeruginosa PA01
cagcgaggggaagaucuccggg

SEQ ID NO: 1508048 - RNA, 15 nt, Pseudomonas aeruginosa PA01
cagcgauacaccugc

SEQ ID NO: 1508049 - RNA, 16 nt, Pseudomonas aeruginosa PA01
cagcgauacaccugca

SEQ ID NO: 1508050 - RNA, 24 nt, Pseudomonas aeruginosa PA01
cagcgaggcgggcgcggaucggcg

SEQ ID NO: 1508051 - RNA, 20 nt, Pseudomonas aeruginosa PA01
cagcgagcuucgccgcgcaa

SEQ ID NO: 1508052 - RNA, 15 nt, Pseudomonas aeruginosa PA01
cagcgaggcccgcgc

SEQ ID NO: 1508053 - RNA, 18 nt, Pseudomonas aeruginosa PA01
cagcgaggcccgcgccgc

SEQ ID NO: 1508054 - RNA, 20 nt, Pseudomonas aeruginosa PA01
cagcgaggcccgcgccgccg

SEQ ID NO: 1508055 - RNA, 20 nt, Pseudomonas aeruginosa PA01
cagcgacucgaugaacgccc

SEQ ID NO: 1508056 - RNA, 21 nt, Pseudomonas aeruginosa PA01
cagcgacucgaugcgcagcuu

SEQ ID NO: 1508057 - RNA, 23 nt, Pseudomonas aeruginosa PA01
cagcgacucgcugccggcgcgca

SEQ ID NO: 1508058 - RNA, 21 nt, Pseudomonas aeruginosa PA01
cagcgacucgcugggcgccgg

SEQ ID NO: 1508059 - RNA, 22 nt, Pseudomonas aeruginosa PA01
cagcgacucgcugggcgccggc

SEQ ID NO: 1508060 - RNA, 20 nt, Pseudomonas aeruginosa PA01
cagcgacuggaaacgcaucc

SEQ ID NO: 1508061 - RNA, 13 nt, Pseudomonas aeruginosa PA01
cagcgacuggccc

SEQ ID NO: 1508062 - RNA, 15 nt, Pseudomonas aeruginosa PA01
cagcgacuggugguc

SEQ ID NO: 1508063 - RNA, 14 nt, Pseudomonas aeruginosa PA01
cagccguucgcugg

SEQ ID NO: 1508064 - RNA, 12 nt, Pseudomonas aeruginosa PA01
cagcgaacgccg

SEQ ID NO: 1508065 - RNA, 13 nt, Pseudomonas aeruginosa PA01
cagcgaacgccgc

SEQ ID NO: 1508066 - RNA, 15 nt, Pseudomonas aeruginosa PA01
cagcgaacgccgcag

SEQ ID NO: 1508067 - RNA, 15 nt, Pseudomonas aeruginosa PA01
cagcgaagcuggcgc

SEQ ID NO: 1508068 - RNA, 17 nt, Pseudomonas aeruginosa PA01
cagccguggcacccagg

SEQ ID NO: 1508069 - RNA, 18 nt, Pseudomonas aeruginosa PA01
cagccguggcacccaggc

SEQ ID NO: 1508070 - RNA, 19 nt, Pseudomonas aeruginosa PA01
cagccguggcacccaggcc

SEQ ID NO: 1508071 - RNA, 20 nt, Pseudomonas aeruginosa PA01
cagccguggcacccaggcca

SEQ ID NO: 1508072 - RNA, 14 nt, Pseudomonas aeruginosa PA01
cagccguggcaggc

SEQ ID NO: 1508073 - RNA, 19 nt, Pseudomonas aeruginosa PA01
cagcgacacaacgcugcaa

SEQ ID NO: 1508074 - RNA, 23 nt, Pseudomonas aeruginosa PA01
cagcgaauggacaggcgccccug

SEQ ID NO: 1508075 - RNA, 14 nt, Pseudomonas aeruginosa PA01
cagcgacgcgacau

SEQ ID NO: 1508076 - RNA, 19 nt, Pseudomonas aeruginosa PA01
cagcgacuccagccaggcg

SEQ ID NO: 1508077 - RNA, 21 nt, Pseudomonas aeruginosa PA01
cagcccggcgugggcggucgg

SEQ ID NO: 1508078 - RNA, 16 nt, Pseudomonas aeruginosa PA01
cagcccggucacgccg

SEQ ID NO: 1508079 - RNA, 19 nt, Pseudomonas aeruginosa PA01
cagcccggucacgccggga

SEQ ID NO: 1508080 - RNA, 16 nt, Pseudomonas aeruginosa PA01
cagcccgucggccucg

SEQ ID NO: 1508081 - RNA, 20 nt, Pseudomonas aeruginosa PA01
cagcccgucggccucgccga

SEQ ID NO: 1508082 - RNA, 14 nt, Pseudomonas aeruginosa PA01
cagcccgucgcgcg

SEQ ID NO: 1508083 - RNA, 16 nt, Pseudomonas aeruginosa PA01
cagcccgucgcgcgcc

SEQ ID NO: 1508084 - RNA, 18 nt, Pseudomonas aeruginosa PA01
cagcccgucgcgcgccgg

SEQ ID NO: 1508085 - RNA, 19 nt, Pseudomonas aeruginosa PA01
cagcccgucgcgcgccgga

SEQ ID NO: 1508086 - RNA, 22 nt, Pseudomonas aeruginosa PA01
cagcccgucgcgcgccggagcc

SEQ ID NO: 1508087 - RNA, 16 nt, Pseudomonas aeruginosa PA01
cagcccuaggcgaccc

SEQ ID NO: 1508088 - RNA, 13 nt, Pseudomonas aeruginosa PA01
cagcccucggccc

SEQ ID NO: 1508089 - RNA, 15 nt, Pseudomonas aeruginosa PA01
cagcccucggcccgg

SEQ ID NO: 1508090 - RNA, 19 nt, Pseudomonas aeruginosa PA01
cagcccucggggaagguca

SEQ ID NO: 1508091 - RNA, 17 nt, Pseudomonas aeruginosa PA01
cagcccguguucggcca

SEQ ID NO: 1508092 - RNA, 19 nt, Pseudomonas aeruginosa PA01
cagcccguguucggccagc

SEQ ID NO: 1508093 - RNA, 21 nt, Pseudomonas aeruginosa PA01
cagcccguguucggccagccg

SEQ ID NO: 1508094 - RNA, 22 nt, Pseudomonas aeruginosa PA01
cagcccguguucggccagccgg

SEQ ID NO: 1508095 - RNA, 23 nt, Pseudomonas aeruginosa PA01
cagcccguguucggccagccggc

SEQ ID NO: 1508096 - RNA, 22 nt, Pseudomonas aeruginosa PA01
cagcccuggaaaggccucggcg

SEQ ID NO: 1508097 - RNA, 12 nt, Pseudomonas aeruginosa PA01
cagcccuggcgc

SEQ ID NO: 1508098 - RNA, 13 nt, Pseudomonas aeruginosa PA01
cagcccuggcgca

SEQ ID NO: 1508099 - RNA, 19 nt, Pseudomonas aeruginosa PA01
cagcccuggcgcagacagg

SEQ ID NO: 1508100 - RNA, 13 nt, Pseudomonas aeruginosa PA01
cagcccuggcgcg

SEQ ID NO: 1508101 - RNA, 14 nt, Pseudomonas aeruginosa PA01
cagcccuggcgcgg

SEQ ID NO: 1508102 - RNA, 16 nt, Pseudomonas aeruginosa PA01
cagcccuggcgcggca

SEQ ID NO: 1508103 - RNA, 18 nt, Pseudomonas aeruginosa PA01
cagcccuggcgcggcaaa

SEQ ID NO: 1508104 - RNA, 20 nt, Pseudomonas aeruginosa PA01
cagcccuggcguggccggcg

SEQ ID NO: 1508105 - RNA, 21 nt, Pseudomonas aeruginosa PA01
cagcccuggcguggccggcga

SEQ ID NO: 1508106 - RNA, 17 nt, Pseudomonas aeruginosa PA01
cagcccuugcaaccgcc

SEQ ID NO: 1508107 - RNA, 19 nt, Pseudomonas aeruginosa PA01
cagcccuugcaaccgccgc

SEQ ID NO: 1508108 - RNA, 15 nt, Pseudomonas aeruginosa PA01
cagcccuucgcgcuc

SEQ ID NO: 1508109 - RNA, 16 nt, Pseudomonas aeruginosa PA01
cagccgaucgaagaag

SEQ ID NO: 1508110 - RNA, 15 nt, Pseudomonas aeruginosa PA01
cagccgcaaggccag

SEQ ID NO: 1508111 - RNA, 21 nt, Pseudomonas aeruginosa PA01
cagccgcaaggccagggcggc

SEQ ID NO: 1508112 - RNA, 18 nt, Pseudomonas aeruginosa PA01
cagccgaugcucgcgcca

SEQ ID NO: 1508113 - RNA, 18 nt, Pseudomonas aeruginosa PA01
cagccacggcacacgucg

SEQ ID NO: 1508114 - RNA, 16 nt, Pseudomonas aeruginosa PA01
cagcccggcggcggca

SEQ ID NO: 1508115 - RNA, 18 nt, Pseudomonas aeruginosa PA01
cagcccggcggcggcacc

SEQ ID NO: 1508116 - RNA, 18 nt, Pseudomonas aeruginosa PA01
cagccacccagcagcaac

SEQ ID NO: 1508117 - RNA, 21 nt, Pseudomonas aeruginosa PA01
cagccaacugcuucaggcgcg

SEQ ID NO: 1508118 - RNA, 17 nt, Pseudomonas aeruginosa PA01
cagccaaccgucgcccu

SEQ ID NO: 1508119 - RNA, 18 nt, Pseudomonas aeruginosa PA01
cagccaccugcucgcuga

SEQ ID NO: 1508120 - RNA, 14 nt, Pseudomonas aeruginosa PA01
cagccacgaagccu

SEQ ID NO: 1508121 - RNA, 15 nt, Pseudomonas aeruginosa PA01
cagccacccgcgggc

SEQ ID NO: 1508122 - RNA, 24 nt, Pseudomonas aeruginosa PA01
cagccacccgcgggcagcagucgc

SEQ ID NO: 1508123 - RNA, 23 nt, Pseudomonas aeruginosa PA01
cagccacccgcucgaccuugccg

SEQ ID NO: 1508124 - RNA, 15 nt, Pseudomonas aeruginosa PA01
cagccccugcggacc

SEQ ID NO: 1508125 - RNA, 14 nt, Pseudomonas aeruginosa PA01
cagccccucgccau

SEQ ID NO: 1508126 - RNA, 16 nt, Pseudomonas aeruginosa PA01
cagccccucggccagg

SEQ ID NO: 1508127 - RNA, 18 nt, Pseudomonas aeruginosa PA01
cagccacggacgcgcagg

SEQ ID NO: 1508128 - RNA, 17 nt, Pseudomonas aeruginosa PA01
cagccacgggcgccagc

SEQ ID NO: 1508129 - RNA, 22 nt, Pseudomonas aeruginosa PA01
cagccggcgcuucugcgagccg

SEQ ID NO: 1508130 - RNA, 12 nt, Pseudomonas aeruginosa PA01
cagccggcgcua

SEQ ID NO: 1508131 - RNA, 17 nt, Pseudomonas aeruginosa PA01
cagccggcgcucggcca

SEQ ID NO: 1508132 - RNA, 14 nt, Pseudomonas aeruginosa PA01
cagccggggcguag

SEQ ID NO: 1508133 - RNA, 13 nt, Pseudomonas aeruginosa PA01
cagccggggcuca

SEQ ID NO: 1508134 - RNA, 17 nt, Pseudomonas aeruginosa PA01
cagccgggaucuccucg

SEQ ID NO: 1508135 - RNA, 21 nt, Pseudomonas aeruginosa PA01
cagccgggcuccgccgcgagc

SEQ ID NO: 1508136 - RNA, 22 nt, Pseudomonas aeruginosa PA01
cagccgggguugaguugcaggc

SEQ ID NO: 1508137 - RNA, 16 nt, Pseudomonas aeruginosa PA01
cagccgguggucuuca

SEQ ID NO: 1508138 - RNA, 20 nt, Pseudomonas aeruginosa PA01
cagccgguggucuucagcac

SEQ ID NO: 1508139 - RNA, 16 nt, Pseudomonas aeruginosa PA01
cagccguccgcgggcg

SEQ ID NO: 1508140 - RNA, 18 nt, Pseudomonas aeruginosa PA01
cagccguauggccccucc

SEQ ID NO: 1508141 - RNA, 16 nt, Pseudomonas aeruginosa PA01
cagccggguucccagu

SEQ ID NO: 1508142 - RNA, 15 nt, Pseudomonas aeruginosa PA01
cagccgguacugcgc

SEQ ID NO: 1508143 - RNA, 17 nt, Pseudomonas aeruginosa PA01
cagccgguacugcgcca

SEQ ID NO: 1508144 - RNA, 12 nt, Pseudomonas aeruginosa PA01
cagccgccauca

SEQ ID NO: 1508145 - RNA, 16 nt, Pseudomonas aeruginosa PA01
cagccgccaggacggc

SEQ ID NO: 1508146 - RNA, 13 nt, Pseudomonas aeruginosa PA01
cagccgcagcccg

SEQ ID NO: 1508147 - RNA, 14 nt, Pseudomonas aeruginosa PA01
cagccgcagcccgg

SEQ ID NO: 1508148 - RNA, 19 nt, Pseudomonas aeruginosa PA01
cagccgcaggaugccgccu

SEQ ID NO: 1508149 - RNA, 12 nt, Pseudomonas aeruginosa PA01
cagccgcaggca

SEQ ID NO: 1508150 - RNA, 17 nt, Pseudomonas aeruginosa PA01
cagccgcaggcagaacg

SEQ ID NO: 1508151 - RNA, 14 nt, Pseudomonas aeruginosa PA01
cagccgcaggccgu

SEQ ID NO: 1508152 - RNA, 13 nt, Pseudomonas aeruginosa PA01
cagccgcagcggc

SEQ ID NO: 1508153 - RNA, 20 nt, Pseudomonas aeruginosa PA01
cagccgcagcggcaugcccu

SEQ ID NO: 1508154 - RNA, 24 nt, Pseudomonas aeruginosa PA01
cagccgcagcggcaugcccugccg

SEQ ID NO: 1508155 - RNA, 17 nt, Pseudomonas aeruginosa PA01
cagccgcucgcguccgc

SEQ ID NO: 1508156 - RNA, 18 nt, Pseudomonas aeruginosa PA01
cagccgcucgcguccgca

SEQ ID NO: 1508157 - RNA, 14 nt, Pseudomonas aeruginosa PA01
cagccgcucggccg

SEQ ID NO: 1508158 - RNA, 19 nt, Pseudomonas aeruginosa PA01
cagccgccccaccaccauc

SEQ ID NO: 1508159 - RNA, 23 nt, Pseudomonas aeruginosa PA01
cagccgccccaccaccaucgccg

SEQ ID NO: 1508160 - RNA, 14 nt, Pseudomonas aeruginosa PA01
cagccgcugcaggg

SEQ ID NO: 1508161 - RNA, 21 nt, Pseudomonas aeruginosa PA01
cagccggcaagcgugccccga

SEQ ID NO: 1508162 - RNA, 15 nt, Pseudomonas aeruginosa PA01
cagccggcgcgcuuc

SEQ ID NO: 1508163 - RNA, 16 nt, Pseudomonas aeruginosa PA01
cagccggcgcgcuucc

SEQ ID NO: 1508164 - RNA, 20 nt, Pseudomonas aeruginosa PA01
cagccggcgcgcuuccucca

SEQ ID NO: 1508165 - RNA, 17 nt, Pseudomonas aeruginosa PA01
cagccggaccagccguc

SEQ ID NO: 1508166 - RNA, 19 nt, Pseudomonas aeruginosa PA01
cagccgcuuccggcgcucc

SEQ ID NO: 1508167 - RNA, 12 nt, Pseudomonas aeruginosa PA01
caccgcccccgc

SEQ ID NO: 1508168 - RNA, 13 nt, Pseudomonas aeruginosa PA01
caccgcccccggc

SEQ ID NO: 1508169 - RNA, 17 nt, Pseudomonas aeruginosa PA01
caccgcccccggcgcca

SEQ ID NO: 1508170 - RNA, 20 nt, Pseudomonas aeruginosa PA01
caccgccagcgggacgaugc

SEQ ID NO: 1508171 - RNA, 14 nt, Pseudomonas aeruginosa PA01
caccgcccagccga

SEQ ID NO: 1508172 - RNA, 16 nt, Pseudomonas aeruginosa PA01
caccgccaggcuggcc

SEQ ID NO: 1508173 - RNA, 17 nt, Pseudomonas aeruginosa PA01
caccgccagggcgcuca

SEQ ID NO: 1508174 - RNA, 17 nt, Pseudomonas aeruginosa PA01
caccgccaucagcacga

SEQ ID NO: 1508175 - RNA, 15 nt, Pseudomonas aeruginosa PA01
caccgcgcagaugau

SEQ ID NO: 1508176 - RNA, 18 nt, Pseudomonas aeruginosa PA01
caccgcgcagaugaucgc

SEQ ID NO: 1508177 - RNA, 20 nt, Pseudomonas aeruginosa PA01
caccgcgcagaugaucgcca

SEQ ID NO: 1508178 - RNA, 19 nt, Pseudomonas aeruginosa PA01
caccgcgacgcgcuggacc

SEQ ID NO: 1508179 - RNA, 11 nt, Pseudomonas aeruginosa PA01
caccgcgcagc

SEQ ID NO: 1508180 - RNA, 14 nt, Pseudomonas aeruginosa PA01
caccgcgccggcgg

SEQ ID NO: 1508181 - RNA, 13 nt, Pseudomonas aeruginosa PA01
caccgcgccgcgc

SEQ ID NO: 1508182 - RNA, 23 nt, Pseudomonas aeruginosa PA01
caccgcggugucggugcccucgc

SEQ ID NO: 1508183 - RNA, 14 nt, Pseudomonas aeruginosa PA01
caccgcggugcgga

SEQ ID NO: 1508184 - RNA, 15 nt, Pseudomonas aeruginosa PA01
caccgcgguggaggc

SEQ ID NO: 1508185 - RNA, 20 nt, Pseudomonas aeruginosa PA01
caccgcgguggaggcggcgg

SEQ ID NO: 1508186 - RNA, 23 nt, Pseudomonas aeruginosa PA01
caccgcgguggaggcggcgguca

SEQ ID NO: 1508187 - RNA, 22 nt, Pseudomonas aeruginosa PA01
caccggaaaggcgucguugccg

SEQ ID NO: 1508188 - RNA, 17 nt, Pseudomonas aeruginosa PA01
caccgcuuucagcgccg

SEQ ID NO: 1508189 - RNA, 20 nt, Pseudomonas aeruginosa PA01
caccgcuuucagcgccgcuc

SEQ ID NO: 1508190 - RNA, 16 nt, Pseudomonas aeruginosa PA01
caccgcuuucguaggg

SEQ ID NO: 1508191 - RNA, 17 nt, Pseudomonas aeruginosa PA01
caccgcuuucguagggc

SEQ ID NO: 1508192 - RNA, 15 nt, Pseudomonas aeruginosa PA01
caccgcuugccagcc

SEQ ID NO: 1508193 - RNA, 13 nt, Pseudomonas aeruginosa PA01
caccgcggcgcgg

SEQ ID NO: 1508194 - RNA, 14 nt, Pseudomonas aeruginosa PA01
caccgcggcguccg

SEQ ID NO: 1508195 - RNA, 12 nt, Pseudomonas aeruginosa PA01
caccgcgcggca

SEQ ID NO: 1508196 - RNA, 13 nt, Pseudomonas aeruginosa PA01
caccgcgcggcac

SEQ ID NO: 1508197 - RNA, 16 nt, Pseudomonas aeruginosa PA01
caccgcgcggcacagc

SEQ ID NO: 1508198 - RNA, 23 nt, Pseudomonas aeruginosa PA01
caccgcgccuuccagcccuucga

SEQ ID NO: 1508199 - RNA, 12 nt, Pseudomonas aeruginosa PA01
caccgcgccggg

SEQ ID NO: 1508200 - RNA, 11 nt, Pseudomonas aeruginosa PA01
caccgcggccu

SEQ ID NO: 1508201 - RNA, 23 nt, Pseudomonas aeruginosa PA01
caccgcggauccacgccuggccc

SEQ ID NO: 1508202 - RNA, 17 nt, Pseudomonas aeruginosa PA01
caccgacagucccaggc

SEQ ID NO: 1508203 - RNA, 16 nt, Pseudomonas aeruginosa PA01
caccgacaggccgacc

SEQ ID NO: 1508204 - RNA, 20 nt, Pseudomonas aeruginosa PA01
caccgacaggccgaccagca

SEQ ID NO: 1508205 - RNA, 14 nt, Pseudomonas aeruginosa PA01
caccgaccaccauc

SEQ ID NO: 1508206 - RNA, 15 nt, Pseudomonas aeruginosa PA01
caccgaccaccauca

SEQ ID NO: 1508207 - RNA, 21 nt, Pseudomonas aeruginosa PA01
caccgaccaccaucaccgcca

SEQ ID NO: 1508208 - RNA, 16 nt, Pseudomonas aeruginosa PA01
caccgagagcugcaag

SEQ ID NO: 1508209 - RNA, 18 nt, Pseudomonas aeruginosa PA01
caccccgucgacgcccug

SEQ ID NO: 1508210 - RNA, 15 nt, Pseudomonas aeruginosa PA01
caccccauccucgcc

SEQ ID NO: 1508211 - RNA, 17 nt, Pseudomonas aeruginosa PA01
cacccccagcccggcca

SEQ ID NO: 1508212 - RNA, 15 nt, Pseudomonas aeruginosa PA01
cacccccagcaggcc

SEQ ID NO: 1508213 - RNA, 16 nt, Pseudomonas aeruginosa PA01
cacccccagcaggcca

SEQ ID NO: 1508214 - RNA, 12 nt, Pseudomonas aeruginosa PA01
caccccaggguu

SEQ ID NO: 1508215 - RNA, 18 nt, Pseudomonas aeruginosa PA01
caccccacgggcgaccca

SEQ ID NO: 1508216 - RNA, 13 nt, Pseudomonas aeruginosa PA01
caccgaggcgcgc

SEQ ID NO: 1508217 - RNA, 15 nt, Pseudomonas aeruginosa PA01
caccgaggcgcgccg

SEQ ID NO: 1508218 - RNA, 17 nt, Pseudomonas aeruginosa PA01
caccgaggcgcgccgac

SEQ ID NO: 1508219 - RNA, 18 nt, Pseudomonas aeruginosa PA01
caccgaguggcgcagcgc

SEQ ID NO: 1508220 - RNA, 17 nt, Pseudomonas aeruginosa PA01
caccgaguugaccagca

SEQ ID NO: 1508221 - RNA, 19 nt, Pseudomonas aeruginosa PA01
caccgaguugaccagcaug

SEQ ID NO: 1508222 - RNA, 17 nt, Pseudomonas aeruginosa PA01
caccgagcugaucgcgc

SEQ ID NO: 1508223 - RNA, 16 nt, Pseudomonas aeruginosa PA01
caccgaggaucggcac

SEQ ID NO: 1508224 - RNA, 20 nt, Pseudomonas aeruginosa PA01
caccgcaucgaaggcgccgg

SEQ ID NO: 1508225 - RNA, 14 nt, Pseudomonas aeruginosa PA01
caccgccagcaccu

SEQ ID NO: 1508226 - RNA, 23 nt, Pseudomonas aeruginosa PA01
caccgccagcaguugcaacagcg

SEQ ID NO: 1508227 - RNA, 16 nt, Pseudomonas aeruginosa PA01
caccgccagcgucgcc

SEQ ID NO: 1508228 - RNA, 18 nt, Pseudomonas aeruginosa PA01
caccgccagcgucgccgc

SEQ ID NO: 1508229 - RNA, 20 nt, Pseudomonas aeruginosa PA01
caccgccagcgucgccgccg

SEQ ID NO: 1508230 - RNA, 17 nt, Pseudomonas aeruginosa PA01
caccgauuucagcggau

SEQ ID NO: 1508231 - RNA, 22 nt, Pseudomonas aeruginosa PA01
caccgauuuccccaaggcacgc

SEQ ID NO: 1508232 - RNA, 15 nt, Pseudomonas aeruginosa PA01
caccgcacugguggc

SEQ ID NO: 1508233 - RNA, 23 nt, Pseudomonas aeruginosa PA01
caccucggcgccauaggccagca

SEQ ID NO: 1508234 - RNA, 14 nt, Pseudomonas aeruginosa PA01
caccucggaccaga

SEQ ID NO: 1508235 - RNA, 15 nt, Pseudomonas aeruginosa PA01
caccucguaggccga

SEQ ID NO: 1508236 - RNA, 13 nt, Pseudomonas aeruginosa PA01
caccucuucgcca

SEQ ID NO: 1508237 - RNA, 14 nt, Pseudomonas aeruginosa PA01
caccugaacgcgcc

SEQ ID NO: 1508238 - RNA, 20 nt, Pseudomonas aeruginosa PA01
caccugaacgcgcccggcca

SEQ ID NO: 1508239 - RNA, 22 nt, Pseudomonas aeruginosa PA01
caccugaacgcgcccggccagg

SEQ ID NO: 1508240 - RNA, 14 nt, Pseudomonas aeruginosa PA01
caccugcaucacca

SEQ ID NO: 1508241 - RNA, 16 nt, Pseudomonas aeruginosa PA01
caccugcaacacgucg

SEQ ID NO: 1508242 - RNA, 13 nt, Pseudomonas aeruginosa PA01
caccgucgcgguc

SEQ ID NO: 1508243 - RNA, 14 nt, Pseudomonas aeruginosa PA01
caccgucgcgguca

SEQ ID NO: 1508244 - RNA, 15 nt, Pseudomonas aeruginosa PA01
caccguggcgccggc

SEQ ID NO: 1508245 - RNA, 16 nt, Pseudomonas aeruginosa PA01
caccguggcgccggcg

SEQ ID NO: 1508246 - RNA, 14 nt, Pseudomonas aeruginosa PA01
caccguggcgccau

SEQ ID NO: 1508247 - RNA, 21 nt, Pseudomonas aeruginosa PA01
caccguggagaggucgccgac

SEQ ID NO: 1508248 - RNA, 18 nt, Pseudomonas aeruginosa PA01
caccucgccaagcuggcg

SEQ ID NO: 1508249 - RNA, 16 nt, Pseudomonas aeruginosa PA01
caccucgcgggaacgg

SEQ ID NO: 1508250 - RNA, 13 nt, Pseudomonas aeruginosa PA01
caccucgacggcg

SEQ ID NO: 1508251 - RNA, 20 nt, Pseudomonas aeruginosa PA01
caccucgaugaacagugcgc

SEQ ID NO: 1508252 - RNA, 23 nt, Pseudomonas aeruginosa PA01
caccucgacccuggcgccgaccu

SEQ ID NO: 1508253 - RNA, 15 nt, Pseudomonas aeruginosa PA01
caccucgaccuggua

SEQ ID NO: 1508254 - RNA, 19 nt, Pseudomonas aeruginosa PA01
caccuccuugggaucggcg

SEQ ID NO: 1508255 - RNA, 17 nt, Pseudomonas aeruginosa PA01
caccguggucagcacca

SEQ ID NO: 1508256 - RNA, 17 nt, Pseudomonas aeruginosa PA01
caccguggucauggcgc

SEQ ID NO: 1508257 - RNA, 21 nt, Pseudomonas aeruginosa PA01
caccucccccagcgggcgguc

SEQ ID NO: 1508258 - RNA, 15 nt, Pseudomonas aeruginosa PA01
caccggcuggccgcg

SEQ ID NO: 1508259 - RNA, 16 nt, Pseudomonas aeruginosa PA01
caccggcuggccgcga

SEQ ID NO: 1508260 - RNA, 17 nt, Pseudomonas aeruginosa PA01
caccggcucgcucucga

SEQ ID NO: 1508261 - RNA, 18 nt, Pseudomonas aeruginosa PA01
caccggcucgcucucgaa

SEQ ID NO: 1508262 - RNA, 20 nt, Pseudomonas aeruginosa PA01
caccggcguuauccgccgau

SEQ ID NO: 1508263 - RNA, 14 nt, Pseudomonas aeruginosa PA01
caccggcuggcggc

SEQ ID NO: 1508264 - RNA, 15 nt, Pseudomonas aeruginosa PA01
caccggcuggcggcu

SEQ ID NO: 1508265 - RNA, 13 nt, Pseudomonas aeruginosa PA01
caccggcuggccg

SEQ ID NO: 1508266 - RNA, 17 nt, Pseudomonas aeruginosa PA01
caccggcuggcccucca

SEQ ID NO: 1508267 - RNA, 21 nt, Pseudomonas aeruginosa PA01
caccgggacgaagcggaagcc

SEQ ID NO: 1508268 - RNA, 14 nt, Pseudomonas aeruginosa PA01
caccggacggcuga

SEQ ID NO: 1508269 - RNA, 15 nt, Pseudomonas aeruginosa PA01
caccggaccgggcgc

SEQ ID NO: 1508270 - RNA, 14 nt, Pseudomonas aeruginosa PA01
caccggcggcgcca

SEQ ID NO: 1508271 - RNA, 18 nt, Pseudomonas aeruginosa PA01
caccggcggcgccaggcc

SEQ ID NO: 1508272 - RNA, 15 nt, Pseudomonas aeruginosa PA01
caccggcggaugacg

SEQ ID NO: 1508273 - RNA, 14 nt, Pseudomonas aeruginosa PA01
caccggcgcgccgg

SEQ ID NO: 1508274 - RNA, 22 nt, Pseudomonas aeruginosa PA01
caccggcgcgccggacaggcca

SEQ ID NO: 1508275 - RNA, 13 nt, Pseudomonas aeruginosa PA01
caccggcgcgccg

SEQ ID NO: 1508276 - RNA, 20 nt, Pseudomonas aeruginosa PA01
caccgguacgcucaccacca

SEQ ID NO: 1508277 - RNA, 23 nt, Pseudomonas aeruginosa PA01
caccgguacgcucaccaccaccg

SEQ ID NO: 1508278 - RNA, 19 nt, Pseudomonas aeruginosa PA01
caccgggaucagcggcggg

SEQ ID NO: 1508279 - RNA, 23 nt, Pseudomonas aeruginosa PA01
caccgggaucagcggcggggcca

SEQ ID NO: 1508280 - RNA, 19 nt, Pseudomonas aeruginosa PA01
caccgggaucugccgguag

SEQ ID NO: 1508281 - RNA, 19 nt, Pseudomonas aeruginosa PA01
caccgggaucuggcccugc

SEQ ID NO: 1508282 - RNA, 23 nt, Pseudomonas aeruginosa PA01
caccgggaucuggcccugcaaca

SEQ ID NO: 1508283 - RNA, 21 nt, Pseudomonas aeruginosa PA01
caccgggauggucgagggcgc

SEQ ID NO: 1508284 - RNA, 23 nt, Pseudomonas aeruginosa PA01
caccgggauggucgagggcgcgu

SEQ ID NO: 1508285 - RNA, 23 nt, Pseudomonas aeruginosa PA01
caccgggaucgcuaccgacagga

SEQ ID NO: 1508286 - RNA, 15 nt, Pseudomonas aeruginosa PA01
caccgucaccuguuc

SEQ ID NO: 1508287 - RNA, 23 nt, Pseudomonas aeruginosa PA01
caccgucaccuguucggcgcuga

SEQ ID NO: 1508288 - RNA, 13 nt, Pseudomonas aeruginosa PA01
caccgucaagggc

SEQ ID NO: 1508289 - RNA, 23 nt, Pseudomonas aeruginosa PA01
caccguaggccaggcagaccagc

SEQ ID NO: 1508290 - RNA, 13 nt, Pseudomonas aeruginosa PA01
caccggugccggg

SEQ ID NO: 1508291 - RNA, 18 nt, Pseudomonas aeruginosa PA01
caccgguggacugguuga

SEQ ID NO: 1508292 - RNA, 14 nt, Pseudomonas aeruginosa PA01
caccgguucgacac

SEQ ID NO: 1508293 - RNA, 20 nt, Pseudomonas aeruginosa PA01
cacgccgagcaacggcagca

SEQ ID NO: 1508294 - RNA, 17 nt, Pseudomonas aeruginosa PA01
cacgccgaggcugcggg

SEQ ID NO: 1508295 - RNA, 14 nt, Pseudomonas aeruginosa PA01
cacgccgagggcgc

SEQ ID NO: 1508296 - RNA, 16 nt, Pseudomonas aeruginosa PA01
cacgccgagggcgcgg

SEQ ID NO: 1508297 - RNA, 17 nt, Pseudomonas aeruginosa PA01
cacgccgagggcgcggc

SEQ ID NO: 1508298 - RNA, 18 nt, Pseudomonas aeruginosa PA01
cacgccgagggcgcggcg

SEQ ID NO: 1508299 - RNA, 19 nt, Pseudomonas aeruginosa PA01
cacgccgagggcgcggcgc

SEQ ID NO: 1508300 - RNA, 13 nt, Pseudomonas aeruginosa PA01
cacgccgauggcg

SEQ ID NO: 1508301 - RNA, 19 nt, Pseudomonas aeruginosa PA01
cacgccgaucccgaucggc

SEQ ID NO: 1508302 - RNA, 14 nt, Pseudomonas aeruginosa PA01
cacgcccggugucg

SEQ ID NO: 1508303 - RNA, 15 nt, Pseudomonas aeruginosa PA01
cacgcccggugucga

SEQ ID NO: 1508304 - RNA, 20 nt, Pseudomonas aeruginosa PA01
cacgccgaaguccugcaaca

SEQ ID NO: 1508305 - RNA, 17 nt, Pseudomonas aeruginosa PA01
cacgccgaagucggcga

SEQ ID NO: 1508306 - RNA, 23 nt, Pseudomonas aeruginosa PA01
cacgccgaagucggcgagccggc

SEQ ID NO: 1508307 - RNA, 22 nt, Pseudomonas aeruginosa PA01
cacgcccuguuucggguccagg

SEQ ID NO: 1508308 - RNA, 18 nt, Pseudomonas aeruginosa PA01
cacgcccuugcuguucgc

SEQ ID NO: 1508309 - RNA, 15 nt, Pseudomonas aeruginosa PA01
cacgcccggcacucg

SEQ ID NO: 1508310 - RNA, 14 nt, Pseudomonas aeruginosa PA01
cacgcccugcgcca

SEQ ID NO: 1508311 - RNA, 20 nt, Pseudomonas aeruginosa PA01
cacgcccugcgccagcaucg

SEQ ID NO: 1508312 - RNA, 17 nt, Pseudomonas aeruginosa PA01
cacgccgggaaucccca

SEQ ID NO: 1508313 - RNA, 15 nt, Pseudomonas aeruginosa PA01
cacgccggugaugua

SEQ ID NO: 1508314 - RNA, 14 nt, Pseudomonas aeruginosa PA01
cacgccggccggcu

SEQ ID NO: 1508315 - RNA, 22 nt, Pseudomonas aeruginosa PA01
cacgccggccucgcgcaacugc

SEQ ID NO: 1508316 - RNA, 14 nt, Pseudomonas aeruginosa PA01
cacgccggcgcucc

SEQ ID NO: 1508317 - RNA, 20 nt, Pseudomonas aeruginosa PA01
cacgccgcggaaggcccgcg

SEQ ID NO: 1508318 - RNA, 23 nt, Pseudomonas aeruginosa PA01
cacgccgcggcugaugccgcggu

SEQ ID NO: 1508319 - RNA, 15 nt, Pseudomonas aeruginosa PA01
cacgccuggcggcug

SEQ ID NO: 1508320 - RNA, 16 nt, Pseudomonas aeruginosa PA01
cacgccuggcggcugg

SEQ ID NO: 1508321 - RNA, 15 nt, Pseudomonas aeruginosa PA01
cacgccuucgcggcc

SEQ ID NO: 1508322 - RNA, 16 nt, Pseudomonas aeruginosa PA01
cacgccuucgcggccg

SEQ ID NO: 1508323 - RNA, 21 nt, Pseudomonas aeruginosa PA01
cacgccuuccggguugaaggc

SEQ ID NO: 1508324 - RNA, 13 nt, Pseudomonas aeruginosa PA01
cacgccgucgccg

SEQ ID NO: 1508325 - RNA, 14 nt, Pseudomonas aeruginosa PA01
cacgccgguggcca

SEQ ID NO: 1508326 - RNA, 16 nt, Pseudomonas aeruginosa PA01
cacgccgguggccagg

SEQ ID NO: 1508327 - RNA, 20 nt, Pseudomonas aeruginosa PA01
cacgccgugcaucaccggca

SEQ ID NO: 1508328 - RNA, 22 nt, Pseudomonas aeruginosa PA01
cacgccgugcaucaccggcagc

SEQ ID NO: 1508329 - RNA, 23 nt, Pseudomonas aeruginosa PA01
cacgccgugcaucaccggcagca

SEQ ID NO: 1508330 - RNA, 18 nt, Pseudomonas aeruginosa PA01
cacgccccuccuucgagc

SEQ ID NO: 1508331 - RNA, 13 nt, Pseudomonas aeruginosa PA01
cacgcccgccgug

SEQ ID NO: 1508332 - RNA, 15 nt, Pseudomonas aeruginosa PA01
cacgcccgccguggc

SEQ ID NO: 1508333 - RNA, 18 nt, Pseudomonas aeruginosa PA01
cacgcccaguugcgccgc

SEQ ID NO: 1508334 - RNA, 19 nt, Pseudomonas aeruginosa PA01
cacgcccaguugcgccgcc

SEQ ID NO: 1508335 - RNA, 20 nt, Pseudomonas aeruginosa PA01
cacgccccauccgggcggcg

SEQ ID NO: 1508336 - RNA, 22 nt, Pseudomonas aeruginosa PA01
cacgccccauccgggcggcggg

SEQ ID NO: 1508337 - RNA, 21 nt, Pseudomonas aeruginosa PA01
cacgcccaugccuugcagcgc

SEQ ID NO: 1508338 - RNA, 13 nt, Pseudomonas aeruginosa PA01
cacgccccagaag

SEQ ID NO: 1508339 - RNA, 23 nt, Pseudomonas aeruginosa PA01
cacgccccagaagccccagagcc

SEQ ID NO: 1508340 - RNA, 14 nt, Pseudomonas aeruginosa PA01
cacgccccagcgca

SEQ ID NO: 1508341 - RNA, 21 nt, Pseudomonas aeruginosa PA01
cacgccauucgaauggcgccg

SEQ ID NO: 1508342 - RNA, 18 nt, Pseudomonas aeruginosa PA01
cacgccauccuccgaggc

SEQ ID NO: 1508343 - RNA, 20 nt, Pseudomonas aeruginosa PA01
cacgccauccuccgaggcca

SEQ ID NO: 1508344 - RNA, 13 nt, Pseudomonas aeruginosa PA01
cacgcccaggcgc

SEQ ID NO: 1508345 - RNA, 14 nt, Pseudomonas aeruginosa PA01
cacgcccaggcgcu

SEQ ID NO: 1508346 - RNA, 17 nt, Pseudomonas aeruginosa PA01
cacgcaggcgcuggccg

SEQ ID NO: 1508347 - RNA, 14 nt, Pseudomonas aeruginosa PA01
cacgcaggaacagc

SEQ ID NO: 1508348 - RNA, 20 nt, Pseudomonas aeruginosa PA01
cacgcaguucgcgggccgcg

SEQ ID NO: 1508349 - RNA, 21 nt, Pseudomonas aeruginosa PA01
cacgcaguucgcgggccgcgg

SEQ ID NO: 1508350 - RNA, 23 nt, Pseudomonas aeruginosa PA01
cacgcauagcgcgcuguagccgg

SEQ ID NO: 1508351 - RNA, 20 nt, Pseudomonas aeruginosa PA01
cacgcauugucgggcguaga

SEQ ID NO: 1508352 - RNA, 12 nt, Pseudomonas aeruginosa PA01
cacgauggccgg

SEQ ID NO: 1508353 - RNA, 15 nt, Pseudomonas aeruginosa PA01
cacgauggccggcag

SEQ ID NO: 1508354 - RNA, 16 nt, Pseudomonas aeruginosa PA01
cacgauggccggcagc

SEQ ID NO: 1508355 - RNA, 17 nt, Pseudomonas aeruginosa PA01
cacgauggccggcagca

SEQ ID NO: 1508356 - RNA, 20 nt, Pseudomonas aeruginosa PA01
cacgauggccggcagcagcg

SEQ ID NO: 1508357 - RNA, 23 nt, Pseudomonas aeruginosa PA01
cacgauggccggcagcagcgcca

SEQ ID NO: 1508358 - RNA, 16 nt, Pseudomonas aeruginosa PA01
cacgaugucgaccugg

SEQ ID NO: 1508359 - RNA, 17 nt, Pseudomonas aeruginosa PA01
cacgaugucgaccuggg

SEQ ID NO: 1508360 - RNA, 14 nt, Pseudomonas aeruginosa PA01
cacgauggcgagga

SEQ ID NO: 1508361 - RNA, 14 nt, Pseudomonas aeruginosa PA01
cacgcaggccagcg

SEQ ID NO: 1508362 - RNA, 17 nt, Pseudomonas aeruginosa PA01
cacgcagagcggcaggc

SEQ ID NO: 1508363 - RNA, 23 nt, Pseudomonas aeruginosa PA01
cacgcagagcggcaggccgccga

SEQ ID NO: 1508364 - RNA, 13 nt, Pseudomonas aeruginosa PA01
cacgcagaaggcg

SEQ ID NO: 1508365 - RNA, 20 nt, Pseudomonas aeruginosa PA01
cacgcagaaggcgcuuucgu

SEQ ID NO: 1508366 - RNA, 12 nt, Pseudomonas aeruginosa PA01
cacgcagcagcu

SEQ ID NO: 1508367 - RNA, 16 nt, Pseudomonas aeruginosa PA01
cacgcagccacccgcg

SEQ ID NO: 1508368 - RNA, 19 nt, Pseudomonas aeruginosa PA01
cacgcaauggcgcagccgc

SEQ ID NO: 1508369 - RNA, 20 nt, Pseudomonas aeruginosa PA01
cacgcaauagugcagcucca

SEQ ID NO: 1508370 - RNA, 14 nt, Pseudomonas aeruginosa PA01
cacgcacgcgccug

SEQ ID NO: 1508371 - RNA, 22 nt, Pseudomonas aeruginosa PA01
caccugcuucugguugcucacc

SEQ ID NO: 1508372 - RNA, 14 nt, Pseudomonas aeruginosa PA01
caccugcucggggc

SEQ ID NO: 1508373 - RNA, 16 nt, Pseudomonas aeruginosa PA01
caccugcucggggccg

SEQ ID NO: 1508374 - RNA, 20 nt, Pseudomonas aeruginosa PA01
caccuggaucgccaggcuga

SEQ ID NO: 1508375 - RNA, 15 nt, Pseudomonas aeruginosa PA01
caccuggccgugcuc

SEQ ID NO: 1508376 - RNA, 24 nt, Pseudomonas aeruginosa PA01
caccuggcagugcgccggcaucgc

SEQ ID NO: 1508377 - RNA, 16 nt, Pseudomonas aeruginosa PA01
caccuggccauucgcu

SEQ ID NO: 1508378 - RNA, 17 nt, Pseudomonas aeruginosa PA01
caccuggcgacaggcga

SEQ ID NO: 1508379 - RNA, 21 nt, Pseudomonas aeruginosa PA01
caccugcguggcgaacgcccg

SEQ ID NO: 1508380 - RNA, 20 nt, Pseudomonas aeruginosa PA01
caccugcucgcugaaccgcg

SEQ ID NO: 1508381 - RNA, 20 nt, Pseudomonas aeruginosa PA01
caccugcgccgaaggcguca

SEQ ID NO: 1508382 - RNA, 22 nt, Pseudomonas aeruginosa PA01
caccuggaacuugcuguugccg

SEQ ID NO: 1508383 - RNA, 22 nt, Pseudomonas aeruginosa PA01
caccugggcguuggccagcgcc

SEQ ID NO: 1508384 - RNA, 23 nt, Pseudomonas aeruginosa PA01
caccuggucuucgguggcggcga

SEQ ID NO: 1508385 - RNA, 14 nt, Pseudomonas aeruginosa PA01
caccuggucgccga

SEQ ID NO: 1508386 - RNA, 18 nt, Pseudomonas aeruginosa PA01
caccuggcggcugagcug

SEQ ID NO: 1508387 - RNA, 20 nt, Pseudomonas aeruginosa PA01
caccuggcggcugagcuguu

SEQ ID NO: 1508388 - RNA, 21 nt, Pseudomonas aeruginosa PA01
caccuggcggucgccgccggc

SEQ ID NO: 1508389 - RNA, 17 nt, Pseudomonas aeruginosa PA01
caccugggacucccgca

SEQ ID NO: 1508390 - RNA, 19 nt, Pseudomonas aeruginosa PA01
caccugggacucccgcaga

SEQ ID NO: 1508391 - RNA, 16 nt, Pseudomonas aeruginosa PA01
caccuguucggcgcug

SEQ ID NO: 1508392 - RNA, 20 nt, Pseudomonas aeruginosa PA01
caccuucaucaccaggucgc

SEQ ID NO: 1508393 - RNA, 11 nt, Pseudomonas aeruginosa PA01
caccuuccucg

SEQ ID NO: 1508394 - RNA, 13 nt, Pseudomonas aeruginosa PA01
caccuuccucgcg

SEQ ID NO: 1508395 - RNA, 17 nt, Pseudomonas aeruginosa PA01
caccuguuucagcgggu

SEQ ID NO: 1508396 - RNA, 19 nt, Pseudomonas aeruginosa PA01
caccuguuccagcaacgcc

SEQ ID NO: 1508397 - RNA, 20 nt, Pseudomonas aeruginosa PA01
caccuguuccagcaacgccu

SEQ ID NO: 1508398 - RNA, 18 nt, Pseudomonas aeruginosa PA01
cacgaacagggucuucag

SEQ ID NO: 1508399 - RNA, 23 nt, Pseudomonas aeruginosa PA01
cacgaacagggucuucaggccga

SEQ ID NO: 1508400 - RNA, 15 nt, Pseudomonas aeruginosa PA01
cacgaacaggugcug

SEQ ID NO: 1508401 - RNA, 18 nt, Pseudomonas aeruginosa PA01
cacgaaagccaugcccag

SEQ ID NO: 1508402 - RNA, 22 nt, Pseudomonas aeruginosa PA01
cacgaaagccaugcccagacgc

SEQ ID NO: 1508403 - RNA, 19 nt, Pseudomonas aeruginosa PA01
caccuuguacggcagcggc

SEQ ID NO: 1508404 - RNA, 13 nt, Pseudomonas aeruginosa PA01
cacgaaaaagccg

SEQ ID NO: 1508405 - RNA, 19 nt, Pseudomonas aeruginosa PA01
cacgaaaaagccggcgcau

SEQ ID NO: 1508406 - RNA, 23 nt, Pseudomonas aeruginosa PA01
cacgaaccauugcggcccgccac

SEQ ID NO: 1508407 - RNA, 12 nt, Pseudomonas aeruginosa PA01
cacgaagcgacc

SEQ ID NO: 1508408 - RNA, 15 nt, Pseudomonas aeruginosa PA01
cacgaagcggucgcc

SEQ ID NO: 1508409 - RNA, 17 nt, Pseudomonas aeruginosa PA01
cacgaagcggucgccgg

SEQ ID NO: 1508410 - RNA, 21 nt, Pseudomonas aeruginosa PA01
cacgaagcggucgccggcgcg

SEQ ID NO: 1508411 - RNA, 14 nt, Pseudomonas aeruginosa PA01
caccuugccgcgcc

SEQ ID NO: 1508412 - RNA, 18 nt, Pseudomonas aeruginosa PA01
caccuugccgcgcccggc

SEQ ID NO: 1508413 - RNA, 16 nt, Pseudomonas aeruginosa PA01
caccuugcgggugguc

SEQ ID NO: 1508414 - RNA, 13 nt, Pseudomonas aeruginosa PA01
caccuugcgcacc

SEQ ID NO: 1508415 - RNA, 18 nt, Pseudomonas aeruginosa PA01
caccuugcgcaccgccug

SEQ ID NO: 1508416 - RNA, 16 nt, Pseudomonas aeruginosa PA01
caccuucgccagcagg

SEQ ID NO: 1508417 - RNA, 22 nt, Pseudomonas aeruginosa PA01
caccuucgcccgcugcgcugcc

SEQ ID NO: 1508418 - RNA, 24 nt, Pseudomonas aeruginosa PA01
caccuucgcccucagcagcgccgc

SEQ ID NO: 1508419 - RNA, 13 nt, Pseudomonas aeruginosa PA01
caccuugaccuug

SEQ ID NO: 1508420 - RNA, 21 nt, Pseudomonas aeruginosa PA01
caccuugaccuugucggccga

SEQ ID NO: 1508421 - RNA, 22 nt, Pseudomonas aeruginosa PA01
caccuugaccuugucggccgac

SEQ ID NO: 1508422 - RNA, 23 nt, Pseudomonas aeruginosa PA01
caccuugaggcggguucggcguc

SEQ ID NO: 1508423 - RNA, 13 nt, Pseudomonas aeruginosa PA01
caccuugauccgc

SEQ ID NO: 1508424 - RNA, 20 nt, Pseudomonas aeruginosa PA01
caccuugucgcaccagccuu

SEQ ID NO: 1508425 - RNA, 14 nt, Pseudomonas aeruginosa PA01
caccuuggcgcgac

SEQ ID NO: 1508426 - RNA, 18 nt, Pseudomonas aeruginosa PA01
caccuugugcugccugcg

SEQ ID NO: 1508427 - RNA, 15 nt, Pseudomonas aeruginosa PA01
caccuugucgcugac

SEQ ID NO: 1508428 - RNA, 14 nt, Pseudomonas aeruginosa PA01
cacgagaccaccga

SEQ ID NO: 1508429 - RNA, 22 nt, Pseudomonas aeruginosa PA01
cacgacucacccgcugcggaag

SEQ ID NO: 1508430 - RNA, 17 nt, Pseudomonas aeruginosa PA01
cacgaggaugucggcga

SEQ ID NO: 1508431 - RNA, 22 nt, Pseudomonas aeruginosa PA01
cacgaggauuuccgcgcccggc

SEQ ID NO: 1508432 - RNA, 21 nt, Pseudomonas aeruginosa PA01
cacgagccgcugcggcucgcc

SEQ ID NO: 1508433 - RNA, 16 nt, Pseudomonas aeruginosa PA01
cacgaucggcaccauc

SEQ ID NO: 1508434 - RNA, 21 nt, Pseudomonas aeruginosa PA01
cacgaucggcaccaucaccga

SEQ ID NO: 1508435 - RNA, 16 nt, Pseudomonas aeruginosa PA01
cacgaucgcggcgacg

SEQ ID NO: 1508436 - RNA, 22 nt, Pseudomonas aeruginosa PA01
cacgaucagcucguugcccggc

SEQ ID NO: 1508437 - RNA, 14 nt, Pseudomonas aeruginosa PA01
cacgacccugcugg

SEQ ID NO: 1508438 - RNA, 15 nt, Pseudomonas aeruginosa PA01
cacgacccugcuggc

SEQ ID NO: 1508439 - RNA, 16 nt, Pseudomonas aeruginosa PA01
cacgacccugcuggcc

SEQ ID NO: 1508440 - RNA, 22 nt, Pseudomonas aeruginosa PA01
cacgacccugcuggccggugcc

SEQ ID NO: 1508441 - RNA, 22 nt, Pseudomonas aeruginosa PA01
cacgacccgcucuuccuugucg

SEQ ID NO: 1508442 - RNA, 23 nt, Pseudomonas aeruginosa PA01
cacgacgaagcgccggcggccug

SEQ ID NO: 1508443 - RNA, 13 nt, Pseudomonas aeruginosa PA01
cacgacgucggcg

SEQ ID NO: 1508444 - RNA, 13 nt, Pseudomonas aeruginosa PA01
cacaucgcccggc

SEQ ID NO: 1508445 - RNA, 23 nt, Pseudomonas aeruginosa PA01
cacaucgcccggcagcaggccgc

SEQ ID NO: 1508446 - RNA, 16 nt, Pseudomonas aeruginosa PA01
cacagguccagcaagg

SEQ ID NO: 1508447 - RNA, 18 nt, Pseudomonas aeruginosa PA01
cacagcguggccagcgcc

SEQ ID NO: 1508448 - RNA, 18 nt, Pseudomonas aeruginosa PA01
cacagggcgacuaccagg

SEQ ID NO: 1508449 - RNA, 13 nt, Pseudomonas aeruginosa PA01
cacaggguggcgg

SEQ ID NO: 1508450 - RNA, 22 nt, Pseudomonas aeruginosa PA01
cacaggguggcgggcggccccu

SEQ ID NO: 1508451 - RNA, 22 nt, Pseudomonas aeruginosa PA01
cacagguugacgaugcggcccg

SEQ ID NO: 1508452 - RNA, 24 nt, Pseudomonas aeruginosa PA01
cacagguugacgaugcggcccgcc

SEQ ID NO: 1508453 - RNA, 15 nt, Pseudomonas aeruginosa PA01
caccacagcaccacg

SEQ ID NO: 1508454 - RNA, 14 nt, Pseudomonas aeruginosa PA01
caccacccagccgc

SEQ ID NO: 1508455 - RNA, 19 nt, Pseudomonas aeruginosa PA01
caccacccagccgcggccg

SEQ ID NO: 1508456 - RNA, 19 nt, Pseudomonas aeruginosa PA01
caccaccgacgggucgcca

SEQ ID NO: 1508457 - RNA, 18 nt, Pseudomonas aeruginosa PA01
caccaccgagagcggcgc

SEQ ID NO: 1508458 - RNA, 22 nt, Pseudomonas aeruginosa PA01
caccaccgagagcggcgccagg

SEQ ID NO: 1508459 - RNA, 15 nt, Pseudomonas aeruginosa PA01
caccacccggccgcg

SEQ ID NO: 1508460 - RNA, 14 nt, Pseudomonas aeruginosa PA01
caccacccgcugca

SEQ ID NO: 1508461 - RNA, 22 nt, Pseudomonas aeruginosa PA01
caccacaaggugggcagcagcg

SEQ ID NO: 1508462 - RNA, 23 nt, Pseudomonas aeruginosa PA01
caccacaaggugggcagcagcga

SEQ ID NO: 1508463 - RNA, 23 nt, Pseudomonas aeruginosa PA01
cacagcacgagcuuggccacucc

SEQ ID NO: 1508464 - RNA, 20 nt, Pseudomonas aeruginosa PA01
cacagcaccacgcuccugga

SEQ ID NO: 1508465 - RNA, 21 nt, Pseudomonas aeruginosa PA01
cacaccgaagucgcccgccgg

SEQ ID NO: 1508466 - RNA, 14 nt, Pseudomonas aeruginosa PA01
cacaccgaccgcga

SEQ ID NO: 1508467 - RNA, 19 nt, Pseudomonas aeruginosa PA01
cacaccgaacuuccgccga

SEQ ID NO: 1508468 - RNA, 12 nt, Pseudomonas aeruginosa PA01
cacaccgucgaa

SEQ ID NO: 1508469 - RNA, 15 nt, Pseudomonas aeruginosa PA01
cacaccugcaacacg

SEQ ID NO: 1508470 - RNA, 12 nt, Pseudomonas aeruginosa PA01
cacaccuggucu

SEQ ID NO: 1508471 - RNA, 20 nt, Pseudomonas aeruginosa PA01
cacacggucgagacccgcaa

SEQ ID NO: 1508472 - RNA, 21 nt, Pseudomonas aeruginosa PA01
cacacggucgagacccgcaac

SEQ ID NO: 1508473 - RNA, 16 nt, Pseudomonas aeruginosa PA01
caccagcgcugccucg

SEQ ID NO: 1508474 - RNA, 16 nt, Pseudomonas aeruginosa PA01
caccaggagcgccagc

SEQ ID NO: 1508475 - RNA, 19 nt, Pseudomonas aeruginosa PA01
caccagcggaccgucgggc

SEQ ID NO: 1508476 - RNA, 18 nt, Pseudomonas aeruginosa PA01
caccagcgcgcgcuggcg

SEQ ID NO: 1508477 - RNA, 17 nt, Pseudomonas aeruginosa PA01
caccagcgccgccaccg

SEQ ID NO: 1508478 - RNA, 16 nt, Pseudomonas aeruginosa PA01
caccagcgccgccagg

SEQ ID NO: 1508479 - RNA, 12 nt, Pseudomonas aeruginosa PA01
caccagcgccgg

SEQ ID NO: 1508480 - RNA, 14 nt, Pseudomonas aeruginosa PA01
caccagcgccggcg

SEQ ID NO: 1508481 - RNA, 17 nt, Pseudomonas aeruginosa PA01
caccagcgccggcggcg

SEQ ID NO: 1508482 - RNA, 20 nt, Pseudomonas aeruginosa PA01
caccagcgccggcggcgcgu

SEQ ID NO: 1508483 - RNA, 13 nt, Pseudomonas aeruginosa PA01
caccagcgccggg

SEQ ID NO: 1508484 - RNA, 14 nt, Pseudomonas aeruginosa PA01
caccagcagcagcg

SEQ ID NO: 1508485 - RNA, 18 nt, Pseudomonas aeruginosa PA01
caccagcacuuccggcgc

SEQ ID NO: 1508486 - RNA, 12 nt, Pseudomonas aeruginosa PA01
caccagcagcaa

SEQ ID NO: 1508487 - RNA, 16 nt, Pseudomonas aeruginosa PA01
caccagcacggugcug

SEQ ID NO: 1508488 - RNA, 14 nt, Pseudomonas aeruginosa PA01
caccagcaccugcg

SEQ ID NO: 1508489 - RNA, 18 nt, Pseudomonas aeruginosa PA01
caccagcaccugcgggcu

SEQ ID NO: 1508490 - RNA, 13 nt, Pseudomonas aeruginosa PA01
caccagcacgccc

SEQ ID NO: 1508491 - RNA, 15 nt, Pseudomonas aeruginosa PA01
caccagcacgcccuu

SEQ ID NO: 1508492 - RNA, 16 nt, Pseudomonas aeruginosa PA01
caccagcaggaagccg

SEQ ID NO: 1508493 - RNA, 18 nt, Pseudomonas aeruginosa PA01
caccagcaggucggcgcg

SEQ ID NO: 1508494 - RNA, 12 nt, Pseudomonas aeruginosa PA01
caccagcaggcg

SEQ ID NO: 1508495 - RNA, 20 nt, Pseudomonas aeruginosa PA01
caccagcagggccaggccga

SEQ ID NO: 1508496 - RNA, 11 nt, Pseudomonas aeruginosa PA01
caccagcaggu

SEQ ID NO: 1508497 - RNA, 14 nt, Pseudomonas aeruginosa PA01
caccagcaucagca

SEQ ID NO: 1508498 - RNA, 15 nt, Pseudomonas aeruginosa PA01
caccagcaucagcag

SEQ ID NO: 1508499 - RNA, 20 nt, Pseudomonas aeruginosa PA01
caccagccacugcuuggcga

SEQ ID NO: 1508500 - RNA, 17 nt, Pseudomonas aeruginosa PA01
caccagccaggcggcca

SEQ ID NO: 1508501 - RNA, 17 nt, Pseudomonas aeruginosa PA01
caccagccagucgagac

SEQ ID NO: 1508502 - RNA, 14 nt, Pseudomonas aeruginosa PA01
caccagacgcagca

SEQ ID NO: 1508503 - RNA, 16 nt, Pseudomonas aeruginosa PA01
caccagacgcagcaug

SEQ ID NO: 1508504 - RNA, 16 nt, Pseudomonas aeruginosa PA01
caccagagccagccgc

SEQ ID NO: 1508505 - RNA, 16 nt, Pseudomonas aeruginosa PA01
caccagaggcugaccu

SEQ ID NO: 1508506 - RNA, 22 nt, Pseudomonas aeruginosa PA01
caccagauggcuggucaggcug

SEQ ID NO: 1508507 - RNA, 22 nt, Pseudomonas aeruginosa PA01
caccagcaccacccggcgcacg

SEQ ID NO: 1508508 - RNA, 18 nt, Pseudomonas aeruginosa PA01
caccacuggaaacgccca

SEQ ID NO: 1508509 - RNA, 20 nt, Pseudomonas aeruginosa PA01
caccaucgcggcgauggccg

SEQ ID NO: 1508510 - RNA, 22 nt, Pseudomonas aeruginosa PA01
caccaucgcggcgauggccgcc

SEQ ID NO: 1508511 - RNA, 16 nt, Pseudomonas aeruginosa PA01
caccauccgccgcagg

SEQ ID NO: 1508512 - RNA, 21 nt, Pseudomonas aeruginosa PA01
caccauccgccgcaggucggc

SEQ ID NO: 1508513 - RNA, 18 nt, Pseudomonas aeruginosa PA01
caccagucccuggccggc

SEQ ID NO: 1508514 - RNA, 19 nt, Pseudomonas aeruginosa PA01
caccagucccuggccggcg

SEQ ID NO: 1508515 - RNA, 21 nt, Pseudomonas aeruginosa PA01
caccagucccuggccggcgau

SEQ ID NO: 1508516 - RNA, 22 nt, Pseudomonas aeruginosa PA01
caccagucccuggccggcgaug

SEQ ID NO: 1508517 - RNA, 12 nt, Pseudomonas aeruginosa PA01
caccaggccagg

SEQ ID NO: 1508518 - RNA, 13 nt, Pseudomonas aeruginosa PA01
caccaggcccgcc

SEQ ID NO: 1508519 - RNA, 15 nt, Pseudomonas aeruginosa PA01
caccaggcccgccgg

SEQ ID NO: 1508520 - RNA, 16 nt, Pseudomonas aeruginosa PA01
caccaggaucgccggg

SEQ ID NO: 1508521 - RNA, 13 nt, Pseudomonas aeruginosa PA01
caccaggacccag

SEQ ID NO: 1508522 - RNA, 12 nt, Pseudomonas aeruginosa PA01
caccaggccgau

SEQ ID NO: 1508523 - RNA, 13 nt, Pseudomonas aeruginosa PA01
caccaggcccugc

SEQ ID NO: 1508524 - RNA, 22 nt, Pseudomonas aeruginosa PA01
caccaggccgaugaacgccgcg

SEQ ID NO: 1508525 - RNA, 23 nt, Pseudomonas aeruginosa PA01
caccaggccgaugaacgccgcga

SEQ ID NO: 1508526 - RNA, 18 nt, Pseudomonas aeruginosa PA01
caccaggccggcggccga

SEQ ID NO: 1508527 - RNA, 14 nt, Pseudomonas aeruginosa PA01
caccaggccgcugc

SEQ ID NO: 1508528 - RNA, 19 nt, Pseudomonas aeruginosa PA01
caccaggucgucgucacgc

SEQ ID NO: 1508529 - RNA, 16 nt, Pseudomonas aeruginosa PA01
caccagguugaagaac

SEQ ID NO: 1508530 - RNA, 23 nt, Pseudomonas aeruginosa PA01
caccagguugaagaacggcccgc

SEQ ID NO: 1508531 - RNA, 21 nt, Pseudomonas aeruginosa PA01
caccaggugcuuggcuucgag

SEQ ID NO: 1508532 - RNA, 13 nt, Pseudomonas aeruginosa PA01
caccaggucggcg

SEQ ID NO: 1508533 - RNA, 14 nt, Pseudomonas aeruginosa PA01
caccaggucggcgc

SEQ ID NO: 1508534 - RNA, 15 nt, Pseudomonas aeruginosa PA01
caccaggucggcgcg

SEQ ID NO: 1508535 - RNA, 16 nt, Pseudomonas aeruginosa PA01
caccaggucggcgcgc

SEQ ID NO: 1508536 - RNA, 18 nt, Pseudomonas aeruginosa PA01
caccaggucggcgcgcga

SEQ ID NO: 1508537 - RNA, 22 nt, Pseudomonas aeruginosa PA01
caccaggucgccgcacaccgcg

SEQ ID NO: 1508538 - RNA, 14 nt, Pseudomonas aeruginosa PA01
cacccacauggcgg

SEQ ID NO: 1508539 - RNA, 21 nt, Pseudomonas aeruginosa PA01
cacccaacuuguuggcauccg

SEQ ID NO: 1508540 - RNA, 21 nt, Pseudomonas aeruginosa PA01
cacccaggauuuguccgcgcc

SEQ ID NO: 1508541 - RNA, 13 nt, Pseudomonas aeruginosa PA01
cacccagccgcgg

SEQ ID NO: 1508542 - RNA, 16 nt, Pseudomonas aeruginosa PA01
cacccagccgcggccg

SEQ ID NO: 1508543 - RNA, 17 nt, Pseudomonas aeruginosa PA01
cacccaucugccggcca

SEQ ID NO: 1508544 - RNA, 18 nt, Pseudomonas aeruginosa PA01
cacccauucgaugccgcg

SEQ ID NO: 1508545 - RNA, 18 nt, Pseudomonas aeruginosa PA01
caaugccuuccgacgccg

SEQ ID NO: 1508546 - RNA, 19 nt, Pseudomonas aeruginosa PA01
caaugcccggaccugggca

SEQ ID NO: 1508547 - RNA, 21 nt, Pseudomonas aeruginosa PA01
caaugcccggaccugggcacc

SEQ ID NO: 1508548 - RNA, 14 nt, Pseudomonas aeruginosa PA01
caauggggcggccg

SEQ ID NO: 1508549 - RNA, 18 nt, Pseudomonas aeruginosa PA01
caauggggcggccggcgc

SEQ ID NO: 1508550 - RNA, 20 nt, Pseudomonas aeruginosa PA01
caaugcggccugcaacgccg

SEQ ID NO: 1508551 - RNA, 21 nt, Pseudomonas aeruginosa PA01
caaugcggccugcaacgccgc

SEQ ID NO: 1508552 - RNA, 14 nt, Pseudomonas aeruginosa PA01
caaucggcgagccg

SEQ ID NO: 1508553 - RNA, 17 nt, Pseudomonas aeruginosa PA01
caaucggucgcccucgg

SEQ ID NO: 1508554 - RNA, 20 nt, Pseudomonas aeruginosa PA01
caaucggucgcccucggcca

SEQ ID NO: 1508555 - RNA, 19 nt, Pseudomonas aeruginosa PA01
caaugaaaaacgccggcga

SEQ ID NO: 1508556 - RNA, 20 nt, Pseudomonas aeruginosa PA01
caaugaaaaacgccggcgau

SEQ ID NO: 1508557 - RNA, 22 nt, Pseudomonas aeruginosa PA01
caaugaaaaagggaugccgccg

SEQ ID NO: 1508558 - RNA, 18 nt, Pseudomonas aeruginosa PA01
caaugagaggugggccgu

SEQ ID NO: 1508559 - RNA, 19 nt, Pseudomonas aeruginosa PA01
caauaccgaacaccagcaa

SEQ ID NO: 1508560 - RNA, 18 nt, Pseudomonas aeruginosa PA01
caaucaggcgcgaucgcg

SEQ ID NO: 1508561 - RNA, 19 nt, Pseudomonas aeruginosa PA01
caaucgcgcaacggcagcg

SEQ ID NO: 1508562 - RNA, 21 nt, Pseudomonas aeruginosa PA01
caaucgcgcaacggcagcgcu

SEQ ID NO: 1508563 - RNA, 22 nt, Pseudomonas aeruginosa PA01
cacaaccugccgaucgccgcgc

SEQ ID NO: 1508564 - RNA, 15 nt, Pseudomonas aeruginosa PA01
caauugcaggcccgg

SEQ ID NO: 1508565 - RNA, 19 nt, Pseudomonas aeruginosa PA01
cacaaggugggcagcagcg

SEQ ID NO: 1508566 - RNA, 23 nt, Pseudomonas aeruginosa PA01
cacaagccguuacgacaucgacg

SEQ ID NO: 1508567 - RNA, 12 nt, Pseudomonas aeruginosa PA01
cacaccaccagc

SEQ ID NO: 1508568 - RNA, 13 nt, Pseudomonas aeruginosa PA01
cacaccagcuccc

SEQ ID NO: 1508569 - RNA, 20 nt, Pseudomonas aeruginosa PA01
caagcccagcucguccaggc

SEQ ID NO: 1508570 - RNA, 15 nt, Pseudomonas aeruginosa PA01
caagcaggccgcggu

SEQ ID NO: 1508571 - RNA, 15 nt, Pseudomonas aeruginosa PA01
caacucgucguccag

SEQ ID NO: 1508572 - RNA, 20 nt, Pseudomonas aeruginosa PA01
caacucggcggcgagcgccg

SEQ ID NO: 1508573 - RNA, 15 nt, Pseudomonas aeruginosa PA01
caacuccgccaggcg

SEQ ID NO: 1508574 - RNA, 16 nt, Pseudomonas aeruginosa PA01
caacagcaggagaagc

SEQ ID NO: 1508575 - RNA, 15 nt, Pseudomonas aeruginosa PA01
caacucagucgaggu

SEQ ID NO: 1508576 - RNA, 20 nt, Pseudomonas aeruginosa PA01
caacuuccacucgccgacca

SEQ ID NO: 1508577 - RNA, 15 nt, Pseudomonas aeruginosa PA01
caacuggucgcggcu

SEQ ID NO: 1508578 - RNA, 20 nt, Pseudomonas aeruginosa PA01
caacuggucgcagccgcgca

SEQ ID NO: 1508579 - RNA, 15 nt, Pseudomonas aeruginosa PA01
caacuggucuugccg

SEQ ID NO: 1508580 - RNA, 21 nt, Pseudomonas aeruginosa PA01
caacugcuuaccuugccggug

SEQ ID NO: 1508581 - RNA, 22 nt, Pseudomonas aeruginosa PA01
caacugcuuaccuugccggugc

SEQ ID NO: 1508582 - RNA, 22 nt, Pseudomonas aeruginosa PA01
caacugcuucaggcgcgcggcc

SEQ ID NO: 1508583 - RNA, 20 nt, Pseudomonas aeruginosa PA01
caacugcuucaggucgugcu

SEQ ID NO: 1508584 - RNA, 20 nt, Pseudomonas aeruginosa PA01
caacuggauacgcuuggcca

SEQ ID NO: 1508585 - RNA, 20 nt, Pseudomonas aeruginosa PA01
caacuggacgaacgagaagc

SEQ ID NO: 1508586 - RNA, 21 nt, Pseudomonas aeruginosa PA01
caacuggcguccccaugcccg

SEQ ID NO: 1508587 - RNA, 11 nt, Pseudomonas aeruginosa PA01
caagcccggcg

SEQ ID NO: 1508588 - RNA, 15 nt, Pseudomonas aeruginosa PA01
caagccgagcggcaa

SEQ ID NO: 1508589 - RNA, 16 nt, Pseudomonas aeruginosa PA01
caagccgagcggcaag

SEQ ID NO: 1508590 - RNA, 20 nt, Pseudomonas aeruginosa PA01
caagccgagcggcaaggcca

SEQ ID NO: 1508591 - RNA, 20 nt, Pseudomonas aeruginosa PA01
caagcgcaugaggcuggcca

SEQ ID NO: 1508592 - RNA, 14 nt, Pseudomonas aeruginosa PA01
caaggugcgggccg

SEQ ID NO: 1508593 - RNA, 12 nt, Pseudomonas aeruginosa PA01
caaggugcugcc

SEQ ID NO: 1508594 - RNA, 17 nt, Pseudomonas aeruginosa PA01
caaggugggcagcagcg

SEQ ID NO: 1508595 - RNA, 23 nt, Pseudomonas aeruginosa PA01
caagucggccugcaccagccagu

SEQ ID NO: 1508596 - RNA, 13 nt, Pseudomonas aeruginosa PA01
caaggggccgcgc

SEQ ID NO: 1508597 - RNA, 14 nt, Pseudomonas aeruginosa PA01
caaggggccgcgcu

SEQ ID NO: 1508598 - RNA, 15 nt, Pseudomonas aeruginosa PA01
caagggcuccgcaag

SEQ ID NO: 1508599 - RNA, 14 nt, Pseudomonas aeruginosa PA01
caaguggcggcuga

SEQ ID NO: 1508600 - RNA, 16 nt, Pseudomonas aeruginosa PA01
augccuugcagcgcca

SEQ ID NO: 1508601 - RNA, 15 nt, Pseudomonas aeruginosa PA01
augccuucaccggcg

SEQ ID NO: 1508602 - RNA, 14 nt, Pseudomonas aeruginosa PA01
augccuuccgacgc

SEQ ID NO: 1508603 - RNA, 18 nt, Pseudomonas aeruginosa PA01
augccuuccgacgccgcg

SEQ ID NO: 1508604 - RNA, 14 nt, Pseudomonas aeruginosa PA01
augccuucggcggc

SEQ ID NO: 1508605 - RNA, 14 nt, Pseudomonas aeruginosa PA01
augccugugcaccg

SEQ ID NO: 1508606 - RNA, 16 nt, Pseudomonas aeruginosa PA01
augccgccgucgcggc

SEQ ID NO: 1508607 - RNA, 13 nt, Pseudomonas aeruginosa PA01
augccggccgggg

SEQ ID NO: 1508608 - RNA, 14 nt, Pseudomonas aeruginosa PA01
augccggccggggc

SEQ ID NO: 1508609 - RNA, 23 nt, Pseudomonas aeruginosa PA01
augccggccucgacgcagagcgc

SEQ ID NO: 1508610 - RNA, 22 nt, Pseudomonas aeruginosa PA01
augcgccccagcgccugggccg

SEQ ID NO: 1508611 - RNA, 23 nt, Pseudomonas aeruginosa PA01
augcgcccccacgacgcacucau

SEQ ID NO: 1508612 - RNA, 16 nt, Pseudomonas aeruginosa PA01
augcgcccguccucca

SEQ ID NO: 1508613 - RNA, 22 nt, Pseudomonas aeruginosa PA01
augcgcccuacgccaccugagc

SEQ ID NO: 1508614 - RNA, 15 nt, Pseudomonas aeruginosa PA01
augcgcccgccgcga

SEQ ID NO: 1508615 - RNA, 13 nt, Pseudomonas aeruginosa PA01
augcgcagcgcgu

SEQ ID NO: 1508616 - RNA, 12 nt, Pseudomonas aeruginosa PA01
augcgccagcgg

SEQ ID NO: 1508617 - RNA, 14 nt, Pseudomonas aeruginosa PA01
augcgcaugcgcag

SEQ ID NO: 1508618 - RNA, 17 nt, Pseudomonas aeruginosa PA01
augcgaaaacggcgacc

SEQ ID NO: 1508619 - RNA, 18 nt, Pseudomonas aeruginosa PA01
augcgcagcuugcucgau

SEQ ID NO: 1508620 - RNA, 15 nt, Pseudomonas aeruginosa PA01
augcggcccgccggc

SEQ ID NO: 1508621 - RNA, 17 nt, Pseudomonas aeruginosa PA01
augcggcccgccggcga

SEQ ID NO: 1508622 - RNA, 14 nt, Pseudomonas aeruginosa PA01
augcggccccggcg

SEQ ID NO: 1508623 - RNA, 15 nt, Pseudomonas aeruginosa PA01
augcgcgucgccgaa

SEQ ID NO: 1508624 - RNA, 14 nt, Pseudomonas aeruginosa PA01
augcgcggucacca

SEQ ID NO: 1508625 - RNA, 23 nt, Pseudomonas aeruginosa PA01
augcgcggcaggaaauccgccgc

SEQ ID NO: 1508626 - RNA, 23 nt, Pseudomonas aeruginosa PA01
augcgcgcggcgagggcgccggg

SEQ ID NO: 1508627 - RNA, 23 nt, Pseudomonas aeruginosa PA01
augcgccgacgccaccagccagg

SEQ ID NO: 1508628 - RNA, 18 nt, Pseudomonas aeruginosa PA01
augcgccgggccucggca

SEQ ID NO: 1508629 - RNA, 22 nt, Pseudomonas aeruginosa PA01
augcgccgccacgugcacgccg

SEQ ID NO: 1508630 - RNA, 22 nt, Pseudomonas aeruginosa PA01
augcgccggaucggcugaccgg

SEQ ID NO: 1508631 - RNA, 16 nt, Pseudomonas aeruginosa PA01
augcgcgaggucugug

SEQ ID NO: 1508632 - RNA, 20 nt, Pseudomonas aeruginosa PA01
augcgcgaauaccgcgcgcg

SEQ ID NO: 1508633 - RNA, 21 nt, Pseudomonas aeruginosa PA01
augcgcgaauaccgcgcgcgc

SEQ ID NO: 1508634 - RNA, 23 nt, Pseudomonas aeruginosa PA01
augcggcggaacuugucgccgcu

SEQ ID NO: 1508635 - RNA, 20 nt, Pseudomonas aeruginosa PA01
augcggccugcaacgccgcc

SEQ ID NO: 1508636 - RNA, 15 nt, Pseudomonas aeruginosa PA01
augcggcuacucgcc

SEQ ID NO: 1508637 - RNA, 14 nt, Pseudomonas aeruginosa PA01
augcgggcgcgagg

SEQ ID NO: 1508638 - RNA, 14 nt, Pseudomonas aeruginosa PA01
augcuccgcgccuc

SEQ ID NO: 1508639 - RNA, 16 nt, Pseudomonas aeruginosa PA01
augcuccggggucagu

SEQ ID NO: 1508640 - RNA, 13 nt, Pseudomonas aeruginosa PA01
augcucagcgccg

SEQ ID NO: 1508641 - RNA, 16 nt, Pseudomonas aeruginosa PA01
augcucagcgccggcc

SEQ ID NO: 1508642 - RNA, 13 nt, Pseudomonas aeruginosa PA01
augcucaggcgcu

SEQ ID NO: 1508643 - RNA, 14 nt, Pseudomonas aeruginosa PA01
augcucaggcgcug

SEQ ID NO: 1508644 - RNA, 16 nt, Pseudomonas aeruginosa PA01
augcucagcacggcga

SEQ ID NO: 1508645 - RNA, 17 nt, Pseudomonas aeruginosa PA01
augcucauccugcccgu

SEQ ID NO: 1508646 - RNA, 21 nt, Pseudomonas aeruginosa PA01
augccgccgccgccccagcaa

SEQ ID NO: 1508647 - RNA, 12 nt, Pseudomonas aeruginosa PA01
augccgccggca

SEQ ID NO: 1508648 - RNA, 11 nt, Pseudomonas aeruginosa PA01
augccgccgac

SEQ ID NO: 1508649 - RNA, 16 nt, Pseudomonas aeruginosa PA01
augccgccgacgccgg

SEQ ID NO: 1508650 - RNA, 19 nt, Pseudomonas aeruginosa PA01
augccgccgacgccggacg

SEQ ID NO: 1508651 - RNA, 19 nt, Pseudomonas aeruginosa PA01
augccgcccuccaucagcg

SEQ ID NO: 1508652 - RNA, 14 nt, Pseudomonas aeruginosa PA01
augccgcccagcac

SEQ ID NO: 1508653 - RNA, 23 nt, Pseudomonas aeruginosa PA01
augccgaaggcgugggcgccggc

SEQ ID NO: 1508654 - RNA, 17 nt, Pseudomonas aeruginosa PA01
augcccggccuggcguc

SEQ ID NO: 1508655 - RNA, 16 nt, Pseudomonas aeruginosa PA01
augcccuccugggccu

SEQ ID NO: 1508656 - RNA, 20 nt, Pseudomonas aeruginosa PA01
augcccuccugggccugucg

SEQ ID NO: 1508657 - RNA, 21 nt, Pseudomonas aeruginosa PA01
augccgaacaccugcaucacc

SEQ ID NO: 1508658 - RNA, 21 nt, Pseudomonas aeruginosa PA01
augcccuuggccagcgcggcg

SEQ ID NO: 1508659 - RNA, 18 nt, Pseudomonas aeruginosa PA01
augcccuugaggucguug

SEQ ID NO: 1508660 - RNA, 12 nt, Pseudomonas aeruginosa PA01
augcccuggccg

SEQ ID NO: 1508661 - RNA, 21 nt, Pseudomonas aeruginosa PA01
augcccuggccgcugccgcuc

SEQ ID NO: 1508662 - RNA, 13 nt, Pseudomonas aeruginosa PA01
augccccgccgac

SEQ ID NO: 1508663 - RNA, 14 nt, Pseudomonas aeruginosa PA01
augccccgccgacu

SEQ ID NO: 1508664 - RNA, 13 nt, Pseudomonas aeruginosa PA01
augcccgccccgc

SEQ ID NO: 1508665 - RNA, 20 nt, Pseudomonas aeruginosa PA01
augcccgccccgcaccagcc

SEQ ID NO: 1508666 - RNA, 13 nt, Pseudomonas aeruginosa PA01
augcccgccagca

SEQ ID NO: 1508667 - RNA, 19 nt, Pseudomonas aeruginosa PA01
augcccgccagcaggcgcc

SEQ ID NO: 1508668 - RNA, 21 nt, Pseudomonas aeruginosa PA01
augcccgucaggccuugcgcg

SEQ ID NO: 1508669 - RNA, 19 nt, Pseudomonas aeruginosa PA01
augcccgucgaccaucacc

SEQ ID NO: 1508670 - RNA, 22 nt, Pseudomonas aeruginosa PA01
augcccgucgaccaucaccagc

SEQ ID NO: 1508671 - RNA, 16 nt, Pseudomonas aeruginosa PA01
augcccgugcgcugcg

SEQ ID NO: 1508672 - RNA, 20 nt, Pseudomonas aeruginosa PA01
augcaguugagucgcgcgcg

SEQ ID NO: 1508673 - RNA, 18 nt, Pseudomonas aeruginosa PA01
augccacgugcggggugc

SEQ ID NO: 1508674 - RNA, 19 nt, Pseudomonas aeruginosa PA01
augccacucgucccagaag

SEQ ID NO: 1508675 - RNA, 18 nt, Pseudomonas aeruginosa PA01
augccagcgccacgccgc

SEQ ID NO: 1508676 - RNA, 14 nt, Pseudomonas aeruginosa PA01
augccagggccuug

SEQ ID NO: 1508677 - RNA, 17 nt, Pseudomonas aeruginosa PA01
augcccaauacccacag

SEQ ID NO: 1508678 - RNA, 12 nt, Pseudomonas aeruginosa PA01
augcccagcgca

SEQ ID NO: 1508679 - RNA, 18 nt, Pseudomonas aeruginosa PA01
augcccagggccagcagc

SEQ ID NO: 1508680 - RNA, 16 nt, Pseudomonas aeruginosa PA01
augcccagccagggcc

SEQ ID NO: 1508681 - RNA, 13 nt, Pseudomonas aeruginosa PA01
augcccaggccgc

SEQ ID NO: 1508682 - RNA, 15 nt, Pseudomonas aeruginosa PA01
augcccaggccgccg

SEQ ID NO: 1508683 - RNA, 12 nt, Pseudomonas aeruginosa PA01
auggggcggccg

SEQ ID NO: 1508684 - RNA, 13 nt, Pseudomonas aeruginosa PA01
auggggaucaccg

SEQ ID NO: 1508685 - RNA, 16 nt, Pseudomonas aeruginosa PA01
augggcgcgcgccggg

SEQ ID NO: 1508686 - RNA, 14 nt, Pseudomonas aeruginosa PA01
augguaucgccguc

SEQ ID NO: 1508687 - RNA, 22 nt, Pseudomonas aeruginosa PA01
augguaggcucccccgcgccgc

SEQ ID NO: 1508688 - RNA, 16 nt, Pseudomonas aeruginosa PA01
auggguucccagcagc

SEQ ID NO: 1508689 - RNA, 14 nt, Pseudomonas aeruginosa PA01
auggcguccaccgc

SEQ ID NO: 1508690 - RNA, 17 nt, Pseudomonas aeruginosa PA01
auggcguccaccgcuuc

SEQ ID NO: 1508691 - RNA, 23 nt, Pseudomonas aeruginosa PA01
auggcguccaccgcuucgcggau

SEQ ID NO: 1508692 - RNA, 16 nt, Pseudomonas aeruginosa PA01
augggcgaugcgccgg

SEQ ID NO: 1508693 - RNA, 13 nt, Pseudomonas aeruginosa PA01
auggcggucagau

SEQ ID NO: 1508694 - RNA, 22 nt, Pseudomonas aeruginosa PA01
auggcggugaccguuucgccgc

SEQ ID NO: 1508695 - RNA, 13 nt, Pseudomonas aeruginosa PA01
auggcggucgccg

SEQ ID NO: 1508696 - RNA, 16 nt, Pseudomonas aeruginosa PA01
auggcggucgccgacc

SEQ ID NO: 1508697 - RNA, 15 nt, Pseudomonas aeruginosa PA01
auggcgcgcgggccu

SEQ ID NO: 1508698 - RNA, 18 nt, Pseudomonas aeruginosa PA01
auggcgcggugggccuug

SEQ ID NO: 1508699 - RNA, 23 nt, Pseudomonas aeruginosa PA01
auggcggcggcguauucgccgaa

SEQ ID NO: 1508700 - RNA, 22 nt, Pseudomonas aeruginosa PA01
auggcgguaguguugaagccgc

SEQ ID NO: 1508701 - RNA, 15 nt, Pseudomonas aeruginosa PA01
auggucaccaugauc

SEQ ID NO: 1508702 - RNA, 19 nt, Pseudomonas aeruginosa PA01
auggucaacaccagcgccg

SEQ ID NO: 1508703 - RNA, 22 nt, Pseudomonas aeruginosa PA01
auggucaacaccagcgccgcca

SEQ ID NO: 1508704 - RNA, 20 nt, Pseudomonas aeruginosa PA01
augcuggagcuugccggcga

SEQ ID NO: 1508705 - RNA, 20 nt, Pseudomonas aeruginosa PA01
augcugcgggcgccgccgcu

SEQ ID NO: 1508706 - RNA, 22 nt, Pseudomonas aeruginosa PA01
augcucggccagcucgccgaac

SEQ ID NO: 1508707 - RNA, 20 nt, Pseudomonas aeruginosa PA01
augcucggccagguauucgc

SEQ ID NO: 1508708 - RNA, 22 nt, Pseudomonas aeruginosa PA01
augcucgguugccaggccggcg

SEQ ID NO: 1508709 - RNA, 23 nt, Pseudomonas aeruginosa PA01
auggaccgagaccgacgcucgcg

SEQ ID NO: 1508710 - RNA, 17 nt, Pseudomonas aeruginosa PA01
auggagcaacagcgucg

SEQ ID NO: 1508711 - RNA, 14 nt, Pseudomonas aeruginosa PA01
auggagacggcccg

SEQ ID NO: 1508712 - RNA, 15 nt, Pseudomonas aeruginosa PA01
auggauguugccgcc

SEQ ID NO: 1508713 - RNA, 21 nt, Pseudomonas aeruginosa PA01
auggaucuggguuucgucgcg

SEQ ID NO: 1508714 - RNA, 14 nt, Pseudomonas aeruginosa PA01
auggaucggccucg

SEQ ID NO: 1508715 - RNA, 16 nt, Pseudomonas aeruginosa PA01
auggaucggccucgcg

SEQ ID NO: 1508716 - RNA, 23 nt, Pseudomonas aeruginosa PA01
auggaucucccguaccagcgcga

SEQ ID NO: 1508717 - RNA, 16 nt, Pseudomonas aeruginosa PA01
auggcgccgccgaggu

SEQ ID NO: 1508718 - RNA, 19 nt, Pseudomonas aeruginosa PA01
auggcgccggccagagcuu

SEQ ID NO: 1508719 - RNA, 21 nt, Pseudomonas aeruginosa PA01
auggcgccacucggcgugccg

SEQ ID NO: 1508720 - RNA, 20 nt, Pseudomonas aeruginosa PA01
auggcgccauugugcgcgcg

SEQ ID NO: 1508721 - RNA, 15 nt, Pseudomonas aeruginosa PA01
auggcgcacgccgcg

SEQ ID NO: 1508722 - RNA, 15 nt, Pseudomonas aeruginosa PA01
auggcgaucuccggg

SEQ ID NO: 1508723 - RNA, 23 nt, Pseudomonas aeruginosa PA01
auggcgaucgagcuguccaucuc

SEQ ID NO: 1508724 - RNA, 14 nt, Pseudomonas aeruginosa PA01
auggccgccgccgc

SEQ ID NO: 1508725 - RNA, 14 nt, Pseudomonas aeruginosa PA01
auggccggcaccag

SEQ ID NO: 1508726 - RNA, 13 nt, Pseudomonas aeruginosa PA01
auggccggcagca

SEQ ID NO: 1508727 - RNA, 16 nt, Pseudomonas aeruginosa PA01
auggccggcagcagcg

SEQ ID NO: 1508728 - RNA, 20 nt, Pseudomonas aeruginosa PA01
auggccggcagcagcgccag

SEQ ID NO: 1508729 - RNA, 13 nt, Pseudomonas aeruginosa PA01
auggccgccagca

SEQ ID NO: 1508730 - RNA, 21 nt, Pseudomonas aeruginosa PA01
auggcgaggaugaucagggca

SEQ ID NO: 1508731 - RNA, 22 nt, Pseudomonas aeruginosa PA01
auggcccguuccaccgccugga

SEQ ID NO: 1508732 - RNA, 16 nt, Pseudomonas aeruginosa PA01
auggccgcagcggcug

SEQ ID NO: 1508733 - RNA, 23 nt, Pseudomonas aeruginosa PA01
auggccgcagcggcuguugccgg

SEQ ID NO: 1508734 - RNA, 21 nt, Pseudomonas aeruginosa PA01
auggccgagcccagcggcagg

SEQ ID NO: 1508735 - RNA, 22 nt, Pseudomonas aeruginosa PA01
auggcaccgucaagggccagga

SEQ ID NO: 1508736 - RNA, 12 nt, Pseudomonas aeruginosa PA01
auggcaccugga

SEQ ID NO: 1508737 - RNA, 16 nt, Pseudomonas aeruginosa PA01
auggcagaacaucgcc

SEQ ID NO: 1508738 - RNA, 21 nt, Pseudomonas aeruginosa PA01
auggcacaguuccuguaccag

SEQ ID NO: 1508739 - RNA, 22 nt, Pseudomonas aeruginosa PA01
auggcagccuuggccacggcau

SEQ ID NO: 1508740 - RNA, 15 nt, Pseudomonas aeruginosa PA01
auggcagcaggcaca

SEQ ID NO: 1508741 - RNA, 20 nt, Pseudomonas aeruginosa PA01
aucuggaauucgccgcgcgc

SEQ ID NO: 1508742 - RNA, 14 nt, Pseudomonas aeruginosa PA01
aucugccgggcgcg

SEQ ID NO: 1508743 - RNA, 18 nt, Pseudomonas aeruginosa PA01
aucugccgggcgcgcugg

SEQ ID NO: 1508744 - RNA, 19 nt, Pseudomonas aeruginosa PA01
aucugccgggcgcgcuggu

SEQ ID NO: 1508745 - RNA, 13 nt, Pseudomonas aeruginosa PA01
aucugcgccaggu

SEQ ID NO: 1508746 - RNA, 15 nt, Pseudomonas aeruginosa PA01
aucugcaugccgucc

SEQ ID NO: 1508747 - RNA, 21 nt, Pseudomonas aeruginosa PA01
aucugcccggccaugccgccg

SEQ ID NO: 1508748 - RNA, 14 nt, Pseudomonas aeruginosa PA01
aucugcagguuggc

SEQ ID NO: 1508749 - RNA, 21 nt, Pseudomonas aeruginosa PA01
aucugcaccacguucggcgcg

SEQ ID NO: 1508750 - RNA, 18 nt, Pseudomonas aeruginosa PA01
aucucuuccucgcugccu

SEQ ID NO: 1508751 - RNA, 22 nt, Pseudomonas aeruginosa PA01
aucucgucggcggggcgcaccg

SEQ ID NO: 1508752 - RNA, 19 nt, Pseudomonas aeruginosa PA01
aucucgugguugaggcgcu

SEQ ID NO: 1508753 - RNA, 16 nt, Pseudomonas aeruginosa PA01
aucucgugggccagca

SEQ ID NO: 1508754 - RNA, 21 nt, Pseudomonas aeruginosa PA01
aucucaggaccuuccgccagc

SEQ ID NO: 1508755 - RNA, 14 nt, Pseudomonas aeruginosa PA01
aucguggccauggg

SEQ ID NO: 1508756 - RNA, 18 nt, Pseudomonas aeruginosa PA01
aucucggcggccaggcgg

SEQ ID NO: 1508757 - RNA, 19 nt, Pseudomonas aeruginosa PA01
aucucggcggccaggcggc

SEQ ID NO: 1508758 - RNA, 16 nt, Pseudomonas aeruginosa PA01
aucucguccucggcgu

SEQ ID NO: 1508759 - RNA, 15 nt, Pseudomonas aeruginosa PA01
aucucggucgcaagc

SEQ ID NO: 1508760 - RNA, 16 nt, Pseudomonas aeruginosa PA01
aucucgguaucgcuuc

SEQ ID NO: 1508761 - RNA, 13 nt, Pseudomonas aeruginosa PA01
aucuccgcgccac

SEQ ID NO: 1508762 - RNA, 15 nt, Pseudomonas aeruginosa PA01
aucuccgcgccacgc

SEQ ID NO: 1508763 - RNA, 14 nt, Pseudomonas aeruginosa PA01
aucuccgcgccggg

SEQ ID NO: 1508764 - RNA, 15 nt, Pseudomonas aeruginosa PA01
aucucgcggcgcggc

SEQ ID NO: 1508765 - RNA, 16 nt, Pseudomonas aeruginosa PA01
aucuccgccaggcggc

SEQ ID NO: 1508766 - RNA, 15 nt, Pseudomonas aeruginosa PA01
aucgguugccgcgcc

SEQ ID NO: 1508767 - RNA, 13 nt, Pseudomonas aeruginosa PA01
aucgguugcgaca

SEQ ID NO: 1508768 - RNA, 15 nt, Pseudomonas aeruginosa PA01
aucgucgcggcgcga

SEQ ID NO: 1508769 - RNA, 20 nt, Pseudomonas aeruginosa PA01
aucgucggcagccaucgcau

SEQ ID NO: 1508770 - RNA, 14 nt, Pseudomonas aeruginosa PA01
aucgucgcuuccgg

SEQ ID NO: 1508771 - RNA, 20 nt, Pseudomonas aeruginosa PA01
aucgucgcuuccggcgccaa

SEQ ID NO: 1508772 - RNA, 12 nt, Pseudomonas aeruginosa PA01
aucgucggcccg

SEQ ID NO: 1508773 - RNA, 12 nt, Pseudomonas aeruginosa PA01
aucgucgccgga

SEQ ID NO: 1508774 - RNA, 22 nt, Pseudomonas aeruginosa PA01
aucgucgccggaggggcggccg

SEQ ID NO: 1508775 - RNA, 13 nt, Pseudomonas aeruginosa PA01
aucgucgccaagc

SEQ ID NO: 1508776 - RNA, 19 nt, Pseudomonas aeruginosa PA01
aucgucgccaagcccggcg

SEQ ID NO: 1508777 - RNA, 14 nt, Pseudomonas aeruginosa PA01
aucgucgaugaggu

SEQ ID NO: 1508778 - RNA, 17 nt, Pseudomonas aeruginosa PA01
aucgucgaugaggucgc

SEQ ID NO: 1508779 - RNA, 15 nt, Pseudomonas aeruginosa PA01
aucgaaggcgccggc

SEQ ID NO: 1508780 - RNA, 16 nt, Pseudomonas aeruginosa PA01
aucgaaggcgccggca

SEQ ID NO: 1508781 - RNA, 21 nt, Pseudomonas aeruginosa PA01
aucgaaggguuggccgcagca

SEQ ID NO: 1508782 - RNA, 19 nt, Pseudomonas aeruginosa PA01
aucgaagaaggcucaccgg

SEQ ID NO: 1508783 - RNA, 18 nt, Pseudomonas aeruginosa PA01
aucgaacuggccagcacc

SEQ ID NO: 1508784 - RNA, 17 nt, Pseudomonas aeruginosa PA01
aucgaacaucucgaagc

SEQ ID NO: 1508785 - RNA, 15 nt, Pseudomonas aeruginosa PA01
aucgaagucgccauc

SEQ ID NO: 1508786 - RNA, 12 nt, Pseudomonas aeruginosa PA01
aucggucgcccu

SEQ ID NO: 1508787 - RNA, 16 nt, Pseudomonas aeruginosa PA01
aucgacagcagcgcca

SEQ ID NO: 1508788 - RNA, 17 nt, Pseudomonas aeruginosa PA01
aucgacagcagcgccag

SEQ ID NO: 1508789 - RNA, 19 nt, Pseudomonas aeruginosa PA01
aucgacagcagcgccaggg

SEQ ID NO: 1508790 - RNA, 23 nt, Pseudomonas aeruginosa PA01
aucgacaccccggucaggccgau

SEQ ID NO: 1508791 - RNA, 15 nt, Pseudomonas aeruginosa PA01
augagcuucgccggg

SEQ ID NO: 1508792 - RNA, 18 nt, Pseudomonas aeruginosa PA01
augauuucguuggcccag

SEQ ID NO: 1508793 - RNA, 21 nt, Pseudomonas aeruginosa PA01
augaugugcgcaggcuggccg

SEQ ID NO: 1508794 - RNA, 22 nt, Pseudomonas aeruginosa PA01
augaugugcgcaggcuggccga

SEQ ID NO: 1508795 - RNA, 16 nt, Pseudomonas aeruginosa PA01
augaggcuggccagca

SEQ ID NO: 1508796 - RNA, 19 nt, Pseudomonas aeruginosa PA01
augaggcuguccagcaggc

SEQ ID NO: 1508797 - RNA, 20 nt, Pseudomonas aeruginosa PA01
augaggaugcugaucagcac

SEQ ID NO: 1508798 - RNA, 14 nt, Pseudomonas aeruginosa PA01
augcaccaggccgc

SEQ ID NO: 1508799 - RNA, 23 nt, Pseudomonas aeruginosa PA01
augcaccuaccaguaguucucca

SEQ ID NO: 1508800 - RNA, 21 nt, Pseudomonas aeruginosa PA01
augcaccggccacucgcagcc

SEQ ID NO: 1508801 - RNA, 12 nt, Pseudomonas aeruginosa PA01
augcacgcccug

SEQ ID NO: 1508802 - RNA, 20 nt, Pseudomonas aeruginosa PA01
augcacgugcagcucggcac

SEQ ID NO: 1508803 - RNA, 16 nt, Pseudomonas aeruginosa PA01
augcagucccgccagg

SEQ ID NO: 1508804 - RNA, 17 nt, Pseudomonas aeruginosa PA01
augcagucccgccaggc

SEQ ID NO: 1508805 - RNA, 18 nt, Pseudomonas aeruginosa PA01
augcagucccgccaggcg

SEQ ID NO: 1508806 - RNA, 13 nt, Pseudomonas aeruginosa PA01
augcagucggcac

SEQ ID NO: 1508807 - RNA, 22 nt, Pseudomonas aeruginosa PA01
augcaggucgugcagcccgguc

SEQ ID NO: 1508808 - RNA, 18 nt, Pseudomonas aeruginosa PA01
augcagguggcgcucacg

SEQ ID NO: 1508809 - RNA, 13 nt, Pseudomonas aeruginosa PA01
augcagcgucgcg

SEQ ID NO: 1508810 - RNA, 19 nt, Pseudomonas aeruginosa PA01
augcagcggcauggucagc

SEQ ID NO: 1508811 - RNA, 17 nt, Pseudomonas aeruginosa PA01
augcaggccagggcggu

SEQ ID NO: 1508812 - RNA, 19 nt, Pseudomonas aeruginosa PA01
augcaggccagggcgguga

SEQ ID NO: 1508813 - RNA, 19 nt, Pseudomonas aeruginosa PA01
augcaggccgaagcguggg

SEQ ID NO: 1508814 - RNA, 14 nt, Pseudomonas aeruginosa PA01
augcaggccggccu

SEQ ID NO: 1508815 - RNA, 15 nt, Pseudomonas aeruginosa PA01
augcaggccgguggu

SEQ ID NO: 1508816 - RNA, 22 nt, Pseudomonas aeruginosa PA01
augcaggcgucgguccagcucc

SEQ ID NO: 1508817 - RNA, 14 nt, Pseudomonas aeruginosa PA01
augcaggcugccgg

SEQ ID NO: 1508818 - RNA, 19 nt, Pseudomonas aeruginosa PA01
augaaaaagccccgccgaa

SEQ ID NO: 1508819 - RNA, 14 nt, Pseudomonas aeruginosa PA01
augaaaaagccgga

SEQ ID NO: 1508820 - RNA, 21 nt, Pseudomonas aeruginosa PA01
augaaaaaggccggucgcaac

SEQ ID NO: 1508821 - RNA, 16 nt, Pseudomonas aeruginosa PA01
augaaaaacgccggcg

SEQ ID NO: 1508822 - RNA, 15 nt, Pseudomonas aeruginosa PA01
aucuggccgaugccg

SEQ ID NO: 1508823 - RNA, 14 nt, Pseudomonas aeruginosa PA01
aucuggcugcgcgc

SEQ ID NO: 1508824 - RNA, 17 nt, Pseudomonas aeruginosa PA01
aucuggcugucgccgau

SEQ ID NO: 1508825 - RNA, 16 nt, Pseudomonas aeruginosa PA01
aucugggccaucguca

SEQ ID NO: 1508826 - RNA, 17 nt, Pseudomonas aeruginosa PA01
aucugguagaccaccgu

SEQ ID NO: 1508827 - RNA, 21 nt, Pseudomonas aeruginosa PA01
aucuggguccuggugaucauc

SEQ ID NO: 1508828 - RNA, 17 nt, Pseudomonas aeruginosa PA01
aucuugaucgccagcgg

SEQ ID NO: 1508829 - RNA, 22 nt, Pseudomonas aeruginosa PA01
augaagcuuuuccagcgcaccg

SEQ ID NO: 1508830 - RNA, 21 nt, Pseudomonas aeruginosa PA01
augaagcccgcggcaucggcc

SEQ ID NO: 1508831 - RNA, 20 nt, Pseudomonas aeruginosa PA01
augaagcacaccuccagcgg

SEQ ID NO: 1508832 - RNA, 19 nt, Pseudomonas aeruginosa PA01
augaacgcccugacccgca

SEQ ID NO: 1508833 - RNA, 22 nt, Pseudomonas aeruginosa PA01
augaacgcccugacccgcaccg

SEQ ID NO: 1508834 - RNA, 13 nt, Pseudomonas aeruginosa PA01
augaacgccgcga

SEQ ID NO: 1508835 - RNA, 17 nt, Pseudomonas aeruginosa PA01
augaccaggguggcggc

SEQ ID NO: 1508836 - RNA, 19 nt, Pseudomonas aeruginosa PA01
augaccaggguggcggcgg

SEQ ID NO: 1508837 - RNA, 23 nt, Pseudomonas aeruginosa PA01
augaccaggcugaucagcccgcu

SEQ ID NO: 1508838 - RNA, 17 nt, Pseudomonas aeruginosa PA01
augacgauaucggcgcc

SEQ ID NO: 1508839 - RNA, 21 nt, Pseudomonas aeruginosa PA01
caaaccauggcguagggcgaa

SEQ ID NO: 1508840 - RNA, 21 nt, Pseudomonas aeruginosa PA01
caaacucaggguggucgauga

SEQ ID NO: 1508841 - RNA, 23 nt, Pseudomonas aeruginosa PA01
caaacgggacagguugucgacca

SEQ ID NO: 1508842 - RNA, 13 nt, Pseudomonas aeruginosa PA01
caaagggcagcgg

SEQ ID NO: 1508843 - RNA, 14 nt, Pseudomonas aeruginosa PA01
caaaggcgcgcagg

SEQ ID NO: 1508844 - RNA, 14 nt, Pseudomonas aeruginosa PA01
caaaggcgucgauc

SEQ ID NO: 1508845 - RNA, 15 nt, Pseudomonas aeruginosa PA01
caaaggcccggcgcg

SEQ ID NO: 1508846 - RNA, 22 nt, Pseudomonas aeruginosa PA01
caaaggcccggcgcgguuucgc

SEQ ID NO: 1508847 - RNA, 17 nt, Pseudomonas aeruginosa PA01
caaaggaaucuucggcg

SEQ ID NO: 1508848 - RNA, 17 nt, Pseudomonas aeruginosa PA01
caacaccaucggcccca

SEQ ID NO: 1508849 - RNA, 22 nt, Pseudomonas aeruginosa PA01
caacaccaucggccccaccgca

SEQ ID NO: 1508850 - RNA, 13 nt, Pseudomonas aeruginosa PA01
caacaccagcgcc

SEQ ID NO: 1508851 - RNA, 14 nt, Pseudomonas aeruginosa PA01
caacaccagcgccg

SEQ ID NO: 1508852 - RNA, 18 nt, Pseudomonas aeruginosa PA01
caacaccagcgccgccag

SEQ ID NO: 1508853 - RNA, 13 nt, Pseudomonas aeruginosa PA01
auuugccgccgag

SEQ ID NO: 1508854 - RNA, 15 nt, Pseudomonas aeruginosa PA01
auuuucuccggcgcc

SEQ ID NO: 1508855 - RNA, 22 nt, Pseudomonas aeruginosa PA01
auuuuccagcaggcaggcgcgg

SEQ ID NO: 1508856 - RNA, 18 nt, Pseudomonas aeruginosa PA01
auuggcacccuggacccg

SEQ ID NO: 1508857 - RNA, 15 nt, Pseudomonas aeruginosa PA01
auuggccgacgccgc

SEQ ID NO: 1508858 - RNA, 16 nt, Pseudomonas aeruginosa PA01
auuggccaggcucgcg

SEQ ID NO: 1508859 - RNA, 17 nt, Pseudomonas aeruginosa PA01
auuggccaucagcgccg

SEQ ID NO: 1508860 - RNA, 18 nt, Pseudomonas aeruginosa PA01
auuggccaucagcgccgc

SEQ ID NO: 1508861 - RNA, 13 nt, Pseudomonas aeruginosa PA01
auugcgccgccgg

SEQ ID NO: 1508862 - RNA, 18 nt, Pseudomonas aeruginosa PA01
auugcgcguggcgucggc

SEQ ID NO: 1508863 - RNA, 13 nt, Pseudomonas aeruginosa PA01
auugucggccucg

SEQ ID NO: 1508864 - RNA, 19 nt, Pseudomonas aeruginosa PA01
auuggcggaugagccgcug

SEQ ID NO: 1508865 - RNA, 19 nt, Pseudomonas aeruginosa PA01
auucuccugggcggucucg

SEQ ID NO: 1508866 - RNA, 18 nt, Pseudomonas aeruginosa PA01
auucgcgcagcaggcggc

SEQ ID NO: 1508867 - RNA, 17 nt, Pseudomonas aeruginosa PA01
auucguccagccgccgc

SEQ ID NO: 1508868 - RNA, 18 nt, Pseudomonas aeruginosa PA01
auucguccagccgccgcu

SEQ ID NO: 1508869 - RNA, 13 nt, Pseudomonas aeruginosa PA01
auucgucgccgcu

SEQ ID NO: 1508870 - RNA, 21 nt, Pseudomonas aeruginosa PA01
auucgcccuaccguccgcagc

SEQ ID NO: 1508871 - RNA, 15 nt, Pseudomonas aeruginosa PA01
auucgccgcgacgcu

SEQ ID NO: 1508872 - RNA, 22 nt, Pseudomonas aeruginosa PA01
auucgccgcgcgccaucaguuc

SEQ ID NO: 1508873 - RNA, 20 nt, Pseudomonas aeruginosa PA01
auucgccccagcggucgauc

SEQ ID NO: 1508874 - RNA, 18 nt, Pseudomonas aeruginosa PA01
auucgcggacgccgaagc

SEQ ID NO: 1508875 - RNA, 19 nt, Pseudomonas aeruginosa PA01
auugccagaggcugcgcuc

SEQ ID NO: 1508876 - RNA, 13 nt, Pseudomonas aeruginosa PA01
auuuccuggcgcg

SEQ ID NO: 1508877 - RNA, 16 nt, Pseudomonas aeruginosa PA01
auuuccucgucgccgu

SEQ ID NO: 1508878 - RNA, 20 nt, Pseudomonas aeruginosa PA01
auuccgcccauugcccggcc

SEQ ID NO: 1508879 - RNA, 13 nt, Pseudomonas aeruginosa PA01
auuccgccgcggc

SEQ ID NO: 1508880 - RNA, 14 nt, Pseudomonas aeruginosa PA01
auuccgccgcggca

SEQ ID NO: 1508881 - RNA, 18 nt, Pseudomonas aeruginosa PA01
auucgacccgccgaccag

SEQ ID NO: 1508882 - RNA, 17 nt, Pseudomonas aeruginosa PA01
auucgacgcagcgcgcg

SEQ ID NO: 1508883 - RNA, 21 nt, Pseudomonas aeruginosa PA01
auucgacgccgaaacgccgac

SEQ ID NO: 1508884 - RNA, 14 nt, Pseudomonas aeruginosa PA01
auuccggcagcgac

SEQ ID NO: 1508885 - RNA, 22 nt, Pseudomonas aeruginosa PA01
auucgcagagaucggcggcgcg

SEQ ID NO: 1508886 - RNA, 19 nt, Pseudomonas aeruginosa PA01
auucgaugccgcgcgccug

SEQ ID NO: 1508887 - RNA, 19 nt, Pseudomonas aeruginosa PA01
auuccgacaaggagcgcga

SEQ ID NO: 1508888 - RNA, 22 nt, Pseudomonas aeruginosa PA01
aaacucaucaggcugccgagca

SEQ ID NO: 1508889 - RNA, 23 nt, Pseudomonas aeruginosa PA01
aaacucaucaggcugccgagcag

SEQ ID NO: 1508890 - RNA, 13 nt, Pseudomonas aeruginosa PA01
auucagcgcgccc

SEQ ID NO: 1508891 - RNA, 18 nt, Pseudomonas aeruginosa PA01
auucagcgcgccccggcg

SEQ ID NO: 1508892 - RNA, 17 nt, Pseudomonas aeruginosa PA01
auuccagcaggucggca

SEQ ID NO: 1508893 - RNA, 21 nt, Pseudomonas aeruginosa PA01
auuccaccggcuggccgcgac

SEQ ID NO: 1508894 - RNA, 17 nt, Pseudomonas aeruginosa PA01
auucccgccgcuccggc

SEQ ID NO: 1508895 - RNA, 17 nt, Pseudomonas aeruginosa PA01
auuccaugggcagacga

SEQ ID NO: 1508896 - RNA, 17 nt, Pseudomonas aeruginosa PA01
augucgcacuggucggc

SEQ ID NO: 1508897 - RNA, 15 nt, Pseudomonas aeruginosa PA01
augucgccggggaag

SEQ ID NO: 1508898 - RNA, 20 nt, Pseudomonas aeruginosa PA01
augucgcggcaggcggcggc

SEQ ID NO: 1508899 - RNA, 11 nt, Pseudomonas aeruginosa PA01
augucgcuggc

SEQ ID NO: 1508900 - RNA, 13 nt, Pseudomonas aeruginosa PA01
augucgcuggccu

SEQ ID NO: 1508901 - RNA, 16 nt, Pseudomonas aeruginosa PA01
augucgcuggccugca

SEQ ID NO: 1508902 - RNA, 23 nt, Pseudomonas aeruginosa PA01
augucgcggguuacuucgccgau

SEQ ID NO: 1508903 - RNA, 13 nt, Pseudomonas aeruginosa PA01
aggggucaggccg

SEQ ID NO: 1508904 - RNA, 12 nt, Pseudomonas aeruginosa PA01
aggggucgacgc

SEQ ID NO: 1508905 - RNA, 14 nt, Pseudomonas aeruginosa PA01
aggggucguugccg

SEQ ID NO: 1508906 - RNA, 21 nt, Pseudomonas aeruginosa PA01
agggguggccaggcgcaccag

SEQ ID NO: 1508907 - RNA, 17 nt, Pseudomonas aeruginosa PA01
aggggcugaacagcgcc

SEQ ID NO: 1508908 - RNA, 17 nt, Pseudomonas aeruginosa PA01
agggggccucggccagc

SEQ ID NO: 1508909 - RNA, 21 nt, Pseudomonas aeruginosa PA01
agggggccucggccagcgccg

SEQ ID NO: 1508910 - RNA, 17 nt, Pseudomonas aeruginosa PA01
agggggcgacauagcgg

SEQ ID NO: 1508911 - RNA, 16 nt, Pseudomonas aeruginosa PA01
agggucagcagcgcca

SEQ ID NO: 1508912 - RNA, 13 nt, Pseudomonas aeruginosa PA01
agggucagccgau

SEQ ID NO: 1508913 - RNA, 18 nt, Pseudomonas aeruginosa PA01
agggucagccgcaggccg

SEQ ID NO: 1508914 - RNA, 20 nt, Pseudomonas aeruginosa PA01
agggucagcuggcgcgccuc

SEQ ID NO: 1508915 - RNA, 15 nt, Pseudomonas aeruginosa PA01
agggucagcuugccg

SEQ ID NO: 1508916 - RNA, 13 nt, Pseudomonas aeruginosa PA01
agggucaggccga

SEQ ID NO: 1508917 - RNA, 19 nt, Pseudomonas aeruginosa PA01
aggguauagguggugcugg

SEQ ID NO: 1508918 - RNA, 14 nt, Pseudomonas aeruginosa PA01
agggucagaccagc

SEQ ID NO: 1508919 - RNA, 15 nt, Pseudomonas aeruginosa PA01
agggucagaccagcc

SEQ ID NO: 1508920 - RNA, 19 nt, Pseudomonas aeruginosa PA01
aggguauuuuccagcaggc

SEQ ID NO: 1508921 - RNA, 14 nt, Pseudomonas aeruginosa PA01
agggucacgccgau

SEQ ID NO: 1508922 - RNA, 19 nt, Pseudomonas aeruginosa PA01
agggucacgcugggcaggu

SEQ ID NO: 1508923 - RNA, 22 nt, Pseudomonas aeruginosa PA01
aggggcuuuuucaugagcgccc

SEQ ID NO: 1508924 - RNA, 13 nt, Pseudomonas aeruginosa PA01
aggggcucggcga

SEQ ID NO: 1508925 - RNA, 16 nt, Pseudomonas aeruginosa PA01
agggcggcgcggagcu

SEQ ID NO: 1508926 - RNA, 12 nt, Pseudomonas aeruginosa PA01
agggcggcgccg

SEQ ID NO: 1508927 - RNA, 14 nt, Pseudomonas aeruginosa PA01
agggcggcgccgaa

SEQ ID NO: 1508928 - RNA, 18 nt, Pseudomonas aeruginosa PA01
agggcgguacgccgcgcu

SEQ ID NO: 1508929 - RNA, 19 nt, Pseudomonas aeruginosa PA01
agggcgguacgccgcgcug

SEQ ID NO: 1508930 - RNA, 19 nt, Pseudomonas aeruginosa PA01
agggcggcuuccagguacg

SEQ ID NO: 1508931 - RNA, 22 nt, Pseudomonas aeruginosa PA01
agggugcuguguucgaucucgu

SEQ ID NO: 1508932 - RNA, 15 nt, Pseudomonas aeruginosa PA01
aggguggucgcgcuc

SEQ ID NO: 1508933 - RNA, 20 nt, Pseudomonas aeruginosa PA01
aggguggugaaccagaacac

SEQ ID NO: 1508934 - RNA, 22 nt, Pseudomonas aeruginosa PA01
aggguggugucguugcgccccg

SEQ ID NO: 1508935 - RNA, 18 nt, Pseudomonas aeruginosa PA01
agggugguuuccaggcuc

SEQ ID NO: 1508936 - RNA, 16 nt, Pseudomonas aeruginosa PA01
aggguggcgaccgccg

SEQ ID NO: 1508937 - RNA, 23 nt, Pseudomonas aeruginosa PA01
aggguggcgcgcaccaccuggca

SEQ ID NO: 1508938 - RNA, 16 nt, Pseudomonas aeruginosa PA01
aggguggcgcuggcca

SEQ ID NO: 1508939 - RNA, 14 nt, Pseudomonas aeruginosa PA01
aggguggcggcggc

SEQ ID NO: 1508940 - RNA, 16 nt, Pseudomonas aeruginosa PA01
aggguggcggcggcga

SEQ ID NO: 1508941 - RNA, 17 nt, Pseudomonas aeruginosa PA01
aggguggcgggcggccc

SEQ ID NO: 1508942 - RNA, 21 nt, Pseudomonas aeruginosa PA01
aggguucggggaacagcgcca

SEQ ID NO: 1508943 - RNA, 23 nt, Pseudomonas aeruginosa PA01
aggguucggggaacagcgccagc

SEQ ID NO: 1508944 - RNA, 14 nt, Pseudomonas aeruginosa PA01
aggguuuccagcag

SEQ ID NO: 1508945 - RNA, 19 nt, Pseudomonas aeruginosa PA01
aggguuggccgcagcagcg

SEQ ID NO: 1508946 - RNA, 16 nt, Pseudomonas aeruginosa PA01
aggguugucaccggca

SEQ ID NO: 1508947 - RNA, 20 nt, Pseudomonas aeruginosa PA01
agguaaaggccaccagagcc

SEQ ID NO: 1508948 - RNA, 13 nt, Pseudomonas aeruginosa PA01
agguaagcggcgu

SEQ ID NO: 1508949 - RNA, 20 nt, Pseudomonas aeruginosa PA01
aggguuucgugaaacgccag

SEQ ID NO: 1508950 - RNA, 14 nt, Pseudomonas aeruginosa PA01
agggcacgccgcuc

SEQ ID NO: 1508951 - RNA, 23 nt, Pseudomonas aeruginosa PA01
agggcacgccgcucugcccgacc

SEQ ID NO: 1508952 - RNA, 22 nt, Pseudomonas aeruginosa PA01
agggcagggaguccgccagccg

SEQ ID NO: 1508953 - RNA, 12 nt, Pseudomonas aeruginosa PA01
agggcagcggcg

SEQ ID NO: 1508954 - RNA, 14 nt, Pseudomonas aeruginosa PA01
agggcaucgccgac

SEQ ID NO: 1508955 - RNA, 21 nt, Pseudomonas aeruginosa PA01
agggcauccucgcgguucugc

SEQ ID NO: 1508956 - RNA, 19 nt, Pseudomonas aeruginosa PA01
agggcauagaugccgcccu

SEQ ID NO: 1508957 - RNA, 20 nt, Pseudomonas aeruginosa PA01
agggcauagaugccgcccug

SEQ ID NO: 1508958 - RNA, 12 nt, Pseudomonas aeruginosa PA01
agggcaucagcc

SEQ ID NO: 1508959 - RNA, 22 nt, Pseudomonas aeruginosa PA01
agggcaucagccccucggccag

SEQ ID NO: 1508960 - RNA, 15 nt, Pseudomonas aeruginosa PA01
agggcauccaucgcc

SEQ ID NO: 1508961 - RNA, 17 nt, Pseudomonas aeruginosa PA01
agggcaguacguggcgc

SEQ ID NO: 1508962 - RNA, 22 nt, Pseudomonas aeruginosa PA01
agggcauuggccaucagcgccg

SEQ ID NO: 1508963 - RNA, 17 nt, Pseudomonas aeruginosa PA01
agggcaugaccgauggc

SEQ ID NO: 1508964 - RNA, 19 nt, Pseudomonas aeruginosa PA01
agggcaugggucagcgcca

SEQ ID NO: 1508965 - RNA, 13 nt, Pseudomonas aeruginosa PA01
agggccucggcga

SEQ ID NO: 1508966 - RNA, 14 nt, Pseudomonas aeruginosa PA01
agggccucggcgaa

SEQ ID NO: 1508967 - RNA, 15 nt, Pseudomonas aeruginosa PA01
agggccucggggccg

SEQ ID NO: 1508968 - RNA, 20 nt, Pseudomonas aeruginosa PA01
agggccggaugccaccgcuc

SEQ ID NO: 1508969 - RNA, 22 nt, Pseudomonas aeruginosa PA01
agggccgguucggauccggacu

SEQ ID NO: 1508970 - RNA, 18 nt, Pseudomonas aeruginosa PA01
agggccugggcgccgcca

SEQ ID NO: 1508971 - RNA, 18 nt, Pseudomonas aeruginosa PA01
agggcgaacaacgccgcc

SEQ ID NO: 1508972 - RNA, 19 nt, Pseudomonas aeruginosa PA01
agggcgaaccacucggcgc

SEQ ID NO: 1508973 - RNA, 21 nt, Pseudomonas aeruginosa PA01
agggcgaaccacucggcgcuu

SEQ ID NO: 1508974 - RNA, 13 nt, Pseudomonas aeruginosa PA01
agggccugcucag

SEQ ID NO: 1508975 - RNA, 17 nt, Pseudomonas aeruginosa PA01
agggccugcuccagcgg

SEQ ID NO: 1508976 - RNA, 19 nt, Pseudomonas aeruginosa PA01
agggccugcuccagcggag

SEQ ID NO: 1508977 - RNA, 14 nt, Pseudomonas aeruginosa PA01
agggcgaaggccac

SEQ ID NO: 1508978 - RNA, 18 nt, Pseudomonas aeruginosa PA01
agggcgaaggucugcccc

SEQ ID NO: 1508979 - RNA, 14 nt, Pseudomonas aeruginosa PA01
agggcgaagucggc

SEQ ID NO: 1508980 - RNA, 12 nt, Pseudomonas aeruginosa PA01
agggcgaauaac

SEQ ID NO: 1508981 - RNA, 17 nt, Pseudomonas aeruginosa PA01
agggcgaauaaccgcuc

SEQ ID NO: 1508982 - RNA, 16 nt, Pseudomonas aeruginosa PA01
agggcgaauagcgccg

SEQ ID NO: 1508983 - RNA, 23 nt, Pseudomonas aeruginosa PA01
agggcgaauagcgccgcaggcgc

SEQ ID NO: 1508984 - RNA, 19 nt, Pseudomonas aeruginosa PA01
agggcgaccgccaggcggc

SEQ ID NO: 1508985 - RNA, 21 nt, Pseudomonas aeruginosa PA01
agggcgaccgccaggcggccg

SEQ ID NO: 1508986 - RNA, 16 nt, Pseudomonas aeruginosa PA01
agggcgacuaccaggu

SEQ ID NO: 1508987 - RNA, 14 nt, Pseudomonas aeruginosa PA01
agggcgacgcccga

SEQ ID NO: 1508988 - RNA, 18 nt, Pseudomonas aeruginosa PA01
agggcgacgccgaugcuc

SEQ ID NO: 1508989 - RNA, 16 nt, Pseudomonas aeruginosa PA01
agggcggcgagcugga

SEQ ID NO: 1508990 - RNA, 21 nt, Pseudomonas aeruginosa PA01
agggcgcguugcccagcccca

SEQ ID NO: 1508991 - RNA, 13 nt, Pseudomonas aeruginosa PA01
agggcgagcaggg

SEQ ID NO: 1508992 - RNA, 16 nt, Pseudomonas aeruginosa PA01
agggaaacaccaggcc

SEQ ID NO: 1508993 - RNA, 16 nt, Pseudomonas aeruginosa PA01
agggaacccgcggcgc

SEQ ID NO: 1508994 - RNA, 22 nt, Pseudomonas aeruginosa PA01
agggaagaugcacaccagcucc

SEQ ID NO: 1508995 - RNA, 23 nt, Pseudomonas aeruginosa PA01
agggacugaagagugggcggggu

SEQ ID NO: 1508996 - RNA, 17 nt, Pseudomonas aeruginosa PA01
agggagaacagcagggu

SEQ ID NO: 1508997 - RNA, 17 nt, Pseudomonas aeruginosa PA01
agggacgcgcagcggcg

SEQ ID NO: 1508998 - RNA, 12 nt, Pseudomonas aeruginosa PA01
agggacgcgccg

SEQ ID NO: 1508999 - RNA, 14 nt, Pseudomonas aeruginosa PA01
agggacgcgccggc

SEQ ID NO: 1509000 - RNA, 21 nt, Pseudomonas aeruginosa PA01
agggaguccgccagccggcug

SEQ ID NO: 1509001 - RNA, 12 nt, Pseudomonas aeruginosa PA01
agggagcgccug

SEQ ID NO: 1509002 - RNA, 17 nt, Pseudomonas aeruginosa PA01
agggagcgccuggcguc

SEQ ID NO: 1509003 - RNA, 12 nt, Pseudomonas aeruginosa PA01
agggaggcgcac

SEQ ID NO: 1509004 - RNA, 18 nt, Pseudomonas aeruginosa PA01
agggauuccgggucgagg

SEQ ID NO: 1509005 - RNA, 19 nt, Pseudomonas aeruginosa PA01
agggauuccgggucgaggc

SEQ ID NO: 1509006 - RNA, 14 nt, Pseudomonas aeruginosa PA01
agggauacucaugc

SEQ ID NO: 1509007 - RNA, 15 nt, Pseudomonas aeruginosa PA01
agggaucgucgccaa

SEQ ID NO: 1509008 - RNA, 18 nt, Pseudomonas aeruginosa PA01
agggaucgucgccaagcc

SEQ ID NO: 1509009 - RNA, 13 nt, Pseudomonas aeruginosa PA01
agggaugccgccg

SEQ ID NO: 1509010 - RNA, 15 nt, Pseudomonas aeruginosa PA01
agggaugccgccggc

SEQ ID NO: 1509011 - RNA, 22 nt, Pseudomonas aeruginosa PA01
agggaugccgccggcaucccuu

SEQ ID NO: 1509012 - RNA, 15 nt, Pseudomonas aeruginosa PA01
agggaugccggcggc

SEQ ID NO: 1509013 - RNA, 18 nt, Pseudomonas aeruginosa PA01
agggcacgugcagcggca

SEQ ID NO: 1509014 - RNA, 19 nt, Pseudomonas aeruginosa PA01
agggcacgugcagcggcag

SEQ ID NO: 1509015 - RNA, 16 nt, Pseudomonas aeruginosa PA01
agggcaaucaacgcuu

SEQ ID NO: 1509016 - RNA, 14 nt, Pseudomonas aeruginosa PA01
agggcaaacagcuc

SEQ ID NO: 1509017 - RNA, 17 nt, Pseudomonas aeruginosa PA01
agggcaaaggcgcgcag

SEQ ID NO: 1509018 - RNA, 19 nt, Pseudomonas aeruginosa PA01
agggcaacgccaggcuguc

SEQ ID NO: 1509019 - RNA, 18 nt, Pseudomonas aeruginosa PA01
aggcuuugcggcaaggcg

SEQ ID NO: 1509020 - RNA, 18 nt, Pseudomonas aeruginosa PA01
aggcuuuccagcccggcg

SEQ ID NO: 1509021 - RNA, 15 nt, Pseudomonas aeruginosa PA01
aggcuuggucgggcg

SEQ ID NO: 1509022 - RNA, 18 nt, Pseudomonas aeruginosa PA01
aggcuugccacugcgcgc

SEQ ID NO: 1509023 - RNA, 14 nt, Pseudomonas aeruginosa PA01
aggcuucggcgcgc

SEQ ID NO: 1509024 - RNA, 18 nt, Pseudomonas aeruginosa PA01
aggcuucuuccuggccgg

SEQ ID NO: 1509025 - RNA, 19 nt, Pseudomonas aeruginosa PA01
aggcuggcggcaucggcgc

SEQ ID NO: 1509026 - RNA, 21 nt, Pseudomonas aeruginosa PA01
aggcuggcggcaucggcgccg

SEQ ID NO: 1509027 - RNA, 12 nt, Pseudomonas aeruginosa PA01
aggcuggccgag

SEQ ID NO: 1509028 - RNA, 21 nt, Pseudomonas aeruginosa PA01
aggcuggccgagcgccgccug

SEQ ID NO: 1509029 - RNA, 18 nt, Pseudomonas aeruginosa PA01
aggcuggaagccgcgcuc

SEQ ID NO: 1509030 - RNA, 18 nt, Pseudomonas aeruginosa PA01
aggcuggagcgcugcgga

SEQ ID NO: 1509031 - RNA, 18 nt, Pseudomonas aeruginosa PA01
aggcugccguccaggcgc

SEQ ID NO: 1509032 - RNA, 14 nt, Pseudomonas aeruginosa PA01
aggcugccgagcag

SEQ ID NO: 1509033 - RNA, 22 nt, Pseudomonas aeruginosa PA01
aggcugccgcaguagaugccgc

SEQ ID NO: 1509034 - RNA, 15 nt, Pseudomonas aeruginosa PA01
aggcugccgccgccg

SEQ ID NO: 1509035 - RNA, 14 nt, Pseudomonas aeruginosa PA01
aggcugcgccgcug

SEQ ID NO: 1509036 - RNA, 13 nt, Pseudomonas aeruginosa PA01
aggcugcgggcga

SEQ ID NO: 1509037 - RNA, 16 nt, Pseudomonas aeruginosa PA01
aggcugaucggcgcgc

SEQ ID NO: 1509038 - RNA, 16 nt, Pseudomonas aeruginosa PA01
aggcugaucagcccgc

SEQ ID NO: 1509039 - RNA, 20 nt, Pseudomonas aeruginosa PA01
aggcugcaucggcucggcaa

SEQ ID NO: 1509040 - RNA, 13 nt, Pseudomonas aeruginosa PA01
aggcgugggccag

SEQ ID NO: 1509041 - RNA, 16 nt, Pseudomonas aeruginosa PA01
aggcgugggccagccc

SEQ ID NO: 1509042 - RNA, 17 nt, Pseudomonas aeruginosa PA01
aggcgugggccagccca

SEQ ID NO: 1509043 - RNA, 14 nt, Pseudomonas aeruginosa PA01
aggcguuauccgcc

SEQ ID NO: 1509044 - RNA, 17 nt, Pseudomonas aeruginosa PA01
aggcguuauccgccgcc

SEQ ID NO: 1509045 - RNA, 18 nt, Pseudomonas aeruginosa PA01
aggcguuauccgccgccg

SEQ ID NO: 1509046 - RNA, 22 nt, Pseudomonas aeruginosa PA01
aggcgugcaguacuuggccagc

SEQ ID NO: 1509047 - RNA, 18 nt, Pseudomonas aeruginosa PA01
aggcguccuggcgagugg

SEQ ID NO: 1509048 - RNA, 18 nt, Pseudomonas aeruginosa PA01
aggcgucgguccagcucc

SEQ ID NO: 1509049 - RNA, 15 nt, Pseudomonas aeruginosa PA01
aggcgugccgcuggc

SEQ ID NO: 1509050 - RNA, 17 nt, Pseudomonas aeruginosa PA01
aggcgugccgcuggccg

SEQ ID NO: 1509051 - RNA, 18 nt, Pseudomonas aeruginosa PA01
aggcgugccgcuggccga

SEQ ID NO: 1509052 - RNA, 19 nt, Pseudomonas aeruginosa PA01
aggcgugccgcuggccgac

SEQ ID NO: 1509053 - RNA, 18 nt, Pseudomonas aeruginosa PA01
aggccgaauccgccggcg

SEQ ID NO: 1509054 - RNA, 15 nt, Pseudomonas aeruginosa PA01
aggccgccaggccuc

SEQ ID NO: 1509055 - RNA, 20 nt, Pseudomonas aeruginosa PA01
aggccgccaggccucggcgc

SEQ ID NO: 1509056 - RNA, 16 nt, Pseudomonas aeruginosa PA01
aggccgcccuggccga

SEQ ID NO: 1509057 - RNA, 11 nt, Pseudomonas aeruginosa PA01
aggccgccgaa

SEQ ID NO: 1509058 - RNA, 15 nt, Pseudomonas aeruginosa PA01
aggccgccgaagaac

SEQ ID NO: 1509059 - RNA, 16 nt, Pseudomonas aeruginosa PA01
aggcgucgaaggccuc

SEQ ID NO: 1509060 - RNA, 13 nt, Pseudomonas aeruginosa PA01
aggcgucggcggg

SEQ ID NO: 1509061 - RNA, 15 nt, Pseudomonas aeruginosa PA01
aggcgucgcgccagc

SEQ ID NO: 1509062 - RNA, 13 nt, Pseudomonas aeruginosa PA01
aggcgucgccguc

SEQ ID NO: 1509063 - RNA, 19 nt, Pseudomonas aeruginosa PA01
aggccgccaugcucggcca

SEQ ID NO: 1509064 - RNA, 21 nt, Pseudomonas aeruginosa PA01
aggccgccaugcucggccagc

SEQ ID NO: 1509065 - RNA, 13 nt, Pseudomonas aeruginosa PA01
aggccgauggccc

SEQ ID NO: 1509066 - RNA, 16 nt, Pseudomonas aeruginosa PA01
aggccgaucagcggcg

SEQ ID NO: 1509067 - RNA, 17 nt, Pseudomonas aeruginosa PA01
aggccgaucagcggcgg

SEQ ID NO: 1509068 - RNA, 16 nt, Pseudomonas aeruginosa PA01
aggccgcaagcgguau

SEQ ID NO: 1509069 - RNA, 22 nt, Pseudomonas aeruginosa PA01
aggccgcaagcgguauugucga

SEQ ID NO: 1509070 - RNA, 14 nt, Pseudomonas aeruginosa PA01
aggucucgccgccg

SEQ ID NO: 1509071 - RNA, 15 nt, Pseudomonas aeruginosa PA01
aggucucaccgcccu

SEQ ID NO: 1509072 - RNA, 17 nt, Pseudomonas aeruginosa PA01
aggucucaccgcccugc

SEQ ID NO: 1509073 - RNA, 23 nt, Pseudomonas aeruginosa PA01
aggucguugcgccggcccagcag

SEQ ID NO: 1509074 - RNA, 13 nt, Pseudomonas aeruginosa PA01
aggucguccaccu

SEQ ID NO: 1509075 - RNA, 14 nt, Pseudomonas aeruginosa PA01
aggucgucggcgaa

SEQ ID NO: 1509076 - RNA, 14 nt, Pseudomonas aeruginosa PA01
aggucgucgcgcuu

SEQ ID NO: 1509077 - RNA, 20 nt, Pseudomonas aeruginosa PA01
aggucgucgcgcuugagcag

SEQ ID NO: 1509078 - RNA, 22 nt, Pseudomonas aeruginosa PA01
aggucgucgggcagaguggcgc

SEQ ID NO: 1509079 - RNA, 20 nt, Pseudomonas aeruginosa PA01
aggucgucgucacgcaggcu

SEQ ID NO: 1509080 - RNA, 16 nt, Pseudomonas aeruginosa PA01
aggucgugcagcccgg

SEQ ID NO: 1509081 - RNA, 22 nt, Pseudomonas aeruginosa PA01
aggugcuugucacgcucggcau

SEQ ID NO: 1509082 - RNA, 16 nt, Pseudomonas aeruginosa PA01
agguggaucgcggcgu

SEQ ID NO: 1509083 - RNA, 22 nt, Pseudomonas aeruginosa PA01
aggugcuggacucgcgccaguc

SEQ ID NO: 1509084 - RNA, 19 nt, Pseudomonas aeruginosa PA01
aggugcugguggcccuggg

SEQ ID NO: 1509085 - RNA, 20 nt, Pseudomonas aeruginosa PA01
aggugcugguggcccugggc

SEQ ID NO: 1509086 - RNA, 14 nt, Pseudomonas aeruginosa PA01
aggucugugccgug

SEQ ID NO: 1509087 - RNA, 17 nt, Pseudomonas aeruginosa PA01
aggucugccccggcuug

SEQ ID NO: 1509088 - RNA, 20 nt, Pseudomonas aeruginosa PA01
aggugcguacuuggcccggc

SEQ ID NO: 1509089 - RNA, 17 nt, Pseudomonas aeruginosa PA01
agguggaugaacagcgg

SEQ ID NO: 1509090 - RNA, 16 nt, Pseudomonas aeruginosa PA01
agguggcugaagcccc

SEQ ID NO: 1509091 - RNA, 15 nt, Pseudomonas aeruginosa PA01
aggugggcagcagcg

SEQ ID NO: 1509092 - RNA, 23 nt, Pseudomonas aeruginosa PA01
aggugggcagcagcgaacgccgc

SEQ ID NO: 1509093 - RNA, 23 nt, Pseudomonas aeruginosa PA01
agguggauugcagcgucgacgcc

SEQ ID NO: 1509094 - RNA, 18 nt, Pseudomonas aeruginosa PA01
agguggcgccgccggcga

SEQ ID NO: 1509095 - RNA, 17 nt, Pseudomonas aeruginosa PA01
agguggcgggucggcgg

SEQ ID NO: 1509096 - RNA, 15 nt, Pseudomonas aeruginosa PA01
agguagaagcggccg

SEQ ID NO: 1509097 - RNA, 21 nt, Pseudomonas aeruginosa PA01
agguagaaauagaaggucacc

SEQ ID NO: 1509098 - RNA, 18 nt, Pseudomonas aeruginosa PA01
agguagaacaggcugccg

SEQ ID NO: 1509099 - RNA, 21 nt, Pseudomonas aeruginosa PA01
agguagccugcggccagcgcc

SEQ ID NO: 1509100 - RNA, 14 nt, Pseudomonas aeruginosa PA01
agguagcagccguc

SEQ ID NO: 1509101 - RNA, 16 nt, Pseudomonas aeruginosa PA01
agguagcagccgucca

SEQ ID NO: 1509102 - RNA, 18 nt, Pseudomonas aeruginosa PA01
agguacaacggcaucggc

SEQ ID NO: 1509103 - RNA, 12 nt, Pseudomonas aeruginosa PA01
agguacagcagc

SEQ ID NO: 1509104 - RNA, 13 nt, Pseudomonas aeruginosa PA01
agguagcgcugcg

SEQ ID NO: 1509105 - RNA, 12 nt, Pseudomonas aeruginosa PA01
agguagcggcgu

SEQ ID NO: 1509106 - RNA, 15 nt, Pseudomonas aeruginosa PA01
agguagcggucgggu

SEQ ID NO: 1509107 - RNA, 17 nt, Pseudomonas aeruginosa PA01
agguagcguugcgccag

SEQ ID NO: 1509108 - RNA, 16 nt, Pseudomonas aeruginosa PA01
agguagcugagcaggc

SEQ ID NO: 1509109 - RNA, 18 nt, Pseudomonas aeruginosa PA01
agguagcugagcaggccg

SEQ ID NO: 1509110 - RNA, 19 nt, Pseudomonas aeruginosa PA01
agguagcugagcaggccga

SEQ ID NO: 1509111 - RNA, 21 nt, Pseudomonas aeruginosa PA01
agguagaccacgcaggccagc

SEQ ID NO: 1509112 - RNA, 21 nt, Pseudomonas aeruginosa PA01
agguaggcaucgacgccagcg

SEQ ID NO: 1509113 - RNA, 16 nt, Pseudomonas aeruginosa PA01
agguagucgcccagcg

SEQ ID NO: 1509114 - RNA, 16 nt, Pseudomonas aeruginosa PA01
agguagucgcccggcu

SEQ ID NO: 1509115 - RNA, 24 nt, Pseudomonas aeruginosa PA01
agguagucgcccggcucgcccaug

SEQ ID NO: 1509116 - RNA, 21 nt, Pseudomonas aeruginosa PA01
agguagucgcucauggcgccg

SEQ ID NO: 1509117 - RNA, 23 nt, Pseudomonas aeruginosa PA01
agguagucggcgaugcgcuggaa

SEQ ID NO: 1509118 - RNA, 20 nt, Pseudomonas aeruginosa PA01
agguagugcaacaccuggcg

SEQ ID NO: 1509119 - RNA, 16 nt, Pseudomonas aeruginosa PA01
agguaguucuccaggc

SEQ ID NO: 1509120 - RNA, 21 nt, Pseudomonas aeruginosa PA01
aggucgcgauguuggcgucga

SEQ ID NO: 1509121 - RNA, 16 nt, Pseudomonas aeruginosa PA01
aggucgcgcaguucgu

SEQ ID NO: 1509122 - RNA, 19 nt, Pseudomonas aeruginosa PA01
aggucgcggaucaggcugg

SEQ ID NO: 1509123 - RNA, 22 nt, Pseudomonas aeruginosa PA01
aggucgcggugcaguucgccgu

SEQ ID NO: 1509124 - RNA, 16 nt, Pseudomonas aeruginosa PA01
aggucgcgcugggcga

SEQ ID NO: 1509125 - RNA, 15 nt, Pseudomonas aeruginosa PA01
aggucgguucgccca

SEQ ID NO: 1509126 - RNA, 18 nt, Pseudomonas aeruginosa PA01
aggucgcuggcaccggcc

SEQ ID NO: 1509127 - RNA, 15 nt, Pseudomonas aeruginosa PA01
aggucggcagcagcu

SEQ ID NO: 1509128 - RNA, 16 nt, Pseudomonas aeruginosa PA01
aggucggcagcagcuu

SEQ ID NO: 1509129 - RNA, 13 nt, Pseudomonas aeruginosa PA01
aggucgccgggcu

SEQ ID NO: 1509130 - RNA, 14 nt, Pseudomonas aeruginosa PA01
aggucgccgccagc

SEQ ID NO: 1509131 - RNA, 15 nt, Pseudomonas aeruginosa PA01
aggucgccgccagcu

SEQ ID NO: 1509132 - RNA, 22 nt, Pseudomonas aeruginosa PA01
aggucgcagcguuccagcgcug

SEQ ID NO: 1509133 - RNA, 15 nt, Pseudomonas aeruginosa PA01
aggucgccagcgccu

SEQ ID NO: 1509134 - RNA, 12 nt, Pseudomonas aeruginosa PA01
aggucgcccugc

SEQ ID NO: 1509135 - RNA, 19 nt, Pseudomonas aeruginosa PA01
aggucgcccugcagcgcgc

SEQ ID NO: 1509136 - RNA, 20 nt, Pseudomonas aeruginosa PA01
aggucgcccugcagcgcgcg

SEQ ID NO: 1509137 - RNA, 24 nt, Pseudomonas aeruginosa PA01
aggucgcccugcagcgcgcgcugg

SEQ ID NO: 1509138 - RNA, 14 nt, Pseudomonas aeruginosa PA01
agguauccgccggc

SEQ ID NO: 1509139 - RNA, 15 nt, Pseudomonas aeruginosa PA01
agguauccgccggcc

SEQ ID NO: 1509140 - RNA, 21 nt, Pseudomonas aeruginosa PA01
agguugccgaucaggcugaag

SEQ ID NO: 1509141 - RNA, 12 nt, Pseudomonas aeruginosa PA01
agguugccggcg

SEQ ID NO: 1509142 - RNA, 23 nt, Pseudomonas aeruginosa PA01
agguugauccugggcgccagccg

SEQ ID NO: 1509143 - RNA, 15 nt, Pseudomonas aeruginosa PA01
aguagccggcggcga

SEQ ID NO: 1509144 - RNA, 17 nt, Pseudomonas aeruginosa PA01
aguagccggcguuggcg

SEQ ID NO: 1509145 - RNA, 22 nt, Pseudomonas aeruginosa PA01
aguagccgguguagaucaggcu

SEQ ID NO: 1509146 - RNA, 21 nt, Pseudomonas aeruginosa PA01
aguaccgcugcggccggcgcg

SEQ ID NO: 1509147 - RNA, 16 nt, Pseudomonas aeruginosa PA01
aguaccggcagcgccg

SEQ ID NO: 1509148 - RNA, 20 nt, Pseudomonas aeruginosa PA01
aguaccugcucacggccgaa

SEQ ID NO: 1509149 - RNA, 16 nt, Pseudomonas aeruginosa PA01
agguucaauccuuccg

SEQ ID NO: 1509150 - RNA, 14 nt, Pseudomonas aeruginosa PA01
agguucaccgccuc

SEQ ID NO: 1509151 - RNA, 23 nt, Pseudomonas aeruginosa PA01
agguucaggacgcuccugcgccg

SEQ ID NO: 1509152 - RNA, 14 nt, Pseudomonas aeruginosa PA01
agguucaugccgcg

SEQ ID NO: 1509153 - RNA, 17 nt, Pseudomonas aeruginosa PA01
agguucgaaugcugccc

SEQ ID NO: 1509154 - RNA, 22 nt, Pseudomonas aeruginosa PA01
agguugaccccgcggccgagga

SEQ ID NO: 1509155 - RNA, 22 nt, Pseudomonas aeruginosa PA01
agguugacgaugcggcccgccg

SEQ ID NO: 1509156 - RNA, 18 nt, Pseudomonas aeruginosa PA01
agguugcccacggccagg

SEQ ID NO: 1509157 - RNA, 20 nt, Pseudomonas aeruginosa PA01
agguugcccacggccaggcc

SEQ ID NO: 1509158 - RNA, 15 nt, Pseudomonas aeruginosa PA01
aguccagcuccucga

SEQ ID NO: 1509159 - RNA, 19 nt, Pseudomonas aeruginosa PA01
aguccagcgagugcaggaa

SEQ ID NO: 1509160 - RNA, 17 nt, Pseudomonas aeruginosa PA01
aguccagcgccgcgcug

SEQ ID NO: 1509161 - RNA, 14 nt, Pseudomonas aeruginosa PA01
aguccaccaggcgc

SEQ ID NO: 1509162 - RNA, 20 nt, Pseudomonas aeruginosa PA01
aguccaccaggcgccggguc

SEQ ID NO: 1509163 - RNA, 14 nt, Pseudomonas aeruginosa PA01
agucauugcgcugu

SEQ ID NO: 1509164 - RNA, 16 nt, Pseudomonas aeruginosa PA01
agucccguccgcugcg

SEQ ID NO: 1509165 - RNA, 19 nt, Pseudomonas aeruginosa PA01
agucccguccgcugcgcca

SEQ ID NO: 1509166 - RNA, 22 nt, Pseudomonas aeruginosa PA01
agucccgccaggcgccgaucaa

SEQ ID NO: 1509167 - RNA, 15 nt, Pseudomonas aeruginosa PA01
agucccgcgcggccc

SEQ ID NO: 1509168 - RNA, 13 nt, Pseudomonas aeruginosa PA01
aguccaucaccgc

SEQ ID NO: 1509169 - RNA, 15 nt, Pseudomonas aeruginosa PA01
aguccaucaccgcgg

SEQ ID NO: 1509170 - RNA, 16 nt, Pseudomonas aeruginosa PA01
aguccagguacaccag

SEQ ID NO: 1509171 - RNA, 13 nt, Pseudomonas aeruginosa PA01
aguagcuggcgca

SEQ ID NO: 1509172 - RNA, 16 nt, Pseudomonas aeruginosa PA01
aguagguccaggcguc

SEQ ID NO: 1509173 - RNA, 18 nt, Pseudomonas aeruginosa PA01
aguagguccaggcgucgg

SEQ ID NO: 1509174 - RNA, 16 nt, Pseudomonas aeruginosa PA01
aguaggucgguucgcc

SEQ ID NO: 1509175 - RNA, 23 nt, Pseudomonas aeruginosa PA01
aguaggucugguaguaggcgcuc

SEQ ID NO: 1509176 - RNA, 21 nt, Pseudomonas aeruginosa PA01
aguaggggaauuucacgccga

SEQ ID NO: 1509177 - RNA, 16 nt, Pseudomonas aeruginosa PA01
aguaggguucgccgac

SEQ ID NO: 1509178 - RNA, 20 nt, Pseudomonas aeruginosa PA01
aguagguagagaugcagcag

SEQ ID NO: 1509179 - RNA, 19 nt, Pseudomonas aeruginosa PA01
aguagcgacggaagcccuc

SEQ ID NO: 1509180 - RNA, 16 nt, Pseudomonas aeruginosa PA01
agucaggcgccggccu

SEQ ID NO: 1509181 - RNA, 20 nt, Pseudomonas aeruginosa PA01
agucaggcgccggccucgca

SEQ ID NO: 1509182 - RNA, 14 nt, Pseudomonas aeruginosa PA01
agucaggaucggcg

SEQ ID NO: 1509183 - RNA, 21 nt, Pseudomonas aeruginosa PA01
agucaggaucggcgcccagca

SEQ ID NO: 1509184 - RNA, 16 nt, Pseudomonas aeruginosa PA01
aguccugcaggaucga

SEQ ID NO: 1509185 - RNA, 12 nt, Pseudomonas aeruginosa PA01
aguccugcugcg

SEQ ID NO: 1509186 - RNA, 19 nt, Pseudomonas aeruginosa PA01
aguccuggacccguugccg

SEQ ID NO: 1509187 - RNA, 15 nt, Pseudomonas aeruginosa PA01
aguccugggugucgu

SEQ ID NO: 1509188 - RNA, 16 nt, Pseudomonas aeruginosa PA01
agucgaagcagcccag

SEQ ID NO: 1509189 - RNA, 22 nt, Pseudomonas aeruginosa PA01
agucgaagcagcccagcgcuuc

SEQ ID NO: 1509190 - RNA, 12 nt, Pseudomonas aeruginosa PA01
agucgagcaguu

SEQ ID NO: 1509191 - RNA, 23 nt, Pseudomonas aeruginosa PA01
agucgaaguacaccuuggcgcga

SEQ ID NO: 1509192 - RNA, 21 nt, Pseudomonas aeruginosa PA01
agucgaccggaaucacgucga

SEQ ID NO: 1509193 - RNA, 16 nt, Pseudomonas aeruginosa PA01
agucgaccgucgccac

SEQ ID NO: 1509194 - RNA, 17 nt, Pseudomonas aeruginosa PA01
agucgaccgucgccacg

SEQ ID NO: 1509195 - RNA, 14 nt, Pseudomonas aeruginosa PA01
agucgacgccgguc

SEQ ID NO: 1509196 - RNA, 23 nt, Pseudomonas aeruginosa PA01
agucgacccaggcccagccggug

SEQ ID NO: 1509197 - RNA, 22 nt, Pseudomonas aeruginosa PA01
aguccgcgcgcgcgcuccucga

SEQ ID NO: 1509198 - RNA, 18 nt, Pseudomonas aeruginosa PA01
aguccgcugcgagcaggu

SEQ ID NO: 1509199 - RNA, 15 nt, Pseudomonas aeruginosa PA01
aguccggcaccgcuc

SEQ ID NO: 1509200 - RNA, 16 nt, Pseudomonas aeruginosa PA01
aguccggcagcacggc

SEQ ID NO: 1509201 - RNA, 17 nt, Pseudomonas aeruginosa PA01
aguccggcagcacggcg

SEQ ID NO: 1509202 - RNA, 12 nt, Pseudomonas aeruginosa PA01
aguccgccagcc

SEQ ID NO: 1509203 - RNA, 16 nt, Pseudomonas aeruginosa PA01
aguccgccagccggcu

SEQ ID NO: 1509204 - RNA, 14 nt, Pseudomonas aeruginosa PA01
aguccgggcgcggc

SEQ ID NO: 1509205 - RNA, 22 nt, Pseudomonas aeruginosa PA01
aguccggguugacccagagccg

SEQ ID NO: 1509206 - RNA, 19 nt, Pseudomonas aeruginosa PA01
aguccggguugagcacccc

SEQ ID NO: 1509207 - RNA, 13 nt, Pseudomonas aeruginosa PA01
agucggccaggcg

SEQ ID NO: 1509208 - RNA, 17 nt, Pseudomonas aeruginosa PA01
agucggccaggcgccag

SEQ ID NO: 1509209 - RNA, 19 nt, Pseudomonas aeruginosa PA01
agucggccaggcgccaggu

SEQ ID NO: 1509210 - RNA, 21 nt, Pseudomonas aeruginosa PA01
agucggaacgaccgguagcca

SEQ ID NO: 1509211 - RNA, 20 nt, Pseudomonas aeruginosa PA01
agucggcagucgccgcaccg

SEQ ID NO: 1509212 - RNA, 16 nt, Pseudomonas aeruginosa PA01
agucggccugcaccag

SEQ ID NO: 1509213 - RNA, 22 nt, Pseudomonas aeruginosa PA01
agucggccuggcucaugucgug

SEQ ID NO: 1509214 - RNA, 14 nt, Pseudomonas aeruginosa PA01
agucggcgaugcgc

SEQ ID NO: 1509215 - RNA, 15 nt, Pseudomonas aeruginosa PA01
agucgcggcccuggu

SEQ ID NO: 1509216 - RNA, 14 nt, Pseudomonas aeruginosa PA01
agucgcucgcgcag

SEQ ID NO: 1509217 - RNA, 17 nt, Pseudomonas aeruginosa PA01
agucgcucgcgcagguc

SEQ ID NO: 1509218 - RNA, 16 nt, Pseudomonas aeruginosa PA01
agucgcugcucggccu

SEQ ID NO: 1509219 - RNA, 15 nt, Pseudomonas aeruginosa PA01
agucgcugcuggcgc

SEQ ID NO: 1509220 - RNA, 17 nt, Pseudomonas aeruginosa PA01
agucgcugcuggcgccg

SEQ ID NO: 1509221 - RNA, 21 nt, Pseudomonas aeruginosa PA01
agucgcugcuggcgccgcugg

SEQ ID NO: 1509222 - RNA, 22 nt, Pseudomonas aeruginosa PA01
agucgcuggccugggguagccg

SEQ ID NO: 1509223 - RNA, 23 nt, Pseudomonas aeruginosa PA01
agucgcgguugcugugcacccag

SEQ ID NO: 1509224 - RNA, 17 nt, Pseudomonas aeruginosa PA01
agucgcucauggcgccg

SEQ ID NO: 1509225 - RNA, 17 nt, Pseudomonas aeruginosa PA01
agucgccuggcccugga

SEQ ID NO: 1509226 - RNA, 20 nt, Pseudomonas aeruginosa PA01
agucgcgcccagugcccggc

SEQ ID NO: 1509227 - RNA, 17 nt, Pseudomonas aeruginosa PA01
agucgccgccaguucgg

SEQ ID NO: 1509228 - RNA, 14 nt, Pseudomonas aeruginosa PA01
agucgccggcaucg

SEQ ID NO: 1509229 - RNA, 14 nt, Pseudomonas aeruginosa PA01
agucgcccgccggc

SEQ ID NO: 1509230 - RNA, 17 nt, Pseudomonas aeruginosa PA01
agucgcccgcuucgcca

SEQ ID NO: 1509231 - RNA, 18 nt, Pseudomonas aeruginosa PA01
agucgcccgcuucgccau

SEQ ID NO: 1509232 - RNA, 19 nt, Pseudomonas aeruginosa PA01
agucgcccggcucgcccau

SEQ ID NO: 1509233 - RNA, 15 nt, Pseudomonas aeruginosa PA01
agucgcccagcgccu

SEQ ID NO: 1509234 - RNA, 18 nt, Pseudomonas aeruginosa PA01
agucgaucaggucgccgc

SEQ ID NO: 1509235 - RNA, 20 nt, Pseudomonas aeruginosa PA01
agucgaugacgaggcccgcc

SEQ ID NO: 1509236 - RNA, 18 nt, Pseudomonas aeruginosa PA01
agucgaucaccgcaucga

SEQ ID NO: 1509237 - RNA, 15 nt, Pseudomonas aeruginosa PA01
agucgagacgccagc

SEQ ID NO: 1509238 - RNA, 17 nt, Pseudomonas aeruginosa PA01
agucgagacgccagccg

SEQ ID NO: 1509239 - RNA, 19 nt, Pseudomonas aeruginosa PA01
agucgcagucguagcgcag

SEQ ID NO: 1509240 - RNA, 20 nt, Pseudomonas aeruginosa PA01
agucgcaccgggaggcgccg

SEQ ID NO: 1509241 - RNA, 11 nt, Pseudomonas aeruginosa PA01
agugggcgggg

SEQ ID NO: 1509242 - RNA, 18 nt, Pseudomonas aeruginosa PA01
agugggcgaggcgcucga

SEQ ID NO: 1509243 - RNA, 18 nt, Pseudomonas aeruginosa PA01
agugguauuggucgcgau

SEQ ID NO: 1509244 - RNA, 23 nt, Pseudomonas aeruginosa PA01
agugugggacaggaagagcaggc

SEQ ID NO: 1509245 - RNA, 15 nt, Pseudomonas aeruginosa PA01
aguguuacagcagga

SEQ ID NO: 1509246 - RNA, 13 nt, Pseudomonas aeruginosa PA01
agugccgaccaca

SEQ ID NO: 1509247 - RNA, 21 nt, Pseudomonas aeruginosa PA01
agugccgaccacaugggcgac

SEQ ID NO: 1509248 - RNA, 22 nt, Pseudomonas aeruginosa PA01
agugccggcgcgucgcugcgca

SEQ ID NO: 1509249 - RNA, 20 nt, Pseudomonas aeruginosa PA01
agugcccccggcaacacccu

SEQ ID NO: 1509250 - RNA, 23 nt, Pseudomonas aeruginosa PA01
aguggcuugugcgaauguccggc

SEQ ID NO: 1509251 - RNA, 14 nt, Pseudomonas aeruginosa PA01
aguggcgcagcgcc

SEQ ID NO: 1509252 - RNA, 15 nt, Pseudomonas aeruginosa PA01
agugccucgcgcgug

SEQ ID NO: 1509253 - RNA, 15 nt, Pseudomonas aeruginosa PA01
agugcccaggcgcug

SEQ ID NO: 1509254 - RNA, 21 nt, Pseudomonas aeruginosa PA01
agugcagggcguccaguagcg

SEQ ID NO: 1509255 - RNA, 18 nt, Pseudomonas aeruginosa PA01
agugcagcgagucgccgu

SEQ ID NO: 1509256 - RNA, 18 nt, Pseudomonas aeruginosa PA01
agugcaggaaguggcgga

SEQ ID NO: 1509257 - RNA, 18 nt, Pseudomonas aeruginosa PA01
agucguuguacuggccga

SEQ ID NO: 1509258 - RNA, 18 nt, Pseudomonas aeruginosa PA01
agugcaacaccuggcgcu

SEQ ID NO: 1509259 - RNA, 17 nt, Pseudomonas aeruginosa PA01
agucggggcaggcgcag

SEQ ID NO: 1509260 - RNA, 18 nt, Pseudomonas aeruginosa PA01
agucggcguccgccucgc

SEQ ID NO: 1509261 - RNA, 13 nt, Pseudomonas aeruginosa PA01
agucggcgcgcca

SEQ ID NO: 1509262 - RNA, 22 nt, Pseudomonas aeruginosa PA01
agucggcuugggucagcggguu

SEQ ID NO: 1509263 - RNA, 12 nt, Pseudomonas aeruginosa PA01
agucguccucgc

SEQ ID NO: 1509264 - RNA, 15 nt, Pseudomonas aeruginosa PA01
agucguugaagcggc

SEQ ID NO: 1509265 - RNA, 18 nt, Pseudomonas aeruginosa PA01
agucguugacggugcugu

SEQ ID NO: 1509266 - RNA, 17 nt, Pseudomonas aeruginosa PA01
agucguagcgcaugccg

SEQ ID NO: 1509267 - RNA, 16 nt, Pseudomonas aeruginosa PA01
agucguagcgcgcggc

SEQ ID NO: 1509268 - RNA, 15 nt, Pseudomonas aeruginosa PA01
agucguaggucugcc

SEQ ID NO: 1509269 - RNA, 13 nt, Pseudomonas aeruginosa PA01
aguuggcggccga

SEQ ID NO: 1509270 - RNA, 17 nt, Pseudomonas aeruginosa PA01
aguuggugcacgcgccg

SEQ ID NO: 1509271 - RNA, 15 nt, Pseudomonas aeruginosa PA01
aguuguacagcgagg

SEQ ID NO: 1509272 - RNA, 16 nt, Pseudomonas aeruginosa PA01
aguuguacagcgaggc

SEQ ID NO: 1509273 - RNA, 22 nt, Pseudomonas aeruginosa PA01
aguucacauuggcuuccgagca

SEQ ID NO: 1509274 - RNA, 15 nt, Pseudomonas aeruginosa PA01
aguucagccgguacu

SEQ ID NO: 1509275 - RNA, 14 nt, Pseudomonas aeruginosa PA01
aguucagcgcgcuc

SEQ ID NO: 1509276 - RNA, 18 nt, Pseudomonas aeruginosa PA01
aguugcuggaugucggcg

SEQ ID NO: 1509277 - RNA, 21 nt, Pseudomonas aeruginosa PA01
aguuggaaggaucgagccagc

SEQ ID NO: 1509278 - RNA, 20 nt, Pseudomonas aeruginosa PA01
aguuggaaguugccgccagc

SEQ ID NO: 1509279 - RNA, 16 nt, Pseudomonas aeruginosa PA01
aguuggacgcggccug

SEQ ID NO: 1509280 - RNA, 20 nt, Pseudomonas aeruginosa PA01
aguuggacugcgaggcggug

SEQ ID NO: 1509281 - RNA, 20 nt, Pseudomonas aeruginosa PA01
aguuaucggggccaggucgg

SEQ ID NO: 1509282 - RNA, 20 nt, Pseudomonas aeruginosa PA01
aguuacuuaaauucaccgag

SEQ ID NO: 1509283 - RNA, 11 nt, Pseudomonas aeruginosa PA01
auaaggcgugc

SEQ ID NO: 1509284 - RNA, 13 nt, Pseudomonas aeruginosa PA01
auacaccgcugcg

SEQ ID NO: 1509285 - RNA, 17 nt, Pseudomonas aeruginosa PA01
auaccagugccgcggug

SEQ ID NO: 1509286 - RNA, 13 nt, Pseudomonas aeruginosa PA01
auaccagcgccgc

SEQ ID NO: 1509287 - RNA, 23 nt, Pseudomonas aeruginosa PA01
auacagcacccgguagccgauca

SEQ ID NO: 1509288 - RNA, 17 nt, Pseudomonas aeruginosa PA01
auagucgccguucaggu

SEQ ID NO: 1509289 - RNA, 17 nt, Pseudomonas aeruginosa PA01
auagugcugcggcaggu

SEQ ID NO: 1509290 - RNA, 20 nt, Pseudomonas aeruginosa PA01
auauccccguauccuccgcg

SEQ ID NO: 1509291 - RNA, 14 nt, Pseudomonas aeruginosa PA01
auaucccgccgccg

SEQ ID NO: 1509292 - RNA, 19 nt, Pseudomonas aeruginosa PA01
aucaacgcggccagcagca

SEQ ID NO: 1509293 - RNA, 13 nt, Pseudomonas aeruginosa PA01
aucaacgccgguc

SEQ ID NO: 1509294 - RNA, 12 nt, Pseudomonas aeruginosa PA01
aucaccgccuug

SEQ ID NO: 1509295 - RNA, 14 nt, Pseudomonas aeruginosa PA01
aucaaucgcuggcg

SEQ ID NO: 1509296 - RNA, 12 nt, Pseudomonas aeruginosa PA01
aucacgccccuc

SEQ ID NO: 1509297 - RNA, 22 nt, Pseudomonas aeruginosa PA01
aucacgauggccggcagcagcg

SEQ ID NO: 1509298 - RNA, 13 nt, Pseudomonas aeruginosa PA01
aucaccgcggugc

SEQ ID NO: 1509299 - RNA, 20 nt, Pseudomonas aeruginosa PA01
aucaccgcgguggaggcggc

SEQ ID NO: 1509300 - RNA, 21 nt, Pseudomonas aeruginosa PA01
aucaccgcgguggaggcggcg

SEQ ID NO: 1509301 - RNA, 22 nt, Pseudomonas aeruginosa PA01
aucaccggaucgaugcccggcu

SEQ ID NO: 1509302 - RNA, 21 nt, Pseudomonas aeruginosa PA01
aucaccgcguccauccccgcc

SEQ ID NO: 1509303 - RNA, 13 nt, Pseudomonas aeruginosa PA01
aucaccgcggugu

SEQ ID NO: 1509304 - RNA, 12 nt, Pseudomonas aeruginosa PA01
aucaccggcggg

SEQ ID NO: 1509305 - RNA, 12 nt, Pseudomonas aeruginosa PA01
aucaccggcugg

SEQ ID NO: 1509306 - RNA, 22 nt, Pseudomonas aeruginosa PA01
aucagccagggcaacgccaggc

SEQ ID NO: 1509307 - RNA, 15 nt, Pseudomonas aeruginosa PA01
aucagccggcgcgcu

SEQ ID NO: 1509308 - RNA, 22 nt, Pseudomonas aeruginosa PA01
aucagccggcccauccgccgca

SEQ ID NO: 1509309 - RNA, 13 nt, Pseudomonas aeruginosa PA01
aucagcgaacccg

SEQ ID NO: 1509310 - RNA, 15 nt, Pseudomonas aeruginosa PA01
aucagcccgcugacc

SEQ ID NO: 1509311 - RNA, 14 nt, Pseudomonas aeruginosa PA01
aucagccgcaggca

SEQ ID NO: 1509312 - RNA, 15 nt, Pseudomonas aeruginosa PA01
aucagccgcaggcag

SEQ ID NO: 1509313 - RNA, 22 nt, Pseudomonas aeruginosa PA01
aucagccgcuccaggaucgccu

SEQ ID NO: 1509314 - RNA, 13 nt, Pseudomonas aeruginosa PA01
aucaucgccagcg

SEQ ID NO: 1509315 - RNA, 14 nt, Pseudomonas aeruginosa PA01
aucaucgccagcgg

SEQ ID NO: 1509316 - RNA, 16 nt, Pseudomonas aeruginosa PA01
aucaucaucagguaga

SEQ ID NO: 1509317 - RNA, 15 nt, Pseudomonas aeruginosa PA01
aucaucggcccuggg

SEQ ID NO: 1509318 - RNA, 22 nt, Pseudomonas aeruginosa PA01
aucagugacauccucccugccc

SEQ ID NO: 1509319 - RNA, 13 nt, Pseudomonas aeruginosa PA01
aucaguaccggca

SEQ ID NO: 1509320 - RNA, 17 nt, Pseudomonas aeruginosa PA01
aucaguacucuggccau

SEQ ID NO: 1509321 - RNA, 20 nt, Pseudomonas aeruginosa PA01
aucagucgucguccagcggg

SEQ ID NO: 1509322 - RNA, 13 nt, Pseudomonas aeruginosa PA01
aucaggucgccgc

SEQ ID NO: 1509323 - RNA, 14 nt, Pseudomonas aeruginosa PA01
aucaggucgccgcc

SEQ ID NO: 1509324 - RNA, 15 nt, Pseudomonas aeruginosa PA01
aucaggucgcgcgcc

SEQ ID NO: 1509325 - RNA, 11 nt, Pseudomonas aeruginosa PA01
aucaggucggc

SEQ ID NO: 1509326 - RNA, 15 nt, Pseudomonas aeruginosa PA01
aucaggucggccgcc

SEQ ID NO: 1509327 - RNA, 16 nt, Pseudomonas aeruginosa PA01
aucaggucggccgccu

SEQ ID NO: 1509328 - RNA, 20 nt, Pseudomonas aeruginosa PA01
aucaggucggucuggcggcc

SEQ ID NO: 1509329 - RNA, 13 nt, Pseudomonas aeruginosa PA01
aucaggucgccag

SEQ ID NO: 1509330 - RNA, 19 nt, Pseudomonas aeruginosa PA01
aucagcuucuucagcagcg

SEQ ID NO: 1509331 - RNA, 13 nt, Pseudomonas aeruginosa PA01
aucaggcugccga

SEQ ID NO: 1509332 - RNA, 17 nt, Pseudomonas aeruginosa PA01
aucagggcaccgccgag

SEQ ID NO: 1509333 - RNA, 13 nt, Pseudomonas aeruginosa PA01
aucagcuucagcu

SEQ ID NO: 1509334 - RNA, 16 nt, Pseudomonas aeruginosa PA01
aucagguaggccggcg

SEQ ID NO: 1509335 - RNA, 18 nt, Pseudomonas aeruginosa PA01
aucagcuccacgucggcc

SEQ ID NO: 1509336 - RNA, 20 nt, Pseudomonas aeruginosa PA01
aucagcuccacgucggcccg

SEQ ID NO: 1509337 - RNA, 19 nt, Pseudomonas aeruginosa PA01
aucagcucguugcccggcu

SEQ ID NO: 1509338 - RNA, 19 nt, Pseudomonas aeruginosa PA01
aucagcucgucuuucaggu

SEQ ID NO: 1509339 - RNA, 22 nt, Pseudomonas aeruginosa PA01
aucagcgucugcagcuugcgcg

SEQ ID NO: 1509340 - RNA, 22 nt, Pseudomonas aeruginosa PA01
aucccuuuuucauucuccagcc

SEQ ID NO: 1509341 - RNA, 15 nt, Pseudomonas aeruginosa PA01
auccgcccgaucgcc

SEQ ID NO: 1509342 - RNA, 18 nt, Pseudomonas aeruginosa PA01
auccgcccgaucgccucg

SEQ ID NO: 1509343 - RNA, 12 nt, Pseudomonas aeruginosa PA01
auccgccgccua

SEQ ID NO: 1509344 - RNA, 13 nt, Pseudomonas aeruginosa PA01
auccgccgccgac

SEQ ID NO: 1509345 - RNA, 12 nt, Pseudomonas aeruginosa PA01
auccgccgccgg

SEQ ID NO: 1509346 - RNA, 18 nt, Pseudomonas aeruginosa PA01
auccgccgcuacugcgcg

SEQ ID NO: 1509347 - RNA, 16 nt, Pseudomonas aeruginosa PA01
auccgccgcucccggc

SEQ ID NO: 1509348 - RNA, 15 nt, Pseudomonas aeruginosa PA01
auccgccgcugggga

SEQ ID NO: 1509349 - RNA, 16 nt, Pseudomonas aeruginosa PA01
auccgcccugcgcagc

SEQ ID NO: 1509350 - RNA, 13 nt, Pseudomonas aeruginosa PA01
auccgcgcggcaa

SEQ ID NO: 1509351 - RNA, 13 nt, Pseudomonas aeruginosa PA01
auccgcgccgacc

SEQ ID NO: 1509352 - RNA, 14 nt, Pseudomonas aeruginosa PA01
auccgcgccgacca

SEQ ID NO: 1509353 - RNA, 21 nt, Pseudomonas aeruginosa PA01
auccgcgccgaccagccgcag

SEQ ID NO: 1509354 - RNA, 22 nt, Pseudomonas aeruginosa PA01
auccgcgaauagggcggcgcca

SEQ ID NO: 1509355 - RNA, 19 nt, Pseudomonas aeruginosa PA01
auccgcgacaguucgccgc

SEQ ID NO: 1509356 - RNA, 21 nt, Pseudomonas aeruginosa PA01
auccgccggccggggcgcgcc

SEQ ID NO: 1509357 - RNA, 13 nt, Pseudomonas aeruginosa PA01
auccgccggcgcg

SEQ ID NO: 1509358 - RNA, 22 nt, Pseudomonas aeruginosa PA01
auccgccggcugugcagggcag

SEQ ID NO: 1509359 - RNA, 17 nt, Pseudomonas aeruginosa PA01
auccgccgggccgccuu

SEQ ID NO: 1509360 - RNA, 19 nt, Pseudomonas aeruginosa PA01
auccgccgugaggcgcgcg

SEQ ID NO: 1509361 - RNA, 12 nt, Pseudomonas aeruginosa PA01
auccgccgugga

SEQ ID NO: 1509362 - RNA, 23 nt, Pseudomonas aeruginosa PA01
auccgccguggaacgcaggggca

SEQ ID NO: 1509363 - RNA, 21 nt, Pseudomonas aeruginosa PA01
auccgccguuccuccucgccg

SEQ ID NO: 1509364 - RNA, 16 nt, Pseudomonas aeruginosa PA01
auccggcaccagucgc

SEQ ID NO: 1509365 - RNA, 14 nt, Pseudomonas aeruginosa PA01
auccggcgcugccg

SEQ ID NO: 1509366 - RNA, 15 nt, Pseudomonas aeruginosa PA01
auccggcgcugccga

SEQ ID NO: 1509367 - RNA, 22 nt, Pseudomonas aeruginosa PA01
auccggccgaucuccuggcggg

SEQ ID NO: 1509368 - RNA, 23 nt, Pseudomonas aeruginosa PA01
auccgcugguagcccaggccgaa

SEQ ID NO: 1509369 - RNA, 23 nt, Pseudomonas aeruginosa PA01
auccgcucuguagggucgcagca

SEQ ID NO: 1509370 - RNA, 16 nt, Pseudomonas aeruginosa PA01
auccggaguucgcccg

SEQ ID NO: 1509371 - RNA, 21 nt, Pseudomonas aeruginosa PA01
auccggaguucgcccgcccca

SEQ ID NO: 1509372 - RNA, 13 nt, Pseudomonas aeruginosa PA01
auccgcgccggug

SEQ ID NO: 1509373 - RNA, 16 nt, Pseudomonas aeruginosa PA01
auccgcgccgguggcc

SEQ ID NO: 1509374 - RNA, 22 nt, Pseudomonas aeruginosa PA01
auccgcggcccugcucgccggc

SEQ ID NO: 1509375 - RNA, 17 nt, Pseudomonas aeruginosa PA01
auccgcguggcgaugcc

SEQ ID NO: 1509376 - RNA, 16 nt, Pseudomonas aeruginosa PA01
auccgcguggcgugcu

SEQ ID NO: 1509377 - RNA, 22 nt, Pseudomonas aeruginosa PA01
auccgcguggcgugcucggcga

SEQ ID NO: 1509378 - RNA, 23 nt, Pseudomonas aeruginosa PA01
auccgcguggcgugcucggcgau

SEQ ID NO: 1509379 - RNA, 20 nt, Pseudomonas aeruginosa PA01
auccgcguuaccguccgcgc

SEQ ID NO: 1509380 - RNA, 13 nt, Pseudomonas aeruginosa PA01
auccgcuccagca

SEQ ID NO: 1509381 - RNA, 17 nt, Pseudomonas aeruginosa PA01
auccgcuccagcaguuc

SEQ ID NO: 1509382 - RNA, 23 nt, Pseudomonas aeruginosa PA01
auccgcuccagcaguucgucgcc

SEQ ID NO: 1509383 - RNA, 17 nt, Pseudomonas aeruginosa PA01
auccgcuccagcgccuc

SEQ ID NO: 1509384 - RNA, 23 nt, Pseudomonas aeruginosa PA01
auccucccugcccgcucggggca

SEQ ID NO: 1509385 - RNA, 14 nt, Pseudomonas aeruginosa PA01
auccgugcuggggg

SEQ ID NO: 1509386 - RNA, 20 nt, Pseudomonas aeruginosa PA01
auccguaaaauggcgcgccu

SEQ ID NO: 1509387 - RNA, 21 nt, Pseudomonas aeruginosa PA01
auccgucauacaacuguugcu

SEQ ID NO: 1509388 - RNA, 15 nt, Pseudomonas aeruginosa PA01
auccguacuggcgcc

SEQ ID NO: 1509389 - RNA, 20 nt, Pseudomonas aeruginosa PA01
auccggguggagaggcgugc

SEQ ID NO: 1509390 - RNA, 21 nt, Pseudomonas aeruginosa PA01
auccggguggagaggcgugcu

SEQ ID NO: 1509391 - RNA, 18 nt, Pseudomonas aeruginosa PA01
auccggcuggcgccggug

SEQ ID NO: 1509392 - RNA, 18 nt, Pseudomonas aeruginosa PA01
auccgggcggcgggcgca

SEQ ID NO: 1509393 - RNA, 19 nt, Pseudomonas aeruginosa PA01
auccgggcguagggcgaau

SEQ ID NO: 1509394 - RNA, 13 nt, Pseudomonas aeruginosa PA01
auccgggcguggg

SEQ ID NO: 1509395 - RNA, 19 nt, Pseudomonas aeruginosa PA01
auccgggcguggggcgaau

SEQ ID NO: 1509396 - RNA, 22 nt, Pseudomonas aeruginosa PA01
auccgggcguggggcgaauaac

SEQ ID NO: 1509397 - RNA, 13 nt, Pseudomonas aeruginosa PA01
auccuccugggga

SEQ ID NO: 1509398 - RNA, 22 nt, Pseudomonas aeruginosa PA01
auccucgccccgccgggagcgg

SEQ ID NO: 1509399 - RNA, 13 nt, Pseudomonas aeruginosa PA01
auccugccgccug

SEQ ID NO: 1509400 - RNA, 17 nt, Pseudomonas aeruginosa PA01
auccugaccccggccug

SEQ ID NO: 1509401 - RNA, 17 nt, Pseudomonas aeruginosa PA01
auccuggccggcggcgu

SEQ ID NO: 1509402 - RNA, 17 nt, Pseudomonas aeruginosa PA01
aucgaaaaaaggcgccu

SEQ ID NO: 1509403 - RNA, 14 nt, Pseudomonas aeruginosa PA01
auccuuggucaggg

SEQ ID NO: 1509404 - RNA, 10 nt, Pseudomonas aeruginosa PA01
auccuugccg

SEQ ID NO: 1509405 - RNA, 15 nt, Pseudomonas aeruginosa PA01
auccuugagcacccg

SEQ ID NO: 1509406 - RNA, 16 nt, Pseudomonas aeruginosa PA01
auccuucgcggcggcg

SEQ ID NO: 1509407 - RNA, 17 nt, Pseudomonas aeruginosa PA01
auccuucgcggcggcgc

SEQ ID NO: 1509408 - RNA, 20 nt, Pseudomonas aeruginosa PA01
auccugggcgccagccgcca

SEQ ID NO: 1509409 - RNA, 22 nt, Pseudomonas aeruginosa PA01
auccuggcgguucuggguggca

SEQ ID NO: 1509410 - RNA, 20 nt, Pseudomonas aeruginosa PA01
auccuguaguacaugacgaa

SEQ ID NO: 1509411 - RNA, 11 nt, Pseudomonas aeruginosa PA01
auccuguccgu

SEQ ID NO: 1509412 - RNA, 14 nt, Pseudomonas aeruginosa PA01
auccagcaccgcuu

SEQ ID NO: 1509413 - RNA, 15 nt, Pseudomonas aeruginosa PA01
auccacgccgucgca

SEQ ID NO: 1509414 - RNA, 20 nt, Pseudomonas aeruginosa PA01
auccacgcugugcggcagca

SEQ ID NO: 1509415 - RNA, 16 nt, Pseudomonas aeruginosa PA01
auccagaagaucagcg

SEQ ID NO: 1509416 - RNA, 16 nt, Pseudomonas aeruginosa PA01
auccacuugccgccgc

SEQ ID NO: 1509417 - RNA, 18 nt, Pseudomonas aeruginosa PA01
auccacuugccgccgccg

SEQ ID NO: 1509418 - RNA, 20 nt, Pseudomonas aeruginosa PA01
auccacuugccgccgccgga

SEQ ID NO: 1509419 - RNA, 21 nt, Pseudomonas aeruginosa PA01
auccacuugccgccgccggag

SEQ ID NO: 1509420 - RNA, 15 nt, Pseudomonas aeruginosa PA01
auccagggccgagca

SEQ ID NO: 1509421 - RNA, 20 nt, Pseudomonas aeruginosa PA01
auccagggagaacagcaggg

SEQ ID NO: 1509422 - RNA, 13 nt, Pseudomonas aeruginosa PA01
auccaggcguggg

SEQ ID NO: 1509423 - RNA, 22 nt, Pseudomonas aeruginosa PA01
auccaggcuuuccaccgccagc

SEQ ID NO: 1509424 - RNA, 21 nt, Pseudomonas aeruginosa PA01
auccagguaaaggccaccaga

SEQ ID NO: 1509425 - RNA, 16 nt, Pseudomonas aeruginosa PA01
auccagcagucgcggc

SEQ ID NO: 1509426 - RNA, 22 nt, Pseudomonas aeruginosa PA01
auccagccaggcgcucucgccg

SEQ ID NO: 1509427 - RNA, 15 nt, Pseudomonas aeruginosa PA01
auccagcggcagccc

SEQ ID NO: 1509428 - RNA, 16 nt, Pseudomonas aeruginosa PA01
auccagcggccgcgag

SEQ ID NO: 1509429 - RNA, 22 nt, Pseudomonas aeruginosa PA01
auccaccgucgcggucaucgcc

SEQ ID NO: 1509430 - RNA, 13 nt, Pseudomonas aeruginosa PA01
auccaccgccagg

SEQ ID NO: 1509431 - RNA, 19 nt, Pseudomonas aeruginosa PA01
auccaccggacccggcugc

SEQ ID NO: 1509432 - RNA, 15 nt, Pseudomonas aeruginosa PA01
auccaccuugccgcg

SEQ ID NO: 1509433 - RNA, 17 nt, Pseudomonas aeruginosa PA01
auccaccuugccgcgcc

SEQ ID NO: 1509434 - RNA, 18 nt, Pseudomonas aeruginosa PA01
auccacgacgucggcggc

SEQ ID NO: 1509435 - RNA, 15 nt, Pseudomonas aeruginosa PA01
aucccggagaucggc

SEQ ID NO: 1509436 - RNA, 17 nt, Pseudomonas aeruginosa PA01
aucccgccgccgcgccu

SEQ ID NO: 1509437 - RNA, 19 nt, Pseudomonas aeruginosa PA01
aucccgacgcccuccagca

SEQ ID NO: 1509438 - RNA, 16 nt, Pseudomonas aeruginosa PA01
auccccucccgcgcca

SEQ ID NO: 1509439 - RNA, 22 nt, Pseudomonas aeruginosa PA01
auccccucccgcgccagcgccg

SEQ ID NO: 1509440 - RNA, 18 nt, Pseudomonas aeruginosa PA01
aucccugugcgguaacga

SEQ ID NO: 1509441 - RNA, 22 nt, Pseudomonas aeruginosa PA01
aucccucuaucacacuguccag

SEQ ID NO: 1509442 - RNA, 21 nt, Pseudomonas aeruginosa PA01
aucccgggguugcccagcagg

SEQ ID NO: 1509443 - RNA, 17 nt, Pseudomonas aeruginosa PA01
aucccggcugagcgcca

SEQ ID NO: 1509444 - RNA, 20 nt, Pseudomonas aeruginosa PA01
aucccggcugagcgccaggc

SEQ ID NO: 1509445 - RNA, 21 nt, Pseudomonas aeruginosa PA01
aucccggcugagcgccaggcg

SEQ ID NO: 1509446 - RNA, 14 nt, Pseudomonas aeruginosa PA01
auccagguucaccc

SEQ ID NO: 1509447 - RNA, 13 nt, Pseudomonas aeruginosa PA01
auccccgccucga

SEQ ID NO: 1509448 - RNA, 20 nt, Pseudomonas aeruginosa PA01
auccccggaccagggcgccg

SEQ ID NO: 1509449 - RNA, 15 nt, Pseudomonas aeruginosa PA01
aucccaggucggcgg

SEQ ID NO: 1509450 - RNA, 16 nt, Pseudomonas aeruginosa PA01
aucccaggucggcggg

SEQ ID NO: 1509451 - RNA, 17 nt, Pseudomonas aeruginosa PA01
agcgagacgggcgaggc

SEQ ID NO: 1509452 - RNA, 16 nt, Pseudomonas aeruginosa PA01
agcgagaccucgccca

SEQ ID NO: 1509453 - RNA, 13 nt, Pseudomonas aeruginosa PA01
agcgagccgauca

SEQ ID NO: 1509454 - RNA, 17 nt, Pseudomonas aeruginosa PA01
agcgagccgaucaccag

SEQ ID NO: 1509455 - RNA, 16 nt, Pseudomonas aeruginosa PA01
agcgagagcuguccgg

SEQ ID NO: 1509456 - RNA, 16 nt, Pseudomonas aeruginosa PA01
agcgacgacuugccca

SEQ ID NO: 1509457 - RNA, 17 nt, Pseudomonas aeruginosa PA01
agcgacugcgcuggccg

SEQ ID NO: 1509458 - RNA, 18 nt, Pseudomonas aeruginosa PA01
agcgacugcgcuggccga

SEQ ID NO: 1509459 - RNA, 20 nt, Pseudomonas aeruginosa PA01
agcgacugcgcuggccgagc

SEQ ID NO: 1509460 - RNA, 13 nt, Pseudomonas aeruginosa PA01
agcgacuggcccu

SEQ ID NO: 1509461 - RNA, 16 nt, Pseudomonas aeruginosa PA01
agcgacuggcccuggu

SEQ ID NO: 1509462 - RNA, 14 nt, Pseudomonas aeruginosa PA01
agcgagacccggua

SEQ ID NO: 1509463 - RNA, 14 nt, Pseudomonas aeruginosa PA01
agcgaccaguugcu

SEQ ID NO: 1509464 - RNA, 21 nt, Pseudomonas aeruginosa PA01
agcgaccaguugcucgcuccg

SEQ ID NO: 1509465 - RNA, 18 nt, Pseudomonas aeruginosa PA01
agcgaaggcuccgcugcu

SEQ ID NO: 1509466 - RNA, 19 nt, Pseudomonas aeruginosa PA01
agcgaagugcgcugcuuga

SEQ ID NO: 1509467 - RNA, 15 nt, Pseudomonas aeruginosa PA01
agcgaaccgccggcc

SEQ ID NO: 1509468 - RNA, 17 nt, Pseudomonas aeruginosa PA01
agcgaacgacagcgaau

SEQ ID NO: 1509469 - RNA, 14 nt, Pseudomonas aeruginosa PA01
agcgaacgccgcag

SEQ ID NO: 1509470 - RNA, 17 nt, Pseudomonas aeruginosa PA01
agcgaccaccaccaggu

SEQ ID NO: 1509471 - RNA, 16 nt, Pseudomonas aeruginosa PA01
agcgaauacaccgagc

SEQ ID NO: 1509472 - RNA, 13 nt, Pseudomonas aeruginosa PA01
agcgacccgcuga

SEQ ID NO: 1509473 - RNA, 17 nt, Pseudomonas aeruginosa PA01
agcgacccgcugaagga

SEQ ID NO: 1509474 - RNA, 19 nt, Pseudomonas aeruginosa PA01
agcgacccuucaacggcga

SEQ ID NO: 1509475 - RNA, 20 nt, Pseudomonas aeruginosa PA01
agcgacccuucaacggcgac

SEQ ID NO: 1509476 - RNA, 21 nt, Pseudomonas aeruginosa PA01
agcgacccuucaacggcgacc

SEQ ID NO: 1509477 - RNA, 16 nt, Pseudomonas aeruginosa PA01
agcgaccgaucaugcc

SEQ ID NO: 1509478 - RNA, 16 nt, Pseudomonas aeruginosa PA01
agcgcaacgcgcgcag

SEQ ID NO: 1509479 - RNA, 14 nt, Pseudomonas aeruginosa PA01
agcgcaacgcgguu

SEQ ID NO: 1509480 - RNA, 20 nt, Pseudomonas aeruginosa PA01
agcgcaacgaaaagccgccc

SEQ ID NO: 1509481 - RNA, 15 nt, Pseudomonas aeruginosa PA01
agcgcagcaccggcu

SEQ ID NO: 1509482 - RNA, 17 nt, Pseudomonas aeruginosa PA01
agcgaucccaggucggc

SEQ ID NO: 1509483 - RNA, 21 nt, Pseudomonas aeruginosa PA01
agcgaucuccugccgcggcga

SEQ ID NO: 1509484 - RNA, 20 nt, Pseudomonas aeruginosa PA01
agcgauguccaggccgaucu

SEQ ID NO: 1509485 - RNA, 14 nt, Pseudomonas aeruginosa PA01
agcgauugaacucg

SEQ ID NO: 1509486 - RNA, 12 nt, Pseudomonas aeruginosa PA01
agcgccagcaac

SEQ ID NO: 1509487 - RNA, 15 nt, Pseudomonas aeruginosa PA01
agcgccagcaggcga

SEQ ID NO: 1509488 - RNA, 13 nt, Pseudomonas aeruginosa PA01
agcgccagcaggu

SEQ ID NO: 1509489 - RNA, 14 nt, Pseudomonas aeruginosa PA01
agcgccagccagcg

SEQ ID NO: 1509490 - RNA, 15 nt, Pseudomonas aeruginosa PA01
agcgccagccagcgc

SEQ ID NO: 1509491 - RNA, 17 nt, Pseudomonas aeruginosa PA01
agcgccagccagcgcgg

SEQ ID NO: 1509492 - RNA, 19 nt, Pseudomonas aeruginosa PA01
agcgccagccagcgcggcu

SEQ ID NO: 1509493 - RNA, 17 nt, Pseudomonas aeruginosa PA01
agcgccagccaggguac

SEQ ID NO: 1509494 - RNA, 21 nt, Pseudomonas aeruginosa PA01
agcgcccaggugcgagucacc

SEQ ID NO: 1509495 - RNA, 17 nt, Pseudomonas aeruginosa PA01
agcgccccaccaggcuc

SEQ ID NO: 1509496 - RNA, 20 nt, Pseudomonas aeruginosa PA01
agcgccccagcaccucgccg

SEQ ID NO: 1509497 - RNA, 23 nt, Pseudomonas aeruginosa PA01
agcgcccagacacgccucaaggc

SEQ ID NO: 1509498 - RNA, 19 nt, Pseudomonas aeruginosa PA01
agcgcccaggccgggucgc

SEQ ID NO: 1509499 - RNA, 12 nt, Pseudomonas aeruginosa PA01
agcgccaugcuc

SEQ ID NO: 1509500 - RNA, 22 nt, Pseudomonas aeruginosa PA01
agcgccaugacccgcggcaggu

SEQ ID NO: 1509501 - RNA, 15 nt, Pseudomonas aeruginosa PA01
agcgccggcaccgag

SEQ ID NO: 1509502 - RNA, 15 nt, Pseudomonas aeruginosa PA01
agcgccgcggcuggc

SEQ ID NO: 1509503 - RNA, 16 nt, Pseudomonas aeruginosa PA01
agcgccgcggcuggcc

SEQ ID NO: 1509504 - RNA, 23 nt, Pseudomonas aeruginosa PA01
agcgccgcggcuggccauccgcc

SEQ ID NO: 1509505 - RNA, 19 nt, Pseudomonas aeruginosa PA01
agcgccgcggugucggcga

SEQ ID NO: 1509506 - RNA, 13 nt, Pseudomonas aeruginosa PA01
agcgcccgcacca

SEQ ID NO: 1509507 - RNA, 15 nt, Pseudomonas aeruginosa PA01
agcgccccgccuacc

SEQ ID NO: 1509508 - RNA, 18 nt, Pseudomonas aeruginosa PA01
agcgccccggccgcgcca

SEQ ID NO: 1509509 - RNA, 23 nt, Pseudomonas aeruginosa PA01
agcgccccggccgcgccagccac

SEQ ID NO: 1509510 - RNA, 20 nt, Pseudomonas aeruginosa PA01
agcgccccuuggccagcacc

SEQ ID NO: 1509511 - RNA, 21 nt, Pseudomonas aeruginosa PA01
agcgccccuuggccagcacca

SEQ ID NO: 1509512 - RNA, 19 nt, Pseudomonas aeruginosa PA01
agcgcccgagucccuugcg

SEQ ID NO: 1509513 - RNA, 18 nt, Pseudomonas aeruginosa PA01
agcgcccgauaggcgccg

SEQ ID NO: 1509514 - RNA, 20 nt, Pseudomonas aeruginosa PA01
agcgcccgauaggcgccggc

SEQ ID NO: 1509515 - RNA, 22 nt, Pseudomonas aeruginosa PA01
agcgcccgaugaucgagcgcac

SEQ ID NO: 1509516 - RNA, 21 nt, Pseudomonas aeruginosa PA01
agcgccgcgcgcuuguggcga

SEQ ID NO: 1509517 - RNA, 15 nt, Pseudomonas aeruginosa PA01
agcgccgcgcggcaa

SEQ ID NO: 1509518 - RNA, 13 nt, Pseudomonas aeruginosa PA01
agcgccgcggccc

SEQ ID NO: 1509519 - RNA, 13 nt, Pseudomonas aeruginosa PA01
agcgccgcggcga

SEQ ID NO: 1509520 - RNA, 15 nt, Pseudomonas aeruginosa PA01
agcgccgcggcgaac

SEQ ID NO: 1509521 - RNA, 17 nt, Pseudomonas aeruginosa PA01
agcgccaccagcagggc

SEQ ID NO: 1509522 - RNA, 13 nt, Pseudomonas aeruginosa PA01
agcgccaccagga

SEQ ID NO: 1509523 - RNA, 13 nt, Pseudomonas aeruginosa PA01
agcgccacgcuga

SEQ ID NO: 1509524 - RNA, 21 nt, Pseudomonas aeruginosa PA01
agcgccacgcugaucaucagc

SEQ ID NO: 1509525 - RNA, 16 nt, Pseudomonas aeruginosa PA01
agcgccacggccagca

SEQ ID NO: 1509526 - RNA, 13 nt, Pseudomonas aeruginosa PA01
agcgccacggcga

SEQ ID NO: 1509527 - RNA, 19 nt, Pseudomonas aeruginosa PA01
agcgccacggugaucugga

SEQ ID NO: 1509528 - RNA, 18 nt, Pseudomonas aeruginosa PA01
agcgcaugaggcuggcca

SEQ ID NO: 1509529 - RNA, 20 nt, Pseudomonas aeruginosa PA01
agcgcaugaggcuggccagc

SEQ ID NO: 1509530 - RNA, 19 nt, Pseudomonas aeruginosa PA01
agcgcaugccguuggccga

SEQ ID NO: 1509531 - RNA, 17 nt, Pseudomonas aeruginosa PA01
agcgcaucgaggccggc

SEQ ID NO: 1509532 - RNA, 15 nt, Pseudomonas aeruginosa PA01
agcgcaguucgucgc

SEQ ID NO: 1509533 - RNA, 19 nt, Pseudomonas aeruginosa PA01
agcgcaguucgucgcccau

SEQ ID NO: 1509534 - RNA, 12 nt, Pseudomonas aeruginosa PA01
agcgcagcaggu

SEQ ID NO: 1509535 - RNA, 19 nt, Pseudomonas aeruginosa PA01
agcgcagccauucgccgcg

SEQ ID NO: 1509536 - RNA, 13 nt, Pseudomonas aeruginosa PA01
agcgcaguucgcc

SEQ ID NO: 1509537 - RNA, 18 nt, Pseudomonas aeruginosa PA01
agcgcagccgcucggccg

SEQ ID NO: 1509538 - RNA, 17 nt, Pseudomonas aeruginosa PA01
agcgcaggugcaccgcg

SEQ ID NO: 1509539 - RNA, 18 nt, Pseudomonas aeruginosa PA01
agcgcaggugcaccgcgc

SEQ ID NO: 1509540 - RNA, 18 nt, Pseudomonas aeruginosa PA01
agcgcagguugcgcuggc

SEQ ID NO: 1509541 - RNA, 21 nt, Pseudomonas aeruginosa PA01
agcgcagguugcgcuggcgca

SEQ ID NO: 1509542 - RNA, 16 nt, Pseudomonas aeruginosa PA01
agccuucagcacggcg

SEQ ID NO: 1509543 - RNA, 20 nt, Pseudomonas aeruginosa PA01
agccuucagcacggcgcggg

SEQ ID NO: 1509544 - RNA, 14 nt, Pseudomonas aeruginosa PA01
agccugcggccagc

SEQ ID NO: 1509545 - RNA, 15 nt, Pseudomonas aeruginosa PA01
agccugcggccagcg

SEQ ID NO: 1509546 - RNA, 17 nt, Pseudomonas aeruginosa PA01
agccugcggccagcgcc

SEQ ID NO: 1509547 - RNA, 15 nt, Pseudomonas aeruginosa PA01
agccugccagaccga

SEQ ID NO: 1509548 - RNA, 14 nt, Pseudomonas aeruginosa PA01
agccugccgggcaa

SEQ ID NO: 1509549 - RNA, 14 nt, Pseudomonas aeruginosa PA01
agccuccacccgga

SEQ ID NO: 1509550 - RNA, 14 nt, Pseudomonas aeruginosa PA01
agccucggcagggc

SEQ ID NO: 1509551 - RNA, 21 nt, Pseudomonas aeruginosa PA01
agccucggcagggcgcccgcc

SEQ ID NO: 1509552 - RNA, 22 nt, Pseudomonas aeruginosa PA01
agccucggcagggcgcccgccc

SEQ ID NO: 1509553 - RNA, 12 nt, Pseudomonas aeruginosa PA01
agccucggcgaa

SEQ ID NO: 1509554 - RNA, 15 nt, Pseudomonas aeruginosa PA01
agccucggcgaaguc

SEQ ID NO: 1509555 - RNA, 22 nt, Pseudomonas aeruginosa PA01
agccucuaaggaaaaacccggc

SEQ ID NO: 1509556 - RNA, 21 nt, Pseudomonas aeruginosa PA01
agccuucgcccagguaggcga

SEQ ID NO: 1509557 - RNA, 15 nt, Pseudomonas aeruginosa PA01
agccuuccggcacca

SEQ ID NO: 1509558 - RNA, 18 nt, Pseudomonas aeruginosa PA01
agccuuccuucucgaagc

SEQ ID NO: 1509559 - RNA, 19 nt, Pseudomonas aeruginosa PA01
agccuuccuucucgaagcc

SEQ ID NO: 1509560 - RNA, 12 nt, Pseudomonas aeruginosa PA01
agccuucgucga

SEQ ID NO: 1509561 - RNA, 21 nt, Pseudomonas aeruginosa PA01
agccuucgucgaugaacagcg

SEQ ID NO: 1509562 - RNA, 16 nt, Pseudomonas aeruginosa PA01
agccuugcggcgcucg

SEQ ID NO: 1509563 - RNA, 13 nt, Pseudomonas aeruginosa PA01
agcgaaccaggca

SEQ ID NO: 1509564 - RNA, 22 nt, Pseudomonas aeruginosa PA01
agcgaacccaggccgcgcagca

SEQ ID NO: 1509565 - RNA, 13 nt, Pseudomonas aeruginosa PA01
agcgaaaacagcc

SEQ ID NO: 1509566 - RNA, 16 nt, Pseudomonas aeruginosa PA01
agcgaaacucgugcuc

SEQ ID NO: 1509567 - RNA, 17 nt, Pseudomonas aeruginosa PA01
agccguuguagaucggc

SEQ ID NO: 1509568 - RNA, 21 nt, Pseudomonas aeruginosa PA01
agccguuguagaucggcagca

SEQ ID NO: 1509569 - RNA, 14 nt, Pseudomonas aeruginosa PA01
agccguuggccagc

SEQ ID NO: 1509570 - RNA, 15 nt, Pseudomonas aeruginosa PA01
agccguuggccagca

SEQ ID NO: 1509571 - RNA, 18 nt, Pseudomonas aeruginosa PA01
agccguuggccagcaggc

SEQ ID NO: 1509572 - RNA, 19 nt, Pseudomonas aeruginosa PA01
agccguuggccagcaggcg

SEQ ID NO: 1509573 - RNA, 16 nt, Pseudomonas aeruginosa PA01
agccucaggcgcugcg

SEQ ID NO: 1509574 - RNA, 12 nt, Pseudomonas aeruginosa PA01
agccucacccug

SEQ ID NO: 1509575 - RNA, 16 nt, Pseudomonas aeruginosa PA01
agccucaagccucgcc

SEQ ID NO: 1509576 - RNA, 18 nt, Pseudomonas aeruginosa PA01
agccucccgccgcggcgu

SEQ ID NO: 1509577 - RNA, 22 nt, Pseudomonas aeruginosa PA01
agccuccuccggcucgcugacg

SEQ ID NO: 1509578 - RNA, 19 nt, Pseudomonas aeruginosa PA01
agccgggccgcagcgcagc

SEQ ID NO: 1509579 - RNA, 18 nt, Pseudomonas aeruginosa PA01
agccgggcuccgccgcga

SEQ ID NO: 1509580 - RNA, 16 nt, Pseudomonas aeruginosa PA01
agccgucgaacagcag

SEQ ID NO: 1509581 - RNA, 22 nt, Pseudomonas aeruginosa PA01
agccgucgaacagcagcucgcc

SEQ ID NO: 1509582 - RNA, 13 nt, Pseudomonas aeruginosa PA01
agccgucggcgau

SEQ ID NO: 1509583 - RNA, 16 nt, Pseudomonas aeruginosa PA01
agccgucggcgaucgc

SEQ ID NO: 1509584 - RNA, 14 nt, Pseudomonas aeruginosa PA01
agccgucgccggcg

SEQ ID NO: 1509585 - RNA, 21 nt, Pseudomonas aeruginosa PA01
agccgucguagcgcagcggca

SEQ ID NO: 1509586 - RNA, 23 nt, Pseudomonas aeruginosa PA01
agccgucguagcgcagcggcagg

SEQ ID NO: 1509587 - RNA, 21 nt, Pseudomonas aeruginosa PA01
agccggccaaccaccggcgca

SEQ ID NO: 1509588 - RNA, 22 nt, Pseudomonas aeruginosa PA01
agccggccaaccaccggcgcac

SEQ ID NO: 1509589 - RNA, 19 nt, Pseudomonas aeruginosa PA01
agccggccaugcuggcgcu

SEQ ID NO: 1509590 - RNA, 13 nt, Pseudomonas aeruginosa PA01
agccggccaggcg

SEQ ID NO: 1509591 - RNA, 22 nt, Pseudomonas aeruginosa PA01
agccggccgaucuucagcagca

SEQ ID NO: 1509592 - RNA, 19 nt, Pseudomonas aeruginosa PA01
agccggcccauccgccgca

SEQ ID NO: 1509593 - RNA, 20 nt, Pseudomonas aeruginosa PA01
agccggccccugggccggcu

SEQ ID NO: 1509594 - RNA, 15 nt, Pseudomonas aeruginosa PA01
agccggcgaacaggu

SEQ ID NO: 1509595 - RNA, 17 nt, Pseudomonas aeruginosa PA01
agccggcgaaccaggcg

SEQ ID NO: 1509596 - RNA, 20 nt, Pseudomonas aeruginosa PA01
agccggcgaagggcaggccg

SEQ ID NO: 1509597 - RNA, 17 nt, Pseudomonas aeruginosa PA01
agccggcgaucagcgcu

SEQ ID NO: 1509598 - RNA, 18 nt, Pseudomonas aeruginosa PA01
agccggcgauccgcugca

SEQ ID NO: 1509599 - RNA, 12 nt, Pseudomonas aeruginosa PA01
agccggcgaugc

SEQ ID NO: 1509600 - RNA, 13 nt, Pseudomonas aeruginosa PA01
agccggcgaugcc

SEQ ID NO: 1509601 - RNA, 17 nt, Pseudomonas aeruginosa PA01
agccggcgaugccgccc

SEQ ID NO: 1509602 - RNA, 21 nt, Pseudomonas aeruginosa PA01
agccggcgaugccgcccagca

SEQ ID NO: 1509603 - RNA, 14 nt, Pseudomonas aeruginosa PA01
agccggcgaugugc

SEQ ID NO: 1509604 - RNA, 21 nt, Pseudomonas aeruginosa PA01
agccggcgaugugcggcgugg

SEQ ID NO: 1509605 - RNA, 22 nt, Pseudomonas aeruginosa PA01
agccggcgaugugcggcguggc

SEQ ID NO: 1509606 - RNA, 17 nt, Pseudomonas aeruginosa PA01
agccggcgacgcaggac

SEQ ID NO: 1509607 - RNA, 14 nt, Pseudomonas aeruginosa PA01
agccggcgagcgcc

SEQ ID NO: 1509608 - RNA, 17 nt, Pseudomonas aeruginosa PA01
agccggcgcgcccggcg

SEQ ID NO: 1509609 - RNA, 14 nt, Pseudomonas aeruginosa PA01
agccggcgcggcgc

SEQ ID NO: 1509610 - RNA, 15 nt, Pseudomonas aeruginosa PA01
agccggcgcggcgca

SEQ ID NO: 1509611 - RNA, 20 nt, Pseudomonas aeruginosa PA01
agccggcgcggcgcagcggc

SEQ ID NO: 1509612 - RNA, 21 nt, Pseudomonas aeruginosa PA01
agccggcgcggcgcagcggcg

SEQ ID NO: 1509613 - RNA, 23 nt, Pseudomonas aeruginosa PA01
agccggcgcugguugaggucgac

SEQ ID NO: 1509614 - RNA, 17 nt, Pseudomonas aeruginosa PA01
agccggcggcgcggcag

SEQ ID NO: 1509615 - RNA, 12 nt, Pseudomonas aeruginosa PA01
agccggcggcga

SEQ ID NO: 1509616 - RNA, 13 nt, Pseudomonas aeruginosa PA01
agccggcugaugc

SEQ ID NO: 1509617 - RNA, 16 nt, Pseudomonas aeruginosa PA01
agccggcuuccucgcc

SEQ ID NO: 1509618 - RNA, 17 nt, Pseudomonas aeruginosa PA01
agccgggcaccgucacc

SEQ ID NO: 1509619 - RNA, 13 nt, Pseudomonas aeruginosa PA01
agccgggcagccg

SEQ ID NO: 1509620 - RNA, 15 nt, Pseudomonas aeruginosa PA01
agccgggcagccguu

SEQ ID NO: 1509621 - RNA, 21 nt, Pseudomonas aeruginosa PA01
agccgggaucuccucgacggc

SEQ ID NO: 1509622 - RNA, 23 nt, Pseudomonas aeruginosa PA01
agccgggaucuccucgacggcgg

SEQ ID NO: 1509623 - RNA, 16 nt, Pseudomonas aeruginosa PA01
agccgggaagccgcuc

SEQ ID NO: 1509624 - RNA, 18 nt, Pseudomonas aeruginosa PA01
agccgggaagccgcucgg

SEQ ID NO: 1509625 - RNA, 16 nt, Pseudomonas aeruginosa PA01
agccggaagcgcucgc

SEQ ID NO: 1509626 - RNA, 16 nt, Pseudomonas aeruginosa PA01
agccggaccagccguc

SEQ ID NO: 1509627 - RNA, 22 nt, Pseudomonas aeruginosa PA01
agccggaccucucucgcugcgc

SEQ ID NO: 1509628 - RNA, 19 nt, Pseudomonas aeruginosa PA01
agccggcacgguagccgcc

SEQ ID NO: 1509629 - RNA, 15 nt, Pseudomonas aeruginosa PA01
agccggcauccagca

SEQ ID NO: 1509630 - RNA, 21 nt, Pseudomonas aeruginosa PA01
agccggcauccagcauccgug

SEQ ID NO: 1509631 - RNA, 16 nt, Pseudomonas aeruginosa PA01
agccggcaagcgugcc

SEQ ID NO: 1509632 - RNA, 20 nt, Pseudomonas aeruginosa PA01
agccggcaagcgugccccga

SEQ ID NO: 1509633 - RNA, 18 nt, Pseudomonas aeruginosa PA01
agccggaggcagcgaugc

SEQ ID NO: 1509634 - RNA, 22 nt, Pseudomonas aeruginosa PA01
agccggauagaucaggccggcg

SEQ ID NO: 1509635 - RNA, 15 nt, Pseudomonas aeruginosa PA01
agccggauucgcgca

SEQ ID NO: 1509636 - RNA, 16 nt, Pseudomonas aeruginosa PA01
agccggauucgcgcag

SEQ ID NO: 1509637 - RNA, 21 nt, Pseudomonas aeruginosa PA01
agccggauucgcgcagcaggc

SEQ ID NO: 1509638 - RNA, 14 nt, Pseudomonas aeruginosa PA01
agccgcuggcgucg

SEQ ID NO: 1509639 - RNA, 20 nt, Pseudomonas aeruginosa PA01
agccgcugcggcucgccgau

SEQ ID NO: 1509640 - RNA, 22 nt, Pseudomonas aeruginosa PA01
agccgcuuggagcgggcgccgg

SEQ ID NO: 1509641 - RNA, 21 nt, Pseudomonas aeruginosa PA01
agccgcuuccggcgcuccaca

SEQ ID NO: 1509642 - RNA, 21 nt, Pseudomonas aeruginosa PA01
agccgcucggcguagccggcg

SEQ ID NO: 1509643 - RNA, 13 nt, Pseudomonas aeruginosa PA01
agccgcucggccg

SEQ ID NO: 1509644 - RNA, 13 nt, Pseudomonas aeruginosa PA01
agccgcucggcgu

SEQ ID NO: 1509645 - RNA, 13 nt, Pseudomonas aeruginosa PA01
agcccuucgacgu

SEQ ID NO: 1509646 - RNA, 14 nt, Pseudomonas aeruginosa PA01
agcccuugauccac

SEQ ID NO: 1509647 - RNA, 21 nt, Pseudomonas aeruginosa PA01
agccgaacggguagagcgggc

SEQ ID NO: 1509648 - RNA, 18 nt, Pseudomonas aeruginosa PA01
agccgaacaguucggcgg

SEQ ID NO: 1509649 - RNA, 12 nt, Pseudomonas aeruginosa PA01
agccgaacuccg

SEQ ID NO: 1509650 - RNA, 16 nt, Pseudomonas aeruginosa PA01
agccgaacuccgccag

SEQ ID NO: 1509651 - RNA, 18 nt, Pseudomonas aeruginosa PA01
agccgaacuccgccagca

SEQ ID NO: 1509652 - RNA, 21 nt, Pseudomonas aeruginosa PA01
agccgaacuccgccagcacca

SEQ ID NO: 1509653 - RNA, 17 nt, Pseudomonas aeruginosa PA01
agccgaggucgccgcca

SEQ ID NO: 1509654 - RNA, 14 nt, Pseudomonas aeruginosa PA01
agccgagcugccgg

SEQ ID NO: 1509655 - RNA, 17 nt, Pseudomonas aeruginosa PA01
agccgagcugccgggcg

SEQ ID NO: 1509656 - RNA, 16 nt, Pseudomonas aeruginosa PA01
agccgaggcagccguc

SEQ ID NO: 1509657 - RNA, 16 nt, Pseudomonas aeruginosa PA01
agccgaucaacgcggc

SEQ ID NO: 1509658 - RNA, 20 nt, Pseudomonas aeruginosa PA01
agccgaucaacgcggccagc

SEQ ID NO: 1509659 - RNA, 21 nt, Pseudomonas aeruginosa PA01
agccgaucaacgcggccagca

SEQ ID NO: 1509660 - RNA, 15 nt, Pseudomonas aeruginosa PA01
agccgaucaccagca

SEQ ID NO: 1509661 - RNA, 16 nt, Pseudomonas aeruginosa PA01
agccgaucaccagcaa

SEQ ID NO: 1509662 - RNA, 17 nt, Pseudomonas aeruginosa PA01
agccgaucaccagcaau

SEQ ID NO: 1509663 - RNA, 15 nt, Pseudomonas aeruginosa PA01
agccgaucaggucgc

SEQ ID NO: 1509664 - RNA, 13 nt, Pseudomonas aeruginosa PA01
agccgcagcgccc

SEQ ID NO: 1509665 - RNA, 15 nt, Pseudomonas aeruginosa PA01
agccgcagcccgguc

SEQ ID NO: 1509666 - RNA, 23 nt, Pseudomonas aeruginosa PA01
agccgcagcccgguccguccagc

SEQ ID NO: 1509667 - RNA, 14 nt, Pseudomonas aeruginosa PA01
agccgaucgaagaa

SEQ ID NO: 1509668 - RNA, 19 nt, Pseudomonas aeruginosa PA01
agccgaugaaauagccggc

SEQ ID NO: 1509669 - RNA, 16 nt, Pseudomonas aeruginosa PA01
agccgcagaugcucca

SEQ ID NO: 1509670 - RNA, 21 nt, Pseudomonas aeruginosa PA01
agccgcaggaugccgccugcg

SEQ ID NO: 1509671 - RNA, 20 nt, Pseudomonas aeruginosa PA01
agccgcgacgacugcggcag

SEQ ID NO: 1509672 - RNA, 14 nt, Pseudomonas aeruginosa PA01
agccgcgacgcgac

SEQ ID NO: 1509673 - RNA, 15 nt, Pseudomonas aeruginosa PA01
agccgcgacgcgacc

SEQ ID NO: 1509674 - RNA, 17 nt, Pseudomonas aeruginosa PA01
agccgcgacggcugcuc

SEQ ID NO: 1509675 - RNA, 20 nt, Pseudomonas aeruginosa PA01
agccgcgaguccuucggcgc

SEQ ID NO: 1509676 - RNA, 21 nt, Pseudomonas aeruginosa PA01
agccgcgaguccuucggcgca

SEQ ID NO: 1509677 - RNA, 17 nt, Pseudomonas aeruginosa PA01
agccgcgacucggcugc

SEQ ID NO: 1509678 - RNA, 14 nt, Pseudomonas aeruginosa PA01
agccgccgccgaga

SEQ ID NO: 1509679 - RNA, 19 nt, Pseudomonas aeruginosa PA01
agccgccgccgagaacccg

SEQ ID NO: 1509680 - RNA, 15 nt, Pseudomonas aeruginosa PA01
agccgccgccgcgcc

SEQ ID NO: 1509681 - RNA, 16 nt, Pseudomonas aeruginosa PA01
agccgccgccgcgccg

SEQ ID NO: 1509682 - RNA, 12 nt, Pseudomonas aeruginosa PA01
agccgccgcugc

SEQ ID NO: 1509683 - RNA, 17 nt, Pseudomonas aeruginosa PA01
agccgccgcugcaccga

SEQ ID NO: 1509684 - RNA, 17 nt, Pseudomonas aeruginosa PA01
agccgccgcggcaccgg

SEQ ID NO: 1509685 - RNA, 21 nt, Pseudomonas aeruginosa PA01
agccgccccaccaccaucgcc

SEQ ID NO: 1509686 - RNA, 19 nt, Pseudomonas aeruginosa PA01
agccgccccgaggggcggc

SEQ ID NO: 1509687 - RNA, 15 nt, Pseudomonas aeruginosa PA01
agccgcccucggggc

SEQ ID NO: 1509688 - RNA, 18 nt, Pseudomonas aeruginosa PA01
agccgccgcccagcagca

SEQ ID NO: 1509689 - RNA, 16 nt, Pseudomonas aeruginosa PA01
agccgcccuggcucug

SEQ ID NO: 1509690 - RNA, 17 nt, Pseudomonas aeruginosa PA01
agccgccgaagggccgc

SEQ ID NO: 1509691 - RNA, 19 nt, Pseudomonas aeruginosa PA01
agccgccgaagggccgcag

SEQ ID NO: 1509692 - RNA, 21 nt, Pseudomonas aeruginosa PA01
agccgccgaagggccgcaggu

SEQ ID NO: 1509693 - RNA, 21 nt, Pseudomonas aeruginosa PA01
agccgcgcguaggcuuggucg

SEQ ID NO: 1509694 - RNA, 20 nt, Pseudomonas aeruginosa PA01
agccgcgcgccgaguuggcc

SEQ ID NO: 1509695 - RNA, 22 nt, Pseudomonas aeruginosa PA01
agccgcgcgccgaguuggccca

SEQ ID NO: 1509696 - RNA, 15 nt, Pseudomonas aeruginosa PA01
agccgcgcucggcca

SEQ ID NO: 1509697 - RNA, 15 nt, Pseudomonas aeruginosa PA01
agccgcggaucaccu

SEQ ID NO: 1509698 - RNA, 12 nt, Pseudomonas aeruginosa PA01
agccgcggccgg

SEQ ID NO: 1509699 - RNA, 23 nt, Pseudomonas aeruginosa PA01
agccgcggcgccacgcucaccgg

SEQ ID NO: 1509700 - RNA, 21 nt, Pseudomonas aeruginosa PA01
agccgcgcggcauagcgcagc

SEQ ID NO: 1509701 - RNA, 13 nt, Pseudomonas aeruginosa PA01
agccgcgcgccga

SEQ ID NO: 1509702 - RNA, 18 nt, Pseudomonas aeruginosa PA01
agccgcgcaaccguucca

SEQ ID NO: 1509703 - RNA, 16 nt, Pseudomonas aeruginosa PA01
agccgcgcaaggcagc

SEQ ID NO: 1509704 - RNA, 12 nt, Pseudomonas aeruginosa PA01
agccgcgcagca

SEQ ID NO: 1509705 - RNA, 19 nt, Pseudomonas aeruginosa PA01
agccgcgccggccguccca

SEQ ID NO: 1509706 - RNA, 16 nt, Pseudomonas aeruginosa PA01
agccgcgccggggcag

SEQ ID NO: 1509707 - RNA, 21 nt, Pseudomonas aeruginosa PA01
agccaugcccagacgccgcuc

SEQ ID NO: 1509708 - RNA, 15 nt, Pseudomonas aeruginosa PA01
agccauucggcuucc

SEQ ID NO: 1509709 - RNA, 21 nt, Pseudomonas aeruginosa PA01
agccauucggcuuccugggcg

SEQ ID NO: 1509710 - RNA, 15 nt, Pseudomonas aeruginosa PA01
agccauugagcgcgc

SEQ ID NO: 1509711 - RNA, 17 nt, Pseudomonas aeruginosa PA01
agccauugagcgcgccc

SEQ ID NO: 1509712 - RNA, 21 nt, Pseudomonas aeruginosa PA01
agccccagagcccgccgaaca

SEQ ID NO: 1509713 - RNA, 19 nt, Pseudomonas aeruginosa PA01
agccauuggccgacgccgc

SEQ ID NO: 1509714 - RNA, 19 nt, Pseudomonas aeruginosa PA01
agccaucgcauagccggcg

SEQ ID NO: 1509715 - RNA, 16 nt, Pseudomonas aeruginosa PA01
agcccccgccggccgg

SEQ ID NO: 1509716 - RNA, 21 nt, Pseudomonas aeruginosa PA01
agcccccaugaaaaaggcgcc

SEQ ID NO: 1509717 - RNA, 20 nt, Pseudomonas aeruginosa PA01
agccccagguaggcgaaggc

SEQ ID NO: 1509718 - RNA, 20 nt, Pseudomonas aeruginosa PA01
agccccagcacgccgagcaa

SEQ ID NO: 1509719 - RNA, 15 nt, Pseudomonas aeruginosa PA01
agcccccggcgccca

SEQ ID NO: 1509720 - RNA, 15 nt, Pseudomonas aeruginosa PA01
agccccgcaucgcgg

SEQ ID NO: 1509721 - RNA, 15 nt, Pseudomonas aeruginosa PA01
agcccgagugcgccc

SEQ ID NO: 1509722 - RNA, 19 nt, Pseudomonas aeruginosa PA01
agcccgagugcgcccagca

SEQ ID NO: 1509723 - RNA, 22 nt, Pseudomonas aeruginosa PA01
agcccgagugcgcccagcagca

SEQ ID NO: 1509724 - RNA, 15 nt, Pseudomonas aeruginosa PA01
agcccgucggccucg

SEQ ID NO: 1509725 - RNA, 16 nt, Pseudomonas aeruginosa PA01
agcccgucggccucgc

SEQ ID NO: 1509726 - RNA, 21 nt, Pseudomonas aeruginosa PA01
agcccgucggcgacgggaagc

SEQ ID NO: 1509727 - RNA, 16 nt, Pseudomonas aeruginosa PA01
agcccgugucgccuuc

SEQ ID NO: 1509728 - RNA, 21 nt, Pseudomonas aeruginosa PA01
agcccgugggaucgccacgcc

SEQ ID NO: 1509729 - RNA, 24 nt, Pseudomonas aeruginosa PA01
agcccgugggaucgccacgccggc

SEQ ID NO: 1509730 - RNA, 13 nt, Pseudomonas aeruginosa PA01
agcccugcuggcg

SEQ ID NO: 1509731 - RNA, 23 nt, Pseudomonas aeruginosa PA01
agcccugcuggcgcagccaggcg

SEQ ID NO: 1509732 - RNA, 21 nt, Pseudomonas aeruginosa PA01
agcccuggaaaggccucggcg

SEQ ID NO: 1509733 - RNA, 22 nt, Pseudomonas aeruginosa PA01
agcccuggaaaggccucggcga

SEQ ID NO: 1509734 - RNA, 19 nt, Pseudomonas aeruginosa PA01
agcccuggcguggccggcg

SEQ ID NO: 1509735 - RNA, 22 nt, Pseudomonas aeruginosa PA01
agcccugguaggugcgcuggcg

SEQ ID NO: 1509736 - RNA, 23 nt, Pseudomonas aeruginosa PA01
agcccugguggugaucagcggcc

SEQ ID NO: 1509737 - RNA, 16 nt, Pseudomonas aeruginosa PA01
agcccugcaaagcggc

SEQ ID NO: 1509738 - RNA, 12 nt, Pseudomonas aeruginosa PA01
agcccucggccc

SEQ ID NO: 1509739 - RNA, 18 nt, Pseudomonas aeruginosa PA01
agcccggcauucgccggg

SEQ ID NO: 1509740 - RNA, 16 nt, Pseudomonas aeruginosa PA01
agcccgcuucgagcgg

SEQ ID NO: 1509741 - RNA, 18 nt, Pseudomonas aeruginosa PA01
agcccgcuuuccccggcg

SEQ ID NO: 1509742 - RNA, 14 nt, Pseudomonas aeruginosa PA01
agcccgcugaccgg

SEQ ID NO: 1509743 - RNA, 14 nt, Pseudomonas aeruginosa PA01
agcccgcuccgcau

SEQ ID NO: 1509744 - RNA, 21 nt, Pseudomonas aeruginosa PA01
agcccgauccguagggcgaau

SEQ ID NO: 1509745 - RNA, 19 nt, Pseudomonas aeruginosa PA01
agcccgccaacguccucga

SEQ ID NO: 1509746 - RNA, 20 nt, Pseudomonas aeruginosa PA01
agcccgccaacguccucgau

SEQ ID NO: 1509747 - RNA, 21 nt, Pseudomonas aeruginosa PA01
agcccgcgcucggccgccugg

SEQ ID NO: 1509748 - RNA, 14 nt, Pseudomonas aeruginosa PA01
agcccgcggaacgc

SEQ ID NO: 1509749 - RNA, 16 nt, Pseudomonas aeruginosa PA01
agcauggccuugccgg

SEQ ID NO: 1509750 - RNA, 18 nt, Pseudomonas aeruginosa PA01
agcauggcgaagcucggc

SEQ ID NO: 1509751 - RNA, 12 nt, Pseudomonas aeruginosa PA01
agccacgaagcc

SEQ ID NO: 1509752 - RNA, 21 nt, Pseudomonas aeruginosa PA01
agccaacccucggaugccgca

SEQ ID NO: 1509753 - RNA, 21 nt, Pseudomonas aeruginosa PA01
agcaugaugccgaggcggccg

SEQ ID NO: 1509754 - RNA, 14 nt, Pseudomonas aeruginosa PA01
agcaugauggugcc

SEQ ID NO: 1509755 - RNA, 18 nt, Pseudomonas aeruginosa PA01
agcaugcucgggcugccg

SEQ ID NO: 1509756 - RNA, 21 nt, Pseudomonas aeruginosa PA01
agcaugcccagcguggccagc

SEQ ID NO: 1509757 - RNA, 20 nt, Pseudomonas aeruginosa PA01
agcaugccgaggaacgccga

SEQ ID NO: 1509758 - RNA, 19 nt, Pseudomonas aeruginosa PA01
agccacggcgagagcgccg

SEQ ID NO: 1509759 - RNA, 21 nt, Pseudomonas aeruginosa PA01
agccacggcacacgucggcau

SEQ ID NO: 1509760 - RNA, 18 nt, Pseudomonas aeruginosa PA01
agccagcccagcggcgcg

SEQ ID NO: 1509761 - RNA, 16 nt, Pseudomonas aeruginosa PA01
agccagcccaguucgu

SEQ ID NO: 1509762 - RNA, 13 nt, Pseudomonas aeruginosa PA01
agccagcccggcg

SEQ ID NO: 1509763 - RNA, 15 nt, Pseudomonas aeruginosa PA01
agccagccaggucgg

SEQ ID NO: 1509764 - RNA, 19 nt, Pseudomonas aeruginosa PA01
agccagccguggcaggcgc

SEQ ID NO: 1509765 - RNA, 20 nt, Pseudomonas aeruginosa PA01
agccagccguggcaggcgcc

SEQ ID NO: 1509766 - RNA, 14 nt, Pseudomonas aeruginosa PA01
agccagccgagcaa

SEQ ID NO: 1509767 - RNA, 19 nt, Pseudomonas aeruginosa PA01
agccagccgcagcccgguc

SEQ ID NO: 1509768 - RNA, 14 nt, Pseudomonas aeruginosa PA01
agccagccgccgaa

SEQ ID NO: 1509769 - RNA, 22 nt, Pseudomonas aeruginosa PA01
agccagcgguugagcagggcgu

SEQ ID NO: 1509770 - RNA, 20 nt, Pseudomonas aeruginosa PA01
agccaggaagagcccgccac

SEQ ID NO: 1509771 - RNA, 17 nt, Pseudomonas aeruginosa PA01
agccaggaagcggcggu

SEQ ID NO: 1509772 - RNA, 17 nt, Pseudomonas aeruginosa PA01
agccaguccuggacccg

SEQ ID NO: 1509773 - RNA, 21 nt, Pseudomonas aeruginosa PA01
agccagucgagacgccagccg

SEQ ID NO: 1509774 - RNA, 22 nt, Pseudomonas aeruginosa PA01
agccagucgagacgccagccgc

SEQ ID NO: 1509775 - RNA, 18 nt, Pseudomonas aeruginosa PA01
agccaguuggaaguugcc

SEQ ID NO: 1509776 - RNA, 15 nt, Pseudomonas aeruginosa PA01
agccaguggcuggcg

SEQ ID NO: 1509777 - RNA, 20 nt, Pseudomonas aeruginosa PA01
agccaucaaacgggcgugag

SEQ ID NO: 1509778 - RNA, 21 nt, Pseudomonas aeruginosa PA01
agccaucaaacgggcgugagu

SEQ ID NO: 1509779 - RNA, 14 nt, Pseudomonas aeruginosa PA01
agccauagcgccgg

SEQ ID NO: 1509780 - RNA, 15 nt, Pseudomonas aeruginosa PA01
agccauagcgccggc

SEQ ID NO: 1509781 - RNA, 15 nt, Pseudomonas aeruginosa PA01
agccauagugcuggg

SEQ ID NO: 1509782 - RNA, 17 nt, Pseudomonas aeruginosa PA01
agccauagugcugggcg

SEQ ID NO: 1509783 - RNA, 20 nt, Pseudomonas aeruginosa PA01
agcaguugcuggaugucggc

SEQ ID NO: 1509784 - RNA, 14 nt, Pseudomonas aeruginosa PA01
agcaguugcaacag

SEQ ID NO: 1509785 - RNA, 13 nt, Pseudomonas aeruginosa PA01
agcagggcgucgc

SEQ ID NO: 1509786 - RNA, 15 nt, Pseudomonas aeruginosa PA01
agcagggcgucggcg

SEQ ID NO: 1509787 - RNA, 15 nt, Pseudomonas aeruginosa PA01
agcagggcgaugccg

SEQ ID NO: 1509788 - RNA, 15 nt, Pseudomonas aeruginosa PA01
agcagggcgauggcc

SEQ ID NO: 1509789 - RNA, 20 nt, Pseudomonas aeruginosa PA01
agcagggcgauggccagcgc

SEQ ID NO: 1509790 - RNA, 13 nt, Pseudomonas aeruginosa PA01
agcaguucgcccg

SEQ ID NO: 1509791 - RNA, 18 nt, Pseudomonas aeruginosa PA01
agcaggguggccaggguc

SEQ ID NO: 1509792 - RNA, 17 nt, Pseudomonas aeruginosa PA01
agcaggguaccgcuggc

SEQ ID NO: 1509793 - RNA, 18 nt, Pseudomonas aeruginosa PA01
agcaggguaccgcuggcg

SEQ ID NO: 1509794 - RNA, 20 nt, Pseudomonas aeruginosa PA01
agcaggguaccgcuggcgcu

SEQ ID NO: 1509795 - RNA, 13 nt, Pseudomonas aeruginosa PA01
agcagggucacgc

SEQ ID NO: 1509796 - RNA, 17 nt, Pseudomonas aeruginosa PA01
agcagggucgcgagcag

SEQ ID NO: 1509797 - RNA, 21 nt, Pseudomonas aeruginosa PA01
agcagggugacggugaucgcc

SEQ ID NO: 1509798 - RNA, 23 nt, Pseudomonas aeruginosa PA01
agcagggugacggugaucgccgc

SEQ ID NO: 1509799 - RNA, 15 nt, Pseudomonas aeruginosa PA01
agcagggccagcagc

SEQ ID NO: 1509800 - RNA, 13 nt, Pseudomonas aeruginosa PA01
agcagggccagcc

SEQ ID NO: 1509801 - RNA, 14 nt, Pseudomonas aeruginosa PA01
agcagggccagcgc

SEQ ID NO: 1509802 - RNA, 13 nt, Pseudomonas aeruginosa PA01
agcagggccaggc

SEQ ID NO: 1509803 - RNA, 13 nt, Pseudomonas aeruginosa PA01
agcagggccgagc

SEQ ID NO: 1509804 - RNA, 14 nt, Pseudomonas aeruginosa PA01
agcagggccgagcg

SEQ ID NO: 1509805 - RNA, 21 nt, Pseudomonas aeruginosa PA01
agcagggccgagcgcagcgcc

SEQ ID NO: 1509806 - RNA, 20 nt, Pseudomonas aeruginosa PA01
agcagggagaaccaggcggu

SEQ ID NO: 1509807 - RNA, 12 nt, Pseudomonas aeruginosa PA01
agcaggcugccg

SEQ ID NO: 1509808 - RNA, 15 nt, Pseudomonas aeruginosa PA01
agcaggcugccguug

SEQ ID NO: 1509809 - RNA, 15 nt, Pseudomonas aeruginosa PA01
agcaggcuggcggca

SEQ ID NO: 1509810 - RNA, 22 nt, Pseudomonas aeruginosa PA01
agcaggcuguacagcaggagcg

SEQ ID NO: 1509811 - RNA, 17 nt, Pseudomonas aeruginosa PA01
agcaggcguucggcgau

SEQ ID NO: 1509812 - RNA, 22 nt, Pseudomonas aeruginosa PA01
agcaggcguucggcgaugucgc

SEQ ID NO: 1509813 - RNA, 19 nt, Pseudomonas aeruginosa PA01
agcaggcguugcagugcgc

SEQ ID NO: 1509814 - RNA, 16 nt, Pseudomonas aeruginosa PA01
agcaggcgcucgggga

SEQ ID NO: 1509815 - RNA, 17 nt, Pseudomonas aeruginosa PA01
agcaggcgggcgaagua

SEQ ID NO: 1509816 - RNA, 22 nt, Pseudomonas aeruginosa PA01
agcaggcggagauugcggcgaa

SEQ ID NO: 1509817 - RNA, 18 nt, Pseudomonas aeruginosa PA01
agcaggcggaguagccgg

SEQ ID NO: 1509818 - RNA, 20 nt, Pseudomonas aeruginosa PA01
agcaggcggaucgccgccuu

SEQ ID NO: 1509819 - RNA, 19 nt, Pseudomonas aeruginosa PA01
agcaggccuugcagggccg

SEQ ID NO: 1509820 - RNA, 15 nt, Pseudomonas aeruginosa PA01
agcaggccgcuggcg

SEQ ID NO: 1509821 - RNA, 16 nt, Pseudomonas aeruginosa PA01
agcaggccgcuggcga

SEQ ID NO: 1509822 - RNA, 13 nt, Pseudomonas aeruginosa PA01
agcaggccggcca

SEQ ID NO: 1509823 - RNA, 17 nt, Pseudomonas aeruginosa PA01
agcaggccggccagccu

SEQ ID NO: 1509824 - RNA, 14 nt, Pseudomonas aeruginosa PA01
agcaggcgccgcgc

SEQ ID NO: 1509825 - RNA, 17 nt, Pseudomonas aeruginosa PA01
agcaggcgcaggucggc

SEQ ID NO: 1509826 - RNA, 16 nt, Pseudomonas aeruginosa PA01
agcaggcgcagcagcg

SEQ ID NO: 1509827 - RNA, 15 nt, Pseudomonas aeruginosa PA01
agcaggcgauacacc

SEQ ID NO: 1509828 - RNA, 15 nt, Pseudomonas aeruginosa PA01
agcaggcgcucggcg

SEQ ID NO: 1509829 - RNA, 19 nt, Pseudomonas aeruginosa PA01
agcagcuccgggcuggcca

SEQ ID NO: 1509830 - RNA, 17 nt, Pseudomonas aeruginosa PA01
agcagcucgccggcguc

SEQ ID NO: 1509831 - RNA, 14 nt, Pseudomonas aeruginosa PA01
agcagcucgccgcu

SEQ ID NO: 1509832 - RNA, 15 nt, Pseudomonas aeruginosa PA01
agcagcucguccaug

SEQ ID NO: 1509833 - RNA, 13 nt, Pseudomonas aeruginosa PA01
agcaggccgaagg

SEQ ID NO: 1509834 - RNA, 15 nt, Pseudomonas aeruginosa PA01
agcaggccgacggcg

SEQ ID NO: 1509835 - RNA, 17 nt, Pseudomonas aeruginosa PA01
agcaggccgacggcgcg

SEQ ID NO: 1509836 - RNA, 20 nt, Pseudomonas aeruginosa PA01
agcaggccgacggcgcgcug

SEQ ID NO: 1509837 - RNA, 19 nt, Pseudomonas aeruginosa PA01
agcaggccgagcccgagug

SEQ ID NO: 1509838 - RNA, 23 nt, Pseudomonas aeruginosa PA01
agcaggccgagcccgagugcgcc

SEQ ID NO: 1509839 - RNA, 18 nt, Pseudomonas aeruginosa PA01
agcaggccgaggucggcg

SEQ ID NO: 1509840 - RNA, 20 nt, Pseudomonas aeruginosa PA01
agcaggccgaucaccagcgc

SEQ ID NO: 1509841 - RNA, 15 nt, Pseudomonas aeruginosa PA01
agcaggccgaucagc

SEQ ID NO: 1509842 - RNA, 19 nt, Pseudomonas aeruginosa PA01
agauugucgcguccggcca

SEQ ID NO: 1509843 - RNA, 23 nt, Pseudomonas aeruginosa PA01
aggcaaaaaaaaggggcggggua

SEQ ID NO: 1509844 - RNA, 14 nt, Pseudomonas aeruginosa PA01
aggcaacagcccgc

SEQ ID NO: 1509845 - RNA, 19 nt, Pseudomonas aeruginosa PA01
aggcaacggagcugguacg

SEQ ID NO: 1509846 - RNA, 15 nt, Pseudomonas aeruginosa PA01
aggauucgccagccu

SEQ ID NO: 1509847 - RNA, 20 nt, Pseudomonas aeruginosa PA01
aggauucgccagccucggcg

SEQ ID NO: 1509848 - RNA, 20 nt, Pseudomonas aeruginosa PA01
aggauguggccgucgcgccg

SEQ ID NO: 1509849 - RNA, 18 nt, Pseudomonas aeruginosa PA01
aggauguugaacaggcuc

SEQ ID NO: 1509850 - RNA, 21 nt, Pseudomonas aeruginosa PA01
aggauguugacgauggcccag

SEQ ID NO: 1509851 - RNA, 21 nt, Pseudomonas aeruginosa PA01
aggauuuccgcgcccggcugg

SEQ ID NO: 1509852 - RNA, 19 nt, Pseudomonas aeruginosa PA01
aggauuuccucgcgcaccg

SEQ ID NO: 1509853 - RNA, 18 nt, Pseudomonas aeruginosa PA01
aggcaaucugcccggcau

SEQ ID NO: 1509854 - RNA, 14 nt, Pseudomonas aeruginosa PA01
aggcacacgcccgg

SEQ ID NO: 1509855 - RNA, 14 nt, Pseudomonas aeruginosa PA01
aggcaccaccgccg

SEQ ID NO: 1509856 - RNA, 18 nt, Pseudomonas aeruginosa PA01
aggcaccaccgccgccag

SEQ ID NO: 1509857 - RNA, 16 nt, Pseudomonas aeruginosa PA01
aggcacgcugccagca

SEQ ID NO: 1509858 - RNA, 21 nt, Pseudomonas aeruginosa PA01
aggcacgcugccagcaggccg

SEQ ID NO: 1509859 - RNA, 19 nt, Pseudomonas aeruginosa PA01
aggcacgaauuuccuggcg

SEQ ID NO: 1509860 - RNA, 14 nt, Pseudomonas aeruginosa PA01
aggcauucucgcga

SEQ ID NO: 1509861 - RNA, 23 nt, Pseudomonas aeruginosa PA01
aggcauucucgcgacccuggccg

SEQ ID NO: 1509862 - RNA, 15 nt, Pseudomonas aeruginosa PA01
aggccgacagcggcu

SEQ ID NO: 1509863 - RNA, 17 nt, Pseudomonas aeruginosa PA01
aggccgacagcggcugg

SEQ ID NO: 1509864 - RNA, 19 nt, Pseudomonas aeruginosa PA01
aggccgacagcggcuggcg

SEQ ID NO: 1509865 - RNA, 20 nt, Pseudomonas aeruginosa PA01
aggccgaagaggcccucggc

SEQ ID NO: 1509866 - RNA, 15 nt, Pseudomonas aeruginosa PA01
aggccgaagccgccg

SEQ ID NO: 1509867 - RNA, 22 nt, Pseudomonas aeruginosa PA01
aggccgaagcgugggcggccgg

SEQ ID NO: 1509868 - RNA, 17 nt, Pseudomonas aeruginosa PA01
aggccgaaggccuggcc

SEQ ID NO: 1509869 - RNA, 19 nt, Pseudomonas aeruginosa PA01
aggccgaacgguagguagc

SEQ ID NO: 1509870 - RNA, 21 nt, Pseudomonas aeruginosa PA01
aggcccuugaacaggcuggcg

SEQ ID NO: 1509871 - RNA, 17 nt, Pseudomonas aeruginosa PA01
aggcccuugagggccuc

SEQ ID NO: 1509872 - RNA, 22 nt, Pseudomonas aeruginosa PA01
aggcccuugagggccucggcga

SEQ ID NO: 1509873 - RNA, 19 nt, Pseudomonas aeruginosa PA01
aggcccuuuuccaccggcc

SEQ ID NO: 1509874 - RNA, 21 nt, Pseudomonas aeruginosa PA01
aggcccuggaucaccgcggcg

SEQ ID NO: 1509875 - RNA, 23 nt, Pseudomonas aeruginosa PA01
aggcccuggaucaccgcggcgcu

SEQ ID NO: 1509876 - RNA, 21 nt, Pseudomonas aeruginosa PA01
aggcccugcuccuccaggcuc

SEQ ID NO: 1509877 - RNA, 16 nt, Pseudomonas aeruginosa PA01
aggcccugcagcgcca

SEQ ID NO: 1509878 - RNA, 23 nt, Pseudomonas aeruginosa PA01
aggcccguauggcgggccuugcg

SEQ ID NO: 1509879 - RNA, 19 nt, Pseudomonas aeruginosa PA01
aggcccagccauugcgcca

SEQ ID NO: 1509880 - RNA, 19 nt, Pseudomonas aeruginosa PA01
aggcccuacaaugauggcc

SEQ ID NO: 1509881 - RNA, 13 nt, Pseudomonas aeruginosa PA01
aggcccucggcga

SEQ ID NO: 1509882 - RNA, 13 nt, Pseudomonas aeruginosa PA01
aggcccucggcgc

SEQ ID NO: 1509883 - RNA, 17 nt, Pseudomonas aeruginosa PA01
aggcccucggcgccgag

SEQ ID NO: 1509884 - RNA, 16 nt, Pseudomonas aeruginosa PA01
aggccaugggugucgg

SEQ ID NO: 1509885 - RNA, 18 nt, Pseudomonas aeruginosa PA01
aggccaugggugucggcg

SEQ ID NO: 1509886 - RNA, 16 nt, Pseudomonas aeruginosa PA01
aggccaagucggccgc

SEQ ID NO: 1509887 - RNA, 17 nt, Pseudomonas aeruginosa PA01
aggccaccaucgcggcg

SEQ ID NO: 1509888 - RNA, 19 nt, Pseudomonas aeruginosa PA01
aggccaccaucgcggcgau

SEQ ID NO: 1509889 - RNA, 22 nt, Pseudomonas aeruginosa PA01
aggccaccaucgcggcgauggc

SEQ ID NO: 1509890 - RNA, 16 nt, Pseudomonas aeruginosa PA01
aggccaaccaccccga

SEQ ID NO: 1509891 - RNA, 16 nt, Pseudomonas aeruginosa PA01
aggccagguggucgau

SEQ ID NO: 1509892 - RNA, 16 nt, Pseudomonas aeruginosa PA01
aggccauagcgcgccg

SEQ ID NO: 1509893 - RNA, 17 nt, Pseudomonas aeruginosa PA01
aggccauagcgcgccgg

SEQ ID NO: 1509894 - RNA, 18 nt, Pseudomonas aeruginosa PA01
aggccaugaucaucgccu

SEQ ID NO: 1509895 - RNA, 20 nt, Pseudomonas aeruginosa PA01
aggccaugaucaucgccugc

SEQ ID NO: 1509896 - RNA, 22 nt, Pseudomonas aeruginosa PA01
aggccagcggcauccgccgcug

SEQ ID NO: 1509897 - RNA, 21 nt, Pseudomonas aeruginosa PA01
aggccagcggcuccucggccu

SEQ ID NO: 1509898 - RNA, 23 nt, Pseudomonas aeruginosa PA01
aggccagcgggcugucguccugg

SEQ ID NO: 1509899 - RNA, 19 nt, Pseudomonas aeruginosa PA01
aggccaggcaaucgaucgc

SEQ ID NO: 1509900 - RNA, 20 nt, Pseudomonas aeruginosa PA01
aggccagcuugucggccuug

SEQ ID NO: 1509901 - RNA, 15 nt, Pseudomonas aeruginosa PA01
aggccaggccgagcg

SEQ ID NO: 1509902 - RNA, 16 nt, Pseudomonas aeruginosa PA01
aggccaggccggcgcc

SEQ ID NO: 1509903 - RNA, 16 nt, Pseudomonas aeruginosa PA01
aggccaggcgauacgc

SEQ ID NO: 1509904 - RNA, 19 nt, Pseudomonas aeruginosa PA01
aggccaggcucgguucugc

SEQ ID NO: 1509905 - RNA, 14 nt, Pseudomonas aeruginosa PA01
aggccagggcauug

SEQ ID NO: 1509906 - RNA, 16 nt, Pseudomonas aeruginosa PA01
aggaucacgauggccg

SEQ ID NO: 1509907 - RNA, 15 nt, Pseudomonas aeruginosa PA01
aggaucaggcucgag

SEQ ID NO: 1509908 - RNA, 15 nt, Pseudomonas aeruginosa PA01
aggauccaggugcgc

SEQ ID NO: 1509909 - RNA, 16 nt, Pseudomonas aeruginosa PA01
aggaucgaacuggcca

SEQ ID NO: 1509910 - RNA, 16 nt, Pseudomonas aeruginosa PA01
aggaucgaccccgccg

SEQ ID NO: 1509911 - RNA, 22 nt, Pseudomonas aeruginosa PA01
aggaguaggucacuuccuugcg

SEQ ID NO: 1509912 - RNA, 22 nt, Pseudomonas aeruginosa PA01
aggauacgucuucgauggcggc

SEQ ID NO: 1509913 - RNA, 17 nt, Pseudomonas aeruginosa PA01
aggauagaugcguccgu

SEQ ID NO: 1509914 - RNA, 14 nt, Pseudomonas aeruginosa PA01
aggaucgucggccc

SEQ ID NO: 1509915 - RNA, 19 nt, Pseudomonas aeruginosa PA01
aggaucuccaacuggcggc

SEQ ID NO: 1509916 - RNA, 18 nt, Pseudomonas aeruginosa PA01
aggaucgcucccaggcuc

SEQ ID NO: 1509917 - RNA, 13 nt, Pseudomonas aeruginosa PA01
aggaucgcgcugg

SEQ ID NO: 1509918 - RNA, 18 nt, Pseudomonas aeruginosa PA01
aggaucgagcccuggucg

SEQ ID NO: 1509919 - RNA, 24 nt, Pseudomonas aeruginosa PA01
aggaucgccuccaccagcgccggc

SEQ ID NO: 1509920 - RNA, 23 nt, Pseudomonas aeruginosa PA01
aggaucugcugcaacauggcguc

SEQ ID NO: 1509921 - RNA, 21 nt, Pseudomonas aeruginosa PA01
aggaugggcgaagccggcggc

SEQ ID NO: 1509922 - RNA, 23 nt, Pseudomonas aeruginosa PA01
aggaugggcgaagccggcggcgc

SEQ ID NO: 1509923 - RNA, 16 nt, Pseudomonas aeruginosa PA01
aggaugcugcacagcc

SEQ ID NO: 1509924 - RNA, 15 nt, Pseudomonas aeruginosa PA01
aggaugcagucggca

SEQ ID NO: 1509925 - RNA, 14 nt, Pseudomonas aeruginosa PA01
aggaugcgccagcg

SEQ ID NO: 1509926 - RNA, 15 nt, Pseudomonas aeruginosa PA01
aggaugcgccagcgg

SEQ ID NO: 1509927 - RNA, 21 nt, Pseudomonas aeruginosa PA01
aggaugccguacuugaaggug

SEQ ID NO: 1509928 - RNA, 12 nt, Pseudomonas aeruginosa PA01
aggagggcugcu

SEQ ID NO: 1509929 - RNA, 19 nt, Pseudomonas aeruginosa PA01
aaacggcaggccagcaggu

SEQ ID NO: 1509930 - RNA, 18 nt, Pseudomonas aeruginosa PA01
aggaggacgauggaacgc

SEQ ID NO: 1509931 - RNA, 20 nt, Pseudomonas aeruginosa PA01
aggaggaaauacagcacccg

SEQ ID NO: 1509932 - RNA, 12 nt, Pseudomonas aeruginosa PA01
aggagccggcca

SEQ ID NO: 1509933 - RNA, 14 nt, Pseudomonas aeruginosa PA01
aggacgugcaccau

SEQ ID NO: 1509934 - RNA, 16 nt, Pseudomonas aeruginosa PA01
aggacguccuggccga

SEQ ID NO: 1509935 - RNA, 14 nt, Pseudomonas aeruginosa PA01
aggagaagcgccuc

SEQ ID NO: 1509936 - RNA, 19 nt, Pseudomonas aeruginosa PA01
aggagcaugaaggucgaca

SEQ ID NO: 1509937 - RNA, 14 nt, Pseudomonas aeruginosa PA01
aggagccgucgccg

SEQ ID NO: 1509938 - RNA, 16 nt, Pseudomonas aeruginosa PA01
aggagccgucgccggc

SEQ ID NO: 1509939 - RNA, 18 nt, Pseudomonas aeruginosa PA01
aggagccugcgugagcug

SEQ ID NO: 1509940 - RNA, 21 nt, Pseudomonas aeruginosa PA01
aggagccuuucacuuucaggu

SEQ ID NO: 1509941 - RNA, 15 nt, Pseudomonas aeruginosa PA01
aggagcgccagcacc

SEQ ID NO: 1509942 - RNA, 17 nt, Pseudomonas aeruginosa PA01
aggagcgccagcaccag

SEQ ID NO: 1509943 - RNA, 12 nt, Pseudomonas aeruginosa PA01
aggagcgccgcg

SEQ ID NO: 1509944 - RNA, 12 nt, Pseudomonas aeruginosa PA01
aggagcgcgagc

SEQ ID NO: 1509945 - RNA, 15 nt, Pseudomonas aeruginosa PA01
aggaaauacagcacc

SEQ ID NO: 1509946 - RNA, 14 nt, Pseudomonas aeruginosa PA01
aggaacacccgguc

SEQ ID NO: 1509947 - RNA, 11 nt, Pseudomonas aeruginosa PA01
aggaacaguug

SEQ ID NO: 1509948 - RNA, 13 nt, Pseudomonas aeruginosa PA01
aggaaccggccau

SEQ ID NO: 1509949 - RNA, 14 nt, Pseudomonas aeruginosa PA01
aggaaccagggguc

SEQ ID NO: 1509950 - RNA, 21 nt, Pseudomonas aeruginosa PA01
aggaaacucacccuggcaccg

SEQ ID NO: 1509951 - RNA, 17 nt, Pseudomonas aeruginosa PA01
agcuuugcgcagccacc

SEQ ID NO: 1509952 - RNA, 13 nt, Pseudomonas aeruginosa PA01
aggaacaggucga

SEQ ID NO: 1509953 - RNA, 13 nt, Pseudomonas aeruginosa PA01
aggaagccgacca

SEQ ID NO: 1509954 - RNA, 13 nt, Pseudomonas aeruginosa PA01
aggaagccgaccg

SEQ ID NO: 1509955 - RNA, 14 nt, Pseudomonas aeruginosa PA01
aggaagaaggcguc

SEQ ID NO: 1509956 - RNA, 15 nt, Pseudomonas aeruginosa PA01
aggaagagcccgcca

SEQ ID NO: 1509957 - RNA, 16 nt, Pseudomonas aeruginosa PA01
aggaagaagcccgccu

SEQ ID NO: 1509958 - RNA, 22 nt, Pseudomonas aeruginosa PA01
aggaagcgucgugcgccggccu

SEQ ID NO: 1509959 - RNA, 16 nt, Pseudomonas aeruginosa PA01
aggaagcgccgggccg

SEQ ID NO: 1509960 - RNA, 18 nt, Pseudomonas aeruginosa PA01
aggaagcgccgggccgca

SEQ ID NO: 1509961 - RNA, 16 nt, Pseudomonas aeruginosa PA01
aggaagcugcgcucgg

SEQ ID NO: 1509962 - RNA, 13 nt, Pseudomonas aeruginosa PA01
aggaaggccgcuu

SEQ ID NO: 1509963 - RNA, 15 nt, Pseudomonas aeruginosa PA01
aggaaggcgccggca

SEQ ID NO: 1509964 - RNA, 16 nt, Pseudomonas aeruginosa PA01
aggaaggcuuccggcu

SEQ ID NO: 1509965 - RNA, 16 nt, Pseudomonas aeruginosa PA01
aggaagguccaggccc

SEQ ID NO: 1509966 - RNA, 13 nt, Pseudomonas aeruginosa PA01
aggaaucuucggc

SEQ ID NO: 1509967 - RNA, 17 nt, Pseudomonas aeruginosa PA01
aggaaucuucggcgccc

SEQ ID NO: 1509968 - RNA, 18 nt, Pseudomonas aeruginosa PA01
aggacacuuccaguucgu

SEQ ID NO: 1509969 - RNA, 21 nt, Pseudomonas aeruginosa PA01
aggacagcacgcucaggcagc

SEQ ID NO: 1509970 - RNA, 21 nt, Pseudomonas aeruginosa PA01
aggacaacacuuccucguggg

SEQ ID NO: 1509971 - RNA, 19 nt, Pseudomonas aeruginosa PA01
aggaaucgaacccccgacc

SEQ ID NO: 1509972 - RNA, 17 nt, Pseudomonas aeruginosa PA01
aggaauacggcgcgaug

SEQ ID NO: 1509973 - RNA, 16 nt, Pseudomonas aeruginosa PA01
aggaagucggcggccg

SEQ ID NO: 1509974 - RNA, 19 nt, Pseudomonas aeruginosa PA01
aggaccucgaagcuggcca

SEQ ID NO: 1509975 - RNA, 20 nt, Pseudomonas aeruginosa PA01
aggaccucgaagcuggccag

SEQ ID NO: 1509976 - RNA, 14 nt, Pseudomonas aeruginosa PA01
aggaccuggccgcg

SEQ ID NO: 1509977 - RNA, 22 nt, Pseudomonas aeruginosa PA01
aggaccuggccgcguucgccga

SEQ ID NO: 1509978 - RNA, 19 nt, Pseudomonas aeruginosa PA01
aggaccuggccguuggcga

SEQ ID NO: 1509979 - RNA, 12 nt, Pseudomonas aeruginosa PA01
aggacaggccga

SEQ ID NO: 1509980 - RNA, 14 nt, Pseudomonas aeruginosa PA01
aggaccagcccguu

SEQ ID NO: 1509981 - RNA, 14 nt, Pseudomonas aeruginosa PA01
aggaccagcgccug

SEQ ID NO: 1509982 - RNA, 17 nt, Pseudomonas aeruginosa PA01
aggaccuucagauacuc

SEQ ID NO: 1509983 - RNA, 22 nt, Pseudomonas aeruginosa PA01
aggaccuuccgccagcaggcgc

SEQ ID NO: 1509984 - RNA, 17 nt, Pseudomonas aeruginosa PA01
aggacgaagucgccggc

SEQ ID NO: 1509985 - RNA, 15 nt, Pseudomonas aeruginosa PA01
aggacgaacaaccgc

SEQ ID NO: 1509986 - RNA, 18 nt, Pseudomonas aeruginosa PA01
aggacgagacgccgagga

SEQ ID NO: 1509987 - RNA, 20 nt, Pseudomonas aeruginosa PA01
aggacgaggaaggcgcgcac

SEQ ID NO: 1509988 - RNA, 20 nt, Pseudomonas aeruginosa PA01
aggacgcauaaccgcuugcg

SEQ ID NO: 1509989 - RNA, 17 nt, Pseudomonas aeruginosa PA01
aggacgccaccaggccg

SEQ ID NO: 1509990 - RNA, 13 nt, Pseudomonas aeruginosa PA01
aggacgccgccgg

SEQ ID NO: 1509991 - RNA, 22 nt, Pseudomonas aeruginosa PA01
aggacgcuacgcucggggugcg

SEQ ID NO: 1509992 - RNA, 17 nt, Pseudomonas aeruginosa PA01
aggacgcuccugcgccg

SEQ ID NO: 1509993 - RNA, 20 nt, Pseudomonas aeruginosa PA01
aggacgcuccugcgccggcu

SEQ ID NO: 1509994 - RNA, 18 nt, Pseudomonas aeruginosa PA01
aggacggauaacggcagc

SEQ ID NO: 1509995 - RNA, 20 nt, Pseudomonas aeruginosa PA01
aggacggauaacggcagccg

SEQ ID NO: 1509996 - RNA, 16 nt, Pseudomonas aeruginosa PA01
aggacgccgggcuggu

SEQ ID NO: 1509997 - RNA, 14 nt, Pseudomonas aeruginosa PA01
aggacgaugaucac

SEQ ID NO: 1509998 - RNA, 13 nt, Pseudomonas aeruginosa PA01
agcuucgccgccc

SEQ ID NO: 1509999 - RNA, 15 nt, Pseudomonas aeruginosa PA01
agcuucgucgcgcag

SEQ ID NO: 1510000 - RNA, 16 nt, Pseudomonas aeruginosa PA01
agcuucgucgcgcagg

SEQ ID NO: 1510001 - RNA, 18 nt, Pseudomonas aeruginosa PA01
agcuucgucgcgcaggcg

SEQ ID NO: 1510002 - RNA, 20 nt, Pseudomonas aeruginosa PA01
agcuucgucgcgcaggcggg

SEQ ID NO: 1510003 - RNA, 23 nt, Pseudomonas aeruginosa PA01
agcuucgucgcgcaggcgggcgg

SEQ ID NO: 1510004 - RNA, 22 nt, Pseudomonas aeruginosa PA01
agcuucucuuucaccuggucgc

SEQ ID NO: 1510005 - RNA, 17 nt, Pseudomonas aeruginosa PA01
agcuucugcagggcggc

SEQ ID NO: 1510006 - RNA, 18 nt, Pseudomonas aeruginosa PA01
agcuugaccuugccgccg

SEQ ID NO: 1510007 - RNA, 18 nt, Pseudomonas aeruginosa PA01
agcuugaugaagcccgcg

SEQ ID NO: 1510008 - RNA, 21 nt, Pseudomonas aeruginosa PA01
agcuuguaguagcgcccgacg

SEQ ID NO: 1510009 - RNA, 20 nt, Pseudomonas aeruginosa PA01
agcuugguauccaccucgcc

SEQ ID NO: 1510010 - RNA, 19 nt, Pseudomonas aeruginosa PA01
agcuuggcgaauagccggc

SEQ ID NO: 1510011 - RNA, 15 nt, Pseudomonas aeruginosa PA01
agcuuggcccuggcc

SEQ ID NO: 1510012 - RNA, 16 nt, Pseudomonas aeruginosa PA01
agcuuggccacguccu

SEQ ID NO: 1510013 - RNA, 16 nt, Pseudomonas aeruginosa PA01
agcuuggccagcaggc

SEQ ID NO: 1510014 - RNA, 22 nt, Pseudomonas aeruginosa PA01
agcuuggccagcaggccgagcg

SEQ ID NO: 1510015 - RNA, 20 nt, Pseudomonas aeruginosa PA01
agcuugccggcauagccgaa

SEQ ID NO: 1510016 - RNA, 17 nt, Pseudomonas aeruginosa PA01
agcuuggcacggccggc

SEQ ID NO: 1510017 - RNA, 16 nt, Pseudomonas aeruginosa PA01
agcuugcgcgccaggg

SEQ ID NO: 1510018 - RNA, 16 nt, Pseudomonas aeruginosa PA01
agcuugccguuggcgu

SEQ ID NO: 1510019 - RNA, 19 nt, Pseudomonas aeruginosa PA01
agcuguccaucucgccgcg

SEQ ID NO: 1510020 - RNA, 14 nt, Pseudomonas aeruginosa PA01
agcuguccgcgccg

SEQ ID NO: 1510021 - RNA, 15 nt, Pseudomonas aeruginosa PA01
agcuguccggcgcug

SEQ ID NO: 1510022 - RNA, 16 nt, Pseudomonas aeruginosa PA01
agcugucgagcacggc

SEQ ID NO: 1510023 - RNA, 23 nt, Pseudomonas aeruginosa PA01
agcugucgagcacggcgcugguc

SEQ ID NO: 1510024 - RNA, 15 nt, Pseudomonas aeruginosa PA01
agcugucgcccucgc

SEQ ID NO: 1510025 - RNA, 15 nt, Pseudomonas aeruginosa PA01
agcugucggcccgcg

SEQ ID NO: 1510026 - RNA, 22 nt, Pseudomonas aeruginosa PA01
agcugguggauguucgccgcca

SEQ ID NO: 1510027 - RNA, 23 nt, Pseudomonas aeruginosa PA01
agcuguuucagcccacgcgccug

SEQ ID NO: 1510028 - RNA, 21 nt, Pseudomonas aeruginosa PA01
agcuucagaccgacacguuca

SEQ ID NO: 1510029 - RNA, 14 nt, Pseudomonas aeruginosa PA01
agcuucagccgacc

SEQ ID NO: 1510030 - RNA, 13 nt, Pseudomonas aeruginosa PA01
agcuucaggcgca

SEQ ID NO: 1510031 - RNA, 14 nt, Pseudomonas aeruginosa PA01
agcuucaggcgcac

SEQ ID NO: 1510032 - RNA, 14 nt, Pseudomonas aeruginosa PA01
agcugcgcgcgauc

SEQ ID NO: 1510033 - RNA, 15 nt, Pseudomonas aeruginosa PA01
agcugcggccgagca

SEQ ID NO: 1510034 - RNA, 17 nt, Pseudomonas aeruginosa PA01
agcuggcgcgccuccug

SEQ ID NO: 1510035 - RNA, 24 nt, Pseudomonas aeruginosa PA01
agcuggcgccgucaucgcugaccu

SEQ ID NO: 1510036 - RNA, 15 nt, Pseudomonas aeruginosa PA01
agcggaaucgcgccc

SEQ ID NO: 1510037 - RNA, 14 nt, Pseudomonas aeruginosa PA01
agcggaugucgucg

SEQ ID NO: 1510038 - RNA, 17 nt, Pseudomonas aeruginosa PA01
agcggaugucgucgcag

SEQ ID NO: 1510039 - RNA, 23 nt, Pseudomonas aeruginosa PA01
agcggaugcgcgaauaccgcgcg

SEQ ID NO: 1510040 - RNA, 14 nt, Pseudomonas aeruginosa PA01
agcggaugcuggcg

SEQ ID NO: 1510041 - RNA, 14 nt, Pseudomonas aeruginosa PA01
agcggaaguucacc

SEQ ID NO: 1510042 - RNA, 16 nt, Pseudomonas aeruginosa PA01
agcggaaaugcucgcc

SEQ ID NO: 1510043 - RNA, 20 nt, Pseudomonas aeruginosa PA01
agcggaaaugcucgccgucc

SEQ ID NO: 1510044 - RNA, 21 nt, Pseudomonas aeruginosa PA01
agcggaaaugcucgccguccg

SEQ ID NO: 1510045 - RNA, 22 nt, Pseudomonas aeruginosa PA01
agcggaacgaaggacaggucgc

SEQ ID NO: 1510046 - RNA, 21 nt, Pseudomonas aeruginosa PA01
agcggaagcacggcucggcga

SEQ ID NO: 1510047 - RNA, 15 nt, Pseudomonas aeruginosa PA01
agcggaagcccagca

SEQ ID NO: 1510048 - RNA, 19 nt, Pseudomonas aeruginosa PA01
agcggaagcccugcuggcg

SEQ ID NO: 1510049 - RNA, 21 nt, Pseudomonas aeruginosa PA01
agcggaagcccugcuggcgca

SEQ ID NO: 1510050 - RNA, 17 nt, Pseudomonas aeruginosa PA01
agcggaaaagcaggcca

SEQ ID NO: 1510051 - RNA, 13 nt, Pseudomonas aeruginosa PA01
agcgcucgcgcag

SEQ ID NO: 1510052 - RNA, 18 nt, Pseudomonas aeruginosa PA01
agcgcucgcgcagccacu

SEQ ID NO: 1510053 - RNA, 18 nt, Pseudomonas aeruginosa PA01
agcgcucggucagcuccc

SEQ ID NO: 1510054 - RNA, 20 nt, Pseudomonas aeruginosa PA01
agcgcucgguggcauggugu

SEQ ID NO: 1510055 - RNA, 14 nt, Pseudomonas aeruginosa PA01
agcgcgugcaggcg

SEQ ID NO: 1510056 - RNA, 17 nt, Pseudomonas aeruginosa PA01
agcgcucgaacgccgcc

SEQ ID NO: 1510057 - RNA, 21 nt, Pseudomonas aeruginosa PA01
agcgcucgaacgccgcccguc

SEQ ID NO: 1510058 - RNA, 13 nt, Pseudomonas aeruginosa PA01
agcgcuggcaggu

SEQ ID NO: 1510059 - RNA, 20 nt, Pseudomonas aeruginosa PA01
agcgcuuguagcagccgcag

SEQ ID NO: 1510060 - RNA, 14 nt, Pseudomonas aeruginosa PA01
agcgcuugcuggcg

SEQ ID NO: 1510061 - RNA, 17 nt, Pseudomonas aeruginosa PA01
agcgcuugcuggcgcga

SEQ ID NO: 1510062 - RNA, 16 nt, Pseudomonas aeruginosa PA01
agcgcuggcgaucacc

SEQ ID NO: 1510063 - RNA, 12 nt, Pseudomonas aeruginosa PA01
agcgcugcgcca

SEQ ID NO: 1510064 - RNA, 20 nt, Pseudomonas aeruginosa PA01
agcgcugcgcccgcucgacc

SEQ ID NO: 1510065 - RNA, 15 nt, Pseudomonas aeruginosa PA01
agcgcugcugggcgg

SEQ ID NO: 1510066 - RNA, 13 nt, Pseudomonas aeruginosa PA01
agcgcugcucgac

SEQ ID NO: 1510067 - RNA, 17 nt, Pseudomonas aeruginosa PA01
agcgcugcucgaccacc

SEQ ID NO: 1510068 - RNA, 12 nt, Pseudomonas aeruginosa PA01
agcgcugaucac

SEQ ID NO: 1510069 - RNA, 14 nt, Pseudomonas aeruginosa PA01
agcgcugccugcac

SEQ ID NO: 1510070 - RNA, 16 nt, Pseudomonas aeruginosa PA01
agcgcugccugcaccg

SEQ ID NO: 1510071 - RNA, 18 nt, Pseudomonas aeruginosa PA01
agcgcgucgaccaccgcg

SEQ ID NO: 1510072 - RNA, 22 nt, Pseudomonas aeruginosa PA01
agcgcgucgaccaccgcguggu

SEQ ID NO: 1510073 - RNA, 17 nt, Pseudomonas aeruginosa PA01
agcgcggcuucagagcu

SEQ ID NO: 1510074 - RNA, 18 nt, Pseudomonas aeruginosa PA01
agcgcggcuucagagcug

SEQ ID NO: 1510075 - RNA, 17 nt, Pseudomonas aeruginosa PA01
agcgcgucaucaggcuc

SEQ ID NO: 1510076 - RNA, 19 nt, Pseudomonas aeruginosa PA01
agcgcgucaucaggcucag

SEQ ID NO: 1510077 - RNA, 22 nt, Pseudomonas aeruginosa PA01
agcgcggcucggggauguagcg

SEQ ID NO: 1510078 - RNA, 21 nt, Pseudomonas aeruginosa PA01
agcgcggcguggccggcgacc

SEQ ID NO: 1510079 - RNA, 17 nt, Pseudomonas aeruginosa PA01
agcgcggcgcuuggcga

SEQ ID NO: 1510080 - RNA, 19 nt, Pseudomonas aeruginosa PA01
agcgcggcgcuuggcgaaa

SEQ ID NO: 1510081 - RNA, 20 nt, Pseudomonas aeruginosa PA01
agcgcggcgccccaggcgcc

SEQ ID NO: 1510082 - RNA, 15 nt, Pseudomonas aeruginosa PA01
agcgcggcggcgcgg

SEQ ID NO: 1510083 - RNA, 16 nt, Pseudomonas aeruginosa PA01
agcgcggcggcggcca

SEQ ID NO: 1510084 - RNA, 19 nt, Pseudomonas aeruginosa PA01
agcgcggcggcggccagca

SEQ ID NO: 1510085 - RNA, 21 nt, Pseudomonas aeruginosa PA01
agcgcggcgcggacauggcgc

SEQ ID NO: 1510086 - RNA, 16 nt, Pseudomonas aeruginosa PA01
agcgccgucaccagca

SEQ ID NO: 1510087 - RNA, 20 nt, Pseudomonas aeruginosa PA01
agcgccgucaccagcagccc

SEQ ID NO: 1510088 - RNA, 23 nt, Pseudomonas aeruginosa PA01
agcgccgucaccagcagccccga

SEQ ID NO: 1510089 - RNA, 21 nt, Pseudomonas aeruginosa PA01
agcgccgguaguucgcugacc

SEQ ID NO: 1510090 - RNA, 22 nt, Pseudomonas aeruginosa PA01
agcgccgguaguucgcugaccg

SEQ ID NO: 1510091 - RNA, 11 nt, Pseudomonas aeruginosa PA01
agcgccggguc

SEQ ID NO: 1510092 - RNA, 13 nt, Pseudomonas aeruginosa PA01
agcgccggccagg

SEQ ID NO: 1510093 - RNA, 18 nt, Pseudomonas aeruginosa PA01
agcgccgcuucuucccgc

SEQ ID NO: 1510094 - RNA, 11 nt, Pseudomonas aeruginosa PA01
agcgccggcca

SEQ ID NO: 1510095 - RNA, 19 nt, Pseudomonas aeruginosa PA01
agcgccggcggccugcccc

SEQ ID NO: 1510096 - RNA, 14 nt, Pseudomonas aeruginosa PA01
agcgccggcggcgc

SEQ ID NO: 1510097 - RNA, 15 nt, Pseudomonas aeruginosa PA01
agcgccggcggcgcg

SEQ ID NO: 1510098 - RNA, 21 nt, Pseudomonas aeruginosa PA01
agcggcgguagcuccaggccg

SEQ ID NO: 1510099 - RNA, 19 nt, Pseudomonas aeruginosa PA01
agcggcggucccaucagca

SEQ ID NO: 1510100 - RNA, 17 nt, Pseudomonas aeruginosa PA01
agcggcggugcgccggc

SEQ ID NO: 1510101 - RNA, 18 nt, Pseudomonas aeruginosa PA01
agcggcgucugccgcucg

SEQ ID NO: 1510102 - RNA, 16 nt, Pseudomonas aeruginosa PA01
agcggcgugaagccgc

SEQ ID NO: 1510103 - RNA, 22 nt, Pseudomonas aeruginosa PA01
agcggcgugaagccgccgccca

SEQ ID NO: 1510104 - RNA, 17 nt, Pseudomonas aeruginosa PA01
agcgggacgaugccgau

SEQ ID NO: 1510105 - RNA, 21 nt, Pseudomonas aeruginosa PA01
agcggcguuucuuuuugccgg

SEQ ID NO: 1510106 - RNA, 21 nt, Pseudomonas aeruginosa PA01
agcggcucacgccccagcgca

SEQ ID NO: 1510107 - RNA, 21 nt, Pseudomonas aeruginosa PA01
agcggcuccucggccugggcg

SEQ ID NO: 1510108 - RNA, 15 nt, Pseudomonas aeruginosa PA01
agcgggaaggucggc

SEQ ID NO: 1510109 - RNA, 21 nt, Pseudomonas aeruginosa PA01
agcgggaaggucggcagcagc

SEQ ID NO: 1510110 - RNA, 17 nt, Pseudomonas aeruginosa PA01
agcgggcgguagaucuc

SEQ ID NO: 1510111 - RNA, 18 nt, Pseudomonas aeruginosa PA01
agcgggcggucgcggacc

SEQ ID NO: 1510112 - RNA, 16 nt, Pseudomonas aeruginosa PA01
agcgggcgagggcggc

SEQ ID NO: 1510113 - RNA, 13 nt, Pseudomonas aeruginosa PA01
agcgggcgccgga

SEQ ID NO: 1510114 - RNA, 13 nt, Pseudomonas aeruginosa PA01
agcgggcgcggua

SEQ ID NO: 1510115 - RNA, 15 nt, Pseudomonas aeruginosa PA01
agcgggccucggcgg

SEQ ID NO: 1510116 - RNA, 17 nt, Pseudomonas aeruginosa PA01
agcgggccuucgccagc

SEQ ID NO: 1510117 - RNA, 20 nt, Pseudomonas aeruginosa PA01
agcgggccuucgccagcggc

SEQ ID NO: 1510118 - RNA, 15 nt, Pseudomonas aeruginosa PA01
agcgggccagcagcu

SEQ ID NO: 1510119 - RNA, 18 nt, Pseudomonas aeruginosa PA01
agcgggccagcagcuccg

SEQ ID NO: 1510120 - RNA, 15 nt, Pseudomonas aeruginosa PA01
agcgggccgauccgc

SEQ ID NO: 1510121 - RNA, 16 nt, Pseudomonas aeruginosa PA01
agcgggccgauccgcg

SEQ ID NO: 1510122 - RNA, 17 nt, Pseudomonas aeruginosa PA01
agcggcgaagcgcaggc

SEQ ID NO: 1510123 - RNA, 18 nt, Pseudomonas aeruginosa PA01
agcggccggcgcggcgcg

SEQ ID NO: 1510124 - RNA, 12 nt, Pseudomonas aeruginosa PA01
agcggcggcgcc

SEQ ID NO: 1510125 - RNA, 19 nt, Pseudomonas aeruginosa PA01
agcggcgacaccgccagca

SEQ ID NO: 1510126 - RNA, 16 nt, Pseudomonas aeruginosa PA01
agcggcccgagcaggc

SEQ ID NO: 1510127 - RNA, 17 nt, Pseudomonas aeruginosa PA01
agcggcccgagcaggcu

SEQ ID NO: 1510128 - RNA, 19 nt, Pseudomonas aeruginosa PA01
agcggccccgagcgggccg

SEQ ID NO: 1510129 - RNA, 15 nt, Pseudomonas aeruginosa PA01
agcggcccagcgccc

SEQ ID NO: 1510130 - RNA, 18 nt, Pseudomonas aeruginosa PA01
agcggcccggcaggcgca

SEQ ID NO: 1510131 - RNA, 19 nt, Pseudomonas aeruginosa PA01
agcggcccggcaggcgcac

SEQ ID NO: 1510132 - RNA, 17 nt, Pseudomonas aeruginosa PA01
agcggccgaccaggccg

SEQ ID NO: 1510133 - RNA, 13 nt, Pseudomonas aeruginosa PA01
agcggcaacgcgc

SEQ ID NO: 1510134 - RNA, 21 nt, Pseudomonas aeruginosa PA01
agcggcaauguccgagcaggu

SEQ ID NO: 1510135 - RNA, 13 nt, Pseudomonas aeruginosa PA01
agcguuaucgccg

SEQ ID NO: 1510136 - RNA, 22 nt, Pseudomonas aeruginosa PA01
agcguguggcgaaacuccagca

SEQ ID NO: 1510137 - RNA, 20 nt, Pseudomonas aeruginosa PA01
agcgucgcgucggccuggcg

SEQ ID NO: 1510138 - RNA, 23 nt, Pseudomonas aeruginosa PA01
agcgucgcgccgcccggcucgcc

SEQ ID NO: 1510139 - RNA, 12 nt, Pseudomonas aeruginosa PA01
agcgucgccggg

SEQ ID NO: 1510140 - RNA, 20 nt, Pseudomonas aeruginosa PA01
agcgucgggcgggaucaggu

SEQ ID NO: 1510141 - RNA, 23 nt, Pseudomonas aeruginosa PA01
agcgucgggcgggaucaggucgc

SEQ ID NO: 1510142 - RNA, 17 nt, Pseudomonas aeruginosa PA01
agcgucgugcgccggcc

SEQ ID NO: 1510143 - RNA, 13 nt, Pseudomonas aeruginosa PA01
agcgucgccaggc

SEQ ID NO: 1510144 - RNA, 14 nt, Pseudomonas aeruginosa PA01
agcgucgccaggcc

SEQ ID NO: 1510145 - RNA, 18 nt, Pseudomonas aeruginosa PA01
agcguccaccagcgcccg

SEQ ID NO: 1510146 - RNA, 19 nt, Pseudomonas aeruginosa PA01
agcguccaggugcggcugg

SEQ ID NO: 1510147 - RNA, 17 nt, Pseudomonas aeruginosa PA01
agcggugugcucaggcg

SEQ ID NO: 1510148 - RNA, 18 nt, Pseudomonas aeruginosa PA01
agcggugugcucaggcga

SEQ ID NO: 1510149 - RNA, 15 nt, Pseudomonas aeruginosa PA01
agcgguugagcaggg

SEQ ID NO: 1510150 - RNA, 14 nt, Pseudomonas aeruginosa PA01
agcgguuauucgcc

SEQ ID NO: 1510151 - RNA, 15 nt, Pseudomonas aeruginosa PA01
agcgguucgcccgcg

SEQ ID NO: 1510152 - RNA, 16 nt, Pseudomonas aeruginosa PA01
agcgguuagccggcga

SEQ ID NO: 1510153 - RNA, 17 nt, Pseudomonas aeruginosa PA01
agcgguuagccggcgau

SEQ ID NO: 1510154 - RNA, 16 nt, Pseudomonas aeruginosa PA01
agcguaucgaugcgcg

SEQ ID NO: 1510155 - RNA, 21 nt, Pseudomonas aeruginosa PA01
agcguaucgaugcgcgcggcg

SEQ ID NO: 1510156 - RNA, 22 nt, Pseudomonas aeruginosa PA01
agcguaucgaugcgcgcggcga

SEQ ID NO: 1510157 - RNA, 17 nt, Pseudomonas aeruginosa PA01
agcgucagccgcggccg

SEQ ID NO: 1510158 - RNA, 18 nt, Pseudomonas aeruginosa PA01
agcgucagccgcggccgg

SEQ ID NO: 1510159 - RNA, 13 nt, Pseudomonas aeruginosa PA01
agcgucagcgcgc

SEQ ID NO: 1510160 - RNA, 15 nt, Pseudomonas aeruginosa PA01
agcgucagcgcgcca

SEQ ID NO: 1510161 - RNA, 16 nt, Pseudomonas aeruginosa PA01
agcuaccgucggccug

SEQ ID NO: 1510162 - RNA, 16 nt, Pseudomonas aeruginosa PA01
agcucagcaggucgcg

SEQ ID NO: 1510163 - RNA, 21 nt, Pseudomonas aeruginosa PA01
agcucagucgguagagcagcu

SEQ ID NO: 1510164 - RNA, 20 nt, Pseudomonas aeruginosa PA01
agcucagucgguagagcagu

SEQ ID NO: 1510165 - RNA, 16 nt, Pseudomonas aeruginosa PA01
agcucauaggucaggu

SEQ ID NO: 1510166 - RNA, 11 nt, Pseudomonas aeruginosa PA01
agcucgaucac

SEQ ID NO: 1510167 - RNA, 18 nt, Pseudomonas aeruginosa PA01
agcucgaucagcccgcca

SEQ ID NO: 1510168 - RNA, 18 nt, Pseudomonas aeruginosa PA01
agcucgacccgcccgccg

SEQ ID NO: 1510169 - RNA, 21 nt, Pseudomonas aeruginosa PA01
agcuccagcgcccaggugcga

SEQ ID NO: 1510170 - RNA, 12 nt, Pseudomonas aeruginosa PA01
agcucgcccgcc

SEQ ID NO: 1510171 - RNA, 13 nt, Pseudomonas aeruginosa PA01
agcucgcccgccu

SEQ ID NO: 1510172 - RNA, 20 nt, Pseudomonas aeruginosa PA01
agcucgccgagguugcugcg

SEQ ID NO: 1510173 - RNA, 13 nt, Pseudomonas aeruginosa PA01
agcuccuggucgc

SEQ ID NO: 1510174 - RNA, 19 nt, Pseudomonas aeruginosa PA01
agcucgaucucauggucgg

SEQ ID NO: 1510175 - RNA, 20 nt, Pseudomonas aeruginosa PA01
agcuccagcaccggcggcgc

SEQ ID NO: 1510176 - RNA, 22 nt, Pseudomonas aeruginosa PA01
agcuccagcaccggcggcgcca

SEQ ID NO: 1510177 - RNA, 13 nt, Pseudomonas aeruginosa PA01
agcucauggagca

SEQ ID NO: 1510178 - RNA, 18 nt, Pseudomonas aeruginosa PA01
agcuccagcagucgcaca

SEQ ID NO: 1510179 - RNA, 13 nt, Pseudomonas aeruginosa PA01
agcuccaccaggc

SEQ ID NO: 1510180 - RNA, 16 nt, Pseudomonas aeruginosa PA01
agcucgaacagcaccg

SEQ ID NO: 1510181 - RNA, 13 nt, Pseudomonas aeruginosa PA01
agcucgaagccgc

SEQ ID NO: 1510182 - RNA, 20 nt, Pseudomonas aeruginosa PA01
agcuccuugcucucgcgcac

SEQ ID NO: 1510183 - RNA, 20 nt, Pseudomonas aeruginosa PA01
agcugccccucguggcgcga

SEQ ID NO: 1510184 - RNA, 13 nt, Pseudomonas aeruginosa PA01
agcugcacggcga

SEQ ID NO: 1510185 - RNA, 14 nt, Pseudomonas aeruginosa PA01
agcugcacggcgac

SEQ ID NO: 1510186 - RNA, 22 nt, Pseudomonas aeruginosa PA01
agcugcaaggcuucggcgguca

SEQ ID NO: 1510187 - RNA, 13 nt, Pseudomonas aeruginosa PA01
agcugcagcgccc

SEQ ID NO: 1510188 - RNA, 15 nt, Pseudomonas aeruginosa PA01
agcugccagccccgc

SEQ ID NO: 1510189 - RNA, 20 nt, Pseudomonas aeruginosa PA01
agcugccgcuucggcugcug

SEQ ID NO: 1510190 - RNA, 23 nt, Pseudomonas aeruginosa PA01
agcugccgaauugggucugcugg

SEQ ID NO: 1510191 - RNA, 18 nt, Pseudomonas aeruginosa PA01
agcugccuuccagcaggu

SEQ ID NO: 1510192 - RNA, 17 nt, Pseudomonas aeruginosa PA01
agcugccgggcgagcug

SEQ ID NO: 1510193 - RNA, 15 nt, Pseudomonas aeruginosa PA01
agcugcgcagggcgc

SEQ ID NO: 1510194 - RNA, 16 nt, Pseudomonas aeruginosa PA01
agcugcgcagggcgcc

SEQ ID NO: 1510195 - RNA, 14 nt, Pseudomonas aeruginosa PA01
agcugcgccgccuu

SEQ ID NO: 1510196 - RNA, 15 nt, Pseudomonas aeruginosa PA01
agcugcgccgccuuu

SEQ ID NO: 1510197 - RNA, 23 nt, Pseudomonas aeruginosa PA01
agcugcgccgccuuucugcccgg

SEQ ID NO: 1510198 - RNA, 22 nt, Pseudomonas aeruginosa PA01
agcucggccaggcacagguuga

SEQ ID NO: 1510199 - RNA, 15 nt, Pseudomonas aeruginosa PA01
agcucggcacgcagc

SEQ ID NO: 1510200 - RNA, 16 nt, Pseudomonas aeruginosa PA01
agcucggcagcacgcu

SEQ ID NO: 1510201 - RNA, 17 nt, Pseudomonas aeruginosa PA01
agcucggcaucgucgaa

SEQ ID NO: 1510202 - RNA, 16 nt, Pseudomonas aeruginosa PA01
agcucgccgcuccaca

SEQ ID NO: 1510203 - RNA, 17 nt, Pseudomonas aeruginosa PA01
agcucggccgagggcag

SEQ ID NO: 1510204 - RNA, 20 nt, Pseudomonas aeruginosa PA01
agcucggccgagggcagccu

SEQ ID NO: 1510205 - RNA, 19 nt, Pseudomonas aeruginosa PA01
agcucggccaucagcgcca

SEQ ID NO: 1510206 - RNA, 12 nt, Pseudomonas aeruginosa PA01
agcucggccugg

SEQ ID NO: 1510207 - RNA, 21 nt, Pseudomonas aeruginosa PA01
agcucggcgacauagccggcg

SEQ ID NO: 1510208 - RNA, 22 nt, Pseudomonas aeruginosa PA01
agcucggcgauccgcgcuuccg

SEQ ID NO: 1510209 - RNA, 15 nt, Pseudomonas aeruginosa PA01
agcucggcgaugccg

SEQ ID NO: 1510210 - RNA, 22 nt, Pseudomonas aeruginosa PA01
agcucggcgaugccgccgggca

SEQ ID NO: 1510211 - RNA, 16 nt, Pseudomonas aeruginosa PA01
agcucggcgauggcgc

SEQ ID NO: 1510212 - RNA, 20 nt, Pseudomonas aeruginosa PA01
agcucggcgauggcgcgcgg

SEQ ID NO: 1510213 - RNA, 12 nt, Pseudomonas aeruginosa PA01
agcugcaccgcg

SEQ ID NO: 1510214 - RNA, 14 nt, Pseudomonas aeruginosa PA01
agcugcaccgcgcg

SEQ ID NO: 1510215 - RNA, 17 nt, Pseudomonas aeruginosa PA01
agcucggugagcaggcg

SEQ ID NO: 1510216 - RNA, 17 nt, Pseudomonas aeruginosa PA01
agcucggcguagcgcug

SEQ ID NO: 1510217 - RNA, 19 nt, Pseudomonas aeruginosa PA01
agcucggcgcccuggccgc

SEQ ID NO: 1510218 - RNA, 23 nt, Pseudomonas aeruginosa PA01
agcucggcgcgaugaugccgccg

SEQ ID NO: 1510219 - RNA, 13 nt, Pseudomonas aeruginosa PA01
agcucggccggca

SEQ ID NO: 1510220 - RNA, 12 nt, Pseudomonas aeruginosa PA01
uuuuuucagccu

SEQ ID NO: 1510221 - RNA, 21 nt, Pseudomonas aeruginosa PA01
uuuaccguggaaccgauggcc

SEQ ID NO: 1510222 - RNA, 13 nt, Pseudomonas aeruginosa PA01
uuuucgaaaauaa

SEQ ID NO: 1510223 - RNA, 16 nt, Pseudomonas aeruginosa PA01
uuuucauccugcggaa

SEQ ID NO: 1510224 - RNA, 17 nt, Pseudomonas aeruginosa PA01
ucucugcaucucggucu

SEQ ID NO: 1510225 - RNA, 17 nt, Pseudomonas aeruginosa PA01
ucucuuccucgcugccu

SEQ ID NO: 1510226 - RNA, 19 nt, Pseudomonas aeruginosa PA01
ucucuacgccguaggccac

SEQ ID NO: 1510227 - RNA, 22 nt, Pseudomonas aeruginosa PA01
ucucgucgccgcccggcagcgg

SEQ ID NO: 1510228 - RNA, 14 nt, Pseudomonas aeruginosa PA01
ucucgucgccgccg

SEQ ID NO: 1510229 - RNA, 14 nt, Pseudomonas aeruginosa PA01
ucucgucguagucg

SEQ ID NO: 1510230 - RNA, 21 nt, Pseudomonas aeruginosa PA01
ucucgacuuccgccuuguccu

SEQ ID NO: 1510231 - RNA, 16 nt, Pseudomonas aeruginosa PA01
ucucggcggccaggcg

SEQ ID NO: 1510232 - RNA, 12 nt, Pseudomonas aeruginosa PA01
ucucggcugccg

SEQ ID NO: 1510233 - RNA, 16 nt, Pseudomonas aeruginosa PA01
ucucggcugccgccag

SEQ ID NO: 1510234 - RNA, 22 nt, Pseudomonas aeruginosa PA01
ucucggcgaacgacagcaccau

SEQ ID NO: 1510235 - RNA, 16 nt, Pseudomonas aeruginosa PA01
ucucgcugacccaggc

SEQ ID NO: 1510236 - RNA, 21 nt, Pseudomonas aeruginosa PA01
ucucccugaagggagagggaa

SEQ ID NO: 1510237 - RNA, 22 nt, Pseudomonas aeruginosa PA01
ucucccugaagggagagggaac

SEQ ID NO: 1510238 - RNA, 16 nt, Pseudomonas aeruginosa PA01
ucuccgaguccugcug

SEQ ID NO: 1510239 - RNA, 17 nt, Pseudomonas aeruginosa PA01
ucuccgccagccagccg

SEQ ID NO: 1510240 - RNA, 20 nt, Pseudomonas aeruginosa PA01
ucuccgccgcuaucgccgcc

SEQ ID NO: 1510241 - RNA, 23 nt, Pseudomonas aeruginosa PA01
ucuccgccgcuaucgccgccgca

SEQ ID NO: 1510242 - RNA, 15 nt, Pseudomonas aeruginosa PA01
ucuccucccgccccu

SEQ ID NO: 1510243 - RNA, 23 nt, Pseudomonas aeruginosa PA01
ucuccucccgccccuccaguucc

SEQ ID NO: 1510244 - RNA, 21 nt, Pseudomonas aeruginosa PA01
ucuccucgauccgcugggccu

SEQ ID NO: 1510245 - RNA, 19 nt, Pseudomonas aeruginosa PA01
ucuccucgcgcagcggcuc

SEQ ID NO: 1510246 - RNA, 16 nt, Pseudomonas aeruginosa PA01
ucucauugcgccgccg

SEQ ID NO: 1510247 - RNA, 21 nt, Pseudomonas aeruginosa PA01
ucuccaggucgaacagcggcu

SEQ ID NO: 1510248 - RNA, 23 nt, Pseudomonas aeruginosa PA01
ucuccaggucggucggcggcggu

SEQ ID NO: 1510249 - RNA, 15 nt, Pseudomonas aeruginosa PA01
ucuccaggcccaucc

SEQ ID NO: 1510250 - RNA, 14 nt, Pseudomonas aeruginosa PA01
ucugucccugggcc

SEQ ID NO: 1510251 - RNA, 17 nt, Pseudomonas aeruginosa PA01
ucuggugcgcguccauc

SEQ ID NO: 1510252 - RNA, 17 nt, Pseudomonas aeruginosa PA01
ucuggcggcccugguug

SEQ ID NO: 1510253 - RNA, 21 nt, Pseudomonas aeruginosa PA01
ucugcacgucguagcccuucu

SEQ ID NO: 1510254 - RNA, 15 nt, Pseudomonas aeruginosa PA01
ucugcaccgcccuuu

SEQ ID NO: 1510255 - RNA, 15 nt, Pseudomonas aeruginosa PA01
ucugcaccucaugcu

SEQ ID NO: 1510256 - RNA, 16 nt, Pseudomonas aeruginosa PA01
ucugcaccucaugcug

SEQ ID NO: 1510257 - RNA, 15 nt, Pseudomonas aeruginosa PA01
ucugcaccuuggcca

SEQ ID NO: 1510258 - RNA, 22 nt, Pseudomonas aeruginosa PA01
ucugcaccaggcucgccccggc

SEQ ID NO: 1510259 - RNA, 20 nt, Pseudomonas aeruginosa PA01
ucugcgcguugcagcgccug

SEQ ID NO: 1510260 - RNA, 16 nt, Pseudomonas aeruginosa PA01
ucugcucguccaggcc

SEQ ID NO: 1510261 - RNA, 18 nt, Pseudomonas aeruginosa PA01
ucugcuggccgcgcagga

SEQ ID NO: 1510262 - RNA, 13 nt, Pseudomonas aeruginosa PA01
ucugcuggccacc

SEQ ID NO: 1510263 - RNA, 16 nt, Pseudomonas aeruginosa PA01
ucugcuggccacccuu

SEQ ID NO: 1510264 - RNA, 16 nt, Pseudomonas aeruginosa PA01
ucugcugcgcgcacca

SEQ ID NO: 1510265 - RNA, 13 nt, Pseudomonas aeruginosa PA01
ucugcuccagcaa

SEQ ID NO: 1510266 - RNA, 17 nt, Pseudomonas aeruginosa PA01
ucugcucggccagcgcc

SEQ ID NO: 1510267 - RNA, 14 nt, Pseudomonas aeruginosa PA01
ucugcucggccugg

SEQ ID NO: 1510268 - RNA, 15 nt, Pseudomonas aeruginosa PA01
ucugcucggccugga

SEQ ID NO: 1510269 - RNA, 18 nt, Pseudomonas aeruginosa PA01
ucuucacuuccagcugcc

SEQ ID NO: 1510270 - RNA, 17 nt, Pseudomonas aeruginosa PA01
ucuucagcagcaggcgc

SEQ ID NO: 1510271 - RNA, 17 nt, Pseudomonas aeruginosa PA01
ucuucacgccuugcugc

SEQ ID NO: 1510272 - RNA, 14 nt, Pseudomonas aeruginosa PA01
ucuucaccaggccg

SEQ ID NO: 1510273 - RNA, 13 nt, Pseudomonas aeruginosa PA01
ucuucaucaccuu

SEQ ID NO: 1510274 - RNA, 16 nt, Pseudomonas aeruginosa PA01
ugaaacgacaacccug

SEQ ID NO: 1510275 - RNA, 14 nt, Pseudomonas aeruginosa PA01
ugaaagggaaaucc

SEQ ID NO: 1510276 - RNA, 14 nt, Pseudomonas aeruginosa PA01
ugaaagagccccuc

SEQ ID NO: 1510277 - RNA, 22 nt, Pseudomonas aeruginosa PA01
ugaaaaauggccgcuugaagcg

SEQ ID NO: 1510278 - RNA, 11 nt, Pseudomonas aeruginosa PA01
ugaaaaaggga

SEQ ID NO: 1510279 - RNA, 14 nt, Pseudomonas aeruginosa PA01
ugaaaaagggaugc

SEQ ID NO: 1510280 - RNA, 15 nt, Pseudomonas aeruginosa PA01
ugaaccuguugcuca

SEQ ID NO: 1510281 - RNA, 14 nt, Pseudomonas aeruginosa PA01
ugaacgacuccagc

SEQ ID NO: 1510282 - RNA, 13 nt, Pseudomonas aeruginosa PA01
ugaacgccaggca

SEQ ID NO: 1510283 - RNA, 21 nt, Pseudomonas aeruginosa PA01
ugaacacauagaccagcagcg

SEQ ID NO: 1510284 - RNA, 12 nt, Pseudomonas aeruginosa PA01
ugaacaccagcg

SEQ ID NO: 1510285 - RNA, 17 nt, Pseudomonas aeruginosa PA01
ugaacaccgcuucgagc

SEQ ID NO: 1510286 - RNA, 17 nt, Pseudomonas aeruginosa PA01
ugaacagggucuugucu

SEQ ID NO: 1510287 - RNA, 21 nt, Pseudomonas aeruginosa PA01
ugaacagcgacucgaugcgca

SEQ ID NO: 1510288 - RNA, 21 nt, Pseudomonas aeruginosa PA01
ugaacagcuggcgcgucgcug

SEQ ID NO: 1510289 - RNA, 22 nt, Pseudomonas aeruginosa PA01
ugaacaggcggauaucggccuc

SEQ ID NO: 1510290 - RNA, 18 nt, Pseudomonas aeruginosa PA01
ugaacagcaggaugccgc

SEQ ID NO: 1510291 - RNA, 20 nt, Pseudomonas aeruginosa PA01
ugaacagcaggaugccgcug

SEQ ID NO: 1510292 - RNA, 16 nt, Pseudomonas aeruginosa PA01
ugaaauuaaaggaaua

SEQ ID NO: 1510293 - RNA, 15 nt, Pseudomonas aeruginosa PA01
ugaaauccaccagca

SEQ ID NO: 1510294 - RNA, 14 nt, Pseudomonas aeruginosa PA01
ucuuggcucggcag

SEQ ID NO: 1510295 - RNA, 15 nt, Pseudomonas aeruginosa PA01
ucuugggcucugccu

SEQ ID NO: 1510296 - RNA, 14 nt, Pseudomonas aeruginosa PA01
ucuugcugccggcg

SEQ ID NO: 1510297 - RNA, 13 nt, Pseudomonas aeruginosa PA01
ucuuccaggugau

SEQ ID NO: 1510298 - RNA, 12 nt, Pseudomonas aeruginosa PA01
ucuuccagggcg

SEQ ID NO: 1510299 - RNA, 17 nt, Pseudomonas aeruginosa PA01
ucuucccagaccccggc

SEQ ID NO: 1510300 - RNA, 17 nt, Pseudomonas aeruginosa PA01
ucuuucaccuggucgcc

SEQ ID NO: 1510301 - RNA, 18 nt, Pseudomonas aeruginosa PA01
ucuuucacgguaaaacaa

SEQ ID NO: 1510302 - RNA, 12 nt, Pseudomonas aeruginosa PA01
ucuuuuccugcu

SEQ ID NO: 1510303 - RNA, 22 nt, Pseudomonas aeruginosa PA01
ucggauggccguccaggcugcc

SEQ ID NO: 1510304 - RNA, 13 nt, Pseudomonas aeruginosa PA01
ucggaugccgcac

SEQ ID NO: 1510305 - RNA, 13 nt, Pseudomonas aeruginosa PA01
ucggccaguuccu

SEQ ID NO: 1510306 - RNA, 19 nt, Pseudomonas aeruginosa PA01
ucggccaugccggccagga

SEQ ID NO: 1510307 - RNA, 17 nt, Pseudomonas aeruginosa PA01
ucggcccgacgccgccc

SEQ ID NO: 1510308 - RNA, 18 nt, Pseudomonas aeruginosa PA01
ucggccauggucucgcug

SEQ ID NO: 1510309 - RNA, 19 nt, Pseudomonas aeruginosa PA01
ucggccagccagggcagca

SEQ ID NO: 1510310 - RNA, 15 nt, Pseudomonas aeruginosa PA01
ucggccagcgccgcc

SEQ ID NO: 1510311 - RNA, 21 nt, Pseudomonas aeruginosa PA01
ucggccagcgccgccgcugcg

SEQ ID NO: 1510312 - RNA, 18 nt, Pseudomonas aeruginosa PA01
ucggccaggcgccagggc

SEQ ID NO: 1510313 - RNA, 15 nt, Pseudomonas aeruginosa PA01
ucggccagcgcggcg

SEQ ID NO: 1510314 - RNA, 21 nt, Pseudomonas aeruginosa PA01
ucggccaggucgcgggugaag

SEQ ID NO: 1510315 - RNA, 19 nt, Pseudomonas aeruginosa PA01
ucggccagggccgcucgag

SEQ ID NO: 1510316 - RNA, 21 nt, Pseudomonas aeruginosa PA01
ucggccaggggagcgccggcg

SEQ ID NO: 1510317 - RNA, 18 nt, Pseudomonas aeruginosa PA01
ucggcgacagccgggcag

SEQ ID NO: 1510318 - RNA, 21 nt, Pseudomonas aeruginosa PA01
ucggcgaagcggaagcgcagc

SEQ ID NO: 1510319 - RNA, 22 nt, Pseudomonas aeruginosa PA01
ucggcgaagcggaagcgcagcc

SEQ ID NO: 1510320 - RNA, 16 nt, Pseudomonas aeruginosa PA01
ucggcgacgcggauac

SEQ ID NO: 1510321 - RNA, 14 nt, Pseudomonas aeruginosa PA01
ucggcgagcaggcg

SEQ ID NO: 1510322 - RNA, 20 nt, Pseudomonas aeruginosa PA01
ucggcgagccgcagcggcuc

SEQ ID NO: 1510323 - RNA, 15 nt, Pseudomonas aeruginosa PA01
ucggcgagccgccgg

SEQ ID NO: 1510324 - RNA, 23 nt, Pseudomonas aeruginosa PA01
ucggcgaccuugcgcaccagggc

SEQ ID NO: 1510325 - RNA, 18 nt, Pseudomonas aeruginosa PA01
ucggcgaccuugucgaug

SEQ ID NO: 1510326 - RNA, 20 nt, Pseudomonas aeruginosa PA01
ucggccugaucaucugggcc

SEQ ID NO: 1510327 - RNA, 22 nt, Pseudomonas aeruginosa PA01
ucggccugcaacacccaggccu

SEQ ID NO: 1510328 - RNA, 16 nt, Pseudomonas aeruginosa PA01
ucggccucgcggcgcu

SEQ ID NO: 1510329 - RNA, 13 nt, Pseudomonas aeruginosa PA01
ucggccgcggcug

SEQ ID NO: 1510330 - RNA, 20 nt, Pseudomonas aeruginosa PA01
ucggccgggauacagcagcc

SEQ ID NO: 1510331 - RNA, 16 nt, Pseudomonas aeruginosa PA01
ucggccggcaggcugu

SEQ ID NO: 1510332 - RNA, 21 nt, Pseudomonas aeruginosa PA01
ucggcccgcgccauguuccac

SEQ ID NO: 1510333 - RNA, 15 nt, Pseudomonas aeruginosa PA01
ucggccgacaggcug

SEQ ID NO: 1510334 - RNA, 18 nt, Pseudomonas aeruginosa PA01
ucggccgacaggcuggug

SEQ ID NO: 1510335 - RNA, 12 nt, Pseudomonas aeruginosa PA01
ucggcccgcugg

SEQ ID NO: 1510336 - RNA, 16 nt, Pseudomonas aeruginosa PA01
ucggcccggggcucug

SEQ ID NO: 1510337 - RNA, 18 nt, Pseudomonas aeruginosa PA01
ucggcccggggcucugcc

SEQ ID NO: 1510338 - RNA, 23 nt, Pseudomonas aeruginosa PA01
ucggcccuccccuggcccugcau

SEQ ID NO: 1510339 - RNA, 11 nt, Pseudomonas aeruginosa PA01
ucggcccuggg

SEQ ID NO: 1510340 - RNA, 16 nt, Pseudomonas aeruginosa PA01
ucggccgccagggcgu

SEQ ID NO: 1510341 - RNA, 18 nt, Pseudomonas aeruginosa PA01
ucggccgccuggcgugcc

SEQ ID NO: 1510342 - RNA, 14 nt, Pseudomonas aeruginosa PA01
ucgcuguuggucug

SEQ ID NO: 1510343 - RNA, 14 nt, Pseudomonas aeruginosa PA01
ucgcuguucuucag

SEQ ID NO: 1510344 - RNA, 22 nt, Pseudomonas aeruginosa PA01
ucgcuguagcggcucgccgaaa

SEQ ID NO: 1510345 - RNA, 15 nt, Pseudomonas aeruginosa PA01
ucgcuggggugcaga

SEQ ID NO: 1510346 - RNA, 18 nt, Pseudomonas aeruginosa PA01
ucgcuggccugcaggucc

SEQ ID NO: 1510347 - RNA, 14 nt, Pseudomonas aeruginosa PA01
ucgcugcucggccu

SEQ ID NO: 1510348 - RNA, 17 nt, Pseudomonas aeruginosa PA01
ucgcgcaggcgggcggc

SEQ ID NO: 1510349 - RNA, 14 nt, Pseudomonas aeruginosa PA01
ucgcgcagcuccuc

SEQ ID NO: 1510350 - RNA, 21 nt, Pseudomonas aeruginosa PA01
ucgcgcagccaggcgaggaac

SEQ ID NO: 1510351 - RNA, 13 nt, Pseudomonas aeruginosa PA01
ucgcgcagcggcg

SEQ ID NO: 1510352 - RNA, 16 nt, Pseudomonas aeruginosa PA01
ucgcgcagcggcgcgu

SEQ ID NO: 1510353 - RNA, 21 nt, Pseudomonas aeruginosa PA01
ucgcgcacgcuguagaccagc

SEQ ID NO: 1510354 - RNA, 15 nt, Pseudomonas aeruginosa PA01
ucgcgcacggcgaag

SEQ ID NO: 1510355 - RNA, 23 nt, Pseudomonas aeruginosa PA01
ucggaucggauagccgugcagca

SEQ ID NO: 1510356 - RNA, 17 nt, Pseudomonas aeruginosa PA01
ucggauaugccgcucag

SEQ ID NO: 1510357 - RNA, 18 nt, Pseudomonas aeruginosa PA01
ucggagauagccuccucc

SEQ ID NO: 1510358 - RNA, 16 nt, Pseudomonas aeruginosa PA01
ucgcuuuccucggucu

SEQ ID NO: 1510359 - RNA, 20 nt, Pseudomonas aeruginosa PA01
ucggcuucgcguugcaggcg

SEQ ID NO: 1510360 - RNA, 14 nt, Pseudomonas aeruginosa PA01
ucggcugcuugccg

SEQ ID NO: 1510361 - RNA, 19 nt, Pseudomonas aeruginosa PA01
ucggcugcaacgccggccc

SEQ ID NO: 1510362 - RNA, 14 nt, Pseudomonas aeruginosa PA01
ucggcuccaggacc

SEQ ID NO: 1510363 - RNA, 18 nt, Pseudomonas aeruginosa PA01
ucggcguuguccaggcug

SEQ ID NO: 1510364 - RNA, 15 nt, Pseudomonas aeruginosa PA01
ucggcuaaccgccuu

SEQ ID NO: 1510365 - RNA, 18 nt, Pseudomonas aeruginosa PA01
ucggcggucaggccaagc

SEQ ID NO: 1510366 - RNA, 20 nt, Pseudomonas aeruginosa PA01
ucggcgggcugccgcggaag

SEQ ID NO: 1510367 - RNA, 23 nt, Pseudomonas aeruginosa PA01
ucggcgggcugccgcggaagugc

SEQ ID NO: 1510368 - RNA, 13 nt, Pseudomonas aeruginosa PA01
ucggcggcuuccu

SEQ ID NO: 1510369 - RNA, 17 nt, Pseudomonas aeruginosa PA01
ucggcgucgcgcuugcc

SEQ ID NO: 1510370 - RNA, 20 nt, Pseudomonas aeruginosa PA01
ucggcgucuuccggcucgcc

SEQ ID NO: 1510371 - RNA, 21 nt, Pseudomonas aeruginosa PA01
ucggcgugcauggccgggccg

SEQ ID NO: 1510372 - RNA, 16 nt, Pseudomonas aeruginosa PA01
ucggcgugccgggccg

SEQ ID NO: 1510373 - RNA, 22 nt, Pseudomonas aeruginosa PA01
ucggcguagaccuucucguccu

SEQ ID NO: 1510374 - RNA, 15 nt, Pseudomonas aeruginosa PA01
ucggcguagccggcg

SEQ ID NO: 1510375 - RNA, 15 nt, Pseudomonas aeruginosa PA01
ucggcgcgcccggcg

SEQ ID NO: 1510376 - RNA, 14 nt, Pseudomonas aeruginosa PA01
ucggcgcgccgaag

SEQ ID NO: 1510377 - RNA, 16 nt, Pseudomonas aeruginosa PA01
ucggcgccgcgcaccu

SEQ ID NO: 1510378 - RNA, 21 nt, Pseudomonas aeruginosa PA01
ucggcgcccuggguggucugc

SEQ ID NO: 1510379 - RNA, 22 nt, Pseudomonas aeruginosa PA01
ucggcgccauaggccagcaccu

SEQ ID NO: 1510380 - RNA, 15 nt, Pseudomonas aeruginosa PA01
ucggcgaugccggag

SEQ ID NO: 1510381 - RNA, 22 nt, Pseudomonas aeruginosa PA01
ucggcgaugccggagagcagca

SEQ ID NO: 1510382 - RNA, 21 nt, Pseudomonas aeruginosa PA01
ucggcgaugaccagcucggcg

SEQ ID NO: 1510383 - RNA, 18 nt, Pseudomonas aeruginosa PA01
ucggcgauccgcgcuucc

SEQ ID NO: 1510384 - RNA, 23 nt, Pseudomonas aeruginosa PA01
ucggcggaacaaugaaaaagggc

SEQ ID NO: 1510385 - RNA, 22 nt, Pseudomonas aeruginosa PA01
ucggcgcggucggguccgggcc

SEQ ID NO: 1510386 - RNA, 14 nt, Pseudomonas aeruginosa PA01
ucggcgcucaccgc

SEQ ID NO: 1510387 - RNA, 19 nt, Pseudomonas aeruginosa PA01
ucggcgcucggcuccagcc

SEQ ID NO: 1510388 - RNA, 13 nt, Pseudomonas aeruginosa PA01
ucggcgcggcgcu

SEQ ID NO: 1510389 - RNA, 14 nt, Pseudomonas aeruginosa PA01
ucggcggcgcggcg

SEQ ID NO: 1510390 - RNA, 14 nt, Pseudomonas aeruginosa PA01
ucggcggcggccug

SEQ ID NO: 1510391 - RNA, 17 nt, Pseudomonas aeruginosa PA01
ucggcggcgugcagggu

SEQ ID NO: 1510392 - RNA, 13 nt, Pseudomonas aeruginosa PA01
ucggcggccaggc

SEQ ID NO: 1510393 - RNA, 16 nt, Pseudomonas aeruginosa PA01
ucggcggcacgcucca

SEQ ID NO: 1510394 - RNA, 19 nt, Pseudomonas aeruginosa PA01
ucggcggcacccucuuccg

SEQ ID NO: 1510395 - RNA, 23 nt, Pseudomonas aeruginosa PA01
ucggcggccgggucgaggucgag

SEQ ID NO: 1510396 - RNA, 21 nt, Pseudomonas aeruginosa PA01
ucgggaugccgugccguggac

SEQ ID NO: 1510397 - RNA, 19 nt, Pseudomonas aeruginosa PA01
ucgggaucgagcaacagca

SEQ ID NO: 1510398 - RNA, 14 nt, Pseudomonas aeruginosa PA01
ucgggaugcaguuc

SEQ ID NO: 1510399 - RNA, 13 nt, Pseudomonas aeruginosa PA01
ucgggcaccagca

SEQ ID NO: 1510400 - RNA, 23 nt, Pseudomonas aeruginosa PA01
ucgggcagcucguugcacagcgc

SEQ ID NO: 1510401 - RNA, 19 nt, Pseudomonas aeruginosa PA01
ucgggaaaggccgccacgg

SEQ ID NO: 1510402 - RNA, 22 nt, Pseudomonas aeruginosa PA01
ucgggaucguaggcgcgcaccu

SEQ ID NO: 1510403 - RNA, 19 nt, Pseudomonas aeruginosa PA01
ucgggacgcaugcgcggcg

SEQ ID NO: 1510404 - RNA, 22 nt, Pseudomonas aeruginosa PA01
ucggggcgcaaggccagcggca

SEQ ID NO: 1510405 - RNA, 22 nt, Pseudomonas aeruginosa PA01
ucgggguugcguguucccugua

SEQ ID NO: 1510406 - RNA, 16 nt, Pseudomonas aeruginosa PA01
ucggggguucgaaucc

SEQ ID NO: 1510407 - RNA, 22 nt, Pseudomonas aeruginosa PA01
ucgggcggaucgagcagcggcg

SEQ ID NO: 1510408 - RNA, 19 nt, Pseudomonas aeruginosa PA01
ucgggccaugagcagggcg

SEQ ID NO: 1510409 - RNA, 23 nt, Pseudomonas aeruginosa PA01
ucgggcgaaacggcaggccagca

SEQ ID NO: 1510410 - RNA, 15 nt, Pseudomonas aeruginosa PA01
ucgggcgagcgcaga

SEQ ID NO: 1510411 - RNA, 12 nt, Pseudomonas aeruginosa PA01
ucggggccggcg

SEQ ID NO: 1510412 - RNA, 21 nt, Pseudomonas aeruginosa PA01
ucgggcucagaagucccagcg

SEQ ID NO: 1510413 - RNA, 21 nt, Pseudomonas aeruginosa PA01
ucgggcucgacgaggaacgcc

SEQ ID NO: 1510414 - RNA, 16 nt, Pseudomonas aeruginosa PA01
ucgggcuucggcagca

SEQ ID NO: 1510415 - RNA, 23 nt, Pseudomonas aeruginosa PA01
ucgguguaguucaccguccacug

SEQ ID NO: 1510416 - RNA, 19 nt, Pseudomonas aeruginosa PA01
ucgguguccaccaccagca

SEQ ID NO: 1510417 - RNA, 16 nt, Pseudomonas aeruginosa PA01
ucgguuugcgccgaau

SEQ ID NO: 1510418 - RNA, 16 nt, Pseudomonas aeruginosa PA01
ucguaagucagguccu

SEQ ID NO: 1510419 - RNA, 18 nt, Pseudomonas aeruginosa PA01
ucggugacccgcacggcg

SEQ ID NO: 1510420 - RNA, 16 nt, Pseudomonas aeruginosa PA01
ucgguccaacccaugu

SEQ ID NO: 1510421 - RNA, 14 nt, Pseudomonas aeruginosa PA01
ucggucggccagga

SEQ ID NO: 1510422 - RNA, 16 nt, Pseudomonas aeruginosa PA01
ucggucggccaggacg

SEQ ID NO: 1510423 - RNA, 15 nt, Pseudomonas aeruginosa PA01
ucggucaucacgcuu

SEQ ID NO: 1510424 - RNA, 16 nt, Pseudomonas aeruginosa PA01
ucggucaucacgcuuu

SEQ ID NO: 1510425 - RNA, 14 nt, Pseudomonas aeruginosa PA01
ucguccagcggcuc

SEQ ID NO: 1510426 - RNA, 16 nt, Pseudomonas aeruginosa PA01
ucguccagcggcucgc

SEQ ID NO: 1510427 - RNA, 13 nt, Pseudomonas aeruginosa PA01
ucguccaguucca

SEQ ID NO: 1510428 - RNA, 12 nt, Pseudomonas aeruginosa PA01
ucguccagggcg

SEQ ID NO: 1510429 - RNA, 13 nt, Pseudomonas aeruginosa PA01
ucguccaggcaag

SEQ ID NO: 1510430 - RNA, 16 nt, Pseudomonas aeruginosa PA01
ucgucccacuugucca

SEQ ID NO: 1510431 - RNA, 20 nt, Pseudomonas aeruginosa PA01
ucgucgccaaagaaaaggcc

SEQ ID NO: 1510432 - RNA, 13 nt, Pseudomonas aeruginosa PA01
ucgucgcccuuca

SEQ ID NO: 1510433 - RNA, 13 nt, Pseudomonas aeruginosa PA01
ucgucgccgaccc

SEQ ID NO: 1510434 - RNA, 13 nt, Pseudomonas aeruginosa PA01
ucgucgcggcgcc

SEQ ID NO: 1510435 - RNA, 15 nt, Pseudomonas aeruginosa PA01
ucgucgcggacuccg

SEQ ID NO: 1510436 - RNA, 14 nt, Pseudomonas aeruginosa PA01
ucgucgcucugggu

SEQ ID NO: 1510437 - RNA, 12 nt, Pseudomonas aeruginosa PA01
ucgucggcccgc

SEQ ID NO: 1510438 - RNA, 15 nt, Pseudomonas aeruginosa PA01
ucgucguaguggccg

SEQ ID NO: 1510439 - RNA, 19 nt, Pseudomonas aeruginosa PA01
ucuaauuucaugucugcaa

SEQ ID NO: 1510440 - RNA, 15 nt, Pseudomonas aeruginosa PA01
ucuaagguuuuccgu

SEQ ID NO: 1510441 - RNA, 14 nt, Pseudomonas aeruginosa PA01
ucguuggccaggcg

SEQ ID NO: 1510442 - RNA, 16 nt, Pseudomonas aeruginosa PA01
ucguuggcccagaccu

SEQ ID NO: 1510443 - RNA, 18 nt, Pseudomonas aeruginosa PA01
ucguuggcccagaccuug

SEQ ID NO: 1510444 - RNA, 23 nt, Pseudomonas aeruginosa PA01
ucguucguagaucccuucguccu

SEQ ID NO: 1510445 - RNA, 18 nt, Pseudomonas aeruginosa PA01
ucguucggcgaccauuca

SEQ ID NO: 1510446 - RNA, 14 nt, Pseudomonas aeruginosa PA01
ucguucuuccugag

SEQ ID NO: 1510447 - RNA, 14 nt, Pseudomonas aeruginosa PA01
ucguucgagcagcu

SEQ ID NO: 1510448 - RNA, 14 nt, Pseudomonas aeruginosa PA01
ucguucgcccuuca

SEQ ID NO: 1510449 - RNA, 18 nt, Pseudomonas aeruginosa PA01
ucguucauguagcgcucc

SEQ ID NO: 1510450 - RNA, 15 nt, Pseudomonas aeruginosa PA01
uccuucaaccacucc

SEQ ID NO: 1510451 - RNA, 19 nt, Pseudomonas aeruginosa PA01
uccuuccaggguuuccagc

SEQ ID NO: 1510452 - RNA, 17 nt, Pseudomonas aeruginosa PA01
uccuucgagccuggcca

SEQ ID NO: 1510453 - RNA, 20 nt, Pseudomonas aeruginosa PA01
uccuucgagccuggccaggc

SEQ ID NO: 1510454 - RNA, 16 nt, Pseudomonas aeruginosa PA01
uccuucagcugguucc

SEQ ID NO: 1510455 - RNA, 14 nt, Pseudomonas aeruginosa PA01
uccuucggaggucg

SEQ ID NO: 1510456 - RNA, 23 nt, Pseudomonas aeruginosa PA01
uccuucuuguauaccagcggcug

SEQ ID NO: 1510457 - RNA, 13 nt, Pseudomonas aeruginosa PA01
uccuugauccacu

SEQ ID NO: 1510458 - RNA, 14 nt, Pseudomonas aeruginosa PA01
uccuugaccaucuu

SEQ ID NO: 1510459 - RNA, 12 nt, Pseudomonas aeruginosa PA01
uccuugagcauc

SEQ ID NO: 1510460 - RNA, 13 nt, Pseudomonas aeruginosa PA01
uccuugagcaucc

SEQ ID NO: 1510461 - RNA, 16 nt, Pseudomonas aeruginosa PA01
uccuugcccggcgcca

SEQ ID NO: 1510462 - RNA, 20 nt, Pseudomonas aeruginosa PA01
uccuugcugaagcccaggcg

SEQ ID NO: 1510463 - RNA, 13 nt, Pseudomonas aeruginosa PA01
uccugcauggcuu

SEQ ID NO: 1510464 - RNA, 22 nt, Pseudomonas aeruginosa PA01
uccugcggccguucgcccuuca

SEQ ID NO: 1510465 - RNA, 14 nt, Pseudomonas aeruginosa PA01
uccugcggcggcag

SEQ ID NO: 1510466 - RNA, 23 nt, Pseudomonas aeruginosa PA01
uccugcucagcggcccagcgccc

SEQ ID NO: 1510467 - RNA, 14 nt, Pseudomonas aeruginosa PA01
ucagccuggccagc

SEQ ID NO: 1510468 - RNA, 21 nt, Pseudomonas aeruginosa PA01
ucagcgagagcuguccggcgc

SEQ ID NO: 1510469 - RNA, 23 nt, Pseudomonas aeruginosa PA01
ucagcgaguugaccuuggccaug

SEQ ID NO: 1510470 - RNA, 11 nt, Pseudomonas aeruginosa PA01
uccugcagcag

SEQ ID NO: 1510471 - RNA, 15 nt, Pseudomonas aeruginosa PA01
uccugcugcuggccu

SEQ ID NO: 1510472 - RNA, 23 nt, Pseudomonas aeruginosa PA01
uccugcugagcagucgccuggcc

SEQ ID NO: 1510473 - RNA, 13 nt, Pseudomonas aeruginosa PA01
uccugcuccuccg

SEQ ID NO: 1510474 - RNA, 20 nt, Pseudomonas aeruginosa PA01
uccugcugguugaccaggcc

SEQ ID NO: 1510475 - RNA, 19 nt, Pseudomonas aeruginosa PA01
uccuggacgugggaaauca

SEQ ID NO: 1510476 - RNA, 19 nt, Pseudomonas aeruginosa PA01
uccuguggauaaaaaggcc

SEQ ID NO: 1510477 - RNA, 13 nt, Pseudomonas aeruginosa PA01
uccuguaccaggg

SEQ ID NO: 1510478 - RNA, 18 nt, Pseudomonas aeruginosa PA01
ucgaagucgaagcagccc

SEQ ID NO: 1510479 - RNA, 20 nt, Pseudomonas aeruginosa PA01
ucgaaaucgcccaccagguc

SEQ ID NO: 1510480 - RNA, 13 nt, Pseudomonas aeruginosa PA01
ucgaacagcagca

SEQ ID NO: 1510481 - RNA, 21 nt, Pseudomonas aeruginosa PA01
ucgaacagguaguugaggucg

SEQ ID NO: 1510482 - RNA, 22 nt, Pseudomonas aeruginosa PA01
ucgaacagguggcuuuccagca

SEQ ID NO: 1510483 - RNA, 19 nt, Pseudomonas aeruginosa PA01
ucgaacagcuugacgaucu

SEQ ID NO: 1510484 - RNA, 15 nt, Pseudomonas aeruginosa PA01
ucgacagcagcgcca

SEQ ID NO: 1510485 - RNA, 20 nt, Pseudomonas aeruginosa PA01
ucgacagcagcgccagggcc

SEQ ID NO: 1510486 - RNA, 23 nt, Pseudomonas aeruginosa PA01
ucgacccgcccgccguccuccag

SEQ ID NO: 1510487 - RNA, 22 nt, Pseudomonas aeruginosa PA01
ucgacgauguacugcucgguau

SEQ ID NO: 1510488 - RNA, 14 nt, Pseudomonas aeruginosa PA01
ucgaccggcgcgcc

SEQ ID NO: 1510489 - RNA, 16 nt, Pseudomonas aeruginosa PA01
uccuuuuuccgaccuu

SEQ ID NO: 1510490 - RNA, 19 nt, Pseudomonas aeruginosa PA01
uccuuucggaacagcgccu

SEQ ID NO: 1510491 - RNA, 17 nt, Pseudomonas aeruginosa PA01
uccuuuccuccgucguu

SEQ ID NO: 1510492 - RNA, 21 nt, Pseudomonas aeruginosa PA01
uccuuucacaugcaccaggcc

SEQ ID NO: 1510493 - RNA, 22 nt, Pseudomonas aeruginosa PA01
uccuugguguuggucaggcccu

SEQ ID NO: 1510494 - RNA, 22 nt, Pseudomonas aeruginosa PA01
uccuuggcuggccagcccuggu

SEQ ID NO: 1510495 - RNA, 20 nt, Pseudomonas aeruginosa PA01
uccuuguuccugggcggcaa

SEQ ID NO: 1510496 - RNA, 15 nt, Pseudomonas aeruginosa PA01
uccuuguccagggcc

SEQ ID NO: 1510497 - RNA, 18 nt, Pseudomonas aeruginosa PA01
uccuugucgaucaggaac

SEQ ID NO: 1510498 - RNA, 16 nt, Pseudomonas aeruginosa PA01
ucgaggacgugcacca

SEQ ID NO: 1510499 - RNA, 15 nt, Pseudomonas aeruginosa PA01
ucgaggcgcuccacc

SEQ ID NO: 1510500 - RNA, 20 nt, Pseudomonas aeruginosa PA01
ucgaggccgcccagcgcagc

SEQ ID NO: 1510501 - RNA, 21 nt, Pseudomonas aeruginosa PA01
ucgaggccgcccagcgcagcc

SEQ ID NO: 1510502 - RNA, 20 nt, Pseudomonas aeruginosa PA01
ucgaggguacuccuggcaug

SEQ ID NO: 1510503 - RNA, 23 nt, Pseudomonas aeruginosa PA01
ucgagggguaaggcaugcccagg

SEQ ID NO: 1510504 - RNA, 22 nt, Pseudomonas aeruginosa PA01
ucgagggugguuuccaggcuca

SEQ ID NO: 1510505 - RNA, 19 nt, Pseudomonas aeruginosa PA01
ucgagguagucggugaagc

SEQ ID NO: 1510506 - RNA, 13 nt, Pseudomonas aeruginosa PA01
ucgagcugcgagg

SEQ ID NO: 1510507 - RNA, 15 nt, Pseudomonas aeruginosa PA01
ucgagcugcucggcg

SEQ ID NO: 1510508 - RNA, 15 nt, Pseudomonas aeruginosa PA01
ucgagcuggcgcagg

SEQ ID NO: 1510509 - RNA, 16 nt, Pseudomonas aeruginosa PA01
ucgagcucggccaggc

SEQ ID NO: 1510510 - RNA, 13 nt, Pseudomonas aeruginosa PA01
ucgacgcucugcu

SEQ ID NO: 1510511 - RNA, 18 nt, Pseudomonas aeruginosa PA01
ucgagcuuguuggccagc

SEQ ID NO: 1510512 - RNA, 22 nt, Pseudomonas aeruginosa PA01
ucgagcuuguuggccagcagcc

SEQ ID NO: 1510513 - RNA, 19 nt, Pseudomonas aeruginosa PA01
ucgacgcuggucaggcuga

SEQ ID NO: 1510514 - RNA, 16 nt, Pseudomonas aeruginosa PA01
ucgacgcccuggcgcu

SEQ ID NO: 1510515 - RNA, 12 nt, Pseudomonas aeruginosa PA01
ucgacgccgaaa

SEQ ID NO: 1510516 - RNA, 13 nt, Pseudomonas aeruginosa PA01
ucgacgccagcgg

SEQ ID NO: 1510517 - RNA, 17 nt, Pseudomonas aeruginosa PA01
ucgacgcagcgcgcgcc

SEQ ID NO: 1510518 - RNA, 20 nt, Pseudomonas aeruginosa PA01
ucgacgcgcggcugcuugcc

SEQ ID NO: 1510519 - RNA, 15 nt, Pseudomonas aeruginosa PA01
ucgacgccagcggcg

SEQ ID NO: 1510520 - RNA, 18 nt, Pseudomonas aeruginosa PA01
ucgaucacugccuggcag

SEQ ID NO: 1510521 - RNA, 18 nt, Pseudomonas aeruginosa PA01
ucgaucgcuucgcggauc

SEQ ID NO: 1510522 - RNA, 14 nt, Pseudomonas aeruginosa PA01
ucgaucggcccggg

SEQ ID NO: 1510523 - RNA, 18 nt, Pseudomonas aeruginosa PA01
ucgauaacaccaggagcg

SEQ ID NO: 1510524 - RNA, 22 nt, Pseudomonas aeruginosa PA01
ucgauaacaccaggagcgccag

SEQ ID NO: 1510525 - RNA, 13 nt, Pseudomonas aeruginosa PA01
ucgagucccgucc

SEQ ID NO: 1510526 - RNA, 16 nt, Pseudomonas aeruginosa PA01
ucgcacagccaggggc

SEQ ID NO: 1510527 - RNA, 20 nt, Pseudomonas aeruginosa PA01
ucgcaccagccuuccggcac

SEQ ID NO: 1510528 - RNA, 23 nt, Pseudomonas aeruginosa PA01
ucgcaccagccuuccggcaccac

SEQ ID NO: 1510529 - RNA, 18 nt, Pseudomonas aeruginosa PA01
ucgcaccaggccaggugg

SEQ ID NO: 1510530 - RNA, 18 nt, Pseudomonas aeruginosa PA01
ucgcaauugaucauccag

SEQ ID NO: 1510531 - RNA, 13 nt, Pseudomonas aeruginosa PA01
ucgcacccggccc

SEQ ID NO: 1510532 - RNA, 16 nt, Pseudomonas aeruginosa PA01
ucgcagaacgcggaaa

SEQ ID NO: 1510533 - RNA, 21 nt, Pseudomonas aeruginosa PA01
ucgcacuggucggccaguucc

SEQ ID NO: 1510534 - RNA, 22 nt, Pseudomonas aeruginosa PA01
ucgcacuggucggccaguuccu

SEQ ID NO: 1510535 - RNA, 15 nt, Pseudomonas aeruginosa PA01
ucgauugcugggugc

SEQ ID NO: 1510536 - RNA, 18 nt, Pseudomonas aeruginosa PA01
ucgaugacguugcugccc

SEQ ID NO: 1510537 - RNA, 20 nt, Pseudomonas aeruginosa PA01
ucgaucucgccgaaggugca

SEQ ID NO: 1510538 - RNA, 19 nt, Pseudomonas aeruginosa PA01
ucgaucucgcguuccagca

SEQ ID NO: 1510539 - RNA, 16 nt, Pseudomonas aeruginosa PA01
ucgaucucgaagacca

SEQ ID NO: 1510540 - RNA, 14 nt, Pseudomonas aeruginosa PA01
ucgaucuggcugcc

SEQ ID NO: 1510541 - RNA, 22 nt, Pseudomonas aeruginosa PA01
ucgaucuggcugcccaggcuga

SEQ ID NO: 1510542 - RNA, 19 nt, Pseudomonas aeruginosa PA01
ucgaugaaauagcucugcc

SEQ ID NO: 1510543 - RNA, 14 nt, Pseudomonas aeruginosa PA01
ucgaugaacgcccu

SEQ ID NO: 1510544 - RNA, 22 nt, Pseudomonas aeruginosa PA01
ucgaugaacgcccugacccgca

SEQ ID NO: 1510545 - RNA, 21 nt, Pseudomonas aeruginosa PA01
ucgccgcacaccgcgcgcgcc

SEQ ID NO: 1510546 - RNA, 18 nt, Pseudomonas aeruginosa PA01
ucgccgaugcgccgacgc

SEQ ID NO: 1510547 - RNA, 16 nt, Pseudomonas aeruginosa PA01
ucgccgcugggcagca

SEQ ID NO: 1510548 - RNA, 12 nt, Pseudomonas aeruginosa PA01
ucgccgcgcgcc

SEQ ID NO: 1510549 - RNA, 18 nt, Pseudomonas aeruginosa PA01
ucgccgcucauccgcugg

SEQ ID NO: 1510550 - RNA, 23 nt, Pseudomonas aeruginosa PA01
ucgccgaccaggcggccgucggc

SEQ ID NO: 1510551 - RNA, 15 nt, Pseudomonas aeruginosa PA01
ucgccgaccgccaag

SEQ ID NO: 1510552 - RNA, 21 nt, Pseudomonas aeruginosa PA01
ucgccgacguccuccaggacc

SEQ ID NO: 1510553 - RNA, 21 nt, Pseudomonas aeruginosa PA01
ucgccgacaacgaaaagagcc

SEQ ID NO: 1510554 - RNA, 16 nt, Pseudomonas aeruginosa PA01
ucgccgaccacuucca

SEQ ID NO: 1510555 - RNA, 15 nt, Pseudomonas aeruginosa PA01
ucgccgagguugcug

SEQ ID NO: 1510556 - RNA, 14 nt, Pseudomonas aeruginosa PA01
ucgccgaucaccag

SEQ ID NO: 1510557 - RNA, 21 nt, Pseudomonas aeruginosa PA01
ucgcccuugcugcccaguacc

SEQ ID NO: 1510558 - RNA, 22 nt, Pseudomonas aeruginosa PA01
ucgcccuggccgaucagcuugg

SEQ ID NO: 1510559 - RNA, 12 nt, Pseudomonas aeruginosa PA01
ucgcccuggugc

SEQ ID NO: 1510560 - RNA, 13 nt, Pseudomonas aeruginosa PA01
ucgcccuggugca

SEQ ID NO: 1510561 - RNA, 16 nt, Pseudomonas aeruginosa PA01
ucgccgaaggugcagg

SEQ ID NO: 1510562 - RNA, 14 nt, Pseudomonas aeruginosa PA01
ucgccgaaguacuc

SEQ ID NO: 1510563 - RNA, 18 nt, Pseudomonas aeruginosa PA01
ucgccgaaagcacgcgca

SEQ ID NO: 1510564 - RNA, 14 nt, Pseudomonas aeruginosa PA01
ucgccugggccggc

SEQ ID NO: 1510565 - RNA, 23 nt, Pseudomonas aeruginosa PA01
ucgccugguaggcggcgacgaag

SEQ ID NO: 1510566 - RNA, 22 nt, Pseudomonas aeruginosa PA01
ucgcgcaccgccucgugcagca

SEQ ID NO: 1510567 - RNA, 15 nt, Pseudomonas aeruginosa PA01
ucgccuugcccuggc

SEQ ID NO: 1510568 - RNA, 22 nt, Pseudomonas aeruginosa PA01
ucgccuuccggcagguucagca

SEQ ID NO: 1510569 - RNA, 18 nt, Pseudomonas aeruginosa PA01
ucgccuuccaccaccagg

SEQ ID NO: 1510570 - RNA, 16 nt, Pseudomonas aeruginosa PA01
ucgccggucaggcugc

SEQ ID NO: 1510571 - RNA, 17 nt, Pseudomonas aeruginosa PA01
ucgccggugacgcugcu

SEQ ID NO: 1510572 - RNA, 18 nt, Pseudomonas aeruginosa PA01
ucgccguagaacagcacg

SEQ ID NO: 1510573 - RNA, 14 nt, Pseudomonas aeruginosa PA01
ucgccguuggccuu

SEQ ID NO: 1510574 - RNA, 23 nt, Pseudomonas aeruginosa PA01
ucgccguuggcgaggacuuucuu

SEQ ID NO: 1510575 - RNA, 21 nt, Pseudomonas aeruginosa PA01
ucgccguggaugucgaggaac

SEQ ID NO: 1510576 - RNA, 15 nt, Pseudomonas aeruginosa PA01
ucgcccuacagcccc

SEQ ID NO: 1510577 - RNA, 14 nt, Pseudomonas aeruginosa PA01
ucgcccuacccccc

SEQ ID NO: 1510578 - RNA, 18 nt, Pseudomonas aeruginosa PA01
ucgcccuaccgcccaccc

SEQ ID NO: 1510579 - RNA, 13 nt, Pseudomonas aeruginosa PA01
ucgcccucggcca

SEQ ID NO: 1510580 - RNA, 16 nt, Pseudomonas aeruginosa PA01
ucgcccugcguggaac

SEQ ID NO: 1510581 - RNA, 18 nt, Pseudomonas aeruginosa PA01
ucgcccugcuuggccagc

SEQ ID NO: 1510582 - RNA, 16 nt, Pseudomonas aeruginosa PA01
ucgcccgccugauggc

SEQ ID NO: 1510583 - RNA, 14 nt, Pseudomonas aeruginosa PA01
ucgcccgcggcggc

SEQ ID NO: 1510584 - RNA, 16 nt, Pseudomonas aeruginosa PA01
ucgcccgcgggcagcu

SEQ ID NO: 1510585 - RNA, 17 nt, Pseudomonas aeruginosa PA01
ucgcccgcugcgcugcc

SEQ ID NO: 1510586 - RNA, 20 nt, Pseudomonas aeruginosa PA01
ucgcccagugguuccaggag

SEQ ID NO: 1510587 - RNA, 12 nt, Pseudomonas aeruginosa PA01
ucgcccccuuca

SEQ ID NO: 1510588 - RNA, 15 nt, Pseudomonas aeruginosa PA01
ucgccccacagcggu

SEQ ID NO: 1510589 - RNA, 17 nt, Pseudomonas aeruginosa PA01
ucgcccagggccagcgg

SEQ ID NO: 1510590 - RNA, 16 nt, Pseudomonas aeruginosa PA01
ucgcccaggccgcugg

SEQ ID NO: 1510591 - RNA, 23 nt, Pseudomonas aeruginosa PA01
ucgcccagcucuucacauggugg

SEQ ID NO: 1510592 - RNA, 13 nt, Pseudomonas aeruginosa PA01
ucgcccagcggcu

SEQ ID NO: 1510593 - RNA, 19 nt, Pseudomonas aeruginosa PA01
ucgcccagaccugcaauuc

SEQ ID NO: 1510594 - RNA, 22 nt, Pseudomonas aeruginosa PA01
ucgcaguagcuguugugucccg

SEQ ID NO: 1510595 - RNA, 22 nt, Pseudomonas aeruginosa PA01
ucgcagucgggcucagaagucc

SEQ ID NO: 1510596 - RNA, 22 nt, Pseudomonas aeruginosa PA01
ucgcauaggcggccagccuucc

SEQ ID NO: 1510597 - RNA, 18 nt, Pseudomonas aeruginosa PA01
ucgccauuggccaggguc

SEQ ID NO: 1510598 - RNA, 16 nt, Pseudomonas aeruginosa PA01
ucgccaugcggcaggc

SEQ ID NO: 1510599 - RNA, 20 nt, Pseudomonas aeruginosa PA01
ucgccaugcggcaggccuuc

SEQ ID NO: 1510600 - RNA, 14 nt, Pseudomonas aeruginosa PA01
ucgccauggcgcug

SEQ ID NO: 1510601 - RNA, 18 nt, Pseudomonas aeruginosa PA01
ucgccaucgcucaccgga

SEQ ID NO: 1510602 - RNA, 18 nt, Pseudomonas aeruginosa PA01
ugauaccgcuggccaggu

SEQ ID NO: 1510603 - RNA, 19 nt, Pseudomonas aeruginosa PA01
ugagcaucugggucuucag

SEQ ID NO: 1510604 - RNA, 20 nt, Pseudomonas aeruginosa PA01
ugagcaucugggucuucagc

SEQ ID NO: 1510605 - RNA, 20 nt, Pseudomonas aeruginosa PA01
ugaguucgaagcgccaggcg

SEQ ID NO: 1510606 - RNA, 20 nt, Pseudomonas aeruginosa PA01
ugauaucguuguucagcagg

SEQ ID NO: 1510607 - RNA, 20 nt, Pseudomonas aeruginosa PA01
ugauauuagcgauucccagu

SEQ ID NO: 1510608 - RNA, 21 nt, Pseudomonas aeruginosa PA01
ugaucaguaccggcagcgccg

SEQ ID NO: 1510609 - RNA, 18 nt, Pseudomonas aeruginosa PA01
ugaucaggccgagcaccg

SEQ ID NO: 1510610 - RNA, 22 nt, Pseudomonas aeruginosa PA01
ugaucaggaggaucgccaggac

SEQ ID NO: 1510611 - RNA, 21 nt, Pseudomonas aeruginosa PA01
ugauagcgcggccuucagcgg

SEQ ID NO: 1510612 - RNA, 21 nt, Pseudomonas aeruginosa PA01
ugaugcccggucaccacccag

SEQ ID NO: 1510613 - RNA, 19 nt, Pseudomonas aeruginosa PA01
ugaugccgaggcggccgua

SEQ ID NO: 1510614 - RNA, 20 nt, Pseudomonas aeruginosa PA01
ugaugccgccguugacgauc

SEQ ID NO: 1510615 - RNA, 15 nt, Pseudomonas aeruginosa PA01
ugaugccgcggacgg

SEQ ID NO: 1510616 - RNA, 19 nt, Pseudomonas aeruginosa PA01
ugaugccgcgguaggucag

SEQ ID NO: 1510617 - RNA, 15 nt, Pseudomonas aeruginosa PA01
ugaucgguucccgcc

SEQ ID NO: 1510618 - RNA, 22 nt, Pseudomonas aeruginosa PA01
ugaucgguucccgcccgcucau

SEQ ID NO: 1510619 - RNA, 14 nt, Pseudomonas aeruginosa PA01
ugaucaucagcagg

SEQ ID NO: 1510620 - RNA, 15 nt, Pseudomonas aeruginosa PA01
ugaucaucgccugcu

SEQ ID NO: 1510621 - RNA, 17 nt, Pseudomonas aeruginosa PA01
ugaucaucgccugcugg

SEQ ID NO: 1510622 - RNA, 13 nt, Pseudomonas aeruginosa PA01
ugaucuggccacc

SEQ ID NO: 1510623 - RNA, 22 nt, Pseudomonas aeruginosa PA01
ugaucucgcugaguuugcccag

SEQ ID NO: 1510624 - RNA, 18 nt, Pseudomonas aeruginosa PA01
ugauuuacaggacugugc

SEQ ID NO: 1510625 - RNA, 19 nt, Pseudomonas aeruginosa PA01
ugauuuacaggacugugcu

SEQ ID NO: 1510626 - RNA, 15 nt, Pseudomonas aeruginosa PA01
ugauucaggcggcga

SEQ ID NO: 1510627 - RNA, 20 nt, Pseudomonas aeruginosa PA01
ugauugagggucagcuugcc

SEQ ID NO: 1510628 - RNA, 13 nt, Pseudomonas aeruginosa PA01
ugauugaaaaaau

SEQ ID NO: 1510629 - RNA, 23 nt, Pseudomonas aeruginosa PA01
ugaugccuuucggggugcagggg

SEQ ID NO: 1510630 - RNA, 18 nt, Pseudomonas aeruginosa PA01
ugcaccgcggcgcggaug

SEQ ID NO: 1510631 - RNA, 21 nt, Pseudomonas aeruginosa PA01
ugcaccgggccgaccugcccg

SEQ ID NO: 1510632 - RNA, 23 nt, Pseudomonas aeruginosa PA01
ugcaccgcuugccagccgcuucc

SEQ ID NO: 1510633 - RNA, 13 nt, Pseudomonas aeruginosa PA01
ugcaccgcgcugg

SEQ ID NO: 1510634 - RNA, 17 nt, Pseudomonas aeruginosa PA01
ugcaccgaggcgcgccg

SEQ ID NO: 1510635 - RNA, 20 nt, Pseudomonas aeruginosa PA01
ugcaccgaguugaccagcau

SEQ ID NO: 1510636 - RNA, 15 nt, Pseudomonas aeruginosa PA01
ugcaccgucauggug

SEQ ID NO: 1510637 - RNA, 19 nt, Pseudomonas aeruginosa PA01
ugcacgccgugcaucaccg

SEQ ID NO: 1510638 - RNA, 18 nt, Pseudomonas aeruginosa PA01
ugcaccugcucggggccg

SEQ ID NO: 1510639 - RNA, 16 nt, Pseudomonas aeruginosa PA01
ugcacgcccaggcgcu

SEQ ID NO: 1510640 - RNA, 19 nt, Pseudomonas aeruginosa PA01
ugcacggauaccacccgca

SEQ ID NO: 1510641 - RNA, 19 nt, Pseudomonas aeruginosa PA01
ugcacguugcugugcugca

SEQ ID NO: 1510642 - RNA, 19 nt, Pseudomonas aeruginosa PA01
ugcaauugcuugcgcucga

SEQ ID NO: 1510643 - RNA, 12 nt, Pseudomonas aeruginosa PA01
ugcaauuccacc

SEQ ID NO: 1510644 - RNA, 15 nt, Pseudomonas aeruginosa PA01
ugcaccagcaacugg

SEQ ID NO: 1510645 - RNA, 23 nt, Pseudomonas aeruginosa PA01
ugcaccagcaggcgacaaaucgg

SEQ ID NO: 1510646 - RNA, 22 nt, Pseudomonas aeruginosa PA01
ugcaccaggcucgccccggcgg

SEQ ID NO: 1510647 - RNA, 20 nt, Pseudomonas aeruginosa PA01
ugcacccagaccuuccagcc

SEQ ID NO: 1510648 - RNA, 20 nt, Pseudomonas aeruginosa PA01
ugcacccgcuguuucuccag

SEQ ID NO: 1510649 - RNA, 14 nt, Pseudomonas aeruginosa PA01
ugcaccgaagggaa

SEQ ID NO: 1510650 - RNA, 19 nt, Pseudomonas aeruginosa PA01
ugcaacuggaaggccgcgc

SEQ ID NO: 1510651 - RNA, 15 nt, Pseudomonas aeruginosa PA01
ugcaacuggccgaga

SEQ ID NO: 1510652 - RNA, 18 nt, Pseudomonas aeruginosa PA01
ugcaacucgucguccagc

SEQ ID NO: 1510653 - RNA, 22 nt, Pseudomonas aeruginosa PA01
ugcaauagaaaagaauaauuaa

SEQ ID NO: 1510654 - RNA, 14 nt, Pseudomonas aeruginosa PA01
ugcaacaccuggcg

SEQ ID NO: 1510655 - RNA, 18 nt, Pseudomonas aeruginosa PA01
ugcaacacguagcgcagg

SEQ ID NO: 1510656 - RNA, 19 nt, Pseudomonas aeruginosa PA01
ugcaacacccaggccuggg

SEQ ID NO: 1510657 - RNA, 23 nt, Pseudomonas aeruginosa PA01
ugcaacaguggguaggccaggca

SEQ ID NO: 1510658 - RNA, 19 nt, Pseudomonas aeruginosa PA01
ugacgucgaaaccgaacgg

SEQ ID NO: 1510659 - RNA, 14 nt, Pseudomonas aeruginosa PA01
ugacuaacagguca

SEQ ID NO: 1510660 - RNA, 15 nt, Pseudomonas aeruginosa PA01
ugacuuccaucagcu

SEQ ID NO: 1510661 - RNA, 13 nt, Pseudomonas aeruginosa PA01
ugagcaauaugau

SEQ ID NO: 1510662 - RNA, 18 nt, Pseudomonas aeruginosa PA01
ugagaguccuuguccagg

SEQ ID NO: 1510663 - RNA, 20 nt, Pseudomonas aeruginosa PA01
ugagaguccuuguccagggc

SEQ ID NO: 1510664 - RNA, 22 nt, Pseudomonas aeruginosa PA01
ugaccgagauucugcaggcgcu

SEQ ID NO: 1510665 - RNA, 20 nt, Pseudomonas aeruginosa PA01
ugaccgccagacaggccagc

SEQ ID NO: 1510666 - RNA, 18 nt, Pseudomonas aeruginosa PA01
ugacccgguacagcgccu

SEQ ID NO: 1510667 - RNA, 20 nt, Pseudomonas aeruginosa PA01
ugaccaggucguggaaggcu

SEQ ID NO: 1510668 - RNA, 21 nt, Pseudomonas aeruginosa PA01
ugaccaggucguggaaggcuu

SEQ ID NO: 1510669 - RNA, 11 nt, Pseudomonas aeruginosa PA01
ugaccaggcug

SEQ ID NO: 1510670 - RNA, 12 nt, Pseudomonas aeruginosa PA01
ugaccaggcuga

SEQ ID NO: 1510671 - RNA, 12 nt, Pseudomonas aeruginosa PA01
ugaccagggugg

SEQ ID NO: 1510672 - RNA, 16 nt, Pseudomonas aeruginosa PA01
ugaccagcggcccggc

SEQ ID NO: 1510673 - RNA, 18 nt, Pseudomonas aeruginosa PA01
ugaccagagccgccgaac

SEQ ID NO: 1510674 - RNA, 21 nt, Pseudomonas aeruginosa PA01
ugacauccuuggucagggugc

SEQ ID NO: 1510675 - RNA, 12 nt, Pseudomonas aeruginosa PA01
ugacgaaggcug

SEQ ID NO: 1510676 - RNA, 19 nt, Pseudomonas aeruginosa PA01
ugacgaacaucgccagcgc

SEQ ID NO: 1510677 - RNA, 19 nt, Pseudomonas aeruginosa PA01
ugacgaauuccgauuucag

SEQ ID NO: 1510678 - RNA, 18 nt, Pseudomonas aeruginosa PA01
ugaccuucagcaccugcg

SEQ ID NO: 1510679 - RNA, 20 nt, Pseudomonas aeruginosa PA01
ugaccgcgaauggcagcagg

SEQ ID NO: 1510680 - RNA, 17 nt, Pseudomonas aeruginosa PA01
ugaccgcgcgccauggc

SEQ ID NO: 1510681 - RNA, 18 nt, Pseudomonas aeruginosa PA01
ugaccgcgcgccauggcc

SEQ ID NO: 1510682 - RNA, 23 nt, Pseudomonas aeruginosa PA01
ugaccgcccagggggccgggccg

SEQ ID NO: 1510683 - RNA, 12 nt, Pseudomonas aeruginosa PA01
ugaccuucaacg

SEQ ID NO: 1510684 - RNA, 13 nt, Pseudomonas aeruginosa PA01
ugaccugcugggc

SEQ ID NO: 1510685 - RNA, 15 nt, Pseudomonas aeruginosa PA01
ugaccugcugggcca

SEQ ID NO: 1510686 - RNA, 21 nt, Pseudomonas aeruginosa PA01
ugacgacgugcccauuuucca

SEQ ID NO: 1510687 - RNA, 18 nt, Pseudomonas aeruginosa PA01
ugacgcgcagcgccgccg

SEQ ID NO: 1510688 - RNA, 24 nt, Pseudomonas aeruginosa PA01
ugacgcagggcgguacgccgcgcu

SEQ ID NO: 1510689 - RNA, 15 nt, Pseudomonas aeruginosa PA01
ugaacgcuguagaau

SEQ ID NO: 1510690 - RNA, 23 nt, Pseudomonas aeruginosa PA01
ugaacugcagcuugugggcaugc

SEQ ID NO: 1510691 - RNA, 18 nt, Pseudomonas aeruginosa PA01
ugaacucgguguagcuga

SEQ ID NO: 1510692 - RNA, 19 nt, Pseudomonas aeruginosa PA01
ugaacuggucgcuccagcc

SEQ ID NO: 1510693 - RNA, 19 nt, Pseudomonas aeruginosa PA01
ugaagacccugcacaucac

SEQ ID NO: 1510694 - RNA, 21 nt, Pseudomonas aeruginosa PA01
ugaagaagccauugccgaugu

SEQ ID NO: 1510695 - RNA, 13 nt, Pseudomonas aeruginosa PA01
ugaagcgccgcag

SEQ ID NO: 1510696 - RNA, 16 nt, Pseudomonas aeruginosa PA01
ugaagcugcggcuuuc

SEQ ID NO: 1510697 - RNA, 15 nt, Pseudomonas aeruginosa PA01
ugaagcuggagcagc

SEQ ID NO: 1510698 - RNA, 20 nt, Pseudomonas aeruginosa PA01
ugaaggaaaccggccagcgc

SEQ ID NO: 1510699 - RNA, 16 nt, Pseudomonas aeruginosa PA01
ugaagggagagggaac

SEQ ID NO: 1510700 - RNA, 18 nt, Pseudomonas aeruginosa PA01
ugaaggcgcggggcgagg

SEQ ID NO: 1510701 - RNA, 16 nt, Pseudomonas aeruginosa PA01
ugaagguucaggugaa

SEQ ID NO: 1510702 - RNA, 16 nt, Pseudomonas aeruginosa PA01
ugaagcgcugcugggc

SEQ ID NO: 1510703 - RNA, 18 nt, Pseudomonas aeruginosa PA01
ugaagccgccgcccagca

SEQ ID NO: 1510704 - RNA, 22 nt, Pseudomonas aeruginosa PA01
ugaagccgccgcccagcagcac

SEQ ID NO: 1510705 - RNA, 14 nt, Pseudomonas aeruginosa PA01
ugaagcccaggcgc

SEQ ID NO: 1510706 - RNA, 22 nt, Pseudomonas aeruginosa PA01
ugaagccccuggcgcugggccu

SEQ ID NO: 1510707 - RNA, 13 nt, Pseudomonas aeruginosa PA01
ugaagaucaucug

SEQ ID NO: 1510708 - RNA, 21 nt, Pseudomonas aeruginosa PA01
ugaagcacaccuccagcggcu

SEQ ID NO: 1510709 - RNA, 19 nt, Pseudomonas aeruginosa PA01
ugaauagcagccauagcaa

SEQ ID NO: 1510710 - RNA, 12 nt, Pseudomonas aeruginosa PA01
ugaagugccauu

SEQ ID NO: 1510711 - RNA, 18 nt, Pseudomonas aeruginosa PA01
ugcugaacaucagguucc

SEQ ID NO: 1510712 - RNA, 16 nt, Pseudomonas aeruginosa PA01
ugcugaaccuguugcu

SEQ ID NO: 1510713 - RNA, 14 nt, Pseudomonas aeruginosa PA01
ugcugaacuguucg

SEQ ID NO: 1510714 - RNA, 22 nt, Pseudomonas aeruginosa PA01
ugcugagcagucgccuggcccu

SEQ ID NO: 1510715 - RNA, 23 nt, Pseudomonas aeruginosa PA01
ugcucgugcagguagccgcgccg

SEQ ID NO: 1510716 - RNA, 15 nt, Pseudomonas aeruginosa PA01
ugcucguccaggccg

SEQ ID NO: 1510717 - RNA, 18 nt, Pseudomonas aeruginosa PA01
ugcugaaaaacgccuggg

SEQ ID NO: 1510718 - RNA, 13 nt, Pseudomonas aeruginosa PA01
ugcugcaccagca

SEQ ID NO: 1510719 - RNA, 15 nt, Pseudomonas aeruginosa PA01
ugcugcaccagcagg

SEQ ID NO: 1510720 - RNA, 14 nt, Pseudomonas aeruginosa PA01
ugcugaucaggagg

SEQ ID NO: 1510721 - RNA, 15 nt, Pseudomonas aeruginosa PA01
ugcugaucagguugc

SEQ ID NO: 1510722 - RNA, 12 nt, Pseudomonas aeruginosa PA01
ugcugcccagua

SEQ ID NO: 1510723 - RNA, 14 nt, Pseudomonas aeruginosa PA01
ugcugccgaggccg

SEQ ID NO: 1510724 - RNA, 15 nt, Pseudomonas aeruginosa PA01
ugcugccgaggccga

SEQ ID NO: 1510725 - RNA, 21 nt, Pseudomonas aeruginosa PA01
ugcguuucguugcggaacgcg

SEQ ID NO: 1510726 - RNA, 15 nt, Pseudomonas aeruginosa PA01
ugcucaguugcaccu

SEQ ID NO: 1510727 - RNA, 17 nt, Pseudomonas aeruginosa PA01
ugcuccacccgcagccg

SEQ ID NO: 1510728 - RNA, 22 nt, Pseudomonas aeruginosa PA01
ugcucgaaugcuguuccucguc

SEQ ID NO: 1510729 - RNA, 19 nt, Pseudomonas aeruginosa PA01
ugcucgaccaccucggcgu

SEQ ID NO: 1510730 - RNA, 22 nt, Pseudomonas aeruginosa PA01
ugcucgaaagccuccagcagcu

SEQ ID NO: 1510731 - RNA, 18 nt, Pseudomonas aeruginosa PA01
ugcuccucgccguacagc

SEQ ID NO: 1510732 - RNA, 21 nt, Pseudomonas aeruginosa PA01
ugcucgacccgguacagccaa

SEQ ID NO: 1510733 - RNA, 16 nt, Pseudomonas aeruginosa PA01
ugcucgaucaggcugu

SEQ ID NO: 1510734 - RNA, 21 nt, Pseudomonas aeruginosa PA01
ugcucggugugaucaccagcc

SEQ ID NO: 1510735 - RNA, 18 nt, Pseudomonas aeruginosa PA01
ugcucgguugccaggccg

SEQ ID NO: 1510736 - RNA, 22 nt, Pseudomonas aeruginosa PA01
ugcuggcgcaacagaucuuccu

SEQ ID NO: 1510737 - RNA, 16 nt, Pseudomonas aeruginosa PA01
ugcuggcgccgcuggc

SEQ ID NO: 1510738 - RNA, 17 nt, Pseudomonas aeruginosa PA01
ugcuggcgcagccaggc

SEQ ID NO: 1510739 - RNA, 18 nt, Pseudomonas aeruginosa PA01
ugcuggcgcagccaggcg

SEQ ID NO: 1510740 - RNA, 18 nt, Pseudomonas aeruginosa PA01
ugcugggacgccuuguuc

SEQ ID NO: 1510741 - RNA, 18 nt, Pseudomonas aeruginosa PA01
ugcuggcgucgccuucca

SEQ ID NO: 1510742 - RNA, 16 nt, Pseudomonas aeruginosa PA01
ugcugcugcggggccg

SEQ ID NO: 1510743 - RNA, 14 nt, Pseudomonas aeruginosa PA01
ugcugcugcucagc

SEQ ID NO: 1510744 - RNA, 16 nt, Pseudomonas aeruginosa PA01
ugcugcugaucaggag

SEQ ID NO: 1510745 - RNA, 13 nt, Pseudomonas aeruginosa PA01
ugcugcucgccau

SEQ ID NO: 1510746 - RNA, 17 nt, Pseudomonas aeruginosa PA01
ugcugccggcguccuug

SEQ ID NO: 1510747 - RNA, 16 nt, Pseudomonas aeruginosa PA01
ugcugccggcuugcug

SEQ ID NO: 1510748 - RNA, 12 nt, Pseudomonas aeruginosa PA01
ugcugcccuggc

SEQ ID NO: 1510749 - RNA, 14 nt, Pseudomonas aeruginosa PA01
ugcugguuggacac

SEQ ID NO: 1510750 - RNA, 21 nt, Pseudomonas aeruginosa PA01
ugcugggcggcgaggccgacc

SEQ ID NO: 1510751 - RNA, 18 nt, Pseudomonas aeruginosa PA01
ugcugggccuugaucacc

SEQ ID NO: 1510752 - RNA, 12 nt, Pseudomonas aeruginosa PA01
ugcugggccagc

SEQ ID NO: 1510753 - RNA, 15 nt, Pseudomonas aeruginosa PA01
ugcuguugccguggc

SEQ ID NO: 1510754 - RNA, 16 nt, Pseudomonas aeruginosa PA01
ugcuguauuccuugcg

SEQ ID NO: 1510755 - RNA, 19 nt, Pseudomonas aeruginosa PA01
ugcuucaggcgcgcggcca

SEQ ID NO: 1510756 - RNA, 23 nt, Pseudomonas aeruginosa PA01
ugcuucagguagugcaacaccug

SEQ ID NO: 1510757 - RNA, 16 nt, Pseudomonas aeruginosa PA01
ugcuugaccgccgccu

SEQ ID NO: 1510758 - RNA, 14 nt, Pseudomonas aeruginosa PA01
ugcuugaccuugcu

SEQ ID NO: 1510759 - RNA, 15 nt, Pseudomonas aeruginosa PA01
ugcuugaccuugcuc

SEQ ID NO: 1510760 - RNA, 12 nt, Pseudomonas aeruginosa PA01
ugcuugaacacc

SEQ ID NO: 1510761 - RNA, 15 nt, Pseudomonas aeruginosa PA01
ugcuuagcccgggau

SEQ ID NO: 1510762 - RNA, 15 nt, Pseudomonas aeruginosa PA01
ugcuugcacaccugg

SEQ ID NO: 1510763 - RNA, 14 nt, Pseudomonas aeruginosa PA01
ugcuugccgcucag

SEQ ID NO: 1510764 - RNA, 18 nt, Pseudomonas aeruginosa PA01
ugcgccagaccagcccca

SEQ ID NO: 1510765 - RNA, 19 nt, Pseudomonas aeruginosa PA01
ugcgccagaccagccccag

SEQ ID NO: 1510766 - RNA, 21 nt, Pseudomonas aeruginosa PA01
ugcgccagaccagccccaguc

SEQ ID NO: 1510767 - RNA, 19 nt, Pseudomonas aeruginosa PA01
ugcgccagagcaggcggau

SEQ ID NO: 1510768 - RNA, 11 nt, Pseudomonas aeruginosa PA01
ugcgccagcau

SEQ ID NO: 1510769 - RNA, 20 nt, Pseudomonas aeruginosa PA01
ugcgccagguguucguccag

SEQ ID NO: 1510770 - RNA, 15 nt, Pseudomonas aeruginosa PA01
ugcgccaggcccggc

SEQ ID NO: 1510771 - RNA, 18 nt, Pseudomonas aeruginosa PA01
ugcgccaggcccggcgcu

SEQ ID NO: 1510772 - RNA, 22 nt, Pseudomonas aeruginosa PA01
ugcgccaggccuugcagcaacu

SEQ ID NO: 1510773 - RNA, 21 nt, Pseudomonas aeruginosa PA01
ugcgccaggcuuuccgccgag

SEQ ID NO: 1510774 - RNA, 18 nt, Pseudomonas aeruginosa PA01
ugcgccagguagccugga

SEQ ID NO: 1510775 - RNA, 12 nt, Pseudomonas aeruginosa PA01
ugcgccagcucg

SEQ ID NO: 1510776 - RNA, 13 nt, Pseudomonas aeruginosa PA01
ugccuuccaggcu

SEQ ID NO: 1510777 - RNA, 15 nt, Pseudomonas aeruginosa PA01
ugccuuccugggcgu

SEQ ID NO: 1510778 - RNA, 18 nt, Pseudomonas aeruginosa PA01
ugccuuccgcgcccaggc

SEQ ID NO: 1510779 - RNA, 22 nt, Pseudomonas aeruginosa PA01
ugccuuccgcgcccaggcugcc

SEQ ID NO: 1510780 - RNA, 16 nt, Pseudomonas aeruginosa PA01
ugccuuccaccggcgu

SEQ ID NO: 1510781 - RNA, 21 nt, Pseudomonas aeruginosa PA01
ugcgccgaccgcgcgccugca

SEQ ID NO: 1510782 - RNA, 21 nt, Pseudomonas aeruginosa PA01
ugcgccgacgccaccagccag

SEQ ID NO: 1510783 - RNA, 15 nt, Pseudomonas aeruginosa PA01
ugcgccgcagcggcc

SEQ ID NO: 1510784 - RNA, 21 nt, Pseudomonas aeruginosa PA01
ugcgccgcagcggccagggaa

SEQ ID NO: 1510785 - RNA, 19 nt, Pseudomonas aeruginosa PA01
ugcgccgcgggucaccagc

SEQ ID NO: 1510786 - RNA, 23 nt, Pseudomonas aeruginosa PA01
ugcgccgcgggucaccagcgccg

SEQ ID NO: 1510787 - RNA, 14 nt, Pseudomonas aeruginosa PA01
ugcgccggcccagc

SEQ ID NO: 1510788 - RNA, 17 nt, Pseudomonas aeruginosa PA01
ugcgccggcccagcagg

SEQ ID NO: 1510789 - RNA, 20 nt, Pseudomonas aeruginosa PA01
ugcgccggcccagcaggccg

SEQ ID NO: 1510790 - RNA, 13 nt, Pseudomonas aeruginosa PA01
ugcgccgccacgu

SEQ ID NO: 1510791 - RNA, 20 nt, Pseudomonas aeruginosa PA01
ugcgccgccgucuugccgcu

SEQ ID NO: 1510792 - RNA, 14 nt, Pseudomonas aeruginosa PA01
ugcgcccagcagca

SEQ ID NO: 1510793 - RNA, 14 nt, Pseudomonas aeruginosa PA01
ugcgccccgggucg

SEQ ID NO: 1510794 - RNA, 15 nt, Pseudomonas aeruginosa PA01
ugcgccccagcucag

SEQ ID NO: 1510795 - RNA, 17 nt, Pseudomonas aeruginosa PA01
ugcgccccaggugcagc

SEQ ID NO: 1510796 - RNA, 14 nt, Pseudomonas aeruginosa PA01
ugcgcccccagcgc

SEQ ID NO: 1510797 - RNA, 14 nt, Pseudomonas aeruginosa PA01
ugcgcccgcugaag

SEQ ID NO: 1510798 - RNA, 13 nt, Pseudomonas aeruginosa PA01
ugcgcccucccgc

SEQ ID NO: 1510799 - RNA, 12 nt, Pseudomonas aeruginosa PA01
ugcgccuggccg

SEQ ID NO: 1510800 - RNA, 20 nt, Pseudomonas aeruginosa PA01
ugcgcgaggggcggagcagc

SEQ ID NO: 1510801 - RNA, 22 nt, Pseudomonas aeruginosa PA01
ugcgcgaggggcggagcagccu

SEQ ID NO: 1510802 - RNA, 19 nt, Pseudomonas aeruginosa PA01
ugcgcgaauaccgcgcgcg

SEQ ID NO: 1510803 - RNA, 15 nt, Pseudomonas aeruginosa PA01
ugcgcgaaugguuca

SEQ ID NO: 1510804 - RNA, 17 nt, Pseudomonas aeruginosa PA01
ugcgccgguccuugucc

SEQ ID NO: 1510805 - RNA, 14 nt, Pseudomonas aeruginosa PA01
ugcgccuccgggcg

SEQ ID NO: 1510806 - RNA, 22 nt, Pseudomonas aeruginosa PA01
ugcgccucgucgacgcccuggc

SEQ ID NO: 1510807 - RNA, 22 nt, Pseudomonas aeruginosa PA01
ugcgccucacggucgcaggggc

SEQ ID NO: 1510808 - RNA, 18 nt, Pseudomonas aeruginosa PA01
ugcgccugcuucagcccg

SEQ ID NO: 1510809 - RNA, 21 nt, Pseudomonas aeruginosa PA01
ugcgcggcgccgguugcugcu

SEQ ID NO: 1510810 - RNA, 22 nt, Pseudomonas aeruginosa PA01
ugcgcgggucguccuccacccc

SEQ ID NO: 1510811 - RNA, 23 nt, Pseudomonas aeruginosa PA01
ugcgcgggguagggguggccagg

SEQ ID NO: 1510812 - RNA, 18 nt, Pseudomonas aeruginosa PA01
ugcgcguccaucccugcu

SEQ ID NO: 1510813 - RNA, 13 nt, Pseudomonas aeruginosa PA01
ugcgcgcggccug

SEQ ID NO: 1510814 - RNA, 17 nt, Pseudomonas aeruginosa PA01
ugcgcgccucgccccag

SEQ ID NO: 1510815 - RNA, 14 nt, Pseudomonas aeruginosa PA01
ugcgcgccucuucc

SEQ ID NO: 1510816 - RNA, 14 nt, Pseudomonas aeruginosa PA01
ugcgcgcaccaggc

SEQ ID NO: 1510817 - RNA, 16 nt, Pseudomonas aeruginosa PA01
ugcgcgcaccaggccu

SEQ ID NO: 1510818 - RNA, 17 nt, Pseudomonas aeruginosa PA01
ugcgcgcaacuggucgc

SEQ ID NO: 1510819 - RNA, 22 nt, Pseudomonas aeruginosa PA01
ugcgcgcaacuggucgcggcug

SEQ ID NO: 1510820 - RNA, 21 nt, Pseudomonas aeruginosa PA01
ugcgcgcaguaggcgcugccg

SEQ ID NO: 1510821 - RNA, 19 nt, Pseudomonas aeruginosa PA01
ugcgcgcaguucagggcgu

SEQ ID NO: 1510822 - RNA, 14 nt, Pseudomonas aeruginosa PA01
ugcggggugaucuu

SEQ ID NO: 1510823 - RNA, 15 nt, Pseudomonas aeruginosa PA01
ugcggucgggugaag

SEQ ID NO: 1510824 - RNA, 12 nt, Pseudomonas aeruginosa PA01
ugcggucuuuca

SEQ ID NO: 1510825 - RNA, 22 nt, Pseudomonas aeruginosa PA01
ugcggcggcaccacgugcagca

SEQ ID NO: 1510826 - RNA, 21 nt, Pseudomonas aeruginosa PA01
ugcgggccuugaccaccgcca

SEQ ID NO: 1510827 - RNA, 17 nt, Pseudomonas aeruginosa PA01
ugcgggcgaugaggcug

SEQ ID NO: 1510828 - RNA, 13 nt, Pseudomonas aeruginosa PA01
ugcgggcgcaggu

SEQ ID NO: 1510829 - RNA, 17 nt, Pseudomonas aeruginosa PA01
ugcggcgccgaggcccu

SEQ ID NO: 1510830 - RNA, 21 nt, Pseudomonas aeruginosa PA01
ugcggcgccgguugcugcugc

SEQ ID NO: 1510831 - RNA, 22 nt, Pseudomonas aeruginosa PA01
ugcggcgccuagacccugggcc

SEQ ID NO: 1510832 - RNA, 22 nt, Pseudomonas aeruginosa PA01
ugcggcggaacuugucgccgcu

SEQ ID NO: 1510833 - RNA, 20 nt, Pseudomonas aeruginosa PA01
ugcgguugaaacugcgcagg

SEQ ID NO: 1510834 - RNA, 14 nt, Pseudomonas aeruginosa PA01
ugcgguggugucug

SEQ ID NO: 1510835 - RNA, 15 nt, Pseudomonas aeruginosa PA01
ugcguucugcugcuu

SEQ ID NO: 1510836 - RNA, 23 nt, Pseudomonas aeruginosa PA01
ugcgugcgagggcggcggcucag

SEQ ID NO: 1510837 - RNA, 22 nt, Pseudomonas aeruginosa PA01
ugcguugcucgcaccaggccag

SEQ ID NO: 1510838 - RNA, 19 nt, Pseudomonas aeruginosa PA01
ugcgugcguugcgcggcag

SEQ ID NO: 1510839 - RNA, 14 nt, Pseudomonas aeruginosa PA01
ugcgugccagcacc

SEQ ID NO: 1510840 - RNA, 21 nt, Pseudomonas aeruginosa PA01
ugcgugccagggcuucccagg

SEQ ID NO: 1510841 - RNA, 21 nt, Pseudomonas aeruginosa PA01
ugcggcccccagaccguggau

SEQ ID NO: 1510842 - RNA, 13 nt, Pseudomonas aeruginosa PA01
ugcggccagcgcc

SEQ ID NO: 1510843 - RNA, 15 nt, Pseudomonas aeruginosa PA01
ugcggccagcgccag

SEQ ID NO: 1510844 - RNA, 12 nt, Pseudomonas aeruginosa PA01
ugcggccgaugc

SEQ ID NO: 1510845 - RNA, 19 nt, Pseudomonas aeruginosa PA01
ugcggccgcaaccagcccu

SEQ ID NO: 1510846 - RNA, 15 nt, Pseudomonas aeruginosa PA01
ugcggcccuugcuca

SEQ ID NO: 1510847 - RNA, 20 nt, Pseudomonas aeruginosa PA01
ugcggccguucuccgggucg

SEQ ID NO: 1510848 - RNA, 15 nt, Pseudomonas aeruginosa PA01
ugcggagggucaggc

SEQ ID NO: 1510849 - RNA, 21 nt, Pseudomonas aeruginosa PA01
ugcggauagccaaccagaucc

SEQ ID NO: 1510850 - RNA, 18 nt, Pseudomonas aeruginosa PA01
ugcgcguuucucagcgcc

SEQ ID NO: 1510851 - RNA, 23 nt, Pseudomonas aeruginosa PA01
ugcgcguguugcgccgcaccacg

SEQ ID NO: 1510852 - RNA, 21 nt, Pseudomonas aeruginosa PA01
ugcggaacccgcgcaguuccu

SEQ ID NO: 1510853 - RNA, 14 nt, Pseudomonas aeruginosa PA01
ugcgcucagggaca

SEQ ID NO: 1510854 - RNA, 13 nt, Pseudomonas aeruginosa PA01
ugcauccgccgca

SEQ ID NO: 1510855 - RNA, 13 nt, Pseudomonas aeruginosa PA01
ugcaucagccugg

SEQ ID NO: 1510856 - RNA, 15 nt, Pseudomonas aeruginosa PA01
ugcaucagccuggcc

SEQ ID NO: 1510857 - RNA, 18 nt, Pseudomonas aeruginosa PA01
ugcaucagccuggccagc

SEQ ID NO: 1510858 - RNA, 15 nt, Pseudomonas aeruginosa PA01
ugcaucugcgccggg

SEQ ID NO: 1510859 - RNA, 14 nt, Pseudomonas aeruginosa PA01
ugcaucggccgcca

SEQ ID NO: 1510860 - RNA, 22 nt, Pseudomonas aeruginosa PA01
ugcaugauuucguuggcccaga

SEQ ID NO: 1510861 - RNA, 12 nt, Pseudomonas aeruginosa PA01
ugcauggccggg

SEQ ID NO: 1510862 - RNA, 19 nt, Pseudomonas aeruginosa PA01
ugcaugccgacgagcagcu

SEQ ID NO: 1510863 - RNA, 14 nt, Pseudomonas aeruginosa PA01
ugcaugaaggcgcu

SEQ ID NO: 1510864 - RNA, 14 nt, Pseudomonas aeruginosa PA01
ugcauguccgccag

SEQ ID NO: 1510865 - RNA, 15 nt, Pseudomonas aeruginosa PA01
ugcaugucgcugagc

SEQ ID NO: 1510866 - RNA, 19 nt, Pseudomonas aeruginosa PA01
ugcaguugagucgcgcgcg

SEQ ID NO: 1510867 - RNA, 16 nt, Pseudomonas aeruginosa PA01
ugcaucaccggcagca

SEQ ID NO: 1510868 - RNA, 19 nt, Pseudomonas aeruginosa PA01
ugcaucaccggcagcagcg

SEQ ID NO: 1510869 - RNA, 20 nt, Pseudomonas aeruginosa PA01
ugcauuucagcggaagccca

SEQ ID NO: 1510870 - RNA, 17 nt, Pseudomonas aeruginosa PA01
ugccacgcaccaccagg

SEQ ID NO: 1510871 - RNA, 24 nt, Pseudomonas aeruginosa PA01
ugccaucaucggacgccguagcgg

SEQ ID NO: 1510872 - RNA, 15 nt, Pseudomonas aeruginosa PA01
ugccauccagcgccu

SEQ ID NO: 1510873 - RNA, 17 nt, Pseudomonas aeruginosa PA01
ugccaucgaggccaggc

SEQ ID NO: 1510874 - RNA, 18 nt, Pseudomonas aeruginosa PA01
ugccauccgcgccgacca

SEQ ID NO: 1510875 - RNA, 20 nt, Pseudomonas aeruginosa PA01
ugccauccgcgccgaccagc

SEQ ID NO: 1510876 - RNA, 17 nt, Pseudomonas aeruginosa PA01
ugccauggaucaccagg

SEQ ID NO: 1510877 - RNA, 18 nt, Pseudomonas aeruginosa PA01
ugccauggaucaccaggg

SEQ ID NO: 1510878 - RNA, 14 nt, Pseudomonas aeruginosa PA01
ugccagggcaggga

SEQ ID NO: 1510879 - RNA, 14 nt, Pseudomonas aeruginosa PA01
ugccagggccuugc

SEQ ID NO: 1510880 - RNA, 20 nt, Pseudomonas aeruginosa PA01
ugccagggcggucggccagg

SEQ ID NO: 1510881 - RNA, 21 nt, Pseudomonas aeruginosa PA01
ugccagggcggucggccaggg

SEQ ID NO: 1510882 - RNA, 23 nt, Pseudomonas aeruginosa PA01
ugccagggcggucggccagggga

SEQ ID NO: 1510883 - RNA, 10 nt, Pseudomonas aeruginosa PA01
ugccaggcuc

SEQ ID NO: 1510884 - RNA, 17 nt, Pseudomonas aeruginosa PA01
ugccaggcucgccgcca

SEQ ID NO: 1510885 - RNA, 14 nt, Pseudomonas aeruginosa PA01
ugccagcgccgccg

SEQ ID NO: 1510886 - RNA, 16 nt, Pseudomonas aeruginosa PA01
ugccagccggccuugc

SEQ ID NO: 1510887 - RNA, 21 nt, Pseudomonas aeruginosa PA01
ugccagccggccuugcuuugc

SEQ ID NO: 1510888 - RNA, 16 nt, Pseudomonas aeruginosa PA01
ugccagaggaucggcc

SEQ ID NO: 1510889 - RNA, 18 nt, Pseudomonas aeruginosa PA01
ugccagaccgagauuggc

SEQ ID NO: 1510890 - RNA, 18 nt, Pseudomonas aeruginosa PA01
ugccgccgcagagccagc

SEQ ID NO: 1510891 - RNA, 17 nt, Pseudomonas aeruginosa PA01
ugccgccgaugcuguuc

SEQ ID NO: 1510892 - RNA, 12 nt, Pseudomonas aeruginosa PA01
ugccgccgaggg

SEQ ID NO: 1510893 - RNA, 20 nt, Pseudomonas aeruginosa PA01
ugccgccugcgucagcgagg

SEQ ID NO: 1510894 - RNA, 19 nt, Pseudomonas aeruginosa PA01
ugccgccgguucgcaggcc

SEQ ID NO: 1510895 - RNA, 17 nt, Pseudomonas aeruginosa PA01
ugccgccgucgcggcca

SEQ ID NO: 1510896 - RNA, 14 nt, Pseudomonas aeruginosa PA01
ugccgcccgcucaa

SEQ ID NO: 1510897 - RNA, 16 nt, Pseudomonas aeruginosa PA01
ugccgcccggccaggc

SEQ ID NO: 1510898 - RNA, 17 nt, Pseudomonas aeruginosa PA01
ugccgcccggccaggcc

SEQ ID NO: 1510899 - RNA, 13 nt, Pseudomonas aeruginosa PA01
ugccgcccggccg

SEQ ID NO: 1510900 - RNA, 15 nt, Pseudomonas aeruginosa PA01
ugccgcccggcgcca

SEQ ID NO: 1510901 - RNA, 21 nt, Pseudomonas aeruginosa PA01
ugccgcccuccaucagcgccu

SEQ ID NO: 1510902 - RNA, 23 nt, Pseudomonas aeruginosa PA01
ugccgcccuucgaacccgcccuc

SEQ ID NO: 1510903 - RNA, 14 nt, Pseudomonas aeruginosa PA01
ugccgcccuugcca

SEQ ID NO: 1510904 - RNA, 16 nt, Pseudomonas aeruginosa PA01
ugccgcccucgggccg

SEQ ID NO: 1510905 - RNA, 19 nt, Pseudomonas aeruginosa PA01
ugccgcccugcggcaggcg

SEQ ID NO: 1510906 - RNA, 11 nt, Pseudomonas aeruginosa PA01
ugccgcagcag

SEQ ID NO: 1510907 - RNA, 14 nt, Pseudomonas aeruginosa PA01
ugccgcagcagcgg

SEQ ID NO: 1510908 - RNA, 13 nt, Pseudomonas aeruginosa PA01
ugccgcaggcauu

SEQ ID NO: 1510909 - RNA, 20 nt, Pseudomonas aeruginosa PA01
ugccgagcgaaaucggcagg

SEQ ID NO: 1510910 - RNA, 21 nt, Pseudomonas aeruginosa PA01
ugccgagcggaaaagcaggcc

SEQ ID NO: 1510911 - RNA, 13 nt, Pseudomonas aeruginosa PA01
ugccgaggaacgc

SEQ ID NO: 1510912 - RNA, 21 nt, Pseudomonas aeruginosa PA01
ugccgaggaagucggcggccg

SEQ ID NO: 1510913 - RNA, 17 nt, Pseudomonas aeruginosa PA01
ugccgcaccccauccuc

SEQ ID NO: 1510914 - RNA, 15 nt, Pseudomonas aeruginosa PA01
ugccgaucagcccgu

SEQ ID NO: 1510915 - RNA, 20 nt, Pseudomonas aeruginosa PA01
ugccgaucgccgcgcggucg

SEQ ID NO: 1510916 - RNA, 14 nt, Pseudomonas aeruginosa PA01
ugccgaucaggcug

SEQ ID NO: 1510917 - RNA, 23 nt, Pseudomonas aeruginosa PA01
ugccgaucaggcugaagcggccg

SEQ ID NO: 1510918 - RNA, 16 nt, Pseudomonas aeruginosa PA01
ugcccucgaccagguc

SEQ ID NO: 1510919 - RNA, 15 nt, Pseudomonas aeruginosa PA01
ugcccucgcagccgg

SEQ ID NO: 1510920 - RNA, 18 nt, Pseudomonas aeruginosa PA01
ugcccucgcagccggcgg

SEQ ID NO: 1510921 - RNA, 21 nt, Pseudomonas aeruginosa PA01
ugcccucgcggaucugcuccu

SEQ ID NO: 1510922 - RNA, 15 nt, Pseudomonas aeruginosa PA01
ugcccucgcggcggc

SEQ ID NO: 1510923 - RNA, 19 nt, Pseudomonas aeruginosa PA01
ugcccucgcggcggcaggc

SEQ ID NO: 1510924 - RNA, 22 nt, Pseudomonas aeruginosa PA01
ugcccucgcuacggaaggucgc

SEQ ID NO: 1510925 - RNA, 18 nt, Pseudomonas aeruginosa PA01
ugcccugcucuuccagcg

SEQ ID NO: 1510926 - RNA, 19 nt, Pseudomonas aeruginosa PA01
ugcccuggcuuuccagggc

SEQ ID NO: 1510927 - RNA, 22 nt, Pseudomonas aeruginosa PA01
ugcccuggcuuuccagggccug

SEQ ID NO: 1510928 - RNA, 11 nt, Pseudomonas aeruginosa PA01
ugcccugggcc

SEQ ID NO: 1510929 - RNA, 11 nt, Pseudomonas aeruginosa PA01
ugcccuggccg

SEQ ID NO: 1510930 - RNA, 15 nt, Pseudomonas aeruginosa PA01
ugcccuggccgacgc

SEQ ID NO: 1510931 - RNA, 15 nt, Pseudomonas aeruginosa PA01
ugcccuggccgcugc

SEQ ID NO: 1510932 - RNA, 22 nt, Pseudomonas aeruginosa PA01
ugcccuggccggcacccugacc

SEQ ID NO: 1510933 - RNA, 18 nt, Pseudomonas aeruginosa PA01
ugcccgagaagccggggc

SEQ ID NO: 1510934 - RNA, 21 nt, Pseudomonas aeruginosa PA01
ugcccgacgaaguugcaggcc

SEQ ID NO: 1510935 - RNA, 19 nt, Pseudomonas aeruginosa PA01
ugcccgagugccggcgcgu

SEQ ID NO: 1510936 - RNA, 21 nt, Pseudomonas aeruginosa PA01
ugcccgaugccgcgccggaag

SEQ ID NO: 1510937 - RNA, 16 nt, Pseudomonas aeruginosa PA01
ugcccgcgccugggcc

SEQ ID NO: 1510938 - RNA, 17 nt, Pseudomonas aeruginosa PA01
ugcccguggcgcggacg

SEQ ID NO: 1510939 - RNA, 22 nt, Pseudomonas aeruginosa PA01
ugcccguggcgcggacgggccg

SEQ ID NO: 1510940 - RNA, 13 nt, Pseudomonas aeruginosa PA01
ugcccgucaggcc

SEQ ID NO: 1510941 - RNA, 22 nt, Pseudomonas aeruginosa PA01
ugcccgcugcaugugccaggcc

SEQ ID NO: 1510942 - RNA, 12 nt, Pseudomonas aeruginosa PA01
ugccccaggcac

SEQ ID NO: 1510943 - RNA, 13 nt, Pseudomonas aeruginosa PA01
ugccccaggcacg

SEQ ID NO: 1510944 - RNA, 15 nt, Pseudomonas aeruginosa PA01
ugccguugcccucgc

SEQ ID NO: 1510945 - RNA, 18 nt, Pseudomonas aeruginosa PA01
ugccguugcccucgcgcu

SEQ ID NO: 1510946 - RNA, 16 nt, Pseudomonas aeruginosa PA01
ugccguugggccaggg

SEQ ID NO: 1510947 - RNA, 18 nt, Pseudomonas aeruginosa PA01
ugccguugggccagggcc

SEQ ID NO: 1510948 - RNA, 20 nt, Pseudomonas aeruginosa PA01
ugccguuaccuuggccacga

SEQ ID NO: 1510949 - RNA, 18 nt, Pseudomonas aeruginosa PA01
ugccguucgcccgcggcg

SEQ ID NO: 1510950 - RNA, 18 nt, Pseudomonas aeruginosa PA01
ugccguucucggugacca

SEQ ID NO: 1510951 - RNA, 20 nt, Pseudomonas aeruginosa PA01
ugccguucaggccggcgccg

SEQ ID NO: 1510952 - RNA, 12 nt, Pseudomonas aeruginosa PA01
ugccgugcagcu

SEQ ID NO: 1510953 - RNA, 19 nt, Pseudomonas aeruginosa PA01
ugccguggcucggcggcag

SEQ ID NO: 1510954 - RNA, 21 nt, Pseudomonas aeruginosa PA01
ugccgguuuguugcaggcugg

SEQ ID NO: 1510955 - RNA, 19 nt, Pseudomonas aeruginosa PA01
ugccgguaauuggccaggc

SEQ ID NO: 1510956 - RNA, 20 nt, Pseudomonas aeruginosa PA01
ugccgguacgcaccagcggu

SEQ ID NO: 1510957 - RNA, 14 nt, Pseudomonas aeruginosa PA01
ugccggucuugccg

SEQ ID NO: 1510958 - RNA, 16 nt, Pseudomonas aeruginosa PA01
ugccggugccaccguc

SEQ ID NO: 1510959 - RNA, 13 nt, Pseudomonas aeruginosa PA01
ugccggucggccu

SEQ ID NO: 1510960 - RNA, 16 nt, Pseudomonas aeruginosa PA01
ugccuccgcucugcug

SEQ ID NO: 1510961 - RNA, 16 nt, Pseudomonas aeruginosa PA01
ugccucgccgaggcgg

SEQ ID NO: 1510962 - RNA, 17 nt, Pseudomonas aeruginosa PA01
ugccucgcgcguggccg

SEQ ID NO: 1510963 - RNA, 20 nt, Pseudomonas aeruginosa PA01
ugccucgcgcguggccgcca

SEQ ID NO: 1510964 - RNA, 19 nt, Pseudomonas aeruginosa PA01
ugccugcuguguccggcgg

SEQ ID NO: 1510965 - RNA, 13 nt, Pseudomonas aeruginosa PA01
ugccuggaaaaag

SEQ ID NO: 1510966 - RNA, 20 nt, Pseudomonas aeruginosa PA01
ugccuggaauucaggcuucc

SEQ ID NO: 1510967 - RNA, 18 nt, Pseudomonas aeruginosa PA01
ugccgcuagcccugcugc

SEQ ID NO: 1510968 - RNA, 23 nt, Pseudomonas aeruginosa PA01
ugccgcuaucgcuggcgcagccg

SEQ ID NO: 1510969 - RNA, 23 nt, Pseudomonas aeruginosa PA01
ugccgcggaagugcgccgguugc

SEQ ID NO: 1510970 - RNA, 20 nt, Pseudomonas aeruginosa PA01
ugccgcgggcuauucccgcc

SEQ ID NO: 1510971 - RNA, 19 nt, Pseudomonas aeruginosa PA01
ugccgcucaggcugugcag

SEQ ID NO: 1510972 - RNA, 16 nt, Pseudomonas aeruginosa PA01
ugccgcucguggaaaa

SEQ ID NO: 1510973 - RNA, 14 nt, Pseudomonas aeruginosa PA01
ugccgcucugccag

SEQ ID NO: 1510974 - RNA, 18 nt, Pseudomonas aeruginosa PA01
ugccgcucuggcugcugg

SEQ ID NO: 1510975 - RNA, 14 nt, Pseudomonas aeruginosa PA01
ugccgcgagccagc

SEQ ID NO: 1510976 - RNA, 23 nt, Pseudomonas aeruginosa PA01
ugccgcgagcuuggcccuggccu

SEQ ID NO: 1510977 - RNA, 21 nt, Pseudomonas aeruginosa PA01
ugccgccuucgcgggccaggc

SEQ ID NO: 1510978 - RNA, 22 nt, Pseudomonas aeruginosa PA01
ugccgccuucgcgggccaggcc

SEQ ID NO: 1510979 - RNA, 13 nt, Pseudomonas aeruginosa PA01
ugccgcgccaggc

SEQ ID NO: 1510980 - RNA, 14 nt, Pseudomonas aeruginosa PA01
ugccgcgcccggcc

SEQ ID NO: 1510981 - RNA, 17 nt, Pseudomonas aeruginosa PA01
ugccgcgcccggccagg

SEQ ID NO: 1510982 - RNA, 16 nt, Pseudomonas aeruginosa PA01
ugccgcgcccggccuu

SEQ ID NO: 1510983 - RNA, 14 nt, Pseudomonas aeruginosa PA01
ugccgcgcgggccg

SEQ ID NO: 1510984 - RNA, 15 nt, Pseudomonas aeruginosa PA01
ugccgggccagcucc

SEQ ID NO: 1510985 - RNA, 17 nt, Pseudomonas aeruginosa PA01
ugccgggcucugguagc

SEQ ID NO: 1510986 - RNA, 18 nt, Pseudomonas aeruginosa PA01
ugccgggcuuccuggccg

SEQ ID NO: 1510987 - RNA, 17 nt, Pseudomonas aeruginosa PA01
ugccgggccggccaggg

SEQ ID NO: 1510988 - RNA, 15 nt, Pseudomonas aeruginosa PA01
ugccggccggggccg

SEQ ID NO: 1510989 - RNA, 17 nt, Pseudomonas aeruginosa PA01
ugccggccggggccggc

SEQ ID NO: 1510990 - RNA, 20 nt, Pseudomonas aeruginosa PA01
ugccggccgucgcgcaccac

SEQ ID NO: 1510991 - RNA, 21 nt, Pseudomonas aeruginosa PA01
ugccggccaugcaggccaggg

SEQ ID NO: 1510992 - RNA, 23 nt, Pseudomonas aeruginosa PA01
ugccggccagggucgccagcagg

SEQ ID NO: 1510993 - RNA, 12 nt, Pseudomonas aeruginosa PA01
ugccggccaggu

SEQ ID NO: 1510994 - RNA, 14 nt, Pseudomonas aeruginosa PA01
ugccggccaccauc

SEQ ID NO: 1510995 - RNA, 16 nt, Pseudomonas aeruginosa PA01
ugccggacaacaggcc

SEQ ID NO: 1510996 - RNA, 16 nt, Pseudomonas aeruginosa PA01
ugccggaaagccuggc

SEQ ID NO: 1510997 - RNA, 20 nt, Pseudomonas aeruginosa PA01
ugccggaaagccuggccggc

SEQ ID NO: 1510998 - RNA, 20 nt, Pseudomonas aeruginosa PA01
uuagaauaccggccugucac

SEQ ID NO: 1510999 - RNA, 22 nt, Pseudomonas aeruginosa PA01
uuaccccgcccacucuucaguc

SEQ ID NO: 1511000 - RNA, 16 nt, Pseudomonas aeruginosa PA01
uuaaauucaccgagcg

SEQ ID NO: 1511001 - RNA, 20 nt, Pseudomonas aeruginosa PA01
uguugccgcugcaggccacc

SEQ ID NO: 1511002 - RNA, 22 nt, Pseudomonas aeruginosa PA01
uguugcggucgauguccugggc

SEQ ID NO: 1511003 - RNA, 16 nt, Pseudomonas aeruginosa PA01
uuaacaguugagcugu

SEQ ID NO: 1511004 - RNA, 15 nt, Pseudomonas aeruginosa PA01
uucaaccguggcucg

SEQ ID NO: 1511005 - RNA, 18 nt, Pseudomonas aeruginosa PA01
uuaugcgcccuaccuguc

SEQ ID NO: 1511006 - RNA, 14 nt, Pseudomonas aeruginosa PA01
uuauccgccgccgg

SEQ ID NO: 1511007 - RNA, 17 nt, Pseudomonas aeruginosa PA01
uuauccgccgccuaucc

SEQ ID NO: 1511008 - RNA, 19 nt, Pseudomonas aeruginosa PA01
uguacagcucaccccagga

SEQ ID NO: 1511009 - RNA, 22 nt, Pseudomonas aeruginosa PA01
uguacaucgggauaccggccau

SEQ ID NO: 1511010 - RNA, 20 nt, Pseudomonas aeruginosa PA01
uguccagggugaucacaccg

SEQ ID NO: 1511011 - RNA, 20 nt, Pseudomonas aeruginosa PA01
uguccagcgcuccuugcgcc

SEQ ID NO: 1511012 - RNA, 23 nt, Pseudomonas aeruginosa PA01
uguccagcgcuccuugcgccagg

SEQ ID NO: 1511013 - RNA, 19 nt, Pseudomonas aeruginosa PA01
uguccacggaaaaauaccc

SEQ ID NO: 1511014 - RNA, 20 nt, Pseudomonas aeruginosa PA01
uguccacggaaaaauacccc

SEQ ID NO: 1511015 - RNA, 22 nt, Pseudomonas aeruginosa PA01
uguccacgucguaggccgagcc

SEQ ID NO: 1511016 - RNA, 23 nt, Pseudomonas aeruginosa PA01
uguccaccaccagcaggcccagu

SEQ ID NO: 1511017 - RNA, 20 nt, Pseudomonas aeruginosa PA01
ugucccgccgcgccgcucag

SEQ ID NO: 1511018 - RNA, 23 nt, Pseudomonas aeruginosa PA01
ugucccggacgacgaaagaagcc

SEQ ID NO: 1511019 - RNA, 23 nt, Pseudomonas aeruginosa PA01
uguccgaacagggcgaaggccac

SEQ ID NO: 1511020 - RNA, 12 nt, Pseudomonas aeruginosa PA01
uguccgccgccg

SEQ ID NO: 1511021 - RNA, 19 nt, Pseudomonas aeruginosa PA01
uguccgggaaguccgggcg

SEQ ID NO: 1511022 - RNA, 21 nt, Pseudomonas aeruginosa PA01
uguccggguaguccagcgagu

SEQ ID NO: 1511023 - RNA, 17 nt, Pseudomonas aeruginosa PA01
uguccgggugaugcccg

SEQ ID NO: 1511024 - RNA, 16 nt, Pseudomonas aeruginosa PA01
uguccggauugccgcg

SEQ ID NO: 1511025 - RNA, 23 nt, Pseudomonas aeruginosa PA01
uguccgcugcgcgaagccaggaa

SEQ ID NO: 1511026 - RNA, 19 nt, Pseudomonas aeruginosa PA01
uguccugcuccugaaggac

SEQ ID NO: 1511027 - RNA, 12 nt, Pseudomonas aeruginosa PA01
uguccugggcca

SEQ ID NO: 1511028 - RNA, 13 nt, Pseudomonas aeruginosa PA01
uguccuggauaag

SEQ ID NO: 1511029 - RNA, 14 nt, Pseudomonas aeruginosa PA01
ugucgaccuccgcc

SEQ ID NO: 1511030 - RNA, 22 nt, Pseudomonas aeruginosa PA01
ugucgauggucaggaucacauc

SEQ ID NO: 1511031 - RNA, 12 nt, Pseudomonas aeruginosa PA01
ugucgcaccagc

SEQ ID NO: 1511032 - RNA, 14 nt, Pseudomonas aeruginosa PA01
ugucgcagcggccg

SEQ ID NO: 1511033 - RNA, 17 nt, Pseudomonas aeruginosa PA01
ugucgcccucgcggagc

SEQ ID NO: 1511034 - RNA, 16 nt, Pseudomonas aeruginosa PA01
ugucgccguuggccuu

SEQ ID NO: 1511035 - RNA, 19 nt, Pseudomonas aeruginosa PA01
ugucgccgcugggcagcac

SEQ ID NO: 1511036 - RNA, 14 nt, Pseudomonas aeruginosa PA01
ugucggguagggcg

SEQ ID NO: 1511037 - RNA, 16 nt, Pseudomonas aeruginosa PA01
ugucgugccuccagcc

SEQ ID NO: 1511038 - RNA, 17 nt, Pseudomonas aeruginosa PA01
ugucgucggcgcggccg

SEQ ID NO: 1511039 - RNA, 14 nt, Pseudomonas aeruginosa PA01
ugucguaguccugg

SEQ ID NO: 1511040 - RNA, 19 nt, Pseudomonas aeruginosa PA01
ugucgucgaggguggcgcc

SEQ ID NO: 1511041 - RNA, 15 nt, Pseudomonas aeruginosa PA01
ugucguauuccaggg

SEQ ID NO: 1511042 - RNA, 17 nt, Pseudomonas aeruginosa PA01
ugucgcggcccuguaca

SEQ ID NO: 1511043 - RNA, 18 nt, Pseudomonas aeruginosa PA01
ugucgcugaaacgcgcgu

SEQ ID NO: 1511044 - RNA, 15 nt, Pseudomonas aeruginosa PA01
ugucggcucgcgccg

SEQ ID NO: 1511045 - RNA, 16 nt, Pseudomonas aeruginosa PA01
ugucggccgccagggu

SEQ ID NO: 1511046 - RNA, 19 nt, Pseudomonas aeruginosa PA01
ugucguggacgccggugac

SEQ ID NO: 1511047 - RNA, 22 nt, Pseudomonas aeruginosa PA01
ugucguggacgccggugaccca

SEQ ID NO: 1511048 - RNA, 20 nt, Pseudomonas aeruginosa PA01
ugucuaucccgugccgggcc

SEQ ID NO: 1511049 - RNA, 13 nt, Pseudomonas aeruginosa PA01
ugucuccugugcc

SEQ ID NO: 1511050 - RNA, 15 nt, Pseudomonas aeruginosa PA01
ugugaaagggcggca

SEQ ID NO: 1511051 - RNA, 15 nt, Pseudomonas aeruginosa PA01
ugugaucaccagcca

SEQ ID NO: 1511052 - RNA, 15 nt, Pseudomonas aeruginosa PA01
ugugccauuccuggg

SEQ ID NO: 1511053 - RNA, 14 nt, Pseudomonas aeruginosa PA01
ugugcugcaccagc

SEQ ID NO: 1511054 - RNA, 15 nt, Pseudomonas aeruginosa PA01
ugugcugcaccagca

SEQ ID NO: 1511055 - RNA, 17 nt, Pseudomonas aeruginosa PA01
ugugcuuguccaccacc

SEQ ID NO: 1511056 - RNA, 14 nt, Pseudomonas aeruginosa PA01
ugugccgaggccgc

SEQ ID NO: 1511057 - RNA, 18 nt, Pseudomonas aeruginosa PA01
uguggcaggcgcugcagc

SEQ ID NO: 1511058 - RNA, 18 nt, Pseudomonas aeruginosa PA01
ugugcugguuggacaccu

SEQ ID NO: 1511059 - RNA, 12 nt, Pseudomonas aeruginosa PA01
uguguggccugg

SEQ ID NO: 1511060 - RNA, 15 nt, Pseudomonas aeruginosa PA01
ugugguugggcaggc

SEQ ID NO: 1511061 - RNA, 18 nt, Pseudomonas aeruginosa PA01
ugugguugggcaggcgca

SEQ ID NO: 1511062 - RNA, 22 nt, Pseudomonas aeruginosa PA01
uguucuucaguuuauguauucg

SEQ ID NO: 1511063 - RNA, 21 nt, Pseudomonas aeruginosa PA01
uguugacgauggcccagauau

SEQ ID NO: 1511064 - RNA, 23 nt, Pseudomonas aeruginosa PA01
uguucgaucucgcguuccagcac

SEQ ID NO: 1511065 - RNA, 18 nt, Pseudomonas aeruginosa PA01
uguucgccacgcugcugc

SEQ ID NO: 1511066 - RNA, 14 nt, Pseudomonas aeruginosa PA01
uguucgcugccuuc

SEQ ID NO: 1511067 - RNA, 14 nt, Pseudomonas aeruginosa PA01
uguucggccuugcu

SEQ ID NO: 1511068 - RNA, 13 nt, Pseudomonas aeruginosa PA01
uguucggcugggc

SEQ ID NO: 1511069 - RNA, 20 nt, Pseudomonas aeruginosa PA01
uguucgggguggcgaaggca

SEQ ID NO: 1511070 - RNA, 13 nt, Pseudomonas aeruginosa PA01
uguucggccaggg

SEQ ID NO: 1511071 - RNA, 14 nt, Pseudomonas aeruginosa PA01
uggucggcagcucu

SEQ ID NO: 1511072 - RNA, 21 nt, Pseudomonas aeruginosa PA01
uggucggccaggucgcgggug

SEQ ID NO: 1511073 - RNA, 16 nt, Pseudomonas aeruginosa PA01
uggucgcgcgcggcca

SEQ ID NO: 1511074 - RNA, 15 nt, Pseudomonas aeruginosa PA01
uggucgccgaaguac

SEQ ID NO: 1511075 - RNA, 20 nt, Pseudomonas aeruginosa PA01
uggucgccgcgaccucguug

SEQ ID NO: 1511076 - RNA, 15 nt, Pseudomonas aeruginosa PA01
uggucuuccucggug

SEQ ID NO: 1511077 - RNA, 16 nt, Pseudomonas aeruginosa PA01
uggugccacaggugga

SEQ ID NO: 1511078 - RNA, 15 nt, Pseudomonas aeruginosa PA01
ugguggaacagcauc

SEQ ID NO: 1511079 - RNA, 16 nt, Pseudomonas aeruginosa PA01
ugguggacacccugcu

SEQ ID NO: 1511080 - RNA, 14 nt, Pseudomonas aeruginosa PA01
uggugcuggugggc

SEQ ID NO: 1511081 - RNA, 22 nt, Pseudomonas aeruginosa PA01
uggugggcucuaugcaaugggg

SEQ ID NO: 1511082 - RNA, 21 nt, Pseudomonas aeruginosa PA01
ugguagucgcgguugcugugc

SEQ ID NO: 1511083 - RNA, 21 nt, Pseudomonas aeruginosa PA01
ugguagcugcugccggcuugc

SEQ ID NO: 1511084 - RNA, 20 nt, Pseudomonas aeruginosa PA01
ugguaggacagggccaggcc

SEQ ID NO: 1511085 - RNA, 16 nt, Pseudomonas aeruginosa PA01
ugguagcccaggccga

SEQ ID NO: 1511086 - RNA, 15 nt, Pseudomonas aeruginosa PA01
ugguagcgcuccagc

SEQ ID NO: 1511087 - RNA, 23 nt, Pseudomonas aeruginosa PA01
ugguagcgcuccagcuccuccag

SEQ ID NO: 1511088 - RNA, 15 nt, Pseudomonas aeruginosa PA01
uggucaccagcgugg

SEQ ID NO: 1511089 - RNA, 11 nt, Pseudomonas aeruginosa PA01
ugguccagcac

SEQ ID NO: 1511090 - RNA, 18 nt, Pseudomonas aeruginosa PA01
ugguaagcgagcagacug

SEQ ID NO: 1511091 - RNA, 13 nt, Pseudomonas aeruginosa PA01
uggggugcagcag

SEQ ID NO: 1511092 - RNA, 17 nt, Pseudomonas aeruginosa PA01
uguaagcgucggugccg

SEQ ID NO: 1511093 - RNA, 14 nt, Pseudomonas aeruginosa PA01
ugguuuucgcuccu

SEQ ID NO: 1511094 - RNA, 18 nt, Pseudomonas aeruginosa PA01
ugguuuugcggauuccua

SEQ ID NO: 1511095 - RNA, 13 nt, Pseudomonas aeruginosa PA01
ugguuuccaggcu

SEQ ID NO: 1511096 - RNA, 14 nt, Pseudomonas aeruginosa PA01
ugguuuccaggcuc

SEQ ID NO: 1511097 - RNA, 17 nt, Pseudomonas aeruginosa PA01
ugguuuccaggcucacc

SEQ ID NO: 1511098 - RNA, 20 nt, Pseudomonas aeruginosa PA01
ugguugcggaacggcucgcg

SEQ ID NO: 1511099 - RNA, 22 nt, Pseudomonas aeruginosa PA01
ugguugacgauauggaagagga

SEQ ID NO: 1511100 - RNA, 13 nt, Pseudomonas aeruginosa PA01
ugguugcccaggg

SEQ ID NO: 1511101 - RNA, 13 nt, Pseudomonas aeruginosa PA01
ugguuccuggugu

SEQ ID NO: 1511102 - RNA, 16 nt, Pseudomonas aeruginosa PA01
ugguggugauccaggc

SEQ ID NO: 1511103 - RNA, 18 nt, Pseudomonas aeruginosa PA01
ugguguagcugcagcgcc

SEQ ID NO: 1511104 - RNA, 15 nt, Pseudomonas aeruginosa PA01
uggcggggaacagca

SEQ ID NO: 1511105 - RNA, 13 nt, Pseudomonas aeruginosa PA01
uggcggcgcgcgu

SEQ ID NO: 1511106 - RNA, 14 nt, Pseudomonas aeruginosa PA01
uggcgcugggccuu

SEQ ID NO: 1511107 - RNA, 21 nt, Pseudomonas aeruginosa PA01
uggcggcgacgaagcccaggc

SEQ ID NO: 1511108 - RNA, 16 nt, Pseudomonas aeruginosa PA01
uggcggaauaacucag

SEQ ID NO: 1511109 - RNA, 17 nt, Pseudomonas aeruginosa PA01
uggcgguccaggucaug

SEQ ID NO: 1511110 - RNA, 20 nt, Pseudomonas aeruginosa PA01
uggcgcgacgaggcgcggcg

SEQ ID NO: 1511111 - RNA, 15 nt, Pseudomonas aeruginosa PA01
uggcgcgcgggccuu

SEQ ID NO: 1511112 - RNA, 19 nt, Pseudomonas aeruginosa PA01
uggcgcggcaaagugcggu

SEQ ID NO: 1511113 - RNA, 15 nt, Pseudomonas aeruginosa PA01
uggcgcggcugaucg

SEQ ID NO: 1511114 - RNA, 17 nt, Pseudomonas aeruginosa PA01
uggcgcggggccccggc

SEQ ID NO: 1511115 - RNA, 15 nt, Pseudomonas aeruginosa PA01
uggcgcuugagcagc

SEQ ID NO: 1511116 - RNA, 16 nt, Pseudomonas aeruginosa PA01
uggcgcuugcgcagca

SEQ ID NO: 1511117 - RNA, 16 nt, Pseudomonas aeruginosa PA01
uggcgcuguaggcgag

SEQ ID NO: 1511118 - RNA, 20 nt, Pseudomonas aeruginosa PA01
uggcgcuguaggcgagcagc

SEQ ID NO: 1511119 - RNA, 18 nt, Pseudomonas aeruginosa PA01
uggcgcucugcagugugg

SEQ ID NO: 1511120 - RNA, 20 nt, Pseudomonas aeruginosa PA01
uggcgcugaacaagcccugg

SEQ ID NO: 1511121 - RNA, 21 nt, Pseudomonas aeruginosa PA01
uggcgcugaacaagcccuggu

SEQ ID NO: 1511122 - RNA, 20 nt, Pseudomonas aeruginosa PA01
uggcgcugaggaagagcagc

SEQ ID NO: 1511123 - RNA, 17 nt, Pseudomonas aeruginosa PA01
uggcucggcggcaggcu

SEQ ID NO: 1511124 - RNA, 18 nt, Pseudomonas aeruginosa PA01
uggcucauggcauggcca

SEQ ID NO: 1511125 - RNA, 20 nt, Pseudomonas aeruginosa PA01
uggcuccgcgcguucagcca

SEQ ID NO: 1511126 - RNA, 20 nt, Pseudomonas aeruginosa PA01
uggcuccacugcuuggccag

SEQ ID NO: 1511127 - RNA, 21 nt, Pseudomonas aeruginosa PA01
uggcuccacugcuuggccagg

SEQ ID NO: 1511128 - RNA, 15 nt, Pseudomonas aeruginosa PA01
uggcguucgccuugc

SEQ ID NO: 1511129 - RNA, 20 nt, Pseudomonas aeruginosa PA01
uggcguuguuggucaggcug

SEQ ID NO: 1511130 - RNA, 15 nt, Pseudomonas aeruginosa PA01
uggcuaaacaagcca

SEQ ID NO: 1511131 - RNA, 22 nt, Pseudomonas aeruginosa PA01
uggcguugucggcaaccgggcg

SEQ ID NO: 1511132 - RNA, 20 nt, Pseudomonas aeruginosa PA01
uggcgucgccuuccaccacc

SEQ ID NO: 1511133 - RNA, 14 nt, Pseudomonas aeruginosa PA01
uggcgucgaacagc

SEQ ID NO: 1511134 - RNA, 18 nt, Pseudomonas aeruginosa PA01
uggcgucgggcuucuuca

SEQ ID NO: 1511135 - RNA, 10 nt, Pseudomonas aeruginosa PA01
ugggcguggc

SEQ ID NO: 1511136 - RNA, 17 nt, Pseudomonas aeruginosa PA01
uggggacggaagcaugg

SEQ ID NO: 1511137 - RNA, 21 nt, Pseudomonas aeruginosa PA01
uggggaaucugcgccaggugu

SEQ ID NO: 1511138 - RNA, 15 nt, Pseudomonas aeruginosa PA01
ugggcgccgccagcc

SEQ ID NO: 1511139 - RNA, 23 nt, Pseudomonas aeruginosa PA01
ugggcgccgccagccagagcagc

SEQ ID NO: 1511140 - RNA, 17 nt, Pseudomonas aeruginosa PA01
ugggcgccggcaggccu

SEQ ID NO: 1511141 - RNA, 12 nt, Pseudomonas aeruginosa PA01
ugggcgccggcg

SEQ ID NO: 1511142 - RNA, 19 nt, Pseudomonas aeruginosa PA01
ugggcgcccuucagcgccu

SEQ ID NO: 1511143 - RNA, 22 nt, Pseudomonas aeruginosa PA01
ugggcgcccuucagcgccucga

SEQ ID NO: 1511144 - RNA, 12 nt, Pseudomonas aeruginosa PA01
ugggcgcgcgcc

SEQ ID NO: 1511145 - RNA, 15 nt, Pseudomonas aeruginosa PA01
ugggcgcgcgccggg

SEQ ID NO: 1511146 - RNA, 21 nt, Pseudomonas aeruginosa PA01
ugggcgcgcgccgggcucagc

SEQ ID NO: 1511147 - RNA, 13 nt, Pseudomonas aeruginosa PA01
ugggcgcucagca

SEQ ID NO: 1511148 - RNA, 15 nt, Pseudomonas aeruginosa PA01
ugggcgcucagcauc

SEQ ID NO: 1511149 - RNA, 22 nt, Pseudomonas aeruginosa PA01
ugggccgaaggccaggccggcg

SEQ ID NO: 1511150 - RNA, 16 nt, Pseudomonas aeruginosa PA01
ugggccccggccaggu

SEQ ID NO: 1511151 - RNA, 16 nt, Pseudomonas aeruginosa PA01
ugggccaggcauccag

SEQ ID NO: 1511152 - RNA, 21 nt, Pseudomonas aeruginosa PA01
ugggccagcccagaacagcaa

SEQ ID NO: 1511153 - RNA, 15 nt, Pseudomonas aeruginosa PA01
ugggccagcaggccg

SEQ ID NO: 1511154 - RNA, 19 nt, Pseudomonas aeruginosa PA01
ugggccagggauuccuugg

SEQ ID NO: 1511155 - RNA, 14 nt, Pseudomonas aeruginosa PA01
ugggacugagccgc

SEQ ID NO: 1511156 - RNA, 22 nt, Pseudomonas aeruginosa PA01
ugggagccgccggacuuggaga

SEQ ID NO: 1511157 - RNA, 19 nt, Pseudomonas aeruginosa PA01
ugggccaccaucagguaga

SEQ ID NO: 1511158 - RNA, 16 nt, Pseudomonas aeruginosa PA01
ugggccaccuggcucu

SEQ ID NO: 1511159 - RNA, 19 nt, Pseudomonas aeruginosa PA01
ugggccacguucugcagga

SEQ ID NO: 1511160 - RNA, 20 nt, Pseudomonas aeruginosa PA01
ugggagaacuuuucccagcg

SEQ ID NO: 1511161 - RNA, 14 nt, Pseudomonas aeruginosa PA01
uggcuucagcuucu

SEQ ID NO: 1511162 - RNA, 15 nt, Pseudomonas aeruginosa PA01
uggcuuccagccagc

SEQ ID NO: 1511163 - RNA, 13 nt, Pseudomonas aeruginosa PA01
uggcuuggcccug

SEQ ID NO: 1511164 - RNA, 14 nt, Pseudomonas aeruginosa PA01
uggcuuggcccugc

SEQ ID NO: 1511165 - RNA, 15 nt, Pseudomonas aeruginosa PA01
uggcuucguccagcg

SEQ ID NO: 1511166 - RNA, 17 nt, Pseudomonas aeruginosa PA01
uggcuucguccagcgag

SEQ ID NO: 1511167 - RNA, 17 nt, Pseudomonas aeruginosa PA01
uggcuuguuuagccauc

SEQ ID NO: 1511168 - RNA, 14 nt, Pseudomonas aeruginosa PA01
uggcuuuccagcau

SEQ ID NO: 1511169 - RNA, 12 nt, Pseudomonas aeruginosa PA01
uggcuuuccagg

SEQ ID NO: 1511170 - RNA, 19 nt, Pseudomonas aeruginosa PA01
uggcugcuggcgaagcugg

SEQ ID NO: 1511171 - RNA, 12 nt, Pseudomonas aeruginosa PA01
uggcuggccucg

SEQ ID NO: 1511172 - RNA, 18 nt, Pseudomonas aeruginosa PA01
uggcuggccagcaggcug

SEQ ID NO: 1511173 - RNA, 15 nt, Pseudomonas aeruginosa PA01
uggcuggucaggcug

SEQ ID NO: 1511174 - RNA, 18 nt, Pseudomonas aeruginosa PA01
uggcuguaggugcccggc

SEQ ID NO: 1511175 - RNA, 17 nt, Pseudomonas aeruginosa PA01
uggcugugcuggccacc

SEQ ID NO: 1511176 - RNA, 21 nt, Pseudomonas aeruginosa PA01
uggcugcagguaggcgguggc

SEQ ID NO: 1511177 - RNA, 13 nt, Pseudomonas aeruginosa PA01
uucagggagagga

SEQ ID NO: 1511178 - RNA, 17 nt, Pseudomonas aeruginosa PA01
uucaggcugucggccau

SEQ ID NO: 1511179 - RNA, 15 nt, Pseudomonas aeruginosa PA01
uucagcggcugcccg

SEQ ID NO: 1511180 - RNA, 20 nt, Pseudomonas aeruginosa PA01
uucagcggguucuugccgcu

SEQ ID NO: 1511181 - RNA, 16 nt, Pseudomonas aeruginosa PA01
uucagcgcuuccuugc

SEQ ID NO: 1511182 - RNA, 17 nt, Pseudomonas aeruginosa PA01
uucagcgccagcagucg

SEQ ID NO: 1511183 - RNA, 13 nt, Pseudomonas aeruginosa PA01
uucagcccacccc

SEQ ID NO: 1511184 - RNA, 14 nt, Pseudomonas aeruginosa PA01
uucagcccaccccc

SEQ ID NO: 1511185 - RNA, 20 nt, Pseudomonas aeruginosa PA01
uucagcucgaggccaggauc

SEQ ID NO: 1511186 - RNA, 15 nt, Pseudomonas aeruginosa PA01
uucauagaaacgcag

SEQ ID NO: 1511187 - RNA, 18 nt, Pseudomonas aeruginosa PA01
uucagucggccaggcgcc

SEQ ID NO: 1511188 - RNA, 13 nt, Pseudomonas aeruginosa PA01
uucaucaccagcu

SEQ ID NO: 1511189 - RNA, 11 nt, Pseudomonas aeruginosa PA01
uucaucaccuu

SEQ ID NO: 1511190 - RNA, 15 nt, Pseudomonas aeruginosa PA01
uucauccugcgcgcc

SEQ ID NO: 1511191 - RNA, 23 nt, Pseudomonas aeruginosa PA01
uucauccugcgcgccucuuccug

SEQ ID NO: 1511192 - RNA, 17 nt, Pseudomonas aeruginosa PA01
uucauuuccgcaggaaa

SEQ ID NO: 1511193 - RNA, 22 nt, Pseudomonas aeruginosa PA01
uucauuuguggagucaggcgcc

SEQ ID NO: 1511194 - RNA, 14 nt, Pseudomonas aeruginosa PA01
uucauucuccagcc

SEQ ID NO: 1511195 - RNA, 20 nt, Pseudomonas aeruginosa PA01
uucaugggacaaacgauugc

SEQ ID NO: 1511196 - RNA, 22 nt, Pseudomonas aeruginosa PA01
uucauggugcccagcaggcugc

SEQ ID NO: 1511197 - RNA, 13 nt, Pseudomonas aeruginosa PA01
uucaccaggccga

SEQ ID NO: 1511198 - RNA, 17 nt, Pseudomonas aeruginosa PA01
uucaccaccagcgagga

SEQ ID NO: 1511199 - RNA, 17 nt, Pseudomonas aeruginosa PA01
uucaccguucccagcag

SEQ ID NO: 1511200 - RNA, 23 nt, Pseudomonas aeruginosa PA01
uucaccgccucggagaacagcag

SEQ ID NO: 1511201 - RNA, 16 nt, Pseudomonas aeruginosa PA01
uucaccgcggccuugg

SEQ ID NO: 1511202 - RNA, 22 nt, Pseudomonas aeruginosa PA01
uucacguaggagccggccaggc

SEQ ID NO: 1511203 - RNA, 13 nt, Pseudomonas aeruginosa PA01
uucacgguaaaac

SEQ ID NO: 1511204 - RNA, 12 nt, Pseudomonas aeruginosa PA01
uuccaaggguau

SEQ ID NO: 1511205 - RNA, 23 nt, Pseudomonas aeruginosa PA01
uuccaaucgggguauagcgcagu

SEQ ID NO: 1511206 - RNA, 15 nt, Pseudomonas aeruginosa PA01
uuccacucccaugcc

SEQ ID NO: 1511207 - RNA, 17 nt, Pseudomonas aeruginosa PA01
uuccacgucgccgacca

SEQ ID NO: 1511208 - RNA, 22 nt, Pseudomonas aeruginosa PA01
uuccacgcugaggcucagcgcg

SEQ ID NO: 1511209 - RNA, 15 nt, Pseudomonas aeruginosa PA01
uuccaccuggcgcag

SEQ ID NO: 1511210 - RNA, 15 nt, Pseudomonas aeruginosa PA01
uuccaccuuggcacg

SEQ ID NO: 1511211 - RNA, 16 nt, Pseudomonas aeruginosa PA01
uuccaccggcuugccg

SEQ ID NO: 1511212 - RNA, 15 nt, Pseudomonas aeruginosa PA01
uuccagguacggccc

SEQ ID NO: 1511213 - RNA, 21 nt, Pseudomonas aeruginosa PA01
uuccaggguuuccagcagcac

SEQ ID NO: 1511214 - RNA, 15 nt, Pseudomonas aeruginosa PA01
uuccagggccuggua

SEQ ID NO: 1511215 - RNA, 22 nt, Pseudomonas aeruginosa PA01
uuccagaucgucuuucucgauc

SEQ ID NO: 1511216 - RNA, 14 nt, Pseudomonas aeruginosa PA01
uuccagcauuaccc

SEQ ID NO: 1511217 - RNA, 21 nt, Pseudomonas aeruginosa PA01
uuccagcuugcgccagagcag

SEQ ID NO: 1511218 - RNA, 20 nt, Pseudomonas aeruginosa PA01
uuccaggcguccgcuggccu

SEQ ID NO: 1511219 - RNA, 21 nt, Pseudomonas aeruginosa PA01
uuccaggcgcaggcgaggaug

SEQ ID NO: 1511220 - RNA, 14 nt, Pseudomonas aeruginosa PA01
uuccaugggcagac

SEQ ID NO: 1511221 - RNA, 18 nt, Pseudomonas aeruginosa PA01
uucccgcagcgaucagca

SEQ ID NO: 1511222 - RNA, 22 nt, Pseudomonas aeruginosa PA01
uucccgcagcgaucagcaccag

SEQ ID NO: 1511223 - RNA, 14 nt, Pseudomonas aeruginosa PA01
uucccucaggauag

SEQ ID NO: 1511224 - RNA, 14 nt, Pseudomonas aeruginosa PA01
uucccucaaccggc

SEQ ID NO: 1511225 - RNA, 21 nt, Pseudomonas aeruginosa PA01
uucccgcggcccgccgccggg

SEQ ID NO: 1511226 - RNA, 14 nt, Pseudomonas aeruginosa PA01
uucccgccgcucug

SEQ ID NO: 1511227 - RNA, 18 nt, Pseudomonas aeruginosa PA01
uucccgccgcucugcugg

SEQ ID NO: 1511228 - RNA, 22 nt, Pseudomonas aeruginosa PA01
uucccggcgcggcuacccucuc

SEQ ID NO: 1511229 - RNA, 17 nt, Pseudomonas aeruginosa PA01
uucccguaaggccaggc

SEQ ID NO: 1511230 - RNA, 19 nt, Pseudomonas aeruginosa PA01
uuccgcgcggcgcccugcc

SEQ ID NO: 1511231 - RNA, 19 nt, Pseudomonas aeruginosa PA01
uuccgcggccggcaggccg

SEQ ID NO: 1511232 - RNA, 16 nt, Pseudomonas aeruginosa PA01
uuccggagccggauag

SEQ ID NO: 1511233 - RNA, 21 nt, Pseudomonas aeruginosa PA01
uuccgccggaagcuuccagcu

SEQ ID NO: 1511234 - RNA, 19 nt, Pseudomonas aeruginosa PA01
uuccgccggacccugccgu

SEQ ID NO: 1511235 - RNA, 14 nt, Pseudomonas aeruginosa PA01
uucgcaggccaggc

SEQ ID NO: 1511236 - RNA, 16 nt, Pseudomonas aeruginosa PA01
uucgcaggccaggcgc

SEQ ID NO: 1511237 - RNA, 15 nt, Pseudomonas aeruginosa PA01
uucgcaggagucgac

SEQ ID NO: 1511238 - RNA, 23 nt, Pseudomonas aeruginosa PA01
uucgcauaggcggccagccuucc

SEQ ID NO: 1511239 - RNA, 16 nt, Pseudomonas aeruginosa PA01
uucgcauuccaccuug

SEQ ID NO: 1511240 - RNA, 17 nt, Pseudomonas aeruginosa PA01
uucgccagcggccaggg

SEQ ID NO: 1511241 - RNA, 14 nt, Pseudomonas aeruginosa PA01
uucgccagcaccuc

SEQ ID NO: 1511242 - RNA, 15 nt, Pseudomonas aeruginosa PA01
uucgccagcaggcuc

SEQ ID NO: 1511243 - RNA, 20 nt, Pseudomonas aeruginosa PA01
uucgccaguucucgcagcag

SEQ ID NO: 1511244 - RNA, 14 nt, Pseudomonas aeruginosa PA01
uucgcccagcucgc

SEQ ID NO: 1511245 - RNA, 16 nt, Pseudomonas aeruginosa PA01
uucgcccuaccgccca

SEQ ID NO: 1511246 - RNA, 20 nt, Pseudomonas aeruginosa PA01
uucgcccuaccgcccacccu

SEQ ID NO: 1511247 - RNA, 19 nt, Pseudomonas aeruginosa PA01
uucgcccgcugcgcugcca

SEQ ID NO: 1511248 - RNA, 23 nt, Pseudomonas aeruginosa PA01
uucgcccgcugcgcugccagcgc

SEQ ID NO: 1511249 - RNA, 17 nt, Pseudomonas aeruginosa PA01
uucgccgcccucgcagu

SEQ ID NO: 1511250 - RNA, 14 nt, Pseudomonas aeruginosa PA01
uucgccggccaggu

SEQ ID NO: 1511251 - RNA, 13 nt, Pseudomonas aeruginosa PA01
uucgccgggcuuu

SEQ ID NO: 1511252 - RNA, 20 nt, Pseudomonas aeruginosa PA01
uucgccggguguuuuuccuc

SEQ ID NO: 1511253 - RNA, 12 nt, Pseudomonas aeruginosa PA01
uucgccggugac

SEQ ID NO: 1511254 - RNA, 17 nt, Pseudomonas aeruginosa PA01
uucgccggugacgcugc

SEQ ID NO: 1511255 - RNA, 17 nt, Pseudomonas aeruginosa PA01
uucgccgcgacgcucca

SEQ ID NO: 1511256 - RNA, 20 nt, Pseudomonas aeruginosa PA01
uucgccgccgccaguugcuu

SEQ ID NO: 1511257 - RNA, 11 nt, Pseudomonas aeruginosa PA01
uucgccgccac

SEQ ID NO: 1511258 - RNA, 20 nt, Pseudomonas aeruginosa PA01
uucgcugaggacugccaggg

SEQ ID NO: 1511259 - RNA, 17 nt, Pseudomonas aeruginosa PA01
uucgccuugcccuggcc

SEQ ID NO: 1511260 - RNA, 15 nt, Pseudomonas aeruginosa PA01
uucgcgcuccaggcc

SEQ ID NO: 1511261 - RNA, 17 nt, Pseudomonas aeruginosa PA01
uucgaucuggcugccca

SEQ ID NO: 1511262 - RNA, 23 nt, Pseudomonas aeruginosa PA01
uucgcaacggccguugaagcaga

SEQ ID NO: 1511263 - RNA, 23 nt, Pseudomonas aeruginosa PA01
uucgacgaugcucgguugccagg

SEQ ID NO: 1511264 - RNA, 21 nt, Pseudomonas aeruginosa PA01
uucgacgcgccacgcaggaac

SEQ ID NO: 1511265 - RNA, 22 nt, Pseudomonas aeruginosa PA01
uucgacgacaccugcaacgccc

SEQ ID NO: 1511266 - RNA, 15 nt, Pseudomonas aeruginosa PA01
uucgagaguuuuauc

SEQ ID NO: 1511267 - RNA, 17 nt, Pseudomonas aeruginosa PA01
uucgagccuggccaggc

SEQ ID NO: 1511268 - RNA, 14 nt, Pseudomonas aeruginosa PA01
uucgagucccgucc

SEQ ID NO: 1511269 - RNA, 19 nt, Pseudomonas aeruginosa PA01
uucgacacgcucagccccg

SEQ ID NO: 1511270 - RNA, 19 nt, Pseudomonas aeruginosa PA01
uucgaaccguggcggccgc

SEQ ID NO: 1511271 - RNA, 23 nt, Pseudomonas aeruginosa PA01
uuccuugcugaagcccaggcguc

SEQ ID NO: 1511272 - RNA, 15 nt, Pseudomonas aeruginosa PA01
uuccuugucguaugc

SEQ ID NO: 1511273 - RNA, 18 nt, Pseudomonas aeruginosa PA01
uuccuuagaggcucagcc

SEQ ID NO: 1511274 - RNA, 17 nt, Pseudomonas aeruginosa PA01
uuccuguccauuuccac

SEQ ID NO: 1511275 - RNA, 20 nt, Pseudomonas aeruginosa PA01
uuccugguacucguccuccc

SEQ ID NO: 1511276 - RNA, 17 nt, Pseudomonas aeruginosa PA01
uuccucguggggccaga

SEQ ID NO: 1511277 - RNA, 17 nt, Pseudomonas aeruginosa PA01
uuccugcugguugacca

SEQ ID NO: 1511278 - RNA, 20 nt, Pseudomonas aeruginosa PA01
uuccgucacgcccugccccu

SEQ ID NO: 1511279 - RNA, 15 nt, Pseudomonas aeruginosa PA01
uuccgugcggaaacc

SEQ ID NO: 1511280 - RNA, 23 nt, Pseudomonas aeruginosa PA01
uuccgggaccggcugcuuggcca

SEQ ID NO: 1511281 - RNA, 17 nt, Pseudomonas aeruginosa PA01
uuccggcccggccaggc

SEQ ID NO: 1511282 - RNA, 17 nt, Pseudomonas aeruginosa PA01
uuccggcccggccaggu

SEQ ID NO: 1511283 - RNA, 18 nt, Pseudomonas aeruginosa PA01
uuccggcagguucagcag

SEQ ID NO: 1511284 - RNA, 12 nt, Pseudomonas aeruginosa PA01
uuccggccaggc

SEQ ID NO: 1511285 - RNA, 20 nt, Pseudomonas aeruginosa PA01
uuccuacgaagguuucgucc

SEQ ID NO: 1511286 - RNA, 22 nt, Pseudomonas aeruginosa PA01
uuccucagugcgggcaguccug

SEQ ID NO: 1511287 - RNA, 18 nt, Pseudomonas aeruginosa PA01
uuccuccagaguccaugc

SEQ ID NO: 1511288 - RNA, 23 nt, Pseudomonas aeruginosa PA01
uuccuccaguagcggaagcacgg

SEQ ID NO: 1511289 - RNA, 16 nt, Pseudomonas aeruginosa PA01
uuccucccaugaaaaa

SEQ ID NO: 1511290 - RNA, 17 nt, Pseudomonas aeruginosa PA01
uuccuccucgccgccga

SEQ ID NO: 1511291 - RNA, 17 nt, Pseudomonas aeruginosa PA01
uuccucgcgagggacga

SEQ ID NO: 1511292 - RNA, 22 nt, Pseudomonas aeruginosa PA01
uuccucggccaugccggccagg

SEQ ID NO: 1511293 - RNA, 23 nt, Pseudomonas aeruginosa PA01
uuccucggccaugccggccagga

SEQ ID NO: 1511294 - RNA, 19 nt, Pseudomonas aeruginosa PA01
uuccucggccgccaggcgc

SEQ ID NO: 1511295 - RNA, 22 nt, Pseudomonas aeruginosa PA01
uuccucggugucggccaacugg

SEQ ID NO: 1511296 - RNA, 17 nt, Pseudomonas aeruginosa PA01
uuccucgaucaggccuu

SEQ ID NO: 1511297 - RNA, 18 nt, Pseudomonas aeruginosa PA01
uugcgccauugccgccag

SEQ ID NO: 1511298 - RNA, 18 nt, Pseudomonas aeruginosa PA01
uugcgcaggggcgcggcg

SEQ ID NO: 1511299 - RNA, 21 nt, Pseudomonas aeruginosa PA01
uugcgcagcuucugcagggcg

SEQ ID NO: 1511300 - RNA, 16 nt, Pseudomonas aeruginosa PA01
uugccuucguuggccu

SEQ ID NO: 1511301 - RNA, 14 nt, Pseudomonas aeruginosa PA01
uugcgcaccagggc

SEQ ID NO: 1511302 - RNA, 16 nt, Pseudomonas aeruginosa PA01
uugcgcaccagggcca

SEQ ID NO: 1511303 - RNA, 13 nt, Pseudomonas aeruginosa PA01
uugcgcaccgccu

SEQ ID NO: 1511304 - RNA, 20 nt, Pseudomonas aeruginosa PA01
uugcgcacgcaauagugcag

SEQ ID NO: 1511305 - RNA, 16 nt, Pseudomonas aeruginosa PA01
uugcucgcaccaggcc

SEQ ID NO: 1511306 - RNA, 20 nt, Pseudomonas aeruginosa PA01
uugcucgcaccaggccaggu

SEQ ID NO: 1511307 - RNA, 13 nt, Pseudomonas aeruginosa PA01
uugcucugggcau

SEQ ID NO: 1511308 - RNA, 19 nt, Pseudomonas aeruginosa PA01
uugcgggcgaugaggcugu

SEQ ID NO: 1511309 - RNA, 14 nt, Pseudomonas aeruginosa PA01
uugccuccgcucug

SEQ ID NO: 1511310 - RNA, 14 nt, Pseudomonas aeruginosa PA01
uugccggucugcug

SEQ ID NO: 1511311 - RNA, 12 nt, Pseudomonas aeruginosa PA01
uugccggugcgg

SEQ ID NO: 1511312 - RNA, 19 nt, Pseudomonas aeruginosa PA01
uugcccagcgccgccugcu

SEQ ID NO: 1511313 - RNA, 16 nt, Pseudomonas aeruginosa PA01
uugcccacggccaggc

SEQ ID NO: 1511314 - RNA, 14 nt, Pseudomonas aeruginosa PA01
uugcccaacuccag

SEQ ID NO: 1511315 - RNA, 24 nt, Pseudomonas aeruginosa PA01
uugcagguaguucuccaggcccau

SEQ ID NO: 1511316 - RNA, 14 nt, Pseudomonas aeruginosa PA01
uugcaguaccugcu

SEQ ID NO: 1511317 - RNA, 12 nt, Pseudomonas aeruginosa PA01
uugccaggagga

SEQ ID NO: 1511318 - RNA, 17 nt, Pseudomonas aeruginosa PA01
uugccagguauuccgcc

SEQ ID NO: 1511319 - RNA, 17 nt, Pseudomonas aeruginosa PA01
uuggaaguugccgccag

SEQ ID NO: 1511320 - RNA, 17 nt, Pseudomonas aeruginosa PA01
uuggauucguugaggcc

SEQ ID NO: 1511321 - RNA, 14 nt, Pseudomonas aeruginosa PA01
uuggcaaagcccgc

SEQ ID NO: 1511322 - RNA, 22 nt, Pseudomonas aeruginosa PA01
uugcuggacaagguuugcgccg

SEQ ID NO: 1511323 - RNA, 12 nt, Pseudomonas aeruginosa PA01
uugcuggcacag

SEQ ID NO: 1511324 - RNA, 15 nt, Pseudomonas aeruginosa PA01
uugcuguagaaugcg

SEQ ID NO: 1511325 - RNA, 19 nt, Pseudomonas aeruginosa PA01
uugggaccgggcauuuccu

SEQ ID NO: 1511326 - RNA, 15 nt, Pseudomonas aeruginosa PA01
uuggccgcagcagcg

SEQ ID NO: 1511327 - RNA, 18 nt, Pseudomonas aeruginosa PA01
uuggccgcagcagcggca

SEQ ID NO: 1511328 - RNA, 24 nt, Pseudomonas aeruginosa PA01
uuggcccugcgcgcgcguuucagc

SEQ ID NO: 1511329 - RNA, 13 nt, Pseudomonas aeruginosa PA01
uuggcccuggccu

SEQ ID NO: 1511330 - RNA, 15 nt, Pseudomonas aeruginosa PA01
uuggccgacgccgcu

SEQ ID NO: 1511331 - RNA, 19 nt, Pseudomonas aeruginosa PA01
uuggcccgguuggccagga

SEQ ID NO: 1511332 - RNA, 16 nt, Pseudomonas aeruginosa PA01
uuggccaguuggcccu

SEQ ID NO: 1511333 - RNA, 17 nt, Pseudomonas aeruginosa PA01
uuggccaucagcgccgc

SEQ ID NO: 1511334 - RNA, 17 nt, Pseudomonas aeruginosa PA01
uuggccuugagcaggcg

SEQ ID NO: 1511335 - RNA, 18 nt, Pseudomonas aeruginosa PA01
uuggccuugaugccggcg

SEQ ID NO: 1511336 - RNA, 15 nt, Pseudomonas aeruginosa PA01
uuggccggcugcucc

SEQ ID NO: 1511337 - RNA, 21 nt, Pseudomonas aeruginosa PA01
uuggccgagcgcgagugcagc

SEQ ID NO: 1511338 - RNA, 19 nt, Pseudomonas aeruginosa PA01
uugggucguuagcucaguc

SEQ ID NO: 1511339 - RNA, 17 nt, Pseudomonas aeruginosa PA01
uuggucggcaccagggc

SEQ ID NO: 1511340 - RNA, 11 nt, Pseudomonas aeruginosa PA01
uuggucugcuc

SEQ ID NO: 1511341 - RNA, 15 nt, Pseudomonas aeruginosa PA01
uuggucugcucggcg

SEQ ID NO: 1511342 - RNA, 23 nt, Pseudomonas aeruginosa PA01
uuggucgaguaauuuuguggagu

SEQ ID NO: 1511343 - RNA, 22 nt, Pseudomonas aeruginosa PA01
uuggucaggcccugcuucugua

SEQ ID NO: 1511344 - RNA, 17 nt, Pseudomonas aeruginosa PA01
uuuaaaguucgacgauu

SEQ ID NO: 1511345 - RNA, 22 nt, Pseudomonas aeruginosa PA01
uuuaccaggaccagcgccugcu

SEQ ID NO: 1511346 - RNA, 20 nt, Pseudomonas aeruginosa PA01
uuuaaguaacuuauugaaau

SEQ ID NO: 1511347 - RNA, 16 nt, Pseudomonas aeruginosa PA01
uuguagaucggcagca

SEQ ID NO: 1511348 - RNA, 19 nt, Pseudomonas aeruginosa PA01
uuguagaucugcaccgccc

SEQ ID NO: 1511349 - RNA, 15 nt, Pseudomonas aeruginosa PA01
uuguaagcauuaacu

SEQ ID NO: 1511350 - RNA, 14 nt, Pseudomonas aeruginosa PA01
uuguagcccagggg

SEQ ID NO: 1511351 - RNA, 14 nt, Pseudomonas aeruginosa PA01
uuguccuccagcug

SEQ ID NO: 1511352 - RNA, 17 nt, Pseudomonas aeruginosa PA01
uugucgaacagguaguu

SEQ ID NO: 1511353 - RNA, 13 nt, Pseudomonas aeruginosa PA01
uuguccuuggccu

SEQ ID NO: 1511354 - RNA, 22 nt, Pseudomonas aeruginosa PA01
uugucgauggucuugaucccag

SEQ ID NO: 1511355 - RNA, 17 nt, Pseudomonas aeruginosa PA01
uuguggguaagcucgau

SEQ ID NO: 1511356 - RNA, 18 nt, Pseudomonas aeruginosa PA01
uuguguagucauggccag

SEQ ID NO: 1511357 - RNA, 15 nt, Pseudomonas aeruginosa PA01
uuguuauggccgacc

SEQ ID NO: 1511358 - RNA, 15 nt, Pseudomonas aeruginosa PA01
uuguugaugcccacc

SEQ ID NO: 1511359 - RNA, 22 nt, Pseudomonas aeruginosa PA01
uugaccuugcucuucuggcuga

SEQ ID NO: 1511360 - RNA, 16 nt, Pseudomonas aeruginosa PA01
uugacgaacaguucga

SEQ ID NO: 1511361 - RNA, 18 nt, Pseudomonas aeruginosa PA01
uugacgaucuucugcacc

SEQ ID NO: 1511362 - RNA, 14 nt, Pseudomonas aeruginosa PA01
uugaagagcagcac

SEQ ID NO: 1511363 - RNA, 19 nt, Pseudomonas aeruginosa PA01
uugaacuggaugucgcugg

SEQ ID NO: 1511364 - RNA, 16 nt, Pseudomonas aeruginosa PA01
uugaacgcuguagaau

SEQ ID NO: 1511365 - RNA, 17 nt, Pseudomonas aeruginosa PA01
uucuugaugucagcgua

SEQ ID NO: 1511366 - RNA, 20 nt, Pseudomonas aeruginosa PA01
uugaucggcaacgagcagga

SEQ ID NO: 1511367 - RNA, 15 nt, Pseudomonas aeruginosa PA01
uugaguagaaaagaa

SEQ ID NO: 1511368 - RNA, 14 nt, Pseudomonas aeruginosa PA01
uugcagccaccagc

SEQ ID NO: 1511369 - RNA, 15 nt, Pseudomonas aeruginosa PA01
uucucgcagcaggcg

SEQ ID NO: 1511370 - RNA, 13 nt, Pseudomonas aeruginosa PA01
uucucguucgggc

SEQ ID NO: 1511371 - RNA, 14 nt, Pseudomonas aeruginosa PA01
uucucgucgccgcc

SEQ ID NO: 1511372 - RNA, 15 nt, Pseudomonas aeruginosa PA01
uucuuccgggaacac

SEQ ID NO: 1511373 - RNA, 16 nt, Pseudomonas aeruginosa PA01
uucuuccuggccggga

SEQ ID NO: 1511374 - RNA, 17 nt, Pseudomonas aeruginosa PA01
uucucgaacagcuccuc

SEQ ID NO: 1511375 - RNA, 15 nt, Pseudomonas aeruginosa PA01
uucuccagaaucucc

SEQ ID NO: 1511376 - RNA, 19 nt, Pseudomonas aeruginosa PA01
uucuccagaaucucccgca

SEQ ID NO: 1511377 - RNA, 13 nt, Pseudomonas aeruginosa PA01
uucguccugcugc

SEQ ID NO: 1511378 - RNA, 23 nt, Pseudomonas aeruginosa PA01
uucggccgcggcuggcaggugcc

SEQ ID NO: 1511379 - RNA, 12 nt, Pseudomonas aeruginosa PA01
uucggccagcgc

SEQ ID NO: 1511380 - RNA, 15 nt, Pseudomonas aeruginosa PA01
uucggccagcggcag

SEQ ID NO: 1511381 - RNA, 11 nt, Pseudomonas aeruginosa PA01
uucggccaggg

SEQ ID NO: 1511382 - RNA, 23 nt, Pseudomonas aeruginosa PA01
uucggccagggagucgcuggcca

SEQ ID NO: 1511383 - RNA, 14 nt, Pseudomonas aeruginosa PA01
uucggcagccauuu

SEQ ID NO: 1511384 - RNA, 13 nt, Pseudomonas aeruginosa PA01
uucggcagcgccu

SEQ ID NO: 1511385 - RNA, 22 nt, Pseudomonas aeruginosa PA01
uucguucgcuguucuucaguuu

SEQ ID NO: 1511386 - RNA, 15 nt, Pseudomonas aeruginosa PA01
uucgucgcgcaggcg

SEQ ID NO: 1511387 - RNA, 18 nt, Pseudomonas aeruginosa PA01
uucguccaugcucgccac

SEQ ID NO: 1511388 - RNA, 23 nt, Pseudomonas aeruginosa PA01
uucgugaaacgccagaagcgacu

SEQ ID NO: 1511389 - RNA, 14 nt, Pseudomonas aeruginosa PA01
gagucguagcgcgc

SEQ ID NO: 1511390 - RNA, 15 nt, Pseudomonas aeruginosa PA01
gagugcccaggcgcu

SEQ ID NO: 1511391 - RNA, 14 nt, Pseudomonas aeruginosa PA01
gagugcgcagcagc

SEQ ID NO: 1511392 - RNA, 14 nt, Pseudomonas aeruginosa PA01
gagugcgcccagca

SEQ ID NO: 1511393 - RNA, 22 nt, Pseudomonas aeruginosa PA01
gaauuugaacgcuguagaaugc

SEQ ID NO: 1511394 - RNA, 15 nt, Pseudomonas aeruginosa PA01
gaguucgcccagcuc

SEQ ID NO: 1511395 - RNA, 21 nt, Pseudomonas aeruginosa PA01
gaguucgccgcgagcaccaug

SEQ ID NO: 1511396 - RNA, 14 nt, Pseudomonas aeruginosa PA01
gaguucggcugcgu

SEQ ID NO: 1511397 - RNA, 14 nt, Pseudomonas aeruginosa PA01
gaguucgcugagga

SEQ ID NO: 1511398 - RNA, 18 nt, Pseudomonas aeruginosa PA01
gaguucgcugaggacugc

SEQ ID NO: 1511399 - RNA, 17 nt, Pseudomonas aeruginosa PA01
gaguucccagaccuggc

SEQ ID NO: 1511400 - RNA, 14 nt, Pseudomonas aeruginosa PA01
gaguucgacccaug

SEQ ID NO: 1511401 - RNA, 13 nt, Pseudomonas aeruginosa PA01
gauaaaaaggccc

SEQ ID NO: 1511402 - RNA, 15 nt, Pseudomonas aeruginosa PA01
gauacgcaucugcuc

SEQ ID NO: 1511403 - RNA, 21 nt, Pseudomonas aeruginosa PA01
gauacgaaaaagccccugcgc

SEQ ID NO: 1511404 - RNA, 22 nt, Pseudomonas aeruginosa PA01
gauacgcggcccggaaugcaaa

SEQ ID NO: 1511405 - RNA, 20 nt, Pseudomonas aeruginosa PA01
gauacgcuccggugccaggg

SEQ ID NO: 1511406 - RNA, 11 nt, Pseudomonas aeruginosa PA01
gauagaggaau

SEQ ID NO: 1511407 - RNA, 14 nt, Pseudomonas aeruginosa PA01
gauacaccagguug

SEQ ID NO: 1511408 - RNA, 19 nt, Pseudomonas aeruginosa PA01
gauacaccagguuggccag

SEQ ID NO: 1511409 - RNA, 20 nt, Pseudomonas aeruginosa PA01
gauacaccagguuggccagu

SEQ ID NO: 1511410 - RNA, 15 nt, Pseudomonas aeruginosa PA01
gauacaggcgcagca

SEQ ID NO: 1511411 - RNA, 22 nt, Pseudomonas aeruginosa PA01
gauaccagcgccgcuccuccuc

SEQ ID NO: 1511412 - RNA, 21 nt, Pseudomonas aeruginosa PA01
gaucaaccccuggaucuccug

SEQ ID NO: 1511413 - RNA, 21 nt, Pseudomonas aeruginosa PA01
gaucaacuggucgcagccgcg

SEQ ID NO: 1511414 - RNA, 20 nt, Pseudomonas aeruginosa PA01
gaucagccggcccauccgcc

SEQ ID NO: 1511415 - RNA, 13 nt, Pseudomonas aeruginosa PA01
gaucagcgcggcc

SEQ ID NO: 1511416 - RNA, 13 nt, Pseudomonas aeruginosa PA01
gaucagcggcggg

SEQ ID NO: 1511417 - RNA, 14 nt, Pseudomonas aeruginosa PA01
gaucagcggcgguc

SEQ ID NO: 1511418 - RNA, 22 nt, Pseudomonas aeruginosa PA01
gaucagcggcggucccaucagc

SEQ ID NO: 1511419 - RNA, 19 nt, Pseudomonas aeruginosa PA01
gaucagcggcccgagcagg

SEQ ID NO: 1511420 - RNA, 11 nt, Pseudomonas aeruginosa PA01
gaucagcggcg

SEQ ID NO: 1511421 - RNA, 15 nt, Pseudomonas aeruginosa PA01
gaucagcagcgccac

SEQ ID NO: 1511422 - RNA, 21 nt, Pseudomonas aeruginosa PA01
gaucagcccgcugaccgggcg

SEQ ID NO: 1511423 - RNA, 15 nt, Pseudomonas aeruginosa PA01
gaucagccgcaggca

SEQ ID NO: 1511424 - RNA, 18 nt, Pseudomonas aeruginosa PA01
gaucagcauggggcggca

SEQ ID NO: 1511425 - RNA, 17 nt, Pseudomonas aeruginosa PA01
gaucaggucgcgcgccu

SEQ ID NO: 1511426 - RNA, 20 nt, Pseudomonas aeruginosa PA01
gaucagguagucgcccggcu

SEQ ID NO: 1511427 - RNA, 14 nt, Pseudomonas aeruginosa PA01
gaucaggugcagga

SEQ ID NO: 1511428 - RNA, 19 nt, Pseudomonas aeruginosa PA01
gaucaggcugaagcggccg

SEQ ID NO: 1511429 - RNA, 22 nt, Pseudomonas aeruginosa PA01
gaucagguugaagagcagcacc

SEQ ID NO: 1511430 - RNA, 22 nt, Pseudomonas aeruginosa PA01
gaucagugcaucggccgccagg

SEQ ID NO: 1511431 - RNA, 21 nt, Pseudomonas aeruginosa PA01
gaucaugggggccagcagggc

SEQ ID NO: 1511432 - RNA, 20 nt, Pseudomonas aeruginosa PA01
gaucagcucguugcccggcu

SEQ ID NO: 1511433 - RNA, 18 nt, Pseudomonas aeruginosa PA01
gaucagcuucucuuucac

SEQ ID NO: 1511434 - RNA, 11 nt, Pseudomonas aeruginosa PA01
gaucaggaaau

SEQ ID NO: 1511435 - RNA, 23 nt, Pseudomonas aeruginosa PA01
gaucagcgcggugagcaggguga

SEQ ID NO: 1511436 - RNA, 14 nt, Pseudomonas aeruginosa PA01
gaucaggaacaccc

SEQ ID NO: 1511437 - RNA, 16 nt, Pseudomonas aeruginosa PA01
gaucaggacgaugaag

SEQ ID NO: 1511438 - RNA, 19 nt, Pseudomonas aeruginosa PA01
gaucaggaggaucgccagg

SEQ ID NO: 1511439 - RNA, 16 nt, Pseudomonas aeruginosa PA01
gauaucacgccccucc

SEQ ID NO: 1511440 - RNA, 20 nt, Pseudomonas aeruginosa PA01
gauaucacgccccuccuucg

SEQ ID NO: 1511441 - RNA, 18 nt, Pseudomonas aeruginosa PA01
gauaucgcaggccaggcc

SEQ ID NO: 1511442 - RNA, 16 nt, Pseudomonas aeruginosa PA01
gauaucgcccagggcc

SEQ ID NO: 1511443 - RNA, 20 nt, Pseudomonas aeruginosa PA01
gauaucguuguucagcaggg

SEQ ID NO: 1511444 - RNA, 12 nt, Pseudomonas aeruginosa PA01
gauaucugggcc

SEQ ID NO: 1511445 - RNA, 22 nt, Pseudomonas aeruginosa PA01
gauauguccgguuggcggauga

SEQ ID NO: 1511446 - RNA, 16 nt, Pseudomonas aeruginosa PA01
gauauggccguagccg

SEQ ID NO: 1511447 - RNA, 15 nt, Pseudomonas aeruginosa PA01
gauaugccgcucagc

SEQ ID NO: 1511448 - RNA, 15 nt, Pseudomonas aeruginosa PA01
gaucgcgcggcuggc

SEQ ID NO: 1511449 - RNA, 23 nt, Pseudomonas aeruginosa PA01
gaucgcgaagaacacgccccaga

SEQ ID NO: 1511450 - RNA, 22 nt, Pseudomonas aeruginosa PA01
gaucgccgcguagcgccaggcc

SEQ ID NO: 1511451 - RNA, 22 nt, Pseudomonas aeruginosa PA01
gaucgccggguugccgcuggcc

SEQ ID NO: 1511452 - RNA, 23 nt, Pseudomonas aeruginosa PA01
gaucgcccggcgcuccaacagca

SEQ ID NO: 1511453 - RNA, 18 nt, Pseudomonas aeruginosa PA01
gaucgccagcgccagcag

SEQ ID NO: 1511454 - RNA, 14 nt, Pseudomonas aeruginosa PA01
gaucgagucgccgg

SEQ ID NO: 1511455 - RNA, 18 nt, Pseudomonas aeruginosa PA01
gaucgagucgccggcgaa

SEQ ID NO: 1511456 - RNA, 12 nt, Pseudomonas aeruginosa PA01
gaucgccaggcg

SEQ ID NO: 1511457 - RNA, 14 nt, Pseudomonas aeruginosa PA01
gaucgccaggcuga

SEQ ID NO: 1511458 - RNA, 16 nt, Pseudomonas aeruginosa PA01
gaucgcccagcggcug

SEQ ID NO: 1511459 - RNA, 22 nt, Pseudomonas aeruginosa PA01
gaucgccagcgguacccgccgg

SEQ ID NO: 1511460 - RNA, 23 nt, Pseudomonas aeruginosa PA01
gaucgccagcaauugccgcugca

SEQ ID NO: 1511461 - RNA, 21 nt, Pseudomonas aeruginosa PA01
gaucggcaacgagcaggacug

SEQ ID NO: 1511462 - RNA, 13 nt, Pseudomonas aeruginosa PA01
gaucgcgcuggcc

SEQ ID NO: 1511463 - RNA, 23 nt, Pseudomonas aeruginosa PA01
gaucgcgucguauaggcgcuggu

SEQ ID NO: 1511464 - RNA, 18 nt, Pseudomonas aeruginosa PA01
gaucggccucgcggcgcu

SEQ ID NO: 1511465 - RNA, 19 nt, Pseudomonas aeruginosa PA01
gaucggcgaucagcgggcg

SEQ ID NO: 1511466 - RNA, 15 nt, Pseudomonas aeruginosa PA01
gaucggcagcaucag

SEQ ID NO: 1511467 - RNA, 17 nt, Pseudomonas aeruginosa PA01
gaucggcagcaucagcc

SEQ ID NO: 1511468 - RNA, 19 nt, Pseudomonas aeruginosa PA01
gaucggcauguugugcuug

SEQ ID NO: 1511469 - RNA, 20 nt, Pseudomonas aeruginosa PA01
gaucggccaacugagcggcg

SEQ ID NO: 1511470 - RNA, 19 nt, Pseudomonas aeruginosa PA01
gaucggguagagcgcggcg

SEQ ID NO: 1511471 - RNA, 16 nt, Pseudomonas aeruginosa PA01
gaucggcguggcgguc

SEQ ID NO: 1511472 - RNA, 16 nt, Pseudomonas aeruginosa PA01
gauccgcugggccuug

SEQ ID NO: 1511473 - RNA, 12 nt, Pseudomonas aeruginosa PA01
gauccgcugcaa

SEQ ID NO: 1511474 - RNA, 15 nt, Pseudomonas aeruginosa PA01
gauccgcgccugcuu

SEQ ID NO: 1511475 - RNA, 22 nt, Pseudomonas aeruginosa PA01
gauccgcccgcaugccagggcc

SEQ ID NO: 1511476 - RNA, 14 nt, Pseudomonas aeruginosa PA01
gauccgccagcaga

SEQ ID NO: 1511477 - RNA, 21 nt, Pseudomonas aeruginosa PA01
gauccacuugccgccgccgga

SEQ ID NO: 1511478 - RNA, 16 nt, Pseudomonas aeruginosa PA01
gaucccgcgcgggccg

SEQ ID NO: 1511479 - RNA, 14 nt, Pseudomonas aeruginosa PA01
gauccacgccuggc

SEQ ID NO: 1511480 - RNA, 15 nt, Pseudomonas aeruginosa PA01
gauccaccgccaggg

SEQ ID NO: 1511481 - RNA, 21 nt, Pseudomonas aeruginosa PA01
gauccuggguagauuuacaag

SEQ ID NO: 1511482 - RNA, 14 nt, Pseudomonas aeruginosa PA01
gaucgacagcagcg

SEQ ID NO: 1511483 - RNA, 17 nt, Pseudomonas aeruginosa PA01
gaucgaccucgcgggcg

SEQ ID NO: 1511484 - RNA, 12 nt, Pseudomonas aeruginosa PA01
gaucgaccugcc

SEQ ID NO: 1511485 - RNA, 18 nt, Pseudomonas aeruginosa PA01
gauccugaccccggccug

SEQ ID NO: 1511486 - RNA, 14 nt, Pseudomonas aeruginosa PA01
gauccggugcaggc

SEQ ID NO: 1511487 - RNA, 21 nt, Pseudomonas aeruginosa PA01
gauccggugcaggccgagcug

SEQ ID NO: 1511488 - RNA, 15 nt, Pseudomonas aeruginosa PA01
gaucgucgccaagcc

SEQ ID NO: 1511489 - RNA, 15 nt, Pseudomonas aeruginosa PA01
gaucggugcgggcag

SEQ ID NO: 1511490 - RNA, 16 nt, Pseudomonas aeruginosa PA01
gaugaccaggguggcg

SEQ ID NO: 1511491 - RNA, 15 nt, Pseudomonas aeruginosa PA01
gaugagccgcugguc

SEQ ID NO: 1511492 - RNA, 20 nt, Pseudomonas aeruginosa PA01
gaugaucgguucccgcccgc

SEQ ID NO: 1511493 - RNA, 21 nt, Pseudomonas aeruginosa PA01
gaugaucuccgcgccgggcug

SEQ ID NO: 1511494 - RNA, 19 nt, Pseudomonas aeruginosa PA01
gaugcagucccgccaggcg

SEQ ID NO: 1511495 - RNA, 17 nt, Pseudomonas aeruginosa PA01
gaugcagucggcaccga

SEQ ID NO: 1511496 - RNA, 18 nt, Pseudomonas aeruginosa PA01
gaugcagcgucgcgcguc

SEQ ID NO: 1511497 - RNA, 16 nt, Pseudomonas aeruginosa PA01
gaugccaaguugccug

SEQ ID NO: 1511498 - RNA, 16 nt, Pseudomonas aeruginosa PA01
gaugcgcaggccggga

SEQ ID NO: 1511499 - RNA, 21 nt, Pseudomonas aeruginosa PA01
gaugccuuucggggugcaggg

SEQ ID NO: 1511500 - RNA, 17 nt, Pseudomonas aeruginosa PA01
gaugcccggucaccacc

SEQ ID NO: 1511501 - RNA, 23 nt, Pseudomonas aeruginosa PA01
gaugcccggcugguugccagcag

SEQ ID NO: 1511502 - RNA, 17 nt, Pseudomonas aeruginosa PA01
gaugccgaacaccugca

SEQ ID NO: 1511503 - RNA, 16 nt, Pseudomonas aeruginosa PA01
gaugcccuuggccagc

SEQ ID NO: 1511504 - RNA, 14 nt, Pseudomonas aeruginosa PA01
gaugccgcccagca

SEQ ID NO: 1511505 - RNA, 23 nt, Pseudomonas aeruginosa PA01
gaugccgccgaccucggccgcca

SEQ ID NO: 1511506 - RNA, 21 nt, Pseudomonas aeruginosa PA01
gaugccgccgccgccccagca

SEQ ID NO: 1511507 - RNA, 23 nt, Pseudomonas aeruginosa PA01
gauggacagcuuggccagcaggc

SEQ ID NO: 1511508 - RNA, 19 nt, Pseudomonas aeruginosa PA01
gaugcgguuccuggcugga

SEQ ID NO: 1511509 - RNA, 14 nt, Pseudomonas aeruginosa PA01
gaugcugucccaac

SEQ ID NO: 1511510 - RNA, 19 nt, Pseudomonas aeruginosa PA01
gaugcuggcaacggcgggc

SEQ ID NO: 1511511 - RNA, 21 nt, Pseudomonas aeruginosa PA01
gaugcugcugaucaggaggau

SEQ ID NO: 1511512 - RNA, 15 nt, Pseudomonas aeruginosa PA01
gaugcuguggguggu

SEQ ID NO: 1511513 - RNA, 22 nt, Pseudomonas aeruginosa PA01
gauggcgccauugugcgcgcgc

SEQ ID NO: 1511514 - RNA, 17 nt, Pseudomonas aeruginosa PA01
gauggcgacguucugcu

SEQ ID NO: 1511515 - RNA, 14 nt, Pseudomonas aeruginosa PA01
gauggcggccuggu

SEQ ID NO: 1511516 - RNA, 20 nt, Pseudomonas aeruginosa PA01
gauggcgcggugggccuuga

SEQ ID NO: 1511517 - RNA, 20 nt, Pseudomonas aeruginosa PA01
gauggguaucaugcgccccg

SEQ ID NO: 1511518 - RNA, 16 nt, Pseudomonas aeruginosa PA01
gauggucaggccggcg

SEQ ID NO: 1511519 - RNA, 16 nt, Pseudomonas aeruginosa PA01
gauggucgagggcgcg

SEQ ID NO: 1511520 - RNA, 14 nt, Pseudomonas aeruginosa PA01
gaugggccguaggu

SEQ ID NO: 1511521 - RNA, 22 nt, Pseudomonas aeruginosa PA01
gaugggcacgaucugcgccgca

SEQ ID NO: 1511522 - RNA, 23 nt, Pseudomonas aeruginosa PA01
gaugguugccguacuucagggug

SEQ ID NO: 1511523 - RNA, 22 nt, Pseudomonas aeruginosa PA01
gauguaguucuugcgcauuuug

SEQ ID NO: 1511524 - RNA, 17 nt, Pseudomonas aeruginosa PA01
gauguaguagacguccu

SEQ ID NO: 1511525 - RNA, 12 nt, Pseudomonas aeruginosa PA01
gauggugcgcuu

SEQ ID NO: 1511526 - RNA, 17 nt, Pseudomonas aeruginosa PA01
gauggugugcagcagca

SEQ ID NO: 1511527 - RNA, 17 nt, Pseudomonas aeruginosa PA01
gaugguggaauccaggg

SEQ ID NO: 1511528 - RNA, 20 nt, Pseudomonas aeruginosa PA01
gaugguggaauccagggccg

SEQ ID NO: 1511529 - RNA, 14 nt, Pseudomonas aeruginosa PA01
gauguccugggcca

SEQ ID NO: 1511530 - RNA, 19 nt, Pseudomonas aeruginosa PA01
gauguccccggccagcagc

SEQ ID NO: 1511531 - RNA, 15 nt, Pseudomonas aeruginosa PA01
gauuacuuggcuuca

SEQ ID NO: 1511532 - RNA, 22 nt, Pseudomonas aeruginosa PA01
gauuacuuggcuucagcuucua

SEQ ID NO: 1511533 - RNA, 13 nt, Pseudomonas aeruginosa PA01
gauucucucccag

SEQ ID NO: 1511534 - RNA, 15 nt, Pseudomonas aeruginosa PA01
gauuggagaugcuca

SEQ ID NO: 1511535 - RNA, 11 nt, Pseudomonas aeruginosa PA01
gauugugcagg

SEQ ID NO: 1511536 - RNA, 13 nt, Pseudomonas aeruginosa PA01
gauugugcagggc

SEQ ID NO: 1511537 - RNA, 21 nt, Pseudomonas aeruginosa PA01
gauuucacggcggauaaccgc

SEQ ID NO: 1511538 - RNA, 15 nt, Pseudomonas aeruginosa PA01
gauuugccgccgagg

SEQ ID NO: 1511539 - RNA, 19 nt, Pseudomonas aeruginosa PA01
gcaaaaaugcccuuggcuu

SEQ ID NO: 1511540 - RNA, 14 nt, Pseudomonas aeruginosa PA01
gauuuugggcagcg

SEQ ID NO: 1511541 - RNA, 15 nt, Pseudomonas aeruginosa PA01
gauuuugggcucaga

SEQ ID NO: 1511542 - RNA, 19 nt, Pseudomonas aeruginosa PA01
gcaaacgccgccaccaacc

SEQ ID NO: 1511543 - RNA, 15 nt, Pseudomonas aeruginosa PA01
gcaaaggcgcgcagg

SEQ ID NO: 1511544 - RNA, 23 nt, Pseudomonas aeruginosa PA01
gcaaaggcgcgcagggccgcggc

SEQ ID NO: 1511545 - RNA, 21 nt, Pseudomonas aeruginosa PA01
gcaaagugcggucggaucgga

SEQ ID NO: 1511546 - RNA, 17 nt, Pseudomonas aeruginosa PA01
gcaaagcgcgggcugcc

SEQ ID NO: 1511547 - RNA, 18 nt, Pseudomonas aeruginosa PA01
gcaaaggcccggcgcggu

SEQ ID NO: 1511548 - RNA, 13 nt, Pseudomonas aeruginosa PA01
gcagcccggucac

SEQ ID NO: 1511549 - RNA, 15 nt, Pseudomonas aeruginosa PA01
gcagcccggccugga

SEQ ID NO: 1511550 - RNA, 17 nt, Pseudomonas aeruginosa PA01
gcagcccuaggcgaccc

SEQ ID NO: 1511551 - RNA, 16 nt, Pseudomonas aeruginosa PA01
gcagcccuggcguggc

SEQ ID NO: 1511552 - RNA, 14 nt, Pseudomonas aeruginosa PA01
gcagccgcggggcu

SEQ ID NO: 1511553 - RNA, 18 nt, Pseudomonas aeruginosa PA01
gcagccgcucggccgcca

SEQ ID NO: 1511554 - RNA, 15 nt, Pseudomonas aeruginosa PA01
gcagccgcgcucggc

SEQ ID NO: 1511555 - RNA, 19 nt, Pseudomonas aeruginosa PA01
gcagccacccgcgggcagc

SEQ ID NO: 1511556 - RNA, 14 nt, Pseudomonas aeruginosa PA01
gcagccacaggcgc

SEQ ID NO: 1511557 - RNA, 20 nt, Pseudomonas aeruginosa PA01
gcagccaaccgucgcccugg

SEQ ID NO: 1511558 - RNA, 16 nt, Pseudomonas aeruginosa PA01
gcagcaucuucucggc

SEQ ID NO: 1511559 - RNA, 18 nt, Pseudomonas aeruginosa PA01
gcagcgccacuuccagcu

SEQ ID NO: 1511560 - RNA, 13 nt, Pseudomonas aeruginosa PA01
gcagcgccagggc

SEQ ID NO: 1511561 - RNA, 23 nt, Pseudomonas aeruginosa PA01
gcagcgccaguacuccgagggcc

SEQ ID NO: 1511562 - RNA, 22 nt, Pseudomonas aeruginosa PA01
gcagcgccaguuggacgcggcc

SEQ ID NO: 1511563 - RNA, 16 nt, Pseudomonas aeruginosa PA01
gcagcgccagccaggg

SEQ ID NO: 1511564 - RNA, 13 nt, Pseudomonas aeruginosa PA01
gcagcgccgccag

SEQ ID NO: 1511565 - RNA, 12 nt, Pseudomonas aeruginosa PA01
gcagcgccgcgc

SEQ ID NO: 1511566 - RNA, 22 nt, Pseudomonas aeruginosa PA01
gcagcgccucccgggccucucg

SEQ ID NO: 1511567 - RNA, 15 nt, Pseudomonas aeruginosa PA01
gcagcgccgccgcgu

SEQ ID NO: 1511568 - RNA, 14 nt, Pseudomonas aeruginosa PA01
gcagcgccgggcau

SEQ ID NO: 1511569 - RNA, 15 nt, Pseudomonas aeruginosa PA01
gcagccggccaugcu

SEQ ID NO: 1511570 - RNA, 13 nt, Pseudomonas aeruginosa PA01
gcagccggcggcg

SEQ ID NO: 1511571 - RNA, 14 nt, Pseudomonas aeruginosa PA01
gcagccggcggcga

SEQ ID NO: 1511572 - RNA, 21 nt, Pseudomonas aeruginosa PA01
gcagccggaccagccguccgc

SEQ ID NO: 1511573 - RNA, 15 nt, Pseudomonas aeruginosa PA01
gcagccgcugcugca

SEQ ID NO: 1511574 - RNA, 12 nt, Pseudomonas aeruginosa PA01
gcagcagcaggu

SEQ ID NO: 1511575 - RNA, 19 nt, Pseudomonas aeruginosa PA01
gcagcagagcgccacgggu

SEQ ID NO: 1511576 - RNA, 21 nt, Pseudomonas aeruginosa PA01
gcagcagagguagagcuuggc

SEQ ID NO: 1511577 - RNA, 13 nt, Pseudomonas aeruginosa PA01
gcagcaccgccug

SEQ ID NO: 1511578 - RNA, 16 nt, Pseudomonas aeruginosa PA01
gcagcaccgccugguc

SEQ ID NO: 1511579 - RNA, 19 nt, Pseudomonas aeruginosa PA01
gcagcacccccagcaggcc

SEQ ID NO: 1511580 - RNA, 22 nt, Pseudomonas aeruginosa PA01
gcagcacccccagcaggccagc

SEQ ID NO: 1511581 - RNA, 11 nt, Pseudomonas aeruginosa PA01
gcagcaccgcc

SEQ ID NO: 1511582 - RNA, 19 nt, Pseudomonas aeruginosa PA01
gcagcaccacauggguguc

SEQ ID NO: 1511583 - RNA, 23 nt, Pseudomonas aeruginosa PA01
gcagcaccaccucgccaagcugg

SEQ ID NO: 1511584 - RNA, 19 nt, Pseudomonas aeruginosa PA01
gcagcaccaggcuggccag

SEQ ID NO: 1511585 - RNA, 12 nt, Pseudomonas aeruginosa PA01
gcagcaccauca

SEQ ID NO: 1511586 - RNA, 16 nt, Pseudomonas aeruginosa PA01
gcagcaccaucagcca

SEQ ID NO: 1511587 - RNA, 18 nt, Pseudomonas aeruginosa PA01
gcagcaccaucagccagc

SEQ ID NO: 1511588 - RNA, 21 nt, Pseudomonas aeruginosa PA01
gcagcaccaucagccagccca

SEQ ID NO: 1511589 - RNA, 23 nt, Pseudomonas aeruginosa PA01
gcagcaccaucagccagcccagu

SEQ ID NO: 1511590 - RNA, 20 nt, Pseudomonas aeruginosa PA01
gcagcagcgaacgccgcagc

SEQ ID NO: 1511591 - RNA, 15 nt, Pseudomonas aeruginosa PA01
gcagcagcgccagga

SEQ ID NO: 1511592 - RNA, 18 nt, Pseudomonas aeruginosa PA01
gcagcagcgccaggaagc

SEQ ID NO: 1511593 - RNA, 20 nt, Pseudomonas aeruginosa PA01
gcagcagcgaccugacccgc

SEQ ID NO: 1511594 - RNA, 17 nt, Pseudomonas aeruginosa PA01
gcagcagguuccuccug

SEQ ID NO: 1511595 - RNA, 23 nt, Pseudomonas aeruginosa PA01
gcagcagcgccgcgaacacaccc

SEQ ID NO: 1511596 - RNA, 18 nt, Pseudomonas aeruginosa PA01
gcagcaacagcgccgcgc

SEQ ID NO: 1511597 - RNA, 23 nt, Pseudomonas aeruginosa PA01
gcacugguggcgaacagcaccuu

SEQ ID NO: 1511598 - RNA, 18 nt, Pseudomonas aeruginosa PA01
gcagcgcuuguagcagcc

SEQ ID NO: 1511599 - RNA, 13 nt, Pseudomonas aeruginosa PA01
gcagcgcuuuuca

SEQ ID NO: 1511600 - RNA, 22 nt, Pseudomonas aeruginosa PA01
gcagcggcaaaggcccggcgcg

SEQ ID NO: 1511601 - RNA, 23 nt, Pseudomonas aeruginosa PA01
gcagcggcagccacucggccagg

SEQ ID NO: 1511602 - RNA, 14 nt, Pseudomonas aeruginosa PA01
gcagcggcagcgcc

SEQ ID NO: 1511603 - RNA, 15 nt, Pseudomonas aeruginosa PA01
gcagcggcagcggcu

SEQ ID NO: 1511604 - RNA, 23 nt, Pseudomonas aeruginosa PA01
gcagcggcagcgucucggcugcc

SEQ ID NO: 1511605 - RNA, 22 nt, Pseudomonas aeruginosa PA01
gcagcggcaggccacggccgcu

SEQ ID NO: 1511606 - RNA, 20 nt, Pseudomonas aeruginosa PA01
gcagcggaggauucagcagg

SEQ ID NO: 1511607 - RNA, 20 nt, Pseudomonas aeruginosa PA01
gcagcggauauucgacgcgc

SEQ ID NO: 1511608 - RNA, 18 nt, Pseudomonas aeruginosa PA01
gcagcggcaugcccugcc

SEQ ID NO: 1511609 - RNA, 22 nt, Pseudomonas aeruginosa PA01
gcagcggcaugcccugccggcg

SEQ ID NO: 1511610 - RNA, 22 nt, Pseudomonas aeruginosa PA01
gcagcggcauggucagcccaua

SEQ ID NO: 1511611 - RNA, 21 nt, Pseudomonas aeruginosa PA01
gcagcggcgacaccgccagca

SEQ ID NO: 1511612 - RNA, 12 nt, Pseudomonas aeruginosa PA01
gcagcggcuggc

SEQ ID NO: 1511613 - RNA, 21 nt, Pseudomonas aeruginosa PA01
gcagcgcggucauccgcccug

SEQ ID NO: 1511614 - RNA, 14 nt, Pseudomonas aeruginosa PA01
gcagcgcggcggcg

SEQ ID NO: 1511615 - RNA, 17 nt, Pseudomonas aeruginosa PA01
gcagcgcggcggcggcc

SEQ ID NO: 1511616 - RNA, 17 nt, Pseudomonas aeruginosa PA01
gcagcgcguagaccacc

SEQ ID NO: 1511617 - RNA, 19 nt, Pseudomonas aeruginosa PA01
gcagcgcguagaccaccuc

SEQ ID NO: 1511618 - RNA, 21 nt, Pseudomonas aeruginosa PA01
gcagcgcgauaucgcaggcca

SEQ ID NO: 1511619 - RNA, 12 nt, Pseudomonas aeruginosa PA01
gcagcgccucgg

SEQ ID NO: 1511620 - RNA, 21 nt, Pseudomonas aeruginosa PA01
gcagcucugcgaucagggccu

SEQ ID NO: 1511621 - RNA, 17 nt, Pseudomonas aeruginosa PA01
gcagcucggugagcagg

SEQ ID NO: 1511622 - RNA, 21 nt, Pseudomonas aeruginosa PA01
gcagcucguucgcccagaccu

SEQ ID NO: 1511623 - RNA, 21 nt, Pseudomonas aeruginosa PA01
gcagcucguugcacagcgccc

SEQ ID NO: 1511624 - RNA, 20 nt, Pseudomonas aeruginosa PA01
gcagcucguuggccaccugc

SEQ ID NO: 1511625 - RNA, 22 nt, Pseudomonas aeruginosa PA01
gcagcuggauccgugccaggcg

SEQ ID NO: 1511626 - RNA, 15 nt, Pseudomonas aeruginosa PA01
gcagcgucucagccc

SEQ ID NO: 1511627 - RNA, 20 nt, Pseudomonas aeruginosa PA01
gcagcgucucagcccucggc

SEQ ID NO: 1511628 - RNA, 17 nt, Pseudomonas aeruginosa PA01
gcagcgucucggcugcc

SEQ ID NO: 1511629 - RNA, 22 nt, Pseudomonas aeruginosa PA01
gcagcgucgagcuggcgcaggc

SEQ ID NO: 1511630 - RNA, 23 nt, Pseudomonas aeruginosa PA01
gcagcgucgagcuggcgcaggcc

SEQ ID NO: 1511631 - RNA, 16 nt, Pseudomonas aeruginosa PA01
gcagcgucgccgggcg

SEQ ID NO: 1511632 - RNA, 22 nt, Pseudomonas aeruginosa PA01
gcagcgucgcgucggccuggcg

SEQ ID NO: 1511633 - RNA, 17 nt, Pseudomonas aeruginosa PA01
gcagcggucgccggucg

SEQ ID NO: 1511634 - RNA, 16 nt, Pseudomonas aeruginosa PA01
gcagcgguucgcccgc

SEQ ID NO: 1511635 - RNA, 21 nt, Pseudomonas aeruginosa PA01
gcagcgggucgaucaggcgca

SEQ ID NO: 1511636 - RNA, 22 nt, Pseudomonas aeruginosa PA01
gcagcgggucgaucaggcgcau

SEQ ID NO: 1511637 - RNA, 22 nt, Pseudomonas aeruginosa PA01
gcagcgguacggucgaggcgga

SEQ ID NO: 1511638 - RNA, 17 nt, Pseudomonas aeruginosa PA01
gcaggcgggaguccagg

SEQ ID NO: 1511639 - RNA, 16 nt, Pseudomonas aeruginosa PA01
gcaggcggcuggcgcg

SEQ ID NO: 1511640 - RNA, 19 nt, Pseudomonas aeruginosa PA01
gcaggcggcuggcgcgauc

SEQ ID NO: 1511641 - RNA, 15 nt, Pseudomonas aeruginosa PA01
gcaggcgcagcagcg

SEQ ID NO: 1511642 - RNA, 16 nt, Pseudomonas aeruginosa PA01
gcaggcgcagcagcga

SEQ ID NO: 1511643 - RNA, 19 nt, Pseudomonas aeruginosa PA01
gcaggcgauucaagugucg

SEQ ID NO: 1511644 - RNA, 18 nt, Pseudomonas aeruginosa PA01
gcaggcgcaaccagacca

SEQ ID NO: 1511645 - RNA, 18 nt, Pseudomonas aeruginosa PA01
gcaggcgaugaccgcccc

SEQ ID NO: 1511646 - RNA, 22 nt, Pseudomonas aeruginosa PA01
gcaggcgaugaucagcccuucg

SEQ ID NO: 1511647 - RNA, 13 nt, Pseudomonas aeruginosa PA01
gcaggcgaugccg

SEQ ID NO: 1511648 - RNA, 15 nt, Pseudomonas aeruginosa PA01
gcaggcgguggagca

SEQ ID NO: 1511649 - RNA, 15 nt, Pseudomonas aeruginosa PA01
gcaggcgggcggcgu

SEQ ID NO: 1511650 - RNA, 19 nt, Pseudomonas aeruginosa PA01
gcaggcgguagcgccgcgc

SEQ ID NO: 1511651 - RNA, 19 nt, Pseudomonas aeruginosa PA01
gcaggcggucagcgcguuc

SEQ ID NO: 1511652 - RNA, 23 nt, Pseudomonas aeruginosa PA01
gcaggccuggaauaccccgcgga

SEQ ID NO: 1511653 - RNA, 15 nt, Pseudomonas aeruginosa PA01
gcaggcgaacagggc

SEQ ID NO: 1511654 - RNA, 13 nt, Pseudomonas aeruginosa PA01
gcaggccugggca

SEQ ID NO: 1511655 - RNA, 13 nt, Pseudomonas aeruginosa PA01
gcaggccuuccca

SEQ ID NO: 1511656 - RNA, 21 nt, Pseudomonas aeruginosa PA01
gcaggccuucgacuucgacga

SEQ ID NO: 1511657 - RNA, 22 nt, Pseudomonas aeruginosa PA01
gcaggcgaaaaaaagccccgcc

SEQ ID NO: 1511658 - RNA, 20 nt, Pseudomonas aeruginosa PA01
gcaggcccaugauggucggc

SEQ ID NO: 1511659 - RNA, 23 nt, Pseudomonas aeruginosa PA01
gcaggcagucccagaaggccagg

SEQ ID NO: 1511660 - RNA, 18 nt, Pseudomonas aeruginosa PA01
gcaggcccgagccggacg

SEQ ID NO: 1511661 - RNA, 15 nt, Pseudomonas aeruginosa PA01
gcaggcccggccgcc

SEQ ID NO: 1511662 - RNA, 15 nt, Pseudomonas aeruginosa PA01
gcaggcaggccuggg

SEQ ID NO: 1511663 - RNA, 15 nt, Pseudomonas aeruginosa PA01
gcaggcacccgcggu

SEQ ID NO: 1511664 - RNA, 21 nt, Pseudomonas aeruginosa PA01
gcaggcaaaaaaaaggggcgg

SEQ ID NO: 1511665 - RNA, 19 nt, Pseudomonas aeruginosa PA01
gcaggcaggucaucaggau

SEQ ID NO: 1511666 - RNA, 17 nt, Pseudomonas aeruginosa PA01
gcaggcagugccgggcg

SEQ ID NO: 1511667 - RNA, 20 nt, Pseudomonas aeruginosa PA01
gcaggcaguggcgccagcca

SEQ ID NO: 1511668 - RNA, 13 nt, Pseudomonas aeruginosa PA01
gcaggccagcgcc

SEQ ID NO: 1511669 - RNA, 17 nt, Pseudomonas aeruginosa PA01
gcaggccagcgccaggg

SEQ ID NO: 1511670 - RNA, 14 nt, Pseudomonas aeruginosa PA01
gcaggccagcaggu

SEQ ID NO: 1511671 - RNA, 23 nt, Pseudomonas aeruginosa PA01
gcaggaaaagcggaagggccgag

SEQ ID NO: 1511672 - RNA, 19 nt, Pseudomonas aeruginosa PA01
gcagcuugguauccaccuc

SEQ ID NO: 1511673 - RNA, 16 nt, Pseudomonas aeruginosa PA01
gcagcuugcucgaugc

SEQ ID NO: 1511674 - RNA, 22 nt, Pseudomonas aeruginosa PA01
gcagcuuggcgaauagccggcg

SEQ ID NO: 1511675 - RNA, 14 nt, Pseudomonas aeruginosa PA01
gcagcuugccggca

SEQ ID NO: 1511676 - RNA, 17 nt, Pseudomonas aeruginosa PA01
gcagcuugccuuccagg

SEQ ID NO: 1511677 - RNA, 19 nt, Pseudomonas aeruginosa PA01
gcauaggucaugcccaggc

SEQ ID NO: 1511678 - RNA, 22 nt, Pseudomonas aeruginosa PA01
gcauaggguccaguucagggcg

SEQ ID NO: 1511679 - RNA, 16 nt, Pseudomonas aeruginosa PA01
gcagugcggggcgcuc

SEQ ID NO: 1511680 - RNA, 20 nt, Pseudomonas aeruginosa PA01
gcaguccuugagcgccagca

SEQ ID NO: 1511681 - RNA, 16 nt, Pseudomonas aeruginosa PA01
gcagucccgcgcggcc

SEQ ID NO: 1511682 - RNA, 21 nt, Pseudomonas aeruginosa PA01
gcagucccugccaggggcuag

SEQ ID NO: 1511683 - RNA, 23 nt, Pseudomonas aeruginosa PA01
gcagucccagaaggccagggcau

SEQ ID NO: 1511684 - RNA, 15 nt, Pseudomonas aeruginosa PA01
gcagucccgccaggc

SEQ ID NO: 1511685 - RNA, 12 nt, Pseudomonas aeruginosa PA01
gcaguagcugga

SEQ ID NO: 1511686 - RNA, 16 nt, Pseudomonas aeruginosa PA01
gcagggaaggcgcgcu

SEQ ID NO: 1511687 - RNA, 22 nt, Pseudomonas aeruginosa PA01
gcaggcuuucguaggcaggcgc

SEQ ID NO: 1511688 - RNA, 18 nt, Pseudomonas aeruginosa PA01
gcagggagaaccaggcgg

SEQ ID NO: 1511689 - RNA, 17 nt, Pseudomonas aeruginosa PA01
gcagggaggagggcgag

SEQ ID NO: 1511690 - RNA, 13 nt, Pseudomonas aeruginosa PA01
gcagggaggcgca

SEQ ID NO: 1511691 - RNA, 16 nt, Pseudomonas aeruginosa PA01
gcagggaguccgccag

SEQ ID NO: 1511692 - RNA, 13 nt, Pseudomonas aeruginosa PA01
gcagggcacagcc

SEQ ID NO: 1511693 - RNA, 22 nt, Pseudomonas aeruginosa PA01
gcagggauuccgggucgaggcu

SEQ ID NO: 1511694 - RNA, 18 nt, Pseudomonas aeruginosa PA01
gcagggcagccgccgcgg

SEQ ID NO: 1511695 - RNA, 18 nt, Pseudomonas aeruginosa PA01
gcaggucgggcaacggcu

SEQ ID NO: 1511696 - RNA, 15 nt, Pseudomonas aeruginosa PA01
gcaggugcaccgcgc

SEQ ID NO: 1511697 - RNA, 19 nt, Pseudomonas aeruginosa PA01
gcaggugcaccgcgcugga

SEQ ID NO: 1511698 - RNA, 22 nt, Pseudomonas aeruginosa PA01
gcaggugcaccgcgcuggagac

SEQ ID NO: 1511699 - RNA, 16 nt, Pseudomonas aeruginosa PA01
gcaggucgugcagccc

SEQ ID NO: 1511700 - RNA, 19 nt, Pseudomonas aeruginosa PA01
gcaggucgugcuggacuuc

SEQ ID NO: 1511701 - RNA, 16 nt, Pseudomonas aeruginosa PA01
gcagguugcgcuggcg

SEQ ID NO: 1511702 - RNA, 18 nt, Pseudomonas aeruginosa PA01
gcagguugcgcuggcgca

SEQ ID NO: 1511703 - RNA, 23 nt, Pseudomonas aeruginosa PA01
gcagguugcgcuggcgcagcagc

SEQ ID NO: 1511704 - RNA, 16 nt, Pseudomonas aeruginosa PA01
gcagguugcgggagca

SEQ ID NO: 1511705 - RNA, 14 nt, Pseudomonas aeruginosa PA01
gcaggugcccuggc

SEQ ID NO: 1511706 - RNA, 22 nt, Pseudomonas aeruginosa PA01
gcagguugagggccgcgcugcu

SEQ ID NO: 1511707 - RNA, 15 nt, Pseudomonas aeruginosa PA01
gcagguugcuggcga

SEQ ID NO: 1511708 - RNA, 13 nt, Pseudomonas aeruginosa PA01
gcagguuggcccc

SEQ ID NO: 1511709 - RNA, 16 nt, Pseudomonas aeruginosa PA01
gcagguuggccccgcc

SEQ ID NO: 1511710 - RNA, 13 nt, Pseudomonas aeruginosa PA01
gcagguuggucug

SEQ ID NO: 1511711 - RNA, 21 nt, Pseudomonas aeruginosa PA01
gcaucaccgcgguggaggcgg

SEQ ID NO: 1511712 - RNA, 14 nt, Pseudomonas aeruginosa PA01
gcaucaccaggcug

SEQ ID NO: 1511713 - RNA, 19 nt, Pseudomonas aeruginosa PA01
gcauauucuucaacagcgu

SEQ ID NO: 1511714 - RNA, 17 nt, Pseudomonas aeruginosa PA01
gcaucaggucggcgcgc

SEQ ID NO: 1511715 - RNA, 19 nt, Pseudomonas aeruginosa PA01
gcaucagcaauuccgcagc

SEQ ID NO: 1511716 - RNA, 22 nt, Pseudomonas aeruginosa PA01
gcaucagcaauuccgcagccuu

SEQ ID NO: 1511717 - RNA, 12 nt, Pseudomonas aeruginosa PA01
gcaucagcagga

SEQ ID NO: 1511718 - RNA, 13 nt, Pseudomonas aeruginosa PA01
gcaucagcaggaa

SEQ ID NO: 1511719 - RNA, 22 nt, Pseudomonas aeruginosa PA01
gcauccguaaaauggcgcgccu

SEQ ID NO: 1511720 - RNA, 14 nt, Pseudomonas aeruginosa PA01
gcauccucgccccg

SEQ ID NO: 1511721 - RNA, 21 nt, Pseudomonas aeruginosa PA01
gcauccucgcgguucugcucc

SEQ ID NO: 1511722 - RNA, 16 nt, Pseudomonas aeruginosa PA01
gcauccucggcaucca

SEQ ID NO: 1511723 - RNA, 20 nt, Pseudomonas aeruginosa PA01
gcauccuccacccccgcaac

SEQ ID NO: 1511724 - RNA, 20 nt, Pseudomonas aeruginosa PA01
gcaucgaaggcgccggcaug

SEQ ID NO: 1511725 - RNA, 14 nt, Pseudomonas aeruginosa PA01
gcauccugccgccu

SEQ ID NO: 1511726 - RNA, 13 nt, Pseudomonas aeruginosa PA01
gcauccuucuucu

SEQ ID NO: 1511727 - RNA, 13 nt, Pseudomonas aeruginosa PA01
gcaucgacgccag

SEQ ID NO: 1511728 - RNA, 15 nt, Pseudomonas aeruginosa PA01
gcaucgaccagcagc

SEQ ID NO: 1511729 - RNA, 21 nt, Pseudomonas aeruginosa PA01
gcaucgaccagggccgggucg

SEQ ID NO: 1511730 - RNA, 18 nt, Pseudomonas aeruginosa PA01
gcauccgccgcuggggac

SEQ ID NO: 1511731 - RNA, 20 nt, Pseudomonas aeruginosa PA01
gcauccccuuuuuucagccu

SEQ ID NO: 1511732 - RNA, 18 nt, Pseudomonas aeruginosa PA01
gcauccaguucguucugg

SEQ ID NO: 1511733 - RNA, 23 nt, Pseudomonas aeruginosa PA01
gcauccagcgauacaccugcaac

SEQ ID NO: 1511734 - RNA, 15 nt, Pseudomonas aeruginosa PA01
gcaucccaguagccg

SEQ ID NO: 1511735 - RNA, 18 nt, Pseudomonas aeruginosa PA01
gcaauuccaccggcuggc

SEQ ID NO: 1511736 - RNA, 19 nt, Pseudomonas aeruginosa PA01
gcaauuccaccggcuggcc

SEQ ID NO: 1511737 - RNA, 16 nt, Pseudomonas aeruginosa PA01
gcaauugaucauccag

SEQ ID NO: 1511738 - RNA, 15 nt, Pseudomonas aeruginosa PA01
gcaauugccgcugca

SEQ ID NO: 1511739 - RNA, 22 nt, Pseudomonas aeruginosa PA01
gcaauggggcgcugguccuuca

SEQ ID NO: 1511740 - RNA, 14 nt, Pseudomonas aeruginosa PA01
gcaauggggcggcc

SEQ ID NO: 1511741 - RNA, 15 nt, Pseudomonas aeruginosa PA01
gcacaaaaaagcccg

SEQ ID NO: 1511742 - RNA, 14 nt, Pseudomonas aeruginosa PA01
gcacaaaaaaggcg

SEQ ID NO: 1511743 - RNA, 20 nt, Pseudomonas aeruginosa PA01
gcacauagagggucagccgg

SEQ ID NO: 1511744 - RNA, 22 nt, Pseudomonas aeruginosa PA01
gcacauagagggucagccggcc

SEQ ID NO: 1511745 - RNA, 15 nt, Pseudomonas aeruginosa PA01
gcacacgcucccaac

SEQ ID NO: 1511746 - RNA, 14 nt, Pseudomonas aeruginosa PA01
gcaccaccucgcca

SEQ ID NO: 1511747 - RNA, 21 nt, Pseudomonas aeruginosa PA01
gcaccaccgccgccagcaacg

SEQ ID NO: 1511748 - RNA, 19 nt, Pseudomonas aeruginosa PA01
gcaccaccgagagcggcgc

SEQ ID NO: 1511749 - RNA, 22 nt, Pseudomonas aeruginosa PA01
gcaccacccggcgcacgccggc

SEQ ID NO: 1511750 - RNA, 20 nt, Pseudomonas aeruginosa PA01
gcaccacguucggcgcgggu

SEQ ID NO: 1511751 - RNA, 21 nt, Pseudomonas aeruginosa PA01
gcaccacgcgcaagccagcca

SEQ ID NO: 1511752 - RNA, 17 nt, Pseudomonas aeruginosa PA01
gcaccaccuggcaggua

SEQ ID NO: 1511753 - RNA, 16 nt, Pseudomonas aeruginosa PA01
gcaagcgcaugaggcu

SEQ ID NO: 1511754 - RNA, 20 nt, Pseudomonas aeruginosa PA01
gcaagcgaucucucagucca

SEQ ID NO: 1511755 - RNA, 20 nt, Pseudomonas aeruginosa PA01
gcaaggucgucucagaccuu

SEQ ID NO: 1511756 - RNA, 13 nt, Pseudomonas aeruginosa PA01
gcaaguggcggcu

SEQ ID NO: 1511757 - RNA, 23 nt, Pseudomonas aeruginosa PA01
gcaagugggucacggugaggacc

SEQ ID NO: 1511758 - RNA, 15 nt, Pseudomonas aeruginosa PA01
gcaagucggccugca

SEQ ID NO: 1511759 - RNA, 16 nt, Pseudomonas aeruginosa PA01
gcaagucgaacaggcc

SEQ ID NO: 1511760 - RNA, 15 nt, Pseudomonas aeruginosa PA01
gcaauggaugaacgu

SEQ ID NO: 1511761 - RNA, 20 nt, Pseudomonas aeruginosa PA01
gcaauggauguugccgccgc

SEQ ID NO: 1511762 - RNA, 20 nt, Pseudomonas aeruginosa PA01
gcacgccgaaguccugcaac

SEQ ID NO: 1511763 - RNA, 23 nt, Pseudomonas aeruginosa PA01
gcacgccccauccgggcggcggg

SEQ ID NO: 1511764 - RNA, 15 nt, Pseudomonas aeruginosa PA01
gcacgcccauggaga

SEQ ID NO: 1511765 - RNA, 23 nt, Pseudomonas aeruginosa PA01
gcacgcccaucgccaccagcagg

SEQ ID NO: 1511766 - RNA, 14 nt, Pseudomonas aeruginosa PA01
gcacgaggcgggcu

SEQ ID NO: 1511767 - RNA, 19 nt, Pseudomonas aeruginosa PA01
gcacgaggcgggcuggaaa

SEQ ID NO: 1511768 - RNA, 15 nt, Pseudomonas aeruginosa PA01
gcaccuguuccagca

SEQ ID NO: 1511769 - RNA, 19 nt, Pseudomonas aeruginosa PA01
gcaccuugcgaaaagcccg

SEQ ID NO: 1511770 - RNA, 12 nt, Pseudomonas aeruginosa PA01
gcaccuuggcca

SEQ ID NO: 1511771 - RNA, 17 nt, Pseudomonas aeruginosa PA01
gcaccuugucgcugacc

SEQ ID NO: 1511772 - RNA, 20 nt, Pseudomonas aeruginosa PA01
gcacgaccacaucggccagu

SEQ ID NO: 1511773 - RNA, 18 nt, Pseudomonas aeruginosa PA01
gcaccucccccagcgggc

SEQ ID NO: 1511774 - RNA, 23 nt, Pseudomonas aeruginosa PA01
gcaccugcagacgguucagcagc

SEQ ID NO: 1511775 - RNA, 20 nt, Pseudomonas aeruginosa PA01
gcaccggggugauccagcug

SEQ ID NO: 1511776 - RNA, 16 nt, Pseudomonas aeruginosa PA01
gcaccguaggccaggc

SEQ ID NO: 1511777 - RNA, 17 nt, Pseudomonas aeruginosa PA01
gcaccguaggccaggca

SEQ ID NO: 1511778 - RNA, 22 nt, Pseudomonas aeruginosa PA01
gcaccguaggccaggcagacca

SEQ ID NO: 1511779 - RNA, 15 nt, Pseudomonas aeruginosa PA01
gcaccgucauggugc

SEQ ID NO: 1511780 - RNA, 19 nt, Pseudomonas aeruginosa PA01
gcaccacugcaacacuucc

SEQ ID NO: 1511781 - RNA, 22 nt, Pseudomonas aeruginosa PA01
gcaccagcggaccgucgggcag

SEQ ID NO: 1511782 - RNA, 15 nt, Pseudomonas aeruginosa PA01
gcaccagcucccggc

SEQ ID NO: 1511783 - RNA, 22 nt, Pseudomonas aeruginosa PA01
gcaccaggaagccccagaagau

SEQ ID NO: 1511784 - RNA, 15 nt, Pseudomonas aeruginosa PA01
gcaccaggccgaugu

SEQ ID NO: 1511785 - RNA, 15 nt, Pseudomonas aeruginosa PA01
gcaccaggccgccau

SEQ ID NO: 1511786 - RNA, 22 nt, Pseudomonas aeruginosa PA01
gcaccaggccgccaugcucggc

SEQ ID NO: 1511787 - RNA, 13 nt, Pseudomonas aeruginosa PA01
gcaccaggccagg

SEQ ID NO: 1511788 - RNA, 14 nt, Pseudomonas aeruginosa PA01
gcaccagggccagg

SEQ ID NO: 1511789 - RNA, 15 nt, Pseudomonas aeruginosa PA01
gcaccagggccagga

SEQ ID NO: 1511790 - RNA, 18 nt, Pseudomonas aeruginosa PA01
gcaccagggccaggagca

SEQ ID NO: 1511791 - RNA, 12 nt, Pseudomonas aeruginosa PA01
gcaccaggcgau

SEQ ID NO: 1511792 - RNA, 20 nt, Pseudomonas aeruginosa PA01
gcaccaggcgaugcgccgga

SEQ ID NO: 1511793 - RNA, 14 nt, Pseudomonas aeruginosa PA01
gcaccaggcuggcc

SEQ ID NO: 1511794 - RNA, 12 nt, Pseudomonas aeruginosa PA01
gcaccgccgagg

SEQ ID NO: 1511795 - RNA, 20 nt, Pseudomonas aeruginosa PA01
gcaccgccggguacagcgcc

SEQ ID NO: 1511796 - RNA, 21 nt, Pseudomonas aeruginosa PA01
gcaccgccggguacagcgcca

SEQ ID NO: 1511797 - RNA, 19 nt, Pseudomonas aeruginosa PA01
gcaccggcggcgccaggcc

SEQ ID NO: 1511798 - RNA, 14 nt, Pseudomonas aeruginosa PA01
gcaccgccaccagc

SEQ ID NO: 1511799 - RNA, 14 nt, Pseudomonas aeruginosa PA01
gcaccgccagcccg

SEQ ID NO: 1511800 - RNA, 20 nt, Pseudomonas aeruginosa PA01
gcaccgagcugaucgcgcag

SEQ ID NO: 1511801 - RNA, 18 nt, Pseudomonas aeruginosa PA01
gcacccuggacccgggcc

SEQ ID NO: 1511802 - RNA, 15 nt, Pseudomonas aeruginosa PA01
gcaccgagcaggcac

SEQ ID NO: 1511803 - RNA, 16 nt, Pseudomonas aeruginosa PA01
gcaccgagcaggcacc

SEQ ID NO: 1511804 - RNA, 17 nt, Pseudomonas aeruginosa PA01
gcaccgagcaggcaccc

SEQ ID NO: 1511805 - RNA, 17 nt, Pseudomonas aeruginosa PA01
gcacggcucggcgagga

SEQ ID NO: 1511806 - RNA, 22 nt, Pseudomonas aeruginosa PA01
gcacggccgucacggccuccgg

SEQ ID NO: 1511807 - RNA, 14 nt, Pseudomonas aeruginosa PA01
gcacguagccgccc

SEQ ID NO: 1511808 - RNA, 22 nt, Pseudomonas aeruginosa PA01
gcacguagccgcccuuuuccgg

SEQ ID NO: 1511809 - RNA, 18 nt, Pseudomonas aeruginosa PA01
gcacgcuguagaccagcu

SEQ ID NO: 1511810 - RNA, 16 nt, Pseudomonas aeruginosa PA01
gcacgcuucuccucgg

SEQ ID NO: 1511811 - RNA, 19 nt, Pseudomonas aeruginosa PA01
gcacgcuucuccucggccg

SEQ ID NO: 1511812 - RNA, 12 nt, Pseudomonas aeruginosa PA01
gcacgcuggcga

SEQ ID NO: 1511813 - RNA, 16 nt, Pseudomonas aeruginosa PA01
gcacgcugcuugcgca

SEQ ID NO: 1511814 - RNA, 15 nt, Pseudomonas aeruginosa PA01
gcacgcugccgccga

SEQ ID NO: 1511815 - RNA, 18 nt, Pseudomonas aeruginosa PA01
gcacgcugccagcaggcc

SEQ ID NO: 1511816 - RNA, 19 nt, Pseudomonas aeruginosa PA01
gcacgcugaagaucgccac

SEQ ID NO: 1511817 - RNA, 17 nt, Pseudomonas aeruginosa PA01
gcacgcugacgccggca

SEQ ID NO: 1511818 - RNA, 14 nt, Pseudomonas aeruginosa PA01
gcacgccgcgaccg

SEQ ID NO: 1511819 - RNA, 15 nt, Pseudomonas aeruginosa PA01
gcacgccggccucgc

SEQ ID NO: 1511820 - RNA, 20 nt, Pseudomonas aeruginosa PA01
gcacgccggccucgcgcaac

SEQ ID NO: 1511821 - RNA, 16 nt, Pseudomonas aeruginosa PA01
gcacgcucuguuucgg

SEQ ID NO: 1511822 - RNA, 15 nt, Pseudomonas aeruginosa PA01
gcacgcucaggcgca

SEQ ID NO: 1511823 - RNA, 15 nt, Pseudomonas aeruginosa PA01
gcacggccaggccac

SEQ ID NO: 1511824 - RNA, 12 nt, Pseudomonas aeruginosa PA01
gcacggccggcg

SEQ ID NO: 1511825 - RNA, 17 nt, Pseudomonas aeruginosa PA01
gcacggaagggaaaaaa

SEQ ID NO: 1511826 - RNA, 16 nt, Pseudomonas aeruginosa PA01
gcacggaagcgcugcu

SEQ ID NO: 1511827 - RNA, 21 nt, Pseudomonas aeruginosa PA01
gcacggaucgcgcugggcgca

SEQ ID NO: 1511828 - RNA, 17 nt, Pseudomonas aeruginosa PA01
gcacggaggcgcucagg

SEQ ID NO: 1511829 - RNA, 14 nt, Pseudomonas aeruginosa PA01
gcacucagccagcg

SEQ ID NO: 1511830 - RNA, 15 nt, Pseudomonas aeruginosa PA01
gcacucauagcucag

SEQ ID NO: 1511831 - RNA, 17 nt, Pseudomonas aeruginosa PA01
gcacucauagcucagcu

SEQ ID NO: 1511832 - RNA, 18 nt, Pseudomonas aeruginosa PA01
gcacucauagcucagcug

SEQ ID NO: 1511833 - RNA, 21 nt, Pseudomonas aeruginosa PA01
gcacucauagcucagcuggau

SEQ ID NO: 1511834 - RNA, 21 nt, Pseudomonas aeruginosa PA01
gcacguugcugugcugcacca

SEQ ID NO: 1511835 - RNA, 16 nt, Pseudomonas aeruginosa PA01
gcacguugccauccag

SEQ ID NO: 1511836 - RNA, 19 nt, Pseudomonas aeruginosa PA01
gcacguuccagcucggugc

SEQ ID NO: 1511837 - RNA, 17 nt, Pseudomonas aeruginosa PA01
gcacgugcagcucggca

SEQ ID NO: 1511838 - RNA, 17 nt, Pseudomonas aeruginosa PA01
gcacucgaugaacagcg

SEQ ID NO: 1511839 - RNA, 22 nt, Pseudomonas aeruginosa PA01
gcacucggcgaccacccggcgg

SEQ ID NO: 1511840 - RNA, 23 nt, Pseudomonas aeruginosa PA01
gcacuccgggcagaccagcagcg

SEQ ID NO: 1511841 - RNA, 14 nt, Pseudomonas aeruginosa PA01
gcacugccaggagc

SEQ ID NO: 1511842 - RNA, 13 nt, Pseudomonas aeruginosa PA01
gcacugcggcggu

SEQ ID NO: 1511843 - RNA, 15 nt, Pseudomonas aeruginosa PA01
gcccgccaggucgag

SEQ ID NO: 1511844 - RNA, 18 nt, Pseudomonas aeruginosa PA01
gcccgaugaucgagcgca

SEQ ID NO: 1511845 - RNA, 21 nt, Pseudomonas aeruginosa PA01
gcccgccccgcaccagccagc

SEQ ID NO: 1511846 - RNA, 12 nt, Pseudomonas aeruginosa PA01
gcccgcccggca

SEQ ID NO: 1511847 - RNA, 21 nt, Pseudomonas aeruginosa PA01
gcccgcccaguugcgggccuc

SEQ ID NO: 1511848 - RNA, 12 nt, Pseudomonas aeruginosa PA01
gcccgccggcga

SEQ ID NO: 1511849 - RNA, 22 nt, Pseudomonas aeruginosa PA01
gcccgccggcgaugcgcaggcc

SEQ ID NO: 1511850 - RNA, 17 nt, Pseudomonas aeruginosa PA01
gcccgccggcgcccugg

SEQ ID NO: 1511851 - RNA, 16 nt, Pseudomonas aeruginosa PA01
gcccgccggcgcgccc

SEQ ID NO: 1511852 - RNA, 21 nt, Pseudomonas aeruginosa PA01
gcccgccggucaaccgcgggc

SEQ ID NO: 1511853 - RNA, 22 nt, Pseudomonas aeruginosa PA01
gcccgccggucaaccgcgggcg

SEQ ID NO: 1511854 - RNA, 15 nt, Pseudomonas aeruginosa PA01
gcccgccguccucca

SEQ ID NO: 1511855 - RNA, 16 nt, Pseudomonas aeruginosa PA01
gcccgccguccuccag

SEQ ID NO: 1511856 - RNA, 19 nt, Pseudomonas aeruginosa PA01
gcccgccuggaaggcgcug

SEQ ID NO: 1511857 - RNA, 19 nt, Pseudomonas aeruginosa PA01
gcccgccuugauggcgggc

SEQ ID NO: 1511858 - RNA, 13 nt, Pseudomonas aeruginosa PA01
gcccgcgggcagc

SEQ ID NO: 1511859 - RNA, 19 nt, Pseudomonas aeruginosa PA01
gcccgcggcgagcagcggc

SEQ ID NO: 1511860 - RNA, 15 nt, Pseudomonas aeruginosa PA01
gcccgcgggcgccuu

SEQ ID NO: 1511861 - RNA, 13 nt, Pseudomonas aeruginosa PA01
gcccgcgcucggc

SEQ ID NO: 1511862 - RNA, 15 nt, Pseudomonas aeruginosa PA01
gcccgcggcagcagc

SEQ ID NO: 1511863 - RNA, 16 nt, Pseudomonas aeruginosa PA01
gcccgcggaccgggcg

SEQ ID NO: 1511864 - RNA, 21 nt, Pseudomonas aeruginosa PA01
gcccgcggaucgcgccgucgc

SEQ ID NO: 1511865 - RNA, 16 nt, Pseudomonas aeruginosa PA01
gcccggaaccaccggu

SEQ ID NO: 1511866 - RNA, 19 nt, Pseudomonas aeruginosa PA01
gcccgcgguauucuccagc

SEQ ID NO: 1511867 - RNA, 23 nt, Pseudomonas aeruginosa PA01
gcccgcgguauucuccagcaggc

SEQ ID NO: 1511868 - RNA, 15 nt, Pseudomonas aeruginosa PA01
gcccggagaccgugc

SEQ ID NO: 1511869 - RNA, 18 nt, Pseudomonas aeruginosa PA01
gcccggagaucgccgcgc

SEQ ID NO: 1511870 - RNA, 20 nt, Pseudomonas aeruginosa PA01
gcccggagaucgccgcgccg

SEQ ID NO: 1511871 - RNA, 16 nt, Pseudomonas aeruginosa PA01
gcccggagcggcugcc

SEQ ID NO: 1511872 - RNA, 18 nt, Pseudomonas aeruginosa PA01
gcccggcacucgccgggc

SEQ ID NO: 1511873 - RNA, 16 nt, Pseudomonas aeruginosa PA01
gcccggcaccaccggu

SEQ ID NO: 1511874 - RNA, 18 nt, Pseudomonas aeruginosa PA01
gcccggcaauagccgggc

SEQ ID NO: 1511875 - RNA, 21 nt, Pseudomonas aeruginosa PA01
gcccggagugugucggggccg

SEQ ID NO: 1511876 - RNA, 22 nt, Pseudomonas aeruginosa PA01
gcccggauagacgccguccacc

SEQ ID NO: 1511877 - RNA, 19 nt, Pseudomonas aeruginosa PA01
gccccguggcgggccagca

SEQ ID NO: 1511878 - RNA, 22 nt, Pseudomonas aeruginosa PA01
gccccguggcgggccagcaggc

SEQ ID NO: 1511879 - RNA, 23 nt, Pseudomonas aeruginosa PA01
gccccguggcgggccagcaggcg

SEQ ID NO: 1511880 - RNA, 19 nt, Pseudomonas aeruginosa PA01
gccccgguuacucgccggc

SEQ ID NO: 1511881 - RNA, 19 nt, Pseudomonas aeruginosa PA01
gccccuccuucgagccugg

SEQ ID NO: 1511882 - RNA, 21 nt, Pseudomonas aeruginosa PA01
gccccuccuucgagccuggcc

SEQ ID NO: 1511883 - RNA, 20 nt, Pseudomonas aeruginosa PA01
gccccucacaccaccagcau

SEQ ID NO: 1511884 - RNA, 21 nt, Pseudomonas aeruginosa PA01
gccccucacaccaccagcauc

SEQ ID NO: 1511885 - RNA, 15 nt, Pseudomonas aeruginosa PA01
gccccucacuccguc

SEQ ID NO: 1511886 - RNA, 16 nt, Pseudomonas aeruginosa PA01
gccccggucucgcgca

SEQ ID NO: 1511887 - RNA, 21 nt, Pseudomonas aeruginosa PA01
gccccggucucgcgcagcggc

SEQ ID NO: 1511888 - RNA, 16 nt, Pseudomonas aeruginosa PA01
gcccaggcagcagagc

SEQ ID NO: 1511889 - RNA, 17 nt, Pseudomonas aeruginosa PA01
gcccagcucguccaggc

SEQ ID NO: 1511890 - RNA, 18 nt, Pseudomonas aeruginosa PA01
gcccagcucguccaggca

SEQ ID NO: 1511891 - RNA, 22 nt, Pseudomonas aeruginosa PA01
gcccaggacaacgacagccccg

SEQ ID NO: 1511892 - RNA, 23 nt, Pseudomonas aeruginosa PA01
gcccaggacaacgacagccccgg

SEQ ID NO: 1511893 - RNA, 18 nt, Pseudomonas aeruginosa PA01
gcccagcuugauguagga

SEQ ID NO: 1511894 - RNA, 19 nt, Pseudomonas aeruginosa PA01
gcccgagugccggcgcguc

SEQ ID NO: 1511895 - RNA, 18 nt, Pseudomonas aeruginosa PA01
gcccgagcuuugcgcagc

SEQ ID NO: 1511896 - RNA, 14 nt, Pseudomonas aeruginosa PA01
gcccgagggcggca

SEQ ID NO: 1511897 - RNA, 19 nt, Pseudomonas aeruginosa PA01
gcccgagggucgccuugac

SEQ ID NO: 1511898 - RNA, 14 nt, Pseudomonas aeruginosa PA01
gccccuuggccagc

SEQ ID NO: 1511899 - RNA, 18 nt, Pseudomonas aeruginosa PA01
gccccuuggccagcacca

SEQ ID NO: 1511900 - RNA, 23 nt, Pseudomonas aeruginosa PA01
gccccuugcgcuguuccgccgug

SEQ ID NO: 1511901 - RNA, 21 nt, Pseudomonas aeruginosa PA01
gcccgguugagauccuggccg

SEQ ID NO: 1511902 - RNA, 15 nt, Pseudomonas aeruginosa PA01
gcccgguguucaccg

SEQ ID NO: 1511903 - RNA, 14 nt, Pseudomonas aeruginosa PA01
gcccgucuagcgca

SEQ ID NO: 1511904 - RNA, 19 nt, Pseudomonas aeruginosa PA01
gcccgucuagcgcaggcgg

SEQ ID NO: 1511905 - RNA, 13 nt, Pseudomonas aeruginosa PA01
gcccgucgcgccg

SEQ ID NO: 1511906 - RNA, 20 nt, Pseudomonas aeruginosa PA01
gcccgucgcgcgccggagcc

SEQ ID NO: 1511907 - RNA, 18 nt, Pseudomonas aeruginosa PA01
gcccggucuagccgggcc

SEQ ID NO: 1511908 - RNA, 19 nt, Pseudomonas aeruginosa PA01
gcccggucuagccgggccu

SEQ ID NO: 1511909 - RNA, 22 nt, Pseudomonas aeruginosa PA01
gcccggucuagcgccccggccg

SEQ ID NO: 1511910 - RNA, 23 nt, Pseudomonas aeruginosa PA01
gcccgguccguccagcgcgcccg

SEQ ID NO: 1511911 - RNA, 17 nt, Pseudomonas aeruginosa PA01
gcccggucaccacccag

SEQ ID NO: 1511912 - RNA, 21 nt, Pseudomonas aeruginosa PA01
gcccggucaccacccagccgc

SEQ ID NO: 1511913 - RNA, 14 nt, Pseudomonas aeruginosa PA01
gcccggucagcuuc

SEQ ID NO: 1511914 - RNA, 15 nt, Pseudomonas aeruginosa PA01
gcccggcgcggcggc

SEQ ID NO: 1511915 - RNA, 23 nt, Pseudomonas aeruginosa PA01
gcccggcgcgguuucgcagcgcu

SEQ ID NO: 1511916 - RNA, 18 nt, Pseudomonas aeruginosa PA01
gcccggcuccagccgggc

SEQ ID NO: 1511917 - RNA, 21 nt, Pseudomonas aeruginosa PA01
gcccggcucgaccuugcuggu

SEQ ID NO: 1511918 - RNA, 13 nt, Pseudomonas aeruginosa PA01
gcccggcucgccc

SEQ ID NO: 1511919 - RNA, 14 nt, Pseudomonas aeruginosa PA01
gcccggcuggcgua

SEQ ID NO: 1511920 - RNA, 21 nt, Pseudomonas aeruginosa PA01
gcccggcugguugccagcagc

SEQ ID NO: 1511921 - RNA, 16 nt, Pseudomonas aeruginosa PA01
gcccggcugcacaggu

SEQ ID NO: 1511922 - RNA, 15 nt, Pseudomonas aeruginosa PA01
gcccggcucgccgcc

SEQ ID NO: 1511923 - RNA, 17 nt, Pseudomonas aeruginosa PA01
gcccggcuucggcggcg

SEQ ID NO: 1511924 - RNA, 20 nt, Pseudomonas aeruginosa PA01
gcccggcuucggcggcgcgc

SEQ ID NO: 1511925 - RNA, 17 nt, Pseudomonas aeruginosa PA01
gcccggcuugaggaagu

SEQ ID NO: 1511926 - RNA, 18 nt, Pseudomonas aeruginosa PA01
gcccggcuuuccucggcc

SEQ ID NO: 1511927 - RNA, 15 nt, Pseudomonas aeruginosa PA01
gcccggcgagagcgu

SEQ ID NO: 1511928 - RNA, 18 nt, Pseudomonas aeruginosa PA01
gcccggcauucgccgggc

SEQ ID NO: 1511929 - RNA, 15 nt, Pseudomonas aeruginosa PA01
gcccggcgaacagcg

SEQ ID NO: 1511930 - RNA, 20 nt, Pseudomonas aeruginosa PA01
gcccggcgaacagcgcuucc

SEQ ID NO: 1511931 - RNA, 15 nt, Pseudomonas aeruginosa PA01
gcccggcgccaggcu

SEQ ID NO: 1511932 - RNA, 13 nt, Pseudomonas aeruginosa PA01
gcccggcgccagu

SEQ ID NO: 1511933 - RNA, 14 nt, Pseudomonas aeruginosa PA01
gcccggcaggcgca

SEQ ID NO: 1511934 - RNA, 15 nt, Pseudomonas aeruginosa PA01
gcccggcaggcgcac

SEQ ID NO: 1511935 - RNA, 17 nt, Pseudomonas aeruginosa PA01
gcccggcaggcgcacgc

SEQ ID NO: 1511936 - RNA, 14 nt, Pseudomonas aeruginosa PA01
gcccggcagcuccc

SEQ ID NO: 1511937 - RNA, 14 nt, Pseudomonas aeruginosa PA01
gcccggcagcaggc

SEQ ID NO: 1511938 - RNA, 17 nt, Pseudomonas aeruginosa PA01
gcccggcagcaggccgc

SEQ ID NO: 1511939 - RNA, 20 nt, Pseudomonas aeruginosa PA01
gcccggcagcaggccgccgc

SEQ ID NO: 1511940 - RNA, 17 nt, Pseudomonas aeruginosa PA01
gcccggcagcgccgggc

SEQ ID NO: 1511941 - RNA, 15 nt, Pseudomonas aeruginosa PA01
gcccggcagcggcug

SEQ ID NO: 1511942 - RNA, 20 nt, Pseudomonas aeruginosa PA01
gcccggcauaggcgccagcc

SEQ ID NO: 1511943 - RNA, 17 nt, Pseudomonas aeruginosa PA01
gcccucgaagcccugca

SEQ ID NO: 1511944 - RNA, 18 nt, Pseudomonas aeruginosa PA01
gcccucagagcaugucga

SEQ ID NO: 1511945 - RNA, 13 nt, Pseudomonas aeruginosa PA01
gcccucagcagcg

SEQ ID NO: 1511946 - RNA, 14 nt, Pseudomonas aeruginosa PA01
gcccucgaccuggc

SEQ ID NO: 1511947 - RNA, 15 nt, Pseudomonas aeruginosa PA01
gcccucgcagccggc

SEQ ID NO: 1511948 - RNA, 21 nt, Pseudomonas aeruginosa PA01
gcccucggugauaccgccggc

SEQ ID NO: 1511949 - RNA, 17 nt, Pseudomonas aeruginosa PA01
gcccugacgaugcaggg

SEQ ID NO: 1511950 - RNA, 20 nt, Pseudomonas aeruginosa PA01
gcccucggcgcccgccugca

SEQ ID NO: 1511951 - RNA, 15 nt, Pseudomonas aeruginosa PA01
gcccucggcgcuggc

SEQ ID NO: 1511952 - RNA, 14 nt, Pseudomonas aeruginosa PA01
gcccucggccaggc

SEQ ID NO: 1511953 - RNA, 17 nt, Pseudomonas aeruginosa PA01
gcccucggcccggagcc

SEQ ID NO: 1511954 - RNA, 20 nt, Pseudomonas aeruginosa PA01
gcccucgcuccaacgcaggc

SEQ ID NO: 1511955 - RNA, 13 nt, Pseudomonas aeruginosa PA01
gcccucgcggacg

SEQ ID NO: 1511956 - RNA, 18 nt, Pseudomonas aeruginosa PA01
gcccucgcggaucugcuc

SEQ ID NO: 1511957 - RNA, 21 nt, Pseudomonas aeruginosa PA01
gcccucgcggcggcaggccag

SEQ ID NO: 1511958 - RNA, 14 nt, Pseudomonas aeruginosa PA01
gcccgugccgacua

SEQ ID NO: 1511959 - RNA, 22 nt, Pseudomonas aeruginosa PA01
gcccgugccucggcggacagcc

SEQ ID NO: 1511960 - RNA, 18 nt, Pseudomonas aeruginosa PA01
gcccgugguagucgagcc

SEQ ID NO: 1511961 - RNA, 19 nt, Pseudomonas aeruginosa PA01
gcccuacaaugauggcccu

SEQ ID NO: 1511962 - RNA, 20 nt, Pseudomonas aeruginosa PA01
gcccuacaaugauggcccuu

SEQ ID NO: 1511963 - RNA, 14 nt, Pseudomonas aeruginosa PA01
gcccuaccccaggg

SEQ ID NO: 1511964 - RNA, 17 nt, Pseudomonas aeruginosa PA01
gcccuaccccagggguc

SEQ ID NO: 1511965 - RNA, 16 nt, Pseudomonas aeruginosa PA01
gcccuaccccccaauu

SEQ ID NO: 1511966 - RNA, 19 nt, Pseudomonas aeruginosa PA01
gcccuaggcgacccggcau

SEQ ID NO: 1511967 - RNA, 21 nt, Pseudomonas aeruginosa PA01
gcccuacgcaacccgcccggc

SEQ ID NO: 1511968 - RNA, 22 nt, Pseudomonas aeruginosa PA01
gcccuacgcaacccgcccggcu

SEQ ID NO: 1511969 - RNA, 14 nt, Pseudomonas aeruginosa PA01
gcccuaccuguccc

SEQ ID NO: 1511970 - RNA, 21 nt, Pseudomonas aeruginosa PA01
gcccuacggggcgugucgagg

SEQ ID NO: 1511971 - RNA, 16 nt, Pseudomonas aeruginosa PA01
gcccugcagcgccaug

SEQ ID NO: 1511972 - RNA, 14 nt, Pseudomonas aeruginosa PA01
gcccugcaucgcga

SEQ ID NO: 1511973 - RNA, 14 nt, Pseudomonas aeruginosa PA01
gcccugccagcggg

SEQ ID NO: 1511974 - RNA, 21 nt, Pseudomonas aeruginosa PA01
gcccugcuggcgcagccaggc

SEQ ID NO: 1511975 - RNA, 15 nt, Pseudomonas aeruginosa PA01
gcccugcaacaggac

SEQ ID NO: 1511976 - RNA, 23 nt, Pseudomonas aeruginosa PA01
gcccugcaacaggacccagccau

SEQ ID NO: 1511977 - RNA, 19 nt, Pseudomonas aeruginosa PA01
gcccugaggcuuuccugcg

SEQ ID NO: 1511978 - RNA, 13 nt, Pseudomonas aeruginosa PA01
gcccuggccgccc

SEQ ID NO: 1511979 - RNA, 18 nt, Pseudomonas aeruginosa PA01
gcccugcuuggccagcgc

SEQ ID NO: 1511980 - RNA, 19 nt, Pseudomonas aeruginosa PA01
gcccugcuuggccagcgcg

SEQ ID NO: 1511981 - RNA, 18 nt, Pseudomonas aeruginosa PA01
gcccuggauaucugggcc

SEQ ID NO: 1511982 - RNA, 19 nt, Pseudomonas aeruginosa PA01
gcccuggauaucugggcca

SEQ ID NO: 1511983 - RNA, 20 nt, Pseudomonas aeruginosa PA01
gcccuggaucaccgcggcgc

SEQ ID NO: 1511984 - RNA, 22 nt, Pseudomonas aeruginosa PA01
gcccuggaucaccgcggcgcug

SEQ ID NO: 1511985 - RNA, 14 nt, Pseudomonas aeruginosa PA01
gcccuggccggcac

SEQ ID NO: 1511986 - RNA, 14 nt, Pseudomonas aeruginosa PA01
gcccuggcgcaggc

SEQ ID NO: 1511987 - RNA, 15 nt, Pseudomonas aeruginosa PA01
gcccuggugcacggc

SEQ ID NO: 1511988 - RNA, 16 nt, Pseudomonas aeruginosa PA01
gcccugguggugauca

SEQ ID NO: 1511989 - RNA, 14 nt, Pseudomonas aeruginosa PA01
gcccuggcgcagac

SEQ ID NO: 1511990 - RNA, 20 nt, Pseudomonas aeruginosa PA01
gcccuggcgcagacaggccu

SEQ ID NO: 1511991 - RNA, 19 nt, Pseudomonas aeruginosa PA01
gcccuguucgucuggcgcc

SEQ ID NO: 1511992 - RNA, 12 nt, Pseudomonas aeruginosa PA01
gccgacagcggc

SEQ ID NO: 1511993 - RNA, 13 nt, Pseudomonas aeruginosa PA01
gccgacagcggcu

SEQ ID NO: 1511994 - RNA, 14 nt, Pseudomonas aeruginosa PA01
gccgacacccgcgc

SEQ ID NO: 1511995 - RNA, 21 nt, Pseudomonas aeruginosa PA01
gccgacagcacgauggcgagg

SEQ ID NO: 1511996 - RNA, 23 nt, Pseudomonas aeruginosa PA01
gccgacaucggagugcaugccgg

SEQ ID NO: 1511997 - RNA, 16 nt, Pseudomonas aeruginosa PA01
gccgacccgugcgccg

SEQ ID NO: 1511998 - RNA, 18 nt, Pseudomonas aeruginosa PA01
gccgacccgcuugagcca

SEQ ID NO: 1511999 - RNA, 13 nt, Pseudomonas aeruginosa PA01
gccgaccgccagg

SEQ ID NO: 1512000 - RNA, 14 nt, Pseudomonas aeruginosa PA01
gccgaccggcgccg

SEQ ID NO: 1512001 - RNA, 13 nt, Pseudomonas aeruginosa PA01
gccgaccgcgcgc

SEQ ID NO: 1512002 - RNA, 18 nt, Pseudomonas aeruginosa PA01
gccgaccgcgcgccugca

SEQ ID NO: 1512003 - RNA, 14 nt, Pseudomonas aeruginosa PA01
gccgacccagagcg

SEQ ID NO: 1512004 - RNA, 15 nt, Pseudomonas aeruginosa PA01
gccgacccagagcgc

SEQ ID NO: 1512005 - RNA, 19 nt, Pseudomonas aeruginosa PA01
gccgacccgcagcggcgcu

SEQ ID NO: 1512006 - RNA, 19 nt, Pseudomonas aeruginosa PA01
gccgaccagguccgccacu

SEQ ID NO: 1512007 - RNA, 14 nt, Pseudomonas aeruginosa PA01
gccgaccagcaggg

SEQ ID NO: 1512008 - RNA, 16 nt, Pseudomonas aeruginosa PA01
gccgaccagccgcagg

SEQ ID NO: 1512009 - RNA, 19 nt, Pseudomonas aeruginosa PA01
gccgaauccuccagccggc

SEQ ID NO: 1512010 - RNA, 14 nt, Pseudomonas aeruginosa PA01
gccgaauccaggcc

SEQ ID NO: 1512011 - RNA, 14 nt, Pseudomonas aeruginosa PA01
gccgaauccgccgg

SEQ ID NO: 1512012 - RNA, 15 nt, Pseudomonas aeruginosa PA01
gccgaauccgccggc

SEQ ID NO: 1512013 - RNA, 17 nt, Pseudomonas aeruginosa PA01
gccgacaagccuccagc

SEQ ID NO: 1512014 - RNA, 16 nt, Pseudomonas aeruginosa PA01
gccgaaguagccggcg

SEQ ID NO: 1512015 - RNA, 18 nt, Pseudomonas aeruginosa PA01
gccgaaggugcaggccgc

SEQ ID NO: 1512016 - RNA, 20 nt, Pseudomonas aeruginosa PA01
gccgaaggugcaggccgcgc

SEQ ID NO: 1512017 - RNA, 13 nt, Pseudomonas aeruginosa PA01
gccgaaggccagg

SEQ ID NO: 1512018 - RNA, 21 nt, Pseudomonas aeruginosa PA01
gccgaaggccaggccggcgcc

SEQ ID NO: 1512019 - RNA, 19 nt, Pseudomonas aeruginosa PA01
gccgaaggcgugggcgccg

SEQ ID NO: 1512020 - RNA, 21 nt, Pseudomonas aeruginosa PA01
gccgaaggcgugggcgccggc

SEQ ID NO: 1512021 - RNA, 20 nt, Pseudomonas aeruginosa PA01
gccgaagucggcgagccggc

SEQ ID NO: 1512022 - RNA, 15 nt, Pseudomonas aeruginosa PA01
gccgaacugcagggc

SEQ ID NO: 1512023 - RNA, 19 nt, Pseudomonas aeruginosa PA01
gccgaacugcagggcgucg

SEQ ID NO: 1512024 - RNA, 19 nt, Pseudomonas aeruginosa PA01
gccgaacuccgagcaggac

SEQ ID NO: 1512025 - RNA, 24 nt, Pseudomonas aeruginosa PA01
gccgaacuccggugucaggccgag

SEQ ID NO: 1512026 - RNA, 14 nt, Pseudomonas aeruginosa PA01
gccgaagagcuuuu

SEQ ID NO: 1512027 - RNA, 23 nt, Pseudomonas aeruginosa PA01
gccgaagaucgacaggccgccgu

SEQ ID NO: 1512028 - RNA, 16 nt, Pseudomonas aeruginosa PA01
gccgaagaagcuucgc

SEQ ID NO: 1512029 - RNA, 20 nt, Pseudomonas aeruginosa PA01
gccgaagaagcuucgcuggg

SEQ ID NO: 1512030 - RNA, 23 nt, Pseudomonas aeruginosa PA01
gccgaagcgcucggucagcuccc

SEQ ID NO: 1512031 - RNA, 20 nt, Pseudomonas aeruginosa PA01
gccgaagccgacgccgagca

SEQ ID NO: 1512032 - RNA, 22 nt, Pseudomonas aeruginosa PA01
gcccuugugaaagggcggcagc

SEQ ID NO: 1512033 - RNA, 16 nt, Pseudomonas aeruginosa PA01
gcccuugcugcccagu

SEQ ID NO: 1512034 - RNA, 14 nt, Pseudomonas aeruginosa PA01
gcccuuggccagcg

SEQ ID NO: 1512035 - RNA, 16 nt, Pseudomonas aeruginosa PA01
gcccuuggcuuccugg

SEQ ID NO: 1512036 - RNA, 18 nt, Pseudomonas aeruginosa PA01
gcccuuggcuuccuggcg

SEQ ID NO: 1512037 - RNA, 20 nt, Pseudomonas aeruginosa PA01
gcccuugccauccuccagca

SEQ ID NO: 1512038 - RNA, 13 nt, Pseudomonas aeruginosa PA01
gcccuugcccgga

SEQ ID NO: 1512039 - RNA, 23 nt, Pseudomonas aeruginosa PA01
gcccuugauggugugcagcagca

SEQ ID NO: 1512040 - RNA, 17 nt, Pseudomonas aeruginosa PA01
gcccuugagcauggcgu

SEQ ID NO: 1512041 - RNA, 23 nt, Pseudomonas aeruginosa PA01
gcccuugaggaaguugcgcagca

SEQ ID NO: 1512042 - RNA, 15 nt, Pseudomonas aeruginosa PA01
gcccuugcgccgcgg

SEQ ID NO: 1512043 - RNA, 15 nt, Pseudomonas aeruginosa PA01
gcccuugccgggaag

SEQ ID NO: 1512044 - RNA, 23 nt, Pseudomonas aeruginosa PA01
gcccuucacgagaccaccgacgg

SEQ ID NO: 1512045 - RNA, 15 nt, Pseudomonas aeruginosa PA01
gcccuucuccgccag

SEQ ID NO: 1512046 - RNA, 21 nt, Pseudomonas aeruginosa PA01
gcccuucgguuucgcgccaug

SEQ ID NO: 1512047 - RNA, 16 nt, Pseudomonas aeruginosa PA01
gcccuucugucuuguc

SEQ ID NO: 1512048 - RNA, 22 nt, Pseudomonas aeruginosa PA01
gcccuugacgucguucagcggc

SEQ ID NO: 1512049 - RNA, 18 nt, Pseudomonas aeruginosa PA01
gcccuucgacgacaccug

SEQ ID NO: 1512050 - RNA, 20 nt, Pseudomonas aeruginosa PA01
gcccuucgacgacaccugca

SEQ ID NO: 1512051 - RNA, 15 nt, Pseudomonas aeruginosa PA01
gcccuucgcccugcg

SEQ ID NO: 1512052 - RNA, 17 nt, Pseudomonas aeruginosa PA01
gcccuucgcccugcgug

SEQ ID NO: 1512053 - RNA, 22 nt, Pseudomonas aeruginosa PA01
gcccuugucgccgcugggcagc

SEQ ID NO: 1512054 - RNA, 19 nt, Pseudomonas aeruginosa PA01
gcccuuucgaacugcaugu

SEQ ID NO: 1512055 - RNA, 21 nt, Pseudomonas aeruginosa PA01
gccgaaaagaagccccgcagc

SEQ ID NO: 1512056 - RNA, 16 nt, Pseudomonas aeruginosa PA01
gcccuuuuccaccggc

SEQ ID NO: 1512057 - RNA, 22 nt, Pseudomonas aeruginosa PA01
gcccuuuuucgucgccagcccg

SEQ ID NO: 1512058 - RNA, 15 nt, Pseudomonas aeruginosa PA01
gccgaaauagcgcgc

SEQ ID NO: 1512059 - RNA, 22 nt, Pseudomonas aeruginosa PA01
gccgaaaucgaugucgcggcgc

SEQ ID NO: 1512060 - RNA, 23 nt, Pseudomonas aeruginosa PA01
gccgaaaucgaugucgcggcgcu

SEQ ID NO: 1512061 - RNA, 17 nt, Pseudomonas aeruginosa PA01
gccgaaaugcugcaggc

SEQ ID NO: 1512062 - RNA, 21 nt, Pseudomonas aeruginosa PA01
gccgaaauugaccagguacgg

SEQ ID NO: 1512063 - RNA, 17 nt, Pseudomonas aeruginosa PA01
gccgaacaggguugggc

SEQ ID NO: 1512064 - RNA, 22 nt, Pseudomonas aeruginosa PA01
gccgaacaggcgucccauggcg

SEQ ID NO: 1512065 - RNA, 20 nt, Pseudomonas aeruginosa PA01
gccgaacagcagggaggcgc

SEQ ID NO: 1512066 - RNA, 17 nt, Pseudomonas aeruginosa PA01
gccgaacacgcacaaug

SEQ ID NO: 1512067 - RNA, 12 nt, Pseudomonas aeruginosa PA01
gccgaacagcag

SEQ ID NO: 1512068 - RNA, 16 nt, Pseudomonas aeruginosa PA01
gccgauugcaugaccu

SEQ ID NO: 1512069 - RNA, 18 nt, Pseudomonas aeruginosa PA01
gccgauugcaugaccuuc

SEQ ID NO: 1512070 - RNA, 14 nt, Pseudomonas aeruginosa PA01
gccgauuccugggc

SEQ ID NO: 1512071 - RNA, 15 nt, Pseudomonas aeruginosa PA01
gccgcaaacccccug

SEQ ID NO: 1512072 - RNA, 18 nt, Pseudomonas aeruginosa PA01
gccgcaaacccccugcgc

SEQ ID NO: 1512073 - RNA, 15 nt, Pseudomonas aeruginosa PA01
gccgcaaccagcccu

SEQ ID NO: 1512074 - RNA, 16 nt, Pseudomonas aeruginosa PA01
gccgcaaccagcccug

SEQ ID NO: 1512075 - RNA, 17 nt, Pseudomonas aeruginosa PA01
gccgcaaccagcccugg

SEQ ID NO: 1512076 - RNA, 21 nt, Pseudomonas aeruginosa PA01
gccgaucaguggucgcagcuc

SEQ ID NO: 1512077 - RNA, 23 nt, Pseudomonas aeruginosa PA01
gccgaucaguggucgcagcucca

SEQ ID NO: 1512078 - RNA, 14 nt, Pseudomonas aeruginosa PA01
gccgaucagcgcgc

SEQ ID NO: 1512079 - RNA, 17 nt, Pseudomonas aeruginosa PA01
gccgaucagcgcgccuu

SEQ ID NO: 1512080 - RNA, 13 nt, Pseudomonas aeruginosa PA01
gccgauccaggcg

SEQ ID NO: 1512081 - RNA, 17 nt, Pseudomonas aeruginosa PA01
gccgauccaggcguggg

SEQ ID NO: 1512082 - RNA, 16 nt, Pseudomonas aeruginosa PA01
gccgaucccggcggcg

SEQ ID NO: 1512083 - RNA, 17 nt, Pseudomonas aeruginosa PA01
gccgaucccggcggcga

SEQ ID NO: 1512084 - RNA, 22 nt, Pseudomonas aeruginosa PA01
gccgaucccgacgcccuccagc

SEQ ID NO: 1512085 - RNA, 19 nt, Pseudomonas aeruginosa PA01
gccgaucgaagaaggcuca

SEQ ID NO: 1512086 - RNA, 14 nt, Pseudomonas aeruginosa PA01
gccgaucgccgcgc

SEQ ID NO: 1512087 - RNA, 21 nt, Pseudomonas aeruginosa PA01
gccgaucgagcggcccgcggu

SEQ ID NO: 1512088 - RNA, 14 nt, Pseudomonas aeruginosa PA01
gccgauccgcgaau

SEQ ID NO: 1512089 - RNA, 18 nt, Pseudomonas aeruginosa PA01
gccgaggaggccagcagc

SEQ ID NO: 1512090 - RNA, 19 nt, Pseudomonas aeruginosa PA01
gccgaggaggccagcagca

SEQ ID NO: 1512091 - RNA, 21 nt, Pseudomonas aeruginosa PA01
gccgaggauacgcucaggaag

SEQ ID NO: 1512092 - RNA, 20 nt, Pseudomonas aeruginosa PA01
gccgaggauagcguccagcu

SEQ ID NO: 1512093 - RNA, 17 nt, Pseudomonas aeruginosa PA01
gccgaggaugcucgccu

SEQ ID NO: 1512094 - RNA, 13 nt, Pseudomonas aeruginosa PA01
gccgaggcgcgcc

SEQ ID NO: 1512095 - RNA, 17 nt, Pseudomonas aeruginosa PA01
gccgaggcgcgccacgc

SEQ ID NO: 1512096 - RNA, 16 nt, Pseudomonas aeruginosa PA01
gccgaggccgccgcgg

SEQ ID NO: 1512097 - RNA, 21 nt, Pseudomonas aeruginosa PA01
gccgaggaagucggcggccgc

SEQ ID NO: 1512098 - RNA, 22 nt, Pseudomonas aeruginosa PA01
gccgaggaagucggcggccgcc

SEQ ID NO: 1512099 - RNA, 16 nt, Pseudomonas aeruginosa PA01
gccgagcuugaccuug

SEQ ID NO: 1512100 - RNA, 22 nt, Pseudomonas aeruginosa PA01
gccgagcuugaccuugccgccg

SEQ ID NO: 1512101 - RNA, 18 nt, Pseudomonas aeruginosa PA01
gccgagcugccgggcgag

SEQ ID NO: 1512102 - RNA, 23 nt, Pseudomonas aeruginosa PA01
gccgagcgggaagcguuccugga

SEQ ID NO: 1512103 - RNA, 15 nt, Pseudomonas aeruginosa PA01
gccgaggucgccgcc

SEQ ID NO: 1512104 - RNA, 14 nt, Pseudomonas aeruginosa PA01
gccgaggcggaaga

SEQ ID NO: 1512105 - RNA, 24 nt, Pseudomonas aeruginosa PA01
gccgaggcguaccggcuacaggcc

SEQ ID NO: 1512106 - RNA, 14 nt, Pseudomonas aeruginosa PA01
gccgagggcugccg

SEQ ID NO: 1512107 - RNA, 14 nt, Pseudomonas aeruginosa PA01
gccgaggggcggga

SEQ ID NO: 1512108 - RNA, 21 nt, Pseudomonas aeruginosa PA01
gccgaggcuuuccagcaggcg

SEQ ID NO: 1512109 - RNA, 23 nt, Pseudomonas aeruginosa PA01
gccgaggcuuuccagcaggcgcu

SEQ ID NO: 1512110 - RNA, 16 nt, Pseudomonas aeruginosa PA01
gccgagggcgaagacu

SEQ ID NO: 1512111 - RNA, 13 nt, Pseudomonas aeruginosa PA01
gccgagggcgcca

SEQ ID NO: 1512112 - RNA, 14 nt, Pseudomonas aeruginosa PA01
gccgagggcgccag

SEQ ID NO: 1512113 - RNA, 16 nt, Pseudomonas aeruginosa PA01
gccgagggcgccaggu

SEQ ID NO: 1512114 - RNA, 14 nt, Pseudomonas aeruginosa PA01
gccgagggcgcgca

SEQ ID NO: 1512115 - RNA, 16 nt, Pseudomonas aeruginosa PA01
gccgagggcgcggcgc

SEQ ID NO: 1512116 - RNA, 20 nt, Pseudomonas aeruginosa PA01
gccgagggcgcggcgccagc

SEQ ID NO: 1512117 - RNA, 14 nt, Pseudomonas aeruginosa PA01
gccgagguguagaa

SEQ ID NO: 1512118 - RNA, 16 nt, Pseudomonas aeruginosa PA01
gccgaggucuuggcca

SEQ ID NO: 1512119 - RNA, 21 nt, Pseudomonas aeruginosa PA01
gccgaggucuuggccagccgc

SEQ ID NO: 1512120 - RNA, 19 nt, Pseudomonas aeruginosa PA01
gccgaggucgcgggccagg

SEQ ID NO: 1512121 - RNA, 16 nt, Pseudomonas aeruginosa PA01
gccgaggucggcggcg

SEQ ID NO: 1512122 - RNA, 17 nt, Pseudomonas aeruginosa PA01
gccgaguggccgaaggc

SEQ ID NO: 1512123 - RNA, 16 nt, Pseudomonas aeruginosa PA01
gccgaguggccgcuga

SEQ ID NO: 1512124 - RNA, 23 nt, Pseudomonas aeruginosa PA01
gccgaguggccgcugagcagcag

SEQ ID NO: 1512125 - RNA, 15 nt, Pseudomonas aeruginosa PA01
gccgaguccgcgcgc

SEQ ID NO: 1512126 - RNA, 20 nt, Pseudomonas aeruginosa PA01
gccgaguccgcgcgcgcgcu

SEQ ID NO: 1512127 - RNA, 21 nt, Pseudomonas aeruginosa PA01
gccgaguccgcgcgcgcgcuc

SEQ ID NO: 1512128 - RNA, 18 nt, Pseudomonas aeruginosa PA01
gccgagaacccggccagg

SEQ ID NO: 1512129 - RNA, 19 nt, Pseudomonas aeruginosa PA01
gccgagacgaucagcagga

SEQ ID NO: 1512130 - RNA, 15 nt, Pseudomonas aeruginosa PA01
gccgacuuccaggcg

SEQ ID NO: 1512131 - RNA, 18 nt, Pseudomonas aeruginosa PA01
gccgagcaacggcagcau

SEQ ID NO: 1512132 - RNA, 13 nt, Pseudomonas aeruginosa PA01
gccgagcaacucg

SEQ ID NO: 1512133 - RNA, 16 nt, Pseudomonas aeruginosa PA01
gccgagauccugcagc

SEQ ID NO: 1512134 - RNA, 22 nt, Pseudomonas aeruginosa PA01
gccgagaagguucucggccacc

SEQ ID NO: 1512135 - RNA, 14 nt, Pseudomonas aeruginosa PA01
gccgagcgcagcgc

SEQ ID NO: 1512136 - RNA, 14 nt, Pseudomonas aeruginosa PA01
gccgagcgccgccu

SEQ ID NO: 1512137 - RNA, 18 nt, Pseudomonas aeruginosa PA01
gccgagcgccgccaggca

SEQ ID NO: 1512138 - RNA, 20 nt, Pseudomonas aeruginosa PA01
gccgagcgccgccaggcagg

SEQ ID NO: 1512139 - RNA, 15 nt, Pseudomonas aeruginosa PA01
gccgagcauccaggu

SEQ ID NO: 1512140 - RNA, 16 nt, Pseudomonas aeruginosa PA01
gccgagcagcgccagc

SEQ ID NO: 1512141 - RNA, 12 nt, Pseudomonas aeruginosa PA01
gccgagcaggcc

SEQ ID NO: 1512142 - RNA, 15 nt, Pseudomonas aeruginosa PA01
gccgagcaggcccau

SEQ ID NO: 1512143 - RNA, 20 nt, Pseudomonas aeruginosa PA01
gccgagcagggucacgccga

SEQ ID NO: 1512144 - RNA, 22 nt, Pseudomonas aeruginosa PA01
gccgagcaauccggcgcugccg

SEQ ID NO: 1512145 - RNA, 15 nt, Pseudomonas aeruginosa PA01
gccgagcccagcggc

SEQ ID NO: 1512146 - RNA, 22 nt, Pseudomonas aeruginosa PA01
gccgagccccgguuacucgccg

SEQ ID NO: 1512147 - RNA, 16 nt, Pseudomonas aeruginosa PA01
gccgacgaacagccag

SEQ ID NO: 1512148 - RNA, 14 nt, Pseudomonas aeruginosa PA01
gccgaccuucacca

SEQ ID NO: 1512149 - RNA, 15 nt, Pseudomonas aeruginosa PA01
gccgaccugcccgcu

SEQ ID NO: 1512150 - RNA, 20 nt, Pseudomonas aeruginosa PA01
gccgacgagcagcucgccgg

SEQ ID NO: 1512151 - RNA, 22 nt, Pseudomonas aeruginosa PA01
gccgacgauguucgaggcgccg

SEQ ID NO: 1512152 - RNA, 16 nt, Pseudomonas aeruginosa PA01
gccgacgauguuguug

SEQ ID NO: 1512153 - RNA, 14 nt, Pseudomonas aeruginosa PA01
gccgacgccgagca

SEQ ID NO: 1512154 - RNA, 18 nt, Pseudomonas aeruginosa PA01
gccgacgccgagcagcac

SEQ ID NO: 1512155 - RNA, 15 nt, Pseudomonas aeruginosa PA01
gccgacggcggcggc

SEQ ID NO: 1512156 - RNA, 13 nt, Pseudomonas aeruginosa PA01
gccgacggcggcg

SEQ ID NO: 1512157 - RNA, 13 nt, Pseudomonas aeruginosa PA01
gccgacggcgcgc

SEQ ID NO: 1512158 - RNA, 23 nt, Pseudomonas aeruginosa PA01
gccgacguagggcaucgccgaca

SEQ ID NO: 1512159 - RNA, 17 nt, Pseudomonas aeruginosa PA01
gccgccuugcucgaccc

SEQ ID NO: 1512160 - RNA, 14 nt, Pseudomonas aeruginosa PA01
gccgcgagccuuca

SEQ ID NO: 1512161 - RNA, 13 nt, Pseudomonas aeruginosa PA01
gccgcgagccagc

SEQ ID NO: 1512162 - RNA, 14 nt, Pseudomonas aeruginosa PA01
gccgcgagccagcc

SEQ ID NO: 1512163 - RNA, 20 nt, Pseudomonas aeruginosa PA01
gccgcgagcgcggccggcca

SEQ ID NO: 1512164 - RNA, 22 nt, Pseudomonas aeruginosa PA01
gccgcgagcuuggcccuggccu

SEQ ID NO: 1512165 - RNA, 15 nt, Pseudomonas aeruginosa PA01
gccgcgcaaggcagc

SEQ ID NO: 1512166 - RNA, 22 nt, Pseudomonas aeruginosa PA01
gccgcgcacaaaaaagcccgcc

SEQ ID NO: 1512167 - RNA, 13 nt, Pseudomonas aeruginosa PA01
gccgcgauggcuc

SEQ ID NO: 1512168 - RNA, 16 nt, Pseudomonas aeruginosa PA01
gccgcgauggcucgcg

SEQ ID NO: 1512169 - RNA, 18 nt, Pseudomonas aeruginosa PA01
gccgcgauggcucgcggc

SEQ ID NO: 1512170 - RNA, 19 nt, Pseudomonas aeruginosa PA01
gccgcgauggcucgcggcg

SEQ ID NO: 1512171 - RNA, 18 nt, Pseudomonas aeruginosa PA01
gccgccgguucgcaggcc

SEQ ID NO: 1512172 - RNA, 17 nt, Pseudomonas aeruginosa PA01
gccgccggucuucacgc

SEQ ID NO: 1512173 - RNA, 17 nt, Pseudomonas aeruginosa PA01
gccgccuugaccugcug

SEQ ID NO: 1512174 - RNA, 23 nt, Pseudomonas aeruginosa PA01
gccgccuugagcggcgcccuggc

SEQ ID NO: 1512175 - RNA, 20 nt, Pseudomonas aeruginosa PA01
gccgccuucgcgggccaggc

SEQ ID NO: 1512176 - RNA, 21 nt, Pseudomonas aeruginosa PA01
gccgccuucgcgggccaggcc

SEQ ID NO: 1512177 - RNA, 19 nt, Pseudomonas aeruginosa PA01
gccgccuucggcaggaccu

SEQ ID NO: 1512178 - RNA, 18 nt, Pseudomonas aeruginosa PA01
gccgccuggucggggccg

SEQ ID NO: 1512179 - RNA, 15 nt, Pseudomonas aeruginosa PA01
gccgccugcuggcug

SEQ ID NO: 1512180 - RNA, 13 nt, Pseudomonas aeruginosa PA01
gccgccuggcgca

SEQ ID NO: 1512181 - RNA, 22 nt, Pseudomonas aeruginosa PA01
gccgccuggcgugccgccaggc

SEQ ID NO: 1512182 - RNA, 17 nt, Pseudomonas aeruginosa PA01
gccgccugggccgccuc

SEQ ID NO: 1512183 - RNA, 15 nt, Pseudomonas aeruginosa PA01
gccgcgccgcccugg

SEQ ID NO: 1512184 - RNA, 15 nt, Pseudomonas aeruginosa PA01
gccgcgccgccgagg

SEQ ID NO: 1512185 - RNA, 12 nt, Pseudomonas aeruginosa PA01
gccgcgccgaga

SEQ ID NO: 1512186 - RNA, 20 nt, Pseudomonas aeruginosa PA01
gccgcgccgcaagggcgucg

SEQ ID NO: 1512187 - RNA, 16 nt, Pseudomonas aeruginosa PA01
gccgcgccgcucaggc

SEQ ID NO: 1512188 - RNA, 13 nt, Pseudomonas aeruginosa PA01
gccgcgccggccg

SEQ ID NO: 1512189 - RNA, 14 nt, Pseudomonas aeruginosa PA01
gccgcgccggccgu

SEQ ID NO: 1512190 - RNA, 16 nt, Pseudomonas aeruginosa PA01
gccgcgccggcucccu

SEQ ID NO: 1512191 - RNA, 16 nt, Pseudomonas aeruginosa PA01
gccgcgcgggccggcg

SEQ ID NO: 1512192 - RNA, 17 nt, Pseudomonas aeruginosa PA01
gccgcgcguaggcuugg

SEQ ID NO: 1512193 - RNA, 23 nt, Pseudomonas aeruginosa PA01
gccgcgcguggcuucguccagcg

SEQ ID NO: 1512194 - RNA, 17 nt, Pseudomonas aeruginosa PA01
gccgcgcguucgcgcga

SEQ ID NO: 1512195 - RNA, 12 nt, Pseudomonas aeruginosa PA01
gccgcgcgggcc

SEQ ID NO: 1512196 - RNA, 22 nt, Pseudomonas aeruginosa PA01
gccgcgcgauggccggcggaga

SEQ ID NO: 1512197 - RNA, 16 nt, Pseudomonas aeruginosa PA01
gccgcgcgaccgcggc

SEQ ID NO: 1512198 - RNA, 18 nt, Pseudomonas aeruginosa PA01
gccgcgcgaccgcggcgc

SEQ ID NO: 1512199 - RNA, 17 nt, Pseudomonas aeruginosa PA01
gccgcgccucgucgcgc

SEQ ID NO: 1512200 - RNA, 23 nt, Pseudomonas aeruginosa PA01
gccgcgccucgucgcgccaggcg

SEQ ID NO: 1512201 - RNA, 20 nt, Pseudomonas aeruginosa PA01
gccgcgccuucagcgccagc

SEQ ID NO: 1512202 - RNA, 19 nt, Pseudomonas aeruginosa PA01
gccgcgccuucugcaccuu

SEQ ID NO: 1512203 - RNA, 14 nt, Pseudomonas aeruginosa PA01
gccgcgcgcgcggu

SEQ ID NO: 1512204 - RNA, 16 nt, Pseudomonas aeruginosa PA01
gccgcgcgcgcggucg

SEQ ID NO: 1512205 - RNA, 16 nt, Pseudomonas aeruginosa PA01
gccgcaaguggcggcu

SEQ ID NO: 1512206 - RNA, 20 nt, Pseudomonas aeruginosa PA01
gccgcaaggccagggcggcg

SEQ ID NO: 1512207 - RNA, 17 nt, Pseudomonas aeruginosa PA01
gccgcaaguaccgccgg

SEQ ID NO: 1512208 - RNA, 20 nt, Pseudomonas aeruginosa PA01
gccgcccuugcggcccgccu

SEQ ID NO: 1512209 - RNA, 16 nt, Pseudomonas aeruginosa PA01
gccgcaauccgccgcu

SEQ ID NO: 1512210 - RNA, 18 nt, Pseudomonas aeruginosa PA01
gccgcccuugaccccacc

SEQ ID NO: 1512211 - RNA, 21 nt, Pseudomonas aeruginosa PA01
gccgccgaaaugcugcaggcc

SEQ ID NO: 1512212 - RNA, 22 nt, Pseudomonas aeruginosa PA01
gccgccgaaaugcugcaggccg

SEQ ID NO: 1512213 - RNA, 17 nt, Pseudomonas aeruginosa PA01
gccgccgaagccgacgc

SEQ ID NO: 1512214 - RNA, 19 nt, Pseudomonas aeruginosa PA01
gccgccgaggugcggcuug

SEQ ID NO: 1512215 - RNA, 23 nt, Pseudomonas aeruginosa PA01
gccgccgaggauagcguccagcu

SEQ ID NO: 1512216 - RNA, 17 nt, Pseudomonas aeruginosa PA01
gccgccgaggcgcgcca

SEQ ID NO: 1512217 - RNA, 19 nt, Pseudomonas aeruginosa PA01
gccgccgaucagcgcgccu

SEQ ID NO: 1512218 - RNA, 17 nt, Pseudomonas aeruginosa PA01
gccgccgaucugcuggg

SEQ ID NO: 1512219 - RNA, 14 nt, Pseudomonas aeruginosa PA01
gccgccgagggcac

SEQ ID NO: 1512220 - RNA, 15 nt, Pseudomonas aeruginosa PA01
gccgccgagggcacc

SEQ ID NO: 1512221 - RNA, 16 nt, Pseudomonas aeruginosa PA01
gccgccgagggcaccg

SEQ ID NO: 1512222 - RNA, 15 nt, Pseudomonas aeruginosa PA01
gccgccgagcaggcc

SEQ ID NO: 1512223 - RNA, 16 nt, Pseudomonas aeruginosa PA01
gccgccggacuuggag

SEQ ID NO: 1512224 - RNA, 13 nt, Pseudomonas aeruginosa PA01
gccgccgcuggcc

SEQ ID NO: 1512225 - RNA, 21 nt, Pseudomonas aeruginosa PA01
gccgccgcuggccuggccacc

SEQ ID NO: 1512226 - RNA, 23 nt, Pseudomonas aeruginosa PA01
gccgccgcuggccuggccacccu

SEQ ID NO: 1512227 - RNA, 15 nt, Pseudomonas aeruginosa PA01
gccgccggcaucccu

SEQ ID NO: 1512228 - RNA, 20 nt, Pseudomonas aeruginosa PA01
gccgccggccaccagcagca

SEQ ID NO: 1512229 - RNA, 21 nt, Pseudomonas aeruginosa PA01
gccgccggccaccagcagcaa

SEQ ID NO: 1512230 - RNA, 13 nt, Pseudomonas aeruginosa PA01
gccgccggccagc

SEQ ID NO: 1512231 - RNA, 16 nt, Pseudomonas aeruginosa PA01
gccgccggccagccgc

SEQ ID NO: 1512232 - RNA, 15 nt, Pseudomonas aeruginosa PA01
gccgccggggcgcag

SEQ ID NO: 1512233 - RNA, 16 nt, Pseudomonas aeruginosa PA01
gccgccggggcgggcc

SEQ ID NO: 1512234 - RNA, 13 nt, Pseudomonas aeruginosa PA01
gccgccgggcgcg

SEQ ID NO: 1512235 - RNA, 14 nt, Pseudomonas aeruginosa PA01
gccgccgggcgcgc

SEQ ID NO: 1512236 - RNA, 22 nt, Pseudomonas aeruginosa PA01
gccgccgcgggcgaacggcagc

SEQ ID NO: 1512237 - RNA, 17 nt, Pseudomonas aeruginosa PA01
gccgccgcggccagccc

SEQ ID NO: 1512238 - RNA, 20 nt, Pseudomonas aeruginosa PA01
gccgccgcggccagcccccu

SEQ ID NO: 1512239 - RNA, 13 nt, Pseudomonas aeruginosa PA01
gccgccgcgugcc

SEQ ID NO: 1512240 - RNA, 17 nt, Pseudomonas aeruginosa PA01
gccgccgcgcagcacca

SEQ ID NO: 1512241 - RNA, 16 nt, Pseudomonas aeruginosa PA01
gccgccgccugcucgc

SEQ ID NO: 1512242 - RNA, 13 nt, Pseudomonas aeruginosa PA01
gccgccgccugcu

SEQ ID NO: 1512243 - RNA, 12 nt, Pseudomonas aeruginosa PA01
gccgcugcgcag

SEQ ID NO: 1512244 - RNA, 22 nt, Pseudomonas aeruginosa PA01
gccgcuguggaaguacggcgcg

SEQ ID NO: 1512245 - RNA, 20 nt, Pseudomonas aeruginosa PA01
gccgcugucgucuucggcca

SEQ ID NO: 1512246 - RNA, 14 nt, Pseudomonas aeruginosa PA01
gccgcugucgucca

SEQ ID NO: 1512247 - RNA, 16 nt, Pseudomonas aeruginosa PA01
gccgcugucguccagc

SEQ ID NO: 1512248 - RNA, 19 nt, Pseudomonas aeruginosa PA01
gccgcuugcccucgcgccc

SEQ ID NO: 1512249 - RNA, 18 nt, Pseudomonas aeruginosa PA01
gccgcuuccggcccggcc

SEQ ID NO: 1512250 - RNA, 19 nt, Pseudomonas aeruginosa PA01
gccgcuuccggcccggcca

SEQ ID NO: 1512251 - RNA, 19 nt, Pseudomonas aeruginosa PA01
gccgcuuccgccggcgccg

SEQ ID NO: 1512252 - RNA, 23 nt, Pseudomonas aeruginosa PA01
gccgcuuccgccggcgccgccuc

SEQ ID NO: 1512253 - RNA, 17 nt, Pseudomonas aeruginosa PA01
gccgcuuacgcggccuu

SEQ ID NO: 1512254 - RNA, 19 nt, Pseudomonas aeruginosa PA01
gccggacaacaggccgggc

SEQ ID NO: 1512255 - RNA, 20 nt, Pseudomonas aeruginosa PA01
gccggacaacaggccgggcg

SEQ ID NO: 1512256 - RNA, 23 nt, Pseudomonas aeruginosa PA01
gccggacaacaggccgggcggcg

SEQ ID NO: 1512257 - RNA, 12 nt, Pseudomonas aeruginosa PA01
gccggaacggcu

SEQ ID NO: 1512258 - RNA, 16 nt, Pseudomonas aeruginosa PA01
gccggaacggcuugcu

SEQ ID NO: 1512259 - RNA, 17 nt, Pseudomonas aeruginosa PA01
gccggaagcgcucgcgc

SEQ ID NO: 1512260 - RNA, 16 nt, Pseudomonas aeruginosa PA01
gccggaagcuuccagc

SEQ ID NO: 1512261 - RNA, 20 nt, Pseudomonas aeruginosa PA01
gccggaaucacgcugcucgc

SEQ ID NO: 1512262 - RNA, 21 nt, Pseudomonas aeruginosa PA01
gccggcacuguuccucagccc

SEQ ID NO: 1512263 - RNA, 13 nt, Pseudomonas aeruginosa PA01
gccggcagcagcg

SEQ ID NO: 1512264 - RNA, 20 nt, Pseudomonas aeruginosa PA01
gccggccaaccaccggcgca

SEQ ID NO: 1512265 - RNA, 20 nt, Pseudomonas aeruginosa PA01
gccggauucgcgcagcaggc

SEQ ID NO: 1512266 - RNA, 18 nt, Pseudomonas aeruginosa PA01
gccggagagcagcacggc

SEQ ID NO: 1512267 - RNA, 23 nt, Pseudomonas aeruginosa PA01
gccggagagcgaauacaccgagc

SEQ ID NO: 1512268 - RNA, 19 nt, Pseudomonas aeruginosa PA01
gccggagaacgccgccacg

SEQ ID NO: 1512269 - RNA, 13 nt, Pseudomonas aeruginosa PA01
gccggagcaggcc

SEQ ID NO: 1512270 - RNA, 16 nt, Pseudomonas aeruginosa PA01
gccgcggccagccccc

SEQ ID NO: 1512271 - RNA, 13 nt, Pseudomonas aeruginosa PA01
gccgcggccggcg

SEQ ID NO: 1512272 - RNA, 19 nt, Pseudomonas aeruginosa PA01
gccgcggccggggaacagg

SEQ ID NO: 1512273 - RNA, 19 nt, Pseudomonas aeruginosa PA01
gccgcggcgauaggcgcgc

SEQ ID NO: 1512274 - RNA, 19 nt, Pseudomonas aeruginosa PA01
gccgcguaguaggcacagg

SEQ ID NO: 1512275 - RNA, 19 nt, Pseudomonas aeruginosa PA01
gccgcguagcgccaggccu

SEQ ID NO: 1512276 - RNA, 12 nt, Pseudomonas aeruginosa PA01
gccgcggcggcg

SEQ ID NO: 1512277 - RNA, 18 nt, Pseudomonas aeruginosa PA01
gccgcggaugacgggcga

SEQ ID NO: 1512278 - RNA, 20 nt, Pseudomonas aeruginosa PA01
gccgcggacggcacggggcg

SEQ ID NO: 1512279 - RNA, 17 nt, Pseudomonas aeruginosa PA01
gccgcggagcaccgcgc

SEQ ID NO: 1512280 - RNA, 16 nt, Pseudomonas aeruginosa PA01
gccgcggaaggcccgc

SEQ ID NO: 1512281 - RNA, 18 nt, Pseudomonas aeruginosa PA01
gccgcggaagugcgccgg

SEQ ID NO: 1512282 - RNA, 20 nt, Pseudomonas aeruginosa PA01
gccgcggaagugcgccgguu

SEQ ID NO: 1512283 - RNA, 17 nt, Pseudomonas aeruginosa PA01
gccgcggaauggcgcgc

SEQ ID NO: 1512284 - RNA, 22 nt, Pseudomonas aeruginosa PA01
gccgcgcggucgagcucggcca

SEQ ID NO: 1512285 - RNA, 17 nt, Pseudomonas aeruginosa PA01
gccgcgcuccaacaggc

SEQ ID NO: 1512286 - RNA, 14 nt, Pseudomonas aeruginosa PA01
gccgcgcucgcgca

SEQ ID NO: 1512287 - RNA, 17 nt, Pseudomonas aeruginosa PA01
gccgcgcucgcgcauga

SEQ ID NO: 1512288 - RNA, 17 nt, Pseudomonas aeruginosa PA01
gccgcgcugcgccaggc

SEQ ID NO: 1512289 - RNA, 13 nt, Pseudomonas aeruginosa PA01
gccgcgcugcagg

SEQ ID NO: 1512290 - RNA, 15 nt, Pseudomonas aeruginosa PA01
gccgcgcugcaggcg

SEQ ID NO: 1512291 - RNA, 14 nt, Pseudomonas aeruginosa PA01
gccgcgcuuggccu

SEQ ID NO: 1512292 - RNA, 17 nt, Pseudomonas aeruginosa PA01
gccgcugcaggccaccg

SEQ ID NO: 1512293 - RNA, 17 nt, Pseudomonas aeruginosa PA01
gccgcugcagggcggcg

SEQ ID NO: 1512294 - RNA, 15 nt, Pseudomonas aeruginosa PA01
gccgcuccggcugcg

SEQ ID NO: 1512295 - RNA, 12 nt, Pseudomonas aeruginosa PA01
gccgcuccuccu

SEQ ID NO: 1512296 - RNA, 15 nt, Pseudomonas aeruginosa PA01
gccgcuccaggaucg

SEQ ID NO: 1512297 - RNA, 15 nt, Pseudomonas aeruginosa PA01
gccgcucaucugcac

SEQ ID NO: 1512298 - RNA, 16 nt, Pseudomonas aeruginosa PA01
gccgcugccgccgcgc

SEQ ID NO: 1512299 - RNA, 19 nt, Pseudomonas aeruginosa PA01
gccgcucccggcuugcuga

SEQ ID NO: 1512300 - RNA, 22 nt, Pseudomonas aeruginosa PA01
gccgcugccugucgcagcgggc

SEQ ID NO: 1512301 - RNA, 18 nt, Pseudomonas aeruginosa PA01
gccgcucgagggcgaccg

SEQ ID NO: 1512302 - RNA, 15 nt, Pseudomonas aeruginosa PA01
gccgcgugcgcgccg

SEQ ID NO: 1512303 - RNA, 16 nt, Pseudomonas aeruginosa PA01
gccgcgugcgcgccgc

SEQ ID NO: 1512304 - RNA, 18 nt, Pseudomonas aeruginosa PA01
gccgcucaccgccacccc

SEQ ID NO: 1512305 - RNA, 16 nt, Pseudomonas aeruginosa PA01
gccgcuaucgccgccg

SEQ ID NO: 1512306 - RNA, 18 nt, Pseudomonas aeruginosa PA01
gccgcuaucgccgccgca

SEQ ID NO: 1512307 - RNA, 22 nt, Pseudomonas aeruginosa PA01
gccgcguccgagagcagggccu

SEQ ID NO: 1512308 - RNA, 20 nt, Pseudomonas aeruginosa PA01
gccgcgucguaguugccucu

SEQ ID NO: 1512309 - RNA, 22 nt, Pseudomonas aeruginosa PA01
gccgcgucguaguugccucucg

SEQ ID NO: 1512310 - RNA, 15 nt, Pseudomonas aeruginosa PA01
gccgcgucgucggcg

SEQ ID NO: 1512311 - RNA, 15 nt, Pseudomonas aeruginosa PA01
gccgcgucgccgcca

SEQ ID NO: 1512312 - RNA, 16 nt, Pseudomonas aeruginosa PA01
gccgcgucgccgccag

SEQ ID NO: 1512313 - RNA, 18 nt, Pseudomonas aeruginosa PA01
gccggucguucgcccuuc

SEQ ID NO: 1512314 - RNA, 19 nt, Pseudomonas aeruginosa PA01
gccggucuugccggcugcg

SEQ ID NO: 1512315 - RNA, 21 nt, Pseudomonas aeruginosa PA01
gccggugacauucgacagcag

SEQ ID NO: 1512316 - RNA, 19 nt, Pseudomonas aeruginosa PA01
gccggugaucucgcggcgc

SEQ ID NO: 1512317 - RNA, 22 nt, Pseudomonas aeruginosa PA01
gccggugaucucgcggcgcggc

SEQ ID NO: 1512318 - RNA, 12 nt, Pseudomonas aeruginosa PA01
gccggucgggca

SEQ ID NO: 1512319 - RNA, 17 nt, Pseudomonas aeruginosa PA01
gccggucgcgcucaggc

SEQ ID NO: 1512320 - RNA, 20 nt, Pseudomonas aeruginosa PA01
gccggucgcgcucaggcgca

SEQ ID NO: 1512321 - RNA, 21 nt, Pseudomonas aeruginosa PA01
gccggucgcgcucaggcgcag

SEQ ID NO: 1512322 - RNA, 22 nt, Pseudomonas aeruginosa PA01
gccggucgcgcucaggcgcagc

SEQ ID NO: 1512323 - RNA, 15 nt, Pseudomonas aeruginosa PA01
gccggugccggcggc

SEQ ID NO: 1512324 - RNA, 13 nt, Pseudomonas aeruginosa PA01
gccgguggccagg

SEQ ID NO: 1512325 - RNA, 14 nt, Pseudomonas aeruginosa PA01
gccgguggccaggc

SEQ ID NO: 1512326 - RNA, 16 nt, Pseudomonas aeruginosa PA01
gccggugcucggccug

SEQ ID NO: 1512327 - RNA, 12 nt, Pseudomonas aeruginosa PA01
gccggugcuggu

SEQ ID NO: 1512328 - RNA, 16 nt, Pseudomonas aeruginosa PA01
gccggugccgcccugg

SEQ ID NO: 1512329 - RNA, 14 nt, Pseudomonas aeruginosa PA01
gccggugccgccgg

SEQ ID NO: 1512330 - RNA, 15 nt, Pseudomonas aeruginosa PA01
gccggugccgccggc

SEQ ID NO: 1512331 - RNA, 14 nt, Pseudomonas aeruginosa PA01
gccggugcaccagg

SEQ ID NO: 1512332 - RNA, 22 nt, Pseudomonas aeruginosa PA01
gccggugcaugaaggcgcugag

SEQ ID NO: 1512333 - RNA, 21 nt, Pseudomonas aeruginosa PA01
gccgggcuccagcaucaccuu

SEQ ID NO: 1512334 - RNA, 22 nt, Pseudomonas aeruginosa PA01
gccgggcuccagcaucaccuug

SEQ ID NO: 1512335 - RNA, 17 nt, Pseudomonas aeruginosa PA01
gccgggcuccgccgcga

SEQ ID NO: 1512336 - RNA, 17 nt, Pseudomonas aeruginosa PA01
gccgggcgugucgagga

SEQ ID NO: 1512337 - RNA, 23 nt, Pseudomonas aeruginosa PA01
gccgggcuagguuuccccguggc

SEQ ID NO: 1512338 - RNA, 22 nt, Pseudomonas aeruginosa PA01
gccgggcucugguagccgcagu

SEQ ID NO: 1512339 - RNA, 15 nt, Pseudomonas aeruginosa PA01
gccgguaggggccga

SEQ ID NO: 1512340 - RNA, 15 nt, Pseudomonas aeruginosa PA01
gccgguagccguucg

SEQ ID NO: 1512341 - RNA, 15 nt, Pseudomonas aeruginosa PA01
gccgguagcggcgca

SEQ ID NO: 1512342 - RNA, 14 nt, Pseudomonas aeruginosa PA01
gccgggcuggccac

SEQ ID NO: 1512343 - RNA, 20 nt, Pseudomonas aeruginosa PA01
gccgggcugccgaacaggcg

SEQ ID NO: 1512344 - RNA, 16 nt, Pseudomonas aeruginosa PA01
gccgguacgcaccagc

SEQ ID NO: 1512345 - RNA, 18 nt, Pseudomonas aeruginosa PA01
gccgguacucgccgggcg

SEQ ID NO: 1512346 - RNA, 17 nt, Pseudomonas aeruginosa PA01
gccggucccgggcuccg

SEQ ID NO: 1512347 - RNA, 14 nt, Pseudomonas aeruginosa PA01
gccggucaggcugc

SEQ ID NO: 1512348 - RNA, 16 nt, Pseudomonas aeruginosa PA01
gccggucaccacugga

SEQ ID NO: 1512349 - RNA, 21 nt, Pseudomonas aeruginosa PA01
gccgggaucuccucgacggcg

SEQ ID NO: 1512350 - RNA, 17 nt, Pseudomonas aeruginosa PA01
gccgggaugaacccggc

SEQ ID NO: 1512351 - RNA, 19 nt, Pseudomonas aeruginosa PA01
gccgggaugcucaccgcgc

SEQ ID NO: 1512352 - RNA, 14 nt, Pseudomonas aeruginosa PA01
gccgggcgcgcgcc

SEQ ID NO: 1512353 - RNA, 13 nt, Pseudomonas aeruginosa PA01
gccgggcgcgcug

SEQ ID NO: 1512354 - RNA, 14 nt, Pseudomonas aeruginosa PA01
gccgggcgcgcugg

SEQ ID NO: 1512355 - RNA, 16 nt, Pseudomonas aeruginosa PA01
gccgggcgcgcugguc

SEQ ID NO: 1512356 - RNA, 21 nt, Pseudomonas aeruginosa PA01
gccgggcggacgcugggcugg

SEQ ID NO: 1512357 - RNA, 16 nt, Pseudomonas aeruginosa PA01
gccgggauacagcagc

SEQ ID NO: 1512358 - RNA, 19 nt, Pseudomonas aeruginosa PA01
gccgggaccacgcucaggu

SEQ ID NO: 1512359 - RNA, 15 nt, Pseudomonas aeruginosa PA01
gccgggaagccgcuc

SEQ ID NO: 1512360 - RNA, 16 nt, Pseudomonas aeruginosa PA01
gccgggaagccgcucg

SEQ ID NO: 1512361 - RNA, 23 nt, Pseudomonas aeruginosa PA01
gccgggaagccgcucggcguagc

SEQ ID NO: 1512362 - RNA, 16 nt, Pseudomonas aeruginosa PA01
gccgggaagcgcaggc

SEQ ID NO: 1512363 - RNA, 20 nt, Pseudomonas aeruginosa PA01
gccggcguccuugccgagga

SEQ ID NO: 1512364 - RNA, 13 nt, Pseudomonas aeruginosa PA01
gccggcgucggcg

SEQ ID NO: 1512365 - RNA, 16 nt, Pseudomonas aeruginosa PA01
gccggcgucggcgagc

SEQ ID NO: 1512366 - RNA, 18 nt, Pseudomonas aeruginosa PA01
gccggcgugcccauccgc

SEQ ID NO: 1512367 - RNA, 22 nt, Pseudomonas aeruginosa PA01
gccggcgugcccuuuuccucca

SEQ ID NO: 1512368 - RNA, 15 nt, Pseudomonas aeruginosa PA01
gccggcuaaccgcga

SEQ ID NO: 1512369 - RNA, 23 nt, Pseudomonas aeruginosa PA01
gccggcgggcgcgaggcgcccgc

SEQ ID NO: 1512370 - RNA, 17 nt, Pseudomonas aeruginosa PA01
gccggcggugcggaaga

SEQ ID NO: 1512371 - RNA, 17 nt, Pseudomonas aeruginosa PA01
gccggcguccuccucca

SEQ ID NO: 1512372 - RNA, 16 nt, Pseudomonas aeruginosa PA01
gccggcgcggcgcagc

SEQ ID NO: 1512373 - RNA, 17 nt, Pseudomonas aeruginosa PA01
gccggcggccugagccg

SEQ ID NO: 1512374 - RNA, 15 nt, Pseudomonas aeruginosa PA01
gccggcggccugccc

SEQ ID NO: 1512375 - RNA, 12 nt, Pseudomonas aeruginosa PA01
gccggcggcgga

SEQ ID NO: 1512376 - RNA, 14 nt, Pseudomonas aeruginosa PA01
gccggcgcgcccgg

SEQ ID NO: 1512377 - RNA, 16 nt, Pseudomonas aeruginosa PA01
gccggcgcgcggcggg

SEQ ID NO: 1512378 - RNA, 18 nt, Pseudomonas aeruginosa PA01
gccggcgcgcccaggccc

SEQ ID NO: 1512379 - RNA, 24 nt, Pseudomonas aeruginosa PA01
gccggcgcgcacggucuuggcguu

SEQ ID NO: 1512380 - RNA, 11 nt, Pseudomonas aeruginosa PA01
gccggcgccuu

SEQ ID NO: 1512381 - RNA, 13 nt, Pseudomonas aeruginosa PA01
gccggccagagcu

SEQ ID NO: 1512382 - RNA, 13 nt, Pseudomonas aeruginosa PA01
gccggccagccgc

SEQ ID NO: 1512383 - RNA, 14 nt, Pseudomonas aeruginosa PA01
gccggccagcaccu

SEQ ID NO: 1512384 - RNA, 17 nt, Pseudomonas aeruginosa PA01
gccggccaccagcagca

SEQ ID NO: 1512385 - RNA, 22 nt, Pseudomonas aeruginosa PA01
gccggccaccaucacgucgcgc

SEQ ID NO: 1512386 - RNA, 19 nt, Pseudomonas aeruginosa PA01
gccggccaggaaggccgcu

SEQ ID NO: 1512387 - RNA, 13 nt, Pseudomonas aeruginosa PA01
gccggcgccgcgg

SEQ ID NO: 1512388 - RNA, 16 nt, Pseudomonas aeruginosa PA01
gccgucgcgcaccacc

SEQ ID NO: 1512389 - RNA, 19 nt, Pseudomonas aeruginosa PA01
gccgucgcgcucuuccuuc

SEQ ID NO: 1512390 - RNA, 20 nt, Pseudomonas aeruginosa PA01
gccgucgcggaagccgugca

SEQ ID NO: 1512391 - RNA, 23 nt, Pseudomonas aeruginosa PA01
gccgucggccugcuugcaggagu

SEQ ID NO: 1512392 - RNA, 15 nt, Pseudomonas aeruginosa PA01
gccgucggccuggcg

SEQ ID NO: 1512393 - RNA, 17 nt, Pseudomonas aeruginosa PA01
gccgucgcacucuuccu

SEQ ID NO: 1512394 - RNA, 19 nt, Pseudomonas aeruginosa PA01
gccgucgcacucuuccugg

SEQ ID NO: 1512395 - RNA, 16 nt, Pseudomonas aeruginosa PA01
gccgucgccgcugaug

SEQ ID NO: 1512396 - RNA, 14 nt, Pseudomonas aeruginosa PA01
gccguccgccaggu

SEQ ID NO: 1512397 - RNA, 16 nt, Pseudomonas aeruginosa PA01
gccguccgcccaguuc

SEQ ID NO: 1512398 - RNA, 22 nt, Pseudomonas aeruginosa PA01
gccguccgcccaguucgccggc

SEQ ID NO: 1512399 - RNA, 14 nt, Pseudomonas aeruginosa PA01
gccguccugcuuga

SEQ ID NO: 1512400 - RNA, 20 nt, Pseudomonas aeruginosa PA01
gccguccugcuugaccuugc

SEQ ID NO: 1512401 - RNA, 13 nt, Pseudomonas aeruginosa PA01
gccguccugugga

SEQ ID NO: 1512402 - RNA, 23 nt, Pseudomonas aeruginosa PA01
gccguccuguuucugcuguggag

SEQ ID NO: 1512403 - RNA, 21 nt, Pseudomonas aeruginosa PA01
gccguccuugaguagcuggcg

SEQ ID NO: 1512404 - RNA, 12 nt, Pseudomonas aeruginosa PA01
gccgucgagcac

SEQ ID NO: 1512405 - RNA, 16 nt, Pseudomonas aeruginosa PA01
gccgucgagcaccagc

SEQ ID NO: 1512406 - RNA, 17 nt, Pseudomonas aeruginosa PA01
gccgucgagcaccagca

SEQ ID NO: 1512407 - RNA, 21 nt, Pseudomonas aeruginosa PA01
gccgucgagccagcccagcgg

SEQ ID NO: 1512408 - RNA, 14 nt, Pseudomonas aeruginosa PA01
gccguucaggguca

SEQ ID NO: 1512409 - RNA, 15 nt, Pseudomonas aeruginosa PA01
gccguuccagcggca

SEQ ID NO: 1512410 - RNA, 14 nt, Pseudomonas aeruginosa PA01
gccguuccaggcgg

SEQ ID NO: 1512411 - RNA, 17 nt, Pseudomonas aeruginosa PA01
gccguucagcucccagg

SEQ ID NO: 1512412 - RNA, 19 nt, Pseudomonas aeruginosa PA01
gccguucaggccggcgccg

SEQ ID NO: 1512413 - RNA, 22 nt, Pseudomonas aeruginosa PA01
gccguucagggacaugucgagg

SEQ ID NO: 1512414 - RNA, 14 nt, Pseudomonas aeruginosa PA01
gccguggaacgcag

SEQ ID NO: 1512415 - RNA, 18 nt, Pseudomonas aeruginosa PA01
gccguggaccaacagccg

SEQ ID NO: 1512416 - RNA, 16 nt, Pseudomonas aeruginosa PA01
gccguggaccaggauc

SEQ ID NO: 1512417 - RNA, 15 nt, Pseudomonas aeruginosa PA01
gccguggcacccagg

SEQ ID NO: 1512418 - RNA, 19 nt, Pseudomonas aeruginosa PA01
gccguggaugucgaggaac

SEQ ID NO: 1512419 - RNA, 16 nt, Pseudomonas aeruginosa PA01
gccgugaggcgcgcgc

SEQ ID NO: 1512420 - RNA, 19 nt, Pseudomonas aeruginosa PA01
gccgucuuccagggcggcg

SEQ ID NO: 1512421 - RNA, 20 nt, Pseudomonas aeruginosa PA01
gccgucuuccagggcggcgc

SEQ ID NO: 1512422 - RNA, 12 nt, Pseudomonas aeruginosa PA01
gccgugaagcac

SEQ ID NO: 1512423 - RNA, 20 nt, Pseudomonas aeruginosa PA01
gccgguuuuuuuaugccugc

SEQ ID NO: 1512424 - RNA, 17 nt, Pseudomonas aeruginosa PA01
gccguacagcaggcagg

SEQ ID NO: 1512425 - RNA, 18 nt, Pseudomonas aeruginosa PA01
gccguacagcaggcaggc

SEQ ID NO: 1512426 - RNA, 20 nt, Pseudomonas aeruginosa PA01
gccguacagcccccgccggc

SEQ ID NO: 1512427 - RNA, 15 nt, Pseudomonas aeruginosa PA01
gccguacaggucggc

SEQ ID NO: 1512428 - RNA, 14 nt, Pseudomonas aeruginosa PA01
gccgguucccgcag

SEQ ID NO: 1512429 - RNA, 22 nt, Pseudomonas aeruginosa PA01
gccgguuaucgaggcgucggcg

SEQ ID NO: 1512430 - RNA, 20 nt, Pseudomonas aeruginosa PA01
gccggugugcgacuggggca

SEQ ID NO: 1512431 - RNA, 21 nt, Pseudomonas aeruginosa PA01
gccgguggcgcccagccagag

SEQ ID NO: 1512432 - RNA, 17 nt, Pseudomonas aeruginosa PA01
gccguacuucaggguga

SEQ ID NO: 1512433 - RNA, 20 nt, Pseudomonas aeruginosa PA01
gccguacucauggccgcagc

SEQ ID NO: 1512434 - RNA, 19 nt, Pseudomonas aeruginosa PA01
gccguagaccaccagcagc

SEQ ID NO: 1512435 - RNA, 21 nt, Pseudomonas aeruginosa PA01
gccguagcgcaguucgccgcc

SEQ ID NO: 1512436 - RNA, 20 nt, Pseudomonas aeruginosa PA01
gccguagcggccucguucgg

SEQ ID NO: 1512437 - RNA, 19 nt, Pseudomonas aeruginosa PA01
gccguauccgcggcagggg

SEQ ID NO: 1512438 - RNA, 13 nt, Pseudomonas aeruginosa PA01
gccguaggccacu

SEQ ID NO: 1512439 - RNA, 17 nt, Pseudomonas aeruginosa PA01
gccgucacuugaagucc

SEQ ID NO: 1512440 - RNA, 13 nt, Pseudomonas aeruginosa PA01
gccguccaccagc

SEQ ID NO: 1512441 - RNA, 16 nt, Pseudomonas aeruginosa PA01
gccguccaccaagcgg

SEQ ID NO: 1512442 - RNA, 15 nt, Pseudomonas aeruginosa PA01
gccgucaucgcugac

SEQ ID NO: 1512443 - RNA, 17 nt, Pseudomonas aeruginosa PA01
gccgucaucgcugaccu

SEQ ID NO: 1512444 - RNA, 15 nt, Pseudomonas aeruginosa PA01
gccguccaggcugcc

SEQ ID NO: 1512445 - RNA, 21 nt, Pseudomonas aeruginosa PA01
gcaucgguggugugauccugc

SEQ ID NO: 1512446 - RNA, 13 nt, Pseudomonas aeruginosa PA01
gcaucggccuggu

SEQ ID NO: 1512447 - RNA, 13 nt, Pseudomonas aeruginosa PA01
gcaucggcgccuc

SEQ ID NO: 1512448 - RNA, 15 nt, Pseudomonas aeruginosa PA01
gcaucggccgccagg

SEQ ID NO: 1512449 - RNA, 14 nt, Pseudomonas aeruginosa PA01
gcaucggccaccuu

SEQ ID NO: 1512450 - RNA, 18 nt, Pseudomonas aeruginosa PA01
gcaucggccauucggccu

SEQ ID NO: 1512451 - RNA, 22 nt, Pseudomonas aeruginosa PA01
gcaucgccgaccacuuccaggu

SEQ ID NO: 1512452 - RNA, 18 nt, Pseudomonas aeruginosa PA01
gcaucgccugggccggcg

SEQ ID NO: 1512453 - RNA, 22 nt, Pseudomonas aeruginosa PA01
gcaucgcgggcgugcuccagca

SEQ ID NO: 1512454 - RNA, 14 nt, Pseudomonas aeruginosa PA01
gcaucgcucgcaac

SEQ ID NO: 1512455 - RNA, 14 nt, Pseudomonas aeruginosa PA01
gcaucgcugaccuc

SEQ ID NO: 1512456 - RNA, 24 nt, Pseudomonas aeruginosa PA01
gcaucguuggcgccguccugcaac

SEQ ID NO: 1512457 - RNA, 18 nt, Pseudomonas aeruginosa PA01
gcaucguuguaggccaug

SEQ ID NO: 1512458 - RNA, 12 nt, Pseudomonas aeruginosa PA01
gcaucucggcca

SEQ ID NO: 1512459 - RNA, 15 nt, Pseudomonas aeruginosa PA01
gcaucucggccaccu

SEQ ID NO: 1512460 - RNA, 17 nt, Pseudomonas aeruginosa PA01
gcaucucgccggcacug

SEQ ID NO: 1512461 - RNA, 19 nt, Pseudomonas aeruginosa PA01
gcaucucuuccucgcugcc

SEQ ID NO: 1512462 - RNA, 14 nt, Pseudomonas aeruginosa PA01
gcaucugccgggcg

SEQ ID NO: 1512463 - RNA, 21 nt, Pseudomonas aeruginosa PA01
gcaucugccgggcgcgcuggu

SEQ ID NO: 1512464 - RNA, 22 nt, Pseudomonas aeruginosa PA01
gcaucugccgggcgcgcugguc

SEQ ID NO: 1512465 - RNA, 12 nt, Pseudomonas aeruginosa PA01
gcaucuggcccg

SEQ ID NO: 1512466 - RNA, 18 nt, Pseudomonas aeruginosa PA01
gcaucuggugcgcgucca

SEQ ID NO: 1512467 - RNA, 11 nt, Pseudomonas aeruginosa PA01
gcaugccaucu

SEQ ID NO: 1512468 - RNA, 18 nt, Pseudomonas aeruginosa PA01
gcaugccgacgagcagcu

SEQ ID NO: 1512469 - RNA, 13 nt, Pseudomonas aeruginosa PA01
gcaugccgggguc

SEQ ID NO: 1512470 - RNA, 20 nt, Pseudomonas aeruginosa PA01
gcaugcggaaggcuuccugg

SEQ ID NO: 1512471 - RNA, 14 nt, Pseudomonas aeruginosa PA01
gcaugccagggccu

SEQ ID NO: 1512472 - RNA, 17 nt, Pseudomonas aeruginosa PA01
gcaugcagguggcgcuc

SEQ ID NO: 1512473 - RNA, 16 nt, Pseudomonas aeruginosa PA01
gcaugaggcuggccag

SEQ ID NO: 1512474 - RNA, 20 nt, Pseudomonas aeruginosa PA01
gcaugaucgccucggcgcgc

SEQ ID NO: 1512475 - RNA, 18 nt, Pseudomonas aeruginosa PA01
gcaugauggugccgccgg

SEQ ID NO: 1512476 - RNA, 17 nt, Pseudomonas aeruginosa PA01
gcaugaaaaagcccggc

SEQ ID NO: 1512477 - RNA, 18 nt, Pseudomonas aeruginosa PA01
gcaugaaaaagcccggca

SEQ ID NO: 1512478 - RNA, 23 nt, Pseudomonas aeruginosa PA01
gcaugaccgagcaugcgcggcag

SEQ ID NO: 1512479 - RNA, 18 nt, Pseudomonas aeruginosa PA01
gcauguucaugcgcuggu

SEQ ID NO: 1512480 - RNA, 18 nt, Pseudomonas aeruginosa PA01
gcauguuccuccagagug

SEQ ID NO: 1512481 - RNA, 14 nt, Pseudomonas aeruginosa PA01
gcaugugccaggcc

SEQ ID NO: 1512482 - RNA, 21 nt, Pseudomonas aeruginosa PA01
gcauguccaccgccgccagca

SEQ ID NO: 1512483 - RNA, 15 nt, Pseudomonas aeruginosa PA01
gcauguagcgcuccu

SEQ ID NO: 1512484 - RNA, 22 nt, Pseudomonas aeruginosa PA01
gcauggcuggcgcuaccgcgca

SEQ ID NO: 1512485 - RNA, 23 nt, Pseudomonas aeruginosa PA01
gcauggccauggcagagcuggaa

SEQ ID NO: 1512486 - RNA, 16 nt, Pseudomonas aeruginosa PA01
gcauggcgaccuggug

SEQ ID NO: 1512487 - RNA, 15 nt, Pseudomonas aeruginosa PA01
gcauggcgcucuuca

SEQ ID NO: 1512488 - RNA, 21 nt, Pseudomonas aeruginosa PA01
gcaugcucacugcgagcacca

SEQ ID NO: 1512489 - RNA, 23 nt, Pseudomonas aeruginosa PA01
gcaugcucacugcgagcaccaug

SEQ ID NO: 1512490 - RNA, 22 nt, Pseudomonas aeruginosa PA01
gcaugcucagccgcgccggggc

SEQ ID NO: 1512491 - RNA, 17 nt, Pseudomonas aeruginosa PA01
gcaugcuuuugaacacc

SEQ ID NO: 1512492 - RNA, 18 nt, Pseudomonas aeruginosa PA01
gcauggagacggcccgcc

SEQ ID NO: 1512493 - RNA, 20 nt, Pseudomonas aeruginosa PA01
gcauggaucaacuggucgca

SEQ ID NO: 1512494 - RNA, 15 nt, Pseudomonas aeruginosa PA01
gcauucaccagcgac

SEQ ID NO: 1512495 - RNA, 23 nt, Pseudomonas aeruginosa PA01
gcauucagcgcgccccggcgagc

SEQ ID NO: 1512496 - RNA, 15 nt, Pseudomonas aeruginosa PA01
gcauuccucagcgcc

SEQ ID NO: 1512497 - RNA, 23 nt, Pseudomonas aeruginosa PA01
gcauucucucuucagcaggggga

SEQ ID NO: 1512498 - RNA, 15 nt, Pseudomonas aeruginosa PA01
gcauuggccaucagc

SEQ ID NO: 1512499 - RNA, 16 nt, Pseudomonas aeruginosa PA01
gccaaccgggcagcag

SEQ ID NO: 1512500 - RNA, 21 nt, Pseudomonas aeruginosa PA01
gccaaccgggcagcagccgga

SEQ ID NO: 1512501 - RNA, 19 nt, Pseudomonas aeruginosa PA01
gccaaccgucgcccuggug

SEQ ID NO: 1512502 - RNA, 22 nt, Pseudomonas aeruginosa PA01
gccaaccgucgcccuggugcac

SEQ ID NO: 1512503 - RNA, 15 nt, Pseudomonas aeruginosa PA01
gccaaccucucccca

SEQ ID NO: 1512504 - RNA, 16 nt, Pseudomonas aeruginosa PA01
gccaaccucuccccag

SEQ ID NO: 1512505 - RNA, 17 nt, Pseudomonas aeruginosa PA01
gccaaccucuccccaga

SEQ ID NO: 1512506 - RNA, 13 nt, Pseudomonas aeruginosa PA01
gccaaccaccggc

SEQ ID NO: 1512507 - RNA, 16 nt, Pseudomonas aeruginosa PA01
gccaaccagauccggg

SEQ ID NO: 1512508 - RNA, 13 nt, Pseudomonas aeruginosa PA01
gccaagcccggcg

SEQ ID NO: 1512509 - RNA, 16 nt, Pseudomonas aeruginosa PA01
gccaacgcgccgucgc

SEQ ID NO: 1512510 - RNA, 14 nt, Pseudomonas aeruginosa PA01
gccaacgcccgggc

SEQ ID NO: 1512511 - RNA, 21 nt, Pseudomonas aeruginosa PA01
gccaacggcguuauccgccgc

SEQ ID NO: 1512512 - RNA, 23 nt, Pseudomonas aeruginosa PA01
gccaacguccucgaugcccgccu

SEQ ID NO: 1512513 - RNA, 16 nt, Pseudomonas aeruginosa PA01
gccaacugggccuuga

SEQ ID NO: 1512514 - RNA, 19 nt, Pseudomonas aeruginosa PA01
gccaacugcuucaggcgcg

SEQ ID NO: 1512515 - RNA, 23 nt, Pseudomonas aeruginosa PA01
gccaacugcuucaggcgcgcggc

SEQ ID NO: 1512516 - RNA, 22 nt, Pseudomonas aeruginosa PA01
gccaaaguucaguagcggcagg

SEQ ID NO: 1512517 - RNA, 20 nt, Pseudomonas aeruginosa PA01
gccaaagaaaaggcccgcug

SEQ ID NO: 1512518 - RNA, 13 nt, Pseudomonas aeruginosa PA01
gccaaaaaaagcc

SEQ ID NO: 1512519 - RNA, 18 nt, Pseudomonas aeruginosa PA01
gccaaaaaaagccccggc

SEQ ID NO: 1512520 - RNA, 15 nt, Pseudomonas aeruginosa PA01
gcauuuccugggugc

SEQ ID NO: 1512521 - RNA, 22 nt, Pseudomonas aeruginosa PA01
gcauuuccugggugccgcgaau

SEQ ID NO: 1512522 - RNA, 14 nt, Pseudomonas aeruginosa PA01
gccacacauccagu

SEQ ID NO: 1512523 - RNA, 15 nt, Pseudomonas aeruginosa PA01
gccacacauccagug

SEQ ID NO: 1512524 - RNA, 22 nt, Pseudomonas aeruginosa PA01
gccacacauccaguguggcggc

SEQ ID NO: 1512525 - RNA, 22 nt, Pseudomonas aeruginosa PA01
gccacagaucgccagcucgccg

SEQ ID NO: 1512526 - RNA, 23 nt, Pseudomonas aeruginosa PA01
gccacagaucgccagcucgccgc

SEQ ID NO: 1512527 - RNA, 14 nt, Pseudomonas aeruginosa PA01
gccacaggcccugg

SEQ ID NO: 1512528 - RNA, 16 nt, Pseudomonas aeruginosa PA01
gccaccccgccgcgca

SEQ ID NO: 1512529 - RNA, 14 nt, Pseudomonas aeruginosa PA01
gccaccccgccggc

SEQ ID NO: 1512530 - RNA, 23 nt, Pseudomonas aeruginosa PA01
gccaccaucacgucgcgcaccug

SEQ ID NO: 1512531 - RNA, 20 nt, Pseudomonas aeruginosa PA01
gccacccgaagguguccgcc

SEQ ID NO: 1512532 - RNA, 20 nt, Pseudomonas aeruginosa PA01
gccacccgcaucgaggccgc

SEQ ID NO: 1512533 - RNA, 14 nt, Pseudomonas aeruginosa PA01
gccacccggcgccc

SEQ ID NO: 1512534 - RNA, 14 nt, Pseudomonas aeruginosa PA01
gccaccgcgcgccc

SEQ ID NO: 1512535 - RNA, 22 nt, Pseudomonas aeruginosa PA01
gccaccgcgacgcgcuggacca

SEQ ID NO: 1512536 - RNA, 19 nt, Pseudomonas aeruginosa PA01
gccacccuugcguccugcc

SEQ ID NO: 1512537 - RNA, 16 nt, Pseudomonas aeruginosa PA01
gccaagggcgccgccg

SEQ ID NO: 1512538 - RNA, 15 nt, Pseudomonas aeruginosa PA01
gccaaggcggggcuu

SEQ ID NO: 1512539 - RNA, 19 nt, Pseudomonas aeruginosa PA01
gccaaggcccugcugcagg

SEQ ID NO: 1512540 - RNA, 20 nt, Pseudomonas aeruginosa PA01
gccaaggaugcgccagcggc

SEQ ID NO: 1512541 - RNA, 17 nt, Pseudomonas aeruginosa PA01
gccaaguugccuggcag

SEQ ID NO: 1512542 - RNA, 20 nt, Pseudomonas aeruginosa PA01
gccacaaggaaaaacggggc

SEQ ID NO: 1512543 - RNA, 23 nt, Pseudomonas aeruginosa PA01
gccaaugccuuccgacgccgcgu

SEQ ID NO: 1512544 - RNA, 20 nt, Pseudomonas aeruginosa PA01
gccagaaaacccagcgaagc

SEQ ID NO: 1512545 - RNA, 14 nt, Pseudomonas aeruginosa PA01
gccacuuccagcuu

SEQ ID NO: 1512546 - RNA, 19 nt, Pseudomonas aeruginosa PA01
gccacuuccagcuugcgcu

SEQ ID NO: 1512547 - RNA, 16 nt, Pseudomonas aeruginosa PA01
gccacuucccggcgca

SEQ ID NO: 1512548 - RNA, 18 nt, Pseudomonas aeruginosa PA01
gccacuucccggcgcaga

SEQ ID NO: 1512549 - RNA, 13 nt, Pseudomonas aeruginosa PA01
gccacuuccagca

SEQ ID NO: 1512550 - RNA, 17 nt, Pseudomonas aeruginosa PA01
gccacuuccagcacgcc

SEQ ID NO: 1512551 - RNA, 18 nt, Pseudomonas aeruginosa PA01
gccagcaccagcaggagc

SEQ ID NO: 1512552 - RNA, 15 nt, Pseudomonas aeruginosa PA01
gccagcaccaguccc

SEQ ID NO: 1512553 - RNA, 16 nt, Pseudomonas aeruginosa PA01
gccagcaccagucccu

SEQ ID NO: 1512554 - RNA, 18 nt, Pseudomonas aeruginosa PA01
gccagcaccagucccugg

SEQ ID NO: 1512555 - RNA, 12 nt, Pseudomonas aeruginosa PA01
gccagcaacagu

SEQ ID NO: 1512556 - RNA, 22 nt, Pseudomonas aeruginosa PA01
gccagcaacaguugccgcagca

SEQ ID NO: 1512557 - RNA, 15 nt, Pseudomonas aeruginosa PA01
gccagcaacggcucc

SEQ ID NO: 1512558 - RNA, 19 nt, Pseudomonas aeruginosa PA01
gccagaggaucggccaacu

SEQ ID NO: 1512559 - RNA, 13 nt, Pseudomonas aeruginosa PA01
gccagagcgcgcu

SEQ ID NO: 1512560 - RNA, 21 nt, Pseudomonas aeruginosa PA01
gccagagcgcugccugcaccg

SEQ ID NO: 1512561 - RNA, 16 nt, Pseudomonas aeruginosa PA01
gccagagcagcgucgu

SEQ ID NO: 1512562 - RNA, 18 nt, Pseudomonas aeruginosa PA01
gccagagaucgcccagcg

SEQ ID NO: 1512563 - RNA, 19 nt, Pseudomonas aeruginosa PA01
gccagacgaucagcggccc

SEQ ID NO: 1512564 - RNA, 16 nt, Pseudomonas aeruginosa PA01
gccagccagccgcgcg

SEQ ID NO: 1512565 - RNA, 13 nt, Pseudomonas aeruginosa PA01
gccagccagagcc

SEQ ID NO: 1512566 - RNA, 14 nt, Pseudomonas aeruginosa PA01
gccagccagagcca

SEQ ID NO: 1512567 - RNA, 20 nt, Pseudomonas aeruginosa PA01
gccagccagagccagucgag

SEQ ID NO: 1512568 - RNA, 21 nt, Pseudomonas aeruginosa PA01
gccagccaugugcuccuugac

SEQ ID NO: 1512569 - RNA, 14 nt, Pseudomonas aeruginosa PA01
gccagccagcgcgg

SEQ ID NO: 1512570 - RNA, 12 nt, Pseudomonas aeruginosa PA01
gccagccagggc

SEQ ID NO: 1512571 - RNA, 15 nt, Pseudomonas aeruginosa PA01
gccagccagggcagc

SEQ ID NO: 1512572 - RNA, 14 nt, Pseudomonas aeruginosa PA01
gccagccaggguac

SEQ ID NO: 1512573 - RNA, 16 nt, Pseudomonas aeruginosa PA01
gccagcccccucgccc

SEQ ID NO: 1512574 - RNA, 15 nt, Pseudomonas aeruginosa PA01
gccagccccugcgga

SEQ ID NO: 1512575 - RNA, 22 nt, Pseudomonas aeruginosa PA01
gccagccccugcggaccgcaga

SEQ ID NO: 1512576 - RNA, 12 nt, Pseudomonas aeruginosa PA01
gccagccccaga

SEQ ID NO: 1512577 - RNA, 14 nt, Pseudomonas aeruginosa PA01
gccagcccagaaca

SEQ ID NO: 1512578 - RNA, 13 nt, Pseudomonas aeruginosa PA01
gccagccccaggc

SEQ ID NO: 1512579 - RNA, 17 nt, Pseudomonas aeruginosa PA01
gccagcccucgcccagg

SEQ ID NO: 1512580 - RNA, 14 nt, Pseudomonas aeruginosa PA01
gccagcccggagcc

SEQ ID NO: 1512581 - RNA, 22 nt, Pseudomonas aeruginosa PA01
gccagcccggcaggucgaggac

SEQ ID NO: 1512582 - RNA, 12 nt, Pseudomonas aeruginosa PA01
gccagcccggcc

SEQ ID NO: 1512583 - RNA, 22 nt, Pseudomonas aeruginosa PA01
gccagcccggccucgccggucg

SEQ ID NO: 1512584 - RNA, 15 nt, Pseudomonas aeruginosa PA01
gccagcagccaggcc

SEQ ID NO: 1512585 - RNA, 16 nt, Pseudomonas aeruginosa PA01
gccagcagccaggccu

SEQ ID NO: 1512586 - RNA, 17 nt, Pseudomonas aeruginosa PA01
gccagcaccuggcagug

SEQ ID NO: 1512587 - RNA, 14 nt, Pseudomonas aeruginosa PA01
gccagcaccucgac

SEQ ID NO: 1512588 - RNA, 20 nt, Pseudomonas aeruginosa PA01
gccagcaccucgacgcccgc

SEQ ID NO: 1512589 - RNA, 21 nt, Pseudomonas aeruginosa PA01
gccagcaccucgacgcccgcu

SEQ ID NO: 1512590 - RNA, 13 nt, Pseudomonas aeruginosa PA01
gccagcaccaugc

SEQ ID NO: 1512591 - RNA, 19 nt, Pseudomonas aeruginosa PA01
gccagcaccaugcgcggca

SEQ ID NO: 1512592 - RNA, 12 nt, Pseudomonas aeruginosa PA01
gccagcacccag

SEQ ID NO: 1512593 - RNA, 15 nt, Pseudomonas aeruginosa PA01
gccagcacccagucu

SEQ ID NO: 1512594 - RNA, 13 nt, Pseudomonas aeruginosa PA01
gccagcagcuccg

SEQ ID NO: 1512595 - RNA, 18 nt, Pseudomonas aeruginosa PA01
gccagcaguugcaacagc

SEQ ID NO: 1512596 - RNA, 21 nt, Pseudomonas aeruginosa PA01
gccagcaguugcaacagcgcg

SEQ ID NO: 1512597 - RNA, 16 nt, Pseudomonas aeruginosa PA01
gccaggcguuccagcu

SEQ ID NO: 1512598 - RNA, 13 nt, Pseudomonas aeruginosa PA01
gccaggcucgccg

SEQ ID NO: 1512599 - RNA, 21 nt, Pseudomonas aeruginosa PA01
gccaggcucgccgccagcagg

SEQ ID NO: 1512600 - RNA, 22 nt, Pseudomonas aeruginosa PA01
gccaggcucgccgccagcagga

SEQ ID NO: 1512601 - RNA, 20 nt, Pseudomonas aeruginosa PA01
gccaggcucgguucugcgca

SEQ ID NO: 1512602 - RNA, 15 nt, Pseudomonas aeruginosa PA01
gccaggcggcucccu

SEQ ID NO: 1512603 - RNA, 12 nt, Pseudomonas aeruginosa PA01
gccaggcggccg

SEQ ID NO: 1512604 - RNA, 14 nt, Pseudomonas aeruginosa PA01
gccaggcggccgcu

SEQ ID NO: 1512605 - RNA, 19 nt, Pseudomonas aeruginosa PA01
gccaggcggccgcuggcga

SEQ ID NO: 1512606 - RNA, 17 nt, Pseudomonas aeruginosa PA01
gccaggcgccagggccg

SEQ ID NO: 1512607 - RNA, 15 nt, Pseudomonas aeruginosa PA01
gccaggcgcuggcga

SEQ ID NO: 1512608 - RNA, 16 nt, Pseudomonas aeruginosa PA01
gccaggcgcuccucca

SEQ ID NO: 1512609 - RNA, 17 nt, Pseudomonas aeruginosa PA01
gccaggcgcuccuccag

SEQ ID NO: 1512610 - RNA, 14 nt, Pseudomonas aeruginosa PA01
gccaggcgcucgcg

SEQ ID NO: 1512611 - RNA, 17 nt, Pseudomonas aeruginosa PA01
gccaggcgcucgcgcug

SEQ ID NO: 1512612 - RNA, 19 nt, Pseudomonas aeruginosa PA01
gccaggcgcucgcgcugca

SEQ ID NO: 1512613 - RNA, 14 nt, Pseudomonas aeruginosa PA01
gccaggcugaccgc

SEQ ID NO: 1512614 - RNA, 14 nt, Pseudomonas aeruginosa PA01
gccaggcuggccac

SEQ ID NO: 1512615 - RNA, 15 nt, Pseudomonas aeruginosa PA01
gccaggcuggccacg

SEQ ID NO: 1512616 - RNA, 23 nt, Pseudomonas aeruginosa PA01
gccaggcuggccacgaacaggcu

SEQ ID NO: 1512617 - RNA, 23 nt, Pseudomonas aeruginosa PA01
gccagggcggcgccgaacagggc

SEQ ID NO: 1512618 - RNA, 18 nt, Pseudomonas aeruginosa PA01
gccagggucgccagcagg

SEQ ID NO: 1512619 - RNA, 21 nt, Pseudomonas aeruginosa PA01
gccaggggcuagucgcgcagc

SEQ ID NO: 1512620 - RNA, 23 nt, Pseudomonas aeruginosa PA01
gccaggggcuagucgcgcagcgc

SEQ ID NO: 1512621 - RNA, 17 nt, Pseudomonas aeruginosa PA01
gccaggggagcgccggc

SEQ ID NO: 1512622 - RNA, 22 nt, Pseudomonas aeruginosa PA01
gccaggguaccguugcgcaggc

SEQ ID NO: 1512623 - RNA, 16 nt, Pseudomonas aeruginosa PA01
gccagggguaggagga

SEQ ID NO: 1512624 - RNA, 15 nt, Pseudomonas aeruginosa PA01
gccaggggucaggcc

SEQ ID NO: 1512625 - RNA, 18 nt, Pseudomonas aeruginosa PA01
gccaggggucaggccgau

SEQ ID NO: 1512626 - RNA, 14 nt, Pseudomonas aeruginosa PA01
gccaggggugccuu

SEQ ID NO: 1512627 - RNA, 23 nt, Pseudomonas aeruginosa PA01
gccagguggucgaucuccuccuc

SEQ ID NO: 1512628 - RNA, 15 nt, Pseudomonas aeruginosa PA01
gccaggcgcaccagc

SEQ ID NO: 1512629 - RNA, 18 nt, Pseudomonas aeruginosa PA01
gccaggcgaggaacagcg

SEQ ID NO: 1512630 - RNA, 18 nt, Pseudomonas aeruginosa PA01
gccaggcgcgucuccagc

SEQ ID NO: 1512631 - RNA, 23 nt, Pseudomonas aeruginosa PA01
gccaggcgcgucuccagcucggc

SEQ ID NO: 1512632 - RNA, 23 nt, Pseudomonas aeruginosa PA01
gccaggccguagaccaccagcag

SEQ ID NO: 1512633 - RNA, 12 nt, Pseudomonas aeruginosa PA01
gccaggccucgg

SEQ ID NO: 1512634 - RNA, 20 nt, Pseudomonas aeruginosa PA01
gccaggccuugugcgccagc

SEQ ID NO: 1512635 - RNA, 22 nt, Pseudomonas aeruginosa PA01
gccaggcgaagaaagccccugc

SEQ ID NO: 1512636 - RNA, 16 nt, Pseudomonas aeruginosa PA01
gccaggccgccgaaga

SEQ ID NO: 1512637 - RNA, 19 nt, Pseudomonas aeruginosa PA01
gccaggccgccgaagaacu

SEQ ID NO: 1512638 - RNA, 21 nt, Pseudomonas aeruginosa PA01
gccaggccggagccgcguuca

SEQ ID NO: 1512639 - RNA, 16 nt, Pseudomonas aeruginosa PA01
gccaggccggcgcauc

SEQ ID NO: 1512640 - RNA, 22 nt, Pseudomonas aeruginosa PA01
gccaggccgcgcagucccgcgc

SEQ ID NO: 1512641 - RNA, 13 nt, Pseudomonas aeruginosa PA01
gccaggcagaccu

SEQ ID NO: 1512642 - RNA, 16 nt, Pseudomonas aeruginosa PA01
gccaggcaccaccucg

SEQ ID NO: 1512643 - RNA, 19 nt, Pseudomonas aeruginosa PA01
gccaggagcuugccgaaga

SEQ ID NO: 1512644 - RNA, 22 nt, Pseudomonas aeruginosa PA01
gccaggaggauucgccagccuc

SEQ ID NO: 1512645 - RNA, 20 nt, Pseudomonas aeruginosa PA01
gccaggaucagucccuugau

SEQ ID NO: 1512646 - RNA, 20 nt, Pseudomonas aeruginosa PA01
gccaggagcaucggcgcggc

SEQ ID NO: 1512647 - RNA, 22 nt, Pseudomonas aeruginosa PA01
gccaggagcaucggcgcggccu

SEQ ID NO: 1512648 - RNA, 14 nt, Pseudomonas aeruginosa PA01
gccagccuuccucg

SEQ ID NO: 1512649 - RNA, 18 nt, Pseudomonas aeruginosa PA01
gccagccugcagccagcu

SEQ ID NO: 1512650 - RNA, 14 nt, Pseudomonas aeruginosa PA01
gccagccgcgcggc

SEQ ID NO: 1512651 - RNA, 11 nt, Pseudomonas aeruginosa PA01
gccagccgcgc

SEQ ID NO: 1512652 - RNA, 14 nt, Pseudomonas aeruginosa PA01
gccagccgcccugg

SEQ ID NO: 1512653 - RNA, 12 nt, Pseudomonas aeruginosa PA01
gccagccgagca

SEQ ID NO: 1512654 - RNA, 14 nt, Pseudomonas aeruginosa PA01
gccagccgccagga

SEQ ID NO: 1512655 - RNA, 14 nt, Pseudomonas aeruginosa PA01
gccagcgccuggcg

SEQ ID NO: 1512656 - RNA, 16 nt, Pseudomonas aeruginosa PA01
gccagcgagacgggcg

SEQ ID NO: 1512657 - RNA, 18 nt, Pseudomonas aeruginosa PA01
gccagcgagacgggcgag

SEQ ID NO: 1512658 - RNA, 15 nt, Pseudomonas aeruginosa PA01
gccagcgcccaggcc

SEQ ID NO: 1512659 - RNA, 18 nt, Pseudomonas aeruginosa PA01
gccagcgcccaggccggg

SEQ ID NO: 1512660 - RNA, 21 nt, Pseudomonas aeruginosa PA01
gccagcgcccaggccgggucg

SEQ ID NO: 1512661 - RNA, 18 nt, Pseudomonas aeruginosa PA01
gccagcggcauccgccgc

SEQ ID NO: 1512662 - RNA, 15 nt, Pseudomonas aeruginosa PA01
gccagcggccagggc

SEQ ID NO: 1512663 - RNA, 18 nt, Pseudomonas aeruginosa PA01
gccagcgugaagaccugg

SEQ ID NO: 1512664 - RNA, 10 nt, Pseudomonas aeruginosa PA01
gccagcggca

SEQ ID NO: 1512665 - RNA, 20 nt, Pseudomonas aeruginosa PA01
gccauguacguaucccagcg

SEQ ID NO: 1512666 - RNA, 19 nt, Pseudomonas aeruginosa PA01
gccauuccuuccaggguuu

SEQ ID NO: 1512667 - RNA, 14 nt, Pseudomonas aeruginosa PA01
gccauucgccgcga

SEQ ID NO: 1512668 - RNA, 22 nt, Pseudomonas aeruginosa PA01
gccauucgccgcgacgcuccag

SEQ ID NO: 1512669 - RNA, 17 nt, Pseudomonas aeruginosa PA01
gccauucgcuucggcca

SEQ ID NO: 1512670 - RNA, 17 nt, Pseudomonas aeruginosa PA01
gccauucggccuggcag

SEQ ID NO: 1512671 - RNA, 17 nt, Pseudomonas aeruginosa PA01
gccauucggcuuccugg

SEQ ID NO: 1512672 - RNA, 23 nt, Pseudomonas aeruginosa PA01
gccauugccgaugugcacgcuga

SEQ ID NO: 1512673 - RNA, 14 nt, Pseudomonas aeruginosa PA01
gccauugccgccag

SEQ ID NO: 1512674 - RNA, 19 nt, Pseudomonas aeruginosa PA01
gccauggucguucagcggc

SEQ ID NO: 1512675 - RNA, 15 nt, Pseudomonas aeruginosa PA01
gccauggggaucacc

SEQ ID NO: 1512676 - RNA, 23 nt, Pseudomonas aeruginosa PA01
gccauggcgggucacgccgaagu

SEQ ID NO: 1512677 - RNA, 19 nt, Pseudomonas aeruginosa PA01
gccauggcgguuccuccau

SEQ ID NO: 1512678 - RNA, 15 nt, Pseudomonas aeruginosa PA01
gccauggcauccccu

SEQ ID NO: 1512679 - RNA, 13 nt, Pseudomonas aeruginosa PA01
gccaucuuccugu

SEQ ID NO: 1512680 - RNA, 23 nt, Pseudomonas aeruginosa PA01
gccaucuuccugugcgaggcugg

SEQ ID NO: 1512681 - RNA, 15 nt, Pseudomonas aeruginosa PA01
gccaugacccgcggc

SEQ ID NO: 1512682 - RNA, 16 nt, Pseudomonas aeruginosa PA01
gccaugacccgcggca

SEQ ID NO: 1512683 - RNA, 17 nt, Pseudomonas aeruginosa PA01
gccaugagcagggcgga

SEQ ID NO: 1512684 - RNA, 14 nt, Pseudomonas aeruginosa PA01
gccaucagcgccag

SEQ ID NO: 1512685 - RNA, 17 nt, Pseudomonas aeruginosa PA01
gccaucagcaccaggaa

SEQ ID NO: 1512686 - RNA, 22 nt, Pseudomonas aeruginosa PA01
gccaucagcaccaggaagcccc

SEQ ID NO: 1512687 - RNA, 24 nt, Pseudomonas aeruginosa PA01
gccaucagcacgaaagccaugccc

SEQ ID NO: 1512688 - RNA, 16 nt, Pseudomonas aeruginosa PA01
gccaucaggccgcggc

SEQ ID NO: 1512689 - RNA, 22 nt, Pseudomonas aeruginosa PA01
gccaucgaggccaggccgagcg

SEQ ID NO: 1512690 - RNA, 23 nt, Pseudomonas aeruginosa PA01
gccaucgaggccaggccgagcgc

SEQ ID NO: 1512691 - RNA, 12 nt, Pseudomonas aeruginosa PA01
gccaucgaucag

SEQ ID NO: 1512692 - RNA, 20 nt, Pseudomonas aeruginosa PA01
gccaucgauggucacuggcg

SEQ ID NO: 1512693 - RNA, 21 nt, Pseudomonas aeruginosa PA01
gccaucgauggucacuggcga

SEQ ID NO: 1512694 - RNA, 16 nt, Pseudomonas aeruginosa PA01
gccaucgauggucagg

SEQ ID NO: 1512695 - RNA, 14 nt, Pseudomonas aeruginosa PA01
gccauccuugaguu

SEQ ID NO: 1512696 - RNA, 19 nt, Pseudomonas aeruginosa PA01
gccauccuccagcgccgca

SEQ ID NO: 1512697 - RNA, 22 nt, Pseudomonas aeruginosa PA01
gccaguagucuuccugggagaa

SEQ ID NO: 1512698 - RNA, 18 nt, Pseudomonas aeruginosa PA01
gccaguaguccuccgcgc

SEQ ID NO: 1512699 - RNA, 16 nt, Pseudomonas aeruginosa PA01
gccagguuuccggcag

SEQ ID NO: 1512700 - RNA, 21 nt, Pseudomonas aeruginosa PA01
gccagguuuccggcagcacgu

SEQ ID NO: 1512701 - RNA, 21 nt, Pseudomonas aeruginosa PA01
gccagguugcguuccaacugg

SEQ ID NO: 1512702 - RNA, 22 nt, Pseudomonas aeruginosa PA01
gccagguuggccuggcccggcg

SEQ ID NO: 1512703 - RNA, 20 nt, Pseudomonas aeruginosa PA01
gccagguugcgcaaccagcg

SEQ ID NO: 1512704 - RNA, 20 nt, Pseudomonas aeruginosa PA01
gccagucccgcaaagcccgc

SEQ ID NO: 1512705 - RNA, 15 nt, Pseudomonas aeruginosa PA01
gcccacaaagucacu

SEQ ID NO: 1512706 - RNA, 17 nt, Pseudomonas aeruginosa PA01
gcccaagccgagcggca

SEQ ID NO: 1512707 - RNA, 23 nt, Pseudomonas aeruginosa PA01
gcccaagccgagcggcaaggcca

SEQ ID NO: 1512708 - RNA, 15 nt, Pseudomonas aeruginosa PA01
gcccaauacccacag

SEQ ID NO: 1512709 - RNA, 20 nt, Pseudomonas aeruginosa PA01
gcccaccaccaggaccaugu

SEQ ID NO: 1512710 - RNA, 14 nt, Pseudomonas aeruginosa PA01
gcccaccaccaccg

SEQ ID NO: 1512711 - RNA, 13 nt, Pseudomonas aeruginosa PA01
gcccacagugcca

SEQ ID NO: 1512712 - RNA, 16 nt, Pseudomonas aeruginosa PA01
gcccacagugccaggc

SEQ ID NO: 1512713 - RNA, 23 nt, Pseudomonas aeruginosa PA01
gcccacagugccaggcucgccgc

SEQ ID NO: 1512714 - RNA, 20 nt, Pseudomonas aeruginosa PA01
gccauuguucuuuggccaau

SEQ ID NO: 1512715 - RNA, 18 nt, Pseudomonas aeruginosa PA01
gcccacccugcgcgagga

SEQ ID NO: 1512716 - RNA, 16 nt, Pseudomonas aeruginosa PA01
gcccacgcgccuggcc

SEQ ID NO: 1512717 - RNA, 20 nt, Pseudomonas aeruginosa PA01
gcccacgccuugcagcaccg

SEQ ID NO: 1512718 - RNA, 15 nt, Pseudomonas aeruginosa PA01
gcccacggccaggcc

SEQ ID NO: 1512719 - RNA, 16 nt, Pseudomonas aeruginosa PA01
gcccacggccaggccc

SEQ ID NO: 1512720 - RNA, 14 nt, Pseudomonas aeruginosa PA01
gcccagaacagcaa

SEQ ID NO: 1512721 - RNA, 16 nt, Pseudomonas aeruginosa PA01
gcccagcgccgccagc

SEQ ID NO: 1512722 - RNA, 17 nt, Pseudomonas aeruginosa PA01
gcccagcgccgccagca

SEQ ID NO: 1512723 - RNA, 19 nt, Pseudomonas aeruginosa PA01
gcccagcgccgccagcagg

SEQ ID NO: 1512724 - RNA, 16 nt, Pseudomonas aeruginosa PA01
gcccagcgccgccugc

SEQ ID NO: 1512725 - RNA, 19 nt, Pseudomonas aeruginosa PA01
gcccagcgccgccugcugg

SEQ ID NO: 1512726 - RNA, 20 nt, Pseudomonas aeruginosa PA01
gcccagcgccgccugcuggc

SEQ ID NO: 1512727 - RNA, 14 nt, Pseudomonas aeruginosa PA01
gcccagcgccccgc

SEQ ID NO: 1512728 - RNA, 13 nt, Pseudomonas aeruginosa PA01
gcccagcgccgcc

SEQ ID NO: 1512729 - RNA, 13 nt, Pseudomonas aeruginosa PA01
gcccagccagagc

SEQ ID NO: 1512730 - RNA, 14 nt, Pseudomonas aeruginosa PA01
gcccagccagagcg

SEQ ID NO: 1512731 - RNA, 15 nt, Pseudomonas aeruginosa PA01
gcccagccagagcgu

SEQ ID NO: 1512732 - RNA, 15 nt, Pseudomonas aeruginosa PA01
gcccagcgcaggccg

SEQ ID NO: 1512733 - RNA, 16 nt, Pseudomonas aeruginosa PA01
gcccagcaggccggcc

SEQ ID NO: 1512734 - RNA, 14 nt, Pseudomonas aeruginosa PA01
gcccagcaggcgcg

SEQ ID NO: 1512735 - RNA, 12 nt, Pseudomonas aeruginosa PA01
gcccagcaggcu

SEQ ID NO: 1512736 - RNA, 13 nt, Pseudomonas aeruginosa PA01
gcccagcaggcug

SEQ ID NO: 1512737 - RNA, 14 nt, Pseudomonas aeruginosa PA01
gcccagcaggcugc

SEQ ID NO: 1512738 - RNA, 23 nt, Pseudomonas aeruginosa PA01
gcccagcaggcugcugcugcggc

SEQ ID NO: 1512739 - RNA, 23 nt, Pseudomonas aeruginosa PA01
gcccagcagggccagccagagcc

SEQ ID NO: 1512740 - RNA, 20 nt, Pseudomonas aeruginosa PA01
gcccagaugaucaggccgag

SEQ ID NO: 1512741 - RNA, 13 nt, Pseudomonas aeruginosa PA01
gcccagcagcgcu

SEQ ID NO: 1512742 - RNA, 16 nt, Pseudomonas aeruginosa PA01
gcccagagcagcacca

SEQ ID NO: 1512743 - RNA, 12 nt, Pseudomonas aeruginosa PA01
gcccagacccca

SEQ ID NO: 1512744 - RNA, 15 nt, Pseudomonas aeruginosa PA01
gcuaucgcuggcgca

SEQ ID NO: 1512745 - RNA, 21 nt, Pseudomonas aeruginosa PA01
gcuaucgcuggcgcagccgcu

SEQ ID NO: 1512746 - RNA, 15 nt, Pseudomonas aeruginosa PA01
gcuaucgcuuucagc

SEQ ID NO: 1512747 - RNA, 19 nt, Pseudomonas aeruginosa PA01
gcuaugggcaccgcgccgg

SEQ ID NO: 1512748 - RNA, 14 nt, Pseudomonas aeruginosa PA01
gcucacgccccagc

SEQ ID NO: 1512749 - RNA, 16 nt, Pseudomonas aeruginosa PA01
gcucacgcaucccuuc

SEQ ID NO: 1512750 - RNA, 15 nt, Pseudomonas aeruginosa PA01
gcucaacggcgugcc

SEQ ID NO: 1512751 - RNA, 17 nt, Pseudomonas aeruginosa PA01
gcucaacgccucgcggc

SEQ ID NO: 1512752 - RNA, 19 nt, Pseudomonas aeruginosa PA01
gcuccgcgauguccccggc

SEQ ID NO: 1512753 - RNA, 23 nt, Pseudomonas aeruginosa PA01
gcuccgcgauguccccggccagc

SEQ ID NO: 1512754 - RNA, 17 nt, Pseudomonas aeruginosa PA01
gcuccgcgcguucagcc

SEQ ID NO: 1512755 - RNA, 14 nt, Pseudomonas aeruginosa PA01
gcuccgcggccggc

SEQ ID NO: 1512756 - RNA, 16 nt, Pseudomonas aeruginosa PA01
gcuccgccgaacgcca

SEQ ID NO: 1512757 - RNA, 21 nt, Pseudomonas aeruginosa PA01
gcuccgccgaacgccaccagg

SEQ ID NO: 1512758 - RNA, 17 nt, Pseudomonas aeruginosa PA01
gcuccgccaggccgcgc

SEQ ID NO: 1512759 - RNA, 18 nt, Pseudomonas aeruginosa PA01
gcuccggauggcugaccc

SEQ ID NO: 1512760 - RNA, 14 nt, Pseudomonas aeruginosa PA01
gcuccggcgccagg

SEQ ID NO: 1512761 - RNA, 19 nt, Pseudomonas aeruginosa PA01
gcuccggcgcgccauggcg

SEQ ID NO: 1512762 - RNA, 13 nt, Pseudomonas aeruginosa PA01
gcuccggcgggcg

SEQ ID NO: 1512763 - RNA, 16 nt, Pseudomonas aeruginosa PA01
gcucccccgcgccgcc

SEQ ID NO: 1512764 - RNA, 23 nt, Pseudomonas aeruginosa PA01
gcucccccacguacuccagcaac

SEQ ID NO: 1512765 - RNA, 19 nt, Pseudomonas aeruginosa PA01
gcuccccacucggccagca

SEQ ID NO: 1512766 - RNA, 14 nt, Pseudomonas aeruginosa PA01
gcucccgcaaccug

SEQ ID NO: 1512767 - RNA, 18 nt, Pseudomonas aeruginosa PA01
gcuccccuggagcccccg

SEQ ID NO: 1512768 - RNA, 19 nt, Pseudomonas aeruginosa PA01
gcuccccuggagcccccgu

SEQ ID NO: 1512769 - RNA, 18 nt, Pseudomonas aeruginosa PA01
gcuccccgucccucaggu

SEQ ID NO: 1512770 - RNA, 18 nt, Pseudomonas aeruginosa PA01
gcucccgcggcccaaggg

SEQ ID NO: 1512771 - RNA, 21 nt, Pseudomonas aeruginosa PA01
gcucgaucggcagggcgccga

SEQ ID NO: 1512772 - RNA, 14 nt, Pseudomonas aeruginosa PA01
gcucgaggccagga

SEQ ID NO: 1512773 - RNA, 16 nt, Pseudomonas aeruginosa PA01
gcucgaggccaggauc

SEQ ID NO: 1512774 - RNA, 12 nt, Pseudomonas aeruginosa PA01
gcucgcccaucu

SEQ ID NO: 1512775 - RNA, 15 nt, Pseudomonas aeruginosa PA01
gcucgcccagcaggc

SEQ ID NO: 1512776 - RNA, 15 nt, Pseudomonas aeruginosa PA01
gcucgcccgccucgg

SEQ ID NO: 1512777 - RNA, 19 nt, Pseudomonas aeruginosa PA01
gcucgccgccagcaggauc

SEQ ID NO: 1512778 - RNA, 15 nt, Pseudomonas aeruginosa PA01
gcucgcccuugcgcc

SEQ ID NO: 1512779 - RNA, 22 nt, Pseudomonas aeruginosa PA01
gcuccuggaugcuccgcgccuc

SEQ ID NO: 1512780 - RNA, 15 nt, Pseudomonas aeruginosa PA01
gcuccuggcaggcuc

SEQ ID NO: 1512781 - RNA, 23 nt, Pseudomonas aeruginosa PA01
gcuccuugaaggcuuccuggaag

SEQ ID NO: 1512782 - RNA, 15 nt, Pseudomonas aeruginosa PA01
gcuccuugagcagcu

SEQ ID NO: 1512783 - RNA, 16 nt, Pseudomonas aeruginosa PA01
gcuccuguugcuggcc

SEQ ID NO: 1512784 - RNA, 14 nt, Pseudomonas aeruginosa PA01
gcuccuuggcuggc

SEQ ID NO: 1512785 - RNA, 23 nt, Pseudomonas aeruginosa PA01
gcucacggccgaacagacgcagg

SEQ ID NO: 1512786 - RNA, 22 nt, Pseudomonas aeruginosa PA01
gcucagccguggcacccaggcc

SEQ ID NO: 1512787 - RNA, 13 nt, Pseudomonas aeruginosa PA01
gcucacguagccc

SEQ ID NO: 1512788 - RNA, 18 nt, Pseudomonas aeruginosa PA01
gcucagcggcccagcgcc

SEQ ID NO: 1512789 - RNA, 11 nt, Pseudomonas aeruginosa PA01
gcucauggcgc

SEQ ID NO: 1512790 - RNA, 14 nt, Pseudomonas aeruginosa PA01
gcucaucucguuga

SEQ ID NO: 1512791 - RNA, 15 nt, Pseudomonas aeruginosa PA01
gcucaucugcaccac

SEQ ID NO: 1512792 - RNA, 20 nt, Pseudomonas aeruginosa PA01
gcucaugagauccgccagca

SEQ ID NO: 1512793 - RNA, 23 nt, Pseudomonas aeruginosa PA01
gcucaugaacacgguguagaccu

SEQ ID NO: 1512794 - RNA, 15 nt, Pseudomonas aeruginosa PA01
gcucagcgccggcca

SEQ ID NO: 1512795 - RNA, 14 nt, Pseudomonas aeruginosa PA01
gcuccagcggcagc

SEQ ID NO: 1512796 - RNA, 19 nt, Pseudomonas aeruginosa PA01
gcuccagcggcagcucggc

SEQ ID NO: 1512797 - RNA, 16 nt, Pseudomonas aeruginosa PA01
gcuccagcuccuccag

SEQ ID NO: 1512798 - RNA, 20 nt, Pseudomonas aeruginosa PA01
gcuccagcgugcccgcugca

SEQ ID NO: 1512799 - RNA, 13 nt, Pseudomonas aeruginosa PA01
gcuccaccaggcc

SEQ ID NO: 1512800 - RNA, 22 nt, Pseudomonas aeruginosa PA01
gcuccaccaggccauagcgcgc

SEQ ID NO: 1512801 - RNA, 15 nt, Pseudomonas aeruginosa PA01
gcuccacacccgguc

SEQ ID NO: 1512802 - RNA, 14 nt, Pseudomonas aeruginosa PA01
gcuccacagcugcc

SEQ ID NO: 1512803 - RNA, 15 nt, Pseudomonas aeruginosa PA01
gcuccacagcugcca

SEQ ID NO: 1512804 - RNA, 12 nt, Pseudomonas aeruginosa PA01
gcuccaggcugu

SEQ ID NO: 1512805 - RNA, 16 nt, Pseudomonas aeruginosa PA01
gcuccaggugcacggc

SEQ ID NO: 1512806 - RNA, 15 nt, Pseudomonas aeruginosa PA01
gcuccagggcugcca

SEQ ID NO: 1512807 - RNA, 13 nt, Pseudomonas aeruginosa PA01
gcuccaggggagc

SEQ ID NO: 1512808 - RNA, 23 nt, Pseudomonas aeruginosa PA01
gcuccagggcgaauaccagugcc

SEQ ID NO: 1512809 - RNA, 15 nt, Pseudomonas aeruginosa PA01
gcuccagggcggccc

SEQ ID NO: 1512810 - RNA, 21 nt, Pseudomonas aeruginosa PA01
gcucccaccgcuuucagcgcc

SEQ ID NO: 1512811 - RNA, 16 nt, Pseudomonas aeruginosa PA01
gcugacuuccaucagc

SEQ ID NO: 1512812 - RNA, 19 nt, Pseudomonas aeruginosa PA01
gcugacgucgacgcagcgc

SEQ ID NO: 1512813 - RNA, 24 nt, Pseudomonas aeruginosa PA01
gcugacgucgacgcagcgcgcguc

SEQ ID NO: 1512814 - RNA, 16 nt, Pseudomonas aeruginosa PA01
gcugagcagcaggugg

SEQ ID NO: 1512815 - RNA, 23 nt, Pseudomonas aeruginosa PA01
gcugaggaucacgauggccggca

SEQ ID NO: 1512816 - RNA, 15 nt, Pseudomonas aeruginosa PA01
gcugaggaucagcca

SEQ ID NO: 1512817 - RNA, 22 nt, Pseudomonas aeruginosa PA01
gcugaggaucagccagccggcg

SEQ ID NO: 1512818 - RNA, 20 nt, Pseudomonas aeruginosa PA01
gcugaggccguagccgaacg

SEQ ID NO: 1512819 - RNA, 18 nt, Pseudomonas aeruginosa PA01
gcugaggaagagcagcgc

SEQ ID NO: 1512820 - RNA, 16 nt, Pseudomonas aeruginosa PA01
gcugaggucgcgggcg

SEQ ID NO: 1512821 - RNA, 13 nt, Pseudomonas aeruginosa PA01
gcugagcggcugg

SEQ ID NO: 1512822 - RNA, 18 nt, Pseudomonas aeruginosa PA01
gcugagcuguuucagccc

SEQ ID NO: 1512823 - RNA, 18 nt, Pseudomonas aeruginosa PA01
gcugagcaguugcgggcg

SEQ ID NO: 1512824 - RNA, 20 nt, Pseudomonas aeruginosa PA01
gcugagcaguugcgggcgca

SEQ ID NO: 1512825 - RNA, 14 nt, Pseudomonas aeruginosa PA01
gcugagcgccaggc

SEQ ID NO: 1512826 - RNA, 13 nt, Pseudomonas aeruginosa PA01
gcugagcgcgguc

SEQ ID NO: 1512827 - RNA, 18 nt, Pseudomonas aeruginosa PA01
gcugagcgcggucaccca

SEQ ID NO: 1512828 - RNA, 21 nt, Pseudomonas aeruginosa PA01
gcugaugccguucucccgcgc

SEQ ID NO: 1512829 - RNA, 15 nt, Pseudomonas aeruginosa PA01
gcugaucaucagcag

SEQ ID NO: 1512830 - RNA, 16 nt, Pseudomonas aeruginosa PA01
gcugaucaucagcagg

SEQ ID NO: 1512831 - RNA, 22 nt, Pseudomonas aeruginosa PA01
gcugaucagcuucuucagcagc

SEQ ID NO: 1512832 - RNA, 15 nt, Pseudomonas aeruginosa PA01
gcugaggggugagaa

SEQ ID NO: 1512833 - RNA, 21 nt, Pseudomonas aeruginosa PA01
gcugagucgcuucacucaucc

SEQ ID NO: 1512834 - RNA, 16 nt, Pseudomonas aeruginosa PA01
gcugaguuugcccagc

SEQ ID NO: 1512835 - RNA, 17 nt, Pseudomonas aeruginosa PA01
gcugaguuugcccagcg

SEQ ID NO: 1512836 - RNA, 21 nt, Pseudomonas aeruginosa PA01
gcugacgaacaucgccagcgc

SEQ ID NO: 1512837 - RNA, 17 nt, Pseudomonas aeruginosa PA01
gcugacgaaguccuugu

SEQ ID NO: 1512838 - RNA, 19 nt, Pseudomonas aeruginosa PA01
gcugaccgcucccaggcaa

SEQ ID NO: 1512839 - RNA, 15 nt, Pseudomonas aeruginosa PA01
gcugacccgcugcug

SEQ ID NO: 1512840 - RNA, 19 nt, Pseudomonas aeruginosa PA01
gcugacccaguagggcccg

SEQ ID NO: 1512841 - RNA, 18 nt, Pseudomonas aeruginosa PA01
gcugaccagcccggcggc

SEQ ID NO: 1512842 - RNA, 18 nt, Pseudomonas aeruginosa PA01
gcugacauccaccagggu

SEQ ID NO: 1512843 - RNA, 21 nt, Pseudomonas aeruginosa PA01
gcugaauucccgcuccaggcc

SEQ ID NO: 1512844 - RNA, 17 nt, Pseudomonas aeruginosa PA01
gcugaaggucgccgcgc

SEQ ID NO: 1512845 - RNA, 17 nt, Pseudomonas aeruginosa PA01
gcugaaggacugugccu

SEQ ID NO: 1512846 - RNA, 14 nt, Pseudomonas aeruginosa PA01
gcugaacagcuggc

SEQ ID NO: 1512847 - RNA, 19 nt, Pseudomonas aeruginosa PA01
gcugaacagcgccaccagc

SEQ ID NO: 1512848 - RNA, 16 nt, Pseudomonas aeruginosa PA01
gcugaacaagcccugg

SEQ ID NO: 1512849 - RNA, 18 nt, Pseudomonas aeruginosa PA01
gcugaacaagcccuggug

SEQ ID NO: 1512850 - RNA, 22 nt, Pseudomonas aeruginosa PA01
gcugaacaagcccuggugguga

SEQ ID NO: 1512851 - RNA, 22 nt, Pseudomonas aeruginosa PA01
gcugaagauaucgccuuccucg

SEQ ID NO: 1512852 - RNA, 17 nt, Pseudomonas aeruginosa PA01
gcugaagcccaggcguc

SEQ ID NO: 1512853 - RNA, 23 nt, Pseudomonas aeruginosa PA01
gcucucgaacaccaggcgccagg

SEQ ID NO: 1512854 - RNA, 16 nt, Pseudomonas aeruginosa PA01
gcucucgaacaccggc

SEQ ID NO: 1512855 - RNA, 15 nt, Pseudomonas aeruginosa PA01
gcucucgaacagcag

SEQ ID NO: 1512856 - RNA, 19 nt, Pseudomonas aeruginosa PA01
gcucucgaacagcagcaag

SEQ ID NO: 1512857 - RNA, 15 nt, Pseudomonas aeruginosa PA01
gcucucgccggccug

SEQ ID NO: 1512858 - RNA, 17 nt, Pseudomonas aeruginosa PA01
gcucucggugaccacca

SEQ ID NO: 1512859 - RNA, 19 nt, Pseudomonas aeruginosa PA01
gcucgucggcguugcugau

SEQ ID NO: 1512860 - RNA, 15 nt, Pseudomonas aeruginosa PA01
gcucgucacccgcgc

SEQ ID NO: 1512861 - RNA, 18 nt, Pseudomonas aeruginosa PA01
gcucgucacccgcgccug

SEQ ID NO: 1512862 - RNA, 14 nt, Pseudomonas aeruginosa PA01
gcucgguuccagcu

SEQ ID NO: 1512863 - RNA, 15 nt, Pseudomonas aeruginosa PA01
gcucgccgccgggcg

SEQ ID NO: 1512864 - RNA, 18 nt, Pseudomonas aeruginosa PA01
gcucgccgccgggcgcgc

SEQ ID NO: 1512865 - RNA, 14 nt, Pseudomonas aeruginosa PA01
gcucgccgcugaag

SEQ ID NO: 1512866 - RNA, 21 nt, Pseudomonas aeruginosa PA01
gcucgccgcugaaguccuggc

SEQ ID NO: 1512867 - RNA, 22 nt, Pseudomonas aeruginosa PA01
gcucgccgcugaaguccuggcc

SEQ ID NO: 1512868 - RNA, 17 nt, Pseudomonas aeruginosa PA01
gcucguucgcccagacc

SEQ ID NO: 1512869 - RNA, 18 nt, Pseudomonas aeruginosa PA01
gcucguucaugucggcuc

SEQ ID NO: 1512870 - RNA, 14 nt, Pseudomonas aeruginosa PA01
gcucguuggcggcc

SEQ ID NO: 1512871 - RNA, 18 nt, Pseudomonas aeruginosa PA01
gcucguccaggccgcagg

SEQ ID NO: 1512872 - RNA, 14 nt, Pseudomonas aeruginosa PA01
gcucgucuuucagg

SEQ ID NO: 1512873 - RNA, 12 nt, Pseudomonas aeruginosa PA01
gcucugcagugc

SEQ ID NO: 1512874 - RNA, 15 nt, Pseudomonas aeruginosa PA01
gcucugcgccaggcg

SEQ ID NO: 1512875 - RNA, 15 nt, Pseudomonas aeruginosa PA01
gcucugccggugugc

SEQ ID NO: 1512876 - RNA, 14 nt, Pseudomonas aeruginosa PA01
gcucugcuggccac

SEQ ID NO: 1512877 - RNA, 17 nt, Pseudomonas aeruginosa PA01
gcucugcuggccacccu

SEQ ID NO: 1512878 - RNA, 17 nt, Pseudomonas aeruginosa PA01
gcucugcuggccgcccu

SEQ ID NO: 1512879 - RNA, 16 nt, Pseudomonas aeruginosa PA01
gcucugcuucuguccc

SEQ ID NO: 1512880 - RNA, 18 nt, Pseudomonas aeruginosa PA01
gcucugcuucugucccug

SEQ ID NO: 1512881 - RNA, 20 nt, Pseudomonas aeruginosa PA01
gcucugcuccagcaaugcca

SEQ ID NO: 1512882 - RNA, 23 nt, Pseudomonas aeruginosa PA01
gcucugcugaauucccgcuccag

SEQ ID NO: 1512883 - RNA, 18 nt, Pseudomonas aeruginosa PA01
gcucugggcauggcuggc

SEQ ID NO: 1512884 - RNA, 15 nt, Pseudomonas aeruginosa PA01
gcucuggguacagug

SEQ ID NO: 1512885 - RNA, 18 nt, Pseudomonas aeruginosa PA01
gcucugguucggcgucuu

SEQ ID NO: 1512886 - RNA, 16 nt, Pseudomonas aeruginosa PA01
gcucuggccguccugc

SEQ ID NO: 1512887 - RNA, 19 nt, Pseudomonas aeruginosa PA01
gcucuggccguucuccagg

SEQ ID NO: 1512888 - RNA, 21 nt, Pseudomonas aeruginosa PA01
gcucuggcgcauagcggccau

SEQ ID NO: 1512889 - RNA, 19 nt, Pseudomonas aeruginosa PA01
gcucuggaugcggcgcugc

SEQ ID NO: 1512890 - RNA, 22 nt, Pseudomonas aeruginosa PA01
gcucuuuccgggucauuggcga

SEQ ID NO: 1512891 - RNA, 21 nt, Pseudomonas aeruginosa PA01
gcucuucugguaggccagcag

SEQ ID NO: 1512892 - RNA, 16 nt, Pseudomonas aeruginosa PA01
gcucuucggcggccag

SEQ ID NO: 1512893 - RNA, 21 nt, Pseudomonas aeruginosa PA01
gcucuucgccaguuccuugag

SEQ ID NO: 1512894 - RNA, 19 nt, Pseudomonas aeruginosa PA01
gcucuuccaggugauccau

SEQ ID NO: 1512895 - RNA, 21 nt, Pseudomonas aeruginosa PA01
gcucuuccaggugauccaugu

SEQ ID NO: 1512896 - RNA, 21 nt, Pseudomonas aeruginosa PA01
gcgucgccuuccaccaccagg

SEQ ID NO: 1512897 - RNA, 16 nt, Pseudomonas aeruginosa PA01
gcgucggccgcucggc

SEQ ID NO: 1512898 - RNA, 16 nt, Pseudomonas aeruginosa PA01
gcgucgcugccgccgc

SEQ ID NO: 1512899 - RNA, 13 nt, Pseudomonas aeruginosa PA01
gcgucgccgggcg

SEQ ID NO: 1512900 - RNA, 15 nt, Pseudomonas aeruginosa PA01
gcgucgccggccgcu

SEQ ID NO: 1512901 - RNA, 16 nt, Pseudomonas aeruginosa PA01
gcgucgcgcggccagc

SEQ ID NO: 1512902 - RNA, 16 nt, Pseudomonas aeruginosa PA01
gcgucgcgcguccagc

SEQ ID NO: 1512903 - RNA, 17 nt, Pseudomonas aeruginosa PA01
gcgucgccugccaggcg

SEQ ID NO: 1512904 - RNA, 20 nt, Pseudomonas aeruginosa PA01
gcgucgccuucggagaacag

SEQ ID NO: 1512905 - RNA, 21 nt, Pseudomonas aeruginosa PA01
gcgucggcggcacccucuucc

SEQ ID NO: 1512906 - RNA, 19 nt, Pseudomonas aeruginosa PA01
gcgucggcgcgggcgccga

SEQ ID NO: 1512907 - RNA, 17 nt, Pseudomonas aeruginosa PA01
gcgucggcugcgcuggg

SEQ ID NO: 1512908 - RNA, 23 nt, Pseudomonas aeruginosa PA01
gcgucgggaaaggccgccacggc

SEQ ID NO: 1512909 - RNA, 13 nt, Pseudomonas aeruginosa PA01
gcgucggcgccuu

SEQ ID NO: 1512910 - RNA, 22 nt, Pseudomonas aeruginosa PA01
gcgucggcccuugugaaagggc

SEQ ID NO: 1512911 - RNA, 22 nt, Pseudomonas aeruginosa PA01
gcgucggccuggcgcagcggca

SEQ ID NO: 1512912 - RNA, 22 nt, Pseudomonas aeruginosa PA01
gcgucggcgaacccggcgcggc

SEQ ID NO: 1512913 - RNA, 14 nt, Pseudomonas aeruginosa PA01
gcgucguccagggc

SEQ ID NO: 1512914 - RNA, 18 nt, Pseudomonas aeruginosa PA01
gcgucggugccgcccggc

SEQ ID NO: 1512915 - RNA, 19 nt, Pseudomonas aeruginosa PA01
gcgucggugccgcccggcg

SEQ ID NO: 1512916 - RNA, 15 nt, Pseudomonas aeruginosa PA01
gcgucgugcgccggc

SEQ ID NO: 1512917 - RNA, 12 nt, Pseudomonas aeruginosa PA01
gcgucuccagcu

SEQ ID NO: 1512918 - RNA, 18 nt, Pseudomonas aeruginosa PA01
gcgucguuguugcgggcg

SEQ ID NO: 1512919 - RNA, 14 nt, Pseudomonas aeruginosa PA01
gcgugccgcuggcc

SEQ ID NO: 1512920 - RNA, 15 nt, Pseudomonas aeruginosa PA01
gcgugccgggccggc

SEQ ID NO: 1512921 - RNA, 20 nt, Pseudomonas aeruginosa PA01
gcgugccgcaggccgcggcc

SEQ ID NO: 1512922 - RNA, 15 nt, Pseudomonas aeruginosa PA01
gcgugccgccaggcc

SEQ ID NO: 1512923 - RNA, 22 nt, Pseudomonas aeruginosa PA01
gcgugccguggcucggcggcag

SEQ ID NO: 1512924 - RNA, 12 nt, Pseudomonas aeruginosa PA01
gcgugcgagggc

SEQ ID NO: 1512925 - RNA, 15 nt, Pseudomonas aeruginosa PA01
gcgugcgagggcggc

SEQ ID NO: 1512926 - RNA, 14 nt, Pseudomonas aeruginosa PA01
gcgugcgccgcucg

SEQ ID NO: 1512927 - RNA, 21 nt, Pseudomonas aeruginosa PA01
gcgugcgccgcucgcgcacgg

SEQ ID NO: 1512928 - RNA, 15 nt, Pseudomonas aeruginosa PA01
gcgugcgcgccgccg

SEQ ID NO: 1512929 - RNA, 19 nt, Pseudomonas aeruginosa PA01
gcguggcccggcgcggcgg

SEQ ID NO: 1512930 - RNA, 14 nt, Pseudomonas aeruginosa PA01
gcguggcgucggcg

SEQ ID NO: 1512931 - RNA, 22 nt, Pseudomonas aeruginosa PA01
gcguggcggacaacccggcgcu

SEQ ID NO: 1512932 - RNA, 17 nt, Pseudomonas aeruginosa PA01
gcguggcggccgccggc

SEQ ID NO: 1512933 - RNA, 14 nt, Pseudomonas aeruginosa PA01
gcguggccagcgcc

SEQ ID NO: 1512934 - RNA, 20 nt, Pseudomonas aeruginosa PA01
gcguggcgaacgcccggcuu

SEQ ID NO: 1512935 - RNA, 15 nt, Pseudomonas aeruginosa PA01
gcguguucggcggcu

SEQ ID NO: 1512936 - RNA, 21 nt, Pseudomonas aeruginosa PA01
gcguguugcgccgcaccacgu

SEQ ID NO: 1512937 - RNA, 23 nt, Pseudomonas aeruginosa PA01
gcguguucauagaaacgcagggc

SEQ ID NO: 1512938 - RNA, 15 nt, Pseudomonas aeruginosa PA01
gcguguucccuguac

SEQ ID NO: 1512939 - RNA, 20 nt, Pseudomonas aeruginosa PA01
gcgugucgaggaaggccagc

SEQ ID NO: 1512940 - RNA, 17 nt, Pseudomonas aeruginosa PA01
gcguggcuuggcccugc

SEQ ID NO: 1512941 - RNA, 13 nt, Pseudomonas aeruginosa PA01
gcguguccagggu

SEQ ID NO: 1512942 - RNA, 17 nt, Pseudomonas aeruginosa PA01
gcguggcuacggaugcu

SEQ ID NO: 1512943 - RNA, 16 nt, Pseudomonas aeruginosa PA01
gcguggcgucggcgcu

SEQ ID NO: 1512944 - RNA, 15 nt, Pseudomonas aeruginosa PA01
gcguugucccugucc

SEQ ID NO: 1512945 - RNA, 23 nt, Pseudomonas aeruginosa PA01
gcguugucccugucccgccgcgc

SEQ ID NO: 1512946 - RNA, 18 nt, Pseudomonas aeruginosa PA01
gcguuguccucggcggcu

SEQ ID NO: 1512947 - RNA, 16 nt, Pseudomonas aeruginosa PA01
gcguuggaucaccggg

SEQ ID NO: 1512948 - RNA, 19 nt, Pseudomonas aeruginosa PA01
gcguugccggacuuccuug

SEQ ID NO: 1512949 - RNA, 19 nt, Pseudomonas aeruginosa PA01
gcguugcuuccaggcaccg

SEQ ID NO: 1512950 - RNA, 22 nt, Pseudomonas aeruginosa PA01
gcguucacuccacgaggauguc

SEQ ID NO: 1512951 - RNA, 15 nt, Pseudomonas aeruginosa PA01
gcguucaugaaagcc

SEQ ID NO: 1512952 - RNA, 19 nt, Pseudomonas aeruginosa PA01
gcguucaugaaagccagca

SEQ ID NO: 1512953 - RNA, 20 nt, Pseudomonas aeruginosa PA01
gcguucaugaaagccagcaa

SEQ ID NO: 1512954 - RNA, 21 nt, Pseudomonas aeruginosa PA01
gcguucaucgucggcagccau

SEQ ID NO: 1512955 - RNA, 21 nt, Pseudomonas aeruginosa PA01
gcguuccaugaacucuucccc

SEQ ID NO: 1512956 - RNA, 19 nt, Pseudomonas aeruginosa PA01
gcguccaccauaaagccca

SEQ ID NO: 1512957 - RNA, 23 nt, Pseudomonas aeruginosa PA01
gcguccaccauaaagcccacacg

SEQ ID NO: 1512958 - RNA, 13 nt, Pseudomonas aeruginosa PA01
gcguccagcucca

SEQ ID NO: 1512959 - RNA, 18 nt, Pseudomonas aeruginosa PA01
gcguccaccuggcggcug

SEQ ID NO: 1512960 - RNA, 21 nt, Pseudomonas aeruginosa PA01
gcguccaccuggcggcugagc

SEQ ID NO: 1512961 - RNA, 17 nt, Pseudomonas aeruginosa PA01
gcguccacuccggcagc

SEQ ID NO: 1512962 - RNA, 21 nt, Pseudomonas aeruginosa PA01
gcguccacuccggcagcaccc

SEQ ID NO: 1512963 - RNA, 19 nt, Pseudomonas aeruginosa PA01
gcgucccgcuccagccggc

SEQ ID NO: 1512964 - RNA, 22 nt, Pseudomonas aeruginosa PA01
gcguccccaugcccggccuggc

SEQ ID NO: 1512965 - RNA, 20 nt, Pseudomonas aeruginosa PA01
gcguccauccaggcuuucca

SEQ ID NO: 1512966 - RNA, 17 nt, Pseudomonas aeruginosa PA01
gcguccauccccgccuc

SEQ ID NO: 1512967 - RNA, 19 nt, Pseudomonas aeruginosa PA01
gcguccaggugcggcuggg

SEQ ID NO: 1512968 - RNA, 22 nt, Pseudomonas aeruginosa PA01
gcguccgagagcagggccuggc

SEQ ID NO: 1512969 - RNA, 19 nt, Pseudomonas aeruginosa PA01
gcgucccugcccgcgccuc

SEQ ID NO: 1512970 - RNA, 20 nt, Pseudomonas aeruginosa PA01
gcguccgaacgcgcugacgg

SEQ ID NO: 1512971 - RNA, 14 nt, Pseudomonas aeruginosa PA01
gcguccgcgcaggc

SEQ ID NO: 1512972 - RNA, 15 nt, Pseudomonas aeruginosa PA01
gcguccgcggccugc

SEQ ID NO: 1512973 - RNA, 20 nt, Pseudomonas aeruginosa PA01
gcguccgcaguucgccccgc

SEQ ID NO: 1512974 - RNA, 23 nt, Pseudomonas aeruginosa PA01
gcguccgcaguucgccccgccgc

SEQ ID NO: 1512975 - RNA, 18 nt, Pseudomonas aeruginosa PA01
gcguccggagugaugccg

SEQ ID NO: 1512976 - RNA, 14 nt, Pseudomonas aeruginosa PA01
gcguccggcagggc

SEQ ID NO: 1512977 - RNA, 14 nt, Pseudomonas aeruginosa PA01
gcguccggccagcc

SEQ ID NO: 1512978 - RNA, 18 nt, Pseudomonas aeruginosa PA01
gcguccggccagccuggc

SEQ ID NO: 1512979 - RNA, 15 nt, Pseudomonas aeruginosa PA01
gcguccgcuggccug

SEQ ID NO: 1512980 - RNA, 19 nt, Pseudomonas aeruginosa PA01
gcguccgcuggccugcagc

SEQ ID NO: 1512981 - RNA, 20 nt, Pseudomonas aeruginosa PA01
gcguccgcuggccugcagca

SEQ ID NO: 1512982 - RNA, 14 nt, Pseudomonas aeruginosa PA01
gcguccgguugcug

SEQ ID NO: 1512983 - RNA, 16 nt, Pseudomonas aeruginosa PA01
gcguccucgcgacacc

SEQ ID NO: 1512984 - RNA, 21 nt, Pseudomonas aeruginosa PA01
gcguccuugcccggcgccagu

SEQ ID NO: 1512985 - RNA, 23 nt, Pseudomonas aeruginosa PA01
gcguccgguaggagcgagagcgc

SEQ ID NO: 1512986 - RNA, 23 nt, Pseudomonas aeruginosa PA01
gcguccuugaguucccagaccug

SEQ ID NO: 1512987 - RNA, 22 nt, Pseudomonas aeruginosa PA01
gcgucgaaggcggcgcggcggg

SEQ ID NO: 1512988 - RNA, 14 nt, Pseudomonas aeruginosa PA01
gcgucgaaacgggc

SEQ ID NO: 1512989 - RNA, 23 nt, Pseudomonas aeruginosa PA01
gcgucgaaacgggcgcucuggcc

SEQ ID NO: 1512990 - RNA, 19 nt, Pseudomonas aeruginosa PA01
gcgucgaaaugcucgugca

SEQ ID NO: 1512991 - RNA, 18 nt, Pseudomonas aeruginosa PA01
gcgucgaggugcggcugc

SEQ ID NO: 1512992 - RNA, 23 nt, Pseudomonas aeruginosa PA01
gcgucgaguaccgcugcggccgg

SEQ ID NO: 1512993 - RNA, 17 nt, Pseudomonas aeruginosa PA01
gcgucgaucaggcgggc

SEQ ID NO: 1512994 - RNA, 21 nt, Pseudomonas aeruginosa PA01
gcgucgaucaucugcugcagc

SEQ ID NO: 1512995 - RNA, 22 nt, Pseudomonas aeruginosa PA01
gcgucgagcguuucgcggaagg

SEQ ID NO: 1512996 - RNA, 14 nt, Pseudomonas aeruginosa PA01
gcgucgcaggcgau

SEQ ID NO: 1512997 - RNA, 14 nt, Pseudomonas aeruginosa PA01
gcgucgccaggccg

SEQ ID NO: 1512998 - RNA, 15 nt, Pseudomonas aeruginosa PA01
gcgucgcccaggccg

SEQ ID NO: 1512999 - RNA, 21 nt, Pseudomonas aeruginosa PA01
gcgucgcccaggccgcuggcg

SEQ ID NO: 1513000 - RNA, 22 nt, Pseudomonas aeruginosa PA01
gcguaggcgcgccaaggccgcc

SEQ ID NO: 1513001 - RNA, 14 nt, Pseudomonas aeruginosa PA01
gcguaggcggugcg

SEQ ID NO: 1513002 - RNA, 14 nt, Pseudomonas aeruginosa PA01
gcguagcugggcga

SEQ ID NO: 1513003 - RNA, 14 nt, Pseudomonas aeruginosa PA01
gcguagcgccaggc

SEQ ID NO: 1513004 - RNA, 15 nt, Pseudomonas aeruginosa PA01
gcguagcgccaggcc

SEQ ID NO: 1513005 - RNA, 19 nt, Pseudomonas aeruginosa PA01
gcggugagguugccgccga

SEQ ID NO: 1513006 - RNA, 13 nt, Pseudomonas aeruginosa PA01
gcggugccgcgca

SEQ ID NO: 1513007 - RNA, 19 nt, Pseudomonas aeruginosa PA01
gcgucaguuccgcaucggc

SEQ ID NO: 1513008 - RNA, 21 nt, Pseudomonas aeruginosa PA01
gcgucagcgaggcgggcgcgg

SEQ ID NO: 1513009 - RNA, 17 nt, Pseudomonas aeruginosa PA01
gcgucagcgcgccagca

SEQ ID NO: 1513010 - RNA, 20 nt, Pseudomonas aeruginosa PA01
gcggcggucaucgcgccgcc

SEQ ID NO: 1513011 - RNA, 17 nt, Pseudomonas aeruginosa PA01
gcggcggucccagacca

SEQ ID NO: 1513012 - RNA, 23 nt, Pseudomonas aeruginosa PA01
gcggcggucccuucgugggccug

SEQ ID NO: 1513013 - RNA, 19 nt, Pseudomonas aeruginosa PA01
gcggcggucgcgaucugcu

SEQ ID NO: 1513014 - RNA, 15 nt, Pseudomonas aeruginosa PA01
gcggcgggcgcccgc

SEQ ID NO: 1513015 - RNA, 17 nt, Pseudomonas aeruginosa PA01
gcggcguaaucgcgcca

SEQ ID NO: 1513016 - RNA, 16 nt, Pseudomonas aeruginosa PA01
gcggcggugcgccggc

SEQ ID NO: 1513017 - RNA, 17 nt, Pseudomonas aeruginosa PA01
gcggcggugcgccggcg

SEQ ID NO: 1513018 - RNA, 16 nt, Pseudomonas aeruginosa PA01
gcggcggcaggccagc

SEQ ID NO: 1513019 - RNA, 15 nt, Pseudomonas aeruginosa PA01
gcggcggcaccacgu

SEQ ID NO: 1513020 - RNA, 12 nt, Pseudomonas aeruginosa PA01
gcggcgggccgg

SEQ ID NO: 1513021 - RNA, 20 nt, Pseudomonas aeruginosa PA01
gcggcggccgcaugccgggg

SEQ ID NO: 1513022 - RNA, 20 nt, Pseudomonas aeruginosa PA01
gcggcggauaacgccuaugg

SEQ ID NO: 1513023 - RNA, 21 nt, Pseudomonas aeruginosa PA01
gcggcggauaacgccuguggc

SEQ ID NO: 1513024 - RNA, 23 nt, Pseudomonas aeruginosa PA01
gcggcggauacaggcgcagcagc

SEQ ID NO: 1513025 - RNA, 13 nt, Pseudomonas aeruginosa PA01
gcggcggaggccu

SEQ ID NO: 1513026 - RNA, 13 nt, Pseudomonas aeruginosa PA01
gcggcgccugcug

SEQ ID NO: 1513027 - RNA, 21 nt, Pseudomonas aeruginosa PA01
gcggcgccugcugcgcgggug

SEQ ID NO: 1513028 - RNA, 15 nt, Pseudomonas aeruginosa PA01
gcggcggaccuccgc

SEQ ID NO: 1513029 - RNA, 15 nt, Pseudomonas aeruginosa PA01
gcggcgccaccgcga

SEQ ID NO: 1513030 - RNA, 14 nt, Pseudomonas aeruginosa PA01
gcggcgcaucggcg

SEQ ID NO: 1513031 - RNA, 13 nt, Pseudomonas aeruginosa PA01
gcggcgcaguucg

SEQ ID NO: 1513032 - RNA, 21 nt, Pseudomonas aeruginosa PA01
gcggcgcaggcggaucgcccg

SEQ ID NO: 1513033 - RNA, 19 nt, Pseudomonas aeruginosa PA01
gcggcgccauagggcaccc

SEQ ID NO: 1513034 - RNA, 14 nt, Pseudomonas aeruginosa PA01
gcggcgccaggccg

SEQ ID NO: 1513035 - RNA, 17 nt, Pseudomonas aeruginosa PA01
gcggcgccaggccggcg

SEQ ID NO: 1513036 - RNA, 14 nt, Pseudomonas aeruginosa PA01
gcggcgccggcagg

SEQ ID NO: 1513037 - RNA, 21 nt, Pseudomonas aeruginosa PA01
gcggcgcaaucagggcugggc

SEQ ID NO: 1513038 - RNA, 16 nt, Pseudomonas aeruginosa PA01
gcggcgcagccagagc

SEQ ID NO: 1513039 - RNA, 22 nt, Pseudomonas aeruginosa PA01
gcggcguuggccgaggaggcca

SEQ ID NO: 1513040 - RNA, 17 nt, Pseudomonas aeruginosa PA01
gcggcguggaaggccac

SEQ ID NO: 1513041 - RNA, 17 nt, Pseudomonas aeruginosa PA01
gcggcguucgcccugcg

SEQ ID NO: 1513042 - RNA, 19 nt, Pseudomonas aeruginosa PA01
gcggcguucgccgcgggcg

SEQ ID NO: 1513043 - RNA, 14 nt, Pseudomonas aeruginosa PA01
gcggcgugcagggu

SEQ ID NO: 1513044 - RNA, 16 nt, Pseudomonas aeruginosa PA01
gcggcguuauccgccc

SEQ ID NO: 1513045 - RNA, 17 nt, Pseudomonas aeruginosa PA01
gcggcguuagccgccug

SEQ ID NO: 1513046 - RNA, 17 nt, Pseudomonas aeruginosa PA01
gcggcguggcgaucagg

SEQ ID NO: 1513047 - RNA, 21 nt, Pseudomonas aeruginosa PA01
gcggcguaggcggugcguucg

SEQ ID NO: 1513048 - RNA, 17 nt, Pseudomonas aeruginosa PA01
gcggcguaugcgccucc

SEQ ID NO: 1513049 - RNA, 19 nt, Pseudomonas aeruginosa PA01
gcggcguauucgccgaaga

SEQ ID NO: 1513050 - RNA, 22 nt, Pseudomonas aeruginosa PA01
gcggcgucgaaaugcucgugca

SEQ ID NO: 1513051 - RNA, 22 nt, Pseudomonas aeruginosa PA01
gcggcgucgaccacggccuucg

SEQ ID NO: 1513052 - RNA, 18 nt, Pseudomonas aeruginosa PA01
gcggcgguucgccgagcg

SEQ ID NO: 1513053 - RNA, 17 nt, Pseudomonas aeruginosa PA01
gcggcgguuggagcgag

SEQ ID NO: 1513054 - RNA, 17 nt, Pseudomonas aeruginosa PA01
gcggcgucugccgcucg

SEQ ID NO: 1513055 - RNA, 17 nt, Pseudomonas aeruginosa PA01
gcggcgugaagccgccg

SEQ ID NO: 1513056 - RNA, 17 nt, Pseudomonas aeruginosa PA01
gcggcuguagccacggc

SEQ ID NO: 1513057 - RNA, 18 nt, Pseudomonas aeruginosa PA01
gcgggaaacgcagcgaca

SEQ ID NO: 1513058 - RNA, 15 nt, Pseudomonas aeruginosa PA01
gcggcuuucuuccag

SEQ ID NO: 1513059 - RNA, 23 nt, Pseudomonas aeruginosa PA01
gcggcuggcgcaggaccgccaug

SEQ ID NO: 1513060 - RNA, 17 nt, Pseudomonas aeruginosa PA01
gcggcuggccgaggacc

SEQ ID NO: 1513061 - RNA, 14 nt, Pseudomonas aeruginosa PA01
gcggcuggccgccu

SEQ ID NO: 1513062 - RNA, 19 nt, Pseudomonas aeruginosa PA01
gcggcuggcgcuugccgcg

SEQ ID NO: 1513063 - RNA, 14 nt, Pseudomonas aeruginosa PA01
gcggcugggcugcg

SEQ ID NO: 1513064 - RNA, 17 nt, Pseudomonas aeruginosa PA01
gcggcuaucgaucacug

SEQ ID NO: 1513065 - RNA, 17 nt, Pseudomonas aeruginosa PA01
gcggcucaacgggaccg

SEQ ID NO: 1513066 - RNA, 23 nt, Pseudomonas aeruginosa PA01
gcggcuccagccgcugcagggcg

SEQ ID NO: 1513067 - RNA, 13 nt, Pseudomonas aeruginosa PA01
gcggcugcgcgcc

SEQ ID NO: 1513068 - RNA, 15 nt, Pseudomonas aeruginosa PA01
gcggcugcgcgccgg

SEQ ID NO: 1513069 - RNA, 21 nt, Pseudomonas aeruginosa PA01
gcggcuggaagucgcccugcc

SEQ ID NO: 1513070 - RNA, 16 nt, Pseudomonas aeruginosa PA01
gcggcugcuugccgcu

SEQ ID NO: 1513071 - RNA, 20 nt, Pseudomonas aeruginosa PA01
gcggcuccuggaugcuccgc

SEQ ID NO: 1513072 - RNA, 14 nt, Pseudomonas aeruginosa PA01
gcgguaccagcagc

SEQ ID NO: 1513073 - RNA, 23 nt, Pseudomonas aeruginosa PA01
gcgguacgcccuccagcacccag

SEQ ID NO: 1513074 - RNA, 22 nt, Pseudomonas aeruginosa PA01
gcggguggcaacugccgcccgc

SEQ ID NO: 1513075 - RNA, 21 nt, Pseudomonas aeruginosa PA01
gcgggugcggcuggcgcgcgc

SEQ ID NO: 1513076 - RNA, 14 nt, Pseudomonas aeruginosa PA01
gcgggugcgcaggc

SEQ ID NO: 1513077 - RNA, 22 nt, Pseudomonas aeruginosa PA01
gcgggugccgaagaccaccaug

SEQ ID NO: 1513078 - RNA, 14 nt, Pseudomonas aeruginosa PA01
gcgggugaccuggc

SEQ ID NO: 1513079 - RNA, 17 nt, Pseudomonas aeruginosa PA01
gcgggugauacggcucu

SEQ ID NO: 1513080 - RNA, 15 nt, Pseudomonas aeruginosa PA01
gcggguacgcgggcc

SEQ ID NO: 1513081 - RNA, 20 nt, Pseudomonas aeruginosa PA01
gcggguaaagcgcccgcgca

SEQ ID NO: 1513082 - RNA, 22 nt, Pseudomonas aeruginosa PA01
gcggguaaagcgcccgcgcaug

SEQ ID NO: 1513083 - RNA, 18 nt, Pseudomonas aeruginosa PA01
gcggucgauccgaccugg

SEQ ID NO: 1513084 - RNA, 22 nt, Pseudomonas aeruginosa PA01
gcggucgauccgaccuggggcg

SEQ ID NO: 1513085 - RNA, 15 nt, Pseudomonas aeruginosa PA01
gcggucgauguccug

SEQ ID NO: 1513086 - RNA, 22 nt, Pseudomonas aeruginosa PA01
gcggucgauguccugggccacc

SEQ ID NO: 1513087 - RNA, 21 nt, Pseudomonas aeruginosa PA01
gcgguccgcgguagcugcgca

SEQ ID NO: 1513088 - RNA, 15 nt, Pseudomonas aeruginosa PA01
gcggucgagcagcgc

SEQ ID NO: 1513089 - RNA, 16 nt, Pseudomonas aeruginosa PA01
gcgguccucgggcacc

SEQ ID NO: 1513090 - RNA, 24 nt, Pseudomonas aeruginosa PA01
gcggugaaaccggcaagcuccgcg

SEQ ID NO: 1513091 - RNA, 16 nt, Pseudomonas aeruginosa PA01
gcgguaggcgcguggg

SEQ ID NO: 1513092 - RNA, 17 nt, Pseudomonas aeruginosa PA01
gcgguagcugcgcaggg

SEQ ID NO: 1513093 - RNA, 21 nt, Pseudomonas aeruginosa PA01
gcgguagcugcgcagggcgcc

SEQ ID NO: 1513094 - RNA, 16 nt, Pseudomonas aeruginosa PA01
gcgguagcccggcagc

SEQ ID NO: 1513095 - RNA, 19 nt, Pseudomonas aeruginosa PA01
gcgguagcgcgaaggcgcc

SEQ ID NO: 1513096 - RNA, 20 nt, Pseudomonas aeruginosa PA01
gcgguagguguacccagggu

SEQ ID NO: 1513097 - RNA, 22 nt, Pseudomonas aeruginosa PA01
gcgguaguaggguucgccgacg

SEQ ID NO: 1513098 - RNA, 22 nt, Pseudomonas aeruginosa PA01
gcggucccagaccagcagcggc

SEQ ID NO: 1513099 - RNA, 20 nt, Pseudomonas aeruginosa PA01
gcggucccgggaaaccacca

SEQ ID NO: 1513100 - RNA, 16 nt, Pseudomonas aeruginosa PA01
gcggucccuggaucug

SEQ ID NO: 1513101 - RNA, 20 nt, Pseudomonas aeruginosa PA01
gcggucccuucgugggccug

SEQ ID NO: 1513102 - RNA, 23 nt, Pseudomonas aeruginosa PA01
gcgguccaucccuucgugcuggc

SEQ ID NO: 1513103 - RNA, 22 nt, Pseudomonas aeruginosa PA01
gcgguccaggucaugcccuggc

SEQ ID NO: 1513104 - RNA, 16 nt, Pseudomonas aeruginosa PA01
gcgguccagcgagcgg

SEQ ID NO: 1513105 - RNA, 14 nt, Pseudomonas aeruginosa PA01
gcgggcgcugcaug

SEQ ID NO: 1513106 - RNA, 16 nt, Pseudomonas aeruginosa PA01
gcgggcgugcuccagc

SEQ ID NO: 1513107 - RNA, 17 nt, Pseudomonas aeruginosa PA01
gcgggcggucgcggacc

SEQ ID NO: 1513108 - RNA, 23 nt, Pseudomonas aeruginosa PA01
gcgggcgccuuuuucauggccug

SEQ ID NO: 1513109 - RNA, 14 nt, Pseudomonas aeruginosa PA01
gcgggcgcgcagca

SEQ ID NO: 1513110 - RNA, 14 nt, Pseudomonas aeruginosa PA01
gcgggcgcgcgcca

SEQ ID NO: 1513111 - RNA, 15 nt, Pseudomonas aeruginosa PA01
gcgggcgcgcgccac

SEQ ID NO: 1513112 - RNA, 18 nt, Pseudomonas aeruginosa PA01
gcgggcuauucccgccgc

SEQ ID NO: 1513113 - RNA, 19 nt, Pseudomonas aeruginosa PA01
gcgggcguuguccacggaa

SEQ ID NO: 1513114 - RNA, 15 nt, Pseudomonas aeruginosa PA01
gcgggcuccgccgcc

SEQ ID NO: 1513115 - RNA, 18 nt, Pseudomonas aeruginosa PA01
gcgggcuccgccgccgug

SEQ ID NO: 1513116 - RNA, 20 nt, Pseudomonas aeruginosa PA01
gcgggcucuaugcgcggggu

SEQ ID NO: 1513117 - RNA, 16 nt, Pseudomonas aeruginosa PA01
gcggggugaucaccca

SEQ ID NO: 1513118 - RNA, 19 nt, Pseudomonas aeruginosa PA01
gcggggugaucacccagag

SEQ ID NO: 1513119 - RNA, 17 nt, Pseudomonas aeruginosa PA01
gcgggguucgacgcgcc

SEQ ID NO: 1513120 - RNA, 20 nt, Pseudomonas aeruginosa PA01
gcgggguagggguggccagg

SEQ ID NO: 1513121 - RNA, 22 nt, Pseudomonas aeruginosa PA01
gcgggguagggguggccaggcg

SEQ ID NO: 1513122 - RNA, 22 nt, Pseudomonas aeruginosa PA01
gcgggcugccccucacaccacc

SEQ ID NO: 1513123 - RNA, 19 nt, Pseudomonas aeruginosa PA01
gcgggaacgaugccgcagg

SEQ ID NO: 1513124 - RNA, 18 nt, Pseudomonas aeruginosa PA01
gcgggaaggucggcagca

SEQ ID NO: 1513125 - RNA, 13 nt, Pseudomonas aeruginosa PA01
gcgggacgcggcg

SEQ ID NO: 1513126 - RNA, 20 nt, Pseudomonas aeruginosa PA01
gcgggcgcccgccaaggccc

SEQ ID NO: 1513127 - RNA, 12 nt, Pseudomonas aeruginosa PA01
gcgggcgccgcc

SEQ ID NO: 1513128 - RNA, 19 nt, Pseudomonas aeruginosa PA01
gcgggcgccgccgcuggcg

SEQ ID NO: 1513129 - RNA, 15 nt, Pseudomonas aeruginosa PA01
gcgggccgcucgcgc

SEQ ID NO: 1513130 - RNA, 13 nt, Pseudomonas aeruginosa PA01
gcgggaggccgcc

SEQ ID NO: 1513131 - RNA, 14 nt, Pseudomonas aeruginosa PA01
gcgggagcggccug

SEQ ID NO: 1513132 - RNA, 20 nt, Pseudomonas aeruginosa PA01
gcgggccgaggucgcgggcc

SEQ ID NO: 1513133 - RNA, 16 nt, Pseudomonas aeruginosa PA01
gcgccgcuggcguggu

SEQ ID NO: 1513134 - RNA, 19 nt, Pseudomonas aeruginosa PA01
gcgccgcuggcguggugga

SEQ ID NO: 1513135 - RNA, 18 nt, Pseudomonas aeruginosa PA01
gcgccggacaggccaccc

SEQ ID NO: 1513136 - RNA, 22 nt, Pseudomonas aeruginosa PA01
gcgccggaccagaucggcgcgc

SEQ ID NO: 1513137 - RNA, 21 nt, Pseudomonas aeruginosa PA01
gcgccggagccaccgggaucu

SEQ ID NO: 1513138 - RNA, 14 nt, Pseudomonas aeruginosa PA01
gcgccgcgccugcu

SEQ ID NO: 1513139 - RNA, 12 nt, Pseudomonas aeruginosa PA01
gcgccgcgccuu

SEQ ID NO: 1513140 - RNA, 18 nt, Pseudomonas aeruginosa PA01
gcgccgcucgcgcacggc

SEQ ID NO: 1513141 - RNA, 18 nt, Pseudomonas aeruginosa PA01
gcgccgcugcccagaucc

SEQ ID NO: 1513142 - RNA, 13 nt, Pseudomonas aeruginosa PA01
gcgccgcugcggc

SEQ ID NO: 1513143 - RNA, 21 nt, Pseudomonas aeruginosa PA01
gcgccgcugcggcugcagggc

SEQ ID NO: 1513144 - RNA, 18 nt, Pseudomonas aeruginosa PA01
gcgccggcuuggcucagu

SEQ ID NO: 1513145 - RNA, 12 nt, Pseudomonas aeruginosa PA01
gcgccggcugcc

SEQ ID NO: 1513146 - RNA, 12 nt, Pseudomonas aeruginosa PA01
gcgccggcggcg

SEQ ID NO: 1513147 - RNA, 14 nt, Pseudomonas aeruginosa PA01
gcgccggcggccug

SEQ ID NO: 1513148 - RNA, 15 nt, Pseudomonas aeruginosa PA01
gcgccggcggccugc

SEQ ID NO: 1513149 - RNA, 13 nt, Pseudomonas aeruginosa PA01
gcgccgggcuggc

SEQ ID NO: 1513150 - RNA, 16 nt, Pseudomonas aeruginosa PA01
gcgccggggcagcagg

SEQ ID NO: 1513151 - RNA, 17 nt, Pseudomonas aeruginosa PA01
gcgccggggcagcaggg

SEQ ID NO: 1513152 - RNA, 18 nt, Pseudomonas aeruginosa PA01
gcgccggggcagcagggc

SEQ ID NO: 1513153 - RNA, 14 nt, Pseudomonas aeruginosa PA01
gcgccgggcucagc

SEQ ID NO: 1513154 - RNA, 18 nt, Pseudomonas aeruginosa PA01
gcgccgggaugcucaccg

SEQ ID NO: 1513155 - RNA, 15 nt, Pseudomonas aeruginosa PA01
gcgccgggccucggc

SEQ ID NO: 1513156 - RNA, 20 nt, Pseudomonas aeruginosa PA01
gcgccgggcauucgcagcgg

SEQ ID NO: 1513157 - RNA, 20 nt, Pseudomonas aeruginosa PA01
gcgcccagaguucgcccagc

SEQ ID NO: 1513158 - RNA, 13 nt, Pseudomonas aeruginosa PA01
gcgcccagcagca

SEQ ID NO: 1513159 - RNA, 16 nt, Pseudomonas aeruginosa PA01
gcgcccagcagcaggc

SEQ ID NO: 1513160 - RNA, 17 nt, Pseudomonas aeruginosa PA01
gcgcccagcagcaggcc

SEQ ID NO: 1513161 - RNA, 18 nt, Pseudomonas aeruginosa PA01
gcgcccagcagcaggccg

SEQ ID NO: 1513162 - RNA, 17 nt, Pseudomonas aeruginosa PA01
gcgcccagacacgccuc

SEQ ID NO: 1513163 - RNA, 14 nt, Pseudomonas aeruginosa PA01
gcgcccagaaaaaa

SEQ ID NO: 1513164 - RNA, 13 nt, Pseudomonas aeruginosa PA01
gcgcccaggcagc

SEQ ID NO: 1513165 - RNA, 21 nt, Pseudomonas aeruginosa PA01
gcgcccaggcagcagagcgcc

SEQ ID NO: 1513166 - RNA, 16 nt, Pseudomonas aeruginosa PA01
gcgcccaggcaggcga

SEQ ID NO: 1513167 - RNA, 14 nt, Pseudomonas aeruginosa PA01
gcgcccaggcccag

SEQ ID NO: 1513168 - RNA, 21 nt, Pseudomonas aeruginosa PA01
gcgccgcccuggccgcccagu

SEQ ID NO: 1513169 - RNA, 14 nt, Pseudomonas aeruginosa PA01
gcgccgccgagggc

SEQ ID NO: 1513170 - RNA, 18 nt, Pseudomonas aeruginosa PA01
gcgccgccgagggcaccg

SEQ ID NO: 1513171 - RNA, 20 nt, Pseudomonas aeruginosa PA01
gcgccgccggugcaccaggc

SEQ ID NO: 1513172 - RNA, 16 nt, Pseudomonas aeruginosa PA01
gcgccgccucgaaggc

SEQ ID NO: 1513173 - RNA, 20 nt, Pseudomonas aeruginosa PA01
gcgccgccucgggcagcccc

SEQ ID NO: 1513174 - RNA, 17 nt, Pseudomonas aeruginosa PA01
gcgccgccugcggcuug

SEQ ID NO: 1513175 - RNA, 18 nt, Pseudomonas aeruginosa PA01
gcgccgccucgcugggcg

SEQ ID NO: 1513176 - RNA, 17 nt, Pseudomonas aeruginosa PA01
gcgccgccuugagcggc

SEQ ID NO: 1513177 - RNA, 19 nt, Pseudomonas aeruginosa PA01
gcgccgccuugagcggcgc

SEQ ID NO: 1513178 - RNA, 16 nt, Pseudomonas aeruginosa PA01
gcgccgcgccagcagg

SEQ ID NO: 1513179 - RNA, 16 nt, Pseudomonas aeruginosa PA01
gcgccugcggaccaca

SEQ ID NO: 1513180 - RNA, 17 nt, Pseudomonas aeruginosa PA01
gcgccugcggaccacag

SEQ ID NO: 1513181 - RNA, 19 nt, Pseudomonas aeruginosa PA01
gcgccugcucuucggcggc

SEQ ID NO: 1513182 - RNA, 23 nt, Pseudomonas aeruginosa PA01
gcgccugcucuucggcggccagc

SEQ ID NO: 1513183 - RNA, 22 nt, Pseudomonas aeruginosa PA01
gcgccuggagcagaaccgccag

SEQ ID NO: 1513184 - RNA, 23 nt, Pseudomonas aeruginosa PA01
gcgccuggaugaucgcgugggcc

SEQ ID NO: 1513185 - RNA, 14 nt, Pseudomonas aeruginosa PA01
gcgccuggccgcgc

SEQ ID NO: 1513186 - RNA, 15 nt, Pseudomonas aeruginosa PA01
gcgccuggccgcgca

SEQ ID NO: 1513187 - RNA, 21 nt, Pseudomonas aeruginosa PA01
gcgccuggccgucuuccaggg

SEQ ID NO: 1513188 - RNA, 13 nt, Pseudomonas aeruginosa PA01
gcgccuggccugg

SEQ ID NO: 1513189 - RNA, 14 nt, Pseudomonas aeruginosa PA01
gcgccuggccugga

SEQ ID NO: 1513190 - RNA, 17 nt, Pseudomonas aeruginosa PA01
gcgccuggccuggaacu

SEQ ID NO: 1513191 - RNA, 14 nt, Pseudomonas aeruginosa PA01
gcgccuggcgcagu

SEQ ID NO: 1513192 - RNA, 18 nt, Pseudomonas aeruginosa PA01
gcgccuucagcgccagca

SEQ ID NO: 1513193 - RNA, 22 nt, Pseudomonas aeruginosa PA01
gcgccuucagcgccagcaggcg

SEQ ID NO: 1513194 - RNA, 22 nt, Pseudomonas aeruginosa PA01
gcgccuucaccguucccagcag

SEQ ID NO: 1513195 - RNA, 11 nt, Pseudomonas aeruginosa PA01
gcgccuuccag

SEQ ID NO: 1513196 - RNA, 21 nt, Pseudomonas aeruginosa PA01
gcgccuucgccggaagcuuca

SEQ ID NO: 1513197 - RNA, 18 nt, Pseudomonas aeruginosa PA01
gcgccuucggcgacacag

SEQ ID NO: 1513198 - RNA, 17 nt, Pseudomonas aeruginosa PA01
gcgccuucgggcgccuu

SEQ ID NO: 1513199 - RNA, 15 nt, Pseudomonas aeruginosa PA01
gcgccuugaccucga

SEQ ID NO: 1513200 - RNA, 15 nt, Pseudomonas aeruginosa PA01
gcgccuucugcaccu

SEQ ID NO: 1513201 - RNA, 16 nt, Pseudomonas aeruginosa PA01
gcgccuuccugcuuca

SEQ ID NO: 1513202 - RNA, 17 nt, Pseudomonas aeruginosa PA01
gcgccuugcgccaggcc

SEQ ID NO: 1513203 - RNA, 12 nt, Pseudomonas aeruginosa PA01
gcgccuugcuca

SEQ ID NO: 1513204 - RNA, 16 nt, Pseudomonas aeruginosa PA01
gcgccuugcucagguc

SEQ ID NO: 1513205 - RNA, 16 nt, Pseudomonas aeruginosa PA01
gcgccgguagcggcgc

SEQ ID NO: 1513206 - RNA, 20 nt, Pseudomonas aeruginosa PA01
gcgccgguagcggcgcaccg

SEQ ID NO: 1513207 - RNA, 20 nt, Pseudomonas aeruginosa PA01
gcgccgggucgaugggccgu

SEQ ID NO: 1513208 - RNA, 15 nt, Pseudomonas aeruginosa PA01
gcgccgggucggaug

SEQ ID NO: 1513209 - RNA, 18 nt, Pseudomonas aeruginosa PA01
gcgccgggugccggugcg

SEQ ID NO: 1513210 - RNA, 20 nt, Pseudomonas aeruginosa PA01
gcgccucacggucgcagggg

SEQ ID NO: 1513211 - RNA, 12 nt, Pseudomonas aeruginosa PA01
gcgccuccagca

SEQ ID NO: 1513212 - RNA, 13 nt, Pseudomonas aeruginosa PA01
gcgccuccaggcg

SEQ ID NO: 1513213 - RNA, 13 nt, Pseudomonas aeruginosa PA01
gcgccucccaggg

SEQ ID NO: 1513214 - RNA, 12 nt, Pseudomonas aeruginosa PA01
gcgccucccggg

SEQ ID NO: 1513215 - RNA, 12 nt, Pseudomonas aeruginosa PA01
gcgccuccucgg

SEQ ID NO: 1513216 - RNA, 18 nt, Pseudomonas aeruginosa PA01
gcgccuccucggcggccu

SEQ ID NO: 1513217 - RNA, 14 nt, Pseudomonas aeruginosa PA01
gcgccucgaccugg

SEQ ID NO: 1513218 - RNA, 22 nt, Pseudomonas aeruginosa PA01
gcgccucgaggaucuugcgccc

SEQ ID NO: 1513219 - RNA, 14 nt, Pseudomonas aeruginosa PA01
gcgccucgccgccc

SEQ ID NO: 1513220 - RNA, 16 nt, Pseudomonas aeruginosa PA01
gcgccucgccgcggca

SEQ ID NO: 1513221 - RNA, 19 nt, Pseudomonas aeruginosa PA01
gcgccucgcaaaggucggc

SEQ ID NO: 1513222 - RNA, 13 nt, Pseudomonas aeruginosa PA01
gcgccucgggccg

SEQ ID NO: 1513223 - RNA, 18 nt, Pseudomonas aeruginosa PA01
gcgccucggcaucgacca

SEQ ID NO: 1513224 - RNA, 21 nt, Pseudomonas aeruginosa PA01
gcgccucggcccuggcggcga

SEQ ID NO: 1513225 - RNA, 16 nt, Pseudomonas aeruginosa PA01
gcgccucgcgggucug

SEQ ID NO: 1513226 - RNA, 20 nt, Pseudomonas aeruginosa PA01
gcgccucgcuagucuuccug

SEQ ID NO: 1513227 - RNA, 22 nt, Pseudomonas aeruginosa PA01
gcgccucgcgcaacgccgacgg

SEQ ID NO: 1513228 - RNA, 18 nt, Pseudomonas aeruginosa PA01
gcgccugcaacgccagca

SEQ ID NO: 1513229 - RNA, 15 nt, Pseudomonas aeruginosa PA01
gcgccucagcggccu

SEQ ID NO: 1513230 - RNA, 20 nt, Pseudomonas aeruginosa PA01
gcgccucgucgcgccaggcg

SEQ ID NO: 1513231 - RNA, 22 nt, Pseudomonas aeruginosa PA01
gcgcggcugaucggccgccagu

SEQ ID NO: 1513232 - RNA, 18 nt, Pseudomonas aeruginosa PA01
gcgcggcuucagagcugg

SEQ ID NO: 1513233 - RNA, 13 nt, Pseudomonas aeruginosa PA01
gcgcggcuugccg

SEQ ID NO: 1513234 - RNA, 18 nt, Pseudomonas aeruginosa PA01
gcgcggcuugccggcgcg

SEQ ID NO: 1513235 - RNA, 14 nt, Pseudomonas aeruginosa PA01
gcgcggcggguggc

SEQ ID NO: 1513236 - RNA, 23 nt, Pseudomonas aeruginosa PA01
gcgcggcguaccagccgcggucc

SEQ ID NO: 1513237 - RNA, 21 nt, Pseudomonas aeruginosa PA01
gcgcggcgucgaccacggccu

SEQ ID NO: 1513238 - RNA, 15 nt, Pseudomonas aeruginosa PA01
gcgcggucgagcagc

SEQ ID NO: 1513239 - RNA, 23 nt, Pseudomonas aeruginosa PA01
gcgcggucucuacgccauacugg

SEQ ID NO: 1513240 - RNA, 14 nt, Pseudomonas aeruginosa PA01
gcgcggugagcagg

SEQ ID NO: 1513241 - RNA, 15 nt, Pseudomonas aeruginosa PA01
gcgcgggucugcucg

SEQ ID NO: 1513242 - RNA, 22 nt, Pseudomonas aeruginosa PA01
gcgcgggucuugccggucugcu

SEQ ID NO: 1513243 - RNA, 16 nt, Pseudomonas aeruginosa PA01
gcgcgggugcggcugg

SEQ ID NO: 1513244 - RNA, 17 nt, Pseudomonas aeruginosa PA01
gcgcgggugcggcuggc

SEQ ID NO: 1513245 - RNA, 18 nt, Pseudomonas aeruginosa PA01
gcgcgggugcggcuggcg

SEQ ID NO: 1513246 - RNA, 14 nt, Pseudomonas aeruginosa PA01
gcgcggccgccgcc

SEQ ID NO: 1513247 - RNA, 15 nt, Pseudomonas aeruginosa PA01
gcgcggccuguucgg

SEQ ID NO: 1513248 - RNA, 14 nt, Pseudomonas aeruginosa PA01
gcgcggccugcgcc

SEQ ID NO: 1513249 - RNA, 12 nt, Pseudomonas aeruginosa PA01
gcgcggcggcgg

SEQ ID NO: 1513250 - RNA, 16 nt, Pseudomonas aeruginosa PA01
gcgcgcggucgagcag

SEQ ID NO: 1513251 - RNA, 16 nt, Pseudomonas aeruginosa PA01
gcgcgcggggucuggc

SEQ ID NO: 1513252 - RNA, 21 nt, Pseudomonas aeruginosa PA01
gcgcgcggggucuggccggcg

SEQ ID NO: 1513253 - RNA, 12 nt, Pseudomonas aeruginosa PA01
gcgcgcuccggc

SEQ ID NO: 1513254 - RNA, 16 nt, Pseudomonas aeruginosa PA01
gcgcgcuccggcgcgc

SEQ ID NO: 1513255 - RNA, 12 nt, Pseudomonas aeruginosa PA01
gcgcgcggcggg

SEQ ID NO: 1513256 - RNA, 18 nt, Pseudomonas aeruginosa PA01
gcgcgcggcgucgaccac

SEQ ID NO: 1513257 - RNA, 14 nt, Pseudomonas aeruginosa PA01
gcgcgcgggccuuc

SEQ ID NO: 1513258 - RNA, 17 nt, Pseudomonas aeruginosa PA01
gcgcgcagggccgcggc

SEQ ID NO: 1513259 - RNA, 19 nt, Pseudomonas aeruginosa PA01
gcgcgcaacuggucgcggc

SEQ ID NO: 1513260 - RNA, 22 nt, Pseudomonas aeruginosa PA01
gcgcgcaacuggucgcggcugc

SEQ ID NO: 1513261 - RNA, 13 nt, Pseudomonas aeruginosa PA01
gcgcgcaaggccg

SEQ ID NO: 1513262 - RNA, 18 nt, Pseudomonas aeruginosa PA01
gcgcgaugcucccgagca

SEQ ID NO: 1513263 - RNA, 18 nt, Pseudomonas aeruginosa PA01
gcgcgauggccggcggag

SEQ ID NO: 1513264 - RNA, 17 nt, Pseudomonas aeruginosa PA01
gcgcgauccgcgcggca

SEQ ID NO: 1513265 - RNA, 20 nt, Pseudomonas aeruginosa PA01
gcgcgcaacgcuuccagcac

SEQ ID NO: 1513266 - RNA, 18 nt, Pseudomonas aeruginosa PA01
gcgccuuucgcucaggcc

SEQ ID NO: 1513267 - RNA, 21 nt, Pseudomonas aeruginosa PA01
gcgcgaucgcguuccagcaac

SEQ ID NO: 1513268 - RNA, 18 nt, Pseudomonas aeruginosa PA01
gcgccuuuuuucauccug

SEQ ID NO: 1513269 - RNA, 14 nt, Pseudomonas aeruginosa PA01
gcgcgcaguucagg

SEQ ID NO: 1513270 - RNA, 17 nt, Pseudomonas aeruginosa PA01
gcgcgccccggcgagcg

SEQ ID NO: 1513271 - RNA, 20 nt, Pseudomonas aeruginosa PA01
gcgcgccccggcgagcgagc

SEQ ID NO: 1513272 - RNA, 16 nt, Pseudomonas aeruginosa PA01
gcgcgcccggcgcaga

SEQ ID NO: 1513273 - RNA, 15 nt, Pseudomonas aeruginosa PA01
gcgcgccucuuccug

SEQ ID NO: 1513274 - RNA, 19 nt, Pseudomonas aeruginosa PA01
gcgcgccucuucgcaggag

SEQ ID NO: 1513275 - RNA, 15 nt, Pseudomonas aeruginosa PA01
gcgcgccugaaacug

SEQ ID NO: 1513276 - RNA, 14 nt, Pseudomonas aeruginosa PA01
gcgcgccugcaacg

SEQ ID NO: 1513277 - RNA, 14 nt, Pseudomonas aeruginosa PA01
gcgcgccuggcugg

SEQ ID NO: 1513278 - RNA, 15 nt, Pseudomonas aeruginosa PA01
gcgcgccuggcuggc

SEQ ID NO: 1513279 - RNA, 23 nt, Pseudomonas aeruginosa PA01
gcgcgccuggcuggccagcaggc

SEQ ID NO: 1513280 - RNA, 16 nt, Pseudomonas aeruginosa PA01
gcgcgcggccaguucg

SEQ ID NO: 1513281 - RNA, 15 nt, Pseudomonas aeruginosa PA01
gcgcgcgcuccucga

SEQ ID NO: 1513282 - RNA, 13 nt, Pseudomonas aeruginosa PA01
gcgcgcgcugguc

SEQ ID NO: 1513283 - RNA, 14 nt, Pseudomonas aeruginosa PA01
gcgcgcgccgggcu

SEQ ID NO: 1513284 - RNA, 15 nt, Pseudomonas aeruginosa PA01
gcgcgccuucgacgc

SEQ ID NO: 1513285 - RNA, 13 nt, Pseudomonas aeruginosa PA01
gcgcgcgcaaggc

SEQ ID NO: 1513286 - RNA, 15 nt, Pseudomonas aeruginosa PA01
gcgcgcgcaaggccg

SEQ ID NO: 1513287 - RNA, 12 nt, Pseudomonas aeruginosa PA01
gcgcgccuggua

SEQ ID NO: 1513288 - RNA, 15 nt, Pseudomonas aeruginosa PA01
gcgcgguuucuucgc

SEQ ID NO: 1513289 - RNA, 21 nt, Pseudomonas aeruginosa PA01
gcgcgguuucuucgccuugcc

SEQ ID NO: 1513290 - RNA, 17 nt, Pseudomonas aeruginosa PA01
gcgcguacgcccgcagc

SEQ ID NO: 1513291 - RNA, 22 nt, Pseudomonas aeruginosa PA01
gcgcguagaccaccucgacggc

SEQ ID NO: 1513292 - RNA, 17 nt, Pseudomonas aeruginosa PA01
gcgcgucaugccgccgu

SEQ ID NO: 1513293 - RNA, 14 nt, Pseudomonas aeruginosa PA01
gcgcguccaccugg

SEQ ID NO: 1513294 - RNA, 19 nt, Pseudomonas aeruginosa PA01
gcgcguccaccuggcggcu

SEQ ID NO: 1513295 - RNA, 20 nt, Pseudomonas aeruginosa PA01
gcgcguccaccuggcggcug

SEQ ID NO: 1513296 - RNA, 13 nt, Pseudomonas aeruginosa PA01
gcgcucgcgcuuc

SEQ ID NO: 1513297 - RNA, 17 nt, Pseudomonas aeruginosa PA01
gcgcucgcgcuuccggc

SEQ ID NO: 1513298 - RNA, 13 nt, Pseudomonas aeruginosa PA01
gcgcucgcggacc

SEQ ID NO: 1513299 - RNA, 23 nt, Pseudomonas aeruginosa PA01
gcgcucggaucaggcgggcuccg

SEQ ID NO: 1513300 - RNA, 22 nt, Pseudomonas aeruginosa PA01
gcgcucggauuccagcgcggug

SEQ ID NO: 1513301 - RNA, 19 nt, Pseudomonas aeruginosa PA01
gcgcucgcugucgcucagc

SEQ ID NO: 1513302 - RNA, 17 nt, Pseudomonas aeruginosa PA01
gcgcucuggccgcgcuc

SEQ ID NO: 1513303 - RNA, 18 nt, Pseudomonas aeruginosa PA01
gcgcucuucagcacgccc

SEQ ID NO: 1513304 - RNA, 17 nt, Pseudomonas aeruginosa PA01
gcgcucgcgcaugaccu

SEQ ID NO: 1513305 - RNA, 13 nt, Pseudomonas aeruginosa PA01
gcgcucgcgcagc

SEQ ID NO: 1513306 - RNA, 14 nt, Pseudomonas aeruginosa PA01
gcgcucgagccggc

SEQ ID NO: 1513307 - RNA, 19 nt, Pseudomonas aeruginosa PA01
gcgcuggaccauggccggc

SEQ ID NO: 1513308 - RNA, 20 nt, Pseudomonas aeruginosa PA01
gcgcuggaguaucgcccugg

SEQ ID NO: 1513309 - RNA, 14 nt, Pseudomonas aeruginosa PA01
gcgcuggaugcccu

SEQ ID NO: 1513310 - RNA, 15 nt, Pseudomonas aeruginosa PA01
gcgcuggcagguugc

SEQ ID NO: 1513311 - RNA, 14 nt, Pseudomonas aeruginosa PA01
gcgcuggccaggua

SEQ ID NO: 1513312 - RNA, 15 nt, Pseudomonas aeruginosa PA01
gcgcuggccaguucc

SEQ ID NO: 1513313 - RNA, 16 nt, Pseudomonas aeruginosa PA01
gcgcuggccaguucca

SEQ ID NO: 1513314 - RNA, 17 nt, Pseudomonas aeruginosa PA01
gcgcuggccgcgcgacc

SEQ ID NO: 1513315 - RNA, 12 nt, Pseudomonas aeruginosa PA01
gcgcuggccggc

SEQ ID NO: 1513316 - RNA, 21 nt, Pseudomonas aeruginosa PA01
gcgcuggcgcuguaggcgagc

SEQ ID NO: 1513317 - RNA, 20 nt, Pseudomonas aeruginosa PA01
gcgcuggcgcagcggguccu

SEQ ID NO: 1513318 - RNA, 21 nt, Pseudomonas aeruginosa PA01
gcgcuggcgaucaccagggug

SEQ ID NO: 1513319 - RNA, 14 nt, Pseudomonas aeruginosa PA01
gcgcuggcgcagca

SEQ ID NO: 1513320 - RNA, 16 nt, Pseudomonas aeruginosa PA01
gcgcuggcgcagcagc

SEQ ID NO: 1513321 - RNA, 19 nt, Pseudomonas aeruginosa PA01
gcgcugcucgauggccuug

SEQ ID NO: 1513322 - RNA, 11 nt, Pseudomonas aeruginosa PA01
gcgcugaccug

SEQ ID NO: 1513323 - RNA, 16 nt, Pseudomonas aeruginosa PA01
gcgcugcugggcggcg

SEQ ID NO: 1513324 - RNA, 14 nt, Pseudomonas aeruginosa PA01
gcgcuggaccuggc

SEQ ID NO: 1513325 - RNA, 16 nt, Pseudomonas aeruginosa PA01
gcgcuggaccuggccg

SEQ ID NO: 1513326 - RNA, 19 nt, Pseudomonas aeruginosa PA01
gcgcuggaccuggccggcg

SEQ ID NO: 1513327 - RNA, 20 nt, Pseudomonas aeruginosa PA01
gcgcuggaacggccaggucu

SEQ ID NO: 1513328 - RNA, 15 nt, Pseudomonas aeruginosa PA01
gcgcugaccgcuccc

SEQ ID NO: 1513329 - RNA, 20 nt, Pseudomonas aeruginosa PA01
gcgcugaccgcucccaggca

SEQ ID NO: 1513330 - RNA, 20 nt, Pseudomonas aeruginosa PA01
gcgcugagcgcggucaccca

SEQ ID NO: 1513331 - RNA, 13 nt, Pseudomonas aeruginosa PA01
gcgcugaccaggu

SEQ ID NO: 1513332 - RNA, 16 nt, Pseudomonas aeruginosa PA01
gcgcugaacaagcccu

SEQ ID NO: 1513333 - RNA, 21 nt, Pseudomonas aeruginosa PA01
gcggaaacccuuccagccgcc

SEQ ID NO: 1513334 - RNA, 15 nt, Pseudomonas aeruginosa PA01
gcgcuuucgcucugg

SEQ ID NO: 1513335 - RNA, 22 nt, Pseudomonas aeruginosa PA01
gcgcuuucgagaaagcgcagga

SEQ ID NO: 1513336 - RNA, 19 nt, Pseudomonas aeruginosa PA01
gcgcuuuuccggcgccggc

SEQ ID NO: 1513337 - RNA, 20 nt, Pseudomonas aeruginosa PA01
gcgcuuuuccggcgccggca

SEQ ID NO: 1513338 - RNA, 14 nt, Pseudomonas aeruginosa PA01
gcggaaggcggcgu

SEQ ID NO: 1513339 - RNA, 14 nt, Pseudomonas aeruginosa PA01
gcggaaggcccgcg

SEQ ID NO: 1513340 - RNA, 22 nt, Pseudomonas aeruginosa PA01
gcggaacuugcgccgaccgcgc

SEQ ID NO: 1513341 - RNA, 15 nt, Pseudomonas aeruginosa PA01
gcggaagaagcccuu

SEQ ID NO: 1513342 - RNA, 20 nt, Pseudomonas aeruginosa PA01
gcggaagaaucgcagccaug

SEQ ID NO: 1513343 - RNA, 23 nt, Pseudomonas aeruginosa PA01
gcggaacgggacgccuggcgucc

SEQ ID NO: 1513344 - RNA, 15 nt, Pseudomonas aeruginosa PA01
gcggaacaccgccug

SEQ ID NO: 1513345 - RNA, 14 nt, Pseudomonas aeruginosa PA01
gcgcuucggcggcu

SEQ ID NO: 1513346 - RNA, 13 nt, Pseudomonas aeruginosa PA01
gcgcuucgcgcag

SEQ ID NO: 1513347 - RNA, 14 nt, Pseudomonas aeruginosa PA01
gcgcuucgcgcagc

SEQ ID NO: 1513348 - RNA, 19 nt, Pseudomonas aeruginosa PA01
gcgcuucgcgcaggacgag

SEQ ID NO: 1513349 - RNA, 20 nt, Pseudomonas aeruginosa PA01
gcgcuucugcucggccugga

SEQ ID NO: 1513350 - RNA, 12 nt, Pseudomonas aeruginosa PA01
gcgcuuccaggg

SEQ ID NO: 1513351 - RNA, 16 nt, Pseudomonas aeruginosa PA01
gcgcuugaagccggcg

SEQ ID NO: 1513352 - RNA, 19 nt, Pseudomonas aeruginosa PA01
gcgcuugaguugccagacg

SEQ ID NO: 1513353 - RNA, 14 nt, Pseudomonas aeruginosa PA01
gcgcuugcauggca

SEQ ID NO: 1513354 - RNA, 17 nt, Pseudomonas aeruginosa PA01
gcgcuugcgggcgcgcc

SEQ ID NO: 1513355 - RNA, 22 nt, Pseudomonas aeruginosa PA01
gcgcuugcugccauggcggcgg

SEQ ID NO: 1513356 - RNA, 14 nt, Pseudomonas aeruginosa PA01
gcgcuugcccaggu

SEQ ID NO: 1513357 - RNA, 15 nt, Pseudomonas aeruginosa PA01
gcgcuugccgcgccc

SEQ ID NO: 1513358 - RNA, 18 nt, Pseudomonas aeruginosa PA01
gcgcuugccgcgcccggc

SEQ ID NO: 1513359 - RNA, 19 nt, Pseudomonas aeruginosa PA01
gcgcuugccgcgcccggcc

SEQ ID NO: 1513360 - RNA, 18 nt, Pseudomonas aeruginosa PA01
gcgcuugccggccgccag

SEQ ID NO: 1513361 - RNA, 13 nt, Pseudomonas aeruginosa PA01
gcgcuuguugaug

SEQ ID NO: 1513362 - RNA, 19 nt, Pseudomonas aeruginosa PA01
gcgcuuguccgagaccggc

SEQ ID NO: 1513363 - RNA, 21 nt, Pseudomonas aeruginosa PA01
gcgcuuguccgagaccggcag

SEQ ID NO: 1513364 - RNA, 22 nt, Pseudomonas aeruginosa PA01
gcgcuuguccgagaccggcagc

SEQ ID NO: 1513365 - RNA, 19 nt, Pseudomonas aeruginosa PA01
gcgcuuguccuccagcugc

SEQ ID NO: 1513366 - RNA, 14 nt, Pseudomonas aeruginosa PA01
gcgcuuggccuugc

SEQ ID NO: 1513367 - RNA, 14 nt, Pseudomonas aeruginosa PA01
gcgcuucccgcggc

SEQ ID NO: 1513368 - RNA, 16 nt, Pseudomonas aeruginosa PA01
gcgcuuccgcaucggc

SEQ ID NO: 1513369 - RNA, 18 nt, Pseudomonas aeruginosa PA01
gcgcuuccgcaucggccg

SEQ ID NO: 1513370 - RNA, 19 nt, Pseudomonas aeruginosa PA01
gcgcuuccggcagccagcc

SEQ ID NO: 1513371 - RNA, 20 nt, Pseudomonas aeruginosa PA01
gcgcuuccggcagccagccg

SEQ ID NO: 1513372 - RNA, 15 nt, Pseudomonas aeruginosa PA01
gcgcuuccuccagua

SEQ ID NO: 1513373 - RNA, 17 nt, Pseudomonas aeruginosa PA01
gcgcuucaggcaguccu

SEQ ID NO: 1513374 - RNA, 18 nt, Pseudomonas aeruginosa PA01
gcgcuuccaccgccugcc

SEQ ID NO: 1513375 - RNA, 16 nt, Pseudomonas aeruginosa PA01
gcgcugggcgcagccc

SEQ ID NO: 1513376 - RNA, 21 nt, Pseudomonas aeruginosa PA01
gcggauugcguacgcccagca

SEQ ID NO: 1513377 - RNA, 17 nt, Pseudomonas aeruginosa PA01
gcggauuggccgggccg

SEQ ID NO: 1513378 - RNA, 23 nt, Pseudomonas aeruginosa PA01
gcggauugacgauggccagcccg

SEQ ID NO: 1513379 - RNA, 17 nt, Pseudomonas aeruginosa PA01
gcggcaauguccgagca

SEQ ID NO: 1513380 - RNA, 22 nt, Pseudomonas aeruginosa PA01
gcggcaauguccgagcaggucg

SEQ ID NO: 1513381 - RNA, 21 nt, Pseudomonas aeruginosa PA01
gcggcaaggcgaucccggcgu

SEQ ID NO: 1513382 - RNA, 15 nt, Pseudomonas aeruginosa PA01
gcggcaccagccagg

SEQ ID NO: 1513383 - RNA, 15 nt, Pseudomonas aeruginosa PA01
gcggcacaggcggcu

SEQ ID NO: 1513384 - RNA, 16 nt, Pseudomonas aeruginosa PA01
gcggcacaggcggcug

SEQ ID NO: 1513385 - RNA, 22 nt, Pseudomonas aeruginosa PA01
gcggcaccccuugcagccagcc

SEQ ID NO: 1513386 - RNA, 16 nt, Pseudomonas aeruginosa PA01
gcggcacccggcuggg

SEQ ID NO: 1513387 - RNA, 12 nt, Pseudomonas aeruginosa PA01
gcggcaccagca

SEQ ID NO: 1513388 - RNA, 21 nt, Pseudomonas aeruginosa PA01
gcggaugacguucccguccgg

SEQ ID NO: 1513389 - RNA, 19 nt, Pseudomonas aeruginosa PA01
gcggauggcaauggcggug

SEQ ID NO: 1513390 - RNA, 17 nt, Pseudomonas aeruginosa PA01
gcggaugcguugcucgc

SEQ ID NO: 1513391 - RNA, 14 nt, Pseudomonas aeruginosa PA01
gcggaugccggcgc

SEQ ID NO: 1513392 - RNA, 15 nt, Pseudomonas aeruginosa PA01
gcggaugccggcgcu

SEQ ID NO: 1513393 - RNA, 21 nt, Pseudomonas aeruginosa PA01
gcggauguaguccagcgccgc

SEQ ID NO: 1513394 - RNA, 23 nt, Pseudomonas aeruginosa PA01
gcggauguaguccagcgccgcgc

SEQ ID NO: 1513395 - RNA, 14 nt, Pseudomonas aeruginosa PA01
gcggauggcgcggg

SEQ ID NO: 1513396 - RNA, 15 nt, Pseudomonas aeruginosa PA01
gcggauucaggcgcg

SEQ ID NO: 1513397 - RNA, 20 nt, Pseudomonas aeruginosa PA01
gcggaucugcuccugcaggc

SEQ ID NO: 1513398 - RNA, 19 nt, Pseudomonas aeruginosa PA01
gcggaucggcguguucagg

SEQ ID NO: 1513399 - RNA, 17 nt, Pseudomonas aeruginosa PA01
gcggaucgucgcggcgc

SEQ ID NO: 1513400 - RNA, 17 nt, Pseudomonas aeruginosa PA01
gcggaucgcccggcgcu

SEQ ID NO: 1513401 - RNA, 19 nt, Pseudomonas aeruginosa PA01
gcggaagcccagcaggucg

SEQ ID NO: 1513402 - RNA, 17 nt, Pseudomonas aeruginosa PA01
gcggaaguaggcggcgg

SEQ ID NO: 1513403 - RNA, 16 nt, Pseudomonas aeruginosa PA01
gcggaaucgcgcccuu

SEQ ID NO: 1513404 - RNA, 14 nt, Pseudomonas aeruginosa PA01
gcggaauuccugcu

SEQ ID NO: 1513405 - RNA, 17 nt, Pseudomonas aeruginosa PA01
gcggacacgcaggcgcc

SEQ ID NO: 1513406 - RNA, 13 nt, Pseudomonas aeruginosa PA01
gcggacagcccgc

SEQ ID NO: 1513407 - RNA, 15 nt, Pseudomonas aeruginosa PA01
gcggacagcccgcgc

SEQ ID NO: 1513408 - RNA, 17 nt, Pseudomonas aeruginosa PA01
gcggacagcccgcgcuc

SEQ ID NO: 1513409 - RNA, 17 nt, Pseudomonas aeruginosa PA01
gcggacaggcagccggc

SEQ ID NO: 1513410 - RNA, 20 nt, Pseudomonas aeruginosa PA01
gcggacaccgcggugucggu

SEQ ID NO: 1513411 - RNA, 17 nt, Pseudomonas aeruginosa PA01
gcggacaacccggcgcu

SEQ ID NO: 1513412 - RNA, 13 nt, Pseudomonas aeruginosa PA01
gcggacaccgcgg

SEQ ID NO: 1513413 - RNA, 14 nt, Pseudomonas aeruginosa PA01
gcggaauggcgcgc

SEQ ID NO: 1513414 - RNA, 18 nt, Pseudomonas aeruginosa PA01
gcggaccccggccuccag

SEQ ID NO: 1513415 - RNA, 23 nt, Pseudomonas aeruginosa PA01
gcggaccccggccuccaggcugg

SEQ ID NO: 1513416 - RNA, 21 nt, Pseudomonas aeruginosa PA01
gcggacaugaaaaagccggag

SEQ ID NO: 1513417 - RNA, 22 nt, Pseudomonas aeruginosa PA01
gcggaccgcagaaccagacgcu

SEQ ID NO: 1513418 - RNA, 15 nt, Pseudomonas aeruginosa PA01
gcggaccuccgccag

SEQ ID NO: 1513419 - RNA, 19 nt, Pseudomonas aeruginosa PA01
gcggaccuucgacggcagg

SEQ ID NO: 1513420 - RNA, 19 nt, Pseudomonas aeruginosa PA01
gcggacgaucacucccugc

SEQ ID NO: 1513421 - RNA, 15 nt, Pseudomonas aeruginosa PA01
gcggacgccgaagcg

SEQ ID NO: 1513422 - RNA, 19 nt, Pseudomonas aeruginosa PA01
gcggacugcucgccgccgg

SEQ ID NO: 1513423 - RNA, 12 nt, Pseudomonas aeruginosa PA01
gcggacgcaggc

SEQ ID NO: 1513424 - RNA, 15 nt, Pseudomonas aeruginosa PA01
gcggacgggccgcgc

SEQ ID NO: 1513425 - RNA, 17 nt, Pseudomonas aeruginosa PA01
gcggacuccggaggcgc

SEQ ID NO: 1513426 - RNA, 17 nt, Pseudomonas aeruginosa PA01
gcggauaacgccacagg

SEQ ID NO: 1513427 - RNA, 16 nt, Pseudomonas aeruginosa PA01
gcggauaacgccagga

SEQ ID NO: 1513428 - RNA, 21 nt, Pseudomonas aeruginosa PA01
gcggauaaucgcagcgcgguc

SEQ ID NO: 1513429 - RNA, 19 nt, Pseudomonas aeruginosa PA01
gcggauagcgcgcaggcgc

SEQ ID NO: 1513430 - RNA, 21 nt, Pseudomonas aeruginosa PA01
gcggauagagcuucccgcaug

SEQ ID NO: 1513431 - RNA, 18 nt, Pseudomonas aeruginosa PA01
gcggauaucgcgccgcga

SEQ ID NO: 1513432 - RNA, 20 nt, Pseudomonas aeruginosa PA01
gcggauaucgcguggugaug

SEQ ID NO: 1513433 - RNA, 17 nt, Pseudomonas aeruginosa PA01
gcggauaucggccucgg

SEQ ID NO: 1513434 - RNA, 15 nt, Pseudomonas aeruginosa PA01
gcggaguagccggcg

SEQ ID NO: 1513435 - RNA, 12 nt, Pseudomonas aeruginosa PA01
gcggagcuggaa

SEQ ID NO: 1513436 - RNA, 17 nt, Pseudomonas aeruginosa PA01
gcggagcguccaccagc

SEQ ID NO: 1513437 - RNA, 20 nt, Pseudomonas aeruginosa PA01
gcggagcguccaccagcgcc

SEQ ID NO: 1513438 - RNA, 23 nt, Pseudomonas aeruginosa PA01
gcggagcguccaccagcgcccgu

SEQ ID NO: 1513439 - RNA, 15 nt, Pseudomonas aeruginosa PA01
gcggagcgucgggcg

SEQ ID NO: 1513440 - RNA, 19 nt, Pseudomonas aeruginosa PA01
gcggagggucaggccgagg

SEQ ID NO: 1513441 - RNA, 19 nt, Pseudomonas aeruginosa PA01
gcgaacagguagccccggc

SEQ ID NO: 1513442 - RNA, 15 nt, Pseudomonas aeruginosa PA01
gcgaaagaacaacuc

SEQ ID NO: 1513443 - RNA, 17 nt, Pseudomonas aeruginosa PA01
gcgaaacggcaggccag

SEQ ID NO: 1513444 - RNA, 19 nt, Pseudomonas aeruginosa PA01
gcgaaacggcaggccagca

SEQ ID NO: 1513445 - RNA, 18 nt, Pseudomonas aeruginosa PA01
gcgaaacucgugcuccac

SEQ ID NO: 1513446 - RNA, 21 nt, Pseudomonas aeruginosa PA01
gcgaaacucgugcuccaccuc

SEQ ID NO: 1513447 - RNA, 16 nt, Pseudomonas aeruginosa PA01
gccguucgucaccggc

SEQ ID NO: 1513448 - RNA, 14 nt, Pseudomonas aeruginosa PA01
gccguucgcccuuc

SEQ ID NO: 1513449 - RNA, 17 nt, Pseudomonas aeruginosa PA01
gccguuguagcugacca

SEQ ID NO: 1513450 - RNA, 14 nt, Pseudomonas aeruginosa PA01
gcgaagcccagcgc

SEQ ID NO: 1513451 - RNA, 19 nt, Pseudomonas aeruginosa PA01
gcgaagcgguuagccggcg

SEQ ID NO: 1513452 - RNA, 16 nt, Pseudomonas aeruginosa PA01
gcgaauccagcaacac

SEQ ID NO: 1513453 - RNA, 16 nt, Pseudomonas aeruginosa PA01
gcgaauagcgccgcgg

SEQ ID NO: 1513454 - RNA, 15 nt, Pseudomonas aeruginosa PA01
gcgaauaccagugcc

SEQ ID NO: 1513455 - RNA, 23 nt, Pseudomonas aeruginosa PA01
gcgaagcggcucggccagggccg

SEQ ID NO: 1513456 - RNA, 21 nt, Pseudomonas aeruginosa PA01
gcgaacccggguugaccuugu

SEQ ID NO: 1513457 - RNA, 14 nt, Pseudomonas aeruginosa PA01
gcgaaccacaccag

SEQ ID NO: 1513458 - RNA, 17 nt, Pseudomonas aeruginosa PA01
gcgaaccacaccagguc

SEQ ID NO: 1513459 - RNA, 17 nt, Pseudomonas aeruginosa PA01
gcgaaccagcagcaggu

SEQ ID NO: 1513460 - RNA, 21 nt, Pseudomonas aeruginosa PA01
gcgaaccaggcaauggccggc

SEQ ID NO: 1513461 - RNA, 22 nt, Pseudomonas aeruginosa PA01
gcgaaccaggcaauggccggcg

SEQ ID NO: 1513462 - RNA, 19 nt, Pseudomonas aeruginosa PA01
gcgaacaugaagccgcgcg

SEQ ID NO: 1513463 - RNA, 21 nt, Pseudomonas aeruginosa PA01
gcgaacaugaagccgcgcgcc

SEQ ID NO: 1513464 - RNA, 15 nt, Pseudomonas aeruginosa PA01
gcgaagaccggccgg

SEQ ID NO: 1513465 - RNA, 20 nt, Pseudomonas aeruginosa PA01
gcgaagaacacgccccagaa

SEQ ID NO: 1513466 - RNA, 18 nt, Pseudomonas aeruginosa PA01
gcgaaucuucggcgcgcc

SEQ ID NO: 1513467 - RNA, 14 nt, Pseudomonas aeruginosa PA01
gcgaauccgcggcc

SEQ ID NO: 1513468 - RNA, 15 nt, Pseudomonas aeruginosa PA01
gcgaauccgcggccc

SEQ ID NO: 1513469 - RNA, 20 nt, Pseudomonas aeruginosa PA01
gcgaauccgcggcccugcuc

SEQ ID NO: 1513470 - RNA, 18 nt, Pseudomonas aeruginosa PA01
gcgaauugcgcuggaagu

SEQ ID NO: 1513471 - RNA, 17 nt, Pseudomonas aeruginosa PA01
gcgaaugcuugccggcg

SEQ ID NO: 1513472 - RNA, 16 nt, Pseudomonas aeruginosa PA01
gcgaauggcagcaggc

SEQ ID NO: 1513473 - RNA, 17 nt, Pseudomonas aeruginosa PA01
gcgaauggcagcaggca

SEQ ID NO: 1513474 - RNA, 18 nt, Pseudomonas aeruginosa PA01
gcgaauggcagcaggcac

SEQ ID NO: 1513475 - RNA, 12 nt, Pseudomonas aeruginosa PA01
gcgacaggaugg

SEQ ID NO: 1513476 - RNA, 19 nt, Pseudomonas aeruginosa PA01
gcgacagcucuggggucag

SEQ ID NO: 1513477 - RNA, 21 nt, Pseudomonas aeruginosa PA01
gcgacaggcccuugaacaggc

SEQ ID NO: 1513478 - RNA, 17 nt, Pseudomonas aeruginosa PA01
gcgacaguucgccgccc

SEQ ID NO: 1513479 - RNA, 16 nt, Pseudomonas aeruginosa PA01
gcgacauagcggcugc

SEQ ID NO: 1513480 - RNA, 17 nt, Pseudomonas aeruginosa PA01
gcgaccaccaccagguc

SEQ ID NO: 1513481 - RNA, 13 nt, Pseudomonas aeruginosa PA01
gcgaccgcggcgc

SEQ ID NO: 1513482 - RNA, 13 nt, Pseudomonas aeruginosa PA01
gcgaccgaucaug

SEQ ID NO: 1513483 - RNA, 17 nt, Pseudomonas aeruginosa PA01
gcgaccagcccgcgcga

SEQ ID NO: 1513484 - RNA, 19 nt, Pseudomonas aeruginosa PA01
gcgacccuggccgcgcggc

SEQ ID NO: 1513485 - RNA, 21 nt, Pseudomonas aeruginosa PA01
gcgaccgaacagcgcgccauc

SEQ ID NO: 1513486 - RNA, 16 nt, Pseudomonas aeruginosa PA01
gcgaccgaagccgcgc

SEQ ID NO: 1513487 - RNA, 21 nt, Pseudomonas aeruginosa PA01
gcgacgcggacagccugggcg

SEQ ID NO: 1513488 - RNA, 13 nt, Pseudomonas aeruginosa PA01
gcgacgccggucg

SEQ ID NO: 1513489 - RNA, 22 nt, Pseudomonas aeruginosa PA01
gcgacgcccuugcggcgcggcc

SEQ ID NO: 1513490 - RNA, 18 nt, Pseudomonas aeruginosa PA01
gcgacgcagcacggcggc

SEQ ID NO: 1513491 - RNA, 19 nt, Pseudomonas aeruginosa PA01
gcgagccagccguggcagg

SEQ ID NO: 1513492 - RNA, 14 nt, Pseudomonas aeruginosa PA01
gcgagcaugcucac

SEQ ID NO: 1513493 - RNA, 22 nt, Pseudomonas aeruginosa PA01
gcgagccagguuuccggcagca

SEQ ID NO: 1513494 - RNA, 19 nt, Pseudomonas aeruginosa PA01
gcgagcauuccucagcgcc

SEQ ID NO: 1513495 - RNA, 13 nt, Pseudomonas aeruginosa PA01
gcgagcaccgcgc

SEQ ID NO: 1513496 - RNA, 19 nt, Pseudomonas aeruginosa PA01
gcgagcaccaugcagcggc

SEQ ID NO: 1513497 - RNA, 15 nt, Pseudomonas aeruginosa PA01
gcgagcaucucggcc

SEQ ID NO: 1513498 - RNA, 18 nt, Pseudomonas aeruginosa PA01
gcgagcaucucggccagg

SEQ ID NO: 1513499 - RNA, 17 nt, Pseudomonas aeruginosa PA01
gcgagaacuugccggcg

SEQ ID NO: 1513500 - RNA, 16 nt, Pseudomonas aeruginosa PA01
gcgacucggcugcaac

SEQ ID NO: 1513501 - RNA, 17 nt, Pseudomonas aeruginosa PA01
gcgacucgcugccggcg

SEQ ID NO: 1513502 - RNA, 18 nt, Pseudomonas aeruginosa PA01
gcgacucgagcaccacca

SEQ ID NO: 1513503 - RNA, 13 nt, Pseudomonas aeruginosa PA01
gcgagacgccgcc

SEQ ID NO: 1513504 - RNA, 18 nt, Pseudomonas aeruginosa PA01
gcgagacgccgccccagc

SEQ ID NO: 1513505 - RNA, 23 nt, Pseudomonas aeruginosa PA01
gcgagaccaucuggaucaggaag

SEQ ID NO: 1513506 - RNA, 17 nt, Pseudomonas aeruginosa PA01
gcgagaccccggcggcg

SEQ ID NO: 1513507 - RNA, 22 nt, Pseudomonas aeruginosa PA01
gcgagaccccggcggcgcguuc

SEQ ID NO: 1513508 - RNA, 23 nt, Pseudomonas aeruginosa PA01
gcgagaccucgcccaucgccagg

SEQ ID NO: 1513509 - RNA, 17 nt, Pseudomonas aeruginosa PA01
gcgagacgggcgaggcu

SEQ ID NO: 1513510 - RNA, 16 nt, Pseudomonas aeruginosa PA01
gcgagaagccgcccac

SEQ ID NO: 1513511 - RNA, 23 nt, Pseudomonas aeruginosa PA01
gcgacggcugcuccggaucgcgc

SEQ ID NO: 1513512 - RNA, 21 nt, Pseudomonas aeruginosa PA01
gcgacgggugcguccauccag

SEQ ID NO: 1513513 - RNA, 19 nt, Pseudomonas aeruginosa PA01
gcgacggucaggccgagca

SEQ ID NO: 1513514 - RNA, 18 nt, Pseudomonas aeruginosa PA01
gcgacgcugaugccggcg

SEQ ID NO: 1513515 - RNA, 20 nt, Pseudomonas aeruginosa PA01
gcgacgcuccagcggcagcu

SEQ ID NO: 1513516 - RNA, 19 nt, Pseudomonas aeruginosa PA01
gcgacggcauuccuggucc

SEQ ID NO: 1513517 - RNA, 14 nt, Pseudomonas aeruginosa PA01
gcgacuaccagguu

SEQ ID NO: 1513518 - RNA, 20 nt, Pseudomonas aeruginosa PA01
gcgaugcgcaugcgcagcgc

SEQ ID NO: 1513519 - RNA, 23 nt, Pseudomonas aeruginosa PA01
gcgaugccggagagcagcacggc

SEQ ID NO: 1513520 - RNA, 13 nt, Pseudomonas aeruginosa PA01
gcgaugccgccgg

SEQ ID NO: 1513521 - RNA, 20 nt, Pseudomonas aeruginosa PA01
gcgaugccgcgccaggcgca

SEQ ID NO: 1513522 - RNA, 17 nt, Pseudomonas aeruginosa PA01
gcgaugcccaggccgcc

SEQ ID NO: 1513523 - RNA, 14 nt, Pseudomonas aeruginosa PA01
gcgaucuccgggag

SEQ ID NO: 1513524 - RNA, 19 nt, Pseudomonas aeruginosa PA01
gcgaucuccugccgcggcg

SEQ ID NO: 1513525 - RNA, 18 nt, Pseudomonas aeruginosa PA01
gcgaucucggcgcgggca

SEQ ID NO: 1513526 - RNA, 24 nt, Pseudomonas aeruginosa PA01
gcgaucucuacuaccgccagcgca

SEQ ID NO: 1513527 - RNA, 14 nt, Pseudomonas aeruginosa PA01
gcgaucagcgggcg

SEQ ID NO: 1513528 - RNA, 18 nt, Pseudomonas aeruginosa PA01
gcgaucacauagcuguag

SEQ ID NO: 1513529 - RNA, 20 nt, Pseudomonas aeruginosa PA01
gcgaucacauagcuguagcg

SEQ ID NO: 1513530 - RNA, 15 nt, Pseudomonas aeruginosa PA01
gcgauaucccgccgc

SEQ ID NO: 1513531 - RNA, 14 nt, Pseudomonas aeruginosa PA01
gcgauauccgccag

SEQ ID NO: 1513532 - RNA, 17 nt, Pseudomonas aeruginosa PA01
gcgauauccgccaggga

SEQ ID NO: 1513533 - RNA, 12 nt, Pseudomonas aeruginosa PA01
gcgauaucgcag

SEQ ID NO: 1513534 - RNA, 14 nt, Pseudomonas aeruginosa PA01
gcgaguucgccggc

SEQ ID NO: 1513535 - RNA, 18 nt, Pseudomonas aeruginosa PA01
gcgaguucgccggccagg

SEQ ID NO: 1513536 - RNA, 19 nt, Pseudomonas aeruginosa PA01
gcgaguucggcgagcaggu

SEQ ID NO: 1513537 - RNA, 22 nt, Pseudomonas aeruginosa PA01
gcgaguucggcguuguccaggc

SEQ ID NO: 1513538 - RNA, 15 nt, Pseudomonas aeruginosa PA01
gcgagucgaucaggu

SEQ ID NO: 1513539 - RNA, 15 nt, Pseudomonas aeruginosa PA01
gcgaguaagcgcggu

SEQ ID NO: 1513540 - RNA, 15 nt, Pseudomonas aeruginosa PA01
gcgagucgacccagg

SEQ ID NO: 1513541 - RNA, 17 nt, Pseudomonas aeruginosa PA01
gcgagucgacccaggcc

SEQ ID NO: 1513542 - RNA, 16 nt, Pseudomonas aeruginosa PA01
gcgagcgggcgagggc

SEQ ID NO: 1513543 - RNA, 19 nt, Pseudomonas aeruginosa PA01
gcgagcgggucagcagcac

SEQ ID NO: 1513544 - RNA, 22 nt, Pseudomonas aeruginosa PA01
gcgaggaaaaggaucgccgcga

SEQ ID NO: 1513545 - RNA, 16 nt, Pseudomonas aeruginosa PA01
gcgagguuccgcggcg

SEQ ID NO: 1513546 - RNA, 22 nt, Pseudomonas aeruginosa PA01
gcgaguaccaccgugcccgccg

SEQ ID NO: 1513547 - RNA, 24 nt, Pseudomonas aeruginosa PA01
gcgaguaccaccgugcccgccggc

SEQ ID NO: 1513548 - RNA, 19 nt, Pseudomonas aeruginosa PA01
gcgagucaccccgaccagc

SEQ ID NO: 1513549 - RNA, 23 nt, Pseudomonas aeruginosa PA01
gcgagucaccccgaccagcgcgc

SEQ ID NO: 1513550 - RNA, 15 nt, Pseudomonas aeruginosa PA01
gcgcaucgaggccgg

SEQ ID NO: 1513551 - RNA, 14 nt, Pseudomonas aeruginosa PA01
gcgcaucgaugccu

SEQ ID NO: 1513552 - RNA, 22 nt, Pseudomonas aeruginosa PA01
gcgcaucgaugccuugcggccc

SEQ ID NO: 1513553 - RNA, 22 nt, Pseudomonas aeruginosa PA01
gcgcauccguaaaauggcgcgc

SEQ ID NO: 1513554 - RNA, 17 nt, Pseudomonas aeruginosa PA01
gcgcauccucggcaucc

SEQ ID NO: 1513555 - RNA, 19 nt, Pseudomonas aeruginosa PA01
gcgcauccucggcauccag

SEQ ID NO: 1513556 - RNA, 14 nt, Pseudomonas aeruginosa PA01
gcgcaucgcggaca

SEQ ID NO: 1513557 - RNA, 15 nt, Pseudomonas aeruginosa PA01
gcgcaucggcgccuc

SEQ ID NO: 1513558 - RNA, 17 nt, Pseudomonas aeruginosa PA01
gcgcaucggugccggca

SEQ ID NO: 1513559 - RNA, 22 nt, Pseudomonas aeruginosa PA01
gcgcaucggugccggcaggccu

SEQ ID NO: 1513560 - RNA, 24 nt, Pseudomonas aeruginosa PA01
gcgcaucgucgaaacgcuggcggc

SEQ ID NO: 1513561 - RNA, 15 nt, Pseudomonas aeruginosa PA01
gcgcaucgugcagcc

SEQ ID NO: 1513562 - RNA, 13 nt, Pseudomonas aeruginosa PA01
gcgcauggcgcuc

SEQ ID NO: 1513563 - RNA, 15 nt, Pseudomonas aeruginosa PA01
gcgcauggcggcgac

SEQ ID NO: 1513564 - RNA, 15 nt, Pseudomonas aeruginosa PA01
gcgcauggacagguc

SEQ ID NO: 1513565 - RNA, 21 nt, Pseudomonas aeruginosa PA01
gcgcauggacaggucgacggc

SEQ ID NO: 1513566 - RNA, 17 nt, Pseudomonas aeruginosa PA01
gcgcaugcccagggcca

SEQ ID NO: 1513567 - RNA, 15 nt, Pseudomonas aeruginosa PA01
gcgcaugccgcagga

SEQ ID NO: 1513568 - RNA, 21 nt, Pseudomonas aeruginosa PA01
gcgcaugccguuggccgagcg

SEQ ID NO: 1513569 - RNA, 14 nt, Pseudomonas aeruginosa PA01
gcgcaugcgccggc

SEQ ID NO: 1513570 - RNA, 14 nt, Pseudomonas aeruginosa PA01
gcgcauguccagcc

SEQ ID NO: 1513571 - RNA, 21 nt, Pseudomonas aeruginosa PA01
gcgcauguccagccaguggcu

SEQ ID NO: 1513572 - RNA, 23 nt, Pseudomonas aeruginosa PA01
gcgcauguccagccaguggcugg

SEQ ID NO: 1513573 - RNA, 19 nt, Pseudomonas aeruginosa PA01
gcgccaccgauagcggcgc

SEQ ID NO: 1513574 - RNA, 19 nt, Pseudomonas aeruginosa PA01
gcgccaccgauucgccggc

SEQ ID NO: 1513575 - RNA, 15 nt, Pseudomonas aeruginosa PA01
gcgccaccccgccgc

SEQ ID NO: 1513576 - RNA, 18 nt, Pseudomonas aeruginosa PA01
gcgccaccccgccgcgca

SEQ ID NO: 1513577 - RNA, 21 nt, Pseudomonas aeruginosa PA01
gcgccaccaccgucacggcga

SEQ ID NO: 1513578 - RNA, 15 nt, Pseudomonas aeruginosa PA01
gcgccaccagcaggg

SEQ ID NO: 1513579 - RNA, 20 nt, Pseudomonas aeruginosa PA01
gcgccaccagcaugcccagc

SEQ ID NO: 1513580 - RNA, 13 nt, Pseudomonas aeruginosa PA01
gcgccaaggccgc

SEQ ID NO: 1513581 - RNA, 18 nt, Pseudomonas aeruginosa PA01
gcgccaaggccgccaggc

SEQ ID NO: 1513582 - RNA, 20 nt, Pseudomonas aeruginosa PA01
gcgccaaggccgccaggccu

SEQ ID NO: 1513583 - RNA, 17 nt, Pseudomonas aeruginosa PA01
gcgccaaccgggcagca

SEQ ID NO: 1513584 - RNA, 22 nt, Pseudomonas aeruginosa PA01
gcgccaaaaagcaggacggcga

SEQ ID NO: 1513585 - RNA, 13 nt, Pseudomonas aeruginosa PA01
gcgccacgcagga

SEQ ID NO: 1513586 - RNA, 15 nt, Pseudomonas aeruginosa PA01
gcgccacgcaggaac

SEQ ID NO: 1513587 - RNA, 22 nt, Pseudomonas aeruginosa PA01
gcgccacgcaggaacagcuccu

SEQ ID NO: 1513588 - RNA, 21 nt, Pseudomonas aeruginosa PA01
gcgccacgcaaacccauuucc

SEQ ID NO: 1513589 - RNA, 21 nt, Pseudomonas aeruginosa PA01
gcgccacgcgcaucgugcagc

SEQ ID NO: 1513590 - RNA, 14 nt, Pseudomonas aeruginosa PA01
gcgccacggccagc

SEQ ID NO: 1513591 - RNA, 18 nt, Pseudomonas aeruginosa PA01
gcgccacggccagcagga

SEQ ID NO: 1513592 - RNA, 19 nt, Pseudomonas aeruginosa PA01
gcgccagccccaggcgcgg

SEQ ID NO: 1513593 - RNA, 16 nt, Pseudomonas aeruginosa PA01
gcgccagcuccagcgc

SEQ ID NO: 1513594 - RNA, 13 nt, Pseudomonas aeruginosa PA01
gcgccagccgacu

SEQ ID NO: 1513595 - RNA, 13 nt, Pseudomonas aeruginosa PA01
gcgccagccgcca

SEQ ID NO: 1513596 - RNA, 15 nt, Pseudomonas aeruginosa PA01
gcgccagccgccauc

SEQ ID NO: 1513597 - RNA, 17 nt, Pseudomonas aeruginosa PA01
gcgccagccagcgcggc

SEQ ID NO: 1513598 - RNA, 22 nt, Pseudomonas aeruginosa PA01
gcgccagccaggaagagcccgc

SEQ ID NO: 1513599 - RNA, 19 nt, Pseudomonas aeruginosa PA01
gcgccagcaucgcaucggc

SEQ ID NO: 1513600 - RNA, 11 nt, Pseudomonas aeruginosa PA01
gcgccagcauc

SEQ ID NO: 1513601 - RNA, 20 nt, Pseudomonas aeruginosa PA01
gcgccagcagguacagcagc

SEQ ID NO: 1513602 - RNA, 12 nt, Pseudomonas aeruginosa PA01
gcgccagcaggc

SEQ ID NO: 1513603 - RNA, 15 nt, Pseudomonas aeruginosa PA01
gcgccagcaggcgca

SEQ ID NO: 1513604 - RNA, 21 nt, Pseudomonas aeruginosa PA01
gcgccagcaggcgcagcagcg

SEQ ID NO: 1513605 - RNA, 17 nt, Pseudomonas aeruginosa PA01
gcgccauaggccagcac

SEQ ID NO: 1513606 - RNA, 18 nt, Pseudomonas aeruginosa PA01
gcgccauaggccagcacc

SEQ ID NO: 1513607 - RNA, 19 nt, Pseudomonas aeruginosa PA01
gcgccauaggccagcaccu

SEQ ID NO: 1513608 - RNA, 21 nt, Pseudomonas aeruginosa PA01
gcgccaucggcgguacgcccu

SEQ ID NO: 1513609 - RNA, 13 nt, Pseudomonas aeruginosa PA01
gcgccaucaggcc

SEQ ID NO: 1513610 - RNA, 16 nt, Pseudomonas aeruginosa PA01
gcgccauccuccagcg

SEQ ID NO: 1513611 - RNA, 17 nt, Pseudomonas aeruginosa PA01
gcgccauccuccagcgc

SEQ ID NO: 1513612 - RNA, 23 nt, Pseudomonas aeruginosa PA01
gcgccauccuccagcgccgcauu

SEQ ID NO: 1513613 - RNA, 18 nt, Pseudomonas aeruginosa PA01
gcgccaugacccgcggca

SEQ ID NO: 1513614 - RNA, 20 nt, Pseudomonas aeruginosa PA01
gcgccaugcaagaacgccga

SEQ ID NO: 1513615 - RNA, 15 nt, Pseudomonas aeruginosa PA01
gcgccaguuggacgc

SEQ ID NO: 1513616 - RNA, 23 nt, Pseudomonas aeruginosa PA01
gcgccaguuggacgcggccuggg

SEQ ID NO: 1513617 - RNA, 19 nt, Pseudomonas aeruginosa PA01
gcgccaggaacgccucugc

SEQ ID NO: 1513618 - RNA, 17 nt, Pseudomonas aeruginosa PA01
gcgccaggaagccgcgc

SEQ ID NO: 1513619 - RNA, 21 nt, Pseudomonas aeruginosa PA01
gcgccaggaagccgcgcccca

SEQ ID NO: 1513620 - RNA, 16 nt, Pseudomonas aeruginosa PA01
gcgccaggagcagggc

SEQ ID NO: 1513621 - RNA, 18 nt, Pseudomonas aeruginosa PA01
gcgccaggagcagggcgc

SEQ ID NO: 1513622 - RNA, 10 nt, Pseudomonas aeruginosa PA01
gcgccaggcc

SEQ ID NO: 1513623 - RNA, 12 nt, Pseudomonas aeruginosa PA01
gcgccaggccgc

SEQ ID NO: 1513624 - RNA, 19 nt, Pseudomonas aeruginosa PA01
gcgcaccaccgagagcggc

SEQ ID NO: 1513625 - RNA, 20 nt, Pseudomonas aeruginosa PA01
gcgcaccaccgagagcggcg

SEQ ID NO: 1513626 - RNA, 21 nt, Pseudomonas aeruginosa PA01
gcgcaccaccgagagcggcgc

SEQ ID NO: 1513627 - RNA, 16 nt, Pseudomonas aeruginosa PA01
gcgcaccagcaggcgc

SEQ ID NO: 1513628 - RNA, 16 nt, Pseudomonas aeruginosa PA01
gcgcaccaggccaggc

SEQ ID NO: 1513629 - RNA, 17 nt, Pseudomonas aeruginosa PA01
gcgcaccaggccaggcu

SEQ ID NO: 1513630 - RNA, 18 nt, Pseudomonas aeruginosa PA01
gcgcaccaggccaggcug

SEQ ID NO: 1513631 - RNA, 16 nt, Pseudomonas aeruginosa PA01
gcgcaagucggccugc

SEQ ID NO: 1513632 - RNA, 21 nt, Pseudomonas aeruginosa PA01
gcgcacaaaaaagcccgccag

SEQ ID NO: 1513633 - RNA, 16 nt, Pseudomonas aeruginosa PA01
gcgcaaggccagcggc

SEQ ID NO: 1513634 - RNA, 14 nt, Pseudomonas aeruginosa PA01
gcgcaagggcgccg

SEQ ID NO: 1513635 - RNA, 19 nt, Pseudomonas aeruginosa PA01
gcgcaaggugccgaggucg

SEQ ID NO: 1513636 - RNA, 15 nt, Pseudomonas aeruginosa PA01
gcgcaacugcggggc

SEQ ID NO: 1513637 - RNA, 12 nt, Pseudomonas aeruginosa PA01
gcgcaagccagc

SEQ ID NO: 1513638 - RNA, 20 nt, Pseudomonas aeruginosa PA01
gcgcaagccagccaugugcu

SEQ ID NO: 1513639 - RNA, 19 nt, Pseudomonas aeruginosa PA01
gcgcaagcccaagggcucc

SEQ ID NO: 1513640 - RNA, 15 nt, Pseudomonas aeruginosa PA01
gcgcaagcgcccggc

SEQ ID NO: 1513641 - RNA, 16 nt, Pseudomonas aeruginosa PA01
gcgcaagcggcggcuu

SEQ ID NO: 1513642 - RNA, 15 nt, Pseudomonas aeruginosa PA01
gcgcaaggaacugga

SEQ ID NO: 1513643 - RNA, 15 nt, Pseudomonas aeruginosa PA01
gcgaugcgcuggaag

SEQ ID NO: 1513644 - RNA, 22 nt, Pseudomonas aeruginosa PA01
gcgaugcgguuccuggcuggag

SEQ ID NO: 1513645 - RNA, 22 nt, Pseudomonas aeruginosa PA01
gcgaugcguuugucgaccugcc

SEQ ID NO: 1513646 - RNA, 18 nt, Pseudomonas aeruginosa PA01
gcgaugcucagcgccggc

SEQ ID NO: 1513647 - RNA, 20 nt, Pseudomonas aeruginosa PA01
gcgaugcugucagcgcccgg

SEQ ID NO: 1513648 - RNA, 17 nt, Pseudomonas aeruginosa PA01
gcgcaccucgaccgcgc

SEQ ID NO: 1513649 - RNA, 16 nt, Pseudomonas aeruginosa PA01
gcgcaccucggccagg

SEQ ID NO: 1513650 - RNA, 17 nt, Pseudomonas aeruginosa PA01
gcgcaccucggccaggc

SEQ ID NO: 1513651 - RNA, 19 nt, Pseudomonas aeruginosa PA01
gcgcaccuggcggucgccg

SEQ ID NO: 1513652 - RNA, 22 nt, Pseudomonas aeruginosa PA01
gcgcacgcaauagugcagcucc

SEQ ID NO: 1513653 - RNA, 21 nt, Pseudomonas aeruginosa PA01
gcgcaccuugcuggacaaggu

SEQ ID NO: 1513654 - RNA, 18 nt, Pseudomonas aeruginosa PA01
gcgcacuuccggacugcc

SEQ ID NO: 1513655 - RNA, 21 nt, Pseudomonas aeruginosa PA01
gcgcagacgaucuccugcugg

SEQ ID NO: 1513656 - RNA, 22 nt, Pseudomonas aeruginosa PA01
gcgcagacgauugaccucccgc

SEQ ID NO: 1513657 - RNA, 15 nt, Pseudomonas aeruginosa PA01
gcgcagacgggugcu

SEQ ID NO: 1513658 - RNA, 20 nt, Pseudomonas aeruginosa PA01
gcgcaccaggccucccagcc

SEQ ID NO: 1513659 - RNA, 16 nt, Pseudomonas aeruginosa PA01
gcgcaccagcgggucg

SEQ ID NO: 1513660 - RNA, 16 nt, Pseudomonas aeruginosa PA01
gcgcaccaggucgcgc

SEQ ID NO: 1513661 - RNA, 19 nt, Pseudomonas aeruginosa PA01
gcgcaccauagcgagccgc

SEQ ID NO: 1513662 - RNA, 15 nt, Pseudomonas aeruginosa PA01
gcgcaccgcgccggg

SEQ ID NO: 1513663 - RNA, 13 nt, Pseudomonas aeruginosa PA01
gcgcaccgcggcc

SEQ ID NO: 1513664 - RNA, 16 nt, Pseudomonas aeruginosa PA01
gcgcaccgcggcgagc

SEQ ID NO: 1513665 - RNA, 15 nt, Pseudomonas aeruginosa PA01
gcgcaggcgggcggc

SEQ ID NO: 1513666 - RNA, 14 nt, Pseudomonas aeruginosa PA01
gcgcaggcggcgcu

SEQ ID NO: 1513667 - RNA, 12 nt, Pseudomonas aeruginosa PA01
gcgcaggcggcu

SEQ ID NO: 1513668 - RNA, 13 nt, Pseudomonas aeruginosa PA01
gcgcaggcggcug

SEQ ID NO: 1513669 - RNA, 13 nt, Pseudomonas aeruginosa PA01
gcgcaggcgcugg

SEQ ID NO: 1513670 - RNA, 20 nt, Pseudomonas aeruginosa PA01
gcgcaggcggacacgcaggc

SEQ ID NO: 1513671 - RNA, 15 nt, Pseudomonas aeruginosa PA01
gcgcagggccagggc

SEQ ID NO: 1513672 - RNA, 12 nt, Pseudomonas aeruginosa PA01
gcgcagggcggc

SEQ ID NO: 1513673 - RNA, 18 nt, Pseudomonas aeruginosa PA01
gcgcaggcuuggucaggg

SEQ ID NO: 1513674 - RNA, 21 nt, Pseudomonas aeruginosa PA01
gcgcaggcuuggucagggucg

SEQ ID NO: 1513675 - RNA, 21 nt, Pseudomonas aeruginosa PA01
gcgcaggcgguaggugagcga

SEQ ID NO: 1513676 - RNA, 20 nt, Pseudomonas aeruginosa PA01
gcgcaggcugucggccagcc

SEQ ID NO: 1513677 - RNA, 13 nt, Pseudomonas aeruginosa PA01
gcgcaggcugccu

SEQ ID NO: 1513678 - RNA, 13 nt, Pseudomonas aeruginosa PA01
gcgcagggucagg

SEQ ID NO: 1513679 - RNA, 14 nt, Pseudomonas aeruginosa PA01
gcgcaggggcgcgc

SEQ ID NO: 1513680 - RNA, 18 nt, Pseudomonas aeruginosa PA01
gcgcaggggcgcgccggc

SEQ ID NO: 1513681 - RNA, 19 nt, Pseudomonas aeruginosa PA01
gcgcaggggcgcgccggcu

SEQ ID NO: 1513682 - RNA, 20 nt, Pseudomonas aeruginosa PA01
gcgcaggggcgcgccggcuu

SEQ ID NO: 1513683 - RNA, 15 nt, Pseudomonas aeruginosa PA01
gcgcaggggcgcggc

SEQ ID NO: 1513684 - RNA, 16 nt, Pseudomonas aeruginosa PA01
gcgcaggggcgcggcg

SEQ ID NO: 1513685 - RNA, 19 nt, Pseudomonas aeruginosa PA01
gcgcagguacucgccggcg

SEQ ID NO: 1513686 - RNA, 23 nt, Pseudomonas aeruginosa PA01
gcgcagguagaaggugcccagcg

SEQ ID NO: 1513687 - RNA, 16 nt, Pseudomonas aeruginosa PA01
gcgcagcgaagaucuu

SEQ ID NO: 1513688 - RNA, 15 nt, Pseudomonas aeruginosa PA01
gcgcaggcgcucgcg

SEQ ID NO: 1513689 - RNA, 14 nt, Pseudomonas aeruginosa PA01
gcgcagcgccgccg

SEQ ID NO: 1513690 - RNA, 17 nt, Pseudomonas aeruginosa PA01
gcgcagccgcucggccg

SEQ ID NO: 1513691 - RNA, 13 nt, Pseudomonas aeruginosa PA01
gcgcagccugcug

SEQ ID NO: 1513692 - RNA, 23 nt, Pseudomonas aeruginosa PA01
gcgcagccguucccggucgaggu

SEQ ID NO: 1513693 - RNA, 16 nt, Pseudomonas aeruginosa PA01
gcgcagccucgcgcuc

SEQ ID NO: 1513694 - RNA, 21 nt, Pseudomonas aeruginosa PA01
gcgcagaugaucgccaccggg

SEQ ID NO: 1513695 - RNA, 16 nt, Pseudomonas aeruginosa PA01
gcgcagaugcggggcg

SEQ ID NO: 1513696 - RNA, 12 nt, Pseudomonas aeruginosa PA01
gcgcagaggcgc

SEQ ID NO: 1513697 - RNA, 14 nt, Pseudomonas aeruginosa PA01
gcgcagaggcgcuc

SEQ ID NO: 1513698 - RNA, 20 nt, Pseudomonas aeruginosa PA01
gcgcagaucgcggcgcaggc

SEQ ID NO: 1513699 - RNA, 20 nt, Pseudomonas aeruginosa PA01
gcgcagaucgcguccagggu

SEQ ID NO: 1513700 - RNA, 14 nt, Pseudomonas aeruginosa PA01
gcgcaggugcuugu

SEQ ID NO: 1513701 - RNA, 17 nt, Pseudomonas aeruginosa PA01
gcgcagguugcgcuggc

SEQ ID NO: 1513702 - RNA, 22 nt, Pseudomonas aeruginosa PA01
gcgcagguugcgcuggcgcagc

SEQ ID NO: 1513703 - RNA, 18 nt, Pseudomonas aeruginosa PA01
gcgcaguagcuggaucug

SEQ ID NO: 1513704 - RNA, 16 nt, Pseudomonas aeruginosa PA01
gcgcaguaggccuggu

SEQ ID NO: 1513705 - RNA, 16 nt, Pseudomonas aeruginosa PA01
gcgcaguacccggccg

SEQ ID NO: 1513706 - RNA, 18 nt, Pseudomonas aeruginosa PA01
gcgcaguacccggccgcc

SEQ ID NO: 1513707 - RNA, 20 nt, Pseudomonas aeruginosa PA01
gcgcaguacccggccgccuu

SEQ ID NO: 1513708 - RNA, 18 nt, Pseudomonas aeruginosa PA01
gcgcaguacgaucagcca

SEQ ID NO: 1513709 - RNA, 15 nt, Pseudomonas aeruginosa PA01
gcgcaguugccagga

SEQ ID NO: 1513710 - RNA, 17 nt, Pseudomonas aeruginosa PA01
gcgcaguugccaggagg

SEQ ID NO: 1513711 - RNA, 15 nt, Pseudomonas aeruginosa PA01
gcgcaguucaucgag

SEQ ID NO: 1513712 - RNA, 22 nt, Pseudomonas aeruginosa PA01
gcgcaguuccuucaccggacgg

SEQ ID NO: 1513713 - RNA, 16 nt, Pseudomonas aeruginosa PA01
gcgcagucccgcgcgg

SEQ ID NO: 1513714 - RNA, 17 nt, Pseudomonas aeruginosa PA01
gcgcagucccgcgcggc

SEQ ID NO: 1513715 - RNA, 18 nt, Pseudomonas aeruginosa PA01
gcgcagucccgcgcggcc

SEQ ID NO: 1513716 - RNA, 20 nt, Pseudomonas aeruginosa PA01
gcgcaguccgguagcgcgcc

SEQ ID NO: 1513717 - RNA, 21 nt, Pseudomonas aeruginosa PA01
gcgcaguccgguagcgcgccu

SEQ ID NO: 1513718 - RNA, 22 nt, Pseudomonas aeruginosa PA01
gcgcaguccgguagcgcgccug

SEQ ID NO: 1513719 - RNA, 14 nt, Pseudomonas aeruginosa PA01
gcgcauagcggcca

SEQ ID NO: 1513720 - RNA, 17 nt, Pseudomonas aeruginosa PA01
gcgcaguucguccaucg

SEQ ID NO: 1513721 - RNA, 18 nt, Pseudomonas aeruginosa PA01
gcgcaucaccccgcaacc

SEQ ID NO: 1513722 - RNA, 14 nt, Pseudomonas aeruginosa PA01
gcgcauagcaggcc

SEQ ID NO: 1513723 - RNA, 14 nt, Pseudomonas aeruginosa PA01
gcugccggucaggc

SEQ ID NO: 1513724 - RNA, 17 nt, Pseudomonas aeruginosa PA01
gcugccggucaggcugg

SEQ ID NO: 1513725 - RNA, 20 nt, Pseudomonas aeruginosa PA01
gcugccggucaggcuggugc

SEQ ID NO: 1513726 - RNA, 19 nt, Pseudomonas aeruginosa PA01
gcugccguacagcccccgc

SEQ ID NO: 1513727 - RNA, 22 nt, Pseudomonas aeruginosa PA01
gcugccguagcgcuucaucagg

SEQ ID NO: 1513728 - RNA, 19 nt, Pseudomonas aeruginosa PA01
gcugccggagucucgggaa

SEQ ID NO: 1513729 - RNA, 15 nt, Pseudomonas aeruginosa PA01
gcugccggccagggu

SEQ ID NO: 1513730 - RNA, 18 nt, Pseudomonas aeruginosa PA01
gcugccggcgcgcacgga

SEQ ID NO: 1513731 - RNA, 21 nt, Pseudomonas aeruginosa PA01
gcugccggcgucguccugcgc

SEQ ID NO: 1513732 - RNA, 18 nt, Pseudomonas aeruginosa PA01
gcugccgggcgagcugca

SEQ ID NO: 1513733 - RNA, 14 nt, Pseudomonas aeruginosa PA01
gcugccgggcucug

SEQ ID NO: 1513734 - RNA, 19 nt, Pseudomonas aeruginosa PA01
gcugccgccgcgcugcagg

SEQ ID NO: 1513735 - RNA, 21 nt, Pseudomonas aeruginosa PA01
gcugccgcggaagugcgccgg

SEQ ID NO: 1513736 - RNA, 23 nt, Pseudomonas aeruginosa PA01
gcugccgccuucgcgggccaggc

SEQ ID NO: 1513737 - RNA, 19 nt, Pseudomonas aeruginosa PA01
gcugccgcuucggcugcug

SEQ ID NO: 1513738 - RNA, 13 nt, Pseudomonas aeruginosa PA01
gcugccgcucugg

SEQ ID NO: 1513739 - RNA, 16 nt, Pseudomonas aeruginosa PA01
gcugccgcucuggcug

SEQ ID NO: 1513740 - RNA, 19 nt, Pseudomonas aeruginosa PA01
gcugccgcucuggcugcug

SEQ ID NO: 1513741 - RNA, 21 nt, Pseudomonas aeruginosa PA01
gcugcgagcgcuucauccugc

SEQ ID NO: 1513742 - RNA, 20 nt, Pseudomonas aeruginosa PA01
gcugccuaccgucacgcgga

SEQ ID NO: 1513743 - RNA, 20 nt, Pseudomonas aeruginosa PA01
gcugccugucgcagcgggca

SEQ ID NO: 1513744 - RNA, 16 nt, Pseudomonas aeruginosa PA01
gcugccuuccagcagg

SEQ ID NO: 1513745 - RNA, 15 nt, Pseudomonas aeruginosa PA01
gcugccgaucagcca

SEQ ID NO: 1513746 - RNA, 22 nt, Pseudomonas aeruginosa PA01
gcugccgaggaacucgcggucc

SEQ ID NO: 1513747 - RNA, 15 nt, Pseudomonas aeruginosa PA01
gcugccgagcagggu

SEQ ID NO: 1513748 - RNA, 21 nt, Pseudomonas aeruginosa PA01
gcugccgaauugggucugcug

SEQ ID NO: 1513749 - RNA, 16 nt, Pseudomonas aeruginosa PA01
gcugccgaacagcagg

SEQ ID NO: 1513750 - RNA, 22 nt, Pseudomonas aeruginosa PA01
gcugcccucgaccagguccggc

SEQ ID NO: 1513751 - RNA, 13 nt, Pseudomonas aeruginosa PA01
gcugccccucaca

SEQ ID NO: 1513752 - RNA, 21 nt, Pseudomonas aeruginosa PA01
gcugcccagauccccugcagg

SEQ ID NO: 1513753 - RNA, 14 nt, Pseudomonas aeruginosa PA01
gcugcccagggccc

SEQ ID NO: 1513754 - RNA, 15 nt, Pseudomonas aeruginosa PA01
gcugcccagggccca

SEQ ID NO: 1513755 - RNA, 22 nt, Pseudomonas aeruginosa PA01
gcugcccagggcccagagcagc

SEQ ID NO: 1513756 - RNA, 16 nt, Pseudomonas aeruginosa PA01
gcugcccaucgccucc

SEQ ID NO: 1513757 - RNA, 17 nt, Pseudomonas aeruginosa PA01
gcugcccaucgccucca

SEQ ID NO: 1513758 - RNA, 21 nt, Pseudomonas aeruginosa PA01
gcugcccaucgccuccacggc

SEQ ID NO: 1513759 - RNA, 17 nt, Pseudomonas aeruginosa PA01
gcugcccagcccgccuu

SEQ ID NO: 1513760 - RNA, 17 nt, Pseudomonas aeruginosa PA01
gcugcccaguacccgcu

SEQ ID NO: 1513761 - RNA, 17 nt, Pseudomonas aeruginosa PA01
gcugccauggcggcgga

SEQ ID NO: 1513762 - RNA, 12 nt, Pseudomonas aeruginosa PA01
gcugccauccgc

SEQ ID NO: 1513763 - RNA, 18 nt, Pseudomonas aeruginosa PA01
gcugcccaagggccuggg

SEQ ID NO: 1513764 - RNA, 18 nt, Pseudomonas aeruginosa PA01
gcugcaaaaaagcgcgcc

SEQ ID NO: 1513765 - RNA, 15 nt, Pseudomonas aeruginosa PA01
gcugcaacauggcgu

SEQ ID NO: 1513766 - RNA, 18 nt, Pseudomonas aeruginosa PA01
gcugcaauucgucggccu

SEQ ID NO: 1513767 - RNA, 15 nt, Pseudomonas aeruginosa PA01
gcugcaccagcaggu

SEQ ID NO: 1513768 - RNA, 16 nt, Pseudomonas aeruginosa PA01
gcugcaccgcgcggau

SEQ ID NO: 1513769 - RNA, 22 nt, Pseudomonas aeruginosa PA01
gcugcacguuguugcccaccuc

SEQ ID NO: 1513770 - RNA, 19 nt, Pseudomonas aeruginosa PA01
gcugcagguaggcgguggc

SEQ ID NO: 1513771 - RNA, 16 nt, Pseudomonas aeruginosa PA01
gcugcagggccaggga

SEQ ID NO: 1513772 - RNA, 18 nt, Pseudomonas aeruginosa PA01
gcugcaggccgagaccgc

SEQ ID NO: 1513773 - RNA, 18 nt, Pseudomonas aeruginosa PA01
gcugcagcaucaggcgcu

SEQ ID NO: 1513774 - RNA, 14 nt, Pseudomonas aeruginosa PA01
gcugcagcgcccca

SEQ ID NO: 1513775 - RNA, 17 nt, Pseudomonas aeruginosa PA01
gcugcagcgccccagca

SEQ ID NO: 1513776 - RNA, 15 nt, Pseudomonas aeruginosa PA01
gcugccacucggugc

SEQ ID NO: 1513777 - RNA, 12 nt, Pseudomonas aeruginosa PA01
gcugccagcccc

SEQ ID NO: 1513778 - RNA, 12 nt, Pseudomonas aeruginosa PA01
gcugccagcagg

SEQ ID NO: 1513779 - RNA, 22 nt, Pseudomonas aeruginosa PA01
gcugcaugccgggguccgccgg

SEQ ID NO: 1513780 - RNA, 23 nt, Pseudomonas aeruginosa PA01
gcugcaugaaaaagcccggccgc

SEQ ID NO: 1513781 - RNA, 21 nt, Pseudomonas aeruginosa PA01
gcugcauguccgcaggcaggu

SEQ ID NO: 1513782 - RNA, 23 nt, Pseudomonas aeruginosa PA01
gcugcuguugccagggauacuca

SEQ ID NO: 1513783 - RNA, 14 nt, Pseudomonas aeruginosa PA01
gcugcuguccagcg

SEQ ID NO: 1513784 - RNA, 16 nt, Pseudomonas aeruginosa PA01
gcugcuguccagcgcu

SEQ ID NO: 1513785 - RNA, 19 nt, Pseudomonas aeruginosa PA01
gcugcugucgagggucugc

SEQ ID NO: 1513786 - RNA, 21 nt, Pseudomonas aeruginosa PA01
gcugcugucgagggucugcuc

SEQ ID NO: 1513787 - RNA, 22 nt, Pseudomonas aeruginosa PA01
gcugcuguacagcucaccccag

SEQ ID NO: 1513788 - RNA, 18 nt, Pseudomonas aeruginosa PA01
gcugcuggcgccgcuggc

SEQ ID NO: 1513789 - RNA, 23 nt, Pseudomonas aeruginosa PA01
gcugcuggggaacugggcgagca

SEQ ID NO: 1513790 - RNA, 13 nt, Pseudomonas aeruginosa PA01
gcugcugcgccug

SEQ ID NO: 1513791 - RNA, 16 nt, Pseudomonas aeruginosa PA01
gcugcugcgccuggcc

SEQ ID NO: 1513792 - RNA, 16 nt, Pseudomonas aeruginosa PA01
gcugcugcugcggcgg

SEQ ID NO: 1513793 - RNA, 16 nt, Pseudomonas aeruginosa PA01
gcugcugcugcggcuu

SEQ ID NO: 1513794 - RNA, 12 nt, Pseudomonas aeruginosa PA01
gcugcugcucag

SEQ ID NO: 1513795 - RNA, 13 nt, Pseudomonas aeruginosa PA01
gcugcugcucagc

SEQ ID NO: 1513796 - RNA, 17 nt, Pseudomonas aeruginosa PA01
gcugcugcggggccugc

SEQ ID NO: 1513797 - RNA, 13 nt, Pseudomonas aeruginosa PA01
gcugcuggauggg

SEQ ID NO: 1513798 - RNA, 16 nt, Pseudomonas aeruginosa PA01
gcuggaagccgcgcuc

SEQ ID NO: 1513799 - RNA, 17 nt, Pseudomonas aeruginosa PA01
gcuggaagucguccagc

SEQ ID NO: 1513800 - RNA, 22 nt, Pseudomonas aeruginosa PA01
gcuggaacggccaggucuucug

SEQ ID NO: 1513801 - RNA, 20 nt, Pseudomonas aeruginosa PA01
gcugcuugccgcucaggcug

SEQ ID NO: 1513802 - RNA, 15 nt, Pseudomonas aeruginosa PA01
gcugcuugccggugc

SEQ ID NO: 1513803 - RNA, 16 nt, Pseudomonas aeruginosa PA01
gcuggaguagcugaag

SEQ ID NO: 1513804 - RNA, 21 nt, Pseudomonas aeruginosa PA01
gcuggaguagcugaagcuguc

SEQ ID NO: 1513805 - RNA, 19 nt, Pseudomonas aeruginosa PA01
gcuggaggcuggggacgga

SEQ ID NO: 1513806 - RNA, 19 nt, Pseudomonas aeruginosa PA01
gcuggagcugcgcgcgauc

SEQ ID NO: 1513807 - RNA, 19 nt, Pseudomonas aeruginosa PA01
gcuggagcgcugcggaaga

SEQ ID NO: 1513808 - RNA, 14 nt, Pseudomonas aeruginosa PA01
gcuggagaccuugu

SEQ ID NO: 1513809 - RNA, 13 nt, Pseudomonas aeruginosa PA01
gcuggacuucccg

SEQ ID NO: 1513810 - RNA, 19 nt, Pseudomonas aeruginosa PA01
gcuggagcagcagcgccgc

SEQ ID NO: 1513811 - RNA, 17 nt, Pseudomonas aeruginosa PA01
gcuggaccaggcggccg

SEQ ID NO: 1513812 - RNA, 17 nt, Pseudomonas aeruginosa PA01
gcuggacgacgcuggcc

SEQ ID NO: 1513813 - RNA, 18 nt, Pseudomonas aeruginosa PA01
gcuggacgacgcuggccu

SEQ ID NO: 1513814 - RNA, 19 nt, Pseudomonas aeruginosa PA01
gcuggacgacgcuggccug

SEQ ID NO: 1513815 - RNA, 20 nt, Pseudomonas aeruginosa PA01
gcuggacacgguccaggauc

SEQ ID NO: 1513816 - RNA, 20 nt, Pseudomonas aeruginosa PA01
gcuggcacagguccagcaag

SEQ ID NO: 1513817 - RNA, 21 nt, Pseudomonas aeruginosa PA01
gcuggcaacggcgggccgcuc

SEQ ID NO: 1513818 - RNA, 22 nt, Pseudomonas aeruginosa PA01
gcuggaucugguggaacagcau

SEQ ID NO: 1513819 - RNA, 15 nt, Pseudomonas aeruginosa PA01
gcuggaucugguuga

SEQ ID NO: 1513820 - RNA, 12 nt, Pseudomonas aeruginosa PA01
gcuggauagagu

SEQ ID NO: 1513821 - RNA, 14 nt, Pseudomonas aeruginosa PA01
gcugcggcucgccg

SEQ ID NO: 1513822 - RNA, 18 nt, Pseudomonas aeruginosa PA01
gcugcggcuucgcgugcc

SEQ ID NO: 1513823 - RNA, 13 nt, Pseudomonas aeruginosa PA01
gcugcgggcgccg

SEQ ID NO: 1513824 - RNA, 17 nt, Pseudomonas aeruginosa PA01
gcugcggggugagcagu

SEQ ID NO: 1513825 - RNA, 22 nt, Pseudomonas aeruginosa PA01
gcugcggcggucccagaccagc

SEQ ID NO: 1513826 - RNA, 13 nt, Pseudomonas aeruginosa PA01
gcugcgcuugcug

SEQ ID NO: 1513827 - RNA, 21 nt, Pseudomonas aeruginosa PA01
gcugcggcagguaguggcccu

SEQ ID NO: 1513828 - RNA, 18 nt, Pseudomonas aeruginosa PA01
gcugcgcguacaucccgc

SEQ ID NO: 1513829 - RNA, 17 nt, Pseudomonas aeruginosa PA01
gcugcgcugccagcgcc

SEQ ID NO: 1513830 - RNA, 16 nt, Pseudomonas aeruginosa PA01
gcugcgcugggcgccg

SEQ ID NO: 1513831 - RNA, 16 nt, Pseudomonas aeruginosa PA01
gcugcgcaggccgaga

SEQ ID NO: 1513832 - RNA, 17 nt, Pseudomonas aeruginosa PA01
gcugcgcaccucggcca

SEQ ID NO: 1513833 - RNA, 19 nt, Pseudomonas aeruginosa PA01
gcugcgcagaugcggggcg

SEQ ID NO: 1513834 - RNA, 14 nt, Pseudomonas aeruginosa PA01
gcugcgcagggcgc

SEQ ID NO: 1513835 - RNA, 14 nt, Pseudomonas aeruginosa PA01
gcugcgcgcggccc

SEQ ID NO: 1513836 - RNA, 13 nt, Pseudomonas aeruginosa PA01
gcugcgcgccgca

SEQ ID NO: 1513837 - RNA, 18 nt, Pseudomonas aeruginosa PA01
gcugcgccgcugcggcug

SEQ ID NO: 1513838 - RNA, 17 nt, Pseudomonas aeruginosa PA01
gcugcugaucaggagga

SEQ ID NO: 1513839 - RNA, 23 nt, Pseudomonas aeruginosa PA01
gcugcucgccucgggccaugagc

SEQ ID NO: 1513840 - RNA, 17 nt, Pseudomonas aeruginosa PA01
gcugcucaccaggugau

SEQ ID NO: 1513841 - RNA, 16 nt, Pseudomonas aeruginosa PA01
gcugcucagcgcgcuc

SEQ ID NO: 1513842 - RNA, 20 nt, Pseudomonas aeruginosa PA01
gcugcucagcgcgcucggcc

SEQ ID NO: 1513843 - RNA, 22 nt, Pseudomonas aeruginosa PA01
gcugcucagcgcgcucggccug

SEQ ID NO: 1513844 - RNA, 21 nt, Pseudomonas aeruginosa PA01
gcugcuccuccccguccuggc

SEQ ID NO: 1513845 - RNA, 14 nt, Pseudomonas aeruginosa PA01
gcugcucgaagcaa

SEQ ID NO: 1513846 - RNA, 16 nt, Pseudomonas aeruginosa PA01
gcugcucgaccaccuc

SEQ ID NO: 1513847 - RNA, 20 nt, Pseudomonas aeruginosa PA01
gcugcucgauggcggccugg

SEQ ID NO: 1513848 - RNA, 15 nt, Pseudomonas aeruginosa PA01
gcugcgugccagcac

SEQ ID NO: 1513849 - RNA, 16 nt, Pseudomonas aeruginosa PA01
gcugcgugccagcacc

SEQ ID NO: 1513850 - RNA, 16 nt, Pseudomonas aeruginosa PA01
gcugcgugccagggcu

SEQ ID NO: 1513851 - RNA, 17 nt, Pseudomonas aeruginosa PA01
gcugcguaguugagccc

SEQ ID NO: 1513852 - RNA, 15 nt, Pseudomonas aeruginosa PA01
gcugcguucuucccc

SEQ ID NO: 1513853 - RNA, 17 nt, Pseudomonas aeruginosa PA01
gcugcguucuuccccug

SEQ ID NO: 1513854 - RNA, 24 nt, Pseudomonas aeruginosa PA01
gcugcguucuuccccugcaugccg

SEQ ID NO: 1513855 - RNA, 23 nt, Pseudomonas aeruginosa PA01
gcugucaaucgcgcaacggcagc

SEQ ID NO: 1513856 - RNA, 13 nt, Pseudomonas aeruginosa PA01
gcugucagggcuu

SEQ ID NO: 1513857 - RNA, 20 nt, Pseudomonas aeruginosa PA01
gcugucagggcuugcgcgcc

SEQ ID NO: 1513858 - RNA, 19 nt, Pseudomonas aeruginosa PA01
gcuguaggcgagcagcggc

SEQ ID NO: 1513859 - RNA, 20 nt, Pseudomonas aeruginosa PA01
gcuguaggcgagcagcggca

SEQ ID NO: 1513860 - RNA, 15 nt, Pseudomonas aeruginosa PA01
gcuguagggacaggc

SEQ ID NO: 1513861 - RNA, 20 nt, Pseudomonas aeruginosa PA01
gcuguagccucccgccgcgg

SEQ ID NO: 1513862 - RNA, 22 nt, Pseudomonas aeruginosa PA01
gcuguaggacagguucaggucg

SEQ ID NO: 1513863 - RNA, 20 nt, Pseudomonas aeruginosa PA01
gcuguaguuguucggcuggg

SEQ ID NO: 1513864 - RNA, 15 nt, Pseudomonas aeruginosa PA01
gcuguccaugaagac

SEQ ID NO: 1513865 - RNA, 21 nt, Pseudomonas aeruginosa PA01
gcugucccggccauuccuucc

SEQ ID NO: 1513866 - RNA, 14 nt, Pseudomonas aeruginosa PA01
gcugucgcggaccc

SEQ ID NO: 1513867 - RNA, 20 nt, Pseudomonas aeruginosa PA01
gcugucgcccgggcgccacc

SEQ ID NO: 1513868 - RNA, 21 nt, Pseudomonas aeruginosa PA01
gcugucgccggucaggcugcg

SEQ ID NO: 1513869 - RNA, 16 nt, Pseudomonas aeruginosa PA01
gcugucgccguuggcc

SEQ ID NO: 1513870 - RNA, 18 nt, Pseudomonas aeruginosa PA01
gcugucgacgcagccggg

SEQ ID NO: 1513871 - RNA, 16 nt, Pseudomonas aeruginosa PA01
gcuguacagcaggagc

SEQ ID NO: 1513872 - RNA, 16 nt, Pseudomonas aeruginosa PA01
gcugguguagaggcuc

SEQ ID NO: 1513873 - RNA, 15 nt, Pseudomonas aeruginosa PA01
gcugguugaccaggc

SEQ ID NO: 1513874 - RNA, 16 nt, Pseudomonas aeruginosa PA01
gcugguugccagcagc

SEQ ID NO: 1513875 - RNA, 16 nt, Pseudomonas aeruginosa PA01
gcugguugcccagggu

SEQ ID NO: 1513876 - RNA, 18 nt, Pseudomonas aeruginosa PA01
gcugguggcccugggcgg

SEQ ID NO: 1513877 - RNA, 20 nt, Pseudomonas aeruginosa PA01
gcugguggcccugggcggcg

SEQ ID NO: 1513878 - RNA, 18 nt, Pseudomonas aeruginosa PA01
gcuggugcugcuccauca

SEQ ID NO: 1513879 - RNA, 22 nt, Pseudomonas aeruginosa PA01
gcuggugccgaucagcccgucg

SEQ ID NO: 1513880 - RNA, 14 nt, Pseudomonas aeruginosa PA01
gcuguugguguuga

SEQ ID NO: 1513881 - RNA, 21 nt, Pseudomonas aeruginosa PA01
gcuguuucagcccacgcgccu

SEQ ID NO: 1513882 - RNA, 22 nt, Pseudomonas aeruginosa PA01
gcuguuucagcccacgcgccug

SEQ ID NO: 1513883 - RNA, 13 nt, Pseudomonas aeruginosa PA01
gcuguucuucagu

SEQ ID NO: 1513884 - RNA, 19 nt, Pseudomonas aeruginosa PA01
gcuguucuugauccgcucc

SEQ ID NO: 1513885 - RNA, 14 nt, Pseudomonas aeruginosa PA01
gcuguggcgcggcu

SEQ ID NO: 1513886 - RNA, 17 nt, Pseudomonas aeruginosa PA01
gcugugcucgaggaagc

SEQ ID NO: 1513887 - RNA, 18 nt, Pseudomonas aeruginosa PA01
gcugugcuggccacccuu

SEQ ID NO: 1513888 - RNA, 15 nt, Pseudomonas aeruginosa PA01
gcugucucgccagcc

SEQ ID NO: 1513889 - RNA, 19 nt, Pseudomonas aeruginosa PA01
gcugucguggacgccggug

SEQ ID NO: 1513890 - RNA, 19 nt, Pseudomonas aeruginosa PA01
gcugucggccagccccugc

SEQ ID NO: 1513891 - RNA, 21 nt, Pseudomonas aeruginosa PA01
gcugucguaguccugggccgg

SEQ ID NO: 1513892 - RNA, 13 nt, Pseudomonas aeruginosa PA01
gcugugccccagg

SEQ ID NO: 1513893 - RNA, 21 nt, Pseudomonas aeruginosa PA01
gcugugccauuccugggcccc

SEQ ID NO: 1513894 - RNA, 12 nt, Pseudomonas aeruginosa PA01
gcugugcagggc

SEQ ID NO: 1513895 - RNA, 20 nt, Pseudomonas aeruginosa PA01
gcugugcacggucugcucgg

SEQ ID NO: 1513896 - RNA, 15 nt, Pseudomonas aeruginosa PA01
gcugggacggcggcu

SEQ ID NO: 1513897 - RNA, 17 nt, Pseudomonas aeruginosa PA01
gcugggacggcggcugg

SEQ ID NO: 1513898 - RNA, 18 nt, Pseudomonas aeruginosa PA01
gcugggacggcugcccaa

SEQ ID NO: 1513899 - RNA, 14 nt, Pseudomonas aeruginosa PA01
gcuggcugcccagu

SEQ ID NO: 1513900 - RNA, 17 nt, Pseudomonas aeruginosa PA01
gcuggcugaagccgggc

SEQ ID NO: 1513901 - RNA, 20 nt, Pseudomonas aeruginosa PA01
gcuggggacggaagcauggc

SEQ ID NO: 1513902 - RNA, 20 nt, Pseudomonas aeruginosa PA01
gcugggcgaccuucagcggg

SEQ ID NO: 1513903 - RNA, 18 nt, Pseudomonas aeruginosa PA01
gcugggcggcgaggccga

SEQ ID NO: 1513904 - RNA, 13 nt, Pseudomonas aeruginosa PA01
gcugggcgccggc

SEQ ID NO: 1513905 - RNA, 17 nt, Pseudomonas aeruginosa PA01
gcugggcgccggcaggc

SEQ ID NO: 1513906 - RNA, 12 nt, Pseudomonas aeruginosa PA01
gcugggccuuga

SEQ ID NO: 1513907 - RNA, 14 nt, Pseudomonas aeruginosa PA01
gcugggccuugagc

SEQ ID NO: 1513908 - RNA, 20 nt, Pseudomonas aeruginosa PA01
gcugggccuuguucagggug

SEQ ID NO: 1513909 - RNA, 21 nt, Pseudomonas aeruginosa PA01
gcugggccuuguucagggugg

SEQ ID NO: 1513910 - RNA, 22 nt, Pseudomonas aeruginosa PA01
gcugggccuuguucaggguggc

SEQ ID NO: 1513911 - RNA, 22 nt, Pseudomonas aeruginosa PA01
gcuggcuuccugcuugucgaug

SEQ ID NO: 1513912 - RNA, 14 nt, Pseudomonas aeruginosa PA01
gcugggcagcacgc

SEQ ID NO: 1513913 - RNA, 13 nt, Pseudomonas aeruginosa PA01
gcugggcaggugg

SEQ ID NO: 1513914 - RNA, 20 nt, Pseudomonas aeruginosa PA01
gcugggugucgaccuccgcc

SEQ ID NO: 1513915 - RNA, 19 nt, Pseudomonas aeruginosa PA01
gcugggugcggugggcgag

SEQ ID NO: 1513916 - RNA, 21 nt, Pseudomonas aeruginosa PA01
gcugguaccugccggcacgcu

SEQ ID NO: 1513917 - RNA, 22 nt, Pseudomonas aeruginosa PA01
gcugguaccugccggcacgcuc

SEQ ID NO: 1513918 - RNA, 19 nt, Pseudomonas aeruginosa PA01
gcugguacgcccccucccc

SEQ ID NO: 1513919 - RNA, 15 nt, Pseudomonas aeruginosa PA01
gcuggggcuguugcu

SEQ ID NO: 1513920 - RNA, 18 nt, Pseudomonas aeruginosa PA01
gcuggggcuguugcuggg

SEQ ID NO: 1513921 - RNA, 20 nt, Pseudomonas aeruginosa PA01
gcugggucggcuggcagggc

SEQ ID NO: 1513922 - RNA, 18 nt, Pseudomonas aeruginosa PA01
gcugggucaucgaggcca

SEQ ID NO: 1513923 - RNA, 16 nt, Pseudomonas aeruginosa PA01
gcuggucucuuccagc

SEQ ID NO: 1513924 - RNA, 21 nt, Pseudomonas aeruginosa PA01
gcuggucguagcgacccuuca

SEQ ID NO: 1513925 - RNA, 23 nt, Pseudomonas aeruginosa PA01
gcuggucggcuuccgccgccagg

SEQ ID NO: 1513926 - RNA, 15 nt, Pseudomonas aeruginosa PA01
gcuggucguggucca

SEQ ID NO: 1513927 - RNA, 16 nt, Pseudomonas aeruginosa PA01
gcuggucguucagugc

SEQ ID NO: 1513928 - RNA, 22 nt, Pseudomonas aeruginosa PA01
gcuggucguucagugccagcag

SEQ ID NO: 1513929 - RNA, 22 nt, Pseudomonas aeruginosa PA01
gcuggucaguucggcccagcag

SEQ ID NO: 1513930 - RNA, 14 nt, Pseudomonas aeruginosa PA01
gcugguccagcacg

SEQ ID NO: 1513931 - RNA, 20 nt, Pseudomonas aeruginosa PA01
gcugguccagcacgcuggcg

SEQ ID NO: 1513932 - RNA, 15 nt, Pseudomonas aeruginosa PA01
gcugguagcccaggc

SEQ ID NO: 1513933 - RNA, 20 nt, Pseudomonas aeruginosa PA01
gcugguagcgcuccagcucc

SEQ ID NO: 1513934 - RNA, 20 nt, Pseudomonas aeruginosa PA01
gcuggcgcaacugcgccagc

SEQ ID NO: 1513935 - RNA, 21 nt, Pseudomonas aeruginosa PA01
gcuggcgaggaacacccagaa

SEQ ID NO: 1513936 - RNA, 22 nt, Pseudomonas aeruginosa PA01
gcuggcgcaacagaucuuccuc

SEQ ID NO: 1513937 - RNA, 20 nt, Pseudomonas aeruginosa PA01
gcuggcgaucucggcgcggg

SEQ ID NO: 1513938 - RNA, 19 nt, Pseudomonas aeruginosa PA01
gcuggcgaucaucgcgcac

SEQ ID NO: 1513939 - RNA, 16 nt, Pseudomonas aeruginosa PA01
gcuggcgaaggcgcuc

SEQ ID NO: 1513940 - RNA, 19 nt, Pseudomonas aeruginosa PA01
gcuggcgaagcuggggcug

SEQ ID NO: 1513941 - RNA, 14 nt, Pseudomonas aeruginosa PA01
gcuggccugcaggu

SEQ ID NO: 1513942 - RNA, 17 nt, Pseudomonas aeruginosa PA01
gcuggcgcagccguucc

SEQ ID NO: 1513943 - RNA, 14 nt, Pseudomonas aeruginosa PA01
gcuggcgcaggccu

SEQ ID NO: 1513944 - RNA, 17 nt, Pseudomonas aeruginosa PA01
gcuggcgcagccaggcg

SEQ ID NO: 1513945 - RNA, 19 nt, Pseudomonas aeruginosa PA01
gcuggcgcagccgcugcug

SEQ ID NO: 1513946 - RNA, 15 nt, Pseudomonas aeruginosa PA01
gcuggcgccgucauc

SEQ ID NO: 1513947 - RNA, 19 nt, Pseudomonas aeruginosa PA01
gcuggcgccgcgggucugc

SEQ ID NO: 1513948 - RNA, 21 nt, Pseudomonas aeruginosa PA01
gcuggcgccgcgggucugcuc

SEQ ID NO: 1513949 - RNA, 22 nt, Pseudomonas aeruginosa PA01
gcuggcgccgcgggucugcucg

SEQ ID NO: 1513950 - RNA, 17 nt, Pseudomonas aeruginosa PA01
gcuggcgccgcuggcgu

SEQ ID NO: 1513951 - RNA, 16 nt, Pseudomonas aeruginosa PA01
gcuggcgcucugcagu

SEQ ID NO: 1513952 - RNA, 20 nt, Pseudomonas aeruginosa PA01
gcuggcggauguaguccagc

SEQ ID NO: 1513953 - RNA, 20 nt, Pseudomonas aeruginosa PA01
gcuggcggcaucggcgccgc

SEQ ID NO: 1513954 - RNA, 16 nt, Pseudomonas aeruginosa PA01
gcuggcggggucgcgc

SEQ ID NO: 1513955 - RNA, 22 nt, Pseudomonas aeruginosa PA01
gcuggccgagcgacuccgggaa

SEQ ID NO: 1513956 - RNA, 19 nt, Pseudomonas aeruginosa PA01
gcuggccgagcgccgccug

SEQ ID NO: 1513957 - RNA, 18 nt, Pseudomonas aeruginosa PA01
gcuggcccuccauccagu

SEQ ID NO: 1513958 - RNA, 20 nt, Pseudomonas aeruginosa PA01
gcuggcccucggcguucacc

SEQ ID NO: 1513959 - RNA, 13 nt, Pseudomonas aeruginosa PA01
gcuggccgcggug

SEQ ID NO: 1513960 - RNA, 15 nt, Pseudomonas aeruginosa PA01
gcuggccggcagcag

SEQ ID NO: 1513961 - RNA, 11 nt, Pseudomonas aeruginosa PA01
gcuggccgcgc

SEQ ID NO: 1513962 - RNA, 11 nt, Pseudomonas aeruginosa PA01
gcuggccgcgg

SEQ ID NO: 1513963 - RNA, 24 nt, Pseudomonas aeruginosa PA01
gcuggccgcgcgaccgcggcgcuc

SEQ ID NO: 1513964 - RNA, 20 nt, Pseudomonas aeruginosa PA01
gcuggccggugccauacagc

SEQ ID NO: 1513965 - RNA, 19 nt, Pseudomonas aeruginosa PA01
gcuggccgucgacccgccu

SEQ ID NO: 1513966 - RNA, 19 nt, Pseudomonas aeruginosa PA01
gcuggccgucgaggucggc

SEQ ID NO: 1513967 - RNA, 16 nt, Pseudomonas aeruginosa PA01
gcuggccugcagcagg

SEQ ID NO: 1513968 - RNA, 14 nt, Pseudomonas aeruginosa PA01
gcuggccuggccac

SEQ ID NO: 1513969 - RNA, 18 nt, Pseudomonas aeruginosa PA01
gcuggccuggccacccuu

SEQ ID NO: 1513970 - RNA, 16 nt, Pseudomonas aeruginosa PA01
gcuggccaccagcacc

SEQ ID NO: 1513971 - RNA, 13 nt, Pseudomonas aeruginosa PA01
gcuggccagcagg

SEQ ID NO: 1513972 - RNA, 14 nt, Pseudomonas aeruginosa PA01
gcuggccagcaggc

SEQ ID NO: 1513973 - RNA, 18 nt, Pseudomonas aeruginosa PA01
gcuggccagcccugguag

SEQ ID NO: 1513974 - RNA, 21 nt, Pseudomonas aeruginosa PA01
gcuggcccaguugcccggccu

SEQ ID NO: 1513975 - RNA, 22 nt, Pseudomonas aeruginosa PA01
gcuggccagcaauacccgccgc

SEQ ID NO: 1513976 - RNA, 18 nt, Pseudomonas aeruginosa PA01
gcuggccauccgcccugc

SEQ ID NO: 1513977 - RNA, 19 nt, Pseudomonas aeruginosa PA01
gcuggccagguaggggucg

SEQ ID NO: 1513978 - RNA, 23 nt, Pseudomonas aeruginosa PA01
gcuggccaguuccaugucgcugg

SEQ ID NO: 1513979 - RNA, 17 nt, Pseudomonas aeruginosa PA01
gcuggcaggugccgcuc

SEQ ID NO: 1513980 - RNA, 13 nt, Pseudomonas aeruginosa PA01
gcuggcagggcgc

SEQ ID NO: 1513981 - RNA, 18 nt, Pseudomonas aeruginosa PA01
gcuggcauacacaugcag

SEQ ID NO: 1513982 - RNA, 20 nt, Pseudomonas aeruginosa PA01
gcuuccagaccucgagcagg

SEQ ID NO: 1513983 - RNA, 17 nt, Pseudomonas aeruginosa PA01
gcuuccaccgccugccc

SEQ ID NO: 1513984 - RNA, 20 nt, Pseudomonas aeruginosa PA01
gcuuccaccagacgcagcau

SEQ ID NO: 1513985 - RNA, 14 nt, Pseudomonas aeruginosa PA01
gcuucauccugcgc

SEQ ID NO: 1513986 - RNA, 16 nt, Pseudomonas aeruginosa PA01
gcuucaggcucggccu

SEQ ID NO: 1513987 - RNA, 15 nt, Pseudomonas aeruginosa PA01
gcuucaucaggcugc

SEQ ID NO: 1513988 - RNA, 19 nt, Pseudomonas aeruginosa PA01
gcuucaucgaggugcuuga

SEQ ID NO: 1513989 - RNA, 21 nt, Pseudomonas aeruginosa PA01
gcuucagcucgaggccaggau

SEQ ID NO: 1513990 - RNA, 19 nt, Pseudomonas aeruginosa PA01
gcuucaggguggcgcugcc

SEQ ID NO: 1513991 - RNA, 22 nt, Pseudomonas aeruginosa PA01
gcuucagguagcucaucggcga

SEQ ID NO: 1513992 - RNA, 22 nt, Pseudomonas aeruginosa PA01
gcuucagguagugcaacaccug

SEQ ID NO: 1513993 - RNA, 17 nt, Pseudomonas aeruginosa PA01
gcuucaggucgugcugg

SEQ ID NO: 1513994 - RNA, 23 nt, Pseudomonas aeruginosa PA01
gcuucagccgaccguccgccugc

SEQ ID NO: 1513995 - RNA, 16 nt, Pseudomonas aeruginosa PA01
gcuucagcgccaggcc

SEQ ID NO: 1513996 - RNA, 19 nt, Pseudomonas aeruginosa PA01
gcuucagcgccucgaccug

SEQ ID NO: 1513997 - RNA, 22 nt, Pseudomonas aeruginosa PA01
gcuucagcgcgccgagccaggu

SEQ ID NO: 1513998 - RNA, 14 nt, Pseudomonas aeruginosa PA01
gcuucacucauccu

SEQ ID NO: 1513999 - RNA, 12 nt, Pseudomonas aeruginosa PA01
gcuucagagcug

SEQ ID NO: 1514000 - RNA, 18 nt, Pseudomonas aeruginosa PA01
gcuucaaccguggcucga

SEQ ID NO: 1514001 - RNA, 17 nt, Pseudomonas aeruginosa PA01
gcuugaacgcgcgccug

SEQ ID NO: 1514002 - RNA, 19 nt, Pseudomonas aeruginosa PA01
gcuucuucagcagcgggcg

SEQ ID NO: 1514003 - RNA, 22 nt, Pseudomonas aeruginosa PA01
gcuucuucagcagcgggcgucc

SEQ ID NO: 1514004 - RNA, 12 nt, Pseudomonas aeruginosa PA01
gcuucugguugu

SEQ ID NO: 1514005 - RNA, 12 nt, Pseudomonas aeruginosa PA01
gcuucuuccugg

SEQ ID NO: 1514006 - RNA, 15 nt, Pseudomonas aeruginosa PA01
gcuucuuccuggccg

SEQ ID NO: 1514007 - RNA, 15 nt, Pseudomonas aeruginosa PA01
gcuucgucccaugac

SEQ ID NO: 1514008 - RNA, 15 nt, Pseudomonas aeruginosa PA01
gcuucguccugcugc

SEQ ID NO: 1514009 - RNA, 17 nt, Pseudomonas aeruginosa PA01
gcuucguccugcugcug

SEQ ID NO: 1514010 - RNA, 20 nt, Pseudomonas aeruginosa PA01
gcuucguccugcugcuggcc

SEQ ID NO: 1514011 - RNA, 22 nt, Pseudomonas aeruginosa PA01
gcuucuccaccggaucgcccug

SEQ ID NO: 1514012 - RNA, 17 nt, Pseudomonas aeruginosa PA01
gcuucugcgccuccucg

SEQ ID NO: 1514013 - RNA, 16 nt, Pseudomonas aeruginosa PA01
gcuucugcucggccug

SEQ ID NO: 1514014 - RNA, 13 nt, Pseudomonas aeruginosa PA01
gcuucugcuggcc

SEQ ID NO: 1514015 - RNA, 20 nt, Pseudomonas aeruginosa PA01
gcuucucgguagggccgagg

SEQ ID NO: 1514016 - RNA, 15 nt, Pseudomonas aeruginosa PA01
gcuucgguguaucgg

SEQ ID NO: 1514017 - RNA, 14 nt, Pseudomonas aeruginosa PA01
gcuucggcggucag

SEQ ID NO: 1514018 - RNA, 22 nt, Pseudomonas aeruginosa PA01
gcuucgggagucaacgccuggc

SEQ ID NO: 1514019 - RNA, 17 nt, Pseudomonas aeruginosa PA01
gcuucgaccagggcauc

SEQ ID NO: 1514020 - RNA, 18 nt, Pseudomonas aeruginosa PA01
gcuucgagcacuucccag

SEQ ID NO: 1514021 - RNA, 17 nt, Pseudomonas aeruginosa PA01
gcuucgaacgugcgcgc

SEQ ID NO: 1514022 - RNA, 12 nt, Pseudomonas aeruginosa PA01
gcuuccuugccc

SEQ ID NO: 1514023 - RNA, 14 nt, Pseudomonas aeruginosa PA01
gcuucgcccuacgc

SEQ ID NO: 1514024 - RNA, 17 nt, Pseudomonas aeruginosa PA01
gcuucgcccgccgccug

SEQ ID NO: 1514025 - RNA, 19 nt, Pseudomonas aeruginosa PA01
gcuucgccgccgcgcgcgc

SEQ ID NO: 1514026 - RNA, 20 nt, Pseudomonas aeruginosa PA01
gcuucgccaucgauggucac

SEQ ID NO: 1514027 - RNA, 20 nt, Pseudomonas aeruginosa PA01
gcuucgcggaucucaggacc

SEQ ID NO: 1514028 - RNA, 23 nt, Pseudomonas aeruginosa PA01
gcuucgccggguguuuuuccucg

SEQ ID NO: 1514029 - RNA, 12 nt, Pseudomonas aeruginosa PA01
gcuuccguaggu

SEQ ID NO: 1514030 - RNA, 16 nt, Pseudomonas aeruginosa PA01
gcuuccucgcccucau

SEQ ID NO: 1514031 - RNA, 22 nt, Pseudomonas aeruginosa PA01
gcuuccugggaauugcgcacgc

SEQ ID NO: 1514032 - RNA, 19 nt, Pseudomonas aeruginosa PA01
gcuuccugggcuucguccg

SEQ ID NO: 1514033 - RNA, 24 nt, Pseudomonas aeruginosa PA01
gcuuccggcgcuccacagcugcca

SEQ ID NO: 1514034 - RNA, 16 nt, Pseudomonas aeruginosa PA01
gcuuccggcagccagc

SEQ ID NO: 1514035 - RNA, 17 nt, Pseudomonas aeruginosa PA01
gcuuccggcagccagcc

SEQ ID NO: 1514036 - RNA, 14 nt, Pseudomonas aeruginosa PA01
gcuuccggcccggc

SEQ ID NO: 1514037 - RNA, 16 nt, Pseudomonas aeruginosa PA01
gcuuccgccgccaggu

SEQ ID NO: 1514038 - RNA, 15 nt, Pseudomonas aeruginosa PA01
gcuucccgcauggca

SEQ ID NO: 1514039 - RNA, 21 nt, Pseudomonas aeruginosa PA01
gcuuccgacucuccgcgccgc

SEQ ID NO: 1514040 - RNA, 19 nt, Pseudomonas aeruginosa PA01
gcuuccgagcaguugcaga

SEQ ID NO: 1514041 - RNA, 15 nt, Pseudomonas aeruginosa PA01
gcuucccaggccagc

SEQ ID NO: 1514042 - RNA, 19 nt, Pseudomonas aeruginosa PA01
gcuucccaggccagcgggc

SEQ ID NO: 1514043 - RNA, 17 nt, Pseudomonas aeruginosa PA01
gcuuccagccagcccuc

SEQ ID NO: 1514044 - RNA, 23 nt, Pseudomonas aeruginosa PA01
gcuuccagccagcccucggggaa

SEQ ID NO: 1514045 - RNA, 23 nt, Pseudomonas aeruginosa PA01
gcuuccagcuuggcacggccggc

SEQ ID NO: 1514046 - RNA, 16 nt, Pseudomonas aeruginosa PA01
gcuuccaggcacgaau

SEQ ID NO: 1514047 - RNA, 16 nt, Pseudomonas aeruginosa PA01
gcuugacgaucuucug

SEQ ID NO: 1514048 - RNA, 20 nt, Pseudomonas aeruginosa PA01
gcuugaggaaguagugcagc

SEQ ID NO: 1514049 - RNA, 20 nt, Pseudomonas aeruginosa PA01
gcuugcaguucagccacugc

SEQ ID NO: 1514050 - RNA, 15 nt, Pseudomonas aeruginosa PA01
gcuugccgggugcua

SEQ ID NO: 1514051 - RNA, 22 nt, Pseudomonas aeruginosa PA01
gcuugccggcagcgaccaccac

SEQ ID NO: 1514052 - RNA, 15 nt, Pseudomonas aeruginosa PA01
gcuugccggccgcca

SEQ ID NO: 1514053 - RNA, 14 nt, Pseudomonas aeruginosa PA01
gcuugccguccagc

SEQ ID NO: 1514054 - RNA, 18 nt, Pseudomonas aeruginosa PA01
gcuugccguccagcgaga

SEQ ID NO: 1514055 - RNA, 14 nt, Pseudomonas aeruginosa PA01
gcuugcccucaggg

SEQ ID NO: 1514056 - RNA, 16 nt, Pseudomonas aeruginosa PA01
gcuugccgagcugggc

SEQ ID NO: 1514057 - RNA, 17 nt, Pseudomonas aeruginosa PA01
gcuugccgagcugggcg

SEQ ID NO: 1514058 - RNA, 19 nt, Pseudomonas aeruginosa PA01
gcuugccgagguucuucca

SEQ ID NO: 1514059 - RNA, 17 nt, Pseudomonas aeruginosa PA01
gcuugcgcucagggaca

SEQ ID NO: 1514060 - RNA, 15 nt, Pseudomonas aeruginosa PA01
gcuugcgggcgcgcc

SEQ ID NO: 1514061 - RNA, 17 nt, Pseudomonas aeruginosa PA01
gcuugcgggcgcgccug

SEQ ID NO: 1514062 - RNA, 20 nt, Pseudomonas aeruginosa PA01
gcuugcgggcgcgccugagc

SEQ ID NO: 1514063 - RNA, 20 nt, Pseudomonas aeruginosa PA01
gcuuggccacuccgggcugg

SEQ ID NO: 1514064 - RNA, 15 nt, Pseudomonas aeruginosa PA01
gcuuggccagcaggc

SEQ ID NO: 1514065 - RNA, 15 nt, Pseudomonas aeruginosa PA01
gcuugcucuccacua

SEQ ID NO: 1514066 - RNA, 15 nt, Pseudomonas aeruginosa PA01
gcuugugggcaugcu

SEQ ID NO: 1514067 - RNA, 22 nt, Pseudomonas aeruginosa PA01
gcuugugguagugguaaugagc

SEQ ID NO: 1514068 - RNA, 18 nt, Pseudomonas aeruginosa PA01
gcuugucgucggccuuga

SEQ ID NO: 1514069 - RNA, 23 nt, Pseudomonas aeruginosa PA01
gcuugucguggcgggcucugugc

SEQ ID NO: 1514070 - RNA, 16 nt, Pseudomonas aeruginosa PA01
gcuugucgccuuccuc

SEQ ID NO: 1514071 - RNA, 20 nt, Pseudomonas aeruginosa PA01
gcuuguccgagaccggcagc

SEQ ID NO: 1514072 - RNA, 21 nt, Pseudomonas aeruginosa PA01
gcuuguccgccggaauguugc

SEQ ID NO: 1514073 - RNA, 15 nt, Pseudomonas aeruginosa PA01
gcuuguccuccagcu

SEQ ID NO: 1514074 - RNA, 16 nt, Pseudomonas aeruginosa PA01
gcuuguccuccagcug

SEQ ID NO: 1514075 - RNA, 22 nt, Pseudomonas aeruginosa PA01
gcuuguccuccagcugcgccug

SEQ ID NO: 1514076 - RNA, 18 nt, Pseudomonas aeruginosa PA01
gcuuguagcccaggggca

SEQ ID NO: 1514077 - RNA, 22 nt, Pseudomonas aeruginosa PA01
gcuuggucacgccguucagggu

SEQ ID NO: 1514078 - RNA, 23 nt, Pseudomonas aeruginosa PA01
gcuuggucacgccguucaggguc

SEQ ID NO: 1514079 - RNA, 15 nt, Pseudomonas aeruginosa PA01
gcuugguguagagau

SEQ ID NO: 1514080 - RNA, 20 nt, Pseudomonas aeruginosa PA01
gcuugggcgccucgccgcgg

SEQ ID NO: 1514081 - RNA, 22 nt, Pseudomonas aeruginosa PA01
gcuugggcacgcggaucuggcc

SEQ ID NO: 1514082 - RNA, 18 nt, Pseudomonas aeruginosa PA01
gcuuggcccugcgcgcgc

SEQ ID NO: 1514083 - RNA, 9 nt, Pseudomonas aeruginosa PA01
gcuuggccu

SEQ ID NO: 1514084 - RNA, 17 nt, Pseudomonas aeruginosa PA01
gcuuggccuugauggug

SEQ ID NO: 1514085 - RNA, 12 nt, Pseudomonas aeruginosa PA01
gcuuggccuugc

SEQ ID NO: 1514086 - RNA, 16 nt, Pseudomonas aeruginosa PA01
gcuuggcgcgcuggca

SEQ ID NO: 1514087 - RNA, 16 nt, Pseudomonas aeruginosa PA01
gcuuguuggccagcag

SEQ ID NO: 1514088 - RNA, 18 nt, Pseudomonas aeruginosa PA01
gcuuuuucauuuccuccg

SEQ ID NO: 1514089 - RNA, 16 nt, Pseudomonas aeruginosa PA01
gcuuuuucguuggcca

SEQ ID NO: 1514090 - RNA, 12 nt, Pseudomonas aeruginosa PA01
gcuuuuuccgcu

SEQ ID NO: 1514091 - RNA, 21 nt, Pseudomonas aeruginosa PA01
gcuuuuccucgacccacuggc

SEQ ID NO: 1514092 - RNA, 14 nt, Pseudomonas aeruginosa PA01
gcuuugggagcagg

SEQ ID NO: 1514093 - RNA, 21 nt, Pseudomonas aeruginosa PA01
gcuuuccucggccaugccggc

SEQ ID NO: 1514094 - RNA, 23 nt, Pseudomonas aeruginosa PA01
gcuuuccucggccaugccggcca

SEQ ID NO: 1514095 - RNA, 14 nt, Pseudomonas aeruginosa PA01
gcuuuccugcgccu

SEQ ID NO: 1514096 - RNA, 15 nt, Pseudomonas aeruginosa PA01
gcuuuccugcuccag

SEQ ID NO: 1514097 - RNA, 17 nt, Pseudomonas aeruginosa PA01
gcuuuccugcuccagca

SEQ ID NO: 1514098 - RNA, 14 nt, Pseudomonas aeruginosa PA01
gcuuucccuguagc

SEQ ID NO: 1514099 - RNA, 19 nt, Pseudomonas aeruginosa PA01
gcuuuccgucucaggcgcc

SEQ ID NO: 1514100 - RNA, 17 nt, Pseudomonas aeruginosa PA01
gcuuuccagggccuggc

SEQ ID NO: 1514101 - RNA, 15 nt, Pseudomonas aeruginosa PA01
gcuuuccccggcggc

SEQ ID NO: 1514102 - RNA, 19 nt, Pseudomonas aeruginosa PA01
gcuuuccggcgcggccugc

SEQ ID NO: 1514103 - RNA, 20 nt, Pseudomonas aeruginosa PA01
gcuuuccggcgcggccugca

SEQ ID NO: 1514104 - RNA, 22 nt, Pseudomonas aeruginosa PA01
gcuuuccggcgcggccugcagc

SEQ ID NO: 1514105 - RNA, 16 nt, Pseudomonas aeruginosa PA01
gcuuuccagcaggcgc

SEQ ID NO: 1514106 - RNA, 18 nt, Pseudomonas aeruginosa PA01
gcuuuccaccgccagcac

SEQ ID NO: 1514107 - RNA, 13 nt, Pseudomonas aeruginosa PA01
gcuuucuuccagc

SEQ ID NO: 1514108 - RNA, 16 nt, Pseudomonas aeruginosa PA01
gcuuucuucgccuggc

SEQ ID NO: 1514109 - RNA, 20 nt, Pseudomonas aeruginosa PA01
gcuuugcauggccuguacca

SEQ ID NO: 1514110 - RNA, 19 nt, Pseudomonas aeruginosa PA01
ggaaaaacccggcccaggc

SEQ ID NO: 1514111 - RNA, 23 nt, Pseudomonas aeruginosa PA01
ggaaaacgccgcgaagcccagcg

SEQ ID NO: 1514112 - RNA, 17 nt, Pseudomonas aeruginosa PA01
ggaaaccuucgguggcg

SEQ ID NO: 1514113 - RNA, 13 nt, Pseudomonas aeruginosa PA01
ggaaaccggccag

SEQ ID NO: 1514114 - RNA, 14 nt, Pseudomonas aeruginosa PA01
ggaaaccggccagc

SEQ ID NO: 1514115 - RNA, 15 nt, Pseudomonas aeruginosa PA01
ggaaaccggccagcg

SEQ ID NO: 1514116 - RNA, 16 nt, Pseudomonas aeruginosa PA01
ggaaaccggccagcgc

SEQ ID NO: 1514117 - RNA, 23 nt, Pseudomonas aeruginosa PA01
ggaaaccccggccuggcgccggg

SEQ ID NO: 1514118 - RNA, 19 nt, Pseudomonas aeruginosa PA01
ggaaacaccaggccgauga

SEQ ID NO: 1514119 - RNA, 14 nt, Pseudomonas aeruginosa PA01
ggaaacucacccug

SEQ ID NO: 1514120 - RNA, 22 nt, Pseudomonas aeruginosa PA01
ggaaaggcgucguugccgauca

SEQ ID NO: 1514121 - RNA, 18 nt, Pseudomonas aeruginosa PA01
ggaacagcuccuccagcg

SEQ ID NO: 1514122 - RNA, 22 nt, Pseudomonas aeruginosa PA01
ggaacauggucgagaaggcugc

SEQ ID NO: 1514123 - RNA, 14 nt, Pseudomonas aeruginosa PA01
ggaacagcagccag

SEQ ID NO: 1514124 - RNA, 17 nt, Pseudomonas aeruginosa PA01
ggaacagcagccaggcg

SEQ ID NO: 1514125 - RNA, 15 nt, Pseudomonas aeruginosa PA01
ggaacagccgcagcg

SEQ ID NO: 1514126 - RNA, 20 nt, Pseudomonas aeruginosa PA01
ggaacagguucggcaggccu

SEQ ID NO: 1514127 - RNA, 22 nt, Pseudomonas aeruginosa PA01
ggaaccaggggucgacgcaggg

SEQ ID NO: 1514128 - RNA, 16 nt, Pseudomonas aeruginosa PA01
ggaaccgacgcgcagg

SEQ ID NO: 1514129 - RNA, 18 nt, Pseudomonas aeruginosa PA01
ggaaccgauggccagggg

SEQ ID NO: 1514130 - RNA, 18 nt, Pseudomonas aeruginosa PA01
ggaacgaugccgcaggca

SEQ ID NO: 1514131 - RNA, 17 nt, Pseudomonas aeruginosa PA01
ggaaaucgagcgccagg

SEQ ID NO: 1514132 - RNA, 19 nt, Pseudomonas aeruginosa PA01
ggaaaugcucgccguccgc

SEQ ID NO: 1514133 - RNA, 15 nt, Pseudomonas aeruginosa PA01
ggaagcgaaccaggc

SEQ ID NO: 1514134 - RNA, 17 nt, Pseudomonas aeruginosa PA01
ggaagcgaucuccugcc

SEQ ID NO: 1514135 - RNA, 17 nt, Pseudomonas aeruginosa PA01
ggaagccgaccggcgcc

SEQ ID NO: 1514136 - RNA, 17 nt, Pseudomonas aeruginosa PA01
ggaagccgaucggcaug

SEQ ID NO: 1514137 - RNA, 21 nt, Pseudomonas aeruginosa PA01
ggaagcacggcucggcgagga

SEQ ID NO: 1514138 - RNA, 15 nt, Pseudomonas aeruginosa PA01
ggaagcucggcagca

SEQ ID NO: 1514139 - RNA, 16 nt, Pseudomonas aeruginosa PA01
ggaagcucggcagcac

SEQ ID NO: 1514140 - RNA, 20 nt, Pseudomonas aeruginosa PA01
ggaagcggucguagcccaug

SEQ ID NO: 1514141 - RNA, 18 nt, Pseudomonas aeruginosa PA01
ggaagcgcugcucgacca

SEQ ID NO: 1514142 - RNA, 15 nt, Pseudomonas aeruginosa PA01
ggaagcugccuucca

SEQ ID NO: 1514143 - RNA, 19 nt, Pseudomonas aeruginosa PA01
ggaagcugccuuccagcag

SEQ ID NO: 1514144 - RNA, 20 nt, Pseudomonas aeruginosa PA01
ggaagcugccuuccagcagg

SEQ ID NO: 1514145 - RNA, 21 nt, Pseudomonas aeruginosa PA01
ggaagcugccuuccagcaggu

SEQ ID NO: 1514146 - RNA, 23 nt, Pseudomonas aeruginosa PA01
ggaagaauaccgccagcucgcug

SEQ ID NO: 1514147 - RNA, 22 nt, Pseudomonas aeruginosa PA01
ggaagaucuccggguccaucug

SEQ ID NO: 1514148 - RNA, 21 nt, Pseudomonas aeruginosa PA01
ggaagaugcacaccagcuccc

SEQ ID NO: 1514149 - RNA, 22 nt, Pseudomonas aeruginosa PA01
ggaagaugcacaccagcucccc

SEQ ID NO: 1514150 - RNA, 19 nt, Pseudomonas aeruginosa PA01
ggaagagcagcgcggcggc

SEQ ID NO: 1514151 - RNA, 13 nt, Pseudomonas aeruginosa PA01
ggaagagcaggcg

SEQ ID NO: 1514152 - RNA, 17 nt, Pseudomonas aeruginosa PA01
ggaagagcccgccacgc

SEQ ID NO: 1514153 - RNA, 20 nt, Pseudomonas aeruginosa PA01
ggaagagcccgccacgcuug

SEQ ID NO: 1514154 - RNA, 15 nt, Pseudomonas aeruginosa PA01
ggaacgcccgcggca

SEQ ID NO: 1514155 - RNA, 12 nt, Pseudomonas aeruginosa PA01
ggaacgcgagga

SEQ ID NO: 1514156 - RNA, 21 nt, Pseudomonas aeruginosa PA01
ggaacgcggcuucggucaggu

SEQ ID NO: 1514157 - RNA, 23 nt, Pseudomonas aeruginosa PA01
ggaacguucaguucugggcggcc

SEQ ID NO: 1514158 - RNA, 13 nt, Pseudomonas aeruginosa PA01
ggaacucgaucag

SEQ ID NO: 1514159 - RNA, 11 nt, Pseudomonas aeruginosa PA01
ggaacugggcg

SEQ ID NO: 1514160 - RNA, 16 nt, Pseudomonas aeruginosa PA01
ggaacuggucgauccg

SEQ ID NO: 1514161 - RNA, 18 nt, Pseudomonas aeruginosa PA01
ggaauccagggccgagca

SEQ ID NO: 1514162 - RNA, 13 nt, Pseudomonas aeruginosa PA01
ggaaugcucagca

SEQ ID NO: 1514163 - RNA, 22 nt, Pseudomonas aeruginosa PA01
ggaauggcgcgcaaaaaaaggg

SEQ ID NO: 1514164 - RNA, 23 nt, Pseudomonas aeruginosa PA01
ggaauggcgcgcaaaaaaagggg

SEQ ID NO: 1514165 - RNA, 21 nt, Pseudomonas aeruginosa PA01
ggaaggcgcugggcggcuggc

SEQ ID NO: 1514166 - RNA, 23 nt, Pseudomonas aeruginosa PA01
ggaaggcucguucguagaucccu

SEQ ID NO: 1514167 - RNA, 17 nt, Pseudomonas aeruginosa PA01
ggaaggcuucgcgguug

SEQ ID NO: 1514168 - RNA, 19 nt, Pseudomonas aeruginosa PA01
ggaagggaaaaaagggagc

SEQ ID NO: 1514169 - RNA, 17 nt, Pseudomonas aeruginosa PA01
ggaaggauuccacccgc

SEQ ID NO: 1514170 - RNA, 19 nt, Pseudomonas aeruginosa PA01
ggaaggauuccacccgcuc

SEQ ID NO: 1514171 - RNA, 13 nt, Pseudomonas aeruginosa PA01
ggaaggccgggcc

SEQ ID NO: 1514172 - RNA, 12 nt, Pseudomonas aeruginosa PA01
ggaaggccagca

SEQ ID NO: 1514173 - RNA, 14 nt, Pseudomonas aeruginosa PA01
ggaaggccagcagg

SEQ ID NO: 1514174 - RNA, 15 nt, Pseudomonas aeruginosa PA01
ggaaggucggcagca

SEQ ID NO: 1514175 - RNA, 12 nt, Pseudomonas aeruginosa PA01
ggaauucuuccg

SEQ ID NO: 1514176 - RNA, 22 nt, Pseudomonas aeruginosa PA01
ggacaccucccgggccagcucc

SEQ ID NO: 1514177 - RNA, 23 nt, Pseudomonas aeruginosa PA01
ggacaccucccgggccagcuccg

SEQ ID NO: 1514178 - RNA, 12 nt, Pseudomonas aeruginosa PA01
ggacacccugcu

SEQ ID NO: 1514179 - RNA, 22 nt, Pseudomonas aeruginosa PA01
ggacacccugcugcugcucagc

SEQ ID NO: 1514180 - RNA, 23 nt, Pseudomonas aeruginosa PA01
ggacaccgcggugucggugcccu

SEQ ID NO: 1514181 - RNA, 18 nt, Pseudomonas aeruginosa PA01
ggacaggcauuccgggca

SEQ ID NO: 1514182 - RNA, 17 nt, Pseudomonas aeruginosa PA01
ggacggcagggucagcc

SEQ ID NO: 1514183 - RNA, 23 nt, Pseudomonas aeruginosa PA01
ggacuaccuucgaucacccgguc

SEQ ID NO: 1514184 - RNA, 19 nt, Pseudomonas aeruginosa PA01
ggacguguaccuggguugc

SEQ ID NO: 1514185 - RNA, 19 nt, Pseudomonas aeruginosa PA01
ggacuagagguaccagucu

SEQ ID NO: 1514186 - RNA, 14 nt, Pseudomonas aeruginosa PA01
ggacaucccggggu

SEQ ID NO: 1514187 - RNA, 14 nt, Pseudomonas aeruginosa PA01
ggacgccgggcugg

SEQ ID NO: 1514188 - RNA, 15 nt, Pseudomonas aeruginosa PA01
ggacgcuccugcgcc

SEQ ID NO: 1514189 - RNA, 13 nt, Pseudomonas aeruginosa PA01
ggacgcgccggcg

SEQ ID NO: 1514190 - RNA, 18 nt, Pseudomonas aeruginosa PA01
ggacgcgcaugcagggcg

SEQ ID NO: 1514191 - RNA, 15 nt, Pseudomonas aeruginosa PA01
ggacagggccaggcc

SEQ ID NO: 1514192 - RNA, 17 nt, Pseudomonas aeruginosa PA01
ggacagguugucgacca

SEQ ID NO: 1514193 - RNA, 18 nt, Pseudomonas aeruginosa PA01
ggacauacaggcgcgccu

SEQ ID NO: 1514194 - RNA, 19 nt, Pseudomonas aeruginosa PA01
ggacauacaggcgcgccug

SEQ ID NO: 1514195 - RNA, 22 nt, Pseudomonas aeruginosa PA01
ggagacaggaaucgacccagcc

SEQ ID NO: 1514196 - RNA, 22 nt, Pseudomonas aeruginosa PA01
ggagaacgccgccacgccgaua

SEQ ID NO: 1514197 - RNA, 23 nt, Pseudomonas aeruginosa PA01
ggagaaguagucauugcgcugug

SEQ ID NO: 1514198 - RNA, 14 nt, Pseudomonas aeruginosa PA01
ggacuccgcccagu

SEQ ID NO: 1514199 - RNA, 16 nt, Pseudomonas aeruginosa PA01
ggagagacccgccagc

SEQ ID NO: 1514200 - RNA, 19 nt, Pseudomonas aeruginosa PA01
ggagagacccgccagcggc

SEQ ID NO: 1514201 - RNA, 15 nt, Pseudomonas aeruginosa PA01
ggagagcagcacggc

SEQ ID NO: 1514202 - RNA, 16 nt, Pseudomonas aeruginosa PA01
ggagagauagucgccg

SEQ ID NO: 1514203 - RNA, 14 nt, Pseudomonas aeruginosa PA01
ggagagcccgggcg

SEQ ID NO: 1514204 - RNA, 21 nt, Pseudomonas aeruginosa PA01
ggagagcgaauacaccgagcg

SEQ ID NO: 1514205 - RNA, 13 nt, Pseudomonas aeruginosa PA01
ggagagggcggcg

SEQ ID NO: 1514206 - RNA, 18 nt, Pseudomonas aeruginosa PA01
ggagcaccgcgccuucca

SEQ ID NO: 1514207 - RNA, 23 nt, Pseudomonas aeruginosa PA01
ggagcacgccgugcagggucagg

SEQ ID NO: 1514208 - RNA, 20 nt, Pseudomonas aeruginosa PA01
ggagcacagccauuucugcu

SEQ ID NO: 1514209 - RNA, 18 nt, Pseudomonas aeruginosa PA01
ggagcagaaccgccagca

SEQ ID NO: 1514210 - RNA, 18 nt, Pseudomonas aeruginosa PA01
ggagccaacgcccgggcc

SEQ ID NO: 1514211 - RNA, 17 nt, Pseudomonas aeruginosa PA01
ggagccccguuuuuccu

SEQ ID NO: 1514212 - RNA, 16 nt, Pseudomonas aeruginosa PA01
ggagccaggcggcucc

SEQ ID NO: 1514213 - RNA, 19 nt, Pseudomonas aeruginosa PA01
ggagccggugccggcggcg

SEQ ID NO: 1514214 - RNA, 16 nt, Pseudomonas aeruginosa PA01
ggagccguagggcgca

SEQ ID NO: 1514215 - RNA, 14 nt, Pseudomonas aeruginosa PA01
ggagccuacggagg

SEQ ID NO: 1514216 - RNA, 14 nt, Pseudomonas aeruginosa PA01
ggagcgucggaagc

SEQ ID NO: 1514217 - RNA, 12 nt, Pseudomonas aeruginosa PA01
ggaggcggcggu

SEQ ID NO: 1514218 - RNA, 23 nt, Pseudomonas aeruginosa PA01
ggaggaauaaagaaaaggccgcg

SEQ ID NO: 1514219 - RNA, 13 nt, Pseudomonas aeruginosa PA01
ggagcuuugcagg

SEQ ID NO: 1514220 - RNA, 18 nt, Pseudomonas aeruginosa PA01
ggaggucgcacgcagcgc

SEQ ID NO: 1514221 - RNA, 18 nt, Pseudomonas aeruginosa PA01
ggagguagcugcgccgcc

SEQ ID NO: 1514222 - RNA, 23 nt, Pseudomonas aeruginosa PA01
ggaguuucaucucggcgcaggca

SEQ ID NO: 1514223 - RNA, 13 nt, Pseudomonas aeruginosa PA01
ggaucagcgccuc

SEQ ID NO: 1514224 - RNA, 21 nt, Pseudomonas aeruginosa PA01
ggaucagucaggaucggcgcc

SEQ ID NO: 1514225 - RNA, 15 nt, Pseudomonas aeruginosa PA01
ggaucauccgcacca

SEQ ID NO: 1514226 - RNA, 16 nt, Pseudomonas aeruginosa PA01
ggauacaggcgcagca

SEQ ID NO: 1514227 - RNA, 17 nt, Pseudomonas aeruginosa PA01
ggauauccccccacccg

SEQ ID NO: 1514228 - RNA, 15 nt, Pseudomonas aeruginosa PA01
ggaucgcgcaaugcc

SEQ ID NO: 1514229 - RNA, 19 nt, Pseudomonas aeruginosa PA01
ggaucgcugagcaucuggg

SEQ ID NO: 1514230 - RNA, 13 nt, Pseudomonas aeruginosa PA01
ggaucgccacgcc

SEQ ID NO: 1514231 - RNA, 17 nt, Pseudomonas aeruginosa PA01
ggaucgccacgccggcg

SEQ ID NO: 1514232 - RNA, 12 nt, Pseudomonas aeruginosa PA01
ggaucgccagca

SEQ ID NO: 1514233 - RNA, 15 nt, Pseudomonas aeruginosa PA01
ggaucgccagcaauu

SEQ ID NO: 1514234 - RNA, 20 nt, Pseudomonas aeruginosa PA01
ggaucgccuccaccagcgcc

SEQ ID NO: 1514235 - RNA, 21 nt, Pseudomonas aeruginosa PA01
ggaucgccuccggcacgcugc

SEQ ID NO: 1514236 - RNA, 19 nt, Pseudomonas aeruginosa PA01
ggaucgcccuggcgccagc

SEQ ID NO: 1514237 - RNA, 15 nt, Pseudomonas aeruginosa PA01
ggaucgccaggcuga

SEQ ID NO: 1514238 - RNA, 16 nt, Pseudomonas aeruginosa PA01
ggauccgugccaggcg

SEQ ID NO: 1514239 - RNA, 17 nt, Pseudomonas aeruginosa PA01
ggauccgugccaggcgc

SEQ ID NO: 1514240 - RNA, 22 nt, Pseudomonas aeruginosa PA01
ggaucgacagcagcgccagggc

SEQ ID NO: 1514241 - RNA, 15 nt, Pseudomonas aeruginosa PA01
ggaucgaacuggcca

SEQ ID NO: 1514242 - RNA, 20 nt, Pseudomonas aeruginosa PA01
ggaucgaacuggccagcacc

SEQ ID NO: 1514243 - RNA, 21 nt, Pseudomonas aeruginosa PA01
ggaucgacgccgcuggcggcg

SEQ ID NO: 1514244 - RNA, 22 nt, Pseudomonas aeruginosa PA01
ggauccugcucagcggcccagc

SEQ ID NO: 1514245 - RNA, 17 nt, Pseudomonas aeruginosa PA01
ggaucgagccagcgcuc

SEQ ID NO: 1514246 - RNA, 16 nt, Pseudomonas aeruginosa PA01
ggaucgaucagcagca

SEQ ID NO: 1514247 - RNA, 14 nt, Pseudomonas aeruginosa PA01
ggauccccucccgc

SEQ ID NO: 1514248 - RNA, 17 nt, Pseudomonas aeruginosa PA01
ggauccccucccgcgcc

SEQ ID NO: 1514249 - RNA, 15 nt, Pseudomonas aeruginosa PA01
ggaugcgccagcggc

SEQ ID NO: 1514250 - RNA, 21 nt, Pseudomonas aeruginosa PA01
ggaugcgccagcggcccggca

SEQ ID NO: 1514251 - RNA, 19 nt, Pseudomonas aeruginosa PA01
ggaugcuccagguucggcg

SEQ ID NO: 1514252 - RNA, 14 nt, Pseudomonas aeruginosa PA01
ggaugccggccucg

SEQ ID NO: 1514253 - RNA, 18 nt, Pseudomonas aeruginosa PA01
ggaugaagaucaucuggg

SEQ ID NO: 1514254 - RNA, 14 nt, Pseudomonas aeruginosa PA01
ggaugccgguggcg

SEQ ID NO: 1514255 - RNA, 22 nt, Pseudomonas aeruginosa PA01
ggaugccgguggcgcccagcca

SEQ ID NO: 1514256 - RNA, 13 nt, Pseudomonas aeruginosa PA01
ggaugccggcggc

SEQ ID NO: 1514257 - RNA, 14 nt, Pseudomonas aeruginosa PA01
ggaugccggcggca

SEQ ID NO: 1514258 - RNA, 16 nt, Pseudomonas aeruginosa PA01
ggaucuucuaccuggc

SEQ ID NO: 1514259 - RNA, 14 nt, Pseudomonas aeruginosa PA01
ggaugaacagcgga

SEQ ID NO: 1514260 - RNA, 18 nt, Pseudomonas aeruginosa PA01
ggaugaacgacuccagcu

SEQ ID NO: 1514261 - RNA, 21 nt, Pseudomonas aeruginosa PA01
ggaucgucgccaagcccggcg

SEQ ID NO: 1514262 - RNA, 24 nt, Pseudomonas aeruginosa PA01
ggaucggcgcccagcaccacagca

SEQ ID NO: 1514263 - RNA, 21 nt, Pseudomonas aeruginosa PA01
ggauguccuuguucggcugga

SEQ ID NO: 1514264 - RNA, 12 nt, Pseudomonas aeruginosa PA01
ggauggucaggc

SEQ ID NO: 1514265 - RNA, 15 nt, Pseudomonas aeruginosa PA01
ggauggucaggccgg

SEQ ID NO: 1514266 - RNA, 14 nt, Pseudomonas aeruginosa PA01
ggaugcuccgcgcc

SEQ ID NO: 1514267 - RNA, 18 nt, Pseudomonas aeruginosa PA01
ggaugcucgccugguagg

SEQ ID NO: 1514268 - RNA, 12 nt, Pseudomonas aeruginosa PA01
ggaugcuggcgg

SEQ ID NO: 1514269 - RNA, 20 nt, Pseudomonas aeruginosa PA01
ggauuccacccgcuccgcgg

SEQ ID NO: 1514270 - RNA, 17 nt, Pseudomonas aeruginosa PA01
ggauguaguccagcgcc

SEQ ID NO: 1514271 - RNA, 15 nt, Pseudomonas aeruginosa PA01
ggauucggccugccg

SEQ ID NO: 1514272 - RNA, 15 nt, Pseudomonas aeruginosa PA01
ggccacgcccaugcc

SEQ ID NO: 1514273 - RNA, 21 nt, Pseudomonas aeruginosa PA01
ggccacgcccggugucgacga

SEQ ID NO: 1514274 - RNA, 14 nt, Pseudomonas aeruginosa PA01
ggccacgcgaccag

SEQ ID NO: 1514275 - RNA, 15 nt, Pseudomonas aeruginosa PA01
ggccacgcgaccagc

SEQ ID NO: 1514276 - RNA, 17 nt, Pseudomonas aeruginosa PA01
ggccacgcgaccagcgc

SEQ ID NO: 1514277 - RNA, 18 nt, Pseudomonas aeruginosa PA01
ggccacgcgaccagcgcc

SEQ ID NO: 1514278 - RNA, 16 nt, Pseudomonas aeruginosa PA01
ggccacggcaucggag

SEQ ID NO: 1514279 - RNA, 20 nt, Pseudomonas aeruginosa PA01
ggccagcagguagccugcgg

SEQ ID NO: 1514280 - RNA, 22 nt, Pseudomonas aeruginosa PA01
ggccagcagguagccugcggcc

SEQ ID NO: 1514281 - RNA, 18 nt, Pseudomonas aeruginosa PA01
ggccagcaggcuggcggc

SEQ ID NO: 1514282 - RNA, 19 nt, Pseudomonas aeruginosa PA01
ggccagcaggcuggcggca

SEQ ID NO: 1514283 - RNA, 20 nt, Pseudomonas aeruginosa PA01
ggccagcagggccgccgagg

SEQ ID NO: 1514284 - RNA, 17 nt, Pseudomonas aeruginosa PA01
ggccagccagggcagca

SEQ ID NO: 1514285 - RNA, 18 nt, Pseudomonas aeruginosa PA01
ggccagccagggcagcag

SEQ ID NO: 1514286 - RNA, 17 nt, Pseudomonas aeruginosa PA01
ggccagcaggccgagcg

SEQ ID NO: 1514287 - RNA, 18 nt, Pseudomonas aeruginosa PA01
ggccagcaggcgcucggc

SEQ ID NO: 1514288 - RNA, 12 nt, Pseudomonas aeruginosa PA01
ggccagcaggau

SEQ ID NO: 1514289 - RNA, 17 nt, Pseudomonas aeruginosa PA01
ggccagcagcuccgggc

SEQ ID NO: 1514290 - RNA, 23 nt, Pseudomonas aeruginosa PA01
ggccagcagcuccgggcuggcca

SEQ ID NO: 1514291 - RNA, 16 nt, Pseudomonas aeruginosa PA01
ggcauguuggcgccuu

SEQ ID NO: 1514292 - RNA, 17 nt, Pseudomonas aeruginosa PA01
ggcauguccaccgccgc

SEQ ID NO: 1514293 - RNA, 16 nt, Pseudomonas aeruginosa PA01
ggccaccagagccagc

SEQ ID NO: 1514294 - RNA, 17 nt, Pseudomonas aeruginosa PA01
ggccaccagagccagcc

SEQ ID NO: 1514295 - RNA, 20 nt, Pseudomonas aeruginosa PA01
ggccaccagagccagccgcg

SEQ ID NO: 1514296 - RNA, 22 nt, Pseudomonas aeruginosa PA01
ggccaccagagccagccgcgag

SEQ ID NO: 1514297 - RNA, 17 nt, Pseudomonas aeruginosa PA01
ggccaccagcaccugcg

SEQ ID NO: 1514298 - RNA, 14 nt, Pseudomonas aeruginosa PA01
ggccaccagcagca

SEQ ID NO: 1514299 - RNA, 15 nt, Pseudomonas aeruginosa PA01
ggccaccgcggcguc

SEQ ID NO: 1514300 - RNA, 20 nt, Pseudomonas aeruginosa PA01
ggccacgccauucgaauggc

SEQ ID NO: 1514301 - RNA, 14 nt, Pseudomonas aeruginosa PA01
ggccaccgccagga

SEQ ID NO: 1514302 - RNA, 19 nt, Pseudomonas aeruginosa PA01
ggccacccuugcgcccggc

SEQ ID NO: 1514303 - RNA, 21 nt, Pseudomonas aeruginosa PA01
ggccaccgaaucgaugcugua

SEQ ID NO: 1514304 - RNA, 16 nt, Pseudomonas aeruginosa PA01
ggccacccgccucguc

SEQ ID NO: 1514305 - RNA, 21 nt, Pseudomonas aeruginosa PA01
ggccauggcgcuugcgcagca

SEQ ID NO: 1514306 - RNA, 16 nt, Pseudomonas aeruginosa PA01
ggccauuccuuccagg

SEQ ID NO: 1514307 - RNA, 17 nt, Pseudomonas aeruginosa PA01
ggccauuccuuccaggg

SEQ ID NO: 1514308 - RNA, 21 nt, Pseudomonas aeruginosa PA01
ggccauucgcugucgagcagg

SEQ ID NO: 1514309 - RNA, 17 nt, Pseudomonas aeruginosa PA01
ggccauuacgccgagca

SEQ ID NO: 1514310 - RNA, 18 nt, Pseudomonas aeruginosa PA01
ggccauggcagagcugga

SEQ ID NO: 1514311 - RNA, 13 nt, Pseudomonas aeruginosa PA01
ggccaucaggucc

SEQ ID NO: 1514312 - RNA, 15 nt, Pseudomonas aeruginosa PA01
ggccaucagcgccag

SEQ ID NO: 1514313 - RNA, 17 nt, Pseudomonas aeruginosa PA01
ggccaucagcgccaggg

SEQ ID NO: 1514314 - RNA, 17 nt, Pseudomonas aeruginosa PA01
ggccaugccggccagga

SEQ ID NO: 1514315 - RNA, 14 nt, Pseudomonas aeruginosa PA01
ggccaugcaggcca

SEQ ID NO: 1514316 - RNA, 15 nt, Pseudomonas aeruginosa PA01
ggccaucagcacguc

SEQ ID NO: 1514317 - RNA, 21 nt, Pseudomonas aeruginosa PA01
ggccaucagcacgucguccag

SEQ ID NO: 1514318 - RNA, 20 nt, Pseudomonas aeruginosa PA01
ggccauaccuccagccagca

SEQ ID NO: 1514319 - RNA, 22 nt, Pseudomonas aeruginosa PA01
ggccauaccuccagccagcagc

SEQ ID NO: 1514320 - RNA, 15 nt, Pseudomonas aeruginosa PA01
ggccauagcgcgccg

SEQ ID NO: 1514321 - RNA, 20 nt, Pseudomonas aeruginosa PA01
ggccaguucgcugacccagc

SEQ ID NO: 1514322 - RNA, 23 nt, Pseudomonas aeruginosa PA01
ggccaguuggugcacgcgccggg

SEQ ID NO: 1514323 - RNA, 19 nt, Pseudomonas aeruginosa PA01
ggccaguuguuccggcugg

SEQ ID NO: 1514324 - RNA, 23 nt, Pseudomonas aeruginosa PA01
ggccaggucgagguucuccaggc

SEQ ID NO: 1514325 - RNA, 20 nt, Pseudomonas aeruginosa PA01
ggccaggucgcgacugacca

SEQ ID NO: 1514326 - RNA, 13 nt, Pseudomonas aeruginosa PA01
ggccaggucgcgg

SEQ ID NO: 1514327 - RNA, 17 nt, Pseudomonas aeruginosa PA01
ggccaggucgcggguga

SEQ ID NO: 1514328 - RNA, 20 nt, Pseudomonas aeruginosa PA01
ggccagguauucgcgcucgg

SEQ ID NO: 1514329 - RNA, 22 nt, Pseudomonas aeruginosa PA01
ggccagguauucgcgcucggcg

SEQ ID NO: 1514330 - RNA, 23 nt, Pseudomonas aeruginosa PA01
ggccaggguccgcuucagcgcgc

SEQ ID NO: 1514331 - RNA, 19 nt, Pseudomonas aeruginosa PA01
ggccagggucgccagcagg

SEQ ID NO: 1514332 - RNA, 20 nt, Pseudomonas aeruginosa PA01
ggccaggucguugcgccggc

SEQ ID NO: 1514333 - RNA, 11 nt, Pseudomonas aeruginosa PA01
ggccagccccc

SEQ ID NO: 1514334 - RNA, 13 nt, Pseudomonas aeruginosa PA01
ggccagccccugc

SEQ ID NO: 1514335 - RNA, 14 nt, Pseudomonas aeruginosa PA01
ggccagccccugcg

SEQ ID NO: 1514336 - RNA, 18 nt, Pseudomonas aeruginosa PA01
ggccagccccugcggacc

SEQ ID NO: 1514337 - RNA, 13 nt, Pseudomonas aeruginosa PA01
ggccagcucgucg

SEQ ID NO: 1514338 - RNA, 14 nt, Pseudomonas aeruginosa PA01
ggccagcgcuucca

SEQ ID NO: 1514339 - RNA, 16 nt, Pseudomonas aeruginosa PA01
ggccagcgcggcgcgg

SEQ ID NO: 1514340 - RNA, 15 nt, Pseudomonas aeruginosa PA01
ggccagcgcggcgga

SEQ ID NO: 1514341 - RNA, 12 nt, Pseudomonas aeruginosa PA01
ggccagcgcggc

SEQ ID NO: 1514342 - RNA, 17 nt, Pseudomonas aeruginosa PA01
ggccagcuggcgacggc

SEQ ID NO: 1514343 - RNA, 23 nt, Pseudomonas aeruginosa PA01
ggccagcuuccaggcgcgcugga

SEQ ID NO: 1514344 - RNA, 19 nt, Pseudomonas aeruginosa PA01
ggccaggcagaccagcgca

SEQ ID NO: 1514345 - RNA, 17 nt, Pseudomonas aeruginosa PA01
ggccaggauguucgccg

SEQ ID NO: 1514346 - RNA, 18 nt, Pseudomonas aeruginosa PA01
ggccaggauguucgccga

SEQ ID NO: 1514347 - RNA, 20 nt, Pseudomonas aeruginosa PA01
ggccaggaugaccaggcuga

SEQ ID NO: 1514348 - RNA, 18 nt, Pseudomonas aeruginosa PA01
ggccaggaccaucggcac

SEQ ID NO: 1514349 - RNA, 13 nt, Pseudomonas aeruginosa PA01
ggccaggccccag

SEQ ID NO: 1514350 - RNA, 21 nt, Pseudomonas aeruginosa PA01
ggccaggccccagggccggcg

SEQ ID NO: 1514351 - RNA, 12 nt, Pseudomonas aeruginosa PA01
ggccagggcgcg

SEQ ID NO: 1514352 - RNA, 22 nt, Pseudomonas aeruginosa PA01
ggccaggaaggccgcuucgccg

SEQ ID NO: 1514353 - RNA, 12 nt, Pseudomonas aeruginosa PA01
ggccagggcggc

SEQ ID NO: 1514354 - RNA, 15 nt, Pseudomonas aeruginosa PA01
ggccagggcggcgcc

SEQ ID NO: 1514355 - RNA, 16 nt, Pseudomonas aeruginosa PA01
ggccagggcggcgccg

SEQ ID NO: 1514356 - RNA, 17 nt, Pseudomonas aeruginosa PA01
ggccagggcggcgccga

SEQ ID NO: 1514357 - RNA, 14 nt, Pseudomonas aeruginosa PA01
ggccagggcgguga

SEQ ID NO: 1514358 - RNA, 18 nt, Pseudomonas aeruginosa PA01
ggccaggggagcgccggc

SEQ ID NO: 1514359 - RNA, 15 nt, Pseudomonas aeruginosa PA01
ggccagggggccugg

SEQ ID NO: 1514360 - RNA, 21 nt, Pseudomonas aeruginosa PA01
ggccagguaccggccaggcgg

SEQ ID NO: 1514361 - RNA, 22 nt, Pseudomonas aeruginosa PA01
ggccagguagcggcguucgccg

SEQ ID NO: 1514362 - RNA, 15 nt, Pseudomonas aeruginosa PA01
ggccagguaggcgac

SEQ ID NO: 1514363 - RNA, 17 nt, Pseudomonas aeruginosa PA01
ggcccaggcuggcggcc

SEQ ID NO: 1514364 - RNA, 21 nt, Pseudomonas aeruginosa PA01
ggcccaguugcccggccuggu

SEQ ID NO: 1514365 - RNA, 17 nt, Pseudomonas aeruginosa PA01
ggcccaguucgcugccg

SEQ ID NO: 1514366 - RNA, 13 nt, Pseudomonas aeruginosa PA01
ggcccagcuucuu

SEQ ID NO: 1514367 - RNA, 21 nt, Pseudomonas aeruginosa PA01
ggcccauuucguagcccaggc

SEQ ID NO: 1514368 - RNA, 15 nt, Pseudomonas aeruginosa PA01
ggccccaccgcacug

SEQ ID NO: 1514369 - RNA, 21 nt, Pseudomonas aeruginosa PA01
ggcccauucguagaggcuguc

SEQ ID NO: 1514370 - RNA, 14 nt, Pseudomonas aeruginosa PA01
ggcccacgggcggc

SEQ ID NO: 1514371 - RNA, 20 nt, Pseudomonas aeruginosa PA01
ggcccagagcagcaccagca

SEQ ID NO: 1514372 - RNA, 18 nt, Pseudomonas aeruginosa PA01
ggcccagauauccagggc

SEQ ID NO: 1514373 - RNA, 12 nt, Pseudomonas aeruginosa PA01
ggcccagaugau

SEQ ID NO: 1514374 - RNA, 14 nt, Pseudomonas aeruginosa PA01
ggcccagcaggccg

SEQ ID NO: 1514375 - RNA, 16 nt, Pseudomonas aeruginosa PA01
ggcccagcaggccggc

SEQ ID NO: 1514376 - RNA, 20 nt, Pseudomonas aeruginosa PA01
ggcccagcgcggcgccccag

SEQ ID NO: 1514377 - RNA, 21 nt, Pseudomonas aeruginosa PA01
ggcccagcguucggcgcuggc

SEQ ID NO: 1514378 - RNA, 17 nt, Pseudomonas aeruginosa PA01
ggccccggcgcucgcug

SEQ ID NO: 1514379 - RNA, 17 nt, Pseudomonas aeruginosa PA01
ggcccgcaaucagcggg

SEQ ID NO: 1514380 - RNA, 18 nt, Pseudomonas aeruginosa PA01
ggccccaggccgccgccu

SEQ ID NO: 1514381 - RNA, 20 nt, Pseudomonas aeruginosa PA01
ggccccaggccgccgccugc

SEQ ID NO: 1514382 - RNA, 19 nt, Pseudomonas aeruginosa PA01
ggccccaggcugcccaggu

SEQ ID NO: 1514383 - RNA, 14 nt, Pseudomonas aeruginosa PA01
ggccccgagaaaac

SEQ ID NO: 1514384 - RNA, 15 nt, Pseudomonas aeruginosa PA01
ggccgacagcggcug

SEQ ID NO: 1514385 - RNA, 18 nt, Pseudomonas aeruginosa PA01
ggccgacagcggcuggcg

SEQ ID NO: 1514386 - RNA, 18 nt, Pseudomonas aeruginosa PA01
ggccgagccggcauccug

SEQ ID NO: 1514387 - RNA, 21 nt, Pseudomonas aeruginosa PA01
ggccgagcccagcggcagggc

SEQ ID NO: 1514388 - RNA, 13 nt, Pseudomonas aeruginosa PA01
ggccgagccccgg

SEQ ID NO: 1514389 - RNA, 22 nt, Pseudomonas aeruginosa PA01
ggccgaauaggcgaucuccggc

SEQ ID NO: 1514390 - RNA, 12 nt, Pseudomonas aeruginosa PA01
ggccgagcgcgc

SEQ ID NO: 1514391 - RNA, 13 nt, Pseudomonas aeruginosa PA01
ggccgagcugcuc

SEQ ID NO: 1514392 - RNA, 19 nt, Pseudomonas aeruginosa PA01
ggccgaggaacuccuccuc

SEQ ID NO: 1514393 - RNA, 17 nt, Pseudomonas aeruginosa PA01
ggccgaggaggccagca

SEQ ID NO: 1514394 - RNA, 20 nt, Pseudomonas aeruginosa PA01
ggccgagggcugccgcccgg

SEQ ID NO: 1514395 - RNA, 22 nt, Pseudomonas aeruginosa PA01
ggccgagggugaucagccgagg

SEQ ID NO: 1514396 - RNA, 18 nt, Pseudomonas aeruginosa PA01
ggccgaguucgcgcaggc

SEQ ID NO: 1514397 - RNA, 17 nt, Pseudomonas aeruginosa PA01
ggccgaucagcggcggu

SEQ ID NO: 1514398 - RNA, 21 nt, Pseudomonas aeruginosa PA01
ggccgaugaucuccgcgccgg

SEQ ID NO: 1514399 - RNA, 16 nt, Pseudomonas aeruginosa PA01
ggccgaucagcgccuc

SEQ ID NO: 1514400 - RNA, 17 nt, Pseudomonas aeruginosa PA01
ggccgaucaccaccagc

SEQ ID NO: 1514401 - RNA, 20 nt, Pseudomonas aeruginosa PA01
ggccgaucaccaccagcgcc

SEQ ID NO: 1514402 - RNA, 22 nt, Pseudomonas aeruginosa PA01
ggccgaucaccaccagcgccgc

SEQ ID NO: 1514403 - RNA, 18 nt, Pseudomonas aeruginosa PA01
ggccgaucaccaccugga

SEQ ID NO: 1514404 - RNA, 17 nt, Pseudomonas aeruginosa PA01
ggccgaucaccagcgcc

SEQ ID NO: 1514405 - RNA, 18 nt, Pseudomonas aeruginosa PA01
ggccgaucaccagcgcca

SEQ ID NO: 1514406 - RNA, 16 nt, Pseudomonas aeruginosa PA01
ggccgaucgagcggcc

SEQ ID NO: 1514407 - RNA, 23 nt, Pseudomonas aeruginosa PA01
ggccgaucgccucguucagcagc

SEQ ID NO: 1514408 - RNA, 15 nt, Pseudomonas aeruginosa PA01
ggccgaucuccuggc

SEQ ID NO: 1514409 - RNA, 20 nt, Pseudomonas aeruginosa PA01
ggccgaucucgugggccagc

SEQ ID NO: 1514410 - RNA, 21 nt, Pseudomonas aeruginosa PA01
ggccgaucucgugggccagca

SEQ ID NO: 1514411 - RNA, 23 nt, Pseudomonas aeruginosa PA01
ggccgaucucgugggccagcagg

SEQ ID NO: 1514412 - RNA, 17 nt, Pseudomonas aeruginosa PA01
ggccgaucuucagcagc

SEQ ID NO: 1514413 - RNA, 20 nt, Pseudomonas aeruginosa PA01
ggccgaucuucagcagcagg

SEQ ID NO: 1514414 - RNA, 14 nt, Pseudomonas aeruginosa PA01
ggccgauggccccg

SEQ ID NO: 1514415 - RNA, 15 nt, Pseudomonas aeruginosa PA01
ggccgcaaccagccc

SEQ ID NO: 1514416 - RNA, 16 nt, Pseudomonas aeruginosa PA01
ggccgcaaccagcccu

SEQ ID NO: 1514417 - RNA, 16 nt, Pseudomonas aeruginosa PA01
ggccgacagagcggcc

SEQ ID NO: 1514418 - RNA, 21 nt, Pseudomonas aeruginosa PA01
ggccgaauccuccagccggcg

SEQ ID NO: 1514419 - RNA, 22 nt, Pseudomonas aeruginosa PA01
ggccgaagcugucgagcacggc

SEQ ID NO: 1514420 - RNA, 16 nt, Pseudomonas aeruginosa PA01
ggccgaaggccaggcc

SEQ ID NO: 1514421 - RNA, 15 nt, Pseudomonas aeruginosa PA01
ggccgaaggccuggc

SEQ ID NO: 1514422 - RNA, 18 nt, Pseudomonas aeruginosa PA01
ggccgaagcgugggcggc

SEQ ID NO: 1514423 - RNA, 19 nt, Pseudomonas aeruginosa PA01
ggccgaagcgugggcggcc

SEQ ID NO: 1514424 - RNA, 17 nt, Pseudomonas aeruginosa PA01
ggccgaacuggaugaug

SEQ ID NO: 1514425 - RNA, 18 nt, Pseudomonas aeruginosa PA01
ggccgaagaggcccucgg

SEQ ID NO: 1514426 - RNA, 14 nt, Pseudomonas aeruginosa PA01
ggcccugcucgccg

SEQ ID NO: 1514427 - RNA, 17 nt, Pseudomonas aeruginosa PA01
ggcccugcucgccggcg

SEQ ID NO: 1514428 - RNA, 15 nt, Pseudomonas aeruginosa PA01
ggccgaaccggggcg

SEQ ID NO: 1514429 - RNA, 14 nt, Pseudomonas aeruginosa PA01
ggcccugcgcgcgc

SEQ ID NO: 1514430 - RNA, 20 nt, Pseudomonas aeruginosa PA01
ggcccugcgcgcgcguuuca

SEQ ID NO: 1514431 - RNA, 14 nt, Pseudomonas aeruginosa PA01
ggcccugcaacagg

SEQ ID NO: 1514432 - RNA, 14 nt, Pseudomonas aeruginosa PA01
ggcccugccacuug

SEQ ID NO: 1514433 - RNA, 22 nt, Pseudomonas aeruginosa PA01
ggcccugccacuugcgggugcg

SEQ ID NO: 1514434 - RNA, 21 nt, Pseudomonas aeruginosa PA01
ggcccggagaccgugccgccg

SEQ ID NO: 1514435 - RNA, 22 nt, Pseudomonas aeruginosa PA01
ggcccggagccaacgcccgggc

SEQ ID NO: 1514436 - RNA, 21 nt, Pseudomonas aeruginosa PA01
ggcccggagugugucggggcc

SEQ ID NO: 1514437 - RNA, 22 nt, Pseudomonas aeruginosa PA01
ggcccggagugugucggggccg

SEQ ID NO: 1514438 - RNA, 14 nt, Pseudomonas aeruginosa PA01
ggcccggccaggcg

SEQ ID NO: 1514439 - RNA, 13 nt, Pseudomonas aeruginosa PA01
ggcccggccaggu

SEQ ID NO: 1514440 - RNA, 12 nt, Pseudomonas aeruginosa PA01
ggcccggccagg

SEQ ID NO: 1514441 - RNA, 13 nt, Pseudomonas aeruginosa PA01
ggcccggccaggc

SEQ ID NO: 1514442 - RNA, 13 nt, Pseudomonas aeruginosa PA01
ggcccuccaucca

SEQ ID NO: 1514443 - RNA, 14 nt, Pseudomonas aeruginosa PA01
ggcccggcgcacug

SEQ ID NO: 1514444 - RNA, 14 nt, Pseudomonas aeruginosa PA01
ggcccucagagcau

SEQ ID NO: 1514445 - RNA, 18 nt, Pseudomonas aeruginosa PA01
ggcccucucucgccucgg

SEQ ID NO: 1514446 - RNA, 14 nt, Pseudomonas aeruginosa PA01
ggcccucggcgccg

SEQ ID NO: 1514447 - RNA, 13 nt, Pseudomonas aeruginosa PA01
ggcccucggcggc

SEQ ID NO: 1514448 - RNA, 18 nt, Pseudomonas aeruginosa PA01
ggcacagccauagugcug

SEQ ID NO: 1514449 - RNA, 20 nt, Pseudomonas aeruginosa PA01
ggcacagccauagugcuggg

SEQ ID NO: 1514450 - RNA, 23 nt, Pseudomonas aeruginosa PA01
ggcacagccauagugcugggcga

SEQ ID NO: 1514451 - RNA, 23 nt, Pseudomonas aeruginosa PA01
ggcacaggacccuuccagcgugu

SEQ ID NO: 1514452 - RNA, 17 nt, Pseudomonas aeruginosa PA01
ggcacagcguggccagc

SEQ ID NO: 1514453 - RNA, 18 nt, Pseudomonas aeruginosa PA01
ggcacagcguggccagcg

SEQ ID NO: 1514454 - RNA, 20 nt, Pseudomonas aeruginosa PA01
ggcacagcguggccagcgcc

SEQ ID NO: 1514455 - RNA, 12 nt, Pseudomonas aeruginosa PA01
ggcaccaccgcc

SEQ ID NO: 1514456 - RNA, 13 nt, Pseudomonas aeruginosa PA01
ggcaccagcgcgu

SEQ ID NO: 1514457 - RNA, 17 nt, Pseudomonas aeruginosa PA01
ggcacaguuccuguacc

SEQ ID NO: 1514458 - RNA, 16 nt, Pseudomonas aeruginosa PA01
ggcaccgaucgcccgc

SEQ ID NO: 1514459 - RNA, 13 nt, Pseudomonas aeruginosa PA01
ggcaccgcgcagc

SEQ ID NO: 1514460 - RNA, 22 nt, Pseudomonas aeruginosa PA01
ggcacgaccuucuccgaccagg

SEQ ID NO: 1514461 - RNA, 20 nt, Pseudomonas aeruginosa PA01
ggcacgaaccauugcggccc

SEQ ID NO: 1514462 - RNA, 19 nt, Pseudomonas aeruginosa PA01
ggcaccgcuuucguagggc

SEQ ID NO: 1514463 - RNA, 13 nt, Pseudomonas aeruginosa PA01
ggcacgcagcagc

SEQ ID NO: 1514464 - RNA, 22 nt, Pseudomonas aeruginosa PA01
ggcacgcagcagcuucggcgcg

SEQ ID NO: 1514465 - RNA, 22 nt, Pseudomonas aeruginosa PA01
ggcacgccccauccgggcggcg

SEQ ID NO: 1514466 - RNA, 17 nt, Pseudomonas aeruginosa PA01
ggcacgagucgaggcga

SEQ ID NO: 1514467 - RNA, 15 nt, Pseudomonas aeruginosa PA01
ggcacguacguccag

SEQ ID NO: 1514468 - RNA, 16 nt, Pseudomonas aeruginosa PA01
ggcacgccauccuccg

SEQ ID NO: 1514469 - RNA, 19 nt, Pseudomonas aeruginosa PA01
ggcacgugcagcggcagcg

SEQ ID NO: 1514470 - RNA, 15 nt, Pseudomonas aeruginosa PA01
ggcagaugccgggcg

SEQ ID NO: 1514471 - RNA, 19 nt, Pseudomonas aeruginosa PA01
ggcagauguccaggcaggc

SEQ ID NO: 1514472 - RNA, 18 nt, Pseudomonas aeruginosa PA01
ggcagaucgcgccgagcu

SEQ ID NO: 1514473 - RNA, 18 nt, Pseudomonas aeruginosa PA01
ggcagaccaggccgagca

SEQ ID NO: 1514474 - RNA, 12 nt, Pseudomonas aeruginosa PA01
ggcagacgcugc

SEQ ID NO: 1514475 - RNA, 18 nt, Pseudomonas aeruginosa PA01
ggcagaccugcagcagga

SEQ ID NO: 1514476 - RNA, 15 nt, Pseudomonas aeruginosa PA01
ggcacucagccagcg

SEQ ID NO: 1514477 - RNA, 16 nt, Pseudomonas aeruginosa PA01
ggcacucagccagcgg

SEQ ID NO: 1514478 - RNA, 22 nt, Pseudomonas aeruginosa PA01
ggcagcacgucuugcaggcuca

SEQ ID NO: 1514479 - RNA, 22 nt, Pseudomonas aeruginosa PA01
ggcagcacggcgauacccaggc

SEQ ID NO: 1514480 - RNA, 19 nt, Pseudomonas aeruginosa PA01
ggcagcacccgcaccagcc

SEQ ID NO: 1514481 - RNA, 22 nt, Pseudomonas aeruginosa PA01
ggcagcacccgcaccagccggc

SEQ ID NO: 1514482 - RNA, 14 nt, Pseudomonas aeruginosa PA01
ggcagcagcgccag

SEQ ID NO: 1514483 - RNA, 15 nt, Pseudomonas aeruginosa PA01
ggcagcagcgccagg

SEQ ID NO: 1514484 - RNA, 15 nt, Pseudomonas aeruginosa PA01
ggcagcagagcgcca

SEQ ID NO: 1514485 - RNA, 23 nt, Pseudomonas aeruginosa PA01
ggcagccaucgcauagccggcgc

SEQ ID NO: 1514486 - RNA, 14 nt, Pseudomonas aeruginosa PA01
ggcagccagccgcc

SEQ ID NO: 1514487 - RNA, 12 nt, Pseudomonas aeruginosa PA01
ggcagcaggccg

SEQ ID NO: 1514488 - RNA, 22 nt, Pseudomonas aeruginosa PA01
ggcagccacucggccaggcgcc

SEQ ID NO: 1514489 - RNA, 18 nt, Pseudomonas aeruginosa PA01
ggcagccggccaugcugg

SEQ ID NO: 1514490 - RNA, 18 nt, Pseudomonas aeruginosa PA01
ggcagcucggccgagggc

SEQ ID NO: 1514491 - RNA, 21 nt, Pseudomonas aeruginosa PA01
ggcagcucguugcacagcgcc

SEQ ID NO: 1514492 - RNA, 15 nt, Pseudomonas aeruginosa PA01
ggcaggaacgcccgc

SEQ ID NO: 1514493 - RNA, 17 nt, Pseudomonas aeruginosa PA01
ggcaggaacgcccgcgg

SEQ ID NO: 1514494 - RNA, 23 nt, Pseudomonas aeruginosa PA01
ggcaggaacgcccgcggcagcag

SEQ ID NO: 1514495 - RNA, 13 nt, Pseudomonas aeruginosa PA01
ggcaggacccaga

SEQ ID NO: 1514496 - RNA, 16 nt, Pseudomonas aeruginosa PA01
ggcaggacgaugauca

SEQ ID NO: 1514497 - RNA, 19 nt, Pseudomonas aeruginosa PA01
ggcaggagcguugcgggca

SEQ ID NO: 1514498 - RNA, 18 nt, Pseudomonas aeruginosa PA01
ggcaggaggaucgcggcc

SEQ ID NO: 1514499 - RNA, 12 nt, Pseudomonas aeruginosa PA01
ggcaggccgccg

SEQ ID NO: 1514500 - RNA, 12 nt, Pseudomonas aeruginosa PA01
ggcaggccgagg

SEQ ID NO: 1514501 - RNA, 17 nt, Pseudomonas aeruginosa PA01
ggcaggccgaggccggc

SEQ ID NO: 1514502 - RNA, 18 nt, Pseudomonas aeruginosa PA01
ggcaggccuucggcgccg

SEQ ID NO: 1514503 - RNA, 15 nt, Pseudomonas aeruginosa PA01
ggcaggccgggcugg

SEQ ID NO: 1514504 - RNA, 17 nt, Pseudomonas aeruginosa PA01
ggcaggccacggccgcu

SEQ ID NO: 1514505 - RNA, 12 nt, Pseudomonas aeruginosa PA01
ggcaggccagca

SEQ ID NO: 1514506 - RNA, 15 nt, Pseudomonas aeruginosa PA01
ggcaggcaaaaaaaa

SEQ ID NO: 1514507 - RNA, 15 nt, Pseudomonas aeruginosa PA01
ggcaggcaggccugg

SEQ ID NO: 1514508 - RNA, 13 nt, Pseudomonas aeruginosa PA01
ggcaggccagcag

SEQ ID NO: 1514509 - RNA, 17 nt, Pseudomonas aeruginosa PA01
ggcaggccagcagguag

SEQ ID NO: 1514510 - RNA, 16 nt, Pseudomonas aeruginosa PA01
ggcaggcaugcggccc

SEQ ID NO: 1514511 - RNA, 22 nt, Pseudomonas aeruginosa PA01
ggcaggcacgcugccagcaggc

SEQ ID NO: 1514512 - RNA, 21 nt, Pseudomonas aeruginosa PA01
ggcagcucauaggucagguac

SEQ ID NO: 1514513 - RNA, 17 nt, Pseudomonas aeruginosa PA01
ggcagcgucgccgggcg

SEQ ID NO: 1514514 - RNA, 21 nt, Pseudomonas aeruginosa PA01
ggcagcgucggaaaacccugu

SEQ ID NO: 1514515 - RNA, 18 nt, Pseudomonas aeruginosa PA01
ggcagcgucucggcugcc

SEQ ID NO: 1514516 - RNA, 17 nt, Pseudomonas aeruginosa PA01
ggcagcgguucgcccgc

SEQ ID NO: 1514517 - RNA, 19 nt, Pseudomonas aeruginosa PA01
ggcagcgguucgcccgcgg

SEQ ID NO: 1514518 - RNA, 23 nt, Pseudomonas aeruginosa PA01
ggcagcgcuucguugcuccugcg

SEQ ID NO: 1514519 - RNA, 14 nt, Pseudomonas aeruginosa PA01
ggcagcggcucguc

SEQ ID NO: 1514520 - RNA, 14 nt, Pseudomonas aeruginosa PA01
ggcagcggcuggcc

SEQ ID NO: 1514521 - RNA, 15 nt, Pseudomonas aeruginosa PA01
ggcagcggcuggccg

SEQ ID NO: 1514522 - RNA, 14 nt, Pseudomonas aeruginosa PA01
ggcagcgaucgccg

SEQ ID NO: 1514523 - RNA, 20 nt, Pseudomonas aeruginosa PA01
ggcagcgccgccagcaggau

SEQ ID NO: 1514524 - RNA, 17 nt, Pseudomonas aeruginosa PA01
ggcagcgccgccgggcg

SEQ ID NO: 1514525 - RNA, 15 nt, Pseudomonas aeruginosa PA01
ggcagcgccgggcau

SEQ ID NO: 1514526 - RNA, 24 nt, Pseudomonas aeruginosa PA01
ggcagcgcgauaucgcaggccagg

SEQ ID NO: 1514527 - RNA, 14 nt, Pseudomonas aeruginosa PA01
ggcagcgcgcggcc

SEQ ID NO: 1514528 - RNA, 13 nt, Pseudomonas aeruginosa PA01
ggcagcgagcggg

SEQ ID NO: 1514529 - RNA, 22 nt, Pseudomonas aeruginosa PA01
ggcagcgagcgggucagcagca

SEQ ID NO: 1514530 - RNA, 12 nt, Pseudomonas aeruginosa PA01
ggcagccgucgg

SEQ ID NO: 1514531 - RNA, 17 nt, Pseudomonas aeruginosa PA01
ggcauagcgcagccgcu

SEQ ID NO: 1514532 - RNA, 18 nt, Pseudomonas aeruginosa PA01
ggcauagaugccggccuc

SEQ ID NO: 1514533 - RNA, 17 nt, Pseudomonas aeruginosa PA01
ggcauacacaugcaggc

SEQ ID NO: 1514534 - RNA, 12 nt, Pseudomonas aeruginosa PA01
ggcagucgccgc

SEQ ID NO: 1514535 - RNA, 22 nt, Pseudomonas aeruginosa PA01
ggcagucgguagaaauccuccg

SEQ ID NO: 1514536 - RNA, 14 nt, Pseudomonas aeruginosa PA01
ggcaguccucgccg

SEQ ID NO: 1514537 - RNA, 18 nt, Pseudomonas aeruginosa PA01
ggcaguccuugagcgcca

SEQ ID NO: 1514538 - RNA, 22 nt, Pseudomonas aeruginosa PA01
ggcaguccuugagcgccagcag

SEQ ID NO: 1514539 - RNA, 16 nt, Pseudomonas aeruginosa PA01
ggcaggcgccggccgg

SEQ ID NO: 1514540 - RNA, 13 nt, Pseudomonas aeruginosa PA01
ggcaggcgcaggc

SEQ ID NO: 1514541 - RNA, 23 nt, Pseudomonas aeruginosa PA01
ggcaggcgccaaccgggcagcag

SEQ ID NO: 1514542 - RNA, 19 nt, Pseudomonas aeruginosa PA01
ggcaggcgcccggucaggu

SEQ ID NO: 1514543 - RNA, 22 nt, Pseudomonas aeruginosa PA01
ggcaggcgcccggucagguugg

SEQ ID NO: 1514544 - RNA, 18 nt, Pseudomonas aeruginosa PA01
ggcaggcggucagcgcgu

SEQ ID NO: 1514545 - RNA, 21 nt, Pseudomonas aeruginosa PA01
ggcauggccgaccgccaggcc

SEQ ID NO: 1514546 - RNA, 21 nt, Pseudomonas aeruginosa PA01
ggcauggccgcucccaccgcu

SEQ ID NO: 1514547 - RNA, 16 nt, Pseudomonas aeruginosa PA01
ggcaugcggccccggc

SEQ ID NO: 1514548 - RNA, 20 nt, Pseudomonas aeruginosa PA01
ggcaugcucagccgcgccgg

SEQ ID NO: 1514549 - RNA, 15 nt, Pseudomonas aeruginosa PA01
ggcaugcccugccgg

SEQ ID NO: 1514550 - RNA, 16 nt, Pseudomonas aeruginosa PA01
ggcaugccguugggcc

SEQ ID NO: 1514551 - RNA, 20 nt, Pseudomonas aeruginosa PA01
ggcaugguguccggcggcga

SEQ ID NO: 1514552 - RNA, 22 nt, Pseudomonas aeruginosa PA01
ggcauggcuuuccaggcgccgc

SEQ ID NO: 1514553 - RNA, 20 nt, Pseudomonas aeruginosa PA01
ggcaucgcgaaaacucccgg

SEQ ID NO: 1514554 - RNA, 22 nt, Pseudomonas aeruginosa PA01
ggcaucgcgaaaacucccggcc

SEQ ID NO: 1514555 - RNA, 16 nt, Pseudomonas aeruginosa PA01
ggcaucgaucuugccc

SEQ ID NO: 1514556 - RNA, 16 nt, Pseudomonas aeruginosa PA01
ggcaucgccgaccacu

SEQ ID NO: 1514557 - RNA, 14 nt, Pseudomonas aeruginosa PA01
ggcaucggccuggu

SEQ ID NO: 1514558 - RNA, 13 nt, Pseudomonas aeruginosa PA01
ggcaugcaggugg

SEQ ID NO: 1514559 - RNA, 16 nt, Pseudomonas aeruginosa PA01
ggcaucgucgaagggc

SEQ ID NO: 1514560 - RNA, 19 nt, Pseudomonas aeruginosa PA01
uaauccggcacuuugcauc

SEQ ID NO: 1514561 - RNA, 21 nt, Pseudomonas aeruginosa PA01
uaauucgcugacgaggacgcc

SEQ ID NO: 1514562 - RNA, 23 nt, Pseudomonas aeruginosa PA01
uacaagagcagacacaaaaaacc

SEQ ID NO: 1514563 - RNA, 22 nt, Pseudomonas aeruginosa PA01
uacacagcuugggauggccagc

SEQ ID NO: 1514564 - RNA, 17 nt, Pseudomonas aeruginosa PA01
uacacaugcaggcucga

SEQ ID NO: 1514565 - RNA, 12 nt, Pseudomonas aeruginosa PA01
uacaccgagcgc

SEQ ID NO: 1514566 - RNA, 13 nt, Pseudomonas aeruginosa PA01
uacagcaggagcg

SEQ ID NO: 1514567 - RNA, 17 nt, Pseudomonas aeruginosa PA01
uacagcucaccccagga

SEQ ID NO: 1514568 - RNA, 19 nt, Pseudomonas aeruginosa PA01
uacagcuucaggcgcacua

SEQ ID NO: 1514569 - RNA, 18 nt, Pseudomonas aeruginosa PA01
uacaggaaucauuuggug

SEQ ID NO: 1514570 - RNA, 15 nt, Pseudomonas aeruginosa PA01
uacaguucaggcugg

SEQ ID NO: 1514571 - RNA, 13 nt, Pseudomonas aeruginosa PA01
uacgcaccggcuu

SEQ ID NO: 1514572 - RNA, 14 nt, Pseudomonas aeruginosa PA01
uacggaugcugaca

SEQ ID NO: 1514573 - RNA, 13 nt, Pseudomonas aeruginosa PA01
uacggcgcagcag

SEQ ID NO: 1514574 - RNA, 14 nt, Pseudomonas aeruginosa PA01
uacggcucuugaaa

SEQ ID NO: 1514575 - RNA, 21 nt, Pseudomonas aeruginosa PA01
uacggggcgugucgagggcug

SEQ ID NO: 1514576 - RNA, 16 nt, Pseudomonas aeruginosa PA01
uaccagcgcaccaggg

SEQ ID NO: 1514577 - RNA, 17 nt, Pseudomonas aeruginosa PA01
uaccagcuugucgccuu

SEQ ID NO: 1514578 - RNA, 24 nt, Pseudomonas aeruginosa PA01
uaccaggaagcucggcagcacgcu

SEQ ID NO: 1514579 - RNA, 16 nt, Pseudomonas aeruginosa PA01
uaccagguucugccag

SEQ ID NO: 1514580 - RNA, 19 nt, Pseudomonas aeruginosa PA01
uaccagguucugccagagc

SEQ ID NO: 1514581 - RNA, 23 nt, Pseudomonas aeruginosa PA01
uaccagguucugccagagcgcug

SEQ ID NO: 1514582 - RNA, 20 nt, Pseudomonas aeruginosa PA01
uaccaggguguugucgcggc

SEQ ID NO: 1514583 - RNA, 22 nt, Pseudomonas aeruginosa PA01
uaccaggguguugucgcggcug

SEQ ID NO: 1514584 - RNA, 19 nt, Pseudomonas aeruginosa PA01
uaccagaucaccaccaccg

SEQ ID NO: 1514585 - RNA, 14 nt, Pseudomonas aeruginosa PA01
uaccagcagcgccg

SEQ ID NO: 1514586 - RNA, 21 nt, Pseudomonas aeruginosa PA01
uaccagcgcgauacccuggcc

SEQ ID NO: 1514587 - RNA, 22 nt, Pseudomonas aeruginosa PA01
uaccagcgcgauacccuggccg

SEQ ID NO: 1514588 - RNA, 22 nt, Pseudomonas aeruginosa PA01
uaccagccgcgguccaucccuu

SEQ ID NO: 1514589 - RNA, 17 nt, Pseudomonas aeruginosa PA01
uaccacgggcaguucca

SEQ ID NO: 1514590 - RNA, 21 nt, Pseudomonas aeruginosa PA01
uaccacgggcaguuccaggcc

SEQ ID NO: 1514591 - RNA, 23 nt, Pseudomonas aeruginosa PA01
uaccgggccaggcaaugucguug

SEQ ID NO: 1514592 - RNA, 14 nt, Pseudomonas aeruginosa PA01
uaccgcucugcacc

SEQ ID NO: 1514593 - RNA, 22 nt, Pseudomonas aeruginosa PA01
uaccgcugcgcgggucuugccg

SEQ ID NO: 1514594 - RNA, 16 nt, Pseudomonas aeruginosa PA01
uaccgcugcggccggc

SEQ ID NO: 1514595 - RNA, 18 nt, Pseudomonas aeruginosa PA01
uaccgcugcgugccaggg

SEQ ID NO: 1514596 - RNA, 17 nt, Pseudomonas aeruginosa PA01
uaccgcccacccugcgc

SEQ ID NO: 1514597 - RNA, 13 nt, Pseudomonas aeruginosa PA01
uaccgccagcucg

SEQ ID NO: 1514598 - RNA, 16 nt, Pseudomonas aeruginosa PA01
uacccuggccggccuc

SEQ ID NO: 1514599 - RNA, 19 nt, Pseudomonas aeruginosa PA01
uacccuucaucccuucuuu

SEQ ID NO: 1514600 - RNA, 14 nt, Pseudomonas aeruginosa PA01
uacccucuccccaa

SEQ ID NO: 1514601 - RNA, 22 nt, Pseudomonas aeruginosa PA01
uaccccgggucgcgcagcggcu

SEQ ID NO: 1514602 - RNA, 18 nt, Pseudomonas aeruginosa PA01
uacccgacaggcagcgcc

SEQ ID NO: 1514603 - RNA, 22 nt, Pseudomonas aeruginosa PA01
uacuccgccggcguugcgcgcc

SEQ ID NO: 1514604 - RNA, 14 nt, Pseudomonas aeruginosa PA01
uacucgacgcugcc

SEQ ID NO: 1514605 - RNA, 21 nt, Pseudomonas aeruginosa PA01
uacuccuggcauggcuuucca

SEQ ID NO: 1514606 - RNA, 18 nt, Pseudomonas aeruginosa PA01
uacucggcggggcgcagc

SEQ ID NO: 1514607 - RNA, 15 nt, Pseudomonas aeruginosa PA01
uacucggcuacgaac

SEQ ID NO: 1514608 - RNA, 15 nt, Pseudomonas aeruginosa PA01
uacucaugaccgccg

SEQ ID NO: 1514609 - RNA, 21 nt, Pseudomonas aeruginosa PA01
uacuccagcagcgcacgcuuc

SEQ ID NO: 1514610 - RNA, 16 nt, Pseudomonas aeruginosa PA01
uacucaugcaggcguc

SEQ ID NO: 1514611 - RNA, 16 nt, Pseudomonas aeruginosa PA01
uacugcgcgggcaugc

SEQ ID NO: 1514612 - RNA, 22 nt, Pseudomonas aeruginosa PA01
uacugcuucaugaagucagcca

SEQ ID NO: 1514613 - RNA, 15 nt, Pseudomonas aeruginosa PA01
uacuugccagggcag

SEQ ID NO: 1514614 - RNA, 14 nt, Pseudomonas aeruginosa PA01
uacuggccgaaauu

SEQ ID NO: 1514615 - RNA, 17 nt, Pseudomonas aeruginosa PA01
uacuggcgccaggccgc

SEQ ID NO: 1514616 - RNA, 18 nt, Pseudomonas aeruginosa PA01
uacugggcguggcggccg

SEQ ID NO: 1514617 - RNA, 17 nt, Pseudomonas aeruginosa PA01
uauguauucgaacagcu

SEQ ID NO: 1514618 - RNA, 21 nt, Pseudomonas aeruginosa PA01
uauggaagaggaucuccuggc

SEQ ID NO: 1514619 - RNA, 14 nt, Pseudomonas aeruginosa PA01
uauggcugcugugc

SEQ ID NO: 1514620 - RNA, 18 nt, Pseudomonas aeruginosa PA01
uauggcggucggccaggc

SEQ ID NO: 1514621 - RNA, 17 nt, Pseudomonas aeruginosa PA01
uaugcgcccuaccuguc

SEQ ID NO: 1514622 - RNA, 19 nt, Pseudomonas aeruginosa PA01
uaugcgcccuaccuguccc

SEQ ID NO: 1514623 - RNA, 19 nt, Pseudomonas aeruginosa PA01
uaugccucggcggcggccu

SEQ ID NO: 1514624 - RNA, 22 nt, Pseudomonas aeruginosa PA01
uauccgccgcucacccuguccc

SEQ ID NO: 1514625 - RNA, 23 nt, Pseudomonas aeruginosa PA01
uauccgccgcucacccuguccca

SEQ ID NO: 1514626 - RNA, 21 nt, Pseudomonas aeruginosa PA01
uauccgccggaaccugcaugu

SEQ ID NO: 1514627 - RNA, 18 nt, Pseudomonas aeruginosa PA01
uaucccagcgcgugcagg

SEQ ID NO: 1514628 - RNA, 17 nt, Pseudomonas aeruginosa PA01
uaucgccgguccucgac

SEQ ID NO: 1514629 - RNA, 15 nt, Pseudomonas aeruginosa PA01
uaucgcaggccaggc

SEQ ID NO: 1514630 - RNA, 17 nt, Pseudomonas aeruginosa PA01
uaucggcuugccggcgg

SEQ ID NO: 1514631 - RNA, 22 nt, Pseudomonas aeruginosa PA01
uaucggcuugccggcggcgcug

SEQ ID NO: 1514632 - RNA, 14 nt, Pseudomonas aeruginosa PA01
uaguugagccccag

SEQ ID NO: 1514633 - RNA, 16 nt, Pseudomonas aeruginosa PA01
uaguucuccaggccca

SEQ ID NO: 1514634 - RNA, 13 nt, Pseudomonas aeruginosa PA01
uagugcucggcca

SEQ ID NO: 1514635 - RNA, 22 nt, Pseudomonas aeruginosa PA01
uagugcuggguggaggcccaga

SEQ ID NO: 1514636 - RNA, 14 nt, Pseudomonas aeruginosa PA01
uagugcggccaggc

SEQ ID NO: 1514637 - RNA, 17 nt, Pseudomonas aeruginosa PA01
uagucgcccggcucgcc

SEQ ID NO: 1514638 - RNA, 12 nt, Pseudomonas aeruginosa PA01
uaguccagccag

SEQ ID NO: 1514639 - RNA, 14 nt, Pseudomonas aeruginosa PA01
uaguccagcuccuc

SEQ ID NO: 1514640 - RNA, 14 nt, Pseudomonas aeruginosa PA01
uaggcuuggucggg

SEQ ID NO: 1514641 - RNA, 12 nt, Pseudomonas aeruginosa PA01
uaggcuggaagc

SEQ ID NO: 1514642 - RNA, 17 nt, Pseudomonas aeruginosa PA01
uaggcucugcuccagca

SEQ ID NO: 1514643 - RNA, 13 nt, Pseudomonas aeruginosa PA01
uaggucaugccca

SEQ ID NO: 1514644 - RNA, 20 nt, Pseudomonas aeruginosa PA01
uagcggccauugucggccuc

SEQ ID NO: 1514645 - RNA, 18 nt, Pseudomonas aeruginosa PA01
uagcgcugcgccaggcuu

SEQ ID NO: 1514646 - RNA, 15 nt, Pseudomonas aeruginosa PA01
uagcggaugugcagg

SEQ ID NO: 1514647 - RNA, 14 nt, Pseudomonas aeruginosa PA01
uagcggcugcuguc

SEQ ID NO: 1514648 - RNA, 16 nt, Pseudomonas aeruginosa PA01
uagcgggccagcagcu

SEQ ID NO: 1514649 - RNA, 22 nt, Pseudomonas aeruginosa PA01
uagcggcguucgccgagcaagc

SEQ ID NO: 1514650 - RNA, 14 nt, Pseudomonas aeruginosa PA01
uagccgaccaggcc

SEQ ID NO: 1514651 - RNA, 15 nt, Pseudomonas aeruginosa PA01
uagccgaccaggccg

SEQ ID NO: 1514652 - RNA, 12 nt, Pseudomonas aeruginosa PA01
uagcccugcugc

SEQ ID NO: 1514653 - RNA, 14 nt, Pseudomonas aeruginosa PA01
uagcccugcugcuc

SEQ ID NO: 1514654 - RNA, 12 nt, Pseudomonas aeruginosa PA01
uagcccugggcg

SEQ ID NO: 1514655 - RNA, 19 nt, Pseudomonas aeruginosa PA01
uagcgcuccucgcgcugcc

SEQ ID NO: 1514656 - RNA, 20 nt, Pseudomonas aeruginosa PA01
uagcgcgaaggcgccuucca

SEQ ID NO: 1514657 - RNA, 16 nt, Pseudomonas aeruginosa PA01
uagcgcgcuguagccg

SEQ ID NO: 1514658 - RNA, 20 nt, Pseudomonas aeruginosa PA01
uagcgccaggccuuggcccg

SEQ ID NO: 1514659 - RNA, 18 nt, Pseudomonas aeruginosa PA01
uaggcggcggauaaccgc

SEQ ID NO: 1514660 - RNA, 16 nt, Pseudomonas aeruginosa PA01
uaggccaugaucaucg

SEQ ID NO: 1514661 - RNA, 18 nt, Pseudomonas aeruginosa PA01
uagcuguagcggcuugca

SEQ ID NO: 1514662 - RNA, 20 nt, Pseudomonas aeruginosa PA01
uagcuguagcggcuugcagu

SEQ ID NO: 1514663 - RNA, 19 nt, Pseudomonas aeruginosa PA01
uagcagccguccagcuuga

SEQ ID NO: 1514664 - RNA, 19 nt, Pseudomonas aeruginosa PA01
uagcagaugucguucuugc

SEQ ID NO: 1514665 - RNA, 19 nt, Pseudomonas aeruginosa PA01
uagcaggccuggagcgccu

SEQ ID NO: 1514666 - RNA, 23 nt, Pseudomonas aeruginosa PA01
uagcccggguugcccucgcagcc

SEQ ID NO: 1514667 - RNA, 17 nt, Pseudomonas aeruginosa PA01
uagcccccgccgcugag

SEQ ID NO: 1514668 - RNA, 13 nt, Pseudomonas aeruginosa PA01
uagaucugcacca

SEQ ID NO: 1514669 - RNA, 15 nt, Pseudomonas aeruginosa PA01
uagaaaagcaaggag

SEQ ID NO: 1514670 - RNA, 16 nt, Pseudomonas aeruginosa PA01
uagaugugcuggguca

SEQ ID NO: 1514671 - RNA, 14 nt, Pseudomonas aeruginosa PA01
uagaugaucuccag

SEQ ID NO: 1514672 - RNA, 12 nt, Pseudomonas aeruginosa PA01
ucagcaggcugc

SEQ ID NO: 1514673 - RNA, 14 nt, Pseudomonas aeruginosa PA01
ucagcaggcugccg

SEQ ID NO: 1514674 - RNA, 23 nt, Pseudomonas aeruginosa PA01
ucagcaggaugcagucggcaccg

SEQ ID NO: 1514675 - RNA, 22 nt, Pseudomonas aeruginosa PA01
ucagcaggaauucgggaaggga

SEQ ID NO: 1514676 - RNA, 14 nt, Pseudomonas aeruginosa PA01
ucagcagcgccgcc

SEQ ID NO: 1514677 - RNA, 12 nt, Pseudomonas aeruginosa PA01
ucagcagcgcca

SEQ ID NO: 1514678 - RNA, 23 nt, Pseudomonas aeruginosa PA01
ucagcagcaggauguccuuguuc

SEQ ID NO: 1514679 - RNA, 13 nt, Pseudomonas aeruginosa PA01
ucagcagcaggcg

SEQ ID NO: 1514680 - RNA, 15 nt, Pseudomonas aeruginosa PA01
ucagcagcaggcgcu

SEQ ID NO: 1514681 - RNA, 21 nt, Pseudomonas aeruginosa PA01
ucagcagcaugccgcucugcc

SEQ ID NO: 1514682 - RNA, 21 nt, Pseudomonas aeruginosa PA01
ucagcacgucguccagcgccg

SEQ ID NO: 1514683 - RNA, 23 nt, Pseudomonas aeruginosa PA01
ucagcacgcccaguugcgccgcc

SEQ ID NO: 1514684 - RNA, 18 nt, Pseudomonas aeruginosa PA01
ucagcaccuugugcugcc

SEQ ID NO: 1514685 - RNA, 16 nt, Pseudomonas aeruginosa PA01
ucagcaccgccaccag

SEQ ID NO: 1514686 - RNA, 17 nt, Pseudomonas aeruginosa PA01
ucagcacccuggccacg

SEQ ID NO: 1514687 - RNA, 13 nt, Pseudomonas aeruginosa PA01
ucagcaccaggaa

SEQ ID NO: 1514688 - RNA, 19 nt, Pseudomonas aeruginosa PA01
ucagcaccagggccagggc

SEQ ID NO: 1514689 - RNA, 14 nt, Pseudomonas aeruginosa PA01
ucagcccgcugacc

SEQ ID NO: 1514690 - RNA, 19 nt, Pseudomonas aeruginosa PA01
ucagcccgccgugcgcucc

SEQ ID NO: 1514691 - RNA, 14 nt, Pseudomonas aeruginosa PA01
ucagcccgucggcc

SEQ ID NO: 1514692 - RNA, 15 nt, Pseudomonas aeruginosa PA01
ucagccgcuccagga

SEQ ID NO: 1514693 - RNA, 16 nt, Pseudomonas aeruginosa PA01
ucagccgcuccaggau

SEQ ID NO: 1514694 - RNA, 18 nt, Pseudomonas aeruginosa PA01
ucagccgcuccaggaucg

SEQ ID NO: 1514695 - RNA, 16 nt, Pseudomonas aeruginosa PA01
ucagccgcgccggggc

SEQ ID NO: 1514696 - RNA, 24 nt, Pseudomonas aeruginosa PA01
ucagccgcgccggggcagcagggc

SEQ ID NO: 1514697 - RNA, 18 nt, Pseudomonas aeruginosa PA01
ucagccgcgacucggcug

SEQ ID NO: 1514698 - RNA, 22 nt, Pseudomonas aeruginosa PA01
ucagccguggcacccaggccac

SEQ ID NO: 1514699 - RNA, 20 nt, Pseudomonas aeruginosa PA01
ucagccucacccugcugggc

SEQ ID NO: 1514700 - RNA, 21 nt, Pseudomonas aeruginosa PA01
ucagccauagaguugcuuggc

SEQ ID NO: 1514701 - RNA, 19 nt, Pseudomonas aeruginosa PA01
ucagcccacgcgccuggcc

SEQ ID NO: 1514702 - RNA, 18 nt, Pseudomonas aeruginosa PA01
ucagcccauacaccaggc

SEQ ID NO: 1514703 - RNA, 19 nt, Pseudomonas aeruginosa PA01
ucagcccauacaccaggcc

SEQ ID NO: 1514704 - RNA, 12 nt, Pseudomonas aeruginosa PA01
ucagccacgggc

SEQ ID NO: 1514705 - RNA, 23 nt, Pseudomonas aeruginosa PA01
ucagccagggcaacgccaggcug

SEQ ID NO: 1514706 - RNA, 14 nt, Pseudomonas aeruginosa PA01
ucagagcuggacga

SEQ ID NO: 1514707 - RNA, 19 nt, Pseudomonas aeruginosa PA01
ucagaacagcggcagcuca

SEQ ID NO: 1514708 - RNA, 15 nt, Pseudomonas aeruginosa PA01
ucagaccagcccugg

SEQ ID NO: 1514709 - RNA, 20 nt, Pseudomonas aeruginosa PA01
ucacggacccgcucggccuu

SEQ ID NO: 1514710 - RNA, 16 nt, Pseudomonas aeruginosa PA01
ucacgcuuuccggcuu

SEQ ID NO: 1514711 - RNA, 18 nt, Pseudomonas aeruginosa PA01
ucacgcugcucgcagccg

SEQ ID NO: 1514712 - RNA, 17 nt, Pseudomonas aeruginosa PA01
ucacggcgcgagaaaaa

SEQ ID NO: 1514713 - RNA, 15 nt, Pseudomonas aeruginosa PA01
ucacggcgaagcggc

SEQ ID NO: 1514714 - RNA, 21 nt, Pseudomonas aeruginosa PA01
ucacggcgcagccgcaaggcc

SEQ ID NO: 1514715 - RNA, 15 nt, Pseudomonas aeruginosa PA01
ucacggcauucucuc

SEQ ID NO: 1514716 - RNA, 14 nt, Pseudomonas aeruginosa PA01
ucacggucuuggcg

SEQ ID NO: 1514717 - RNA, 18 nt, Pseudomonas aeruginosa PA01
ucacggugacggugcagc

SEQ ID NO: 1514718 - RNA, 17 nt, Pseudomonas aeruginosa PA01
ucacgccuggcggcugg

SEQ ID NO: 1514719 - RNA, 14 nt, Pseudomonas aeruginosa PA01
ucacgcccugcccc

SEQ ID NO: 1514720 - RNA, 11 nt, Pseudomonas aeruginosa PA01
ucacgccgaag

SEQ ID NO: 1514721 - RNA, 18 nt, Pseudomonas aeruginosa PA01
ucacgcaggcgcuggccg

SEQ ID NO: 1514722 - RNA, 17 nt, Pseudomonas aeruginosa PA01
ucacgcaggcuuuccag

SEQ ID NO: 1514723 - RNA, 20 nt, Pseudomonas aeruginosa PA01
ucacgcaggcuuuccagccc

SEQ ID NO: 1514724 - RNA, 17 nt, Pseudomonas aeruginosa PA01
ucacgaucggcaccauc

SEQ ID NO: 1514725 - RNA, 18 nt, Pseudomonas aeruginosa PA01
ucacgaucggcaccauca

SEQ ID NO: 1514726 - RNA, 21 nt, Pseudomonas aeruginosa PA01
ucacgaucggcaccaucaccg

SEQ ID NO: 1514727 - RNA, 21 nt, Pseudomonas aeruginosa PA01
ucacgauggccggcagcagcg

SEQ ID NO: 1514728 - RNA, 16 nt, Pseudomonas aeruginosa PA01
ucaccuguucggcgcu

SEQ ID NO: 1514729 - RNA, 18 nt, Pseudomonas aeruginosa PA01
ucaccuggaucgccaggc

SEQ ID NO: 1514730 - RNA, 20 nt, Pseudomonas aeruginosa PA01
ucaccuugucgcaccagccu

SEQ ID NO: 1514731 - RNA, 21 nt, Pseudomonas aeruginosa PA01
ucacguaggagccggccaggc

SEQ ID NO: 1514732 - RNA, 20 nt, Pseudomonas aeruginosa PA01
ucacguaguugacccgcccc

SEQ ID NO: 1514733 - RNA, 17 nt, Pseudomonas aeruginosa PA01
ucacguccuugaccacg

SEQ ID NO: 1514734 - RNA, 16 nt, Pseudomonas aeruginosa PA01
ucacgucgagcacgcc

SEQ ID NO: 1514735 - RNA, 19 nt, Pseudomonas aeruginosa PA01
ucacgucgaucugcucguc

SEQ ID NO: 1514736 - RNA, 18 nt, Pseudomonas aeruginosa PA01
ucacgucggcguuguaca

SEQ ID NO: 1514737 - RNA, 15 nt, Pseudomonas aeruginosa PA01
ucacucgacaggcca

SEQ ID NO: 1514738 - RNA, 20 nt, Pseudomonas aeruginosa PA01
ucacucgacaggccauucuu

SEQ ID NO: 1514739 - RNA, 16 nt, Pseudomonas aeruginosa PA01
ucacuugaggaagugc

SEQ ID NO: 1514740 - RNA, 21 nt, Pseudomonas aeruginosa PA01
ucacuugaggaagugcagggc

SEQ ID NO: 1514741 - RNA, 15 nt, Pseudomonas aeruginosa PA01
ucacuuccagcugcc

SEQ ID NO: 1514742 - RNA, 12 nt, Pseudomonas aeruginosa PA01
ucacuucaccuu

SEQ ID NO: 1514743 - RNA, 18 nt, Pseudomonas aeruginosa PA01
ucacugccuggcaggucc

SEQ ID NO: 1514744 - RNA, 12 nt, Pseudomonas aeruginosa PA01
ucaagggcuggc

SEQ ID NO: 1514745 - RNA, 14 nt, Pseudomonas aeruginosa PA01
ucaagggcuggcag

SEQ ID NO: 1514746 - RNA, 19 nt, Pseudomonas aeruginosa PA01
ucaaggcagaaaaacccag

SEQ ID NO: 1514747 - RNA, 22 nt, Pseudomonas aeruginosa PA01
ucaaggcgaaacguccggcguc

SEQ ID NO: 1514748 - RNA, 13 nt, Pseudomonas aeruginosa PA01
ucacaaaggcguc

SEQ ID NO: 1514749 - RNA, 16 nt, Pseudomonas aeruginosa PA01
ucaaugcggccugcaa

SEQ ID NO: 1514750 - RNA, 15 nt, Pseudomonas aeruginosa PA01
ucacccgcgccugca

SEQ ID NO: 1514751 - RNA, 19 nt, Pseudomonas aeruginosa PA01
ucaccgagcguuuuuggca

SEQ ID NO: 1514752 - RNA, 14 nt, Pseudomonas aeruginosa PA01
ucaccgcauagucg

SEQ ID NO: 1514753 - RNA, 20 nt, Pseudomonas aeruginosa PA01
ucaccgaaaggcucuugggc

SEQ ID NO: 1514754 - RNA, 17 nt, Pseudomonas aeruginosa PA01
ucacccugucccaucac

SEQ ID NO: 1514755 - RNA, 19 nt, Pseudomonas aeruginosa PA01
ucaccgacagucccaggcc

SEQ ID NO: 1514756 - RNA, 13 nt, Pseudomonas aeruginosa PA01
ucaccgcggccuu

SEQ ID NO: 1514757 - RNA, 21 nt, Pseudomonas aeruginosa PA01
ucaccgcgcaaaccggcagca

SEQ ID NO: 1514758 - RNA, 18 nt, Pseudomonas aeruginosa PA01
ucaccggacggcugaggc

SEQ ID NO: 1514759 - RNA, 15 nt, Pseudomonas aeruginosa PA01
ucaccgccaccuugc

SEQ ID NO: 1514760 - RNA, 15 nt, Pseudomonas aeruginosa PA01
ucaccgccaucagca

SEQ ID NO: 1514761 - RNA, 15 nt, Pseudomonas aeruginosa PA01
ucaccggcagcagcg

SEQ ID NO: 1514762 - RNA, 22 nt, Pseudomonas aeruginosa PA01
ucaccggcgccacccucggcuu

SEQ ID NO: 1514763 - RNA, 18 nt, Pseudomonas aeruginosa PA01
ucaccguucccagcagcg

SEQ ID NO: 1514764 - RNA, 12 nt, Pseudomonas aeruginosa PA01
ucaccgugaucc

SEQ ID NO: 1514765 - RNA, 15 nt, Pseudomonas aeruginosa PA01
ucaccaugaucaucg

SEQ ID NO: 1514766 - RNA, 23 nt, Pseudomonas aeruginosa PA01
ucaccccacgggcgacccaggcc

SEQ ID NO: 1514767 - RNA, 17 nt, Pseudomonas aeruginosa PA01
ucaccaccuggauggug

SEQ ID NO: 1514768 - RNA, 17 nt, Pseudomonas aeruginosa PA01
ucaccacucgccagcgc

SEQ ID NO: 1514769 - RNA, 19 nt, Pseudomonas aeruginosa PA01
ucaccacuggaaacgccca

SEQ ID NO: 1514770 - RNA, 14 nt, Pseudomonas aeruginosa PA01
ucaccagcaauugc

SEQ ID NO: 1514771 - RNA, 18 nt, Pseudomonas aeruginosa PA01
ucaccagcaauugccggc

SEQ ID NO: 1514772 - RNA, 15 nt, Pseudomonas aeruginosa PA01
ucaccagcagccccg

SEQ ID NO: 1514773 - RNA, 12 nt, Pseudomonas aeruginosa PA01
ucaccagcgccg

SEQ ID NO: 1514774 - RNA, 23 nt, Pseudomonas aeruginosa PA01
ucaccaggccgaacgggaaguag

SEQ ID NO: 1514775 - RNA, 12 nt, Pseudomonas aeruginosa PA01
ucaccaggaucg

SEQ ID NO: 1514776 - RNA, 21 nt, Pseudomonas aeruginosa PA01
ucaccagggucggcaccugca

SEQ ID NO: 1514777 - RNA, 15 nt, Pseudomonas aeruginosa PA01
ucacaugcaccaggc

SEQ ID NO: 1514778 - RNA, 17 nt, Pseudomonas aeruginosa PA01
ucacaugcaccaggccc

SEQ ID NO: 1514779 - RNA, 15 nt, Pseudomonas aeruginosa PA01
ucacauacaccuugc

SEQ ID NO: 1514780 - RNA, 14 nt, Pseudomonas aeruginosa PA01
ucacaccgaacuuc

SEQ ID NO: 1514781 - RNA, 14 nt, Pseudomonas aeruginosa PA01
ucacaccaccagca

SEQ ID NO: 1514782 - RNA, 23 nt, Pseudomonas aeruginosa PA01
uauuaccccgcccacucuucagu

SEQ ID NO: 1514783 - RNA, 22 nt, Pseudomonas aeruginosa PA01
uauucgacgguauguuucuggc

SEQ ID NO: 1514784 - RNA, 11 nt, Pseudomonas aeruginosa PA01
uauuccucagu

SEQ ID NO: 1514785 - RNA, 15 nt, Pseudomonas aeruginosa PA01
uauucgcccuacccc

SEQ ID NO: 1514786 - RNA, 23 nt, Pseudomonas aeruginosa PA01
uauucgcccuaccccccaauugc

SEQ ID NO: 1514787 - RNA, 22 nt, Pseudomonas aeruginosa PA01
uauucgcccuaccgcccacccu

SEQ ID NO: 1514788 - RNA, 16 nt, Pseudomonas aeruginosa PA01
uauuucucgacuuccg

SEQ ID NO: 1514789 - RNA, 20 nt, Pseudomonas aeruginosa PA01
uauuucgaaggguuccucuc

SEQ ID NO: 1514790 - RNA, 18 nt, Pseudomonas aeruginosa PA01
uauugucgaugggcagga

SEQ ID NO: 1514791 - RNA, 16 nt, Pseudomonas aeruginosa PA01
uauugguauccagguu

SEQ ID NO: 1514792 - RNA, 23 nt, Pseudomonas aeruginosa PA01
ucaagcaauucgugugggugcuu

SEQ ID NO: 1514793 - RNA, 15 nt, Pseudomonas aeruginosa PA01
ucaagacggcccgca

SEQ ID NO: 1514794 - RNA, 16 nt, Pseudomonas aeruginosa PA01
ucaacuccgccaggcg

SEQ ID NO: 1514795 - RNA, 17 nt, Pseudomonas aeruginosa PA01
ucaacaccagcgccgcc

SEQ ID NO: 1514796 - RNA, 23 nt, Pseudomonas aeruginosa PA01
ucaacaccagcgccgccaggcag

SEQ ID NO: 1514797 - RNA, 12 nt, Pseudomonas aeruginosa PA01
ucaaccaggcga

SEQ ID NO: 1514798 - RNA, 22 nt, Pseudomonas aeruginosa PA01
ucaacauccugaaaagcgcugc

SEQ ID NO: 1514799 - RNA, 21 nt, Pseudomonas aeruginosa PA01
ucaaaaccagccuugagccuu

SEQ ID NO: 1514800 - RNA, 20 nt, Pseudomonas aeruginosa PA01
guuucauucgucgcugcacg

SEQ ID NO: 1514801 - RNA, 14 nt, Pseudomonas aeruginosa PA01
guuucguccccuuc

SEQ ID NO: 1514802 - RNA, 13 nt, Pseudomonas aeruginosa PA01
guuuccagcagca

SEQ ID NO: 1514803 - RNA, 17 nt, Pseudomonas aeruginosa PA01
guuucaacucccaggac

SEQ ID NO: 1514804 - RNA, 20 nt, Pseudomonas aeruginosa PA01
guuucacggcggauaaccgc

SEQ ID NO: 1514805 - RNA, 16 nt, Pseudomonas aeruginosa PA01
guugugccgccaccuc

SEQ ID NO: 1514806 - RNA, 15 nt, Pseudomonas aeruginosa PA01
guucugggcggccag

SEQ ID NO: 1514807 - RNA, 16 nt, Pseudomonas aeruginosa PA01
guucugguaacuggga

SEQ ID NO: 1514808 - RNA, 15 nt, Pseudomonas aeruginosa PA01
guucuguguggccug

SEQ ID NO: 1514809 - RNA, 19 nt, Pseudomonas aeruginosa PA01
guucuguucgucccgagca

SEQ ID NO: 1514810 - RNA, 17 nt, Pseudomonas aeruginosa PA01
guucuucacccgcagcg

SEQ ID NO: 1514811 - RNA, 19 nt, Pseudomonas aeruginosa PA01
guugucccugucccgccgc

SEQ ID NO: 1514812 - RNA, 18 nt, Pseudomonas aeruginosa PA01
guucuuccaccguggcga

SEQ ID NO: 1514813 - RNA, 14 nt, Pseudomonas aeruginosa PA01
guuuuccauggcga

SEQ ID NO: 1514814 - RNA, 17 nt, Pseudomonas aeruginosa PA01
guuuuccgguugcagcc

SEQ ID NO: 1514815 - RNA, 13 nt, Pseudomonas aeruginosa PA01
guuuuuuuugccu

SEQ ID NO: 1514816 - RNA, 18 nt, Pseudomonas aeruginosa PA01
guuuuucauugggcagcc

SEQ ID NO: 1514817 - RNA, 17 nt, Pseudomonas aeruginosa PA01
uaaagguaauaucaccc

SEQ ID NO: 1514818 - RNA, 22 nt, Pseudomonas aeruginosa PA01
uaaaugcuugaaaaucaaggau

SEQ ID NO: 1514819 - RNA, 22 nt, Pseudomonas aeruginosa PA01
gucugcgcggcguucgcccugc

SEQ ID NO: 1514820 - RNA, 19 nt, Pseudomonas aeruginosa PA01
gucugcucauucggccagc

SEQ ID NO: 1514821 - RNA, 14 nt, Pseudomonas aeruginosa PA01
gucugcaccgcccu

SEQ ID NO: 1514822 - RNA, 17 nt, Pseudomonas aeruginosa PA01
gucugcaccgcccuuuc

SEQ ID NO: 1514823 - RNA, 17 nt, Pseudomonas aeruginosa PA01
gucucgcagacggggcc

SEQ ID NO: 1514824 - RNA, 17 nt, Pseudomonas aeruginosa PA01
gucucggugcucaggcg

SEQ ID NO: 1514825 - RNA, 20 nt, Pseudomonas aeruginosa PA01
gucucggugcucaggcggcc

SEQ ID NO: 1514826 - RNA, 15 nt, Pseudomonas aeruginosa PA01
gucucgcgacacgug

SEQ ID NO: 1514827 - RNA, 12 nt, Pseudomonas aeruginosa PA01
gucucgccgccg

SEQ ID NO: 1514828 - RNA, 20 nt, Pseudomonas aeruginosa PA01
gucucgccgccgagcaggcc

SEQ ID NO: 1514829 - RNA, 22 nt, Pseudomonas aeruginosa PA01
gucucgauggcagccuuggcca

SEQ ID NO: 1514830 - RNA, 11 nt, Pseudomonas aeruginosa PA01
gucuccugugc

SEQ ID NO: 1514831 - RNA, 14 nt, Pseudomonas aeruginosa PA01
gucuccugugccuu

SEQ ID NO: 1514832 - RNA, 15 nt, Pseudomonas aeruginosa PA01
gucuccugccgccga

SEQ ID NO: 1514833 - RNA, 19 nt, Pseudomonas aeruginosa PA01
gucucgaacgccaggcagg

SEQ ID NO: 1514834 - RNA, 18 nt, Pseudomonas aeruginosa PA01
gucugggacggcagccug

SEQ ID NO: 1514835 - RNA, 19 nt, Pseudomonas aeruginosa PA01
gucugggacggcagccugg

SEQ ID NO: 1514836 - RNA, 23 nt, Pseudomonas aeruginosa PA01
gucugguagauggacgguuccca

SEQ ID NO: 1514837 - RNA, 21 nt, Pseudomonas aeruginosa PA01
gucugcugguagcugcugccg

SEQ ID NO: 1514838 - RNA, 12 nt, Pseudomonas aeruginosa PA01
gucuggcgccug

SEQ ID NO: 1514839 - RNA, 18 nt, Pseudomonas aeruginosa PA01
gucuggcgccuggccugg

SEQ ID NO: 1514840 - RNA, 19 nt, Pseudomonas aeruginosa PA01
gucuggcgccuggccugga

SEQ ID NO: 1514841 - RNA, 18 nt, Pseudomonas aeruginosa PA01
gucuucacgccuugcugc

SEQ ID NO: 1514842 - RNA, 12 nt, Pseudomonas aeruginosa PA01
gucuucagcuug

SEQ ID NO: 1514843 - RNA, 20 nt, Pseudomonas aeruginosa PA01
gucuucaggcgugggccagc

SEQ ID NO: 1514844 - RNA, 21 nt, Pseudomonas aeruginosa PA01
gucuucaggcgugggccagcc

SEQ ID NO: 1514845 - RNA, 22 nt, Pseudomonas aeruginosa PA01
gucugugccgugaucaccugga

SEQ ID NO: 1514846 - RNA, 14 nt, Pseudomonas aeruginosa PA01
gucuguugcggugg

SEQ ID NO: 1514847 - RNA, 16 nt, Pseudomonas aeruginosa PA01
gucuguugcgguggug

SEQ ID NO: 1514848 - RNA, 17 nt, Pseudomonas aeruginosa PA01
gucuugccggucugcug

SEQ ID NO: 1514849 - RNA, 18 nt, Pseudomonas aeruginosa PA01
gucuugcccaacuccagc

SEQ ID NO: 1514850 - RNA, 18 nt, Pseudomonas aeruginosa PA01
gucuucguuuucaggcga

SEQ ID NO: 1514851 - RNA, 16 nt, Pseudomonas aeruginosa PA01
gucuucgccggccugc

SEQ ID NO: 1514852 - RNA, 18 nt, Pseudomonas aeruginosa PA01
gucuucgccggccugcgc

SEQ ID NO: 1514853 - RNA, 16 nt, Pseudomonas aeruginosa PA01
gucuucgauggcggcc

SEQ ID NO: 1514854 - RNA, 22 nt, Pseudomonas aeruginosa PA01
gucuuccuugcugaagcccagg

SEQ ID NO: 1514855 - RNA, 18 nt, Pseudomonas aeruginosa PA01
gucuucgaaguucaggga

SEQ ID NO: 1514856 - RNA, 14 nt, Pseudomonas aeruginosa PA01
gucuuccugcacgc

SEQ ID NO: 1514857 - RNA, 21 nt, Pseudomonas aeruginosa PA01
gucuuucacgguaaaacaagc

SEQ ID NO: 1514858 - RNA, 13 nt, Pseudomonas aeruginosa PA01
gucuuucagcuuc

SEQ ID NO: 1514859 - RNA, 18 nt, Pseudomonas aeruginosa PA01
gucuuucagcuucagggu

SEQ ID NO: 1514860 - RNA, 20 nt, Pseudomonas aeruginosa PA01
gucuuucagcuucagggugg

SEQ ID NO: 1514861 - RNA, 13 nt, Pseudomonas aeruginosa PA01
gugaaagggaaau

SEQ ID NO: 1514862 - RNA, 17 nt, Pseudomonas aeruginosa PA01
gugaacagcggcccgag

SEQ ID NO: 1514863 - RNA, 17 nt, Pseudomonas aeruginosa PA01
gugaacgagcccaggca

SEQ ID NO: 1514864 - RNA, 14 nt, Pseudomonas aeruginosa PA01
gugaaccaggcgcc

SEQ ID NO: 1514865 - RNA, 19 nt, Pseudomonas aeruginosa PA01
gugaauucgagaguuuuau

SEQ ID NO: 1514866 - RNA, 22 nt, Pseudomonas aeruginosa PA01
gugaaggucugguaggccauga

SEQ ID NO: 1514867 - RNA, 16 nt, Pseudomonas aeruginosa PA01
gugaagcccaggcgcu

SEQ ID NO: 1514868 - RNA, 20 nt, Pseudomonas aeruginosa PA01
gugaagccccuggcgcuggg

SEQ ID NO: 1514869 - RNA, 15 nt, Pseudomonas aeruginosa PA01
gugaagcgcaggcgg

SEQ ID NO: 1514870 - RNA, 22 nt, Pseudomonas aeruginosa PA01
gugaagcgcaggcggcuggcgc

SEQ ID NO: 1514871 - RNA, 19 nt, Pseudomonas aeruginosa PA01
gugaggcgcauggacaggu

SEQ ID NO: 1514872 - RNA, 13 nt, Pseudomonas aeruginosa PA01
gugaggcgcgcgc

SEQ ID NO: 1514873 - RNA, 22 nt, Pseudomonas aeruginosa PA01
gugagggcgacggcggugcgca

SEQ ID NO: 1514874 - RNA, 22 nt, Pseudomonas aeruginosa PA01
gugagccccggcgucggcgcgg

SEQ ID NO: 1514875 - RNA, 19 nt, Pseudomonas aeruginosa PA01
gugauaccgccggcggcga

SEQ ID NO: 1514876 - RNA, 17 nt, Pseudomonas aeruginosa PA01
gugauccgcagguagcu

SEQ ID NO: 1514877 - RNA, 22 nt, Pseudomonas aeruginosa PA01
gugauccaggucgaucagcagc

SEQ ID NO: 1514878 - RNA, 14 nt, Pseudomonas aeruginosa PA01
gugaucaccgccuu

SEQ ID NO: 1514879 - RNA, 21 nt, Pseudomonas aeruginosa PA01
gugaucaccuggaucgccagg

SEQ ID NO: 1514880 - RNA, 16 nt, Pseudomonas aeruginosa PA01
gugacguuggccgggg

SEQ ID NO: 1514881 - RNA, 12 nt, Pseudomonas aeruginosa PA01
gugacggccggg

SEQ ID NO: 1514882 - RNA, 15 nt, Pseudomonas aeruginosa PA01
gugacggccggggcg

SEQ ID NO: 1514883 - RNA, 12 nt, Pseudomonas aeruginosa PA01
gugacacccugc

SEQ ID NO: 1514884 - RNA, 17 nt, Pseudomonas aeruginosa PA01
gugacauucgacagcag

SEQ ID NO: 1514885 - RNA, 19 nt, Pseudomonas aeruginosa PA01
gugaccgcgcgccauggcc

SEQ ID NO: 1514886 - RNA, 17 nt, Pseudomonas aeruginosa PA01
gugaccggcuuggucac

SEQ ID NO: 1514887 - RNA, 21 nt, Pseudomonas aeruginosa PA01
gugaccgcccagggggccggg

SEQ ID NO: 1514888 - RNA, 21 nt, Pseudomonas aeruginosa PA01
gugaccgagauucugcaggcg

SEQ ID NO: 1514889 - RNA, 23 nt, Pseudomonas aeruginosa PA01
gugaccgagauucugcaggcgcu

SEQ ID NO: 1514890 - RNA, 19 nt, Pseudomonas aeruginosa PA01
gugccgggccggccagggc

SEQ ID NO: 1514891 - RNA, 20 nt, Pseudomonas aeruginosa PA01
gugccggccaugcaggccag

SEQ ID NO: 1514892 - RNA, 21 nt, Pseudomonas aeruginosa PA01
gugccgggcgucugcucauuc

SEQ ID NO: 1514893 - RNA, 18 nt, Pseudomonas aeruginosa PA01
gugccgggaagcgcaggc

SEQ ID NO: 1514894 - RNA, 22 nt, Pseudomonas aeruginosa PA01
gugccgggaagcgcaggccgcc

SEQ ID NO: 1514895 - RNA, 18 nt, Pseudomonas aeruginosa PA01
gugccguggaccaacagc

SEQ ID NO: 1514896 - RNA, 16 nt, Pseudomonas aeruginosa PA01
gugccguuccagcggc

SEQ ID NO: 1514897 - RNA, 22 nt, Pseudomonas aeruginosa PA01
gugccguacucauggccgcagc

SEQ ID NO: 1514898 - RNA, 13 nt, Pseudomonas aeruginosa PA01
gugccgucaugca

SEQ ID NO: 1514899 - RNA, 16 nt, Pseudomonas aeruginosa PA01
gugccgucaugcacuu

SEQ ID NO: 1514900 - RNA, 16 nt, Pseudomonas aeruginosa PA01
gugccauucggugcgc

SEQ ID NO: 1514901 - RNA, 18 nt, Pseudomonas aeruginosa PA01
gugccauacagcgcccau

SEQ ID NO: 1514902 - RNA, 18 nt, Pseudomonas aeruginosa PA01
gugccaucaggccgcggc

SEQ ID NO: 1514903 - RNA, 16 nt, Pseudomonas aeruginosa PA01
gugccgagcaggauga

SEQ ID NO: 1514904 - RNA, 14 nt, Pseudomonas aeruginosa PA01
gugccgaggccgcc

SEQ ID NO: 1514905 - RNA, 15 nt, Pseudomonas aeruginosa PA01
gugccgcaggccgcg

SEQ ID NO: 1514906 - RNA, 23 nt, Pseudomonas aeruginosa PA01
gugccgccauagagugcccaggc

SEQ ID NO: 1514907 - RNA, 12 nt, Pseudomonas aeruginosa PA01
gugccgccaggc

SEQ ID NO: 1514908 - RNA, 18 nt, Pseudomonas aeruginosa PA01
gugccgccaggccuucca

SEQ ID NO: 1514909 - RNA, 23 nt, Pseudomonas aeruginosa PA01
gugcagcucggcacgcagcagcu

SEQ ID NO: 1514910 - RNA, 13 nt, Pseudomonas aeruginosa PA01
gugcaggccgccg

SEQ ID NO: 1514911 - RNA, 13 nt, Pseudomonas aeruginosa PA01
gugcagcuccacc

SEQ ID NO: 1514912 - RNA, 24 nt, Pseudomonas aeruginosa PA01
gugcagcuugguauccaccucgcc

SEQ ID NO: 1514913 - RNA, 21 nt, Pseudomonas aeruginosa PA01
gugcaguacuuggccagcagc

SEQ ID NO: 1514914 - RNA, 17 nt, Pseudomonas aeruginosa PA01
gugcagguagcagccgu

SEQ ID NO: 1514915 - RNA, 16 nt, Pseudomonas aeruginosa PA01
gugcagguagccgcgc

SEQ ID NO: 1514916 - RNA, 18 nt, Pseudomonas aeruginosa PA01
gugcagggucagucgagc

SEQ ID NO: 1514917 - RNA, 22 nt, Pseudomonas aeruginosa PA01
gugcaggguauuuuccagcagg

SEQ ID NO: 1514918 - RNA, 17 nt, Pseudomonas aeruginosa PA01
gugcagggucacgcugg

SEQ ID NO: 1514919 - RNA, 18 nt, Pseudomonas aeruginosa PA01
gugcagggcagcggcccu

SEQ ID NO: 1514920 - RNA, 16 nt, Pseudomonas aeruginosa PA01
gugcauccgccgcaga

SEQ ID NO: 1514921 - RNA, 17 nt, Pseudomonas aeruginosa PA01
gugcauccgccgcagac

SEQ ID NO: 1514922 - RNA, 19 nt, Pseudomonas aeruginosa PA01
gugcaucggccgccaggcu

SEQ ID NO: 1514923 - RNA, 15 nt, Pseudomonas aeruginosa PA01
gugcaugaaggcgcu

SEQ ID NO: 1514924 - RNA, 17 nt, Pseudomonas aeruginosa PA01
gugcaugcgugcauccu

SEQ ID NO: 1514925 - RNA, 17 nt, Pseudomonas aeruginosa PA01
gugcaucaccggcagca

SEQ ID NO: 1514926 - RNA, 19 nt, Pseudomonas aeruginosa PA01
gugcaucagccuggccagc

SEQ ID NO: 1514927 - RNA, 22 nt, Pseudomonas aeruginosa PA01
gugcaacaccuggcgcucgccg

SEQ ID NO: 1514928 - RNA, 11 nt, Pseudomonas aeruginosa PA01
gugaucuggca

SEQ ID NO: 1514929 - RNA, 17 nt, Pseudomonas aeruginosa PA01
gugaucucgcggcgcgg

SEQ ID NO: 1514930 - RNA, 19 nt, Pseudomonas aeruginosa PA01
gugauuucuucagccuggg

SEQ ID NO: 1514931 - RNA, 14 nt, Pseudomonas aeruginosa PA01
gugcacgcgccggg

SEQ ID NO: 1514932 - RNA, 15 nt, Pseudomonas aeruginosa PA01
gugcacgcgccgggu

SEQ ID NO: 1514933 - RNA, 17 nt, Pseudomonas aeruginosa PA01
gugcacggucugcucgg

SEQ ID NO: 1514934 - RNA, 16 nt, Pseudomonas aeruginosa PA01
gugcagcgagucgccg

SEQ ID NO: 1514935 - RNA, 17 nt, Pseudomonas aeruginosa PA01
gugcagcgagucgccgu

SEQ ID NO: 1514936 - RNA, 21 nt, Pseudomonas aeruginosa PA01
gugcagcggaagcccugcugg

SEQ ID NO: 1514937 - RNA, 18 nt, Pseudomonas aeruginosa PA01
guuauugaaguggugaug

SEQ ID NO: 1514938 - RNA, 23 nt, Pseudomonas aeruginosa PA01
guuaugcacguucuugaccuucu

SEQ ID NO: 1514939 - RNA, 16 nt, Pseudomonas aeruginosa PA01
guuauccgccgccuau

SEQ ID NO: 1514940 - RNA, 15 nt, Pseudomonas aeruginosa PA01
guuaaugccgguggg

SEQ ID NO: 1514941 - RNA, 17 nt, Pseudomonas aeruginosa PA01
guuaccgcgggcucagg

SEQ ID NO: 1514942 - RNA, 16 nt, Pseudomonas aeruginosa PA01
guuccgcaucggccac

SEQ ID NO: 1514943 - RNA, 14 nt, Pseudomonas aeruginosa PA01
guuccgcucaccag

SEQ ID NO: 1514944 - RNA, 18 nt, Pseudomonas aeruginosa PA01
guucccagaaaaucggca

SEQ ID NO: 1514945 - RNA, 21 nt, Pseudomonas aeruginosa PA01
guucccagaccuggccgcugu

SEQ ID NO: 1514946 - RNA, 16 nt, Pseudomonas aeruginosa PA01
guuccauuuguuuuaa

SEQ ID NO: 1514947 - RNA, 12 nt, Pseudomonas aeruginosa PA01
guuccagcggcc

SEQ ID NO: 1514948 - RNA, 18 nt, Pseudomonas aeruginosa PA01
guuccagcgccucgggcc

SEQ ID NO: 1514949 - RNA, 13 nt, Pseudomonas aeruginosa PA01
guuccagcuccgu

SEQ ID NO: 1514950 - RNA, 13 nt, Pseudomonas aeruginosa PA01
guuccagcaccuc

SEQ ID NO: 1514951 - RNA, 20 nt, Pseudomonas aeruginosa PA01
guuccaguacacccagggca

SEQ ID NO: 1514952 - RNA, 22 nt, Pseudomonas aeruginosa PA01
guuccaguacacccagggcagu

SEQ ID NO: 1514953 - RNA, 13 nt, Pseudomonas aeruginosa PA01
guucaugccgcga

SEQ ID NO: 1514954 - RNA, 19 nt, Pseudomonas aeruginosa PA01
guuccacgucgagcgggcg

SEQ ID NO: 1514955 - RNA, 14 nt, Pseudomonas aeruginosa PA01
guucaccgcggccu

SEQ ID NO: 1514956 - RNA, 18 nt, Pseudomonas aeruginosa PA01
guucaccguggcgcuggc

SEQ ID NO: 1514957 - RNA, 20 nt, Pseudomonas aeruginosa PA01
guucacgccuggcggcuggc

SEQ ID NO: 1514958 - RNA, 23 nt, Pseudomonas aeruginosa PA01
guucaccgaggguuuccaccugu

SEQ ID NO: 1514959 - RNA, 18 nt, Pseudomonas aeruginosa PA01
guucaccgccucggagaa

SEQ ID NO: 1514960 - RNA, 12 nt, Pseudomonas aeruginosa PA01
guucaccgcgca

SEQ ID NO: 1514961 - RNA, 14 nt, Pseudomonas aeruginosa PA01
guucugcccgccgg

SEQ ID NO: 1514962 - RNA, 13 nt, Pseudomonas aeruginosa PA01
guucugccgcaga

SEQ ID NO: 1514963 - RNA, 17 nt, Pseudomonas aeruginosa PA01
guucugccgcagcgccu

SEQ ID NO: 1514964 - RNA, 13 nt, Pseudomonas aeruginosa PA01
guucuccagcaag

SEQ ID NO: 1514965 - RNA, 14 nt, Pseudomonas aeruginosa PA01
guucucccugagcc

SEQ ID NO: 1514966 - RNA, 16 nt, Pseudomonas aeruginosa PA01
guucucggccagguac

SEQ ID NO: 1514967 - RNA, 17 nt, Pseudomonas aeruginosa PA01
guucucggccagguacu

SEQ ID NO: 1514968 - RNA, 18 nt, Pseudomonas aeruginosa PA01
guucucgaucaucgccag

SEQ ID NO: 1514969 - RNA, 15 nt, Pseudomonas aeruginosa PA01
guucggucaggcuga

SEQ ID NO: 1514970 - RNA, 22 nt, Pseudomonas aeruginosa PA01
guucggcuguuucaggccggcg

SEQ ID NO: 1514971 - RNA, 21 nt, Pseudomonas aeruginosa PA01
guucggcgaccauucaugggc

SEQ ID NO: 1514972 - RNA, 12 nt, Pseudomonas aeruginosa PA01
guucgagcagcu

SEQ ID NO: 1514973 - RNA, 20 nt, Pseudomonas aeruginosa PA01
guuccgggcagcggcgcaac

SEQ ID NO: 1514974 - RNA, 22 nt, Pseudomonas aeruginosa PA01
guuccuguccauuuccacgcuc

SEQ ID NO: 1514975 - RNA, 21 nt, Pseudomonas aeruginosa PA01
guuccuucuugacccgcugca

SEQ ID NO: 1514976 - RNA, 16 nt, Pseudomonas aeruginosa PA01
guucgaaugcugcccg

SEQ ID NO: 1514977 - RNA, 16 nt, Pseudomonas aeruginosa PA01
guguagguauccgccg

SEQ ID NO: 1514978 - RNA, 22 nt, Pseudomonas aeruginosa PA01
guguagaggcucaacugguccu

SEQ ID NO: 1514979 - RNA, 15 nt, Pseudomonas aeruginosa PA01
guguagaccaccagc

SEQ ID NO: 1514980 - RNA, 14 nt, Pseudomonas aeruginosa PA01
guguagcugcagcg

SEQ ID NO: 1514981 - RNA, 17 nt, Pseudomonas aeruginosa PA01
guguagcugcagcgccc

SEQ ID NO: 1514982 - RNA, 20 nt, Pseudomonas aeruginosa PA01
gugucgaggaaggccagcag

SEQ ID NO: 1514983 - RNA, 22 nt, Pseudomonas aeruginosa PA01
gugucgcucccuacgaugcugg

SEQ ID NO: 1514984 - RNA, 23 nt, Pseudomonas aeruginosa PA01
gugucgacgacgaaaggccgcgc

SEQ ID NO: 1514985 - RNA, 12 nt, Pseudomonas aeruginosa PA01
guguccgcggug

SEQ ID NO: 1514986 - RNA, 20 nt, Pseudomonas aeruginosa PA01
guguucggcggcgugcaggg

SEQ ID NO: 1514987 - RNA, 21 nt, Pseudomonas aeruginosa PA01
guguucggcggcgugcagggu

SEQ ID NO: 1514988 - RNA, 13 nt, Pseudomonas aeruginosa PA01
guguucggcggcu

SEQ ID NO: 1514989 - RNA, 15 nt, Pseudomonas aeruginosa PA01
guguucauagaaacg

SEQ ID NO: 1514990 - RNA, 20 nt, Pseudomonas aeruginosa PA01
guguucccggaucagcucgc

SEQ ID NO: 1514991 - RNA, 16 nt, Pseudomonas aeruginosa PA01
guuaacaguugagcug

SEQ ID NO: 1514992 - RNA, 14 nt, Pseudomonas aeruginosa PA01
guggagucaggcgc

SEQ ID NO: 1514993 - RNA, 23 nt, Pseudomonas aeruginosa PA01
guggaguagguuuucguugggug

SEQ ID NO: 1514994 - RNA, 19 nt, Pseudomonas aeruginosa PA01
guggaggaucuccaacugg

SEQ ID NO: 1514995 - RNA, 20 nt, Pseudomonas aeruginosa PA01
guggaggaucuccaacuggc

SEQ ID NO: 1514996 - RNA, 14 nt, Pseudomonas aeruginosa PA01
guggaggcgggcuc

SEQ ID NO: 1514997 - RNA, 15 nt, Pseudomonas aeruginosa PA01
guggaccagcgccgc

SEQ ID NO: 1514998 - RNA, 19 nt, Pseudomonas aeruginosa PA01
guggaccaacagccggcgg

SEQ ID NO: 1514999 - RNA, 15 nt, Pseudomonas aeruginosa PA01
guggacauacaggcg

SEQ ID NO: 1515000 - RNA, 17 nt, Pseudomonas aeruginosa PA01
guggacauacaggcgcg

SEQ ID NO: 1515001 - RNA, 16 nt, Pseudomonas aeruginosa PA01
guggacacccugcugc

SEQ ID NO: 1515002 - RNA, 18 nt, Pseudomonas aeruginosa PA01
guggacacccugcugcug

SEQ ID NO: 1515003 - RNA, 19 nt, Pseudomonas aeruginosa PA01
guggaacagcaucagaggc

SEQ ID NO: 1515004 - RNA, 19 nt, Pseudomonas aeruginosa PA01
guggaaccgauggccaggg

SEQ ID NO: 1515005 - RNA, 16 nt, Pseudomonas aeruginosa PA01
guggaaccgcggcgcc

SEQ ID NO: 1515006 - RNA, 19 nt, Pseudomonas aeruginosa PA01
guggaaccgcggcgcccuc

SEQ ID NO: 1515007 - RNA, 15 nt, Pseudomonas aeruginosa PA01
guggaagcgcgcguc

SEQ ID NO: 1515008 - RNA, 18 nt, Pseudomonas aeruginosa PA01
guggaagccguggcgggc

SEQ ID NO: 1515009 - RNA, 13 nt, Pseudomonas aeruginosa PA01
gugcgcagcagcg

SEQ ID NO: 1515010 - RNA, 13 nt, Pseudomonas aeruginosa PA01
gugcgcaggcugg

SEQ ID NO: 1515011 - RNA, 23 nt, Pseudomonas aeruginosa PA01
gugcgcaggcuggccgagcgccg

SEQ ID NO: 1515012 - RNA, 17 nt, Pseudomonas aeruginosa PA01
gugcuugugguaguggu

SEQ ID NO: 1515013 - RNA, 14 nt, Pseudomonas aeruginosa PA01
gugggccagcaggc

SEQ ID NO: 1515014 - RNA, 12 nt, Pseudomonas aeruginosa PA01
gugggccaggga

SEQ ID NO: 1515015 - RNA, 15 nt, Pseudomonas aeruginosa PA01
gugggccggcaugcu

SEQ ID NO: 1515016 - RNA, 15 nt, Pseudomonas aeruginosa PA01
gugggcgaggcgcuc

SEQ ID NO: 1515017 - RNA, 23 nt, Pseudomonas aeruginosa PA01
gugggcuucgccgccgcgcgcgc

SEQ ID NO: 1515018 - RNA, 12 nt, Pseudomonas aeruginosa PA01
guggucugcacg

SEQ ID NO: 1515019 - RNA, 18 nt, Pseudomonas aeruginosa PA01
guggucguagcagguccg

SEQ ID NO: 1515020 - RNA, 15 nt, Pseudomonas aeruginosa PA01
gugguccgccagcag

SEQ ID NO: 1515021 - RNA, 15 nt, Pseudomonas aeruginosa PA01
guggucgaauggagu

SEQ ID NO: 1515022 - RNA, 15 nt, Pseudomonas aeruginosa PA01
guggucgaccaggcg

SEQ ID NO: 1515023 - RNA, 14 nt, Pseudomonas aeruginosa PA01
guggucgcagcucc

SEQ ID NO: 1515024 - RNA, 15 nt, Pseudomonas aeruginosa PA01
guggucgcagcucca

SEQ ID NO: 1515025 - RNA, 21 nt, Pseudomonas aeruginosa PA01
guggucgcagcuccagcggaa

SEQ ID NO: 1515026 - RNA, 18 nt, Pseudomonas aeruginosa PA01
guggucgccgcccacgcc

SEQ ID NO: 1515027 - RNA, 13 nt, Pseudomonas aeruginosa PA01
guggcgggcucug

SEQ ID NO: 1515028 - RNA, 17 nt, Pseudomonas aeruginosa PA01
guggcgucgaucaggcg

SEQ ID NO: 1515029 - RNA, 14 nt, Pseudomonas aeruginosa PA01
guggcgugcucggc

SEQ ID NO: 1515030 - RNA, 23 nt, Pseudomonas aeruginosa PA01
guggcguucucguguugcagcag

SEQ ID NO: 1515031 - RNA, 19 nt, Pseudomonas aeruginosa PA01
guggcguuccaggcggcgg

SEQ ID NO: 1515032 - RNA, 20 nt, Pseudomonas aeruginosa PA01
guggcguugucggcaaccgg

SEQ ID NO: 1515033 - RNA, 23 nt, Pseudomonas aeruginosa PA01
guggcguugucggcaaccgggcg

SEQ ID NO: 1515034 - RNA, 17 nt, Pseudomonas aeruginosa PA01
guggcuacggaugcugu

SEQ ID NO: 1515035 - RNA, 22 nt, Pseudomonas aeruginosa PA01
gugggaagagcaucucgccggc

SEQ ID NO: 1515036 - RNA, 23 nt, Pseudomonas aeruginosa PA01
gugggaagagcaucucgccggca

SEQ ID NO: 1515037 - RNA, 23 nt, Pseudomonas aeruginosa PA01
guggccuccugcaacgccuggug

SEQ ID NO: 1515038 - RNA, 15 nt, Pseudomonas aeruginosa PA01
guggcggcgcgcguc

SEQ ID NO: 1515039 - RNA, 14 nt, Pseudomonas aeruginosa PA01
guggcgggccagca

SEQ ID NO: 1515040 - RNA, 15 nt, Pseudomonas aeruginosa PA01
guggcgggccagcag

SEQ ID NO: 1515041 - RNA, 18 nt, Pseudomonas aeruginosa PA01
guggcgggccagcaggcg

SEQ ID NO: 1515042 - RNA, 13 nt, Pseudomonas aeruginosa PA01
guggcggcugaag

SEQ ID NO: 1515043 - RNA, 17 nt, Pseudomonas aeruginosa PA01
guggcccugggcggcga

SEQ ID NO: 1515044 - RNA, 20 nt, Pseudomonas aeruginosa PA01
guggccgaaggcgcuccccu

SEQ ID NO: 1515045 - RNA, 15 nt, Pseudomonas aeruginosa PA01
guggccggaaaaagc

SEQ ID NO: 1515046 - RNA, 19 nt, Pseudomonas aeruginosa PA01
guggccgcugagcagcagg

SEQ ID NO: 1515047 - RNA, 14 nt, Pseudomonas aeruginosa PA01
guggccgccagggu

SEQ ID NO: 1515048 - RNA, 15 nt, Pseudomonas aeruginosa PA01
guaauuggccaggcu

SEQ ID NO: 1515049 - RNA, 23 nt, Pseudomonas aeruginosa PA01
guaauccacgcugugcggcagca

SEQ ID NO: 1515050 - RNA, 14 nt, Pseudomonas aeruginosa PA01
guaaucaccuuccu

SEQ ID NO: 1515051 - RNA, 16 nt, Pseudomonas aeruginosa PA01
guacagcucggcgccc

SEQ ID NO: 1515052 - RNA, 22 nt, Pseudomonas aeruginosa PA01
guacagcucggcgcccuggccg

SEQ ID NO: 1515053 - RNA, 14 nt, Pseudomonas aeruginosa PA01
guacagcgaggccc

SEQ ID NO: 1515054 - RNA, 20 nt, Pseudomonas aeruginosa PA01
guacagcgccacggccagca

SEQ ID NO: 1515055 - RNA, 22 nt, Pseudomonas aeruginosa PA01
guacagcgccacggccagcagg

SEQ ID NO: 1515056 - RNA, 21 nt, Pseudomonas aeruginosa PA01
guacagcccccgccggccggg

SEQ ID NO: 1515057 - RNA, 22 nt, Pseudomonas aeruginosa PA01
guacagcccccgccggccggga

SEQ ID NO: 1515058 - RNA, 16 nt, Pseudomonas aeruginosa PA01
guacaguucaggcugg

SEQ ID NO: 1515059 - RNA, 20 nt, Pseudomonas aeruginosa PA01
guacaggaaucauuuggugu

SEQ ID NO: 1515060 - RNA, 14 nt, Pseudomonas aeruginosa PA01
guacagcaggagcg

SEQ ID NO: 1515061 - RNA, 17 nt, Pseudomonas aeruginosa PA01
guacagcaggcaggcau

SEQ ID NO: 1515062 - RNA, 18 nt, Pseudomonas aeruginosa PA01
guacagaaacaaagagcc

SEQ ID NO: 1515063 - RNA, 15 nt, Pseudomonas aeruginosa PA01
guacaccgcgcggca

SEQ ID NO: 1515064 - RNA, 16 nt, Pseudomonas aeruginosa PA01
guacuccuggcauggc

SEQ ID NO: 1515065 - RNA, 20 nt, Pseudomonas aeruginosa PA01
guacucggcccgggccuggu

SEQ ID NO: 1515066 - RNA, 14 nt, Pseudomonas aeruginosa PA01
guacgcccgcagcc

SEQ ID NO: 1515067 - RNA, 15 nt, Pseudomonas aeruginosa PA01
guacucguccuccca

SEQ ID NO: 1515068 - RNA, 15 nt, Pseudomonas aeruginosa PA01
guacuuggcccggcg

SEQ ID NO: 1515069 - RNA, 23 nt, Pseudomonas aeruginosa PA01
guacgaaaucuccuuggccaugu

SEQ ID NO: 1515070 - RNA, 23 nt, Pseudomonas aeruginosa PA01
guaccuuucuccccucaggcgcc

SEQ ID NO: 1515071 - RNA, 14 nt, Pseudomonas aeruginosa PA01
guaccuuccauuuc

SEQ ID NO: 1515072 - RNA, 17 nt, Pseudomonas aeruginosa PA01
guaccuucgagcaggag

SEQ ID NO: 1515073 - RNA, 17 nt, Pseudomonas aeruginosa PA01
guaccagcaaugcccag

SEQ ID NO: 1515074 - RNA, 21 nt, Pseudomonas aeruginosa PA01
guaccagcaaugcccagcgca

SEQ ID NO: 1515075 - RNA, 12 nt, Pseudomonas aeruginosa PA01
guaccaggggau

SEQ ID NO: 1515076 - RNA, 22 nt, Pseudomonas aeruginosa PA01
guaccaggguguugucgcggcu

SEQ ID NO: 1515077 - RNA, 13 nt, Pseudomonas aeruginosa PA01
guaccaguagcga

SEQ ID NO: 1515078 - RNA, 17 nt, Pseudomonas aeruginosa PA01
guaccagcgcgcagcgg

SEQ ID NO: 1515079 - RNA, 20 nt, Pseudomonas aeruginosa PA01
guagaaggugcccagcggcg

SEQ ID NO: 1515080 - RNA, 16 nt, Pseudomonas aeruginosa PA01
guagauuuacaagccc

SEQ ID NO: 1515081 - RNA, 17 nt, Pseudomonas aeruginosa PA01
guagaccaccagcagca

SEQ ID NO: 1515082 - RNA, 17 nt, Pseudomonas aeruginosa PA01
guagaccaccagcagga

SEQ ID NO: 1515083 - RNA, 19 nt, Pseudomonas aeruginosa PA01
guagauggucagcaacugc

SEQ ID NO: 1515084 - RNA, 14 nt, Pseudomonas aeruginosa PA01
guagauguccagug

SEQ ID NO: 1515085 - RNA, 23 nt, Pseudomonas aeruginosa PA01
guagcacauggucuucccagacc

SEQ ID NO: 1515086 - RNA, 15 nt, Pseudomonas aeruginosa PA01
guagccaugcacacg

SEQ ID NO: 1515087 - RNA, 20 nt, Pseudomonas aeruginosa PA01
guagccaugcacacgcuccc

SEQ ID NO: 1515088 - RNA, 16 nt, Pseudomonas aeruginosa PA01
guagccaggggucagg

SEQ ID NO: 1515089 - RNA, 19 nt, Pseudomonas aeruginosa PA01
guagccaggggucaggccg

SEQ ID NO: 1515090 - RNA, 17 nt, Pseudomonas aeruginosa PA01
guagccacggcgagagc

SEQ ID NO: 1515091 - RNA, 14 nt, Pseudomonas aeruginosa PA01
guagcccaccucgg

SEQ ID NO: 1515092 - RNA, 18 nt, Pseudomonas aeruginosa PA01
guagccggccaaccaccg

SEQ ID NO: 1515093 - RNA, 17 nt, Pseudomonas aeruginosa PA01
guagccgcgcgccagca

SEQ ID NO: 1515094 - RNA, 16 nt, Pseudomonas aeruginosa PA01
guagccgccgggaccc

SEQ ID NO: 1515095 - RNA, 15 nt, Pseudomonas aeruginosa PA01
guagccggcgcggcg

SEQ ID NO: 1515096 - RNA, 20 nt, Pseudomonas aeruginosa PA01
guagccggcgaugugcggcg

SEQ ID NO: 1515097 - RNA, 13 nt, Pseudomonas aeruginosa PA01
guagcgcugggcu

SEQ ID NO: 1515098 - RNA, 20 nt, Pseudomonas aeruginosa PA01
guagccguagauggucagca

SEQ ID NO: 1515099 - RNA, 17 nt, Pseudomonas aeruginosa PA01
guagcggaagcacggcu

SEQ ID NO: 1515100 - RNA, 19 nt, Pseudomonas aeruginosa PA01
guagcggaagccgucggcg

SEQ ID NO: 1515101 - RNA, 13 nt, Pseudomonas aeruginosa PA01
guagcggaucagg

SEQ ID NO: 1515102 - RNA, 14 nt, Pseudomonas aeruginosa PA01
guagcgggccagca

SEQ ID NO: 1515103 - RNA, 16 nt, Pseudomonas aeruginosa PA01
guagcgggccagcagc

SEQ ID NO: 1515104 - RNA, 17 nt, Pseudomonas aeruginosa PA01
guagcgggccagcagcu

SEQ ID NO: 1515105 - RNA, 21 nt, Pseudomonas aeruginosa PA01
guagcgcuucccgcggcucca

SEQ ID NO: 1515106 - RNA, 15 nt, Pseudomonas aeruginosa PA01
guagcggcaggagca

SEQ ID NO: 1515107 - RNA, 16 nt, Pseudomonas aeruginosa PA01
guagcggcaggagcau

SEQ ID NO: 1515108 - RNA, 18 nt, Pseudomonas aeruginosa PA01
guauaggcgcuggugcug

SEQ ID NO: 1515109 - RNA, 17 nt, Pseudomonas aeruginosa PA01
guaggacagggccaggc

SEQ ID NO: 1515110 - RNA, 16 nt, Pseudomonas aeruginosa PA01
guagcugcugccggcu

SEQ ID NO: 1515111 - RNA, 17 nt, Pseudomonas aeruginosa PA01
guagcugcugccggcuu

SEQ ID NO: 1515112 - RNA, 20 nt, Pseudomonas aeruginosa PA01
guauccaccggacccggcug

SEQ ID NO: 1515113 - RNA, 22 nt, Pseudomonas aeruginosa PA01
guauccucggccauaccuccag

SEQ ID NO: 1515114 - RNA, 22 nt, Pseudomonas aeruginosa PA01
guauccguacuggcgccaggcc

SEQ ID NO: 1515115 - RNA, 11 nt, Pseudomonas aeruginosa PA01
guauccauguc

SEQ ID NO: 1515116 - RNA, 19 nt, Pseudomonas aeruginosa PA01
guauccaugucagcgguga

SEQ ID NO: 1515117 - RNA, 13 nt, Pseudomonas aeruginosa PA01
guaucccagcgcg

SEQ ID NO: 1515118 - RNA, 22 nt, Pseudomonas aeruginosa PA01
guaucccggcugagcgccaggc

SEQ ID NO: 1515119 - RNA, 19 nt, Pseudomonas aeruginosa PA01
guauggcggucggccaggc

SEQ ID NO: 1515120 - RNA, 17 nt, Pseudomonas aeruginosa PA01
guaugcgcggucaccag

SEQ ID NO: 1515121 - RNA, 15 nt, Pseudomonas aeruginosa PA01
guaucgccguccugg

SEQ ID NO: 1515122 - RNA, 9 nt, Pseudomonas aeruginosa PA01
guaucggcg

SEQ ID NO: 1515123 - RNA, 14 nt, Pseudomonas aeruginosa PA01
guaucgcgcuugga

SEQ ID NO: 1515124 - RNA, 13 nt, Pseudomonas aeruginosa PA01
gucaccaggguca

SEQ ID NO: 1515125 - RNA, 20 nt, Pseudomonas aeruginosa PA01
gucaccguggucauggcgca

SEQ ID NO: 1515126 - RNA, 16 nt, Pseudomonas aeruginosa PA01
gucaccuugaccuugu

SEQ ID NO: 1515127 - RNA, 24 nt, Pseudomonas aeruginosa PA01
guauucgccgaagauccgcuccag

SEQ ID NO: 1515128 - RNA, 18 nt, Pseudomonas aeruginosa PA01
guauugcgcccagaguuc

SEQ ID NO: 1515129 - RNA, 17 nt, Pseudomonas aeruginosa PA01
gucaucgcugaccugga

SEQ ID NO: 1515130 - RNA, 22 nt, Pseudomonas aeruginosa PA01
gucaugccgaacuucuccgcca

SEQ ID NO: 1515131 - RNA, 12 nt, Pseudomonas aeruginosa PA01
gucauggccagc

SEQ ID NO: 1515132 - RNA, 21 nt, Pseudomonas aeruginosa PA01
gucauggccagcucgaccuug

SEQ ID NO: 1515133 - RNA, 19 nt, Pseudomonas aeruginosa PA01
gucauggcgcacgccgcgg

SEQ ID NO: 1515134 - RNA, 16 nt, Pseudomonas aeruginosa PA01
gucauggugccgagca

SEQ ID NO: 1515135 - RNA, 19 nt, Pseudomonas aeruginosa PA01
gucauggugccgagcagga

SEQ ID NO: 1515136 - RNA, 14 nt, Pseudomonas aeruginosa PA01
gucauguccggggc

SEQ ID NO: 1515137 - RNA, 14 nt, Pseudomonas aeruginosa PA01
guccaccaccagca

SEQ ID NO: 1515138 - RNA, 15 nt, Pseudomonas aeruginosa PA01
guccaccaccagcag

SEQ ID NO: 1515139 - RNA, 16 nt, Pseudomonas aeruginosa PA01
guccaccaccagcagg

SEQ ID NO: 1515140 - RNA, 22 nt, Pseudomonas aeruginosa PA01
guccaccaccgacgggucgcca

SEQ ID NO: 1515141 - RNA, 22 nt, Pseudomonas aeruginosa PA01
gucaucaccuucgccagcaggc

SEQ ID NO: 1515142 - RNA, 16 nt, Pseudomonas aeruginosa PA01
guccaccgcggccucg

SEQ ID NO: 1515143 - RNA, 21 nt, Pseudomonas aeruginosa PA01
guccaccgcggccucgcuggc

SEQ ID NO: 1515144 - RNA, 21 nt, Pseudomonas aeruginosa PA01
guccaccuggcggcugagcug

SEQ ID NO: 1515145 - RNA, 23 nt, Pseudomonas aeruginosa PA01
guccaccgaguggcgcagcgccc

SEQ ID NO: 1515146 - RNA, 19 nt, Pseudomonas aeruginosa PA01
guccaccgccgccagcaac

SEQ ID NO: 1515147 - RNA, 20 nt, Pseudomonas aeruginosa PA01
guccaccagccaguagucuu

SEQ ID NO: 1515148 - RNA, 13 nt, Pseudomonas aeruginosa PA01
guccaccagcccg

SEQ ID NO: 1515149 - RNA, 20 nt, Pseudomonas aeruginosa PA01
guccaccagcgcccguagca

SEQ ID NO: 1515150 - RNA, 17 nt, Pseudomonas aeruginosa PA01
guccaccaggcgccggg

SEQ ID NO: 1515151 - RNA, 22 nt, Pseudomonas aeruginosa PA01
guccacuccggcagcacccgca

SEQ ID NO: 1515152 - RNA, 18 nt, Pseudomonas aeruginosa PA01
guccagcacgcuggcgag

SEQ ID NO: 1515153 - RNA, 14 nt, Pseudomonas aeruginosa PA01
guccagccagccgc

SEQ ID NO: 1515154 - RNA, 15 nt, Pseudomonas aeruginosa PA01
guccagccagugcau

SEQ ID NO: 1515155 - RNA, 16 nt, Pseudomonas aeruginosa PA01
guccagccaguggcug

SEQ ID NO: 1515156 - RNA, 18 nt, Pseudomonas aeruginosa PA01
guccagccaguggcuggc

SEQ ID NO: 1515157 - RNA, 17 nt, Pseudomonas aeruginosa PA01
guccagcaaggugcggg

SEQ ID NO: 1515158 - RNA, 17 nt, Pseudomonas aeruginosa PA01
guccacugucucgccga

SEQ ID NO: 1515159 - RNA, 21 nt, Pseudomonas aeruginosa PA01
guccagaugaaacugcccggc

SEQ ID NO: 1515160 - RNA, 22 nt, Pseudomonas aeruginosa PA01
guccagaugaaacugcccggcu

SEQ ID NO: 1515161 - RNA, 16 nt, Pseudomonas aeruginosa PA01
guccaggcgccagagc

SEQ ID NO: 1515162 - RNA, 13 nt, Pseudomonas aeruginosa PA01
guccaggcugccg

SEQ ID NO: 1515163 - RNA, 17 nt, Pseudomonas aeruginosa PA01
guccaggcgucggcgcc

SEQ ID NO: 1515164 - RNA, 20 nt, Pseudomonas aeruginosa PA01
guccaggguuggaagaaaga

SEQ ID NO: 1515165 - RNA, 22 nt, Pseudomonas aeruginosa PA01
guccaggguuuccugguacucg

SEQ ID NO: 1515166 - RNA, 23 nt, Pseudomonas aeruginosa PA01
guccagggccggaucggccuugg

SEQ ID NO: 1515167 - RNA, 22 nt, Pseudomonas aeruginosa PA01
guccagggcgaaccacucggcg

SEQ ID NO: 1515168 - RNA, 19 nt, Pseudomonas aeruginosa PA01
guccagggucuucagugca

SEQ ID NO: 1515169 - RNA, 22 nt, Pseudomonas aeruginosa PA01
guccagggucuucagugcacgu

SEQ ID NO: 1515170 - RNA, 19 nt, Pseudomonas aeruginosa PA01
guccaggcuguggcgcggc

SEQ ID NO: 1515171 - RNA, 21 nt, Pseudomonas aeruginosa PA01
guccaggcuguggcgcggcug

SEQ ID NO: 1515172 - RNA, 14 nt, Pseudomonas aeruginosa PA01
guccaugcucgcca

SEQ ID NO: 1515173 - RNA, 23 nt, Pseudomonas aeruginosa PA01
guccaguucagggcgagcagggc

SEQ ID NO: 1515174 - RNA, 14 nt, Pseudomonas aeruginosa PA01
guccagcggcucgc

SEQ ID NO: 1515175 - RNA, 18 nt, Pseudomonas aeruginosa PA01
guccagcuccaccaggcc

SEQ ID NO: 1515176 - RNA, 13 nt, Pseudomonas aeruginosa PA01
guccagcuccucg

SEQ ID NO: 1515177 - RNA, 17 nt, Pseudomonas aeruginosa PA01
guccagcucggucagcg

SEQ ID NO: 1515178 - RNA, 11 nt, Pseudomonas aeruginosa PA01
guccagcggcc

SEQ ID NO: 1515179 - RNA, 12 nt, Pseudomonas aeruginosa PA01
guccagccgccg

SEQ ID NO: 1515180 - RNA, 19 nt, Pseudomonas aeruginosa PA01
guccagccgguaggggccg

SEQ ID NO: 1515181 - RNA, 17 nt, Pseudomonas aeruginosa PA01
gucgaauuggacagcag

SEQ ID NO: 1515182 - RNA, 15 nt, Pseudomonas aeruginosa PA01
gucgacaccuggcaa

SEQ ID NO: 1515183 - RNA, 12 nt, Pseudomonas aeruginosa PA01
gucgacaugcag

SEQ ID NO: 1515184 - RNA, 16 nt, Pseudomonas aeruginosa PA01
gucgacaugcaggccg

SEQ ID NO: 1515185 - RNA, 15 nt, Pseudomonas aeruginosa PA01
gucgaccaucaccag

SEQ ID NO: 1515186 - RNA, 17 nt, Pseudomonas aeruginosa PA01
gucgaccaucaccagcg

SEQ ID NO: 1515187 - RNA, 23 nt, Pseudomonas aeruginosa PA01
gucgaccacggccuucggcagga

SEQ ID NO: 1515188 - RNA, 14 nt, Pseudomonas aeruginosa PA01
gucgacgccgagcu

SEQ ID NO: 1515189 - RNA, 14 nt, Pseudomonas aeruginosa PA01
gucgacgccgccga

SEQ ID NO: 1515190 - RNA, 20 nt, Pseudomonas aeruginosa PA01
gucgacgcucagcacccugg

SEQ ID NO: 1515191 - RNA, 16 nt, Pseudomonas aeruginosa PA01
gucgagaaggcugccg

SEQ ID NO: 1515192 - RNA, 23 nt, Pseudomonas aeruginosa PA01
gucgacuucgucgaagaccaggg

SEQ ID NO: 1515193 - RNA, 21 nt, Pseudomonas aeruginosa PA01
gucgagcacggcgcuggucuc

SEQ ID NO: 1515194 - RNA, 17 nt, Pseudomonas aeruginosa PA01
gucgaagggccauuguu

SEQ ID NO: 1515195 - RNA, 19 nt, Pseudomonas aeruginosa PA01
gucgaaggugaagcugccg

SEQ ID NO: 1515196 - RNA, 18 nt, Pseudomonas aeruginosa PA01
gucgaagucgaagcagcc

SEQ ID NO: 1515197 - RNA, 21 nt, Pseudomonas aeruginosa PA01
gucgaagucgaagcagcccag

SEQ ID NO: 1515198 - RNA, 16 nt, Pseudomonas aeruginosa PA01
gucgaagcagcccagc

SEQ ID NO: 1515199 - RNA, 14 nt, Pseudomonas aeruginosa PA01
gucgaagccaggca

SEQ ID NO: 1515200 - RNA, 18 nt, Pseudomonas aeruginosa PA01
gucgaagcgcagcagguc

SEQ ID NO: 1515201 - RNA, 16 nt, Pseudomonas aeruginosa PA01
gucgaagcgcaggugc

SEQ ID NO: 1515202 - RNA, 21 nt, Pseudomonas aeruginosa PA01
gucgaaacggaacaggaaacu

SEQ ID NO: 1515203 - RNA, 16 nt, Pseudomonas aeruginosa PA01
guccuccgcgcccagg

SEQ ID NO: 1515204 - RNA, 20 nt, Pseudomonas aeruginosa PA01
guccucgcccgucacuucac

SEQ ID NO: 1515205 - RNA, 14 nt, Pseudomonas aeruginosa PA01
guccucggcggcuc

SEQ ID NO: 1515206 - RNA, 21 nt, Pseudomonas aeruginosa PA01
guccucggggaagcgcggcuc

SEQ ID NO: 1515207 - RNA, 16 nt, Pseudomonas aeruginosa PA01
guccuugggccaggca

SEQ ID NO: 1515208 - RNA, 22 nt, Pseudomonas aeruginosa PA01
gucccggacgacgaaagaagcc

SEQ ID NO: 1515209 - RNA, 19 nt, Pseudomonas aeruginosa PA01
gucccggccauuccuucca

SEQ ID NO: 1515210 - RNA, 15 nt, Pseudomonas aeruginosa PA01
gucccggcgccgccc

SEQ ID NO: 1515211 - RNA, 21 nt, Pseudomonas aeruginosa PA01
guccgaacagggcgaaggcca

SEQ ID NO: 1515212 - RNA, 17 nt, Pseudomonas aeruginosa PA01
gucccuucgugggccug

SEQ ID NO: 1515213 - RNA, 22 nt, Pseudomonas aeruginosa PA01
gucccguuccgcucaccaggcc

SEQ ID NO: 1515214 - RNA, 20 nt, Pseudomonas aeruginosa PA01
guccgagaccggcagccggg

SEQ ID NO: 1515215 - RNA, 15 nt, Pseudomonas aeruginosa PA01
guccgagagcagggc

SEQ ID NO: 1515216 - RNA, 20 nt, Pseudomonas aeruginosa PA01
guccgcgccacggaugcagu

SEQ ID NO: 1515217 - RNA, 17 nt, Pseudomonas aeruginosa PA01
guccgggucggucacga

SEQ ID NO: 1515218 - RNA, 17 nt, Pseudomonas aeruginosa PA01
guccggguuggcgcagg

SEQ ID NO: 1515219 - RNA, 19 nt, Pseudomonas aeruginosa PA01
guccgguacugcugggccu

SEQ ID NO: 1515220 - RNA, 20 nt, Pseudomonas aeruginosa PA01
guccggucgcaccgccagca

SEQ ID NO: 1515221 - RNA, 21 nt, Pseudomonas aeruginosa PA01
guccgggcgguacaggcgcac

SEQ ID NO: 1515222 - RNA, 18 nt, Pseudomonas aeruginosa PA01
guccgcugcgagcagguc

SEQ ID NO: 1515223 - RNA, 22 nt, Pseudomonas aeruginosa PA01
guccgcuggccugcagcagguc

SEQ ID NO: 1515224 - RNA, 16 nt, Pseudomonas aeruginosa PA01
guccguaaugcaaccc

SEQ ID NO: 1515225 - RNA, 11 nt, Pseudomonas aeruginosa PA01
guccuccagca

SEQ ID NO: 1515226 - RNA, 16 nt, Pseudomonas aeruginosa PA01
guccucccagugcgag

SEQ ID NO: 1515227 - RNA, 14 nt, Pseudomonas aeruginosa PA01
gucgauguccuggg

SEQ ID NO: 1515228 - RNA, 14 nt, Pseudomonas aeruginosa PA01
gucgaugcgcccgc

SEQ ID NO: 1515229 - RNA, 14 nt, Pseudomonas aeruginosa PA01
gucgaugggcagga

SEQ ID NO: 1515230 - RNA, 16 nt, Pseudomonas aeruginosa PA01
gucgagcaugccgagg

SEQ ID NO: 1515231 - RNA, 12 nt, Pseudomonas aeruginosa PA01
gucgagccagcc

SEQ ID NO: 1515232 - RNA, 24 nt, Pseudomonas aeruginosa PA01
gucgagcagaguuuagccgccagu

SEQ ID NO: 1515233 - RNA, 12 nt, Pseudomonas aeruginosa PA01
gucgaucugcuc

SEQ ID NO: 1515234 - RNA, 23 nt, Pseudomonas aeruginosa PA01
gucgaucugcucguccaggccgc

SEQ ID NO: 1515235 - RNA, 17 nt, Pseudomonas aeruginosa PA01
gucgaugaacagcgacu

SEQ ID NO: 1515236 - RNA, 13 nt, Pseudomonas aeruginosa PA01
gucgaugaagaag

SEQ ID NO: 1515237 - RNA, 19 nt, Pseudomonas aeruginosa PA01
gucgcgggucugcgaguug

SEQ ID NO: 1515238 - RNA, 19 nt, Pseudomonas aeruginosa PA01
gucgcgcccgcugugcggg

SEQ ID NO: 1515239 - RNA, 13 nt, Pseudomonas aeruginosa PA01
gucgcgccaggcg

SEQ ID NO: 1515240 - RNA, 15 nt, Pseudomonas aeruginosa PA01
gucgcgcagcgccuc

SEQ ID NO: 1515241 - RNA, 17 nt, Pseudomonas aeruginosa PA01
gucgcgcagcuccucgg

SEQ ID NO: 1515242 - RNA, 19 nt, Pseudomonas aeruginosa PA01
gucgcgcaggcgggcggcg

SEQ ID NO: 1515243 - RNA, 19 nt, Pseudomonas aeruginosa PA01
gucgcgcaggcgguggagc

SEQ ID NO: 1515244 - RNA, 14 nt, Pseudomonas aeruginosa PA01
gucgcgaucugcug

SEQ ID NO: 1515245 - RNA, 18 nt, Pseudomonas aeruginosa PA01
gucgcgaucugcugguug

SEQ ID NO: 1515246 - RNA, 19 nt, Pseudomonas aeruginosa PA01
gucgcgauagacgccggcg

SEQ ID NO: 1515247 - RNA, 16 nt, Pseudomonas aeruginosa PA01
gucgaugcguccgcgc

SEQ ID NO: 1515248 - RNA, 22 nt, Pseudomonas aeruginosa PA01
gucggcagguggguaccgaacu

SEQ ID NO: 1515249 - RNA, 21 nt, Pseudomonas aeruginosa PA01
gucggcaucgaacucacagau

SEQ ID NO: 1515250 - RNA, 15 nt, Pseudomonas aeruginosa PA01
gucggcaucgcguag

SEQ ID NO: 1515251 - RNA, 14 nt, Pseudomonas aeruginosa PA01
gucggcauggcugu

SEQ ID NO: 1515252 - RNA, 14 nt, Pseudomonas aeruginosa PA01
gucggaggcgagga

SEQ ID NO: 1515253 - RNA, 15 nt, Pseudomonas aeruginosa PA01
gucggcaccugcaga

SEQ ID NO: 1515254 - RNA, 21 nt, Pseudomonas aeruginosa PA01
gucggcaacgauaccgccgcc

SEQ ID NO: 1515255 - RNA, 15 nt, Pseudomonas aeruginosa PA01
gucgcuccagcccca

SEQ ID NO: 1515256 - RNA, 14 nt, Pseudomonas aeruginosa PA01
gucgcucgcgcagg

SEQ ID NO: 1515257 - RNA, 22 nt, Pseudomonas aeruginosa PA01
gucgcugaccagcccggcggcg

SEQ ID NO: 1515258 - RNA, 20 nt, Pseudomonas aeruginosa PA01
gucgcggugcaguucgccgu

SEQ ID NO: 1515259 - RNA, 18 nt, Pseudomonas aeruginosa PA01
gucgcggucaucgccggc

SEQ ID NO: 1515260 - RNA, 16 nt, Pseudomonas aeruginosa PA01
gucgcguuccagcucc

SEQ ID NO: 1515261 - RNA, 19 nt, Pseudomonas aeruginosa PA01
gucggcgaugcgcuggaag

SEQ ID NO: 1515262 - RNA, 13 nt, Pseudomonas aeruginosa PA01
gucggcgagggca

SEQ ID NO: 1515263 - RNA, 19 nt, Pseudomonas aeruginosa PA01
gucggcgcgcaucuggugc

SEQ ID NO: 1515264 - RNA, 14 nt, Pseudomonas aeruginosa PA01
gucggcggggcgca

SEQ ID NO: 1515265 - RNA, 15 nt, Pseudomonas aeruginosa PA01
gucggccugcagccu

SEQ ID NO: 1515266 - RNA, 21 nt, Pseudomonas aeruginosa PA01
gucggccuggcgguugaugcc

SEQ ID NO: 1515267 - RNA, 13 nt, Pseudomonas aeruginosa PA01
gucggcgaccuug

SEQ ID NO: 1515268 - RNA, 22 nt, Pseudomonas aeruginosa PA01
gucggccuugaggcgggccagc

SEQ ID NO: 1515269 - RNA, 23 nt, Pseudomonas aeruginosa PA01
gucggcgaacccggcgcggcgca

SEQ ID NO: 1515270 - RNA, 15 nt, Pseudomonas aeruginosa PA01
gucggccaguuccuu

SEQ ID NO: 1515271 - RNA, 23 nt, Pseudomonas aeruginosa PA01
gucggccaguuccuucacggcau

SEQ ID NO: 1515272 - RNA, 19 nt, Pseudomonas aeruginosa PA01
gucggccaucgccgucucg

SEQ ID NO: 1515273 - RNA, 17 nt, Pseudomonas aeruginosa PA01
gucggccaucuggcugc

SEQ ID NO: 1515274 - RNA, 16 nt, Pseudomonas aeruginosa PA01
gucggccgacggguuc

SEQ ID NO: 1515275 - RNA, 14 nt, Pseudomonas aeruginosa PA01
gucggccggcagcu

SEQ ID NO: 1515276 - RNA, 17 nt, Pseudomonas aeruginosa PA01
gucggccggcagcuccg

SEQ ID NO: 1515277 - RNA, 16 nt, Pseudomonas aeruginosa PA01
gucggccagccccugc

SEQ ID NO: 1515278 - RNA, 13 nt, Pseudomonas aeruginosa PA01
gucggggccggcg

SEQ ID NO: 1515279 - RNA, 23 nt, Pseudomonas aeruginosa PA01
gucgggcgaaacggcaggccagc

SEQ ID NO: 1515280 - RNA, 13 nt, Pseudomonas aeruginosa PA01
gucgggcgccgcg

SEQ ID NO: 1515281 - RNA, 14 nt, Pseudomonas aeruginosa PA01
gucgggcgccgcgc

SEQ ID NO: 1515282 - RNA, 13 nt, Pseudomonas aeruginosa PA01
gucggggcaggcg

SEQ ID NO: 1515283 - RNA, 20 nt, Pseudomonas aeruginosa PA01
gucggcgugguugccugcug

SEQ ID NO: 1515284 - RNA, 15 nt, Pseudomonas aeruginosa PA01
gucggcuccgcucaa

SEQ ID NO: 1515285 - RNA, 14 nt, Pseudomonas aeruginosa PA01
gucggcucgcgccg

SEQ ID NO: 1515286 - RNA, 23 nt, Pseudomonas aeruginosa PA01
gucggcuuccgccgccagguccg

SEQ ID NO: 1515287 - RNA, 20 nt, Pseudomonas aeruginosa PA01
gucgggacgcaugcgcggcg

SEQ ID NO: 1515288 - RNA, 13 nt, Pseudomonas aeruginosa PA01
gucgggcaggugg

SEQ ID NO: 1515289 - RNA, 22 nt, Pseudomonas aeruginosa PA01
gucgggcagauguccaggcagg

SEQ ID NO: 1515290 - RNA, 23 nt, Pseudomonas aeruginosa PA01
gucgugaucuucgagugcuucug

SEQ ID NO: 1515291 - RNA, 16 nt, Pseudomonas aeruginosa PA01
gucgucuucggccagu

SEQ ID NO: 1515292 - RNA, 22 nt, Pseudomonas aeruginosa PA01
gucgugccuccagccucagcca

SEQ ID NO: 1515293 - RNA, 17 nt, Pseudomonas aeruginosa PA01
gucguggauaggcggcg

SEQ ID NO: 1515294 - RNA, 16 nt, Pseudomonas aeruginosa PA01
gucguccaggcugagu

SEQ ID NO: 1515295 - RNA, 23 nt, Pseudomonas aeruginosa PA01
gucgucccacuuguccagagacu

SEQ ID NO: 1515296 - RNA, 14 nt, Pseudomonas aeruginosa PA01
gucgucgggcagag

SEQ ID NO: 1515297 - RNA, 14 nt, Pseudomonas aeruginosa PA01
gucgucgcugagca

SEQ ID NO: 1515298 - RNA, 14 nt, Pseudomonas aeruginosa PA01
gucgucgaucggau

SEQ ID NO: 1515299 - RNA, 16 nt, Pseudomonas aeruginosa PA01
gucguccugcgcggcg

SEQ ID NO: 1515300 - RNA, 21 nt, Pseudomonas aeruginosa PA01
gucgucgcgcagcuccucggc

SEQ ID NO: 1515301 - RNA, 24 nt, Pseudomonas aeruginosa PA01
gucggugaucgagacgccguagcg

SEQ ID NO: 1515302 - RNA, 20 nt, Pseudomonas aeruginosa PA01
gucggugaagcgcggcggcg

SEQ ID NO: 1515303 - RNA, 15 nt, Pseudomonas aeruginosa PA01
gucggugugaccuuc

SEQ ID NO: 1515304 - RNA, 17 nt, Pseudomonas aeruginosa PA01
gucggucacgaaggcga

SEQ ID NO: 1515305 - RNA, 19 nt, Pseudomonas aeruginosa PA01
gucggucauguccggggcg

SEQ ID NO: 1515306 - RNA, 20 nt, Pseudomonas aeruginosa PA01
gucggucauguccggggcga

SEQ ID NO: 1515307 - RNA, 16 nt, Pseudomonas aeruginosa PA01
gucgguccgccgaugc

SEQ ID NO: 1515308 - RNA, 14 nt, Pseudomonas aeruginosa PA01
gucgguagagcagu

SEQ ID NO: 1515309 - RNA, 18 nt, Pseudomonas aeruginosa PA01
gucgguucgcggcgcagc

SEQ ID NO: 1515310 - RNA, 20 nt, Pseudomonas aeruginosa PA01
gucguagcccuucuccgcca

SEQ ID NO: 1515311 - RNA, 24 nt, Pseudomonas aeruginosa PA01
gucguaguccugggccgguugcgg

SEQ ID NO: 1515312 - RNA, 21 nt, Pseudomonas aeruginosa PA01
gucguaggaacgugcggccug

SEQ ID NO: 1515313 - RNA, 16 nt, Pseudomonas aeruginosa PA01
gucguaggcgcgggcg

SEQ ID NO: 1515314 - RNA, 20 nt, Pseudomonas aeruginosa PA01
gucguagggcgucaguucca

SEQ ID NO: 1515315 - RNA, 20 nt, Pseudomonas aeruginosa PA01
gucucagcgguagaacaggc

SEQ ID NO: 1515316 - RNA, 12 nt, Pseudomonas aeruginosa PA01
gucuccaugcgg

SEQ ID NO: 1515317 - RNA, 15 nt, Pseudomonas aeruginosa PA01
gucuccgugcuggcc

SEQ ID NO: 1515318 - RNA, 18 nt, Pseudomonas aeruginosa PA01
gucuccgugcuggccggc

SEQ ID NO: 1515319 - RNA, 22 nt, Pseudomonas aeruginosa PA01
gucuaauggcaccuggauauca

SEQ ID NO: 1515320 - RNA, 17 nt, Pseudomonas aeruginosa PA01
gucuaucccgugccggg

SEQ ID NO: 1515321 - RNA, 18 nt, Pseudomonas aeruginosa PA01
gucguuggccggcugcuc

SEQ ID NO: 1515322 - RNA, 16 nt, Pseudomonas aeruginosa PA01
gucguugacggugcug

SEQ ID NO: 1515323 - RNA, 13 nt, Pseudomonas aeruginosa PA01
gucguucccggcc

SEQ ID NO: 1515324 - RNA, 16 nt, Pseudomonas aeruginosa PA01
gucguugaagacgcuc

SEQ ID NO: 1515325 - RNA, 16 nt, Pseudomonas aeruginosa PA01
gucguuccggcucagc

SEQ ID NO: 1515326 - RNA, 13 nt, Pseudomonas aeruginosa PA01
gucguucgcccuu

SEQ ID NO: 1515327 - RNA, 14 nt, Pseudomonas aeruginosa PA01
gggacagguugucg

SEQ ID NO: 1515328 - RNA, 16 nt, Pseudomonas aeruginosa PA01
gggacaugucgagggc

SEQ ID NO: 1515329 - RNA, 17 nt, Pseudomonas aeruginosa PA01
gggacagggcggcagcg

SEQ ID NO: 1515330 - RNA, 23 nt, Pseudomonas aeruginosa PA01
gggagaacuuuucccagcggcug

SEQ ID NO: 1515331 - RNA, 13 nt, Pseudomonas aeruginosa PA01
gggagaacagcag

SEQ ID NO: 1515332 - RNA, 15 nt, Pseudomonas aeruginosa PA01
gggacggcggcuggu

SEQ ID NO: 1515333 - RNA, 19 nt, Pseudomonas aeruginosa PA01
gggacggcugcccaacugg

SEQ ID NO: 1515334 - RNA, 23 nt, Pseudomonas aeruginosa PA01
gggacgaagccgauugccagagu

SEQ ID NO: 1515335 - RNA, 13 nt, Pseudomonas aeruginosa PA01
gggacgcgcagcg

SEQ ID NO: 1515336 - RNA, 14 nt, Pseudomonas aeruginosa PA01
gggacgcgcagcgg

SEQ ID NO: 1515337 - RNA, 20 nt, Pseudomonas aeruginosa PA01
gggacgcgcaugcagggcgu

SEQ ID NO: 1515338 - RNA, 13 nt, Pseudomonas aeruginosa PA01
gggacgccaggcg

SEQ ID NO: 1515339 - RNA, 17 nt, Pseudomonas aeruginosa PA01
ggcuuucuucgccuggc

SEQ ID NO: 1515340 - RNA, 16 nt, Pseudomonas aeruginosa PA01
gggaagacggccagga

SEQ ID NO: 1515341 - RNA, 16 nt, Pseudomonas aeruginosa PA01
gggaagccgcucggcg

SEQ ID NO: 1515342 - RNA, 17 nt, Pseudomonas aeruginosa PA01
gggaagcgaaccaggca

SEQ ID NO: 1515343 - RNA, 14 nt, Pseudomonas aeruginosa PA01
gggaaucgccagca

SEQ ID NO: 1515344 - RNA, 13 nt, Pseudomonas aeruginosa PA01
gggaagcgcaggc

SEQ ID NO: 1515345 - RNA, 22 nt, Pseudomonas aeruginosa PA01
gggaagcugccuuccagcaggu

SEQ ID NO: 1515346 - RNA, 12 nt, Pseudomonas aeruginosa PA01
gggaagggccgg

SEQ ID NO: 1515347 - RNA, 21 nt, Pseudomonas aeruginosa PA01
gggaagucguucccggccugg

SEQ ID NO: 1515348 - RNA, 22 nt, Pseudomonas aeruginosa PA01
ggcugucgcggacccgcgccgg

SEQ ID NO: 1515349 - RNA, 15 nt, Pseudomonas aeruginosa PA01
ggcugucggccagcc

SEQ ID NO: 1515350 - RNA, 12 nt, Pseudomonas aeruginosa PA01
ggcugugcagga

SEQ ID NO: 1515351 - RNA, 12 nt, Pseudomonas aeruginosa PA01
ggcugugcaggg

SEQ ID NO: 1515352 - RNA, 16 nt, Pseudomonas aeruginosa PA01
ggcugugcagggcagc

SEQ ID NO: 1515353 - RNA, 22 nt, Pseudomonas aeruginosa PA01
ggcugugccauuccugggcccc

SEQ ID NO: 1515354 - RNA, 18 nt, Pseudomonas aeruginosa PA01
ggcugugcgccaggccgg

SEQ ID NO: 1515355 - RNA, 14 nt, Pseudomonas aeruginosa PA01
ggcuguccagcagg

SEQ ID NO: 1515356 - RNA, 15 nt, Pseudomonas aeruginosa PA01
ggcuguccagcaggc

SEQ ID NO: 1515357 - RNA, 15 nt, Pseudomonas aeruginosa PA01
ggccgcccgagccgc

SEQ ID NO: 1515358 - RNA, 16 nt, Pseudomonas aeruginosa PA01
ggccgcccgagccgcu

SEQ ID NO: 1515359 - RNA, 17 nt, Pseudomonas aeruginosa PA01
ggccgcccgagccgcug

SEQ ID NO: 1515360 - RNA, 12 nt, Pseudomonas aeruginosa PA01
ggccgcccaggu

SEQ ID NO: 1515361 - RNA, 13 nt, Pseudomonas aeruginosa PA01
ggccgcccagcgc

SEQ ID NO: 1515362 - RNA, 18 nt, Pseudomonas aeruginosa PA01
ggccgcccagcgcagccu

SEQ ID NO: 1515363 - RNA, 15 nt, Pseudomonas aeruginosa PA01
ggccgccaggcuggg

SEQ ID NO: 1515364 - RNA, 12 nt, Pseudomonas aeruginosa PA01
ggccgccagggc

SEQ ID NO: 1515365 - RNA, 14 nt, Pseudomonas aeruginosa PA01
ggccgccagggcgu

SEQ ID NO: 1515366 - RNA, 13 nt, Pseudomonas aeruginosa PA01
ggccgccaggccu

SEQ ID NO: 1515367 - RNA, 20 nt, Pseudomonas aeruginosa PA01
ggccgccaggccucggcgcg

SEQ ID NO: 1515368 - RNA, 12 nt, Pseudomonas aeruginosa PA01
ggccgccaggcg

SEQ ID NO: 1515369 - RNA, 14 nt, Pseudomonas aeruginosa PA01
ggccgccaggcgcg

SEQ ID NO: 1515370 - RNA, 17 nt, Pseudomonas aeruginosa PA01
ggccgccagggucagcu

SEQ ID NO: 1515371 - RNA, 21 nt, Pseudomonas aeruginosa PA01
ggccgccaugcucggccagcu

SEQ ID NO: 1515372 - RNA, 13 nt, Pseudomonas aeruginosa PA01
ggccgcagcagcg

SEQ ID NO: 1515373 - RNA, 13 nt, Pseudomonas aeruginosa PA01
ggccgcagcaggu

SEQ ID NO: 1515374 - RNA, 14 nt, Pseudomonas aeruginosa PA01
ggcuucagagcugg

SEQ ID NO: 1515375 - RNA, 13 nt, Pseudomonas aeruginosa PA01
ggcuucagcuucu

SEQ ID NO: 1515376 - RNA, 22 nt, Pseudomonas aeruginosa PA01
ggcuuuccaccgccagcaccca

SEQ ID NO: 1515377 - RNA, 14 nt, Pseudomonas aeruginosa PA01
ggcuuuccagcauu

SEQ ID NO: 1515378 - RNA, 19 nt, Pseudomonas aeruginosa PA01
ggcuucuuccuggccggga

SEQ ID NO: 1515379 - RNA, 16 nt, Pseudomonas aeruginosa PA01
ggcuugcccugcucgu

SEQ ID NO: 1515380 - RNA, 23 nt, Pseudomonas aeruginosa PA01
ggcuugccggcgcgcgguuucuu

SEQ ID NO: 1515381 - RNA, 15 nt, Pseudomonas aeruginosa PA01
ggcuugccggcggcg

SEQ ID NO: 1515382 - RNA, 16 nt, Pseudomonas aeruginosa PA01
ggcuugccggcggcgc

SEQ ID NO: 1515383 - RNA, 17 nt, Pseudomonas aeruginosa PA01
ggcuugccgucgguguc

SEQ ID NO: 1515384 - RNA, 14 nt, Pseudomonas aeruginosa PA01
gggcagcgccgccg

SEQ ID NO: 1515385 - RNA, 22 nt, Pseudomonas aeruginosa PA01
gggccagcaggguggccagggu

SEQ ID NO: 1515386 - RNA, 13 nt, Pseudomonas aeruginosa PA01
gggccagcccaga

SEQ ID NO: 1515387 - RNA, 14 nt, Pseudomonas aeruginosa PA01
gggccagcccagaa

SEQ ID NO: 1515388 - RNA, 15 nt, Pseudomonas aeruginosa PA01
gggcagcggucgccg

SEQ ID NO: 1515389 - RNA, 14 nt, Pseudomonas aeruginosa PA01
gggcagcgucgccg

SEQ ID NO: 1515390 - RNA, 19 nt, Pseudomonas aeruginosa PA01
gggccagcuccagcaccgg

SEQ ID NO: 1515391 - RNA, 13 nt, Pseudomonas aeruginosa PA01
gggccagggaggc

SEQ ID NO: 1515392 - RNA, 20 nt, Pseudomonas aeruginosa PA01
gggccagggaggcgcuggcc

SEQ ID NO: 1515393 - RNA, 12 nt, Pseudomonas aeruginosa PA01
gggccagggccu

SEQ ID NO: 1515394 - RNA, 16 nt, Pseudomonas aeruginosa PA01
gggccagggcggcggc

SEQ ID NO: 1515395 - RNA, 23 nt, Pseudomonas aeruginosa PA01
gggccagcgccguacgcaccgcg

SEQ ID NO: 1515396 - RNA, 20 nt, Pseudomonas aeruginosa PA01
gggcccaggcuggcggccag

SEQ ID NO: 1515397 - RNA, 13 nt, Pseudomonas aeruginosa PA01
gggcccugggccc

SEQ ID NO: 1515398 - RNA, 17 nt, Pseudomonas aeruginosa PA01
gggcccugggccccggc

SEQ ID NO: 1515399 - RNA, 18 nt, Pseudomonas aeruginosa PA01
gggcccacagugccaggc

SEQ ID NO: 1515400 - RNA, 19 nt, Pseudomonas aeruginosa PA01
gggcccacagugccaggcu

SEQ ID NO: 1515401 - RNA, 16 nt, Pseudomonas aeruginosa PA01
gggcccaagccgagcg

SEQ ID NO: 1515402 - RNA, 23 nt, Pseudomonas aeruginosa PA01
gggccauugcagguaguccagcc

SEQ ID NO: 1515403 - RNA, 14 nt, Pseudomonas aeruginosa PA01
gggccaugagcagg

SEQ ID NO: 1515404 - RNA, 20 nt, Pseudomonas aeruginosa PA01
gggccaucagguccaccagc

SEQ ID NO: 1515405 - RNA, 20 nt, Pseudomonas aeruginosa PA01
gggccaucagugccugcacg

SEQ ID NO: 1515406 - RNA, 14 nt, Pseudomonas aeruginosa PA01
gggccaggcccuug

SEQ ID NO: 1515407 - RNA, 13 nt, Pseudomonas aeruginosa PA01
gggccaggccgag

SEQ ID NO: 1515408 - RNA, 22 nt, Pseudomonas aeruginosa PA01
gggccaggccgagcgcgccgcc

SEQ ID NO: 1515409 - RNA, 23 nt, Pseudomonas aeruginosa PA01
gggccaggaaaucgagcgccagg

SEQ ID NO: 1515410 - RNA, 18 nt, Pseudomonas aeruginosa PA01
gggccaggaugaccaggc

SEQ ID NO: 1515411 - RNA, 17 nt, Pseudomonas aeruginosa PA01
gggccaggcauccagca

SEQ ID NO: 1515412 - RNA, 23 nt, Pseudomonas aeruginosa PA01
gggccgccuggucggggccggcg

SEQ ID NO: 1515413 - RNA, 18 nt, Pseudomonas aeruginosa PA01
gggccgccggcgacgagg

SEQ ID NO: 1515414 - RNA, 22 nt, Pseudomonas aeruginosa PA01
gggccgcgccuuucgcucaggc

SEQ ID NO: 1515415 - RNA, 20 nt, Pseudomonas aeruginosa PA01
gggccgcgccgacccagagc

SEQ ID NO: 1515416 - RNA, 15 nt, Pseudomonas aeruginosa PA01
gggccgcgccgagcc

SEQ ID NO: 1515417 - RNA, 22 nt, Pseudomonas aeruginosa PA01
gggccgcgccgcaagggcgucg

SEQ ID NO: 1515418 - RNA, 12 nt, Pseudomonas aeruginosa PA01
gggccgcgcaga

SEQ ID NO: 1515419 - RNA, 15 nt, Pseudomonas aeruginosa PA01
gggccggcguccagg

SEQ ID NO: 1515420 - RNA, 24 nt, Pseudomonas aeruginosa PA01
gggccgguuccgaaucgccuacca

SEQ ID NO: 1515421 - RNA, 23 nt, Pseudomonas aeruginosa PA01
gggccgguucggauccggacugg

SEQ ID NO: 1515422 - RNA, 16 nt, Pseudomonas aeruginosa PA01
gggccgaugccgggca

SEQ ID NO: 1515423 - RNA, 10 nt, Pseudomonas aeruginosa PA01
gggccgcagg

SEQ ID NO: 1515424 - RNA, 14 nt, Pseudomonas aeruginosa PA01
gggccgcagguugg

SEQ ID NO: 1515425 - RNA, 12 nt, Pseudomonas aeruginosa PA01
gggccgccagcc

SEQ ID NO: 1515426 - RNA, 15 nt, Pseudomonas aeruginosa PA01
gggccgccagccgcc

SEQ ID NO: 1515427 - RNA, 16 nt, Pseudomonas aeruginosa PA01
gggccgccagccgcca

SEQ ID NO: 1515428 - RNA, 18 nt, Pseudomonas aeruginosa PA01
gggccgccagccgccagg

SEQ ID NO: 1515429 - RNA, 19 nt, Pseudomonas aeruginosa PA01
gggccgccagccgccagga

SEQ ID NO: 1515430 - RNA, 22 nt, Pseudomonas aeruginosa PA01
gggccgagggcugagacgcugc

SEQ ID NO: 1515431 - RNA, 21 nt, Pseudomonas aeruginosa PA01
gggccgaggucgcgggccagg

SEQ ID NO: 1515432 - RNA, 22 nt, Pseudomonas aeruginosa PA01
gggccgaggucgcgggccaggc

SEQ ID NO: 1515433 - RNA, 19 nt, Pseudomonas aeruginosa PA01
gggccgaucaccaccugga

SEQ ID NO: 1515434 - RNA, 14 nt, Pseudomonas aeruginosa PA01
gggccgagcgcagc

SEQ ID NO: 1515435 - RNA, 21 nt, Pseudomonas aeruginosa PA01
gggccgagcgcagcgccacca

SEQ ID NO: 1515436 - RNA, 19 nt, Pseudomonas aeruginosa PA01
gggccgacgaaggccgcgg

SEQ ID NO: 1515437 - RNA, 20 nt, Pseudomonas aeruginosa PA01
gggccgacgaaggccgcggu

SEQ ID NO: 1515438 - RNA, 15 nt, Pseudomonas aeruginosa PA01
gggccgacgcgcugc

SEQ ID NO: 1515439 - RNA, 15 nt, Pseudomonas aeruginosa PA01
gggccgaccugcccg

SEQ ID NO: 1515440 - RNA, 16 nt, Pseudomonas aeruginosa PA01
gggccgaaggccaggc

SEQ ID NO: 1515441 - RNA, 17 nt, Pseudomonas aeruginosa PA01
gggccgaaggccaggcc

SEQ ID NO: 1515442 - RNA, 19 nt, Pseudomonas aeruginosa PA01
gggcaacgcgcagaggcgc

SEQ ID NO: 1515443 - RNA, 18 nt, Pseudomonas aeruginosa PA01
gggcaaccgcggcggccu

SEQ ID NO: 1515444 - RNA, 17 nt, Pseudomonas aeruginosa PA01
gggcaacgccaggccgc

SEQ ID NO: 1515445 - RNA, 15 nt, Pseudomonas aeruginosa PA01
gggcaacgccaggcu

SEQ ID NO: 1515446 - RNA, 15 nt, Pseudomonas aeruginosa PA01
gggcaaaugccgcaa

SEQ ID NO: 1515447 - RNA, 15 nt, Pseudomonas aeruginosa PA01
gggcaacaggccgau

SEQ ID NO: 1515448 - RNA, 17 nt, Pseudomonas aeruginosa PA01
gggcaaaggcgcgcagg

SEQ ID NO: 1515449 - RNA, 22 nt, Pseudomonas aeruginosa PA01
gggcaaaggcgcgcagggccgc

SEQ ID NO: 1515450 - RNA, 12 nt, Pseudomonas aeruginosa PA01
gggcagccccuu

SEQ ID NO: 1515451 - RNA, 16 nt, Pseudomonas aeruginosa PA01
gggcagauguccaggc

SEQ ID NO: 1515452 - RNA, 19 nt, Pseudomonas aeruginosa PA01
gggcagauguccaggcagg

SEQ ID NO: 1515453 - RNA, 20 nt, Pseudomonas aeruginosa PA01
gggcagauguccaggcaggc

SEQ ID NO: 1515454 - RNA, 23 nt, Pseudomonas aeruginosa PA01
gggcagcagccggaccagccguc

SEQ ID NO: 1515455 - RNA, 20 nt, Pseudomonas aeruginosa PA01
gggcacuucguccaggccgc

SEQ ID NO: 1515456 - RNA, 23 nt, Pseudomonas aeruginosa PA01
gggcacuucguccaggccgccua

SEQ ID NO: 1515457 - RNA, 22 nt, Pseudomonas aeruginosa PA01
gggcacuucucgaacagcuccu

SEQ ID NO: 1515458 - RNA, 23 nt, Pseudomonas aeruginosa PA01
gggcacuucucgaacagcuccuc

SEQ ID NO: 1515459 - RNA, 22 nt, Pseudomonas aeruginosa PA01
gggcacuuguugguauggcagc

SEQ ID NO: 1515460 - RNA, 17 nt, Pseudomonas aeruginosa PA01
gggcagacaccaccagg

SEQ ID NO: 1515461 - RNA, 16 nt, Pseudomonas aeruginosa PA01
gggcagaguggcgcgg

SEQ ID NO: 1515462 - RNA, 13 nt, Pseudomonas aeruginosa PA01
gggaucagcgaga

SEQ ID NO: 1515463 - RNA, 20 nt, Pseudomonas aeruginosa PA01
gggaucgacgccgcuggcgg

SEQ ID NO: 1515464 - RNA, 23 nt, Pseudomonas aeruginosa PA01
gggaucgacgccgcuggcggcgc

SEQ ID NO: 1515465 - RNA, 14 nt, Pseudomonas aeruginosa PA01
gggagccaggcggc

SEQ ID NO: 1515466 - RNA, 23 nt, Pseudomonas aeruginosa PA01
gggagauguccaucagccgcgcg

SEQ ID NO: 1515467 - RNA, 19 nt, Pseudomonas aeruginosa PA01
gggaucgcgaagaacacgc

SEQ ID NO: 1515468 - RNA, 18 nt, Pseudomonas aeruginosa PA01
gggauuccuuggucaggu

SEQ ID NO: 1515469 - RNA, 14 nt, Pseudomonas aeruginosa PA01
gggauguuccaggc

SEQ ID NO: 1515470 - RNA, 16 nt, Pseudomonas aeruginosa PA01
gggauguuccaggccc

SEQ ID NO: 1515471 - RNA, 16 nt, Pseudomonas aeruginosa PA01
gggggcuccaggggag

SEQ ID NO: 1515472 - RNA, 14 nt, Pseudomonas aeruginosa PA01
gggguagccggccg

SEQ ID NO: 1515473 - RNA, 20 nt, Pseudomonas aeruginosa PA01
gggguaaggcaugcccaggc

SEQ ID NO: 1515474 - RNA, 14 nt, Pseudomonas aeruginosa PA01
gggggccuggcucg

SEQ ID NO: 1515475 - RNA, 21 nt, Pseudomonas aeruginosa PA01
gggguaggggucggccugggu

SEQ ID NO: 1515476 - RNA, 22 nt, Pseudomonas aeruginosa PA01
ggggucaguucguugagggccu

SEQ ID NO: 1515477 - RNA, 13 nt, Pseudomonas aeruginosa PA01
ggggucgcgccgg

SEQ ID NO: 1515478 - RNA, 12 nt, Pseudomonas aeruginosa PA01
ggggugcagggg

SEQ ID NO: 1515479 - RNA, 19 nt, Pseudomonas aeruginosa PA01
ggggugagaacguuuccau

SEQ ID NO: 1515480 - RNA, 15 nt, Pseudomonas aeruginosa PA01
ggggucuggccggcg

SEQ ID NO: 1515481 - RNA, 18 nt, Pseudomonas aeruginosa PA01
ggggucuucguuuucagg

SEQ ID NO: 1515482 - RNA, 17 nt, Pseudomonas aeruginosa PA01
ggggucguagagguugc

SEQ ID NO: 1515483 - RNA, 20 nt, Pseudomonas aeruginosa PA01
ggggcuuuuuuaugcgcagc

SEQ ID NO: 1515484 - RNA, 22 nt, Pseudomonas aeruginosa PA01
ggggcuuuuuucguggccgcga

SEQ ID NO: 1515485 - RNA, 21 nt, Pseudomonas aeruginosa PA01
ggggcuagucgcgcagcgccu

SEQ ID NO: 1515486 - RNA, 16 nt, Pseudomonas aeruginosa PA01
ggggcugaacagcgcc

SEQ ID NO: 1515487 - RNA, 16 nt, Pseudomonas aeruginosa PA01
ggggcggcacggugga

SEQ ID NO: 1515488 - RNA, 18 nt, Pseudomonas aeruginosa PA01
ggggcguauagcccgggu

SEQ ID NO: 1515489 - RNA, 14 nt, Pseudomonas aeruginosa PA01
ggggcgcgcccgcc

SEQ ID NO: 1515490 - RNA, 11 nt, Pseudomonas aeruginosa PA01
ggggcgcuggu

SEQ ID NO: 1515491 - RNA, 20 nt, Pseudomonas aeruginosa PA01
ggggcgcuguuggccugggc

SEQ ID NO: 1515492 - RNA, 18 nt, Pseudomonas aeruginosa PA01
ggggcgcucaggguggcg

SEQ ID NO: 1515493 - RNA, 20 nt, Pseudomonas aeruginosa PA01
ggggcgccggcucgcccagc

SEQ ID NO: 1515494 - RNA, 14 nt, Pseudomonas aeruginosa PA01
gggucggcacggcc

SEQ ID NO: 1515495 - RNA, 21 nt, Pseudomonas aeruginosa PA01
gggucggccuggguacgcacc

SEQ ID NO: 1515496 - RNA, 13 nt, Pseudomonas aeruginosa PA01
gggugaugcccgg

SEQ ID NO: 1515497 - RNA, 16 nt, Pseudomonas aeruginosa PA01
gggugaucacccagag

SEQ ID NO: 1515498 - RNA, 13 nt, Pseudomonas aeruginosa PA01
ggguggcgcuggc

SEQ ID NO: 1515499 - RNA, 21 nt, Pseudomonas aeruginosa PA01
gggugccgcgaauguggugga

SEQ ID NO: 1515500 - RNA, 15 nt, Pseudomonas aeruginosa PA01
gggugcagcccuggc

SEQ ID NO: 1515501 - RNA, 14 nt, Pseudomonas aeruginosa PA01
gggugcaggggcgc

SEQ ID NO: 1515502 - RNA, 22 nt, Pseudomonas aeruginosa PA01
gggucgaugcccucgcggcggc

SEQ ID NO: 1515503 - RNA, 21 nt, Pseudomonas aeruginosa PA01
gggucgauuccugucuccgca

SEQ ID NO: 1515504 - RNA, 13 nt, Pseudomonas aeruginosa PA01
gggucgcagccga

SEQ ID NO: 1515505 - RNA, 20 nt, Pseudomonas aeruginosa PA01
gggucgcggcugaagaagcu

SEQ ID NO: 1515506 - RNA, 14 nt, Pseudomonas aeruginosa PA01
gggucgcgcagcgg

SEQ ID NO: 1515507 - RNA, 12 nt, Pseudomonas aeruginosa PA01
gggucgcgcagg

SEQ ID NO: 1515508 - RNA, 21 nt, Pseudomonas aeruginosa PA01
gggucgcugcucagggccgcg

SEQ ID NO: 1515509 - RNA, 15 nt, Pseudomonas aeruginosa PA01
gggucggaugcagcg

SEQ ID NO: 1515510 - RNA, 20 nt, Pseudomonas aeruginosa PA01
gggucggcaccugcagacgg

SEQ ID NO: 1515511 - RNA, 21 nt, Pseudomonas aeruginosa PA01
gggucagcuugccgcaggucu

SEQ ID NO: 1515512 - RNA, 17 nt, Pseudomonas aeruginosa PA01
gggucagcggguuggcu

SEQ ID NO: 1515513 - RNA, 16 nt, Pseudomonas aeruginosa PA01
gggucagcaggcugcc

SEQ ID NO: 1515514 - RNA, 15 nt, Pseudomonas aeruginosa PA01
gggucagccgaugcu

SEQ ID NO: 1515515 - RNA, 17 nt, Pseudomonas aeruginosa PA01
gggucagccgaugcucg

SEQ ID NO: 1515516 - RNA, 15 nt, Pseudomonas aeruginosa PA01
gggucagccgcaggc

SEQ ID NO: 1515517 - RNA, 19 nt, Pseudomonas aeruginosa PA01
ggguaaggcaugcccaggc

SEQ ID NO: 1515518 - RNA, 14 nt, Pseudomonas aeruginosa PA01
ggguacagcgccac

SEQ ID NO: 1515519 - RNA, 18 nt, Pseudomonas aeruginosa PA01
ggguaacccagggugcgg

SEQ ID NO: 1515520 - RNA, 14 nt, Pseudomonas aeruginosa PA01
ggguaccugcucgc

SEQ ID NO: 1515521 - RNA, 19 nt, Pseudomonas aeruginosa PA01
ggguaccgcuggcgcuggg

SEQ ID NO: 1515522 - RNA, 22 nt, Pseudomonas aeruginosa PA01
gggucacgccgaaguucuucag

SEQ ID NO: 1515523 - RNA, 16 nt, Pseudomonas aeruginosa PA01
gggucacgccgagggc

SEQ ID NO: 1515524 - RNA, 14 nt, Pseudomonas aeruginosa PA01
gggucacgccgcgg

SEQ ID NO: 1515525 - RNA, 20 nt, Pseudomonas aeruginosa PA01
gggucacgccgcggcugaug

SEQ ID NO: 1515526 - RNA, 20 nt, Pseudomonas aeruginosa PA01
gggucacgcguugcgagggc

SEQ ID NO: 1515527 - RNA, 19 nt, Pseudomonas aeruginosa PA01
gggucagaccagcccuggc

SEQ ID NO: 1515528 - RNA, 14 nt, Pseudomonas aeruginosa PA01
gggucaccagcgcc

SEQ ID NO: 1515529 - RNA, 18 nt, Pseudomonas aeruginosa PA01
gggguugcaauagaaaag

SEQ ID NO: 1515530 - RNA, 14 nt, Pseudomonas aeruginosa PA01
gggguugcccagca

SEQ ID NO: 1515531 - RNA, 15 nt, Pseudomonas aeruginosa PA01
gggguugcccagcag

SEQ ID NO: 1515532 - RNA, 21 nt, Pseudomonas aeruginosa PA01
gggguugcccagcaggcucau

SEQ ID NO: 1515533 - RNA, 22 nt, Pseudomonas aeruginosa PA01
gggguugaguugcaggccggcg

SEQ ID NO: 1515534 - RNA, 12 nt, Pseudomonas aeruginosa PA01
ggggugaagcgc

SEQ ID NO: 1515535 - RNA, 22 nt, Pseudomonas aeruginosa PA01
gggguggccaggcgcaccagca

SEQ ID NO: 1515536 - RNA, 17 nt, Pseudomonas aeruginosa PA01
gggcggcuuccugcugg

SEQ ID NO: 1515537 - RNA, 22 nt, Pseudomonas aeruginosa PA01
gggcggcgcggcguggcggaag

SEQ ID NO: 1515538 - RNA, 19 nt, Pseudomonas aeruginosa PA01
gggcggccucguaggcggc

SEQ ID NO: 1515539 - RNA, 20 nt, Pseudomonas aeruginosa PA01
gggcggccucguaggcggcg

SEQ ID NO: 1515540 - RNA, 12 nt, Pseudomonas aeruginosa PA01
gggcggccggcg

SEQ ID NO: 1515541 - RNA, 17 nt, Pseudomonas aeruginosa PA01
gggcuacuucgccgggu

SEQ ID NO: 1515542 - RNA, 15 nt, Pseudomonas aeruginosa PA01
gggcgggcgaagcga

SEQ ID NO: 1515543 - RNA, 22 nt, Pseudomonas aeruginosa PA01
gggcguuuucguuggcggccau

SEQ ID NO: 1515544 - RNA, 15 nt, Pseudomonas aeruginosa PA01
gggcucgcgcggggc

SEQ ID NO: 1515545 - RNA, 23 nt, Pseudomonas aeruginosa PA01
gggcucuaugcaauggggcgcug

SEQ ID NO: 1515546 - RNA, 14 nt, Pseudomonas aeruginosa PA01
gggcucagcccagg

SEQ ID NO: 1515547 - RNA, 15 nt, Pseudomonas aeruginosa PA01
gggcucagcccaggc

SEQ ID NO: 1515548 - RNA, 17 nt, Pseudomonas aeruginosa PA01
gggcuauagcucagcug

SEQ ID NO: 1515549 - RNA, 15 nt, Pseudomonas aeruginosa PA01
gggcuagucgcgcag

SEQ ID NO: 1515550 - RNA, 16 nt, Pseudomonas aeruginosa PA01
gggcuagucgcgcagc

SEQ ID NO: 1515551 - RNA, 17 nt, Pseudomonas aeruginosa PA01
gggcuagucgcgcagcg

SEQ ID NO: 1515552 - RNA, 22 nt, Pseudomonas aeruginosa PA01
gggccguuuuuuaugccgaggc

SEQ ID NO: 1515553 - RNA, 23 nt, Pseudomonas aeruginosa PA01
gggccguaggugaccgcccaggg

SEQ ID NO: 1515554 - RNA, 19 nt, Pseudomonas aeruginosa PA01
gggccguccgccaggucca

SEQ ID NO: 1515555 - RNA, 20 nt, Pseudomonas aeruginosa PA01
gggccuacugcuggacggcg

SEQ ID NO: 1515556 - RNA, 16 nt, Pseudomonas aeruginosa PA01
gggccuccuggcggcg

SEQ ID NO: 1515557 - RNA, 14 nt, Pseudomonas aeruginosa PA01
gggccucgggcggg

SEQ ID NO: 1515558 - RNA, 14 nt, Pseudomonas aeruginosa PA01
gggccucggggccg

SEQ ID NO: 1515559 - RNA, 16 nt, Pseudomonas aeruginosa PA01
gggcgcuugaagccgg

SEQ ID NO: 1515560 - RNA, 11 nt, Pseudomonas aeruginosa PA01
gggcgcugguc

SEQ ID NO: 1515561 - RNA, 20 nt, Pseudomonas aeruginosa PA01
gggcgcuguuggccugggcg

SEQ ID NO: 1515562 - RNA, 20 nt, Pseudomonas aeruginosa PA01
gggcggauaacgccacaggc

SEQ ID NO: 1515563 - RNA, 11 nt, Pseudomonas aeruginosa PA01
gggcggccuca

SEQ ID NO: 1515564 - RNA, 14 nt, Pseudomonas aeruginosa PA01
gggcggccucaggc

SEQ ID NO: 1515565 - RNA, 13 nt, Pseudomonas aeruginosa PA01
gggcggaucgcca

SEQ ID NO: 1515566 - RNA, 15 nt, Pseudomonas aeruginosa PA01
gggcugggucggcug

SEQ ID NO: 1515567 - RNA, 16 nt, Pseudomonas aeruginosa PA01
gggcugggucggcugg

SEQ ID NO: 1515568 - RNA, 21 nt, Pseudomonas aeruginosa PA01
gggcugucguccuggguaugc

SEQ ID NO: 1515569 - RNA, 17 nt, Pseudomonas aeruginosa PA01
gggcuucagcgccgggu

SEQ ID NO: 1515570 - RNA, 13 nt, Pseudomonas aeruginosa PA01
gggcuucuucagg

SEQ ID NO: 1515571 - RNA, 12 nt, Pseudomonas aeruginosa PA01
gggcuucuuuua

SEQ ID NO: 1515572 - RNA, 14 nt, Pseudomonas aeruginosa PA01
gggcuucgcgcaga

SEQ ID NO: 1515573 - RNA, 13 nt, Pseudomonas aeruginosa PA01
ggggauggcgggc

SEQ ID NO: 1515574 - RNA, 24 nt, Pseudomonas aeruginosa PA01
ggggcauguccaccgccgccagca

SEQ ID NO: 1515575 - RNA, 20 nt, Pseudomonas aeruginosa PA01
ggggcauucguccagccgcc

SEQ ID NO: 1515576 - RNA, 12 nt, Pseudomonas aeruginosa PA01
ggggcaggcgca

SEQ ID NO: 1515577 - RNA, 15 nt, Pseudomonas aeruginosa PA01
ggggcagcagggcgu

SEQ ID NO: 1515578 - RNA, 14 nt, Pseudomonas aeruginosa PA01
ggggccaucagugc

SEQ ID NO: 1515579 - RNA, 16 nt, Pseudomonas aeruginosa PA01
ggggccaucagugccu

SEQ ID NO: 1515580 - RNA, 13 nt, Pseudomonas aeruginosa PA01
ggggcccggcagg

SEQ ID NO: 1515581 - RNA, 15 nt, Pseudomonas aeruginosa PA01
ggggccccggcaagg

SEQ ID NO: 1515582 - RNA, 21 nt, Pseudomonas aeruginosa PA01
ggggccccggcaagggccugc

SEQ ID NO: 1515583 - RNA, 18 nt, Pseudomonas aeruginosa PA01
ggggccggccugggcccc

SEQ ID NO: 1515584 - RNA, 20 nt, Pseudomonas aeruginosa PA01
ggggccucggccagcgccgc

SEQ ID NO: 1515585 - RNA, 15 nt, Pseudomonas aeruginosa PA01
ggggccggcacccgg

SEQ ID NO: 1515586 - RNA, 15 nt, Pseudomonas aeruginosa PA01
ggggccuucaggcgc

SEQ ID NO: 1515587 - RNA, 14 nt, Pseudomonas aeruginosa PA01
gguauucuccagca

SEQ ID NO: 1515588 - RNA, 17 nt, Pseudomonas aeruginosa PA01
gguauagcucauggcca

SEQ ID NO: 1515589 - RNA, 12 nt, Pseudomonas aeruginosa PA01
gguaucccggcu

SEQ ID NO: 1515590 - RNA, 22 nt, Pseudomonas aeruginosa PA01
gguaucccggcugagcgccagg

SEQ ID NO: 1515591 - RNA, 12 nt, Pseudomonas aeruginosa PA01
gguauccgccgg

SEQ ID NO: 1515592 - RNA, 15 nt, Pseudomonas aeruginosa PA01
gguauccgggcacuu

SEQ ID NO: 1515593 - RNA, 21 nt, Pseudomonas aeruginosa PA01
ggucaacaagaauaggaacag

SEQ ID NO: 1515594 - RNA, 16 nt, Pseudomonas aeruginosa PA01
ggucaacaccagcgcc

SEQ ID NO: 1515595 - RNA, 20 nt, Pseudomonas aeruginosa PA01
ggucaauucgcggacgccga

SEQ ID NO: 1515596 - RNA, 21 nt, Pseudomonas aeruginosa PA01
ggucaccacccagccgcggcc

SEQ ID NO: 1515597 - RNA, 17 nt, Pseudomonas aeruginosa PA01
gguagccugcggccagc

SEQ ID NO: 1515598 - RNA, 20 nt, Pseudomonas aeruginosa PA01
gguagcgaaucugcagggca

SEQ ID NO: 1515599 - RNA, 21 nt, Pseudomonas aeruginosa PA01
gguagcgaaucugcagggcau

SEQ ID NO: 1515600 - RNA, 14 nt, Pseudomonas aeruginosa PA01
gguagcggucgggu

SEQ ID NO: 1515601 - RNA, 22 nt, Pseudomonas aeruginosa PA01
gguauagaccagcaccgccugc

SEQ ID NO: 1515602 - RNA, 12 nt, Pseudomonas aeruginosa PA01
gguagcccgcgg

SEQ ID NO: 1515603 - RNA, 20 nt, Pseudomonas aeruginosa PA01
gguagcccgcggcgagcagc

SEQ ID NO: 1515604 - RNA, 14 nt, Pseudomonas aeruginosa PA01
gguagcccggcagc

SEQ ID NO: 1515605 - RNA, 16 nt, Pseudomonas aeruginosa PA01
gguagccgcgccggcc

SEQ ID NO: 1515606 - RNA, 11 nt, Pseudomonas aeruginosa PA01
gguagccgagg

SEQ ID NO: 1515607 - RNA, 16 nt, Pseudomonas aeruginosa PA01
gguagccgaggcggcc

SEQ ID NO: 1515608 - RNA, 23 nt, Pseudomonas aeruginosa PA01
gguccaccaggguaccgaaacag

SEQ ID NO: 1515609 - RNA, 15 nt, Pseudomonas aeruginosa PA01
gguccagcgagcggg

SEQ ID NO: 1515610 - RNA, 22 nt, Pseudomonas aeruginosa PA01
gguccagcgagcgggcgagggc

SEQ ID NO: 1515611 - RNA, 13 nt, Pseudomonas aeruginosa PA01
gguccagcggccg

SEQ ID NO: 1515612 - RNA, 22 nt, Pseudomonas aeruginosa PA01
gguccagcucggucagcggcgc

SEQ ID NO: 1515613 - RNA, 14 nt, Pseudomonas aeruginosa PA01
gguccagcggccgc

SEQ ID NO: 1515614 - RNA, 22 nt, Pseudomonas aeruginosa PA01
gguccaguucagggcgagcagg

SEQ ID NO: 1515615 - RNA, 17 nt, Pseudomonas aeruginosa PA01
gguccaggcgccagagc

SEQ ID NO: 1515616 - RNA, 18 nt, Pseudomonas aeruginosa PA01
gguccauggaccgagacc

SEQ ID NO: 1515617 - RNA, 17 nt, Pseudomonas aeruginosa PA01
ggucagcaccagggcca

SEQ ID NO: 1515618 - RNA, 19 nt, Pseudomonas aeruginosa PA01
ggucagcaccagggccagg

SEQ ID NO: 1515619 - RNA, 23 nt, Pseudomonas aeruginosa PA01
ggucagcaacugccaaccgcgcu

SEQ ID NO: 1515620 - RNA, 15 nt, Pseudomonas aeruginosa PA01
ggucagcagcagggu

SEQ ID NO: 1515621 - RNA, 21 nt, Pseudomonas aeruginosa PA01
ggucaguuccaggucggcggc

SEQ ID NO: 1515622 - RNA, 14 nt, Pseudomonas aeruginosa PA01
ggucagcaggcugc

SEQ ID NO: 1515623 - RNA, 17 nt, Pseudomonas aeruginosa PA01
ggucacuccgcugguaa

SEQ ID NO: 1515624 - RNA, 13 nt, Pseudomonas aeruginosa PA01
ggucacucggccu

SEQ ID NO: 1515625 - RNA, 23 nt, Pseudomonas aeruginosa PA01
ggucaugcccuggccgacgcuga

SEQ ID NO: 1515626 - RNA, 14 nt, Pseudomonas aeruginosa PA01
ggucaugcccaggc

SEQ ID NO: 1515627 - RNA, 15 nt, Pseudomonas aeruginosa PA01
ggucaugcccaggcc

SEQ ID NO: 1515628 - RNA, 21 nt, Pseudomonas aeruginosa PA01
ggucaguucguugagggccuu

SEQ ID NO: 1515629 - RNA, 22 nt, Pseudomonas aeruginosa PA01
ggugaugcacguugggauagcu

SEQ ID NO: 1515630 - RNA, 24 nt, Pseudomonas aeruginosa PA01
ggugaugaccccggcgaugcugcu

SEQ ID NO: 1515631 - RNA, 23 nt, Pseudomonas aeruginosa PA01
ggugaugucggcgcugucgccgu

SEQ ID NO: 1515632 - RNA, 15 nt, Pseudomonas aeruginosa PA01
ggugcaggccgagcu

SEQ ID NO: 1515633 - RNA, 18 nt, Pseudomonas aeruginosa PA01
ggugcaggaagcgccggg

SEQ ID NO: 1515634 - RNA, 20 nt, Pseudomonas aeruginosa PA01
ggugcaguucgccguucagc

SEQ ID NO: 1515635 - RNA, 21 nt, Pseudomonas aeruginosa PA01
ggugcauguagcgcuccucgc

SEQ ID NO: 1515636 - RNA, 20 nt, Pseudomonas aeruginosa PA01
ggugcaugaaggcgcugagc

SEQ ID NO: 1515637 - RNA, 21 nt, Pseudomonas aeruginosa PA01
ggugccagggcggucggccag

SEQ ID NO: 1515638 - RNA, 16 nt, Pseudomonas aeruginosa PA01
ggugccauacagcgcc

SEQ ID NO: 1515639 - RNA, 21 nt, Pseudomonas aeruginosa PA01
ggugccauacucggacggcuc

SEQ ID NO: 1515640 - RNA, 22 nt, Pseudomonas aeruginosa PA01
ggucugguagcgauugaacucg

SEQ ID NO: 1515641 - RNA, 16 nt, Pseudomonas aeruginosa PA01
ggucugcucgcgcuuc

SEQ ID NO: 1515642 - RNA, 15 nt, Pseudomonas aeruginosa PA01
ggucugcucggcgcc

SEQ ID NO: 1515643 - RNA, 20 nt, Pseudomonas aeruginosa PA01
ggucugcucggcgcccuggg

SEQ ID NO: 1515644 - RNA, 15 nt, Pseudomonas aeruginosa PA01
ggugacccgcacggc

SEQ ID NO: 1515645 - RNA, 16 nt, Pseudomonas aeruginosa PA01
ggucguacaccagaug

SEQ ID NO: 1515646 - RNA, 21 nt, Pseudomonas aeruginosa PA01
ggucgguucgcggcgcagcuu

SEQ ID NO: 1515647 - RNA, 14 nt, Pseudomonas aeruginosa PA01
ggucucgccacccc

SEQ ID NO: 1515648 - RNA, 19 nt, Pseudomonas aeruginosa PA01
ggucucgcgcagcggcgga

SEQ ID NO: 1515649 - RNA, 12 nt, Pseudomonas aeruginosa PA01
ggucuccuccuc

SEQ ID NO: 1515650 - RNA, 15 nt, Pseudomonas aeruginosa PA01
ggucggguccgggcc

SEQ ID NO: 1515651 - RNA, 21 nt, Pseudomonas aeruginosa PA01
ggucggcgguucgaucccguc

SEQ ID NO: 1515652 - RNA, 14 nt, Pseudomonas aeruginosa PA01
ggucggugagcacg

SEQ ID NO: 1515653 - RNA, 15 nt, Pseudomonas aeruginosa PA01
ggucggugagcacgc

SEQ ID NO: 1515654 - RNA, 18 nt, Pseudomonas aeruginosa PA01
ggucgguagaaugcgccc

SEQ ID NO: 1515655 - RNA, 15 nt, Pseudomonas aeruginosa PA01
ggucggucggcggcg

SEQ ID NO: 1515656 - RNA, 13 nt, Pseudomonas aeruginosa PA01
ggucggugacccg

SEQ ID NO: 1515657 - RNA, 23 nt, Pseudomonas aeruginosa PA01
ggucggugacccgcacggcgacg

SEQ ID NO: 1515658 - RNA, 17 nt, Pseudomonas aeruginosa PA01
ggucgcggucuggauga

SEQ ID NO: 1515659 - RNA, 14 nt, Pseudomonas aeruginosa PA01
ggucgcuccagccc

SEQ ID NO: 1515660 - RNA, 17 nt, Pseudomonas aeruginosa PA01
ggucgcguuccagcucc

SEQ ID NO: 1515661 - RNA, 13 nt, Pseudomonas aeruginosa PA01
ggucggcggcggu

SEQ ID NO: 1515662 - RNA, 19 nt, Pseudomonas aeruginosa PA01
ggucgcugaccagcccggc

SEQ ID NO: 1515663 - RNA, 22 nt, Pseudomonas aeruginosa PA01
ggucgcugcccucgaccagguc

SEQ ID NO: 1515664 - RNA, 15 nt, Pseudomonas aeruginosa PA01
ggucgcgcagcggcu

SEQ ID NO: 1515665 - RNA, 18 nt, Pseudomonas aeruginosa PA01
ggucgcgcgcggccagcu

SEQ ID NO: 1515666 - RNA, 20 nt, Pseudomonas aeruginosa PA01
ggucgcgcccgcugugcggg

SEQ ID NO: 1515667 - RNA, 15 nt, Pseudomonas aeruginosa PA01
ggucgcgaucugcug

SEQ ID NO: 1515668 - RNA, 17 nt, Pseudomonas aeruginosa PA01
ggucgcggaucaggcug

SEQ ID NO: 1515669 - RNA, 21 nt, Pseudomonas aeruginosa PA01
ggucgcggaagugcgggguga

SEQ ID NO: 1515670 - RNA, 20 nt, Pseudomonas aeruginosa PA01
gguccuggcgcgagaagcca

SEQ ID NO: 1515671 - RNA, 15 nt, Pseudomonas aeruginosa PA01
gguccguccagcgcg

SEQ ID NO: 1515672 - RNA, 15 nt, Pseudomonas aeruginosa PA01
gguccguucggcgcc

SEQ ID NO: 1515673 - RNA, 19 nt, Pseudomonas aeruginosa PA01
gguccguucggcgcccagg

SEQ ID NO: 1515674 - RNA, 20 nt, Pseudomonas aeruginosa PA01
ggucccuucgugggccugcu

SEQ ID NO: 1515675 - RNA, 23 nt, Pseudomonas aeruginosa PA01
ggucccuucgugggccugcucgg

SEQ ID NO: 1515676 - RNA, 22 nt, Pseudomonas aeruginosa PA01
gguccgacaaucagcggcgggc

SEQ ID NO: 1515677 - RNA, 23 nt, Pseudomonas aeruginosa PA01
gguccgcgguagcugcgcagggc

SEQ ID NO: 1515678 - RNA, 23 nt, Pseudomonas aeruginosa PA01
gguccgcuucagcgcgccgagcc

SEQ ID NO: 1515679 - RNA, 12 nt, Pseudomonas aeruginosa PA01
gguccggcacuu

SEQ ID NO: 1515680 - RNA, 21 nt, Pseudomonas aeruginosa PA01
gguccggcacuuccuugguga

SEQ ID NO: 1515681 - RNA, 21 nt, Pseudomonas aeruginosa PA01
gguccggcugucgacgcagcc

SEQ ID NO: 1515682 - RNA, 22 nt, Pseudomonas aeruginosa PA01
gguccggguuggcgcaggccgg

SEQ ID NO: 1515683 - RNA, 13 nt, Pseudomonas aeruginosa PA01
gguuuccgcagcg

SEQ ID NO: 1515684 - RNA, 18 nt, Pseudomonas aeruginosa PA01
gguuucgcuuuccucggu

SEQ ID NO: 1515685 - RNA, 14 nt, Pseudomonas aeruginosa PA01
gguuuuccugcccc

SEQ ID NO: 1515686 - RNA, 14 nt, Pseudomonas aeruginosa PA01
gguucggcaggccu

SEQ ID NO: 1515687 - RNA, 21 nt, Pseudomonas aeruginosa PA01
gguucggcgucuucggcggcg

SEQ ID NO: 1515688 - RNA, 17 nt, Pseudomonas aeruginosa PA01
gguucgcguggcccggc

SEQ ID NO: 1515689 - RNA, 23 nt, Pseudomonas aeruginosa PA01
gguucgccgagcgccgccaggca

SEQ ID NO: 1515690 - RNA, 19 nt, Pseudomonas aeruginosa PA01
gguucgcccgcgggcagcu

SEQ ID NO: 1515691 - RNA, 17 nt, Pseudomonas aeruginosa PA01
gguucgcaggccaggcg

SEQ ID NO: 1515692 - RNA, 15 nt, Pseudomonas aeruginosa PA01
gguucuggucgccga

SEQ ID NO: 1515693 - RNA, 22 nt, Pseudomonas aeruginosa PA01
gguucucgucgaugucgcggcu

SEQ ID NO: 1515694 - RNA, 17 nt, Pseudomonas aeruginosa PA01
gguugaccuucuguccg

SEQ ID NO: 1515695 - RNA, 14 nt, Pseudomonas aeruginosa PA01
gguugacgaugcgg

SEQ ID NO: 1515696 - RNA, 20 nt, Pseudomonas aeruginosa PA01
gguugaccccgaggucggcg

SEQ ID NO: 1515697 - RNA, 20 nt, Pseudomonas aeruginosa PA01
gguugagauccuggccggcg

SEQ ID NO: 1515698 - RNA, 22 nt, Pseudomonas aeruginosa PA01
gguugagauccuggccggcggc

SEQ ID NO: 1515699 - RNA, 20 nt, Pseudomonas aeruginosa PA01
gguugaguugcaggccggcg

SEQ ID NO: 1515700 - RNA, 24 nt, Pseudomonas aeruginosa PA01
gguugaguugcaggccggcgagcc

SEQ ID NO: 1515701 - RNA, 18 nt, Pseudomonas aeruginosa PA01
gguugagguagagcacgc

SEQ ID NO: 1515702 - RNA, 14 nt, Pseudomonas aeruginosa PA01
gguugcuguagaau

SEQ ID NO: 1515703 - RNA, 14 nt, Pseudomonas aeruginosa PA01
gguugcugcggcau

SEQ ID NO: 1515704 - RNA, 13 nt, Pseudomonas aeruginosa PA01
gguugcgcaggau

SEQ ID NO: 1515705 - RNA, 12 nt, Pseudomonas aeruginosa PA01
gguugccaggcc

SEQ ID NO: 1515706 - RNA, 19 nt, Pseudomonas aeruginosa PA01
gguugcccacggccaggcc

SEQ ID NO: 1515707 - RNA, 22 nt, Pseudomonas aeruginosa PA01
gguugcccacggccaggcccac

SEQ ID NO: 1515708 - RNA, 18 nt, Pseudomonas aeruginosa PA01
gguugcgcuggcgcagca

SEQ ID NO: 1515709 - RNA, 23 nt, Pseudomonas aeruginosa PA01
gguugcgcuggcgcagcagcagg

SEQ ID NO: 1515710 - RNA, 16 nt, Pseudomonas aeruginosa PA01
gguugccgcagagcau

SEQ ID NO: 1515711 - RNA, 15 nt, Pseudomonas aeruginosa PA01
gguuguagcccuggg

SEQ ID NO: 1515712 - RNA, 12 nt, Pseudomonas aeruginosa PA01
gguugggcagcg

SEQ ID NO: 1515713 - RNA, 13 nt, Pseudomonas aeruginosa PA01
gguuccggucggg

SEQ ID NO: 1515714 - RNA, 17 nt, Pseudomonas aeruginosa PA01
gguucgaauccuccuga

SEQ ID NO: 1515715 - RNA, 13 nt, Pseudomonas aeruginosa PA01
gguucccgcagcg

SEQ ID NO: 1515716 - RNA, 14 nt, Pseudomonas aeruginosa PA01
gguucccagcagca

SEQ ID NO: 1515717 - RNA, 22 nt, Pseudomonas aeruginosa PA01
gguucccagcagcaacagcgcc

SEQ ID NO: 1515718 - RNA, 22 nt, Pseudomonas aeruginosa PA01
gguucagcgggacagcuugccg

SEQ ID NO: 1515719 - RNA, 19 nt, Pseudomonas aeruginosa PA01
gguucaggugaaaagcgcu

SEQ ID NO: 1515720 - RNA, 19 nt, Pseudomonas aeruginosa PA01
gguucaucgagcggcggcc

SEQ ID NO: 1515721 - RNA, 14 nt, Pseudomonas aeruginosa PA01
gguuauucgcccua

SEQ ID NO: 1515722 - RNA, 21 nt, Pseudomonas aeruginosa PA01
gguuauucgcccuacccccca

SEQ ID NO: 1515723 - RNA, 22 nt, Pseudomonas aeruginosa PA01
ggugcuuggcuucgagcugcga

SEQ ID NO: 1515724 - RNA, 23 nt, Pseudomonas aeruginosa PA01
ggugcuuuccugcuccagcaggg

SEQ ID NO: 1515725 - RNA, 17 nt, Pseudomonas aeruginosa PA01
gguggcccugggcggcg

SEQ ID NO: 1515726 - RNA, 18 nt, Pseudomonas aeruginosa PA01
gguggcccugggcggcga

SEQ ID NO: 1515727 - RNA, 14 nt, Pseudomonas aeruginosa PA01
gguggccuccugca

SEQ ID NO: 1515728 - RNA, 14 nt, Pseudomonas aeruginosa PA01
gguggccgugcagc

SEQ ID NO: 1515729 - RNA, 17 nt, Pseudomonas aeruginosa PA01
gguggcgaccaggacag

SEQ ID NO: 1515730 - RNA, 17 nt, Pseudomonas aeruginosa PA01
ggugcccagcaggcugc

SEQ ID NO: 1515731 - RNA, 21 nt, Pseudomonas aeruginosa PA01
ggugccccgcuggcccaacag

SEQ ID NO: 1515732 - RNA, 21 nt, Pseudomonas aeruginosa PA01
ggugcccaucaggcucaggcg

SEQ ID NO: 1515733 - RNA, 21 nt, Pseudomonas aeruginosa PA01
ggugcugcgcgcggcccacca

SEQ ID NO: 1515734 - RNA, 23 nt, Pseudomonas aeruginosa PA01
ggugcuggugcggccgaugaucu

SEQ ID NO: 1515735 - RNA, 23 nt, Pseudomonas aeruginosa PA01
ggugcugguggcccugggcggcg

SEQ ID NO: 1515736 - RNA, 18 nt, Pseudomonas aeruginosa PA01
ggugcuggcgagcagggu

SEQ ID NO: 1515737 - RNA, 23 nt, Pseudomonas aeruginosa PA01
ggugcuggcgucgccuuccacca

SEQ ID NO: 1515738 - RNA, 22 nt, Pseudomonas aeruginosa PA01
gguggggccgccgaugccgacg

SEQ ID NO: 1515739 - RNA, 14 nt, Pseudomonas aeruginosa PA01
gguguucggcggcg

SEQ ID NO: 1515740 - RNA, 20 nt, Pseudomonas aeruginosa PA01
cuccacagcugccagccccg

SEQ ID NO: 1515741 - RNA, 19 nt, Pseudomonas aeruginosa PA01
cuccaccucgacccuggcg

SEQ ID NO: 1515742 - RNA, 13 nt, Pseudomonas aeruginosa PA01
cuccaccgccccc

SEQ ID NO: 1515743 - RNA, 16 nt, Pseudomonas aeruginosa PA01
cuccacccaggcgccg

SEQ ID NO: 1515744 - RNA, 14 nt, Pseudomonas aeruginosa PA01
cuccaccagggccu

SEQ ID NO: 1515745 - RNA, 18 nt, Pseudomonas aeruginosa PA01
cuccaccgauggcgcgcu

SEQ ID NO: 1515746 - RNA, 22 nt, Pseudomonas aeruginosa PA01
cuccacuaccgccgagggcgcc

SEQ ID NO: 1515747 - RNA, 14 nt, Pseudomonas aeruginosa PA01
cuccacgucggccc

SEQ ID NO: 1515748 - RNA, 14 nt, Pseudomonas aeruginosa PA01
cuccacugcuuggc

SEQ ID NO: 1515749 - RNA, 21 nt, Pseudomonas aeruginosa PA01
cuccagcaccgccuggcgcaa

SEQ ID NO: 1515750 - RNA, 17 nt, Pseudomonas aeruginosa PA01
cuccagcaccggcggcg

SEQ ID NO: 1515751 - RNA, 20 nt, Pseudomonas aeruginosa PA01
cuccagcaccggcggcgcca

SEQ ID NO: 1515752 - RNA, 14 nt, Pseudomonas aeruginosa PA01
cuccagcaccgugg

SEQ ID NO: 1515753 - RNA, 17 nt, Pseudomonas aeruginosa PA01
cuccagcaacgccgccc

SEQ ID NO: 1515754 - RNA, 12 nt, Pseudomonas aeruginosa PA01
cuccagcaagcc

SEQ ID NO: 1515755 - RNA, 14 nt, Pseudomonas aeruginosa PA01
cuccagcaagccgu

SEQ ID NO: 1515756 - RNA, 15 nt, Pseudomonas aeruginosa PA01
cuccagcaaggcguc

SEQ ID NO: 1515757 - RNA, 20 nt, Pseudomonas aeruginosa PA01
cuccagagccaugggccggc

SEQ ID NO: 1515758 - RNA, 22 nt, Pseudomonas aeruginosa PA01
cuccagagccaugggccggccg

SEQ ID NO: 1515759 - RNA, 22 nt, Pseudomonas aeruginosa PA01
cuccagaucgcauuguugcggu

SEQ ID NO: 1515760 - RNA, 16 nt, Pseudomonas aeruginosa PA01
cuccaacagcagguag

SEQ ID NO: 1515761 - RNA, 20 nt, Pseudomonas aeruginosa PA01
cuccaaagccuggagcaggg

SEQ ID NO: 1515762 - RNA, 22 nt, Pseudomonas aeruginosa PA01
cuccaacuggcggcugggcugc

SEQ ID NO: 1515763 - RNA, 15 nt, Pseudomonas aeruginosa PA01
cucauugcgccgccg

SEQ ID NO: 1515764 - RNA, 18 nt, Pseudomonas aeruginosa PA01
cucauugcgccgccggcu

SEQ ID NO: 1515765 - RNA, 18 nt, Pseudomonas aeruginosa PA01
cucauucaucucgccguc

SEQ ID NO: 1515766 - RNA, 22 nt, Pseudomonas aeruginosa PA01
cucauucgcucugcgccaggcg

SEQ ID NO: 1515767 - RNA, 16 nt, Pseudomonas aeruginosa PA01
cucaggauagccggcg

SEQ ID NO: 1515768 - RNA, 19 nt, Pseudomonas aeruginosa PA01
cucaggcgcugcuggugga

SEQ ID NO: 1515769 - RNA, 20 nt, Pseudomonas aeruginosa PA01
cucaggcgcagcguccugcc

SEQ ID NO: 1515770 - RNA, 14 nt, Pseudomonas aeruginosa PA01
cucaggccgccgcg

SEQ ID NO: 1515771 - RNA, 23 nt, Pseudomonas aeruginosa PA01
cucaggccgccgcgucgaagcug

SEQ ID NO: 1515772 - RNA, 22 nt, Pseudomonas aeruginosa PA01
cucaggcggccgaacuggauga

SEQ ID NO: 1515773 - RNA, 15 nt, Pseudomonas aeruginosa PA01
cucccaggcuggcgg

SEQ ID NO: 1515774 - RNA, 20 nt, Pseudomonas aeruginosa PA01
cuccaugcgggagagcgccg

SEQ ID NO: 1515775 - RNA, 16 nt, Pseudomonas aeruginosa PA01
cuccagccgcacccuc

SEQ ID NO: 1515776 - RNA, 13 nt, Pseudomonas aeruginosa PA01
cuccagccggcaa

SEQ ID NO: 1515777 - RNA, 17 nt, Pseudomonas aeruginosa PA01
cuccagcagucgcacag

SEQ ID NO: 1515778 - RNA, 19 nt, Pseudomonas aeruginosa PA01
cuccagcagucgcacagcc

SEQ ID NO: 1515779 - RNA, 19 nt, Pseudomonas aeruginosa PA01
cuccagcagggucgccugg

SEQ ID NO: 1515780 - RNA, 20 nt, Pseudomonas aeruginosa PA01
cuccagcagggucgccuggg

SEQ ID NO: 1515781 - RNA, 21 nt, Pseudomonas aeruginosa PA01
cuccagcagggucgccugggu

SEQ ID NO: 1515782 - RNA, 20 nt, Pseudomonas aeruginosa PA01
cuccagcaguucgucgccac

SEQ ID NO: 1515783 - RNA, 14 nt, Pseudomonas aeruginosa PA01
cucccgggccucuc

SEQ ID NO: 1515784 - RNA, 16 nt, Pseudomonas aeruginosa PA01
cucccguaccagcgcg

SEQ ID NO: 1515785 - RNA, 18 nt, Pseudomonas aeruginosa PA01
cuccccucaggcgccgcu

SEQ ID NO: 1515786 - RNA, 21 nt, Pseudomonas aeruginosa PA01
cuccccuggaaugccggccgg

SEQ ID NO: 1515787 - RNA, 13 nt, Pseudomonas aeruginosa PA01
cucccggccuggu

SEQ ID NO: 1515788 - RNA, 16 nt, Pseudomonas aeruginosa PA01
cucccggcuggucaga

SEQ ID NO: 1515789 - RNA, 17 nt, Pseudomonas aeruginosa PA01
cucccgggccagcuccg

SEQ ID NO: 1515790 - RNA, 11 nt, Pseudomonas aeruginosa PA01
cuccccgcucc

SEQ ID NO: 1515791 - RNA, 13 nt, Pseudomonas aeruginosa PA01
cucccccgcgccg

SEQ ID NO: 1515792 - RNA, 19 nt, Pseudomonas aeruginosa PA01
cuccccagcaggcaggcau

SEQ ID NO: 1515793 - RNA, 17 nt, Pseudomonas aeruginosa PA01
cuccccagacccucucc

SEQ ID NO: 1515794 - RNA, 19 nt, Pseudomonas aeruginosa PA01
cuccccagacccucucccu

SEQ ID NO: 1515795 - RNA, 16 nt, Pseudomonas aeruginosa PA01
cuccggggcgcuguug

SEQ ID NO: 1515796 - RNA, 21 nt, Pseudomonas aeruginosa PA01
cuccgggcuggccaccagcac

SEQ ID NO: 1515797 - RNA, 16 nt, Pseudomonas aeruginosa PA01
cuccgucgcuucgccc

SEQ ID NO: 1515798 - RNA, 18 nt, Pseudomonas aeruginosa PA01
cuccgucgcuucgcccgc

SEQ ID NO: 1515799 - RNA, 15 nt, Pseudomonas aeruginosa PA01
cuccgucuguucggc

SEQ ID NO: 1515800 - RNA, 18 nt, Pseudomonas aeruginosa PA01
cuccguccagugcggcag

SEQ ID NO: 1515801 - RNA, 17 nt, Pseudomonas aeruginosa PA01
cuccguugaccugguug

SEQ ID NO: 1515802 - RNA, 13 nt, Pseudomonas aeruginosa PA01
cuccgaagggaac

SEQ ID NO: 1515803 - RNA, 19 nt, Pseudomonas aeruginosa PA01
cuccgaagggaacccgcgg

SEQ ID NO: 1515804 - RNA, 17 nt, Pseudomonas aeruginosa PA01
cuccgagcaggccuugc

SEQ ID NO: 1515805 - RNA, 14 nt, Pseudomonas aeruginosa PA01
cuccgagacgcugc

SEQ ID NO: 1515806 - RNA, 17 nt, Pseudomonas aeruginosa PA01
cuccgacgccccccacu

SEQ ID NO: 1515807 - RNA, 16 nt, Pseudomonas aeruginosa PA01
cuccgagggccgcgcc

SEQ ID NO: 1515808 - RNA, 22 nt, Pseudomonas aeruginosa PA01
cuccgcuaagcgucacucccag

SEQ ID NO: 1515809 - RNA, 17 nt, Pseudomonas aeruginosa PA01
cuccgcguguucgcggc

SEQ ID NO: 1515810 - RNA, 23 nt, Pseudomonas aeruginosa PA01
cuccggcgggcgguagcgggcca

SEQ ID NO: 1515811 - RNA, 15 nt, Pseudomonas aeruginosa PA01
cuccgggaacagccc

SEQ ID NO: 1515812 - RNA, 14 nt, Pseudomonas aeruginosa PA01
cuccggcucucccc

SEQ ID NO: 1515813 - RNA, 15 nt, Pseudomonas aeruginosa PA01
cuccggcucuccccg

SEQ ID NO: 1515814 - RNA, 16 nt, Pseudomonas aeruginosa PA01
cuccggcucuccccgc

SEQ ID NO: 1515815 - RNA, 15 nt, Pseudomonas aeruginosa PA01
cuccggaacgccugc

SEQ ID NO: 1515816 - RNA, 14 nt, Pseudomonas aeruginosa PA01
cuccggaggcgcac

SEQ ID NO: 1515817 - RNA, 23 nt, Pseudomonas aeruginosa PA01
cuccggacucgcuaucaggcauc

SEQ ID NO: 1515818 - RNA, 14 nt, Pseudomonas aeruginosa PA01
cuccgcucugcugg

SEQ ID NO: 1515819 - RNA, 19 nt, Pseudomonas aeruginosa PA01
cuccgcucugcuggccacc

SEQ ID NO: 1515820 - RNA, 21 nt, Pseudomonas aeruginosa PA01
cuccgcucugcuggccacccu

SEQ ID NO: 1515821 - RNA, 13 nt, Pseudomonas aeruginosa PA01
cucgccuaccggc

SEQ ID NO: 1515822 - RNA, 13 nt, Pseudomonas aeruginosa PA01
cucgccucccggc

SEQ ID NO: 1515823 - RNA, 19 nt, Pseudomonas aeruginosa PA01
cucgccucccggcucgccg

SEQ ID NO: 1515824 - RNA, 20 nt, Pseudomonas aeruginosa PA01
cucgccucgcgccagagauc

SEQ ID NO: 1515825 - RNA, 20 nt, Pseudomonas aeruginosa PA01
cucgccggcgcgggcggccu

SEQ ID NO: 1515826 - RNA, 17 nt, Pseudomonas aeruginosa PA01
cucgccguacagcaggc

SEQ ID NO: 1515827 - RNA, 21 nt, Pseudomonas aeruginosa PA01
cucgccgggaaucgccagcag

SEQ ID NO: 1515828 - RNA, 22 nt, Pseudomonas aeruginosa PA01
cucgccgggucgccgcagcccu

SEQ ID NO: 1515829 - RNA, 16 nt, Pseudomonas aeruginosa PA01
cucgcgcagcaggauc

SEQ ID NO: 1515830 - RNA, 19 nt, Pseudomonas aeruginosa PA01
cucgcgcagcaggauccag

SEQ ID NO: 1515831 - RNA, 13 nt, Pseudomonas aeruginosa PA01
cucgcgcagccag

SEQ ID NO: 1515832 - RNA, 16 nt, Pseudomonas aeruginosa PA01
cucgcgcagcggcgga

SEQ ID NO: 1515833 - RNA, 13 nt, Pseudomonas aeruginosa PA01
cucgcgcaccgcg

SEQ ID NO: 1515834 - RNA, 21 nt, Pseudomonas aeruginosa PA01
cucgcgcacggcgaagaacag

SEQ ID NO: 1515835 - RNA, 13 nt, Pseudomonas aeruginosa PA01
cucgcgacccugg

SEQ ID NO: 1515836 - RNA, 16 nt, Pseudomonas aeruginosa PA01
cucgcggcaucccgcc

SEQ ID NO: 1515837 - RNA, 18 nt, Pseudomonas aeruginosa PA01
cucgcgcguggccgccag

SEQ ID NO: 1515838 - RNA, 18 nt, Pseudomonas aeruginosa PA01
cucgcgcaagcgcccggc

SEQ ID NO: 1515839 - RNA, 18 nt, Pseudomonas aeruginosa PA01
cucgcgcaugaucgccuc

SEQ ID NO: 1515840 - RNA, 20 nt, Pseudomonas aeruginosa PA01
cucgccgaaggugcaggccg

SEQ ID NO: 1515841 - RNA, 14 nt, Pseudomonas aeruginosa PA01
cucgcccucauggc

SEQ ID NO: 1515842 - RNA, 18 nt, Pseudomonas aeruginosa PA01
cucgcccucgaagcccug

SEQ ID NO: 1515843 - RNA, 19 nt, Pseudomonas aeruginosa PA01
cucgcccucgaagcccugc

SEQ ID NO: 1515844 - RNA, 17 nt, Pseudomonas aeruginosa PA01
cucgccgacuuccaggc

SEQ ID NO: 1515845 - RNA, 16 nt, Pseudomonas aeruginosa PA01
cucgccgccagcagga

SEQ ID NO: 1515846 - RNA, 18 nt, Pseudomonas aeruginosa PA01
cucgccgccgaccgggcg

SEQ ID NO: 1515847 - RNA, 22 nt, Pseudomonas aeruginosa PA01
cucgccggcauuggcacccugg

SEQ ID NO: 1515848 - RNA, 15 nt, Pseudomonas aeruginosa PA01
cucgccaucggccug

SEQ ID NO: 1515849 - RNA, 17 nt, Pseudomonas aeruginosa PA01
cucgcccagcaggcgcg

SEQ ID NO: 1515850 - RNA, 13 nt, Pseudomonas aeruginosa PA01
cucgcccagggcg

SEQ ID NO: 1515851 - RNA, 15 nt, Pseudomonas aeruginosa PA01
cucgccagcgcgcgc

SEQ ID NO: 1515852 - RNA, 19 nt, Pseudomonas aeruginosa PA01
cucgccaccccgcuccgcu

SEQ ID NO: 1515853 - RNA, 23 nt, Pseudomonas aeruginosa PA01
cucgcagagcgccagccagcgcg

SEQ ID NO: 1515854 - RNA, 14 nt, Pseudomonas aeruginosa PA01
cucgcagccggcgg

SEQ ID NO: 1515855 - RNA, 23 nt, Pseudomonas aeruginosa PA01
cucgcagccgguggucuucagca

SEQ ID NO: 1515856 - RNA, 12 nt, Pseudomonas aeruginosa PA01
cucgcaccaggc

SEQ ID NO: 1515857 - RNA, 22 nt, Pseudomonas aeruginosa PA01
cucgcaauugaucauccaggac

SEQ ID NO: 1515858 - RNA, 19 nt, Pseudomonas aeruginosa PA01
cucgcaaguuacgcgcagc

SEQ ID NO: 1515859 - RNA, 18 nt, Pseudomonas aeruginosa PA01
cucgauguccgggaugcc

SEQ ID NO: 1515860 - RNA, 22 nt, Pseudomonas aeruginosa PA01
cucgauggugaacgccaggcag

SEQ ID NO: 1515861 - RNA, 16 nt, Pseudomonas aeruginosa PA01
cucgauggcggccugg

SEQ ID NO: 1515862 - RNA, 18 nt, Pseudomonas aeruginosa PA01
cucgauggccuugaggua

SEQ ID NO: 1515863 - RNA, 13 nt, Pseudomonas aeruginosa PA01
cucgacgagccgc

SEQ ID NO: 1515864 - RNA, 22 nt, Pseudomonas aeruginosa PA01
cucgacgagguugcucugggca

SEQ ID NO: 1515865 - RNA, 20 nt, Pseudomonas aeruginosa PA01
cucgacgauauccacgccgu

SEQ ID NO: 1515866 - RNA, 21 nt, Pseudomonas aeruginosa PA01
cucgacgcccgcuugcgccgc

SEQ ID NO: 1515867 - RNA, 22 nt, Pseudomonas aeruginosa PA01
cucgacgcccgcuugcgccgcc

SEQ ID NO: 1515868 - RNA, 16 nt, Pseudomonas aeruginosa PA01
cucgaugaacgcccug

SEQ ID NO: 1515869 - RNA, 14 nt, Pseudomonas aeruginosa PA01
cucgaugagcaugc

SEQ ID NO: 1515870 - RNA, 15 nt, Pseudomonas aeruginosa PA01
cucgaugauccacuu

SEQ ID NO: 1515871 - RNA, 23 nt, Pseudomonas aeruginosa PA01
cucgaugcccgccagcaggcgcc

SEQ ID NO: 1515872 - RNA, 16 nt, Pseudomonas aeruginosa PA01
cuccuccgacgccccc

SEQ ID NO: 1515873 - RNA, 14 nt, Pseudomonas aeruginosa PA01
cuccuccgccugca

SEQ ID NO: 1515874 - RNA, 20 nt, Pseudomonas aeruginosa PA01
cuccucauggcgucaacgaa

SEQ ID NO: 1515875 - RNA, 15 nt, Pseudomonas aeruginosa PA01
cuccuccagcaucca

SEQ ID NO: 1515876 - RNA, 23 nt, Pseudomonas aeruginosa PA01
cuccuccagcgccgccaggcgcg

SEQ ID NO: 1515877 - RNA, 16 nt, Pseudomonas aeruginosa PA01
cucgaacaccaggcgc

SEQ ID NO: 1515878 - RNA, 14 nt, Pseudomonas aeruginosa PA01
cucgaaccccuggc

SEQ ID NO: 1515879 - RNA, 15 nt, Pseudomonas aeruginosa PA01
cucgaaccccuggcg

SEQ ID NO: 1515880 - RNA, 16 nt, Pseudomonas aeruginosa PA01
cuccuccucgcuccag

SEQ ID NO: 1515881 - RNA, 23 nt, Pseudomonas aeruginosa PA01
cuccuccucgcucugcgccgcgg

SEQ ID NO: 1515882 - RNA, 15 nt, Pseudomonas aeruginosa PA01
cucgaacagcagcaa

SEQ ID NO: 1515883 - RNA, 21 nt, Pseudomonas aeruginosa PA01
cucgaacagcagcaagccgau

SEQ ID NO: 1515884 - RNA, 14 nt, Pseudomonas aeruginosa PA01
cucgaccuugcccu

SEQ ID NO: 1515885 - RNA, 15 nt, Pseudomonas aeruginosa PA01
cucgaccucggccgc

SEQ ID NO: 1515886 - RNA, 14 nt, Pseudomonas aeruginosa PA01
cucgaccugguagc

SEQ ID NO: 1515887 - RNA, 17 nt, Pseudomonas aeruginosa PA01
cucgaccaucggcggcg

SEQ ID NO: 1515888 - RNA, 13 nt, Pseudomonas aeruginosa PA01
cucgaaggccagc

SEQ ID NO: 1515889 - RNA, 16 nt, Pseudomonas aeruginosa PA01
cucgaagcccugcaaa

SEQ ID NO: 1515890 - RNA, 14 nt, Pseudomonas aeruginosa PA01
cucgaacgccgccc

SEQ ID NO: 1515891 - RNA, 17 nt, Pseudomonas aeruginosa PA01
cucgaacugcuccuggg

SEQ ID NO: 1515892 - RNA, 19 nt, Pseudomonas aeruginosa PA01
cucgaagcccagcgccugc

SEQ ID NO: 1515893 - RNA, 19 nt, Pseudomonas aeruginosa PA01
cucggggcgccuccagcgg

SEQ ID NO: 1515894 - RNA, 15 nt, Pseudomonas aeruginosa PA01
cucggguuuggcgcc

SEQ ID NO: 1515895 - RNA, 19 nt, Pseudomonas aeruginosa PA01
cucggguuuggcgcccgcc

SEQ ID NO: 1515896 - RNA, 19 nt, Pseudomonas aeruginosa PA01
cucgguauuguggccccag

SEQ ID NO: 1515897 - RNA, 17 nt, Pseudomonas aeruginosa PA01
cucgguauggcugcugu

SEQ ID NO: 1515898 - RNA, 20 nt, Pseudomonas aeruginosa PA01
cucgguagccggccaaccac

SEQ ID NO: 1515899 - RNA, 16 nt, Pseudomonas aeruginosa PA01
cucgguaaagcccagg

SEQ ID NO: 1515900 - RNA, 14 nt, Pseudomonas aeruginosa PA01
cucggugcgcccca

SEQ ID NO: 1515901 - RNA, 20 nt, Pseudomonas aeruginosa PA01
cucggugcggccgaggaacu

SEQ ID NO: 1515902 - RNA, 19 nt, Pseudomonas aeruginosa PA01
cucggugcagaugaccagc

SEQ ID NO: 1515903 - RNA, 17 nt, Pseudomonas aeruginosa PA01
cucgguguagcugaggc

SEQ ID NO: 1515904 - RNA, 16 nt, Pseudomonas aeruginosa PA01
cucgguguccaccacc

SEQ ID NO: 1515905 - RNA, 19 nt, Pseudomonas aeruginosa PA01
cucgguguccaccaccagc

SEQ ID NO: 1515906 - RNA, 18 nt, Pseudomonas aeruginosa PA01
cucggcuccagccaggcc

SEQ ID NO: 1515907 - RNA, 22 nt, Pseudomonas aeruginosa PA01
cucgggggugcccaucaggcuc

SEQ ID NO: 1515908 - RNA, 16 nt, Pseudomonas aeruginosa PA01
cucggggaaggucacc

SEQ ID NO: 1515909 - RNA, 20 nt, Pseudomonas aeruginosa PA01
cucggcguagccggccaggg

SEQ ID NO: 1515910 - RNA, 15 nt, Pseudomonas aeruginosa PA01
cucggcgucgcgcag

SEQ ID NO: 1515911 - RNA, 16 nt, Pseudomonas aeruginosa PA01
cucggcgugccgggcc

SEQ ID NO: 1515912 - RNA, 18 nt, Pseudomonas aeruginosa PA01
cucggcgugccgggccgg

SEQ ID NO: 1515913 - RNA, 13 nt, Pseudomonas aeruginosa PA01
cucggcgggagag

SEQ ID NO: 1515914 - RNA, 18 nt, Pseudomonas aeruginosa PA01
cucgcggcguaggccucg

SEQ ID NO: 1515915 - RNA, 16 nt, Pseudomonas aeruginosa PA01
cucgcggcuggccgcc

SEQ ID NO: 1515916 - RNA, 18 nt, Pseudomonas aeruginosa PA01
cucgcggcuggccgccuc

SEQ ID NO: 1515917 - RNA, 13 nt, Pseudomonas aeruginosa PA01
cucgcgggccgcc

SEQ ID NO: 1515918 - RNA, 15 nt, Pseudomonas aeruginosa PA01
cucgcgggccgccug

SEQ ID NO: 1515919 - RNA, 15 nt, Pseudomonas aeruginosa PA01
cucgcugacccaggc

SEQ ID NO: 1515920 - RNA, 16 nt, Pseudomonas aeruginosa PA01
cucgcugacccaggcu

SEQ ID NO: 1515921 - RNA, 20 nt, Pseudomonas aeruginosa PA01
cucgcgguaggccagcuccu

SEQ ID NO: 1515922 - RNA, 19 nt, Pseudomonas aeruginosa PA01
cucgcggaucugcuccugc

SEQ ID NO: 1515923 - RNA, 15 nt, Pseudomonas aeruginosa PA01
cucgcugcgcggguc

SEQ ID NO: 1515924 - RNA, 14 nt, Pseudomonas aeruginosa PA01
cucgcuguccagca

SEQ ID NO: 1515925 - RNA, 18 nt, Pseudomonas aeruginosa PA01
cucgcugucgccgagcac

SEQ ID NO: 1515926 - RNA, 17 nt, Pseudomonas aeruginosa PA01
cucgcugucgcucagcg

SEQ ID NO: 1515927 - RNA, 16 nt, Pseudomonas aeruginosa PA01
cucggcgaucucgccc

SEQ ID NO: 1515928 - RNA, 18 nt, Pseudomonas aeruginosa PA01
cucggcgaucucgcccag

SEQ ID NO: 1515929 - RNA, 14 nt, Pseudomonas aeruginosa PA01
cucggcgaugccgc

SEQ ID NO: 1515930 - RNA, 16 nt, Pseudomonas aeruginosa PA01
cucggcgaugccgccg

SEQ ID NO: 1515931 - RNA, 17 nt, Pseudomonas aeruginosa PA01
cucggcgcaggcaugga

SEQ ID NO: 1515932 - RNA, 19 nt, Pseudomonas aeruginosa PA01
cucggcgccauaggccagc

SEQ ID NO: 1515933 - RNA, 16 nt, Pseudomonas aeruginosa PA01
cucggcgcccugggug

SEQ ID NO: 1515934 - RNA, 13 nt, Pseudomonas aeruginosa PA01
cucggcgcccgcc

SEQ ID NO: 1515935 - RNA, 15 nt, Pseudomonas aeruginosa PA01
cucggcggacagccc

SEQ ID NO: 1515936 - RNA, 19 nt, Pseudomonas aeruginosa PA01
cucggcgcgauccuccgcc

SEQ ID NO: 1515937 - RNA, 14 nt, Pseudomonas aeruginosa PA01
cucguucgggcgcu

SEQ ID NO: 1515938 - RNA, 23 nt, Pseudomonas aeruginosa PA01
cucguugaguucgaagcgccagg

SEQ ID NO: 1515939 - RNA, 15 nt, Pseudomonas aeruginosa PA01
cucguugcaggcacg

SEQ ID NO: 1515940 - RNA, 15 nt, Pseudomonas aeruginosa PA01
cucguugcgccgcuc

SEQ ID NO: 1515941 - RNA, 15 nt, Pseudomonas aeruginosa PA01
cucguguuccggcag

SEQ ID NO: 1515942 - RNA, 24 nt, Pseudomonas aeruginosa PA01
cucgugcagguagccgcgccggcc

SEQ ID NO: 1515943 - RNA, 20 nt, Pseudomonas aeruginosa PA01
cucgugcaacggcacgaccu

SEQ ID NO: 1515944 - RNA, 18 nt, Pseudomonas aeruginosa PA01
cucgugccaucaggccgc

SEQ ID NO: 1515945 - RNA, 19 nt, Pseudomonas aeruginosa PA01
cucgugcagcaagccgcag

SEQ ID NO: 1515946 - RNA, 16 nt, Pseudomonas aeruginosa PA01
cucguggacccgugcg

SEQ ID NO: 1515947 - RNA, 22 nt, Pseudomonas aeruginosa PA01
cucguggacccgugcgccccag

SEQ ID NO: 1515948 - RNA, 17 nt, Pseudomonas aeruginosa PA01
cucgugcuccaccucgg

SEQ ID NO: 1515949 - RNA, 22 nt, Pseudomonas aeruginosa PA01
cucgugcuuggugucggccgcc

SEQ ID NO: 1515950 - RNA, 23 nt, Pseudomonas aeruginosa PA01
cucgugcuuggugucggccgcca

SEQ ID NO: 1515951 - RNA, 20 nt, Pseudomonas aeruginosa PA01
cucgucggcggggcgcaccg

SEQ ID NO: 1515952 - RNA, 22 nt, Pseudomonas aeruginosa PA01
cucgucggcggggcgcaccgcc

SEQ ID NO: 1515953 - RNA, 15 nt, Pseudomonas aeruginosa PA01
cucgguugccaggcc

SEQ ID NO: 1515954 - RNA, 16 nt, Pseudomonas aeruginosa PA01
cucgguugccaggccg

SEQ ID NO: 1515955 - RNA, 16 nt, Pseudomonas aeruginosa PA01
cucgguuuccaggaug

SEQ ID NO: 1515956 - RNA, 18 nt, Pseudomonas aeruginosa PA01
cucgguuuccggccaggc

SEQ ID NO: 1515957 - RNA, 13 nt, Pseudomonas aeruginosa PA01
cucgucguagucg

SEQ ID NO: 1515958 - RNA, 18 nt, Pseudomonas aeruginosa PA01
cuauuccggggacgcugu

SEQ ID NO: 1515959 - RNA, 20 nt, Pseudomonas aeruginosa PA01
cuauuccggggacgcugucc

SEQ ID NO: 1515960 - RNA, 21 nt, Pseudomonas aeruginosa PA01
cuauuccggggacgcuguccc

SEQ ID NO: 1515961 - RNA, 21 nt, Pseudomonas aeruginosa PA01
cuauggguggcccuuucaaug

SEQ ID NO: 1515962 - RNA, 17 nt, Pseudomonas aeruginosa PA01
cucacgccgaacuugua

SEQ ID NO: 1515963 - RNA, 15 nt, Pseudomonas aeruginosa PA01
cucaccaggcccgcc

SEQ ID NO: 1515964 - RNA, 14 nt, Pseudomonas aeruginosa PA01
cucaccaccaccgc

SEQ ID NO: 1515965 - RNA, 18 nt, Pseudomonas aeruginosa PA01
cucacaccaccagcauca

SEQ ID NO: 1515966 - RNA, 22 nt, Pseudomonas aeruginosa PA01
cucagccccgaucgccucggcc

SEQ ID NO: 1515967 - RNA, 14 nt, Pseudomonas aeruginosa PA01
cucagcccaggcgc

SEQ ID NO: 1515968 - RNA, 15 nt, Pseudomonas aeruginosa PA01
cucagccgaccaccu

SEQ ID NO: 1515969 - RNA, 17 nt, Pseudomonas aeruginosa PA01
cucagccgaccaccuuc

SEQ ID NO: 1515970 - RNA, 22 nt, Pseudomonas aeruginosa PA01
cucagccguggcacccaggcca

SEQ ID NO: 1515971 - RNA, 23 nt, Pseudomonas aeruginosa PA01
cucagccguggcacccaggccac

SEQ ID NO: 1515972 - RNA, 19 nt, Pseudomonas aeruginosa PA01
cucagccucacccugcugg

SEQ ID NO: 1515973 - RNA, 17 nt, Pseudomonas aeruginosa PA01
cucagcgccggccaggg

SEQ ID NO: 1515974 - RNA, 17 nt, Pseudomonas aeruginosa PA01
cucagcgccguugcggc

SEQ ID NO: 1515975 - RNA, 21 nt, Pseudomonas aeruginosa PA01
cucagcgccguugcggcagca

SEQ ID NO: 1515976 - RNA, 21 nt, Pseudomonas aeruginosa PA01
cucagcucggcgaugccgccg

SEQ ID NO: 1515977 - RNA, 15 nt, Pseudomonas aeruginosa PA01
cucagcucugucucc

SEQ ID NO: 1515978 - RNA, 17 nt, Pseudomonas aeruginosa PA01
cucagcuccaggccgcg

SEQ ID NO: 1515979 - RNA, 19 nt, Pseudomonas aeruginosa PA01
cucagcguccucagccuca

SEQ ID NO: 1515980 - RNA, 14 nt, Pseudomonas aeruginosa PA01
cucagcggcccagc

SEQ ID NO: 1515981 - RNA, 17 nt, Pseudomonas aeruginosa PA01
cucagcggaacauuucc

SEQ ID NO: 1515982 - RNA, 22 nt, Pseudomonas aeruginosa PA01
cucagcgcggcggcggccgcau

SEQ ID NO: 1515983 - RNA, 13 nt, Pseudomonas aeruginosa PA01
cucagcgccgcuu

SEQ ID NO: 1515984 - RNA, 19 nt, Pseudomonas aeruginosa PA01
cucagcgcgcucggccugg

SEQ ID NO: 1515985 - RNA, 20 nt, Pseudomonas aeruginosa PA01
cucacgugaccguccagcgc

SEQ ID NO: 1515986 - RNA, 21 nt, Pseudomonas aeruginosa PA01
cucacggguguuucggccgcu

SEQ ID NO: 1515987 - RNA, 20 nt, Pseudomonas aeruginosa PA01
cucacggcauucucucuuca

SEQ ID NO: 1515988 - RNA, 15 nt, Pseudomonas aeruginosa PA01
cucacggcgcagccg

SEQ ID NO: 1515989 - RNA, 22 nt, Pseudomonas aeruginosa PA01
cucagcaccuugugcugccugc

SEQ ID NO: 1515990 - RNA, 18 nt, Pseudomonas aeruginosa PA01
cucagaaauccaccuugc

SEQ ID NO: 1515991 - RNA, 20 nt, Pseudomonas aeruginosa PA01
cucagaacagcggcagcuca

SEQ ID NO: 1515992 - RNA, 18 nt, Pseudomonas aeruginosa PA01
cucagcaucagcgacagc

SEQ ID NO: 1515993 - RNA, 11 nt, Pseudomonas aeruginosa PA01
cucagaaguag

SEQ ID NO: 1515994 - RNA, 17 nt, Pseudomonas aeruginosa PA01
cucagcagcgccgcccu

SEQ ID NO: 1515995 - RNA, 22 nt, Pseudomonas aeruginosa PA01
cuaggaauaucuugcgcauggu

SEQ ID NO: 1515996 - RNA, 13 nt, Pseudomonas aeruginosa PA01
cuagucgagggga

SEQ ID NO: 1515997 - RNA, 18 nt, Pseudomonas aeruginosa PA01
cuacgcggcgggagguca

SEQ ID NO: 1515998 - RNA, 22 nt, Pseudomonas aeruginosa PA01
cuacgguacaguucaggcuggg

SEQ ID NO: 1515999 - RNA, 20 nt, Pseudomonas aeruginosa PA01
cuacguuccagggccuggua

SEQ ID NO: 1516000 - RNA, 18 nt, Pseudomonas aeruginosa PA01
cuagcccucgaccuggcu

SEQ ID NO: 1516001 - RNA, 14 nt, Pseudomonas aeruginosa PA01
cuagcccugcugcu

SEQ ID NO: 1516002 - RNA, 13 nt, Pseudomonas aeruginosa PA01
cuagcgcauggcg

SEQ ID NO: 1516003 - RNA, 20 nt, Pseudomonas aeruginosa PA01
cuaccgcugggacggcggcu

SEQ ID NO: 1516004 - RNA, 13 nt, Pseudomonas aeruginosa PA01
cuacccucucccc

SEQ ID NO: 1516005 - RNA, 13 nt, Pseudomonas aeruginosa PA01
cuaccggcaaggc

SEQ ID NO: 1516006 - RNA, 15 nt, Pseudomonas aeruginosa PA01
cuaccgcaucgccac

SEQ ID NO: 1516007 - RNA, 20 nt, Pseudomonas aeruginosa PA01
cuacccgacaggcagcgccg

SEQ ID NO: 1516008 - RNA, 19 nt, Pseudomonas aeruginosa PA01
cuaccaguaguucuccacc

SEQ ID NO: 1516009 - RNA, 13 nt, Pseudomonas aeruginosa PA01
cuaccagaccgca

SEQ ID NO: 1516010 - RNA, 12 nt, Pseudomonas aeruginosa PA01
cuaccagcaauu

SEQ ID NO: 1516011 - RNA, 13 nt, Pseudomonas aeruginosa PA01
cuaccagcaauuc

SEQ ID NO: 1516012 - RNA, 13 nt, Pseudomonas aeruginosa PA01
cguaccaguagcg

SEQ ID NO: 1516013 - RNA, 17 nt, Pseudomonas aeruginosa PA01
cguacccgcccuacgca

SEQ ID NO: 1516014 - RNA, 14 nt, Pseudomonas aeruginosa PA01
cguaccucgccagg

SEQ ID NO: 1516015 - RNA, 15 nt, Pseudomonas aeruginosa PA01
cguaccuucgagcag

SEQ ID NO: 1516016 - RNA, 14 nt, Pseudomonas aeruginosa PA01
cguacgcccagcag

SEQ ID NO: 1516017 - RNA, 15 nt, Pseudomonas aeruginosa PA01
cguacgcccgcagcc

SEQ ID NO: 1516018 - RNA, 14 nt, Pseudomonas aeruginosa PA01
cguacgcaccgcgu

SEQ ID NO: 1516019 - RNA, 15 nt, Pseudomonas aeruginosa PA01
cguacuccagcaacg

SEQ ID NO: 1516020 - RNA, 22 nt, Pseudomonas aeruginosa PA01
cguacuugaaggugcccagggc

SEQ ID NO: 1516021 - RNA, 22 nt, Pseudomonas aeruginosa PA01
cggcguacgaaccccgggccgc

SEQ ID NO: 1516022 - RNA, 16 nt, Pseudomonas aeruginosa PA01
cguaccaggaugcccu

SEQ ID NO: 1516023 - RNA, 12 nt, Pseudomonas aeruginosa PA01
cguaccagcgcg

SEQ ID NO: 1516024 - RNA, 14 nt, Pseudomonas aeruginosa PA01
cguaccagcgcgca

SEQ ID NO: 1516025 - RNA, 15 nt, Pseudomonas aeruginosa PA01
cguaccagccgcggu

SEQ ID NO: 1516026 - RNA, 16 nt, Pseudomonas aeruginosa PA01
cguacaccgcgcggca

SEQ ID NO: 1516027 - RNA, 21 nt, Pseudomonas aeruginosa PA01
cguagguuuccggguccugga

SEQ ID NO: 1516028 - RNA, 21 nt, Pseudomonas aeruginosa PA01
cguauccaagagagcgccagc

SEQ ID NO: 1516029 - RNA, 24 nt, Pseudomonas aeruginosa PA01
cguaggcgaacacgucggcgcgca

SEQ ID NO: 1516030 - RNA, 15 nt, Pseudomonas aeruginosa PA01
cguaggagccggcca

SEQ ID NO: 1516031 - RNA, 20 nt, Pseudomonas aeruginosa PA01
cguaggccaguucgcugacc

SEQ ID NO: 1516032 - RNA, 21 nt, Pseudomonas aeruginosa PA01
cguaggccacuucccggcgca

SEQ ID NO: 1516033 - RNA, 15 nt, Pseudomonas aeruginosa PA01
cguagguggauugca

SEQ ID NO: 1516034 - RNA, 20 nt, Pseudomonas aeruginosa PA01
cguagggcgaacaacgccgc

SEQ ID NO: 1516035 - RNA, 22 nt, Pseudomonas aeruginosa PA01
cguagggcgaacaacgccgccg

SEQ ID NO: 1516036 - RNA, 21 nt, Pseudomonas aeruginosa PA01
cguagagcuugcugaagcccc

SEQ ID NO: 1516037 - RNA, 18 nt, Pseudomonas aeruginosa PA01
cguagaggcucggcggcc

SEQ ID NO: 1516038 - RNA, 17 nt, Pseudomonas aeruginosa PA01
cguagaccggcuccagg

SEQ ID NO: 1516039 - RNA, 13 nt, Pseudomonas aeruginosa PA01
cguagaccaccag

SEQ ID NO: 1516040 - RNA, 16 nt, Pseudomonas aeruginosa PA01
cguagaccaccagcag

SEQ ID NO: 1516041 - RNA, 18 nt, Pseudomonas aeruginosa PA01
cguagaccaccagcagca

SEQ ID NO: 1516042 - RNA, 23 nt, Pseudomonas aeruginosa PA01
cguagcuguucucuuugaccuug

SEQ ID NO: 1516043 - RNA, 15 nt, Pseudomonas aeruginosa PA01
cguagccggccaggg

SEQ ID NO: 1516044 - RNA, 19 nt, Pseudomonas aeruginosa PA01
cguagccguagauggucag

SEQ ID NO: 1516045 - RNA, 21 nt, Pseudomonas aeruginosa PA01
cguagccgucgaacagcagcu

SEQ ID NO: 1516046 - RNA, 14 nt, Pseudomonas aeruginosa PA01
cguagccgcgcgcc

SEQ ID NO: 1516047 - RNA, 17 nt, Pseudomonas aeruginosa PA01
cguagccgcgcgccagc

SEQ ID NO: 1516048 - RNA, 18 nt, Pseudomonas aeruginosa PA01
cguccgccagguccaggc

SEQ ID NO: 1516049 - RNA, 19 nt, Pseudomonas aeruginosa PA01
cguccgcccaguucgccgg

SEQ ID NO: 1516050 - RNA, 12 nt, Pseudomonas aeruginosa PA01
cguccgcagcac

SEQ ID NO: 1516051 - RNA, 23 nt, Pseudomonas aeruginosa PA01
cguccgagagcagggccuggccc

SEQ ID NO: 1516052 - RNA, 13 nt, Pseudomonas aeruginosa PA01
cguccgaacgcgc

SEQ ID NO: 1516053 - RNA, 15 nt, Pseudomonas aeruginosa PA01
cgucccuugcgggua

SEQ ID NO: 1516054 - RNA, 23 nt, Pseudomonas aeruginosa PA01
cgucccuuguuuuccuggcccug

SEQ ID NO: 1516055 - RNA, 19 nt, Pseudomonas aeruginosa PA01
cgucccguuccgcucacca

SEQ ID NO: 1516056 - RNA, 17 nt, Pseudomonas aeruginosa PA01
cgucccguuccggcgca

SEQ ID NO: 1516057 - RNA, 19 nt, Pseudomonas aeruginosa PA01
cgucccguuccggcgcagc

SEQ ID NO: 1516058 - RNA, 17 nt, Pseudomonas aeruginosa PA01
cgucccugcccgcgccu

SEQ ID NO: 1516059 - RNA, 17 nt, Pseudomonas aeruginosa PA01
cguccccuuccuccucg

SEQ ID NO: 1516060 - RNA, 13 nt, Pseudomonas aeruginosa PA01
cgucccgcuccag

SEQ ID NO: 1516061 - RNA, 15 nt, Pseudomonas aeruginosa PA01
cgucccggcgccgcc

SEQ ID NO: 1516062 - RNA, 19 nt, Pseudomonas aeruginosa PA01
cgucccggguucugcucga

SEQ ID NO: 1516063 - RNA, 19 nt, Pseudomonas aeruginosa PA01
cgucccgcgcgccgagccc

SEQ ID NO: 1516064 - RNA, 21 nt, Pseudomonas aeruginosa PA01
cguccagaugcuugcacaccu

SEQ ID NO: 1516065 - RNA, 16 nt, Pseudomonas aeruginosa PA01
cgucaugaccagagcc

SEQ ID NO: 1516066 - RNA, 16 nt, Pseudomonas aeruginosa PA01
cgucaugccgccgucg

SEQ ID NO: 1516067 - RNA, 21 nt, Pseudomonas aeruginosa PA01
cguccaccgaguggcgcagcg

SEQ ID NO: 1516068 - RNA, 13 nt, Pseudomonas aeruginosa PA01
cguccaccauaaa

SEQ ID NO: 1516069 - RNA, 15 nt, Pseudomonas aeruginosa PA01
cguccaccagccagc

SEQ ID NO: 1516070 - RNA, 18 nt, Pseudomonas aeruginosa PA01
cguccacggcgcgucggc

SEQ ID NO: 1516071 - RNA, 20 nt, Pseudomonas aeruginosa PA01
cguccacuccggcagcaccc

SEQ ID NO: 1516072 - RNA, 21 nt, Pseudomonas aeruginosa PA01
cguccacuccggcagcacccg

SEQ ID NO: 1516073 - RNA, 18 nt, Pseudomonas aeruginosa PA01
cgucacuguuuuccaugg

SEQ ID NO: 1516074 - RNA, 19 nt, Pseudomonas aeruginosa PA01
cgucacuucacgacaggcg

SEQ ID NO: 1516075 - RNA, 13 nt, Pseudomonas aeruginosa PA01
cgucacuugaagu

SEQ ID NO: 1516076 - RNA, 13 nt, Pseudomonas aeruginosa PA01
cgucaggccuugc

SEQ ID NO: 1516077 - RNA, 14 nt, Pseudomonas aeruginosa PA01
cgucaccggcgcca

SEQ ID NO: 1516078 - RNA, 12 nt, Pseudomonas aeruginosa PA01
cgugccuccagc

SEQ ID NO: 1516079 - RNA, 12 nt, Pseudomonas aeruginosa PA01
cgugcuccagca

SEQ ID NO: 1516080 - RNA, 20 nt, Pseudomonas aeruginosa PA01
cgugcucgcggaccagcucc

SEQ ID NO: 1516081 - RNA, 14 nt, Pseudomonas aeruginosa PA01
cgugccgggccggc

SEQ ID NO: 1516082 - RNA, 19 nt, Pseudomonas aeruginosa PA01
cgugccgggccggccaggg

SEQ ID NO: 1516083 - RNA, 14 nt, Pseudomonas aeruginosa PA01
cgugccggucgcgc

SEQ ID NO: 1516084 - RNA, 21 nt, Pseudomonas aeruginosa PA01
cgugccgccaucgccucgccg

SEQ ID NO: 1516085 - RNA, 23 nt, Pseudomonas aeruginosa PA01
cgugcccgccggcgcgcccaggc

SEQ ID NO: 1516086 - RNA, 15 nt, Pseudomonas aeruginosa PA01
cgugccccguggcgg

SEQ ID NO: 1516087 - RNA, 17 nt, Pseudomonas aeruginosa PA01
cgugccccguggcgggc

SEQ ID NO: 1516088 - RNA, 14 nt, Pseudomonas aeruginosa PA01
cgugccccaggccg

SEQ ID NO: 1516089 - RNA, 14 nt, Pseudomonas aeruginosa PA01
cgugaggcgcgcgc

SEQ ID NO: 1516090 - RNA, 14 nt, Pseudomonas aeruginosa PA01
cgugagcuugucca

SEQ ID NO: 1516091 - RNA, 22 nt, Pseudomonas aeruginosa PA01
cgugcagcucggcacgcagcag

SEQ ID NO: 1516092 - RNA, 12 nt, Pseudomonas aeruginosa PA01
cgugcagcagcg

SEQ ID NO: 1516093 - RNA, 14 nt, Pseudomonas aeruginosa PA01
cgugcagcagcgcc

SEQ ID NO: 1516094 - RNA, 19 nt, Pseudomonas aeruginosa PA01
cgugcaucaccggcagcag

SEQ ID NO: 1516095 - RNA, 22 nt, Pseudomonas aeruginosa PA01
cgugcaguacuuggccagcagc

SEQ ID NO: 1516096 - RNA, 14 nt, Pseudomonas aeruginosa PA01
cgugcagcggcagc

SEQ ID NO: 1516097 - RNA, 13 nt, Pseudomonas aeruginosa PA01
cgugaagccccug

SEQ ID NO: 1516098 - RNA, 14 nt, Pseudomonas aeruginosa PA01
cgugaagccgccgc

SEQ ID NO: 1516099 - RNA, 16 nt, Pseudomonas aeruginosa PA01
cgugaagccgccgccc

SEQ ID NO: 1516100 - RNA, 22 nt, Pseudomonas aeruginosa PA01
cgugaagccgccgcccagcagc

SEQ ID NO: 1516101 - RNA, 23 nt, Pseudomonas aeruginosa PA01
cgugaagccgccgcccagcagca

SEQ ID NO: 1516102 - RNA, 16 nt, Pseudomonas aeruginosa PA01
cgugaagcuggagcag

SEQ ID NO: 1516103 - RNA, 21 nt, Pseudomonas aeruginosa PA01
cgugaagcuggagcagcagcg

SEQ ID NO: 1516104 - RNA, 20 nt, Pseudomonas aeruginosa PA01
cgucuccgccgcuaucgccg

SEQ ID NO: 1516105 - RNA, 17 nt, Pseudomonas aeruginosa PA01
cgucucauggaacagca

SEQ ID NO: 1516106 - RNA, 22 nt, Pseudomonas aeruginosa PA01
cgucucauggaacagcagccag

SEQ ID NO: 1516107 - RNA, 15 nt, Pseudomonas aeruginosa PA01
cgucuccaggcgcgc

SEQ ID NO: 1516108 - RNA, 19 nt, Pseudomonas aeruginosa PA01
cgucucggcugccgccagc

SEQ ID NO: 1516109 - RNA, 20 nt, Pseudomonas aeruginosa PA01
cgucuucgauggcggccgcc

SEQ ID NO: 1516110 - RNA, 21 nt, Pseudomonas aeruginosa PA01
cgucugugccgaggccgccgc

SEQ ID NO: 1516111 - RNA, 14 nt, Pseudomonas aeruginosa PA01
cgucugggacggca

SEQ ID NO: 1516112 - RNA, 15 nt, Pseudomonas aeruginosa PA01
cgucugggacggcag

SEQ ID NO: 1516113 - RNA, 21 nt, Pseudomonas aeruginosa PA01
cgucugggacggcagccuggg

SEQ ID NO: 1516114 - RNA, 22 nt, Pseudomonas aeruginosa PA01
cgucgggaucgagcaacagcag

SEQ ID NO: 1516115 - RNA, 19 nt, Pseudomonas aeruginosa PA01
cgucgggaaaggccgccac

SEQ ID NO: 1516116 - RNA, 17 nt, Pseudomonas aeruginosa PA01
cgucggcgcggccggcg

SEQ ID NO: 1516117 - RNA, 13 nt, Pseudomonas aeruginosa PA01
cgucggcggcgga

SEQ ID NO: 1516118 - RNA, 18 nt, Pseudomonas aeruginosa PA01
cgucggcgggaagggucu

SEQ ID NO: 1516119 - RNA, 21 nt, Pseudomonas aeruginosa PA01
cgucggcggcacccucuuccg

SEQ ID NO: 1516120 - RNA, 23 nt, Pseudomonas aeruginosa PA01
cgucgggcgaaacggcaggccag

SEQ ID NO: 1516121 - RNA, 18 nt, Pseudomonas aeruginosa PA01
cgucggggugccgccagu

SEQ ID NO: 1516122 - RNA, 18 nt, Pseudomonas aeruginosa PA01
cgucguacucggcggggc

SEQ ID NO: 1516123 - RNA, 21 nt, Pseudomonas aeruginosa PA01
cgucguagccaggcaccaccu

SEQ ID NO: 1516124 - RNA, 18 nt, Pseudomonas aeruginosa PA01
cgucguaguggccgucga

SEQ ID NO: 1516125 - RNA, 19 nt, Pseudomonas aeruginosa PA01
cgucgucaccucggcgcca

SEQ ID NO: 1516126 - RNA, 23 nt, Pseudomonas aeruginosa PA01
cgucguccaccgaguggcgcagc

SEQ ID NO: 1516127 - RNA, 15 nt, Pseudomonas aeruginosa PA01
cgucguccggcgcca

SEQ ID NO: 1516128 - RNA, 22 nt, Pseudomonas aeruginosa PA01
cgucgucggagauagccuccuc

SEQ ID NO: 1516129 - RNA, 16 nt, Pseudomonas aeruginosa PA01
cgucguuuuguccggc

SEQ ID NO: 1516130 - RNA, 22 nt, Pseudomonas aeruginosa PA01
cgucgccacgcccgccguggcg

SEQ ID NO: 1516131 - RNA, 14 nt, Pseudomonas aeruginosa PA01
cgucgccaacgcgc

SEQ ID NO: 1516132 - RNA, 21 nt, Pseudomonas aeruginosa PA01
cguccgcgaugcguuccaggg

SEQ ID NO: 1516133 - RNA, 13 nt, Pseudomonas aeruginosa PA01
cguccgcgcaggc

SEQ ID NO: 1516134 - RNA, 23 nt, Pseudomonas aeruginosa PA01
cgucgcaccugggacucccgcag

SEQ ID NO: 1516135 - RNA, 15 nt, Pseudomonas aeruginosa PA01
cgucgcacugcugcu

SEQ ID NO: 1516136 - RNA, 17 nt, Pseudomonas aeruginosa PA01
cgucgcagagacgcagc

SEQ ID NO: 1516137 - RNA, 17 nt, Pseudomonas aeruginosa PA01
cgucgccaugcggcagg

SEQ ID NO: 1516138 - RNA, 20 nt, Pseudomonas aeruginosa PA01
cgucgccaugcggcaggccu

SEQ ID NO: 1516139 - RNA, 16 nt, Pseudomonas aeruginosa PA01
cgucgcccaggccgcu

SEQ ID NO: 1516140 - RNA, 14 nt, Pseudomonas aeruginosa PA01
cgucgccccaggga

SEQ ID NO: 1516141 - RNA, 17 nt, Pseudomonas aeruginosa PA01
cgucgccgaacggcagc

SEQ ID NO: 1516142 - RNA, 13 nt, Pseudomonas aeruginosa PA01
cgucgccgaccag

SEQ ID NO: 1516143 - RNA, 13 nt, Pseudomonas aeruginosa PA01
cgucgccgaugcg

SEQ ID NO: 1516144 - RNA, 13 nt, Pseudomonas aeruginosa PA01
cgucgcgcggcca

SEQ ID NO: 1516145 - RNA, 14 nt, Pseudomonas aeruginosa PA01
cgucgcgcggccag

SEQ ID NO: 1516146 - RNA, 17 nt, Pseudomonas aeruginosa PA01
cgucgcgcggccagcgu

SEQ ID NO: 1516147 - RNA, 18 nt, Pseudomonas aeruginosa PA01
cgucgcgcguccagccgg

SEQ ID NO: 1516148 - RNA, 21 nt, Pseudomonas aeruginosa PA01
cgucgcggagaauccgcucgg

SEQ ID NO: 1516149 - RNA, 21 nt, Pseudomonas aeruginosa PA01
cgucgccggaggggcggccgc

SEQ ID NO: 1516150 - RNA, 17 nt, Pseudomonas aeruginosa PA01
cgucgccgccgaggcgc

SEQ ID NO: 1516151 - RNA, 19 nt, Pseudomonas aeruginosa PA01
cgucgcccucggcgcuggc

SEQ ID NO: 1516152 - RNA, 17 nt, Pseudomonas aeruginosa PA01
cgucgccgcccggcagc

SEQ ID NO: 1516153 - RNA, 13 nt, Pseudomonas aeruginosa PA01
cgucggcagccau

SEQ ID NO: 1516154 - RNA, 21 nt, Pseudomonas aeruginosa PA01
cgucggccuggcgcagcggca

SEQ ID NO: 1516155 - RNA, 12 nt, Pseudomonas aeruginosa PA01
cgucggccuuga

SEQ ID NO: 1516156 - RNA, 14 nt, Pseudomonas aeruginosa PA01
cgucggcccucccc

SEQ ID NO: 1516157 - RNA, 13 nt, Pseudomonas aeruginosa PA01
cgucggcgacgcu

SEQ ID NO: 1516158 - RNA, 12 nt, Pseudomonas aeruginosa PA01
cgucggcgcccu

SEQ ID NO: 1516159 - RNA, 14 nt, Pseudomonas aeruginosa PA01
cgucgcugcacgca

SEQ ID NO: 1516160 - RNA, 14 nt, Pseudomonas aeruginosa PA01
cgucgcugccgccg

SEQ ID NO: 1516161 - RNA, 18 nt, Pseudomonas aeruginosa PA01
cgucgcugccgccgcgcc

SEQ ID NO: 1516162 - RNA, 17 nt, Pseudomonas aeruginosa PA01
cgucgcuggagcugcgc

SEQ ID NO: 1516163 - RNA, 22 nt, Pseudomonas aeruginosa PA01
cgucggauggccguccaggcug

SEQ ID NO: 1516164 - RNA, 17 nt, Pseudomonas aeruginosa PA01
cgucggagauagccucc

SEQ ID NO: 1516165 - RNA, 17 nt, Pseudomonas aeruginosa PA01
cgucgcuuccggcgcca

SEQ ID NO: 1516166 - RNA, 20 nt, Pseudomonas aeruginosa PA01
cgucgcuauggugagguugu

SEQ ID NO: 1516167 - RNA, 15 nt, Pseudomonas aeruginosa PA01
cgucgcgcgccggag

SEQ ID NO: 1516168 - RNA, 15 nt, Pseudomonas aeruginosa PA01
cgucgcggcgccugg

SEQ ID NO: 1516169 - RNA, 20 nt, Pseudomonas aeruginosa PA01
cuaauuucaugucugcaacc

SEQ ID NO: 1516170 - RNA, 17 nt, Pseudomonas aeruginosa PA01
cuaauggcaccuggaua

SEQ ID NO: 1516171 - RNA, 12 nt, Pseudomonas aeruginosa PA01
cguuguccaggg

SEQ ID NO: 1516172 - RNA, 20 nt, Pseudomonas aeruginosa PA01
cguugucccugucccgccgc

SEQ ID NO: 1516173 - RNA, 16 nt, Pseudomonas aeruginosa PA01
cguugucggccagcag

SEQ ID NO: 1516174 - RNA, 17 nt, Pseudomonas aeruginosa PA01
cguugucggccagcagc

SEQ ID NO: 1516175 - RNA, 18 nt, Pseudomonas aeruginosa PA01
cguugucggccagcagca

SEQ ID NO: 1516176 - RNA, 13 nt, Pseudomonas aeruginosa PA01
cguuguaggaaaa

SEQ ID NO: 1516177 - RNA, 18 nt, Pseudomonas aeruginosa PA01
cguuguagaucggcagca

SEQ ID NO: 1516178 - RNA, 21 nt, Pseudomonas aeruginosa PA01
cguugugauuggguuccucua

SEQ ID NO: 1516179 - RNA, 13 nt, Pseudomonas aeruginosa PA01
cguugccagccgg

SEQ ID NO: 1516180 - RNA, 15 nt, Pseudomonas aeruginosa PA01
cguugccagccggcc

SEQ ID NO: 1516181 - RNA, 17 nt, Pseudomonas aeruginosa PA01
cguugcauguccucggc

SEQ ID NO: 1516182 - RNA, 15 nt, Pseudomonas aeruginosa PA01
cguugcaguccaggc

SEQ ID NO: 1516183 - RNA, 16 nt, Pseudomonas aeruginosa PA01
cguugcagugcgccgc

SEQ ID NO: 1516184 - RNA, 14 nt, Pseudomonas aeruginosa PA01
cguugcccagcccc

SEQ ID NO: 1516185 - RNA, 15 nt, Pseudomonas aeruginosa PA01
cguugcaggcccagc

SEQ ID NO: 1516186 - RNA, 13 nt, Pseudomonas aeruginosa PA01
cguuucucagcgc

SEQ ID NO: 1516187 - RNA, 16 nt, Pseudomonas aeruginosa PA01
cguuuccggucacgca

SEQ ID NO: 1516188 - RNA, 17 nt, Pseudomonas aeruginosa PA01
cguuucccggcgcggcu

SEQ ID NO: 1516189 - RNA, 16 nt, Pseudomonas aeruginosa PA01
cguuguugccgcgcac

SEQ ID NO: 1516190 - RNA, 14 nt, Pseudomonas aeruginosa PA01
cuaaacaagccacc

SEQ ID NO: 1516191 - RNA, 15 nt, Pseudomonas aeruginosa PA01
cguuuuuucuuucca

SEQ ID NO: 1516192 - RNA, 14 nt, Pseudomonas aeruginosa PA01
cguuuuuuuauccu

SEQ ID NO: 1516193 - RNA, 17 nt, Pseudomonas aeruginosa PA01
cguuuucuuuugcaauc

SEQ ID NO: 1516194 - RNA, 15 nt, Pseudomonas aeruginosa PA01
cguggaugucgagga

SEQ ID NO: 1516195 - RNA, 15 nt, Pseudomonas aeruginosa PA01
cgugcugggucuccu

SEQ ID NO: 1516196 - RNA, 23 nt, Pseudomonas aeruginosa PA01
cgugcuuacggagaagggcgcgc

SEQ ID NO: 1516197 - RNA, 12 nt, Pseudomonas aeruginosa PA01
cgugcuucucac

SEQ ID NO: 1516198 - RNA, 19 nt, Pseudomonas aeruginosa PA01
cguggcauucgucgccgcu

SEQ ID NO: 1516199 - RNA, 14 nt, Pseudomonas aeruginosa PA01
cguuagcucagucg

SEQ ID NO: 1516200 - RNA, 18 nt, Pseudomonas aeruginosa PA01
cguuaccgcgggcucagg

SEQ ID NO: 1516201 - RNA, 23 nt, Pseudomonas aeruginosa PA01
cguuacggguggcaugggccagu

SEQ ID NO: 1516202 - RNA, 22 nt, Pseudomonas aeruginosa PA01
cguuauccgccccaccccaggg

SEQ ID NO: 1516203 - RNA, 14 nt, Pseudomonas aeruginosa PA01
cguucaccccgccc

SEQ ID NO: 1516204 - RNA, 15 nt, Pseudomonas aeruginosa PA01
cguucagcagcaugc

SEQ ID NO: 1516205 - RNA, 17 nt, Pseudomonas aeruginosa PA01
cguucaggcuguugccc

SEQ ID NO: 1516206 - RNA, 12 nt, Pseudomonas aeruginosa PA01
cguucaguucug

SEQ ID NO: 1516207 - RNA, 17 nt, Pseudomonas aeruginosa PA01
cguucaguugccucugu

SEQ ID NO: 1516208 - RNA, 14 nt, Pseudomonas aeruginosa PA01
cguucccagcagcg

SEQ ID NO: 1516209 - RNA, 21 nt, Pseudomonas aeruginosa PA01
cguucaucgucggcagccauc

SEQ ID NO: 1516210 - RNA, 19 nt, Pseudomonas aeruginosa PA01
cguucggggcccuccaggc

SEQ ID NO: 1516211 - RNA, 20 nt, Pseudomonas aeruginosa PA01
cguucggggcccuccaggcg

SEQ ID NO: 1516212 - RNA, 19 nt, Pseudomonas aeruginosa PA01
cguuccgcucaccaggccc

SEQ ID NO: 1516213 - RNA, 15 nt, Pseudomonas aeruginosa PA01
cguucccggccuggc

SEQ ID NO: 1516214 - RNA, 15 nt, Pseudomonas aeruginosa PA01
cguucccggucgagg

SEQ ID NO: 1516215 - RNA, 19 nt, Pseudomonas aeruginosa PA01
cguuccuggaagccgaucg

SEQ ID NO: 1516216 - RNA, 16 nt, Pseudomonas aeruginosa PA01
cguucgucaccggcgc

SEQ ID NO: 1516217 - RNA, 18 nt, Pseudomonas aeruginosa PA01
cguucucccugagccugu

SEQ ID NO: 1516218 - RNA, 20 nt, Pseudomonas aeruginosa PA01
cguugaucggcaacgagcag

SEQ ID NO: 1516219 - RNA, 21 nt, Pseudomonas aeruginosa PA01
cugaccgcgaauggcagcagg

SEQ ID NO: 1516220 - RNA, 15 nt, Pseudomonas aeruginosa PA01
cugaccgcgagcgcc

SEQ ID NO: 1516221 - RNA, 13 nt, Pseudomonas aeruginosa PA01
cugaccguccugg

SEQ ID NO: 1516222 - RNA, 18 nt, Pseudomonas aeruginosa PA01
cugaccguccuggcccug

SEQ ID NO: 1516223 - RNA, 17 nt, Pseudomonas aeruginosa PA01
cugacgucgacgcagcg

SEQ ID NO: 1516224 - RNA, 21 nt, Pseudomonas aeruginosa PA01
cugacguugccgcgcgggccg

SEQ ID NO: 1516225 - RNA, 20 nt, Pseudomonas aeruginosa PA01
cugacuuccaucagcuccac

SEQ ID NO: 1516226 - RNA, 17 nt, Pseudomonas aeruginosa PA01
cugacgaugcagggcug

SEQ ID NO: 1516227 - RNA, 17 nt, Pseudomonas aeruginosa PA01
cugacgaugaagcccca

SEQ ID NO: 1516228 - RNA, 19 nt, Pseudomonas aeruginosa PA01
cugacgaugaagccccagc

SEQ ID NO: 1516229 - RNA, 15 nt, Pseudomonas aeruginosa PA01
cugacggcguggcgg

SEQ ID NO: 1516230 - RNA, 16 nt, Pseudomonas aeruginosa PA01
cugacggcguggcgga

SEQ ID NO: 1516231 - RNA, 20 nt, Pseudomonas aeruginosa PA01
cugacggucugccagcucug

SEQ ID NO: 1516232 - RNA, 16 nt, Pseudomonas aeruginosa PA01
cucuacuaccgccagc

SEQ ID NO: 1516233 - RNA, 22 nt, Pseudomonas aeruginosa PA01
cucuaccaggcgguuggcccgc

SEQ ID NO: 1516234 - RNA, 15 nt, Pseudomonas aeruginosa PA01
cugaguuugcccagc

SEQ ID NO: 1516235 - RNA, 20 nt, Pseudomonas aeruginosa PA01
cugaggccgguguagcgacg

SEQ ID NO: 1516236 - RNA, 22 nt, Pseudomonas aeruginosa PA01
cugaggguggaacccauggcgc

SEQ ID NO: 1516237 - RNA, 15 nt, Pseudomonas aeruginosa PA01
cugaggacugccagg

SEQ ID NO: 1516238 - RNA, 14 nt, Pseudomonas aeruginosa PA01
cugaggaucagcca

SEQ ID NO: 1516239 - RNA, 15 nt, Pseudomonas aeruginosa PA01
cugaggaucagccag

SEQ ID NO: 1516240 - RNA, 20 nt, Pseudomonas aeruginosa PA01
cugaggcucccagguggaaa

SEQ ID NO: 1516241 - RNA, 17 nt, Pseudomonas aeruginosa PA01
cugaggccgacgaacag

SEQ ID NO: 1516242 - RNA, 15 nt, Pseudomonas aeruginosa PA01
cugagcuggcccagu

SEQ ID NO: 1516243 - RNA, 21 nt, Pseudomonas aeruginosa PA01
cugagccucuaaggaaaaacc

SEQ ID NO: 1516244 - RNA, 23 nt, Pseudomonas aeruginosa PA01
cugauaucguuguucagcagggu

SEQ ID NO: 1516245 - RNA, 19 nt, Pseudomonas aeruginosa PA01
cugcaccuuggccacgcug

SEQ ID NO: 1516246 - RNA, 23 nt, Pseudomonas aeruginosa PA01
cugcacgcccaggcgcucggcga

SEQ ID NO: 1516247 - RNA, 15 nt, Pseudomonas aeruginosa PA01
cugcacgcugcgccg

SEQ ID NO: 1516248 - RNA, 20 nt, Pseudomonas aeruginosa PA01
cugcacguggaguucaccgu

SEQ ID NO: 1516249 - RNA, 17 nt, Pseudomonas aeruginosa PA01
cugcacggauaccaccc

SEQ ID NO: 1516250 - RNA, 15 nt, Pseudomonas aeruginosa PA01
cugcaccgggccgac

SEQ ID NO: 1516251 - RNA, 16 nt, Pseudomonas aeruginosa PA01
cugcaccgucauggug

SEQ ID NO: 1516252 - RNA, 14 nt, Pseudomonas aeruginosa PA01
cugcaccgcccagc

SEQ ID NO: 1516253 - RNA, 22 nt, Pseudomonas aeruginosa PA01
cugcaacacguagcgcaggucg

SEQ ID NO: 1516254 - RNA, 20 nt, Pseudomonas aeruginosa PA01
cugcaacauggcgucggcga

SEQ ID NO: 1516255 - RNA, 23 nt, Pseudomonas aeruginosa PA01
cugcaacaguggguaggccaggc

SEQ ID NO: 1516256 - RNA, 22 nt, Pseudomonas aeruginosa PA01
cugcaacagaaguugcuggcga

SEQ ID NO: 1516257 - RNA, 14 nt, Pseudomonas aeruginosa PA01
cugcaacaggaccc

SEQ ID NO: 1516258 - RNA, 21 nt, Pseudomonas aeruginosa PA01
cugcaccaggcucgccccggc

SEQ ID NO: 1516259 - RNA, 23 nt, Pseudomonas aeruginosa PA01
cugcaccaggcucgccccggcgg

SEQ ID NO: 1516260 - RNA, 13 nt, Pseudomonas aeruginosa PA01
cugcaccagcuuc

SEQ ID NO: 1516261 - RNA, 14 nt, Pseudomonas aeruginosa PA01
cugcaccagccagu

SEQ ID NO: 1516262 - RNA, 14 nt, Pseudomonas aeruginosa PA01
cugcaccacgcagg

SEQ ID NO: 1516263 - RNA, 13 nt, Pseudomonas aeruginosa PA01
cugcacagggacg

SEQ ID NO: 1516264 - RNA, 19 nt, Pseudomonas aeruginosa PA01
cugcacagggacgcggcgu

SEQ ID NO: 1516265 - RNA, 17 nt, Pseudomonas aeruginosa PA01
cugcagauaaagcugga

SEQ ID NO: 1516266 - RNA, 23 nt, Pseudomonas aeruginosa PA01
cugcagauaaagcuggaccaccg

SEQ ID NO: 1516267 - RNA, 22 nt, Pseudomonas aeruginosa PA01
cugcagcaccaccucgccaagc

SEQ ID NO: 1516268 - RNA, 15 nt, Pseudomonas aeruginosa PA01
cugcagccagcuuca

SEQ ID NO: 1516269 - RNA, 16 nt, Pseudomonas aeruginosa PA01
cugcagcgacuccagc

SEQ ID NO: 1516270 - RNA, 19 nt, Pseudomonas aeruginosa PA01
cugcagcgacuccagccag

SEQ ID NO: 1516271 - RNA, 21 nt, Pseudomonas aeruginosa PA01
cugcagcgccucguggaacag

SEQ ID NO: 1516272 - RNA, 23 nt, Pseudomonas aeruginosa PA01
cugcagcgccucguggaacagcg

SEQ ID NO: 1516273 - RNA, 15 nt, Pseudomonas aeruginosa PA01
cugcagcucggccug

SEQ ID NO: 1516274 - RNA, 11 nt, Pseudomonas aeruginosa PA01
cugcagcgccc

SEQ ID NO: 1516275 - RNA, 16 nt, Pseudomonas aeruginosa PA01
cugcagcuugcgcgcc

SEQ ID NO: 1516276 - RNA, 22 nt, Pseudomonas aeruginosa PA01
cugcagcuugugggcaugcucg

SEQ ID NO: 1516277 - RNA, 13 nt, Pseudomonas aeruginosa PA01
cugcaggcccugc

SEQ ID NO: 1516278 - RNA, 16 nt, Pseudomonas aeruginosa PA01
cugcaggcccugccag

SEQ ID NO: 1516279 - RNA, 14 nt, Pseudomonas aeruginosa PA01
cugcaucaccaggc

SEQ ID NO: 1516280 - RNA, 14 nt, Pseudomonas aeruginosa PA01
cugcagggcggcgc

SEQ ID NO: 1516281 - RNA, 20 nt, Pseudomonas aeruginosa PA01
cugcagggcggcuuccaggu

SEQ ID NO: 1516282 - RNA, 22 nt, Pseudomonas aeruginosa PA01
cugcagggcguagugcuccucg

SEQ ID NO: 1516283 - RNA, 19 nt, Pseudomonas aeruginosa PA01
cugcagggcaucgaccaga

SEQ ID NO: 1516284 - RNA, 21 nt, Pseudomonas aeruginosa PA01
cugcagggccagggaggcgcu

SEQ ID NO: 1516285 - RNA, 14 nt, Pseudomonas aeruginosa PA01
cugcaggcgcucca

SEQ ID NO: 1516286 - RNA, 15 nt, Pseudomonas aeruginosa PA01
cugcaggccaccgga

SEQ ID NO: 1516287 - RNA, 15 nt, Pseudomonas aeruginosa PA01
cugcaggccgugcca

SEQ ID NO: 1516288 - RNA, 23 nt, Pseudomonas aeruginosa PA01
cugccggccagggucgccagcag

SEQ ID NO: 1516289 - RNA, 12 nt, Pseudomonas aeruginosa PA01
cugccggcgcgc

SEQ ID NO: 1516290 - RNA, 14 nt, Pseudomonas aeruginosa PA01
cugccguacagccc

SEQ ID NO: 1516291 - RNA, 20 nt, Pseudomonas aeruginosa PA01
cugccgucgaagucguugaa

SEQ ID NO: 1516292 - RNA, 18 nt, Pseudomonas aeruginosa PA01
cugccgucggcgcccuuc

SEQ ID NO: 1516293 - RNA, 20 nt, Pseudomonas aeruginosa PA01
cugccgcccggccaggccac

SEQ ID NO: 1516294 - RNA, 18 nt, Pseudomonas aeruginosa PA01
cugccgcccucgggccgc

SEQ ID NO: 1516295 - RNA, 14 nt, Pseudomonas aeruginosa PA01
cugccgccuguucg

SEQ ID NO: 1516296 - RNA, 13 nt, Pseudomonas aeruginosa PA01
cugccgagcuucc

SEQ ID NO: 1516297 - RNA, 14 nt, Pseudomonas aeruginosa PA01
cugccgagcuucca

SEQ ID NO: 1516298 - RNA, 16 nt, Pseudomonas aeruginosa PA01
cugccgcgacaggaug

SEQ ID NO: 1516299 - RNA, 16 nt, Pseudomonas aeruginosa PA01
cugccgcgcguggcuu

SEQ ID NO: 1516300 - RNA, 13 nt, Pseudomonas aeruginosa PA01
cugccgcgccgga

SEQ ID NO: 1516301 - RNA, 17 nt, Pseudomonas aeruginosa PA01
cugccgaacagcaggga

SEQ ID NO: 1516302 - RNA, 20 nt, Pseudomonas aeruginosa PA01
cugccgagaaucugcccggc

SEQ ID NO: 1516303 - RNA, 16 nt, Pseudomonas aeruginosa PA01
cugccccuggcucagg

SEQ ID NO: 1516304 - RNA, 14 nt, Pseudomonas aeruginosa PA01
cugcccuccugcuc

SEQ ID NO: 1516305 - RNA, 20 nt, Pseudomonas aeruginosa PA01
cugcccggcucguucauguc

SEQ ID NO: 1516306 - RNA, 16 nt, Pseudomonas aeruginosa PA01
cugccccgugcaccga

SEQ ID NO: 1516307 - RNA, 11 nt, Pseudomonas aeruginosa PA01
cugcccaccac

SEQ ID NO: 1516308 - RNA, 15 nt, Pseudomonas aeruginosa PA01
cugccacaguuucau

SEQ ID NO: 1516309 - RNA, 17 nt, Pseudomonas aeruginosa PA01
cugccacaguuucaugg

SEQ ID NO: 1516310 - RNA, 13 nt, Pseudomonas aeruginosa PA01
cugccacucggug

SEQ ID NO: 1516311 - RNA, 13 nt, Pseudomonas aeruginosa PA01
cugccagccccgc

SEQ ID NO: 1516312 - RNA, 15 nt, Pseudomonas aeruginosa PA01
cugccagcucuugcc

SEQ ID NO: 1516313 - RNA, 20 nt, Pseudomonas aeruginosa PA01
cugccaggggcuagucgcgc

SEQ ID NO: 1516314 - RNA, 22 nt, Pseudomonas aeruginosa PA01
cugcggcaagugggucacggug

SEQ ID NO: 1516315 - RNA, 14 nt, Pseudomonas aeruginosa PA01
cugcggauggcgcg

SEQ ID NO: 1516316 - RNA, 22 nt, Pseudomonas aeruginosa PA01
cugcggauggcgcggggccccg

SEQ ID NO: 1516317 - RNA, 14 nt, Pseudomonas aeruginosa PA01
cugcggaugucacg

SEQ ID NO: 1516318 - RNA, 14 nt, Pseudomonas aeruginosa PA01
cugcgagcgcacaa

SEQ ID NO: 1516319 - RNA, 22 nt, Pseudomonas aeruginosa PA01
cugcgagggauguuccaggccc

SEQ ID NO: 1516320 - RNA, 12 nt, Pseudomonas aeruginosa PA01
cugcgaccuggc

SEQ ID NO: 1516321 - RNA, 15 nt, Pseudomonas aeruginosa PA01
cugcgagcaccaugc

SEQ ID NO: 1516322 - RNA, 12 nt, Pseudomonas aeruginosa PA01
cugcgagcaggu

SEQ ID NO: 1516323 - RNA, 22 nt, Pseudomonas aeruginosa PA01
cugcgagcagguccugucccag

SEQ ID NO: 1516324 - RNA, 18 nt, Pseudomonas aeruginosa PA01
cugcgaauagacgccgcu

SEQ ID NO: 1516325 - RNA, 22 nt, Pseudomonas aeruginosa PA01
cugcggccgcaaccagcccugg

SEQ ID NO: 1516326 - RNA, 14 nt, Pseudomonas aeruginosa PA01
cugcggccggcgcg

SEQ ID NO: 1516327 - RNA, 14 nt, Pseudomonas aeruginosa PA01
cugcgggcgccgcc

SEQ ID NO: 1516328 - RNA, 15 nt, Pseudomonas aeruginosa PA01
cugcgggucauuggc

SEQ ID NO: 1516329 - RNA, 20 nt, Pseudomonas aeruginosa PA01
cugcggccccaaggggccgc

SEQ ID NO: 1516330 - RNA, 14 nt, Pseudomonas aeruginosa PA01
cugcggggccugcu

SEQ ID NO: 1516331 - RNA, 16 nt, Pseudomonas aeruginosa PA01
cugcggggugagcagu

SEQ ID NO: 1516332 - RNA, 20 nt, Pseudomonas aeruginosa PA01
cugcggguugccgcagagca

SEQ ID NO: 1516333 - RNA, 17 nt, Pseudomonas aeruginosa PA01
cugcggguuggucggca

SEQ ID NO: 1516334 - RNA, 18 nt, Pseudomonas aeruginosa PA01
cugcgguaccagcgcacc

SEQ ID NO: 1516335 - RNA, 22 nt, Pseudomonas aeruginosa PA01
cugcgguaccagcgcaccaggg

SEQ ID NO: 1516336 - RNA, 13 nt, Pseudomonas aeruginosa PA01
cugcggucgggug

SEQ ID NO: 1516337 - RNA, 13 nt, Pseudomonas aeruginosa PA01
cugcgucgcagag

SEQ ID NO: 1516338 - RNA, 17 nt, Pseudomonas aeruginosa PA01
cugcgucgcagagacgc

SEQ ID NO: 1516339 - RNA, 23 nt, Pseudomonas aeruginosa PA01
cugcgucgcagagacgcagcgcu

SEQ ID NO: 1516340 - RNA, 18 nt, Pseudomonas aeruginosa PA01
cugcgucguuggccggcu

SEQ ID NO: 1516341 - RNA, 14 nt, Pseudomonas aeruginosa PA01
cugcucccaugagc

SEQ ID NO: 1516342 - RNA, 15 nt, Pseudomonas aeruginosa PA01
cugcuccagcccggc

SEQ ID NO: 1516343 - RNA, 15 nt, Pseudomonas aeruginosa PA01
cugcuccagcggagc

SEQ ID NO: 1516344 - RNA, 22 nt, Pseudomonas aeruginosa PA01
cugcuccagcggagcgaccgga

SEQ ID NO: 1516345 - RNA, 13 nt, Pseudomonas aeruginosa PA01
cugcuccagcagg

SEQ ID NO: 1516346 - RNA, 15 nt, Pseudomonas aeruginosa PA01
cugcuaggcuggaag

SEQ ID NO: 1516347 - RNA, 15 nt, Pseudomonas aeruginosa PA01
cugcgugccagcacc

SEQ ID NO: 1516348 - RNA, 14 nt, Pseudomonas aeruginosa PA01
cugcgugagcuggg

SEQ ID NO: 1516349 - RNA, 21 nt, Pseudomonas aeruginosa PA01
cugcguggcgaacgcccggcu

SEQ ID NO: 1516350 - RNA, 20 nt, Pseudomonas aeruginosa PA01
cugcucuucggcggccagcg

SEQ ID NO: 1516351 - RNA, 14 nt, Pseudomonas aeruginosa PA01
cugcucggcgcccu

SEQ ID NO: 1516352 - RNA, 14 nt, Pseudomonas aeruginosa PA01
cugcucgcgcuucu

SEQ ID NO: 1516353 - RNA, 13 nt, Pseudomonas aeruginosa PA01
cugcucgccgccg

SEQ ID NO: 1516354 - RNA, 15 nt, Pseudomonas aeruginosa PA01
cugcucgccgccggc

SEQ ID NO: 1516355 - RNA, 16 nt, Pseudomonas aeruginosa PA01
cugcucgccgccggcg

SEQ ID NO: 1516356 - RNA, 20 nt, Pseudomonas aeruginosa PA01
cugcucgccucgggccauga

SEQ ID NO: 1516357 - RNA, 18 nt, Pseudomonas aeruginosa PA01
cugcucgcgcagccaggc

SEQ ID NO: 1516358 - RNA, 17 nt, Pseudomonas aeruginosa PA01
cugcugaauucccgcuc

SEQ ID NO: 1516359 - RNA, 23 nt, Pseudomonas aeruginosa PA01
cugcugaauucccgcuccaggcc

SEQ ID NO: 1516360 - RNA, 21 nt, Pseudomonas aeruginosa PA01
cugcugugcgucgagggccuu

SEQ ID NO: 1516361 - RNA, 20 nt, Pseudomonas aeruginosa PA01
cugcugucguuccggcucag

SEQ ID NO: 1516362 - RNA, 15 nt, Pseudomonas aeruginosa PA01
cugcuguugccaggg

SEQ ID NO: 1516363 - RNA, 19 nt, Pseudomonas aeruginosa PA01
cugcuucgaacgugcgcgc

SEQ ID NO: 1516364 - RNA, 17 nt, Pseudomonas aeruginosa PA01
cugcuguguccggcgga

SEQ ID NO: 1516365 - RNA, 14 nt, Pseudomonas aeruginosa PA01
cugcuggcuggcag

SEQ ID NO: 1516366 - RNA, 16 nt, Pseudomonas aeruginosa PA01
cugcuggcuggcaggu

SEQ ID NO: 1516367 - RNA, 20 nt, Pseudomonas aeruginosa PA01
cugcuggcuggcagguugau

SEQ ID NO: 1516368 - RNA, 18 nt, Pseudomonas aeruginosa PA01
cugcuggcgaagcugggg

SEQ ID NO: 1516369 - RNA, 21 nt, Pseudomonas aeruginosa PA01
cugcuggcgaagcuggggcug

SEQ ID NO: 1516370 - RNA, 18 nt, Pseudomonas aeruginosa PA01
cugcuggcgcagccaggc

SEQ ID NO: 1516371 - RNA, 14 nt, Pseudomonas aeruginosa PA01
cugcuggcgccgcu

SEQ ID NO: 1516372 - RNA, 19 nt, Pseudomonas aeruginosa PA01
cugcuggcgccgcuggcgu

SEQ ID NO: 1516373 - RNA, 13 nt, Pseudomonas aeruginosa PA01
cugcugaucagga

SEQ ID NO: 1516374 - RNA, 16 nt, Pseudomonas aeruginosa PA01
cugcugaucaggagga

SEQ ID NO: 1516375 - RNA, 16 nt, Pseudomonas aeruginosa PA01
cugcugggccagcgcc

SEQ ID NO: 1516376 - RNA, 18 nt, Pseudomonas aeruginosa PA01
cugcugggccagcgccgu

SEQ ID NO: 1516377 - RNA, 12 nt, Pseudomonas aeruginosa PA01
cugcuggcugcc

SEQ ID NO: 1516378 - RNA, 21 nt, Pseudomonas aeruginosa PA01
cugcuggguacgguuggccag

SEQ ID NO: 1516379 - RNA, 23 nt, Pseudomonas aeruginosa PA01
cugcugguagcugcugccggcuu

SEQ ID NO: 1516380 - RNA, 23 nt, Pseudomonas aeruginosa PA01
cugcuggugggugaucucgcuga

SEQ ID NO: 1516381 - RNA, 18 nt, Pseudomonas aeruginosa PA01
cugcuugaaauggcggac

SEQ ID NO: 1516382 - RNA, 22 nt, Pseudomonas aeruginosa PA01
cugcuucugucccugggccaug

SEQ ID NO: 1516383 - RNA, 15 nt, Pseudomonas aeruginosa PA01
cugcuucggcagccu

SEQ ID NO: 1516384 - RNA, 20 nt, Pseudomonas aeruginosa PA01
cugcuugccgagcugggcgu

SEQ ID NO: 1516385 - RNA, 12 nt, Pseudomonas aeruginosa PA01
cugcuugcgcug

SEQ ID NO: 1516386 - RNA, 20 nt, Pseudomonas aeruginosa PA01
cugcuugcgcuggccggcaa

SEQ ID NO: 1516387 - RNA, 18 nt, Pseudomonas aeruginosa PA01
cugcuugcgcgccgccgc

SEQ ID NO: 1516388 - RNA, 19 nt, Pseudomonas aeruginosa PA01
cuggaacuagcccucgacc

SEQ ID NO: 1516389 - RNA, 16 nt, Pseudomonas aeruginosa PA01
cugcuuggccaggcgc

SEQ ID NO: 1516390 - RNA, 18 nt, Pseudomonas aeruginosa PA01
cuggaugcuccgcgccuc

SEQ ID NO: 1516391 - RNA, 15 nt, Pseudomonas aeruginosa PA01
cuggaugcagccggg

SEQ ID NO: 1516392 - RNA, 14 nt, Pseudomonas aeruginosa PA01
cuggaugcccuccu

SEQ ID NO: 1516393 - RNA, 20 nt, Pseudomonas aeruginosa PA01
cuggaugaucgcgugggcca

SEQ ID NO: 1516394 - RNA, 20 nt, Pseudomonas aeruginosa PA01
cuggaugaucucgcaguacu

SEQ ID NO: 1516395 - RNA, 14 nt, Pseudomonas aeruginosa PA01
cuggauaucugggc

SEQ ID NO: 1516396 - RNA, 15 nt, Pseudomonas aeruginosa PA01
cuggauaucugggcc

SEQ ID NO: 1516397 - RNA, 18 nt, Pseudomonas aeruginosa PA01
cuggauaucugggccauc

SEQ ID NO: 1516398 - RNA, 23 nt, Pseudomonas aeruginosa PA01
cuggcaccggccaggcgcugguc

SEQ ID NO: 1516399 - RNA, 20 nt, Pseudomonas aeruginosa PA01
cuggaugucgaagcgcaggu

SEQ ID NO: 1516400 - RNA, 23 nt, Pseudomonas aeruginosa PA01
cuggauggucacgccgaggcugc

SEQ ID NO: 1516401 - RNA, 12 nt, Pseudomonas aeruginosa PA01
cuggaagucgcc

SEQ ID NO: 1516402 - RNA, 17 nt, Pseudomonas aeruginosa PA01
cuggaaggcgcugggcg

SEQ ID NO: 1516403 - RNA, 20 nt, Pseudomonas aeruginosa PA01
cuggaaggcgcugggcggcu

SEQ ID NO: 1516404 - RNA, 20 nt, Pseudomonas aeruginosa PA01
cuggaagcggguucccugcg

SEQ ID NO: 1516405 - RNA, 23 nt, Pseudomonas aeruginosa PA01
cuggaaugccggccggggccggc

SEQ ID NO: 1516406 - RNA, 17 nt, Pseudomonas aeruginosa PA01
cuggaauaccccgcgga

SEQ ID NO: 1516407 - RNA, 17 nt, Pseudomonas aeruginosa PA01
cuggaagucguccagca

SEQ ID NO: 1516408 - RNA, 13 nt, Pseudomonas aeruginosa PA01
cuggagcagggcg

SEQ ID NO: 1516409 - RNA, 20 nt, Pseudomonas aeruginosa PA01
cuggagcagggcgcaaccug

SEQ ID NO: 1516410 - RNA, 18 nt, Pseudomonas aeruginosa PA01
cuggagcagaaccgccag

SEQ ID NO: 1516411 - RNA, 15 nt, Pseudomonas aeruginosa PA01
cuggagaaugaaaaa

SEQ ID NO: 1516412 - RNA, 19 nt, Pseudomonas aeruginosa PA01
cuggagaaugaaaaaggga

SEQ ID NO: 1516413 - RNA, 17 nt, Pseudomonas aeruginosa PA01
cuggcgguagcccggca

SEQ ID NO: 1516414 - RNA, 15 nt, Pseudomonas aeruginosa PA01
cuggcggggucgcgc

SEQ ID NO: 1516415 - RNA, 19 nt, Pseudomonas aeruginosa PA01
cuggcggggucgcgccggu

SEQ ID NO: 1516416 - RNA, 23 nt, Pseudomonas aeruginosa PA01
cuggcguaguagugccccuugau

SEQ ID NO: 1516417 - RNA, 16 nt, Pseudomonas aeruginosa PA01
cuggcguccccaugcc

SEQ ID NO: 1516418 - RNA, 19 nt, Pseudomonas aeruginosa PA01
cuggcgucgcacugcugcu

SEQ ID NO: 1516419 - RNA, 17 nt, Pseudomonas aeruginosa PA01
cuggcgucgccuuccac

SEQ ID NO: 1516420 - RNA, 14 nt, Pseudomonas aeruginosa PA01
cuggcggcugggcu

SEQ ID NO: 1516421 - RNA, 23 nt, Pseudomonas aeruginosa PA01
aaacucaucaggcugccgagcag

SEQ ID NO: 1516422 - RNA, 15 nt, Pseudomonas aeruginosa PA01
cuggcugacagcuug

SEQ ID NO: 1516423 - RNA, 16 nt, Pseudomonas aeruginosa PA01
cuggcugaagacccug

SEQ ID NO: 1516424 - RNA, 17 nt, Pseudomonas aeruginosa PA01
cuggcugaagacccugc

SEQ ID NO: 1516425 - RNA, 16 nt, Pseudomonas aeruginosa PA01
cuggcuccacugcuug

SEQ ID NO: 1516426 - RNA, 23 nt, Pseudomonas aeruginosa PA01
cuggcugccgaggguguagagga

SEQ ID NO: 1516427 - RNA, 14 nt, Pseudomonas aeruginosa PA01
cuggcugcuggcga

SEQ ID NO: 1516428 - RNA, 16 nt, Pseudomonas aeruginosa PA01
cuggcugaucaguucg

SEQ ID NO: 1516429 - RNA, 16 nt, Pseudomonas aeruginosa PA01
cuggcugaggcguucc

SEQ ID NO: 1516430 - RNA, 19 nt, Pseudomonas aeruginosa PA01
cuggcguucucggccaggu

SEQ ID NO: 1516431 - RNA, 13 nt, Pseudomonas aeruginosa PA01
cuggcuuuccagg

SEQ ID NO: 1516432 - RNA, 14 nt, Pseudomonas aeruginosa PA01
cuggcuuuccaggg

SEQ ID NO: 1516433 - RNA, 17 nt, Pseudomonas aeruginosa PA01
cugggacgccuuguuca

SEQ ID NO: 1516434 - RNA, 19 nt, Pseudomonas aeruginosa PA01
cugggacggcagccugggg

SEQ ID NO: 1516435 - RNA, 16 nt, Pseudomonas aeruginosa PA01
cugggacggcugccca

SEQ ID NO: 1516436 - RNA, 16 nt, Pseudomonas aeruginosa PA01
cugggacucccgcaga

SEQ ID NO: 1516437 - RNA, 21 nt, Pseudomonas aeruginosa PA01
cugggaauggcgaugccgagg

SEQ ID NO: 1516438 - RNA, 19 nt, Pseudomonas aeruginosa PA01
cugggaacccuugcgcagg

SEQ ID NO: 1516439 - RNA, 16 nt, Pseudomonas aeruginosa PA01
cuggcuggccagcagg

SEQ ID NO: 1516440 - RNA, 23 nt, Pseudomonas aeruginosa PA01
cuggcuggccuuguacagggcgc

SEQ ID NO: 1516441 - RNA, 17 nt, Pseudomonas aeruginosa PA01
cuggcugucgagcgaag

SEQ ID NO: 1516442 - RNA, 18 nt, Pseudomonas aeruginosa PA01
cuggcugucguagaacuu

SEQ ID NO: 1516443 - RNA, 17 nt, Pseudomonas aeruginosa PA01
cugggaguuccgcgcaa

SEQ ID NO: 1516444 - RNA, 12 nt, Pseudomonas aeruginosa PA01
cugggcaggcug

SEQ ID NO: 1516445 - RNA, 14 nt, Pseudomonas aeruginosa PA01
cugggcacgaugcu

SEQ ID NO: 1516446 - RNA, 17 nt, Pseudomonas aeruginosa PA01
cugggccccggccaggu

SEQ ID NO: 1516447 - RNA, 18 nt, Pseudomonas aeruginosa PA01
cugggccaucgccggccc

SEQ ID NO: 1516448 - RNA, 20 nt, Pseudomonas aeruginosa PA01
cugggccacguucugcagga

SEQ ID NO: 1516449 - RNA, 11 nt, Pseudomonas aeruginosa PA01
cugggccaugu

SEQ ID NO: 1516450 - RNA, 15 nt, Pseudomonas aeruginosa PA01
cugggccaccuggcu

SEQ ID NO: 1516451 - RNA, 17 nt, Pseudomonas aeruginosa PA01
cugggccaccuggcucu

SEQ ID NO: 1516452 - RNA, 15 nt, Pseudomonas aeruginosa PA01
cugggcauggcuggc

SEQ ID NO: 1516453 - RNA, 19 nt, Pseudomonas aeruginosa PA01
cugggccggcgccagcagg

SEQ ID NO: 1516454 - RNA, 13 nt, Pseudomonas aeruginosa PA01
cugggcgaacagc

SEQ ID NO: 1516455 - RNA, 17 nt, Pseudomonas aeruginosa PA01
cugggcgaacagcgaga

SEQ ID NO: 1516456 - RNA, 18 nt, Pseudomonas aeruginosa PA01
cugggccgguugcggcgc

SEQ ID NO: 1516457 - RNA, 19 nt, Pseudomonas aeruginosa PA01
cugggccuuguucagggug

SEQ ID NO: 1516458 - RNA, 19 nt, Pseudomonas aeruginosa PA01
cuggcgaguggcgaagcca

SEQ ID NO: 1516459 - RNA, 21 nt, Pseudomonas aeruginosa PA01
cuggcgaccggguccugcaga

SEQ ID NO: 1516460 - RNA, 16 nt, Pseudomonas aeruginosa PA01
cuggcgaagaaccacu

SEQ ID NO: 1516461 - RNA, 16 nt, Pseudomonas aeruginosa PA01
cuggccuggccacccu

SEQ ID NO: 1516462 - RNA, 16 nt, Pseudomonas aeruginosa PA01
cuggccugggacggcg

SEQ ID NO: 1516463 - RNA, 14 nt, Pseudomonas aeruginosa PA01
cuggccugggguag

SEQ ID NO: 1516464 - RNA, 13 nt, Pseudomonas aeruginosa PA01
cuggccugcaggu

SEQ ID NO: 1516465 - RNA, 16 nt, Pseudomonas aeruginosa PA01
cuggcgaacgauggug

SEQ ID NO: 1516466 - RNA, 15 nt, Pseudomonas aeruginosa PA01
cuggccuuggccacg

SEQ ID NO: 1516467 - RNA, 21 nt, Pseudomonas aeruginosa PA01
cuggccgucccugaccagcag

SEQ ID NO: 1516468 - RNA, 17 nt, Pseudomonas aeruginosa PA01
cuggccgucggccugcu

SEQ ID NO: 1516469 - RNA, 17 nt, Pseudomonas aeruginosa PA01
cuggccgucuuccaggg

SEQ ID NO: 1516470 - RNA, 19 nt, Pseudomonas aeruginosa PA01
cuggccgucuuccagggcg

SEQ ID NO: 1516471 - RNA, 23 nt, Pseudomonas aeruginosa PA01
cuggccgucuuccagggcggcgc

SEQ ID NO: 1516472 - RNA, 16 nt, Pseudomonas aeruginosa PA01
cuggccggugccgccc

SEQ ID NO: 1516473 - RNA, 19 nt, Pseudomonas aeruginosa PA01
cuggccggugccgcccugg

SEQ ID NO: 1516474 - RNA, 21 nt, Pseudomonas aeruginosa PA01
cuggccggugccgcccugggg

SEQ ID NO: 1516475 - RNA, 17 nt, Pseudomonas aeruginosa PA01
cuggccggcgaccuugu

SEQ ID NO: 1516476 - RNA, 19 nt, Pseudomonas aeruginosa PA01
cuggccggcgauggccgcc

SEQ ID NO: 1516477 - RNA, 21 nt, Pseudomonas aeruginosa PA01
cuggccggcgauggccgccug

SEQ ID NO: 1516478 - RNA, 21 nt, Pseudomonas aeruginosa PA01
cuggccguccugcuugaccuu

SEQ ID NO: 1516479 - RNA, 14 nt, Pseudomonas aeruginosa PA01
cuggccguucucca

SEQ ID NO: 1516480 - RNA, 19 nt, Pseudomonas aeruginosa PA01
cuggccguucuccaggucg

SEQ ID NO: 1516481 - RNA, 17 nt, Pseudomonas aeruginosa PA01
cuggccguugcgcaggc

SEQ ID NO: 1516482 - RNA, 15 nt, Pseudomonas aeruginosa PA01
cuggccgcgcaggaa

SEQ ID NO: 1516483 - RNA, 16 nt, Pseudomonas aeruginosa PA01
cuggccgcgcaggaag

SEQ ID NO: 1516484 - RNA, 13 nt, Pseudomonas aeruginosa PA01
cuggccgccuggc

SEQ ID NO: 1516485 - RNA, 16 nt, Pseudomonas aeruginosa PA01
cuggccgcgcaggacg

SEQ ID NO: 1516486 - RNA, 18 nt, Pseudomonas aeruginosa PA01
cuggccgcgcuccaacag

SEQ ID NO: 1516487 - RNA, 23 nt, Pseudomonas aeruginosa PA01
cuggccgcgcuccaacaggcauu

SEQ ID NO: 1516488 - RNA, 21 nt, Pseudomonas aeruginosa PA01
cuggccgcggugggcuccagc

SEQ ID NO: 1516489 - RNA, 16 nt, Pseudomonas aeruginosa PA01
cuggccgcugccgcuc

SEQ ID NO: 1516490 - RNA, 21 nt, Pseudomonas aeruginosa PA01
cuggccgcugccgcucuggcu

SEQ ID NO: 1516491 - RNA, 22 nt, Pseudomonas aeruginosa PA01
cuggccgcugccgcucuggcug

SEQ ID NO: 1516492 - RNA, 12 nt, Pseudomonas aeruginosa PA01
cuggccgcugug

SEQ ID NO: 1516493 - RNA, 23 nt, Pseudomonas aeruginosa PA01
cuggccgcuguggaaguacggcg

SEQ ID NO: 1516494 - RNA, 23 nt, Pseudomonas aeruginosa PA01
cuggccgcccuugcggcccgccu

SEQ ID NO: 1516495 - RNA, 18 nt, Pseudomonas aeruginosa PA01
cuggccgaggacccggcg

SEQ ID NO: 1516496 - RNA, 13 nt, Pseudomonas aeruginosa PA01
cuggccgaucagc

SEQ ID NO: 1516497 - RNA, 16 nt, Pseudomonas aeruginosa PA01
cuggccgaucagcuug

SEQ ID NO: 1516498 - RNA, 20 nt, Pseudomonas aeruginosa PA01
cuggccgaucagcuuggccu

SEQ ID NO: 1516499 - RNA, 17 nt, Pseudomonas aeruginosa PA01
cuggcaguugcaguacc

SEQ ID NO: 1516500 - RNA, 23 nt, Pseudomonas aeruginosa PA01
cuggcaggucguuacgugucgua

SEQ ID NO: 1516501 - RNA, 12 nt, Pseudomonas aeruginosa PA01
cuggcaggcuca

SEQ ID NO: 1516502 - RNA, 23 nt, Pseudomonas aeruginosa PA01
cuggcagggcgcguccagcucca

SEQ ID NO: 1516503 - RNA, 16 nt, Pseudomonas aeruginosa PA01
cuggcgcucagcgccg

SEQ ID NO: 1516504 - RNA, 21 nt, Pseudomonas aeruginosa PA01
cuggcgcguugugccgccacc

SEQ ID NO: 1516505 - RNA, 20 nt, Pseudomonas aeruginosa PA01
cuggcgcgucaugccgccgu

SEQ ID NO: 1516506 - RNA, 21 nt, Pseudomonas aeruginosa PA01
cuggcgcgucaugccgccguc

SEQ ID NO: 1516507 - RNA, 21 nt, Pseudomonas aeruginosa PA01
cuggcgcgucgcugccgccgc

SEQ ID NO: 1516508 - RNA, 18 nt, Pseudomonas aeruginosa PA01
cuggcgcgucggccgcuc

SEQ ID NO: 1516509 - RNA, 17 nt, Pseudomonas aeruginosa PA01
cuggcgcuugccgcgcc

SEQ ID NO: 1516510 - RNA, 16 nt, Pseudomonas aeruginosa PA01
cuggcggaacagcucg

SEQ ID NO: 1516511 - RNA, 16 nt, Pseudomonas aeruginosa PA01
cuggcggaccgccucg

SEQ ID NO: 1516512 - RNA, 15 nt, Pseudomonas aeruginosa PA01
cuggcggagaaacuu

SEQ ID NO: 1516513 - RNA, 23 nt, Pseudomonas aeruginosa PA01
cuggcgcugcgcggcgucggcga

SEQ ID NO: 1516514 - RNA, 20 nt, Pseudomonas aeruginosa PA01
cuggcgcugaacaagcccug

SEQ ID NO: 1516515 - RNA, 15 nt, Pseudomonas aeruginosa PA01
cuggcggcaucggcg

SEQ ID NO: 1516516 - RNA, 16 nt, Pseudomonas aeruginosa PA01
cuggcggcaucggcgc

SEQ ID NO: 1516517 - RNA, 24 nt, Pseudomonas aeruginosa PA01
cuggcggcaugccguugggccagg

SEQ ID NO: 1516518 - RNA, 23 nt, Pseudomonas aeruginosa PA01
cuggcggauguaguccagcgccg

SEQ ID NO: 1516519 - RNA, 22 nt, Pseudomonas aeruginosa PA01
cuggcggauaucgcgccgcgau

SEQ ID NO: 1516520 - RNA, 16 nt, Pseudomonas aeruginosa PA01
cuggcggaucaccggc

SEQ ID NO: 1516521 - RNA, 20 nt, Pseudomonas aeruginosa PA01
cuggcgcagcggcagcgcca

SEQ ID NO: 1516522 - RNA, 15 nt, Pseudomonas aeruginosa PA01
cuggcgcagccguuc

SEQ ID NO: 1516523 - RNA, 15 nt, Pseudomonas aeruginosa PA01
cuggcgcagccgcug

SEQ ID NO: 1516524 - RNA, 16 nt, Pseudomonas aeruginosa PA01
cuggcgcagccgcugc

SEQ ID NO: 1516525 - RNA, 19 nt, Pseudomonas aeruginosa PA01
cuggcgcagccaggcgaug

SEQ ID NO: 1516526 - RNA, 14 nt, Pseudomonas aeruginosa PA01
cuggcgcagccgcu

SEQ ID NO: 1516527 - RNA, 12 nt, Pseudomonas aeruginosa PA01
cuggcgcagcag

SEQ ID NO: 1516528 - RNA, 19 nt, Pseudomonas aeruginosa PA01
cuggcgcagacaggccucc

SEQ ID NO: 1516529 - RNA, 20 nt, Pseudomonas aeruginosa PA01
cuggcgcagacaggccucca

SEQ ID NO: 1516530 - RNA, 19 nt, Pseudomonas aeruginosa PA01
cuggcgcacggccugcacc

SEQ ID NO: 1516531 - RNA, 17 nt, Pseudomonas aeruginosa PA01
cuggcgaucgaccugcc

SEQ ID NO: 1516532 - RNA, 20 nt, Pseudomonas aeruginosa PA01
cuggcgaucgaccugccggu

SEQ ID NO: 1516533 - RNA, 20 nt, Pseudomonas aeruginosa PA01
cuggcgaugcccuggccgcu

SEQ ID NO: 1516534 - RNA, 19 nt, Pseudomonas aeruginosa PA01
cuggcgauucuccugggcg

SEQ ID NO: 1516535 - RNA, 17 nt, Pseudomonas aeruginosa PA01
cuggcgccggugcauga

SEQ ID NO: 1516536 - RNA, 18 nt, Pseudomonas aeruginosa PA01
cuggcgccaggccgcguc

SEQ ID NO: 1516537 - RNA, 13 nt, Pseudomonas aeruginosa PA01
cuggcgcagggcg

SEQ ID NO: 1516538 - RNA, 14 nt, Pseudomonas aeruginosa PA01
cuggcgcaggaccg

SEQ ID NO: 1516539 - RNA, 15 nt, Pseudomonas aeruginosa PA01
cuggcgccuggccug

SEQ ID NO: 1516540 - RNA, 21 nt, Pseudomonas aeruginosa PA01
cuggcgcgacgaggcgcggcg

SEQ ID NO: 1516541 - RNA, 11 nt, Pseudomonas aeruginosa PA01
cuggcgcggca

SEQ ID NO: 1516542 - RNA, 20 nt, Pseudomonas aeruginosa PA01
cuggcgcggcaaagugcggu

SEQ ID NO: 1516543 - RNA, 15 nt, Pseudomonas aeruginosa PA01
cuggcgcgcgcgcca

SEQ ID NO: 1516544 - RNA, 21 nt, Pseudomonas aeruginosa PA01
cuggcgcgagaagccagccag

SEQ ID NO: 1516545 - RNA, 18 nt, Pseudomonas aeruginosa PA01
cuguugaaaaccgguccc

SEQ ID NO: 1516546 - RNA, 22 nt, Pseudomonas aeruginosa PA01
cuguuccagggccugcuccagc

SEQ ID NO: 1516547 - RNA, 19 nt, Pseudomonas aeruginosa PA01
cuguucgucuggcgccugg

SEQ ID NO: 1516548 - RNA, 17 nt, Pseudomonas aeruginosa PA01
cuguggucaggcgccag

SEQ ID NO: 1516549 - RNA, 17 nt, Pseudomonas aeruginosa PA01
cugugguuguggguaug

SEQ ID NO: 1516550 - RNA, 18 nt, Pseudomonas aeruginosa PA01
cugugguguagcgcaggu

SEQ ID NO: 1516551 - RNA, 15 nt, Pseudomonas aeruginosa PA01
cuguugcccugggcc

SEQ ID NO: 1516552 - RNA, 15 nt, Pseudomonas aeruginosa PA01
cuguuggccugggcg

SEQ ID NO: 1516553 - RNA, 16 nt, Pseudomonas aeruginosa PA01
cuguugguggggcgcc

SEQ ID NO: 1516554 - RNA, 14 nt, Pseudomonas aeruginosa PA01
cuguuuuccauggc

SEQ ID NO: 1516555 - RNA, 14 nt, Pseudomonas aeruginosa PA01
cuuacgcggccuuu

SEQ ID NO: 1516556 - RNA, 22 nt, Pseudomonas aeruginosa PA01
cuuaaggugacggaucacggug

SEQ ID NO: 1516557 - RNA, 20 nt, Pseudomonas aeruginosa PA01
cuucagacgcaccgagggca

SEQ ID NO: 1516558 - RNA, 19 nt, Pseudomonas aeruginosa PA01
cuucagcccggcaccaggc

SEQ ID NO: 1516559 - RNA, 21 nt, Pseudomonas aeruginosa PA01
cuucagcccggcaccaggccg

SEQ ID NO: 1516560 - RNA, 21 nt, Pseudomonas aeruginosa PA01
cuucagccgaccguccgccug

SEQ ID NO: 1516561 - RNA, 22 nt, Pseudomonas aeruginosa PA01
cuucagccgaccguccgccugc

SEQ ID NO: 1516562 - RNA, 15 nt, Pseudomonas aeruginosa PA01
cuucagccccagcac

SEQ ID NO: 1516563 - RNA, 19 nt, Pseudomonas aeruginosa PA01
cuucagccccagcacgccg

SEQ ID NO: 1516564 - RNA, 15 nt, Pseudomonas aeruginosa PA01
cuucagcgccgccag

SEQ ID NO: 1516565 - RNA, 17 nt, Pseudomonas aeruginosa PA01
cuucagcgccuccagca

SEQ ID NO: 1516566 - RNA, 14 nt, Pseudomonas aeruginosa PA01
cuucagcgagcggu

SEQ ID NO: 1516567 - RNA, 19 nt, Pseudomonas aeruginosa PA01
cuucagcgccagcaggcga

SEQ ID NO: 1516568 - RNA, 13 nt, Pseudomonas aeruginosa PA01
cuucaucccuucu

SEQ ID NO: 1516569 - RNA, 16 nt, Pseudomonas aeruginosa PA01
cuucaucccuucuuuu

SEQ ID NO: 1516570 - RNA, 19 nt, Pseudomonas aeruginosa PA01
cuucacgcagcucugcgau

SEQ ID NO: 1516571 - RNA, 22 nt, Pseudomonas aeruginosa PA01
cuucacgaauacccgguagacg

SEQ ID NO: 1516572 - RNA, 19 nt, Pseudomonas aeruginosa PA01
cuucacauggugggcgccg

SEQ ID NO: 1516573 - RNA, 17 nt, Pseudomonas aeruginosa PA01
cuucaccggcacgcccu

SEQ ID NO: 1516574 - RNA, 22 nt, Pseudomonas aeruginosa PA01
cuuccaaggguauugguaucca

SEQ ID NO: 1516575 - RNA, 21 nt, Pseudomonas aeruginosa PA01
cuuccagcaccucccccagcg

SEQ ID NO: 1516576 - RNA, 15 nt, Pseudomonas aeruginosa PA01
cuuccagaucgucuu

SEQ ID NO: 1516577 - RNA, 16 nt, Pseudomonas aeruginosa PA01
cuuccagccgcgcgcg

SEQ ID NO: 1516578 - RNA, 17 nt, Pseudomonas aeruginosa PA01
cuucccaggccagcggg

SEQ ID NO: 1516579 - RNA, 20 nt, Pseudomonas aeruginosa PA01
cuucccaggugcccuggaag

SEQ ID NO: 1516580 - RNA, 15 nt, Pseudomonas aeruginosa PA01
cuucccagacgucca

SEQ ID NO: 1516581 - RNA, 13 nt, Pseudomonas aeruginosa PA01
cuucccagauacc

SEQ ID NO: 1516582 - RNA, 20 nt, Pseudomonas aeruginosa PA01
cuucccaauagguguagccc

SEQ ID NO: 1516583 - RNA, 22 nt, Pseudomonas aeruginosa PA01
cuuccaucguggggcggcgcag

SEQ ID NO: 1516584 - RNA, 21 nt, Pseudomonas aeruginosa PA01
cuuccuugcugaagcccaggc

SEQ ID NO: 1516585 - RNA, 18 nt, Pseudomonas aeruginosa PA01
cuuccuucucgaagccga

SEQ ID NO: 1516586 - RNA, 15 nt, Pseudomonas aeruginosa PA01
cuuccuucucccggc

SEQ ID NO: 1516587 - RNA, 19 nt, Pseudomonas aeruginosa PA01
cuuccuucucccggcuggu

SEQ ID NO: 1516588 - RNA, 23 nt, Pseudomonas aeruginosa PA01
cuuccugagcagggucaugccua

SEQ ID NO: 1516589 - RNA, 23 nt, Pseudomonas aeruginosa PA01
cuuccucggugucggccaacugg

SEQ ID NO: 1516590 - RNA, 18 nt, Pseudomonas aeruginosa PA01
cuuccucggcacucagcc

SEQ ID NO: 1516591 - RNA, 13 nt, Pseudomonas aeruginosa PA01
cuuccucgcccuc

SEQ ID NO: 1516592 - RNA, 13 nt, Pseudomonas aeruginosa PA01
cuuccgccgccag

SEQ ID NO: 1516593 - RNA, 19 nt, Pseudomonas aeruginosa PA01
cuuccgccggcgccgccuc

SEQ ID NO: 1516594 - RNA, 16 nt, Pseudomonas aeruginosa PA01
cuuccgcaucggccga

SEQ ID NO: 1516595 - RNA, 19 nt, Pseudomonas aeruginosa PA01
cuuccgcaucggccgacag

SEQ ID NO: 1516596 - RNA, 23 nt, Pseudomonas aeruginosa PA01
cuuccgccagcaggcgcgggcug

SEQ ID NO: 1516597 - RNA, 20 nt, Pseudomonas aeruginosa PA01
cuucgcccauggcacgcagg

SEQ ID NO: 1516598 - RNA, 16 nt, Pseudomonas aeruginosa PA01
cuucgcgguuggauuc

SEQ ID NO: 1516599 - RNA, 14 nt, Pseudomonas aeruginosa PA01
cuucgcgguagacg

SEQ ID NO: 1516600 - RNA, 22 nt, Pseudomonas aeruginosa PA01
cuucgccgaaagcacgcgcauc

SEQ ID NO: 1516601 - RNA, 22 nt, Pseudomonas aeruginosa PA01
cuucgccgaccagguccgccac

SEQ ID NO: 1516602 - RNA, 15 nt, Pseudomonas aeruginosa PA01
cuucgccaguuccuu

SEQ ID NO: 1516603 - RNA, 13 nt, Pseudomonas aeruginosa PA01
cuucgcagauguc

SEQ ID NO: 1516604 - RNA, 16 nt, Pseudomonas aeruginosa PA01
cuucgcaccagccggc

SEQ ID NO: 1516605 - RNA, 21 nt, Pseudomonas aeruginosa PA01
cuucgaacccgcccucguggc

SEQ ID NO: 1516606 - RNA, 20 nt, Pseudomonas aeruginosa PA01
cuucgaagccgagcugccgg

SEQ ID NO: 1516607 - RNA, 16 nt, Pseudomonas aeruginosa PA01
cuucgaugcgccgcag

SEQ ID NO: 1516608 - RNA, 21 nt, Pseudomonas aeruginosa PA01
cuucgauugcuacagcaauua

SEQ ID NO: 1516609 - RNA, 17 nt, Pseudomonas aeruginosa PA01
cugguggucaccgccag

SEQ ID NO: 1516610 - RNA, 20 nt, Pseudomonas aeruginosa PA01
cugguggacacccugcugcu

SEQ ID NO: 1516611 - RNA, 20 nt, Pseudomonas aeruginosa PA01
cugguggacgucgucggcga

SEQ ID NO: 1516612 - RNA, 20 nt, Pseudomonas aeruginosa PA01
cugguggauguucgccgcca

SEQ ID NO: 1516613 - RNA, 22 nt, Pseudomonas aeruginosa PA01
cugguggauguucgccgccacc

SEQ ID NO: 1516614 - RNA, 23 nt, Pseudomonas aeruginosa PA01
cugguggauguucgccgccacca

SEQ ID NO: 1516615 - RNA, 17 nt, Pseudomonas aeruginosa PA01
cugguggcccugggcgg

SEQ ID NO: 1516616 - RNA, 19 nt, Pseudomonas aeruginosa PA01
cugguggcccugggcggcg

SEQ ID NO: 1516617 - RNA, 15 nt, Pseudomonas aeruginosa PA01
cugguggcgaacagc

SEQ ID NO: 1516618 - RNA, 13 nt, Pseudomonas aeruginosa PA01
cuggugucgggug

SEQ ID NO: 1516619 - RNA, 17 nt, Pseudomonas aeruginosa PA01
cuggugcggcaccagcc

SEQ ID NO: 1516620 - RNA, 17 nt, Pseudomonas aeruginosa PA01
cuggugcggccgaugau

SEQ ID NO: 1516621 - RNA, 17 nt, Pseudomonas aeruginosa PA01
cuggugccgcuguagga

SEQ ID NO: 1516622 - RNA, 20 nt, Pseudomonas aeruginosa PA01
cuggugccggauagaggaau

SEQ ID NO: 1516623 - RNA, 15 nt, Pseudomonas aeruginosa PA01
cuggugcccugggcg

SEQ ID NO: 1516624 - RNA, 14 nt, Pseudomonas aeruginosa PA01
cuggugccgacgcu

SEQ ID NO: 1516625 - RNA, 13 nt, Pseudomonas aeruginosa PA01
cuggugcacggcg

SEQ ID NO: 1516626 - RNA, 19 nt, Pseudomonas aeruginosa PA01
cugguugaccugcagcgcc

SEQ ID NO: 1516627 - RNA, 15 nt, Pseudomonas aeruginosa PA01
cugguugccagcagc

SEQ ID NO: 1516628 - RNA, 14 nt, Pseudomonas aeruginosa PA01
cugguugcccaggg

SEQ ID NO: 1516629 - RNA, 15 nt, Pseudomonas aeruginosa PA01
cugguugcccagggu

SEQ ID NO: 1516630 - RNA, 18 nt, Pseudomonas aeruginosa PA01
cugguuggacaccucccg

SEQ ID NO: 1516631 - RNA, 16 nt, Pseudomonas aeruginosa PA01
cugguuggccgccugg

SEQ ID NO: 1516632 - RNA, 17 nt, Pseudomonas aeruginosa PA01
cugguucgaguccaggu

SEQ ID NO: 1516633 - RNA, 13 nt, Pseudomonas aeruginosa PA01
cugguugaggucg

SEQ ID NO: 1516634 - RNA, 18 nt, Pseudomonas aeruginosa PA01
cuguaccgcuccccacuc

SEQ ID NO: 1516635 - RNA, 18 nt, Pseudomonas aeruginosa PA01
cuguaccgcuuccugggc

SEQ ID NO: 1516636 - RNA, 23 nt, Pseudomonas aeruginosa PA01
cuguacagaaacaaagagcccgc

SEQ ID NO: 1516637 - RNA, 17 nt, Pseudomonas aeruginosa PA01
cugggucgcgcagggca

SEQ ID NO: 1516638 - RNA, 23 nt, Pseudomonas aeruginosa PA01
cugggucgcguacagcgggccgg

SEQ ID NO: 1516639 - RNA, 14 nt, Pseudomonas aeruginosa PA01
cugggugaccagca

SEQ ID NO: 1516640 - RNA, 20 nt, Pseudomonas aeruginosa PA01
cuggguacgguuggccagcg

SEQ ID NO: 1516641 - RNA, 18 nt, Pseudomonas aeruginosa PA01
cuggguauagaccagcac

SEQ ID NO: 1516642 - RNA, 21 nt, Pseudomonas aeruginosa PA01
cugggugauuucuucagccug

SEQ ID NO: 1516643 - RNA, 23 nt, Pseudomonas aeruginosa PA01
cugggugauuucuucagccuggg

SEQ ID NO: 1516644 - RNA, 19 nt, Pseudomonas aeruginosa PA01
cuggguggucugcacggca

SEQ ID NO: 1516645 - RNA, 15 nt, Pseudomonas aeruginosa PA01
cuggguggcgacgaa

SEQ ID NO: 1516646 - RNA, 22 nt, Pseudomonas aeruginosa PA01
cuggguguccuucaugaacaca

SEQ ID NO: 1516647 - RNA, 19 nt, Pseudomonas aeruginosa PA01
cuggggcaucucggccacc

SEQ ID NO: 1516648 - RNA, 18 nt, Pseudomonas aeruginosa PA01
cuggggcggccucaggcc

SEQ ID NO: 1516649 - RNA, 18 nt, Pseudomonas aeruginosa PA01
cuggggcuguugcugggc

SEQ ID NO: 1516650 - RNA, 17 nt, Pseudomonas aeruginosa PA01
cugggcugcggggugag

SEQ ID NO: 1516651 - RNA, 24 nt, Pseudomonas aeruginosa PA01
cugggcgucgaacaccggcgccgc

SEQ ID NO: 1516652 - RNA, 22 nt, Pseudomonas aeruginosa PA01
cugggcguggcaaaaaugcccu

SEQ ID NO: 1516653 - RNA, 22 nt, Pseudomonas aeruginosa PA01
cugggcguggcggccgccggcg

SEQ ID NO: 1516654 - RNA, 18 nt, Pseudomonas aeruginosa PA01
cugggcguuggccagcgc

SEQ ID NO: 1516655 - RNA, 20 nt, Pseudomonas aeruginosa PA01
cugggcguuggccagcgcca

SEQ ID NO: 1516656 - RNA, 19 nt, Pseudomonas aeruginosa PA01
cuggggaaucugcgccagg

SEQ ID NO: 1516657 - RNA, 20 nt, Pseudomonas aeruginosa PA01
cuggggaaucugcgccaggu

SEQ ID NO: 1516658 - RNA, 22 nt, Pseudomonas aeruginosa PA01
cugggcuucguccgccugggac

SEQ ID NO: 1516659 - RNA, 19 nt, Pseudomonas aeruginosa PA01
cugggcgccgccagccaga

SEQ ID NO: 1516660 - RNA, 22 nt, Pseudomonas aeruginosa PA01
cugggcgccgccagccagagca

SEQ ID NO: 1516661 - RNA, 23 nt, Pseudomonas aeruginosa PA01
cugggcgccgccagccagagcag

SEQ ID NO: 1516662 - RNA, 18 nt, Pseudomonas aeruginosa PA01
cugggcgaccuucagcgg

SEQ ID NO: 1516663 - RNA, 22 nt, Pseudomonas aeruginosa PA01
cugggcgcgaauggcauucagc

SEQ ID NO: 1516664 - RNA, 20 nt, Pseudomonas aeruginosa PA01
cugggcggcgaccugcggca

SEQ ID NO: 1516665 - RNA, 10 nt, Pseudomonas aeruginosa PA01
cugggcggcc

SEQ ID NO: 1516666 - RNA, 15 nt, Pseudomonas aeruginosa PA01
cugggcggucucggc

SEQ ID NO: 1516667 - RNA, 20 nt, Pseudomonas aeruginosa PA01
cugggcggcuggccgaggac

SEQ ID NO: 1516668 - RNA, 15 nt, Pseudomonas aeruginosa PA01
cugggcggcuuccug

SEQ ID NO: 1516669 - RNA, 16 nt, Pseudomonas aeruginosa PA01
cugguaggccaugagg

SEQ ID NO: 1516670 - RNA, 16 nt, Pseudomonas aeruginosa PA01
cugguaguaggcgcuc

SEQ ID NO: 1516671 - RNA, 17 nt, Pseudomonas aeruginosa PA01
cugguaguccagcaggu

SEQ ID NO: 1516672 - RNA, 12 nt, Pseudomonas aeruginosa PA01
cugguagucgcc

SEQ ID NO: 1516673 - RNA, 16 nt, Pseudomonas aeruginosa PA01
cuggucauccuggccc

SEQ ID NO: 1516674 - RNA, 20 nt, Pseudomonas aeruginosa PA01
cuggucaggcugaucuugcc

SEQ ID NO: 1516675 - RNA, 19 nt, Pseudomonas aeruginosa PA01
cugguacagcacccaggcg

SEQ ID NO: 1516676 - RNA, 20 nt, Pseudomonas aeruginosa PA01
cugguaccugccggcacgcu

SEQ ID NO: 1516677 - RNA, 19 nt, Pseudomonas aeruginosa PA01
cugguaauggugaucaccu

SEQ ID NO: 1516678 - RNA, 20 nt, Pseudomonas aeruginosa PA01
cugguagccgaagucggcgu

SEQ ID NO: 1516679 - RNA, 22 nt, Pseudomonas aeruginosa PA01
cugguagccgcaguccagggcg

SEQ ID NO: 1516680 - RNA, 13 nt, Pseudomonas aeruginosa PA01
cugguagcagagg

SEQ ID NO: 1516681 - RNA, 14 nt, Pseudomonas aeruginosa PA01
cugguacucguccu

SEQ ID NO: 1516682 - RNA, 15 nt, Pseudomonas aeruginosa PA01
cugguacgcccccuc

SEQ ID NO: 1516683 - RNA, 22 nt, Pseudomonas aeruginosa PA01
cugguccuuauucggcccaugc

SEQ ID NO: 1516684 - RNA, 19 nt, Pseudomonas aeruginosa PA01
cugguccggcacuuccuug

SEQ ID NO: 1516685 - RNA, 20 nt, Pseudomonas aeruginosa PA01
cugguccggguuggcgcagg

SEQ ID NO: 1516686 - RNA, 18 nt, Pseudomonas aeruginosa PA01
cugguccaccagcccgca

SEQ ID NO: 1516687 - RNA, 20 nt, Pseudomonas aeruginosa PA01
cuggucgcgcgcggccagcu

SEQ ID NO: 1516688 - RNA, 13 nt, Pseudomonas aeruginosa PA01
cuggucgcggggc

SEQ ID NO: 1516689 - RNA, 17 nt, Pseudomonas aeruginosa PA01
cuggucgcagccgcgca

SEQ ID NO: 1516690 - RNA, 17 nt, Pseudomonas aeruginosa PA01
cuggucggcuuccgccg

SEQ ID NO: 1516691 - RNA, 19 nt, Pseudomonas aeruginosa PA01
cuggucgucguaguggccg

SEQ ID NO: 1516692 - RNA, 17 nt, Pseudomonas aeruginosa PA01
cuggucguucagugcca

SEQ ID NO: 1516693 - RNA, 22 nt, Pseudomonas aeruginosa PA01
cuggucguugcgcgcauagcag

SEQ ID NO: 1516694 - RNA, 22 nt, Pseudomonas aeruginosa PA01
cuggucuugccgauggcgcacc

SEQ ID NO: 1516695 - RNA, 20 nt, Pseudomonas aeruginosa PA01
cuggugaucgaccacacaug

SEQ ID NO: 1516696 - RNA, 19 nt, Pseudomonas aeruginosa PA01
cuggugacggugaccuugu

SEQ ID NO: 1516697 - RNA, 13 nt, Pseudomonas aeruginosa PA01
cugugccuggaag

SEQ ID NO: 1516698 - RNA, 20 nt, Pseudomonas aeruginosa PA01
cugugcgucgagggccuugu

SEQ ID NO: 1516699 - RNA, 23 nt, Pseudomonas aeruginosa PA01
cugugcggggaaagcuccucggc

SEQ ID NO: 1516700 - RNA, 17 nt, Pseudomonas aeruginosa PA01
cugugcugcaccagcag

SEQ ID NO: 1516701 - RNA, 17 nt, Pseudomonas aeruginosa PA01
cuguggaauguccugcc

SEQ ID NO: 1516702 - RNA, 16 nt, Pseudomonas aeruginosa PA01
cugugcuggccacccu

SEQ ID NO: 1516703 - RNA, 13 nt, Pseudomonas aeruginosa PA01
cuguggcgcggcu

SEQ ID NO: 1516704 - RNA, 18 nt, Pseudomonas aeruginosa PA01
cuguggcgcggcuggaag

SEQ ID NO: 1516705 - RNA, 17 nt, Pseudomonas aeruginosa PA01
cugugccauuccugggc

SEQ ID NO: 1516706 - RNA, 14 nt, Pseudomonas aeruginosa PA01
cugugccccaggca

SEQ ID NO: 1516707 - RNA, 23 nt, Pseudomonas aeruginosa PA01
cugugcacccagaccuuccagcc

SEQ ID NO: 1516708 - RNA, 18 nt, Pseudomonas aeruginosa PA01
cugugcaggaaggcgacg

SEQ ID NO: 1516709 - RNA, 13 nt, Pseudomonas aeruginosa PA01
cugugaggugggc

SEQ ID NO: 1516710 - RNA, 22 nt, Pseudomonas aeruginosa PA01
cugucgcggggcuugcgccccc

SEQ ID NO: 1516711 - RNA, 15 nt, Pseudomonas aeruginosa PA01
cugucgcccgggcgc

SEQ ID NO: 1516712 - RNA, 17 nt, Pseudomonas aeruginosa PA01
cugucggccagccccug

SEQ ID NO: 1516713 - RNA, 15 nt, Pseudomonas aeruginosa PA01
cugucgagcacggcg

SEQ ID NO: 1516714 - RNA, 17 nt, Pseudomonas aeruginosa PA01
cugucgagggucugcuc

SEQ ID NO: 1516715 - RNA, 18 nt, Pseudomonas aeruginosa PA01
cugucgauaccagcgccg

SEQ ID NO: 1516716 - RNA, 20 nt, Pseudomonas aeruginosa PA01
cugucgauaccagcgccgcu

SEQ ID NO: 1516717 - RNA, 12 nt, Pseudomonas aeruginosa PA01
cuguccuccagc

SEQ ID NO: 1516718 - RNA, 15 nt, Pseudomonas aeruginosa PA01
cugucguccagcggg

SEQ ID NO: 1516719 - RNA, 15 nt, Pseudomonas aeruginosa PA01
cugucgugccuccag

SEQ ID NO: 1516720 - RNA, 19 nt, Pseudomonas aeruginosa PA01
cugucgugccuccagccuc

SEQ ID NO: 1516721 - RNA, 18 nt, Pseudomonas aeruginosa PA01
cugucguaguccugggcc

SEQ ID NO: 1516722 - RNA, 18 nt, Pseudomonas aeruginosa PA01
cugucguuccggcucagc

SEQ ID NO: 1516723 - RNA, 13 nt, Pseudomonas aeruginosa PA01
cugucguggacgc

SEQ ID NO: 1516724 - RNA, 22 nt, Pseudomonas aeruginosa PA01
cuguccaccgguggcgacgcgc

SEQ ID NO: 1516725 - RNA, 19 nt, Pseudomonas aeruginosa PA01
cuguccaauauagccauca

SEQ ID NO: 1516726 - RNA, 18 nt, Pseudomonas aeruginosa PA01
cugucccaucacggcccc

SEQ ID NO: 1516727 - RNA, 19 nt, Pseudomonas aeruginosa PA01
cugucccaucacggccccg

SEQ ID NO: 1516728 - RNA, 13 nt, Pseudomonas aeruginosa PA01
cugucccugggcc

SEQ ID NO: 1516729 - RNA, 17 nt, Pseudomonas aeruginosa PA01
cuguccagcucccccac

SEQ ID NO: 1516730 - RNA, 18 nt, Pseudomonas aeruginosa PA01
cugucacgccgggggucg

SEQ ID NO: 1516731 - RNA, 12 nt, Pseudomonas aeruginosa PA01
cuguagaaugcg

SEQ ID NO: 1516732 - RNA, 15 nt, Pseudomonas aeruginosa PA01
cuguagccucccgcc

SEQ ID NO: 1516733 - RNA, 20 nt, Pseudomonas aeruginosa PA01
cuguagcagggugcgggcgc

SEQ ID NO: 1516734 - RNA, 22 nt, Pseudomonas aeruginosa PA01
cuguaguacaugacgaagcgca

SEQ ID NO: 1516735 - RNA, 22 nt, Pseudomonas aeruginosa PA01
cuguagggucgcagcaggccgc

SEQ ID NO: 1516736 - RNA, 20 nt, Pseudomonas aeruginosa PA01
cuguagugcuccggggcgcu

SEQ ID NO: 1516737 - RNA, 21 nt, Pseudomonas aeruginosa PA01
cuguaguugacgucgccgaug

SEQ ID NO: 1516738 - RNA, 15 nt, Pseudomonas aeruginosa PA01
cuguagcggaucagg

SEQ ID NO: 1516739 - RNA, 19 nt, Pseudomonas aeruginosa PA01
cuguagcucugcuggcugu

SEQ ID NO: 1516740 - RNA, 17 nt, Pseudomonas aeruginosa PA01
gaacuuucccguuuugc

SEQ ID NO: 1516741 - RNA, 15 nt, Pseudomonas aeruginosa PA01
gaacuugcgcaccgc

SEQ ID NO: 1516742 - RNA, 18 nt, Pseudomonas aeruginosa PA01
gaacuugcuguugccgcu

SEQ ID NO: 1516743 - RNA, 14 nt, Pseudomonas aeruginosa PA01
gaacuuguagggcu

SEQ ID NO: 1516744 - RNA, 14 nt, Pseudomonas aeruginosa PA01
gaacuuuucccagc

SEQ ID NO: 1516745 - RNA, 16 nt, Pseudomonas aeruginosa PA01
gaacuggucgcuccag

SEQ ID NO: 1516746 - RNA, 21 nt, Pseudomonas aeruginosa PA01
gaacuggucgcuccagcccca

SEQ ID NO: 1516747 - RNA, 23 nt, Pseudomonas aeruginosa PA01
gaacuggucgcuccagccccacu

SEQ ID NO: 1516748 - RNA, 15 nt, Pseudomonas aeruginosa PA01
gaacuucagggcucc

SEQ ID NO: 1516749 - RNA, 16 nt, Pseudomonas aeruginosa PA01
gaagacgcccagcagg

SEQ ID NO: 1516750 - RNA, 19 nt, Pseudomonas aeruginosa PA01
gaagacgcccagcagggcc

SEQ ID NO: 1516751 - RNA, 21 nt, Pseudomonas aeruginosa PA01
gaagacgcccagcagggccag

SEQ ID NO: 1516752 - RNA, 23 nt, Pseudomonas aeruginosa PA01
gaagaacaggcgcuucagcucga

SEQ ID NO: 1516753 - RNA, 11 nt, Pseudomonas aeruginosa PA01
gaagccaggca

SEQ ID NO: 1516754 - RNA, 22 nt, Pseudomonas aeruginosa PA01
gaagcacaccuccagcggcuug

SEQ ID NO: 1516755 - RNA, 18 nt, Pseudomonas aeruginosa PA01
gaagcagccauggcuggu

SEQ ID NO: 1516756 - RNA, 14 nt, Pseudomonas aeruginosa PA01
gaagcagcccagcg

SEQ ID NO: 1516757 - RNA, 23 nt, Pseudomonas aeruginosa PA01
gaagcagcccagcgcuuccucgg

SEQ ID NO: 1516758 - RNA, 22 nt, Pseudomonas aeruginosa PA01
gaagcagaacgccccgcauugc

SEQ ID NO: 1516759 - RNA, 20 nt, Pseudomonas aeruginosa PA01
gaagcagagggcguccugcu

SEQ ID NO: 1516760 - RNA, 15 nt, Pseudomonas aeruginosa PA01
gaagauaucgccuuc

SEQ ID NO: 1516761 - RNA, 21 nt, Pseudomonas aeruginosa PA01
gaagauauaacgcgagccaca

SEQ ID NO: 1516762 - RNA, 15 nt, Pseudomonas aeruginosa PA01
gaagcgucagccgcg

SEQ ID NO: 1516763 - RNA, 19 nt, Pseudomonas aeruginosa PA01
gaagcgucgugcgccggcc

SEQ ID NO: 1516764 - RNA, 15 nt, Pseudomonas aeruginosa PA01
gaagcgugggcggcc

SEQ ID NO: 1516765 - RNA, 22 nt, Pseudomonas aeruginosa PA01
gaagcgugggcggccggccagg

SEQ ID NO: 1516766 - RNA, 14 nt, Pseudomonas aeruginosa PA01
gaagcgggccucgg

SEQ ID NO: 1516767 - RNA, 16 nt, Pseudomonas aeruginosa PA01
gaagcggucgccggcg

SEQ ID NO: 1516768 - RNA, 22 nt, Pseudomonas aeruginosa PA01
gaagcggaucucgucgccgacc

SEQ ID NO: 1516769 - RNA, 17 nt, Pseudomonas aeruginosa PA01
gaagcggaagcgcagcc

SEQ ID NO: 1516770 - RNA, 20 nt, Pseudomonas aeruginosa PA01
gaagcgcucggucagcuccc

SEQ ID NO: 1516771 - RNA, 23 nt, Pseudomonas aeruginosa PA01
gaagcgcucgacauacuccgccg

SEQ ID NO: 1516772 - RNA, 15 nt, Pseudomonas aeruginosa PA01
gaagcgcugcugggc

SEQ ID NO: 1516773 - RNA, 16 nt, Pseudomonas aeruginosa PA01
gaagcgcugcugggcg

SEQ ID NO: 1516774 - RNA, 19 nt, Pseudomonas aeruginosa PA01
gaagcgcugcugggcggcg

SEQ ID NO: 1516775 - RNA, 17 nt, Pseudomonas aeruginosa PA01
gaagcggccgaccaggc

SEQ ID NO: 1516776 - RNA, 23 nt, Pseudomonas aeruginosa PA01
gaagcggccgccgaaaugcugca

SEQ ID NO: 1516777 - RNA, 15 nt, Pseudomonas aeruginosa PA01
gaagcgcggcggcgc

SEQ ID NO: 1516778 - RNA, 16 nt, Pseudomonas aeruginosa PA01
gaagcgccugcgguga

SEQ ID NO: 1516779 - RNA, 12 nt, Pseudomonas aeruginosa PA01
gaagcgccaggc

SEQ ID NO: 1516780 - RNA, 13 nt, Pseudomonas aeruginosa PA01
gaagcgccaggcg

SEQ ID NO: 1516781 - RNA, 13 nt, Pseudomonas aeruginosa PA01
gaagcgcagcagg

SEQ ID NO: 1516782 - RNA, 15 nt, Pseudomonas aeruginosa PA01
gaagcgcagccauuc

SEQ ID NO: 1516783 - RNA, 22 nt, Pseudomonas aeruginosa PA01
gaagcgcagcuccggcagcagg

SEQ ID NO: 1516784 - RNA, 22 nt, Pseudomonas aeruginosa PA01
gaagcgcaggccgccggcggcc

SEQ ID NO: 1516785 - RNA, 16 nt, Pseudomonas aeruginosa PA01
gaagcgcaggcggcug

SEQ ID NO: 1516786 - RNA, 17 nt, Pseudomonas aeruginosa PA01
gaagcgcaggcggcugg

SEQ ID NO: 1516787 - RNA, 17 nt, Pseudomonas aeruginosa PA01
gaagccccgcagccgcg

SEQ ID NO: 1516788 - RNA, 19 nt, Pseudomonas aeruginosa PA01
gaagccccuggcgcugggc

SEQ ID NO: 1516789 - RNA, 13 nt, Pseudomonas aeruginosa PA01
gaagcccagcgcc

SEQ ID NO: 1516790 - RNA, 16 nt, Pseudomonas aeruginosa PA01
gaagcccaucgacugc

SEQ ID NO: 1516791 - RNA, 23 nt, Pseudomonas aeruginosa PA01
gaagcccgcggcaucggccuggu

SEQ ID NO: 1516792 - RNA, 22 nt, Pseudomonas aeruginosa PA01
gaagcccgugucgccuuccggc

SEQ ID NO: 1516793 - RNA, 17 nt, Pseudomonas aeruginosa PA01
gaagcgcaccaccugca

SEQ ID NO: 1516794 - RNA, 20 nt, Pseudomonas aeruginosa PA01
gaaggcgguguagaccacca

SEQ ID NO: 1516795 - RNA, 19 nt, Pseudomonas aeruginosa PA01
gaagggccguuuugccgcu

SEQ ID NO: 1516796 - RNA, 18 nt, Pseudomonas aeruginosa PA01
gaagggcgcgccccgucc

SEQ ID NO: 1516797 - RNA, 16 nt, Pseudomonas aeruginosa PA01
gaaggcgccuuccagg

SEQ ID NO: 1516798 - RNA, 14 nt, Pseudomonas aeruginosa PA01
gaaggcgcggcgga

SEQ ID NO: 1516799 - RNA, 22 nt, Pseudomonas aeruginosa PA01
gaaggcgcggggcgaggucggc

SEQ ID NO: 1516800 - RNA, 12 nt, Pseudomonas aeruginosa PA01
gaaggcgcuggg

SEQ ID NO: 1516801 - RNA, 13 nt, Pseudomonas aeruginosa PA01
gaaggcgcugggc

SEQ ID NO: 1516802 - RNA, 15 nt, Pseudomonas aeruginosa PA01
gaaggcggcagcggu

SEQ ID NO: 1516803 - RNA, 15 nt, Pseudomonas aeruginosa PA01
gaaguaaucaccuuc

SEQ ID NO: 1516804 - RNA, 18 nt, Pseudomonas aeruginosa PA01
gaagguaucgaagucgcc

SEQ ID NO: 1516805 - RNA, 20 nt, Pseudomonas aeruginosa PA01
gaaggucagcacgccuucca

SEQ ID NO: 1516806 - RNA, 15 nt, Pseudomonas aeruginosa PA01
gaagguacugccgcu

SEQ ID NO: 1516807 - RNA, 18 nt, Pseudomonas aeruginosa PA01
gaaggucaccgaaaggcu

SEQ ID NO: 1516808 - RNA, 12 nt, Pseudomonas aeruginosa PA01
gaaggccgcuug

SEQ ID NO: 1516809 - RNA, 16 nt, Pseudomonas aeruginosa PA01
gaaggccaguccggca

SEQ ID NO: 1516810 - RNA, 16 nt, Pseudomonas aeruginosa PA01
gaaggcauauccccuc

SEQ ID NO: 1516811 - RNA, 20 nt, Pseudomonas aeruginosa PA01
gaaggcccgcgagccgcgca

SEQ ID NO: 1516812 - RNA, 16 nt, Pseudomonas aeruginosa PA01
gaaggccuggccguug

SEQ ID NO: 1516813 - RNA, 13 nt, Pseudomonas aeruginosa PA01
gaaggccuggucg

SEQ ID NO: 1516814 - RNA, 20 nt, Pseudomonas aeruginosa PA01
gaaggccgacaccucgauca

SEQ ID NO: 1516815 - RNA, 14 nt, Pseudomonas aeruginosa PA01
gaaggccuccucgu

SEQ ID NO: 1516816 - RNA, 19 nt, Pseudomonas aeruginosa PA01
gaaggccugcgcuuccggc

SEQ ID NO: 1516817 - RNA, 21 nt, Pseudomonas aeruginosa PA01
gaaggccuggaacaccaggcc

SEQ ID NO: 1516818 - RNA, 14 nt, Pseudomonas aeruginosa PA01
gaaggacaggccgu

SEQ ID NO: 1516819 - RNA, 18 nt, Pseudomonas aeruginosa PA01
gaaggagaacgacaugcu

SEQ ID NO: 1516820 - RNA, 21 nt, Pseudomonas aeruginosa PA01
gaaggaaaccggccagcgcau

SEQ ID NO: 1516821 - RNA, 17 nt, Pseudomonas aeruginosa PA01
gaagcuuuuccagcgca

SEQ ID NO: 1516822 - RNA, 16 nt, Pseudomonas aeruginosa PA01
gaagcuuccagcuugg

SEQ ID NO: 1516823 - RNA, 14 nt, Pseudomonas aeruginosa PA01
gaagcuucgcuggg

SEQ ID NO: 1516824 - RNA, 17 nt, Pseudomonas aeruginosa PA01
gaaguucaccucgguga

SEQ ID NO: 1516825 - RNA, 14 nt, Pseudomonas aeruginosa PA01
gaaguucagggagg

SEQ ID NO: 1516826 - RNA, 18 nt, Pseudomonas aeruginosa PA01
gaagucguccucgcccug

SEQ ID NO: 1516827 - RNA, 20 nt, Pseudomonas aeruginosa PA01
gaagucguccucgcccugcu

SEQ ID NO: 1516828 - RNA, 16 nt, Pseudomonas aeruginosa PA01
gaaguagaucgcccgc

SEQ ID NO: 1516829 - RNA, 16 nt, Pseudomonas aeruginosa PA01
gaagugaagcgaucca

SEQ ID NO: 1516830 - RNA, 19 nt, Pseudomonas aeruginosa PA01
gaagugaccgcgcgccaug

SEQ ID NO: 1516831 - RNA, 21 nt, Pseudomonas aeruginosa PA01
gaagucgcccugcccgguggg

SEQ ID NO: 1516832 - RNA, 21 nt, Pseudomonas aeruginosa PA01
gaauaccgcgcgcgcaaggcc

SEQ ID NO: 1516833 - RNA, 19 nt, Pseudomonas aeruginosa PA01
gaauagcgccgcaggcgcu

SEQ ID NO: 1516834 - RNA, 11 nt, Pseudomonas aeruginosa PA01
gaauccagggc

SEQ ID NO: 1516835 - RNA, 13 nt, Pseudomonas aeruginosa PA01
gaaucaagcaauu

SEQ ID NO: 1516836 - RNA, 23 nt, Pseudomonas aeruginosa PA01
gaaucgcaggcgaaaaaaagccc

SEQ ID NO: 1516837 - RNA, 14 nt, Pseudomonas aeruginosa PA01
gaaucgaacagggc

SEQ ID NO: 1516838 - RNA, 19 nt, Pseudomonas aeruginosa PA01
gaauccuucgcggcggcgc

SEQ ID NO: 1516839 - RNA, 13 nt, Pseudomonas aeruginosa PA01
gaaucgaaccccc

SEQ ID NO: 1516840 - RNA, 15 nt, Pseudomonas aeruginosa PA01
gaauguccugccgca

SEQ ID NO: 1516841 - RNA, 16 nt, Pseudomonas aeruginosa PA01
gaauguccugccgcag

SEQ ID NO: 1516842 - RNA, 22 nt, Pseudomonas aeruginosa PA01
gaauguccugccgcaggcgggc

SEQ ID NO: 1516843 - RNA, 23 nt, Pseudomonas aeruginosa PA01
gaauguugcggcgguggccgcgu

SEQ ID NO: 1516844 - RNA, 16 nt, Pseudomonas aeruginosa PA01
gaaugcgccucccgcu

SEQ ID NO: 1516845 - RNA, 16 nt, Pseudomonas aeruginosa PA01
gaaugcccggcagcgc

SEQ ID NO: 1516846 - RNA, 19 nt, Pseudomonas aeruginosa PA01
gaaugcccgugcgcugcgu

SEQ ID NO: 1516847 - RNA, 15 nt, Pseudomonas aeruginosa PA01
gacaagggccagagc

SEQ ID NO: 1516848 - RNA, 18 nt, Pseudomonas aeruginosa PA01
gacaagguuugcgccgcc

SEQ ID NO: 1516849 - RNA, 17 nt, Pseudomonas aeruginosa PA01
gacaacgaaaagagccg

SEQ ID NO: 1516850 - RNA, 19 nt, Pseudomonas aeruginosa PA01
gacaccccggucaggccga

SEQ ID NO: 1516851 - RNA, 14 nt, Pseudomonas aeruginosa PA01
gacuaacaggucaa

SEQ ID NO: 1516852 - RNA, 13 nt, Pseudomonas aeruginosa PA01
gacguucccgucc

SEQ ID NO: 1516853 - RNA, 23 nt, Pseudomonas aeruginosa PA01
gacguuccgcgauagcucagucg

SEQ ID NO: 1516854 - RNA, 14 nt, Pseudomonas aeruginosa PA01
gacguaggcggcga

SEQ ID NO: 1516855 - RNA, 19 nt, Pseudomonas aeruginosa PA01
gacguagaggaucucgcca

SEQ ID NO: 1516856 - RNA, 14 nt, Pseudomonas aeruginosa PA01
gacggcucuucccc

SEQ ID NO: 1516857 - RNA, 23 nt, Pseudomonas aeruginosa PA01
gacggcggacugcucgccgccgg

SEQ ID NO: 1516858 - RNA, 17 nt, Pseudomonas aeruginosa PA01
gacggugcggccguuca

SEQ ID NO: 1516859 - RNA, 20 nt, Pseudomonas aeruginosa PA01
gacggugauucguccggagc

SEQ ID NO: 1516860 - RNA, 21 nt, Pseudomonas aeruginosa PA01
gacggugcagccacccagcag

SEQ ID NO: 1516861 - RNA, 17 nt, Pseudomonas aeruginosa PA01
gacggugaucgccgcga

SEQ ID NO: 1516862 - RNA, 23 nt, Pseudomonas aeruginosa PA01
gacggugaucgccgcgaggugga

SEQ ID NO: 1516863 - RNA, 23 nt, Pseudomonas aeruginosa PA01
gacggaccgcgacaacccugucc

SEQ ID NO: 1516864 - RNA, 19 nt, Pseudomonas aeruginosa PA01
gacggcauuccugguccag

SEQ ID NO: 1516865 - RNA, 21 nt, Pseudomonas aeruginosa PA01
gacggcauuccugguccagcc

SEQ ID NO: 1516866 - RNA, 18 nt, Pseudomonas aeruginosa PA01
gacggaagcauggccggc

SEQ ID NO: 1516867 - RNA, 13 nt, Pseudomonas aeruginosa PA01
gacggaagcccuc

SEQ ID NO: 1516868 - RNA, 20 nt, Pseudomonas aeruginosa PA01
gacggcccugacauccuugg

SEQ ID NO: 1516869 - RNA, 13 nt, Pseudomonas aeruginosa PA01
gacgcuuguccuu

SEQ ID NO: 1516870 - RNA, 20 nt, Pseudomonas aeruginosa PA01
gacgccguccaccagccagc

SEQ ID NO: 1516871 - RNA, 17 nt, Pseudomonas aeruginosa PA01
gacgccggcgacgacga

SEQ ID NO: 1516872 - RNA, 14 nt, Pseudomonas aeruginosa PA01
gacgccggcuucca

SEQ ID NO: 1516873 - RNA, 18 nt, Pseudomonas aeruginosa PA01
gaccugccgcccggccag

SEQ ID NO: 1516874 - RNA, 15 nt, Pseudomonas aeruginosa PA01
gaccuggaagcgggu

SEQ ID NO: 1516875 - RNA, 19 nt, Pseudomonas aeruginosa PA01
gaccuggccggcgaccuug

SEQ ID NO: 1516876 - RNA, 21 nt, Pseudomonas aeruginosa PA01
gaccuggccgucccugaccag

SEQ ID NO: 1516877 - RNA, 15 nt, Pseudomonas aeruginosa PA01
gaccugcugcccggc

SEQ ID NO: 1516878 - RNA, 21 nt, Pseudomonas aeruginosa PA01
gaccggauguucgaaggccag

SEQ ID NO: 1516879 - RNA, 16 nt, Pseudomonas aeruginosa PA01
gaccggcagccggguu

SEQ ID NO: 1516880 - RNA, 13 nt, Pseudomonas aeruginosa PA01
gaccggccggcuc

SEQ ID NO: 1516881 - RNA, 17 nt, Pseudomonas aeruginosa PA01
gaccggcaucgaccagc

SEQ ID NO: 1516882 - RNA, 15 nt, Pseudomonas aeruginosa PA01
gacgaagaguaaaug

SEQ ID NO: 1516883 - RNA, 14 nt, Pseudomonas aeruginosa PA01
gacgaagcgccggc

SEQ ID NO: 1516884 - RNA, 18 nt, Pseudomonas aeruginosa PA01
gacgaagcgccggcggcc

SEQ ID NO: 1516885 - RNA, 18 nt, Pseudomonas aeruginosa PA01
gacgaaggcuggagcgcu

SEQ ID NO: 1516886 - RNA, 17 nt, Pseudomonas aeruginosa PA01
gacgaacgccuuggugu

SEQ ID NO: 1516887 - RNA, 16 nt, Pseudomonas aeruginosa PA01
gacgaagacgcugcgc

SEQ ID NO: 1516888 - RNA, 14 nt, Pseudomonas aeruginosa PA01
gacgaaagaagccg

SEQ ID NO: 1516889 - RNA, 17 nt, Pseudomonas aeruginosa PA01
gacgaaacucaucaggc

SEQ ID NO: 1516890 - RNA, 19 nt, Pseudomonas aeruginosa PA01
gacgaacaucgccagcgcc

SEQ ID NO: 1516891 - RNA, 17 nt, Pseudomonas aeruginosa PA01
gaccuuguccaggcgcu

SEQ ID NO: 1516892 - RNA, 15 nt, Pseudomonas aeruginosa PA01
gaccuuguccagggu

SEQ ID NO: 1516893 - RNA, 12 nt, Pseudomonas aeruginosa PA01
gaccuuguccug

SEQ ID NO: 1516894 - RNA, 19 nt, Pseudomonas aeruginosa PA01
gaccuuguccuggccggcg

SEQ ID NO: 1516895 - RNA, 16 nt, Pseudomonas aeruginosa PA01
gaccuuggagccaugc

SEQ ID NO: 1516896 - RNA, 16 nt, Pseudomonas aeruginosa PA01
gaccuugcucuucugg

SEQ ID NO: 1516897 - RNA, 13 nt, Pseudomonas aeruginosa PA01
gaccuugcccacc

SEQ ID NO: 1516898 - RNA, 22 nt, Pseudomonas aeruginosa PA01
gaccuugcccaccgggaucugc

SEQ ID NO: 1516899 - RNA, 21 nt, Pseudomonas aeruginosa PA01
gaccuugccccaggugcuuca

SEQ ID NO: 1516900 - RNA, 13 nt, Pseudomonas aeruginosa PA01
gaccuugcccuug

SEQ ID NO: 1516901 - RNA, 15 nt, Pseudomonas aeruginosa PA01
gaccuugccgagcgc

SEQ ID NO: 1516902 - RNA, 14 nt, Pseudomonas aeruginosa PA01
gaccuggggcggcc

SEQ ID NO: 1516903 - RNA, 21 nt, Pseudomonas aeruginosa PA01
gaccuggggcggccucaggcc

SEQ ID NO: 1516904 - RNA, 23 nt, Pseudomonas aeruginosa PA01
gacgcaggacgucguagccaggc

SEQ ID NO: 1516905 - RNA, 14 nt, Pseudomonas aeruginosa PA01
gacgcagggcggcg

SEQ ID NO: 1516906 - RNA, 15 nt, Pseudomonas aeruginosa PA01
gacgcagggcggcgc

SEQ ID NO: 1516907 - RNA, 13 nt, Pseudomonas aeruginosa PA01
gacgcagcgcgcg

SEQ ID NO: 1516908 - RNA, 16 nt, Pseudomonas aeruginosa PA01
gacgcagcgcgcgccg

SEQ ID NO: 1516909 - RNA, 21 nt, Pseudomonas aeruginosa PA01
gacgaucagcaggaugcaguc

SEQ ID NO: 1516910 - RNA, 20 nt, Pseudomonas aeruginosa PA01
gacgacgugcccauuuucca

SEQ ID NO: 1516911 - RNA, 15 nt, Pseudomonas aeruginosa PA01
gacgagguugcucug

SEQ ID NO: 1516912 - RNA, 23 nt, Pseudomonas aeruginosa PA01
gacgccaguuucuaucucccuau

SEQ ID NO: 1516913 - RNA, 14 nt, Pseudomonas aeruginosa PA01
gacgccagcucggc

SEQ ID NO: 1516914 - RNA, 12 nt, Pseudomonas aeruginosa PA01
gacgccauggcg

SEQ ID NO: 1516915 - RNA, 18 nt, Pseudomonas aeruginosa PA01
gacgccaccaggccgcug

SEQ ID NO: 1516916 - RNA, 14 nt, Pseudomonas aeruginosa PA01
gacgcccuccagca

SEQ ID NO: 1516917 - RNA, 20 nt, Pseudomonas aeruginosa PA01
gacgcccucggcgacgagga

SEQ ID NO: 1516918 - RNA, 16 nt, Pseudomonas aeruginosa PA01
gacgcccgcagccagc

SEQ ID NO: 1516919 - RNA, 24 nt, Pseudomonas aeruginosa PA01
gacgcccuggaugaucucgcagua

SEQ ID NO: 1516920 - RNA, 22 nt, Pseudomonas aeruginosa PA01
gacgcccuggcgcuugggcgcg

SEQ ID NO: 1516921 - RNA, 20 nt, Pseudomonas aeruginosa PA01
gacgcccugggcgacgcgga

SEQ ID NO: 1516922 - RNA, 20 nt, Pseudomonas aeruginosa PA01
gacgcccuugcggcgcggcc

SEQ ID NO: 1516923 - RNA, 16 nt, Pseudomonas aeruginosa PA01
gacgccgaacgcccca

SEQ ID NO: 1516924 - RNA, 15 nt, Pseudomonas aeruginosa PA01
gacgccgaagcgggc

SEQ ID NO: 1516925 - RNA, 16 nt, Pseudomonas aeruginosa PA01
gacgccgaagcgggcu

SEQ ID NO: 1516926 - RNA, 18 nt, Pseudomonas aeruginosa PA01
gacgccgaaggacaggcc

SEQ ID NO: 1516927 - RNA, 14 nt, Pseudomonas aeruginosa PA01
gacgccgcccggca

SEQ ID NO: 1516928 - RNA, 17 nt, Pseudomonas aeruginosa PA01
gacgccgagccagccgc

SEQ ID NO: 1516929 - RNA, 13 nt, Pseudomonas aeruginosa PA01
gacgccgcaggaa

SEQ ID NO: 1516930 - RNA, 14 nt, Pseudomonas aeruginosa PA01
gacgccggacgcac

SEQ ID NO: 1516931 - RNA, 20 nt, Pseudomonas aeruginosa PA01
gacgccggacgcaccagcag

SEQ ID NO: 1516932 - RNA, 13 nt, Pseudomonas aeruginosa PA01
gacgccgcuggcg

SEQ ID NO: 1516933 - RNA, 16 nt, Pseudomonas aeruginosa PA01
gacgccgcuggcggcg

SEQ ID NO: 1516934 - RNA, 22 nt, Pseudomonas aeruginosa PA01
gaccccgcccuagcgguccgga

SEQ ID NO: 1516935 - RNA, 15 nt, Pseudomonas aeruginosa PA01
gacccccugcggccc

SEQ ID NO: 1516936 - RNA, 16 nt, Pseudomonas aeruginosa PA01
gacccccugcggcccg

SEQ ID NO: 1516937 - RNA, 15 nt, Pseudomonas aeruginosa PA01
gaccccgaggucggc

SEQ ID NO: 1516938 - RNA, 22 nt, Pseudomonas aeruginosa PA01
gacccaucgaugcucauccugc

SEQ ID NO: 1516939 - RNA, 20 nt, Pseudomonas aeruginosa PA01
gaccgaagccgcgcagcacu

SEQ ID NO: 1516940 - RNA, 18 nt, Pseudomonas aeruginosa PA01
gaccgaacaucagcagca

SEQ ID NO: 1516941 - RNA, 10 nt, Pseudomonas aeruginosa PA01
gaccgagcag

SEQ ID NO: 1516942 - RNA, 16 nt, Pseudomonas aeruginosa PA01
gaccgagcagcggacg

SEQ ID NO: 1516943 - RNA, 12 nt, Pseudomonas aeruginosa PA01
gaccgccaggcc

SEQ ID NO: 1516944 - RNA, 17 nt, Pseudomonas aeruginosa PA01
gaccgcccgccucaggc

SEQ ID NO: 1516945 - RNA, 15 nt, Pseudomonas aeruginosa PA01
gaccgcccaggcugc

SEQ ID NO: 1516946 - RNA, 20 nt, Pseudomonas aeruginosa PA01
gaccgccccggcagccacca

SEQ ID NO: 1516947 - RNA, 19 nt, Pseudomonas aeruginosa PA01
gaccgccgcucaucugcac

SEQ ID NO: 1516948 - RNA, 21 nt, Pseudomonas aeruginosa PA01
gaccgcgacaacccugucccc

SEQ ID NO: 1516949 - RNA, 15 nt, Pseudomonas aeruginosa PA01
gaccgcgugggccgg

SEQ ID NO: 1516950 - RNA, 20 nt, Pseudomonas aeruginosa PA01
gaccgcgcgccauggccugg

SEQ ID NO: 1516951 - RNA, 18 nt, Pseudomonas aeruginosa PA01
gaccgcgcgccugcaacg

SEQ ID NO: 1516952 - RNA, 21 nt, Pseudomonas aeruginosa PA01
gaccgcgaguucgccggccag

SEQ ID NO: 1516953 - RNA, 17 nt, Pseudomonas aeruginosa PA01
gaccgccugccagaccg

SEQ ID NO: 1516954 - RNA, 17 nt, Pseudomonas aeruginosa PA01
gaccgcgagcgccgccu

SEQ ID NO: 1516955 - RNA, 12 nt, Pseudomonas aeruginosa PA01
gaccaucaccag

SEQ ID NO: 1516956 - RNA, 21 nt, Pseudomonas aeruginosa PA01
gaccaucgccggcgagccgcu

SEQ ID NO: 1516957 - RNA, 19 nt, Pseudomonas aeruginosa PA01
gaccauaggcuugcgccga

SEQ ID NO: 1516958 - RNA, 18 nt, Pseudomonas aeruginosa PA01
gacccaggcccagccggu

SEQ ID NO: 1516959 - RNA, 14 nt, Pseudomonas aeruginosa PA01
gacccaggccgaca

SEQ ID NO: 1516960 - RNA, 20 nt, Pseudomonas aeruginosa PA01
gacccaggugcgcaggcgcu

SEQ ID NO: 1516961 - RNA, 16 nt, Pseudomonas aeruginosa PA01
gacccagcgcacgccg

SEQ ID NO: 1516962 - RNA, 14 nt, Pseudomonas aeruginosa PA01
gacccagcgcuggu

SEQ ID NO: 1516963 - RNA, 16 nt, Pseudomonas aeruginosa PA01
gaccaucuuuuccugc

SEQ ID NO: 1516964 - RNA, 17 nt, Pseudomonas aeruginosa PA01
gaccaucuuuuccugcu

SEQ ID NO: 1516965 - RNA, 14 nt, Pseudomonas aeruginosa PA01
gaccauggccggcg

SEQ ID NO: 1516966 - RNA, 23 nt, Pseudomonas aeruginosa PA01
gaccauggugaugcgcaugcugg

SEQ ID NO: 1516967 - RNA, 17 nt, Pseudomonas aeruginosa PA01
gaccacccggugcagga

SEQ ID NO: 1516968 - RNA, 23 nt, Pseudomonas aeruginosa PA01
gaccacccggugcaggaacaggu

SEQ ID NO: 1516969 - RNA, 15 nt, Pseudomonas aeruginosa PA01
gaccaccgccaggcu

SEQ ID NO: 1516970 - RNA, 21 nt, Pseudomonas aeruginosa PA01
gaccaccgugcgcaccucgcc

SEQ ID NO: 1516971 - RNA, 18 nt, Pseudomonas aeruginosa PA01
gaccaccuucaggcugcu

SEQ ID NO: 1516972 - RNA, 21 nt, Pseudomonas aeruginosa PA01
gaccaccuucaggcugcucau

SEQ ID NO: 1516973 - RNA, 14 nt, Pseudomonas aeruginosa PA01
gaccacgcaggcca

SEQ ID NO: 1516974 - RNA, 15 nt, Pseudomonas aeruginosa PA01
gaccacgcaggccag

SEQ ID NO: 1516975 - RNA, 17 nt, Pseudomonas aeruginosa PA01
gaccacgcaggccagcg

SEQ ID NO: 1516976 - RNA, 13 nt, Pseudomonas aeruginosa PA01
gaccagcggcggu

SEQ ID NO: 1516977 - RNA, 17 nt, Pseudomonas aeruginosa PA01
gaccagcuccgaaggga

SEQ ID NO: 1516978 - RNA, 23 nt, Pseudomonas aeruginosa PA01
gaccagcggcaccgagagcugca

SEQ ID NO: 1516979 - RNA, 19 nt, Pseudomonas aeruginosa PA01
gaccagcgccgcggcgacc

SEQ ID NO: 1516980 - RNA, 13 nt, Pseudomonas aeruginosa PA01
gacauccaccagg

SEQ ID NO: 1516981 - RNA, 22 nt, Pseudomonas aeruginosa PA01
gacaucgauaacaccaggagcg

SEQ ID NO: 1516982 - RNA, 15 nt, Pseudomonas aeruginosa PA01
gacauccucccugcc

SEQ ID NO: 1516983 - RNA, 16 nt, Pseudomonas aeruginosa PA01
gacauccucccugccc

SEQ ID NO: 1516984 - RNA, 14 nt, Pseudomonas aeruginosa PA01
gacauggcgcucga

SEQ ID NO: 1516985 - RNA, 21 nt, Pseudomonas aeruginosa PA01
gacaugccgguucccgcagcg

SEQ ID NO: 1516986 - RNA, 18 nt, Pseudomonas aeruginosa PA01
gacauggagaccuggcug

SEQ ID NO: 1516987 - RNA, 15 nt, Pseudomonas aeruginosa PA01
gaccacacaugcagg

SEQ ID NO: 1516988 - RNA, 17 nt, Pseudomonas aeruginosa PA01
gaccaccaucaccgcca

SEQ ID NO: 1516989 - RNA, 23 nt, Pseudomonas aeruginosa PA01
gaccaccaucaccgccaucagca

SEQ ID NO: 1516990 - RNA, 16 nt, Pseudomonas aeruginosa PA01
gaccaccagcagcagc

SEQ ID NO: 1516991 - RNA, 13 nt, Pseudomonas aeruginosa PA01
gaccaccagcagg

SEQ ID NO: 1516992 - RNA, 12 nt, Pseudomonas aeruginosa PA01
gaccacaggcgg

SEQ ID NO: 1516993 - RNA, 22 nt, Pseudomonas aeruginosa PA01
gaccacaggcggcggaagaagc

SEQ ID NO: 1516994 - RNA, 23 nt, Pseudomonas aeruginosa PA01
gaccacaggcggcggaagaagcc

SEQ ID NO: 1516995 - RNA, 16 nt, Pseudomonas aeruginosa PA01
gaccacaucggccagu

SEQ ID NO: 1516996 - RNA, 14 nt, Pseudomonas aeruginosa PA01
gaccaccaccaggu

SEQ ID NO: 1516997 - RNA, 18 nt, Pseudomonas aeruginosa PA01
gaccaccaccaggucggc

SEQ ID NO: 1516998 - RNA, 18 nt, Pseudomonas aeruginosa PA01
gacagaucgagagcuucu

SEQ ID NO: 1516999 - RNA, 14 nt, Pseudomonas aeruginosa PA01
gacaccgccagcac

SEQ ID NO: 1517000 - RNA, 16 nt, Pseudomonas aeruginosa PA01
gacaccgccagcaccu

SEQ ID NO: 1517001 - RNA, 21 nt, Pseudomonas aeruginosa PA01
gacacccugcugcugcucagc

SEQ ID NO: 1517002 - RNA, 20 nt, Pseudomonas aeruginosa PA01
gacaggcccuugaacaggcu

SEQ ID NO: 1517003 - RNA, 17 nt, Pseudomonas aeruginosa PA01
gacaggccgaccagcag

SEQ ID NO: 1517004 - RNA, 18 nt, Pseudomonas aeruginosa PA01
gacaggccgaccagcagg

SEQ ID NO: 1517005 - RNA, 13 nt, Pseudomonas aeruginosa PA01
gacaggcagccgg

SEQ ID NO: 1517006 - RNA, 14 nt, Pseudomonas aeruginosa PA01
gacaggcagccggc

SEQ ID NO: 1517007 - RNA, 18 nt, Pseudomonas aeruginosa PA01
gacagcccgcgcucggcc

SEQ ID NO: 1517008 - RNA, 22 nt, Pseudomonas aeruginosa PA01
gacagcccuccaaagaaaagcc

SEQ ID NO: 1517009 - RNA, 17 nt, Pseudomonas aeruginosa PA01
gacaggcuggugccgua

SEQ ID NO: 1517010 - RNA, 21 nt, Pseudomonas aeruginosa PA01
gacaggcgucccuggagcagg

SEQ ID NO: 1517011 - RNA, 22 nt, Pseudomonas aeruginosa PA01
gacaggcgucccuggagcaggg

SEQ ID NO: 1517012 - RNA, 23 nt, Pseudomonas aeruginosa PA01
gacaggccuguggauagaaaagc

SEQ ID NO: 1517013 - RNA, 18 nt, Pseudomonas aeruginosa PA01
gacaggucggcgaaaucc

SEQ ID NO: 1517014 - RNA, 20 nt, Pseudomonas aeruginosa PA01
gacaggucggcgaaauccuc

SEQ ID NO: 1517015 - RNA, 17 nt, Pseudomonas aeruginosa PA01
gacagguucaggacgcu

SEQ ID NO: 1517016 - RNA, 16 nt, Pseudomonas aeruginosa PA01
gacagguucaggucga

SEQ ID NO: 1517017 - RNA, 19 nt, Pseudomonas aeruginosa PA01
gaaaucaccgcugcgcagg

SEQ ID NO: 1517018 - RNA, 15 nt, Pseudomonas aeruginosa PA01
gaaauccggugccuu

SEQ ID NO: 1517019 - RNA, 22 nt, Pseudomonas aeruginosa PA01
gaaagcuccucggccuugcugg

SEQ ID NO: 1517020 - RNA, 17 nt, Pseudomonas aeruginosa PA01
gaaagcgucagcgcgcc

SEQ ID NO: 1517021 - RNA, 21 nt, Pseudomonas aeruginosa PA01
gaaagcgucagcgcgccagca

SEQ ID NO: 1517022 - RNA, 18 nt, Pseudomonas aeruginosa PA01
gaaaaucauccacaggcg

SEQ ID NO: 1517023 - RNA, 13 nt, Pseudomonas aeruginosa PA01
gaaacugcgcagg

SEQ ID NO: 1517024 - RNA, 18 nt, Pseudomonas aeruginosa PA01
gaaacugcgcaggcuggu

SEQ ID NO: 1517025 - RNA, 18 nt, Pseudomonas aeruginosa PA01
gaaauucagcgcuuccuu

SEQ ID NO: 1517026 - RNA, 16 nt, Pseudomonas aeruginosa PA01
gaaauucgcgcuggau

SEQ ID NO: 1517027 - RNA, 15 nt, Pseudomonas aeruginosa PA01
gaaaucggccacucc

SEQ ID NO: 1517028 - RNA, 19 nt, Pseudomonas aeruginosa PA01
gaaaucggccacuccagcc

SEQ ID NO: 1517029 - RNA, 15 nt, Pseudomonas aeruginosa PA01
gaaaucgagcugcuc

SEQ ID NO: 1517030 - RNA, 19 nt, Pseudomonas aeruginosa PA01
gaacaggcgauagccgacc

SEQ ID NO: 1517031 - RNA, 23 nt, Pseudomonas aeruginosa PA01
gaacagcuugaaccgcgagaccc

SEQ ID NO: 1517032 - RNA, 15 nt, Pseudomonas aeruginosa PA01
gaacagcuugccgcu

SEQ ID NO: 1517033 - RNA, 12 nt, Pseudomonas aeruginosa PA01
gaacaggaaacu

SEQ ID NO: 1517034 - RNA, 16 nt, Pseudomonas aeruginosa PA01
gaacagcuccuccagc

SEQ ID NO: 1517035 - RNA, 18 nt, Pseudomonas aeruginosa PA01
gaacagcuccuccagccg

SEQ ID NO: 1517036 - RNA, 20 nt, Pseudomonas aeruginosa PA01
gaacagcuccuccagccgcg

SEQ ID NO: 1517037 - RNA, 12 nt, Pseudomonas aeruginosa PA01
gaacagcagcgg

SEQ ID NO: 1517038 - RNA, 12 nt, Pseudomonas aeruginosa PA01
gaacagcaggga

SEQ ID NO: 1517039 - RNA, 13 nt, Pseudomonas aeruginosa PA01
gaacagcaggguc

SEQ ID NO: 1517040 - RNA, 20 nt, Pseudomonas aeruginosa PA01
gaacagcgggucgcggcugg

SEQ ID NO: 1517041 - RNA, 13 nt, Pseudomonas aeruginosa PA01
gaacagccagagg

SEQ ID NO: 1517042 - RNA, 14 nt, Pseudomonas aeruginosa PA01
gaacagcagcaagc

SEQ ID NO: 1517043 - RNA, 23 nt, Pseudomonas aeruginosa PA01
gaacacgcacaaugaaaaaggga

SEQ ID NO: 1517044 - RNA, 21 nt, Pseudomonas aeruginosa PA01
gaacacgccccagaagcccca

SEQ ID NO: 1517045 - RNA, 21 nt, Pseudomonas aeruginosa PA01
gaacaccggcgccgccuggcc

SEQ ID NO: 1517046 - RNA, 22 nt, Pseudomonas aeruginosa PA01
gaacgguggccccucagaagua

SEQ ID NO: 1517047 - RNA, 16 nt, Pseudomonas aeruginosa PA01
gaacgugcgcgcaacu

SEQ ID NO: 1517048 - RNA, 14 nt, Pseudomonas aeruginosa PA01
gaacgugcggccug

SEQ ID NO: 1517049 - RNA, 19 nt, Pseudomonas aeruginosa PA01
gaacggcagcgucucagcc

SEQ ID NO: 1517050 - RNA, 21 nt, Pseudomonas aeruginosa PA01
gaacggcagcuggauccgugc

SEQ ID NO: 1517051 - RNA, 19 nt, Pseudomonas aeruginosa PA01
gaacggccaggucuucugg

SEQ ID NO: 1517052 - RNA, 21 nt, Pseudomonas aeruginosa PA01
gaacggccaggucuucuggaa

SEQ ID NO: 1517053 - RNA, 22 nt, Pseudomonas aeruginosa PA01
gaacggccaggucuucuggaaa

SEQ ID NO: 1517054 - RNA, 13 nt, Pseudomonas aeruginosa PA01
gaacgggcucacc

SEQ ID NO: 1517055 - RNA, 20 nt, Pseudomonas aeruginosa PA01
gaacggcuuguucagcucgg

SEQ ID NO: 1517056 - RNA, 19 nt, Pseudomonas aeruginosa PA01
gaacgcggcuucggucagg

SEQ ID NO: 1517057 - RNA, 23 nt, Pseudomonas aeruginosa PA01
gaacgcggcuucggucagguggg

SEQ ID NO: 1517058 - RNA, 18 nt, Pseudomonas aeruginosa PA01
gaacgcgcugacggcaag

SEQ ID NO: 1517059 - RNA, 13 nt, Pseudomonas aeruginosa PA01
gaacgccucgcag

SEQ ID NO: 1517060 - RNA, 22 nt, Pseudomonas aeruginosa PA01
gaacgccucgcagagcgccagc

SEQ ID NO: 1517061 - RNA, 20 nt, Pseudomonas aeruginosa PA01
gaacgccgcgcaccucgacc

SEQ ID NO: 1517062 - RNA, 21 nt, Pseudomonas aeruginosa PA01
gaacgccgggcaacgccaggc

SEQ ID NO: 1517063 - RNA, 11 nt, Pseudomonas aeruginosa PA01
gaacgccaggc

SEQ ID NO: 1517064 - RNA, 13 nt, Pseudomonas aeruginosa PA01
gaacgccaggcag

SEQ ID NO: 1517065 - RNA, 19 nt, Pseudomonas aeruginosa PA01
gaacgccaggcaggcgguc

SEQ ID NO: 1517066 - RNA, 13 nt, Pseudomonas aeruginosa PA01
gaacgccgcagcu

SEQ ID NO: 1517067 - RNA, 20 nt, Pseudomonas aeruginosa PA01
gaacgcccgcggcagcagcc

SEQ ID NO: 1517068 - RNA, 20 nt, Pseudomonas aeruginosa PA01
gaacgcacuucguccgccac

SEQ ID NO: 1517069 - RNA, 22 nt, Pseudomonas aeruginosa PA01
gaacgcacuucguccgccacca

SEQ ID NO: 1517070 - RNA, 17 nt, Pseudomonas aeruginosa PA01
gaacgaggcgacccggg

SEQ ID NO: 1517071 - RNA, 22 nt, Pseudomonas aeruginosa PA01
gaacgaggcgacccgggucagg

SEQ ID NO: 1517072 - RNA, 22 nt, Pseudomonas aeruginosa PA01
gaacgaguugggcgaccugcuc

SEQ ID NO: 1517073 - RNA, 11 nt, Pseudomonas aeruginosa PA01
gaacugcaggg

SEQ ID NO: 1517074 - RNA, 17 nt, Pseudomonas aeruginosa PA01
gaacuggaugucgcugg

SEQ ID NO: 1517075 - RNA, 21 nt, Pseudomonas aeruginosa PA01
gaacuggaugucgcuggccag

SEQ ID NO: 1517076 - RNA, 22 nt, Pseudomonas aeruginosa PA01
gaacuggaugucgcuggccagc

SEQ ID NO: 1517077 - RNA, 19 nt, Pseudomonas aeruginosa PA01
gaacucgguguagcugagg

SEQ ID NO: 1517078 - RNA, 20 nt, Pseudomonas aeruginosa PA01
gaacucggcgcccagggcuu

SEQ ID NO: 1517079 - RNA, 21 nt, Pseudomonas aeruginosa PA01
gaacucguccggucgcaccgc

SEQ ID NO: 1517080 - RNA, 17 nt, Pseudomonas aeruginosa PA01
gaacucgcuguagcaca

SEQ ID NO: 1517081 - RNA, 18 nt, Pseudomonas aeruginosa PA01
gaacuccggggugaagcu

SEQ ID NO: 1517082 - RNA, 19 nt, Pseudomonas aeruginosa PA01
gaacuccggggugaagcuc

SEQ ID NO: 1517083 - RNA, 22 nt, Pseudomonas aeruginosa PA01
gaacuccggggugaagcucuuc

SEQ ID NO: 1517084 - RNA, 22 nt, Pseudomonas aeruginosa PA01
gaacuccugauagggggcugcg

SEQ ID NO: 1517085 - RNA, 16 nt, Pseudomonas aeruginosa PA01
gaacuccgagcaggac

SEQ ID NO: 1517086 - RNA, 15 nt, Pseudomonas aeruginosa PA01
gaacuccgccagcac

SEQ ID NO: 1517087 - RNA, 16 nt, Pseudomonas aeruginosa PA01
gaacuccgccagcacc

SEQ ID NO: 1517088 - RNA, 18 nt, Pseudomonas aeruginosa PA01
gaacucgacuucuucgcu

SEQ ID NO: 1517089 - RNA, 23 nt, Pseudomonas aeruginosa PA01
gaacucgcccucgaucuugccgg

SEQ ID NO: 1517090 - RNA, 20 nt, Pseudomonas aeruginosa PA01
gaacucgaacgcgugaagcu

SEQ ID NO: 1517091 - RNA, 17 nt, Pseudomonas aeruginosa PA01
gaacucgaaggccagcu

SEQ ID NO: 1517092 - RNA, 23 nt, Pseudomonas aeruginosa PA01
gaacucaacgaagugaagcgauc

SEQ ID NO: 1517093 - RNA, 15 nt, Pseudomonas aeruginosa PA01
gaacuagcccucgac

SEQ ID NO: 1517094 - RNA, 15 nt, Pseudomonas aeruginosa PA01
gaaccacaccugcaa

SEQ ID NO: 1517095 - RNA, 17 nt, Pseudomonas aeruginosa PA01
gaaccacaccugcaaca

SEQ ID NO: 1517096 - RNA, 15 nt, Pseudomonas aeruginosa PA01
gaacccaaucacaac

SEQ ID NO: 1517097 - RNA, 14 nt, Pseudomonas aeruginosa PA01
gaacccagacagcc

SEQ ID NO: 1517098 - RNA, 17 nt, Pseudomonas aeruginosa PA01
gaacccagacagcccuc

SEQ ID NO: 1517099 - RNA, 20 nt, Pseudomonas aeruginosa PA01
gaacccauggcgcgaugcuc

SEQ ID NO: 1517100 - RNA, 23 nt, Pseudomonas aeruginosa PA01
gaacccaggcgcugcguuccugu

SEQ ID NO: 1517101 - RNA, 16 nt, Pseudomonas aeruginosa PA01
gaaccaguccagcacg

SEQ ID NO: 1517102 - RNA, 21 nt, Pseudomonas aeruginosa PA01
gaaccaggggucgacgcaggg

SEQ ID NO: 1517103 - RNA, 12 nt, Pseudomonas aeruginosa PA01
gaaccagcagca

SEQ ID NO: 1517104 - RNA, 17 nt, Pseudomonas aeruginosa PA01
gaaccagcucagcucca

SEQ ID NO: 1517105 - RNA, 16 nt, Pseudomonas aeruginosa PA01
gaaccagcagcagguc

SEQ ID NO: 1517106 - RNA, 19 nt, Pseudomonas aeruginosa PA01
gaaccagacgcucggccag

SEQ ID NO: 1517107 - RNA, 21 nt, Pseudomonas aeruginosa PA01
gaaccagacgcucggccagcg

SEQ ID NO: 1517108 - RNA, 15 nt, Pseudomonas aeruginosa PA01
gaaccgcagaagacg

SEQ ID NO: 1517109 - RNA, 23 nt, Pseudomonas aeruginosa PA01
gaacccgaaucccuuggcugcuc

SEQ ID NO: 1517110 - RNA, 17 nt, Pseudomonas aeruginosa PA01
gaaccccgggccgcgca

SEQ ID NO: 1517111 - RNA, 14 nt, Pseudomonas aeruginosa PA01
gaaccggggcggcc

SEQ ID NO: 1517112 - RNA, 18 nt, Pseudomonas aeruginosa PA01
gaaccggggcguuacagu

SEQ ID NO: 1517113 - RNA, 18 nt, Pseudomonas aeruginosa PA01
gaaccggaaaagaagccg

SEQ ID NO: 1517114 - RNA, 20 nt, Pseudomonas aeruginosa PA01
gaaccggaaaagaagccgcg

SEQ ID NO: 1517115 - RNA, 15 nt, Pseudomonas aeruginosa PA01
gaaccguccgcagcg

SEQ ID NO: 1517116 - RNA, 19 nt, Pseudomonas aeruginosa PA01
gaaccguggcggccgccgc

SEQ ID NO: 1517117 - RNA, 16 nt, Pseudomonas aeruginosa PA01
gaaccugcaugucacc

SEQ ID NO: 1517118 - RNA, 16 nt, Pseudomonas aeruginosa PA01
gaacgaccgguagcca

SEQ ID NO: 1517119 - RNA, 13 nt, Pseudomonas aeruginosa PA01
gaacgagaagccg

SEQ ID NO: 1517120 - RNA, 22 nt, Pseudomonas aeruginosa PA01
gaacgagagguugcuguagaau

SEQ ID NO: 1517121 - RNA, 14 nt, Pseudomonas aeruginosa PA01
gaacgagcccaggc

SEQ ID NO: 1517122 - RNA, 14 nt, Pseudomonas aeruginosa PA01
gaacgacuccagcu

SEQ ID NO: 1517123 - RNA, 20 nt, Pseudomonas aeruginosa PA01
aaagaccgaccaguaccagc

SEQ ID NO: 1517124 - RNA, 16 nt, Pseudomonas aeruginosa PA01
cuuuucgaacaauccc

SEQ ID NO: 1517125 - RNA, 20 nt, Pseudomonas aeruginosa PA01
cuuuucgaacaaucccagcu

SEQ ID NO: 1517126 - RNA, 19 nt, Pseudomonas aeruginosa PA01
cuuuucuauuucccgugcg

SEQ ID NO: 1517127 - RNA, 15 nt, Pseudomonas aeruginosa PA01
cuuuucucgccuccc

SEQ ID NO: 1517128 - RNA, 22 nt, Pseudomonas aeruginosa PA01
cuuuuccugcuggcgaauuucc

SEQ ID NO: 1517129 - RNA, 20 nt, Pseudomonas aeruginosa PA01
cuuuucccgcaccggcgcgc

SEQ ID NO: 1517130 - RNA, 17 nt, Pseudomonas aeruginosa PA01
cuuuuccgaauacugca

SEQ ID NO: 1517131 - RNA, 14 nt, Pseudomonas aeruginosa PA01
cuuuucccagcggc

SEQ ID NO: 1517132 - RNA, 17 nt, Pseudomonas aeruginosa PA01
gaaaacaagaagccccg

SEQ ID NO: 1517133 - RNA, 21 nt, Pseudomonas aeruginosa PA01
gaaaaagccggcgcaugcgcc

SEQ ID NO: 1517134 - RNA, 22 nt, Pseudomonas aeruginosa PA01
gaaaaaggcgccuucgggcgcc

SEQ ID NO: 1517135 - RNA, 12 nt, Pseudomonas aeruginosa PA01
gaaaaagccccu

SEQ ID NO: 1517136 - RNA, 17 nt, Pseudomonas aeruginosa PA01
gaaaaagccccugcgcc

SEQ ID NO: 1517137 - RNA, 14 nt, Pseudomonas aeruginosa PA01
gaaaaagcccggcc

SEQ ID NO: 1517138 - RNA, 18 nt, Pseudomonas aeruginosa PA01
gaaaaagcccggccuggu

SEQ ID NO: 1517139 - RNA, 13 nt, Pseudomonas aeruginosa PA01
gaaaaaaaagccc

SEQ ID NO: 1517140 - RNA, 15 nt, Pseudomonas aeruginosa PA01
cuuuuuucagccugu

SEQ ID NO: 1517141 - RNA, 16 nt, Pseudomonas aeruginosa PA01
cuuuuucguuggccag

SEQ ID NO: 1517142 - RNA, 12 nt, Pseudomonas aeruginosa PA01
gaaaaccgcaga

SEQ ID NO: 1517143 - RNA, 18 nt, Pseudomonas aeruginosa PA01
gaaaacggcgacccuggg

SEQ ID NO: 1517144 - RNA, 21 nt, Pseudomonas aeruginosa PA01
gaaaacgcccggcaucugccg

SEQ ID NO: 1517145 - RNA, 12 nt, Pseudomonas aeruginosa PA01
gaaaacgccgcu

SEQ ID NO: 1517146 - RNA, 12 nt, Pseudomonas aeruginosa PA01
gaaaagcaggcc

SEQ ID NO: 1517147 - RNA, 16 nt, Pseudomonas aeruginosa PA01
gaaaauaacgcuugac

SEQ ID NO: 1517148 - RNA, 19 nt, Pseudomonas aeruginosa PA01
gaaaagaagccccgcagcc

SEQ ID NO: 1517149 - RNA, 21 nt, Pseudomonas aeruginosa PA01
gaaaagaagccgcgcaaggca

SEQ ID NO: 1517150 - RNA, 22 nt, Pseudomonas aeruginosa PA01
cuucggcgcauagccaccgccg

SEQ ID NO: 1517151 - RNA, 15 nt, Pseudomonas aeruginosa PA01
cuucggcgcccacuc

SEQ ID NO: 1517152 - RNA, 19 nt, Pseudomonas aeruginosa PA01
cuucggcgccggagcuggu

SEQ ID NO: 1517153 - RNA, 15 nt, Pseudomonas aeruginosa PA01
cuucggcgcgcggca

SEQ ID NO: 1517154 - RNA, 14 nt, Pseudomonas aeruginosa PA01
cuucggcggcgccg

SEQ ID NO: 1517155 - RNA, 17 nt, Pseudomonas aeruginosa PA01
cuucgcuggaccaggcg

SEQ ID NO: 1517156 - RNA, 14 nt, Pseudomonas aeruginosa PA01
cuucgcgugggcca

SEQ ID NO: 1517157 - RNA, 22 nt, Pseudomonas aeruginosa PA01
cuucgcguuggcggugccgcag

SEQ ID NO: 1517158 - RNA, 14 nt, Pseudomonas aeruginosa PA01
cuucggcaagcacc

SEQ ID NO: 1517159 - RNA, 20 nt, Pseudomonas aeruginosa PA01
cuucgcuggugcucaugccu

SEQ ID NO: 1517160 - RNA, 18 nt, Pseudomonas aeruginosa PA01
cuuucagguccuugauca

SEQ ID NO: 1517161 - RNA, 19 nt, Pseudomonas aeruginosa PA01
cuuucagguccuugaucac

SEQ ID NO: 1517162 - RNA, 23 nt, Pseudomonas aeruginosa PA01
cuuuauccacgcgguuccacucc

SEQ ID NO: 1517163 - RNA, 15 nt, Pseudomonas aeruginosa PA01
cuuucuucugcugug

SEQ ID NO: 1517164 - RNA, 15 nt, Pseudomonas aeruginosa PA01
cuuuccgaagccccg

SEQ ID NO: 1517165 - RNA, 17 nt, Pseudomonas aeruginosa PA01
cuuucguuucagcgcca

SEQ ID NO: 1517166 - RNA, 15 nt, Pseudomonas aeruginosa PA01
gauagggcaucagcc

SEQ ID NO: 1517167 - RNA, 16 nt, Pseudomonas aeruginosa PA01
gauagggcaucagccc

SEQ ID NO: 1517168 - RNA, 15 nt, Pseudomonas aeruginosa PA01
gauagcuuuccaggg

SEQ ID NO: 1517169 - RNA, 15 nt, Pseudomonas aeruginosa PA01
gauacgcacgcuggu

SEQ ID NO: 1517170 - RNA, 12 nt, Pseudomonas aeruginosa PA01
gauacuccuuca

SEQ ID NO: 1517171 - RNA, 18 nt, Pseudomonas aeruginosa PA01
gauacggcaggguagcca

SEQ ID NO: 1517172 - RNA, 16 nt, Pseudomonas aeruginosa PA01
gauagagcacgcccau

SEQ ID NO: 1517173 - RNA, 21 nt, Pseudomonas aeruginosa PA01
gauagagcacgcccauggaga

SEQ ID NO: 1517174 - RNA, 13 nt, Pseudomonas aeruginosa PA01
gauagagcuucuc

SEQ ID NO: 1517175 - RNA, 23 nt, Pseudomonas aeruginosa PA01
gaucagccggcccauccgccgca

SEQ ID NO: 1517176 - RNA, 16 nt, Pseudomonas aeruginosa PA01
gaucagccagccggcg

SEQ ID NO: 1517177 - RNA, 13 nt, Pseudomonas aeruginosa PA01
gaucagccagggc

SEQ ID NO: 1517178 - RNA, 19 nt, Pseudomonas aeruginosa PA01
gaucagcccgcugaccggg

SEQ ID NO: 1517179 - RNA, 16 nt, Pseudomonas aeruginosa PA01
gaucagcccgucggcc

SEQ ID NO: 1517180 - RNA, 22 nt, Pseudomonas aeruginosa PA01
gaucagcccuucgcgcucgacg

SEQ ID NO: 1517181 - RNA, 14 nt, Pseudomonas aeruginosa PA01
gaucagcagcaccg

SEQ ID NO: 1517182 - RNA, 11 nt, Pseudomonas aeruginosa PA01
gaucagcagca

SEQ ID NO: 1517183 - RNA, 21 nt, Pseudomonas aeruginosa PA01
gaucaccggcuggcccuccau

SEQ ID NO: 1517184 - RNA, 20 nt, Pseudomonas aeruginosa PA01
gaucacgaagcggucgccgg

SEQ ID NO: 1517185 - RNA, 21 nt, Pseudomonas aeruginosa PA01
gaucaccuuaguuaucacaac

SEQ ID NO: 1517186 - RNA, 22 nt, Pseudomonas aeruginosa PA01
gaucacgaucggcaccaucacc

SEQ ID NO: 1517187 - RNA, 23 nt, Pseudomonas aeruginosa PA01
gaucacgcaagugcccugggcga

SEQ ID NO: 1517188 - RNA, 11 nt, Pseudomonas aeruginosa PA01
gaucacgcuga

SEQ ID NO: 1517189 - RNA, 15 nt, Pseudomonas aeruginosa PA01
gaucacggcgccccg

SEQ ID NO: 1517190 - RNA, 21 nt, Pseudomonas aeruginosa PA01
gaucacggugaugguaucgcc

SEQ ID NO: 1517191 - RNA, 14 nt, Pseudomonas aeruginosa PA01
gaucacucccugcu

SEQ ID NO: 1517192 - RNA, 12 nt, Pseudomonas aeruginosa PA01
gaucacccccag

SEQ ID NO: 1517193 - RNA, 18 nt, Pseudomonas aeruginosa PA01
gaucacccccagcgagcc

SEQ ID NO: 1517194 - RNA, 16 nt, Pseudomonas aeruginosa PA01
gaucaccagccacugc

SEQ ID NO: 1517195 - RNA, 19 nt, Pseudomonas aeruginosa PA01
gaucaccaccagcaucagc

SEQ ID NO: 1517196 - RNA, 16 nt, Pseudomonas aeruginosa PA01
gaucaccaccagcgcc

SEQ ID NO: 1517197 - RNA, 22 nt, Pseudomonas aeruginosa PA01
gauauggccgaucaccuggcca

SEQ ID NO: 1517198 - RNA, 17 nt, Pseudomonas aeruginosa PA01
gaucaacgcggccagca

SEQ ID NO: 1517199 - RNA, 18 nt, Pseudomonas aeruginosa PA01
gaucaacgcggccagcag

SEQ ID NO: 1517200 - RNA, 19 nt, Pseudomonas aeruginosa PA01
gaucaacgcggccagcagc

SEQ ID NO: 1517201 - RNA, 20 nt, Pseudomonas aeruginosa PA01
gaucaacgcggccagcagca

SEQ ID NO: 1517202 - RNA, 18 nt, Pseudomonas aeruginosa PA01
gaucaacuccgccaggcg

SEQ ID NO: 1517203 - RNA, 17 nt, Pseudomonas aeruginosa PA01
gaucaggcguaggccgu

SEQ ID NO: 1517204 - RNA, 21 nt, Pseudomonas aeruginosa PA01
gaucagggccucgccacgcuu

SEQ ID NO: 1517205 - RNA, 16 nt, Pseudomonas aeruginosa PA01
gaucaggcugggguug

SEQ ID NO: 1517206 - RNA, 16 nt, Pseudomonas aeruginosa PA01
gaucaggcuguccacg

SEQ ID NO: 1517207 - RNA, 18 nt, Pseudomonas aeruginosa PA01
gaucaggucgcgcgccuu

SEQ ID NO: 1517208 - RNA, 22 nt, Pseudomonas aeruginosa PA01
gaucaggucgcgcgccuucagc

SEQ ID NO: 1517209 - RNA, 19 nt, Pseudomonas aeruginosa PA01
gaucagugcaucggccgcc

SEQ ID NO: 1517210 - RNA, 18 nt, Pseudomonas aeruginosa PA01
gaucaguucggagaagga

SEQ ID NO: 1517211 - RNA, 21 nt, Pseudomonas aeruginosa PA01
gaucaguucgugccaggcgac

SEQ ID NO: 1517212 - RNA, 23 nt, Pseudomonas aeruginosa PA01
gaucaguggucgcagcuccagcg

SEQ ID NO: 1517213 - RNA, 17 nt, Pseudomonas aeruginosa PA01
gaucaggccuuccggga

SEQ ID NO: 1517214 - RNA, 14 nt, Pseudomonas aeruginosa PA01
gaucaggccgagca

SEQ ID NO: 1517215 - RNA, 18 nt, Pseudomonas aeruginosa PA01
gaucagcucgaucagccc

SEQ ID NO: 1517216 - RNA, 23 nt, Pseudomonas aeruginosa PA01
gaucagcucgcgguaggccagcu

SEQ ID NO: 1517217 - RNA, 22 nt, Pseudomonas aeruginosa PA01
gaucagcuccgccucgaucuuc

SEQ ID NO: 1517218 - RNA, 20 nt, Pseudomonas aeruginosa PA01
gaucagcuucucuuucaccu

SEQ ID NO: 1517219 - RNA, 15 nt, Pseudomonas aeruginosa PA01
gaucagcuuggccuu

SEQ ID NO: 1517220 - RNA, 19 nt, Pseudomonas aeruginosa PA01
gaucagcggaccggugaga

SEQ ID NO: 1517221 - RNA, 17 nt, Pseudomonas aeruginosa PA01
gaucagcggcccgagca

SEQ ID NO: 1517222 - RNA, 16 nt, Pseudomonas aeruginosa PA01
gaucagcgcccggcac

SEQ ID NO: 1517223 - RNA, 15 nt, Pseudomonas aeruginosa PA01
gaucaucagcagggu

SEQ ID NO: 1517224 - RNA, 20 nt, Pseudomonas aeruginosa PA01
gaucaucgccagcggcguau

SEQ ID NO: 1517225 - RNA, 16 nt, Pseudomonas aeruginosa PA01
gaucauguagagcagg

SEQ ID NO: 1517226 - RNA, 19 nt, Pseudomonas aeruginosa PA01
gaucaugggggccagcagg

SEQ ID NO: 1517227 - RNA, 20 nt, Pseudomonas aeruginosa PA01
gaucaugggugaagaccagu

SEQ ID NO: 1517228 - RNA, 21 nt, Pseudomonas aeruginosa PA01
gaucuccgcgccgggcuggcc

SEQ ID NO: 1517229 - RNA, 22 nt, Pseudomonas aeruginosa PA01
gaucucgaagaccagcggagcg

SEQ ID NO: 1517230 - RNA, 20 nt, Pseudomonas aeruginosa PA01
gaucuccuccucggcggcuu

SEQ ID NO: 1517231 - RNA, 11 nt, Pseudomonas aeruginosa PA01
gaucuccuggc

SEQ ID NO: 1517232 - RNA, 22 nt, Pseudomonas aeruginosa PA01
gaucuccaacuggcggcugggc

SEQ ID NO: 1517233 - RNA, 17 nt, Pseudomonas aeruginosa PA01
gaucucggcgcgggcau

SEQ ID NO: 1517234 - RNA, 22 nt, Pseudomonas aeruginosa PA01
gaucucggcggccaggcggcua

SEQ ID NO: 1517235 - RNA, 16 nt, Pseudomonas aeruginosa PA01
gaucucgugggccagc

SEQ ID NO: 1517236 - RNA, 22 nt, Pseudomonas aeruginosa PA01
gaucucgguuuccaggaugcaa

SEQ ID NO: 1517237 - RNA, 19 nt, Pseudomonas aeruginosa PA01
gaucucugcgagacgggcg

SEQ ID NO: 1517238 - RNA, 19 nt, Pseudomonas aeruginosa PA01
gaucugcgaauagacgccg

SEQ ID NO: 1517239 - RNA, 16 nt, Pseudomonas aeruginosa PA01
gaucugguagcgggcc

SEQ ID NO: 1517240 - RNA, 18 nt, Pseudomonas aeruginosa PA01
gaucugguggaacagcau

SEQ ID NO: 1517241 - RNA, 19 nt, Pseudomonas aeruginosa PA01
gaucggcagcaucagccgc

SEQ ID NO: 1517242 - RNA, 16 nt, Pseudomonas aeruginosa PA01
gaucggcagccguccg

SEQ ID NO: 1517243 - RNA, 17 nt, Pseudomonas aeruginosa PA01
gaucggccccaccuggc

SEQ ID NO: 1517244 - RNA, 23 nt, Pseudomonas aeruginosa PA01
gaucggugcuuugcauggccugu

SEQ ID NO: 1517245 - RNA, 19 nt, Pseudomonas aeruginosa PA01
gaucgguucccgcccgcuc

SEQ ID NO: 1517246 - RNA, 17 nt, Pseudomonas aeruginosa PA01
gaucgcggccagccgcu

SEQ ID NO: 1517247 - RNA, 14 nt, Pseudomonas aeruginosa PA01
gaucgcguccaggg

SEQ ID NO: 1517248 - RNA, 17 nt, Pseudomonas aeruginosa PA01
gaucggaugcacgugca

SEQ ID NO: 1517249 - RNA, 17 nt, Pseudomonas aeruginosa PA01
gaucggauagccgugca

SEQ ID NO: 1517250 - RNA, 14 nt, Pseudomonas aeruginosa PA01
gaucggcaccauca

SEQ ID NO: 1517251 - RNA, 16 nt, Pseudomonas aeruginosa PA01
gaucgcucucgcgcuu

SEQ ID NO: 1517252 - RNA, 16 nt, Pseudomonas aeruginosa PA01
gaucgcgaagcgcagc

SEQ ID NO: 1517253 - RNA, 19 nt, Pseudomonas aeruginosa PA01
gaucgccucggcgcgcgcc

SEQ ID NO: 1517254 - RNA, 21 nt, Pseudomonas aeruginosa PA01
gaucgccucgucgagcgcagc

SEQ ID NO: 1517255 - RNA, 20 nt, Pseudomonas aeruginosa PA01
gaucgccucguucagcagca

SEQ ID NO: 1517256 - RNA, 18 nt, Pseudomonas aeruginosa PA01
gaucgccgcgaccugcuc

SEQ ID NO: 1517257 - RNA, 12 nt, Pseudomonas aeruginosa PA01
gaucgcccggcg

SEQ ID NO: 1517258 - RNA, 14 nt, Pseudomonas aeruginosa PA01
gaucgcccagcggc

SEQ ID NO: 1517259 - RNA, 21 nt, Pseudomonas aeruginosa PA01
gaucgccauaggaugccgagg

SEQ ID NO: 1517260 - RNA, 20 nt, Pseudomonas aeruginosa PA01
gauccugcugguugaagccg

SEQ ID NO: 1517261 - RNA, 23 nt, Pseudomonas aeruginosa PA01
gauccuccuggggaaucugcgcc

SEQ ID NO: 1517262 - RNA, 20 nt, Pseudomonas aeruginosa PA01
gauccugaccccggccuggc

SEQ ID NO: 1517263 - RNA, 16 nt, Pseudomonas aeruginosa PA01
gauccggugcaggccg

SEQ ID NO: 1517264 - RNA, 18 nt, Pseudomonas aeruginosa PA01
gauccggguggagaggcg

SEQ ID NO: 1517265 - RNA, 17 nt, Pseudomonas aeruginosa PA01
gauccgugccaggcgcu

SEQ ID NO: 1517266 - RNA, 12 nt, Pseudomonas aeruginosa PA01
gauccuccgcca

SEQ ID NO: 1517267 - RNA, 15 nt, Pseudomonas aeruginosa PA01
gaucgcacggcggga

SEQ ID NO: 1517268 - RNA, 13 nt, Pseudomonas aeruginosa PA01
gaucgcaagauua

SEQ ID NO: 1517269 - RNA, 15 nt, Pseudomonas aeruginosa PA01
gaucgaucggcuggu

SEQ ID NO: 1517270 - RNA, 15 nt, Pseudomonas aeruginosa PA01
gaucgaucagcagca

SEQ ID NO: 1517271 - RNA, 14 nt, Pseudomonas aeruginosa PA01
gaucgagucgccga

SEQ ID NO: 1517272 - RNA, 23 nt, Pseudomonas aeruginosa PA01
gaucgaagaagcgcaccaccugc

SEQ ID NO: 1517273 - RNA, 21 nt, Pseudomonas aeruginosa PA01
gauccugggcgccagccgcca

SEQ ID NO: 1517274 - RNA, 18 nt, Pseudomonas aeruginosa PA01
gauccuggcggcacucca

SEQ ID NO: 1517275 - RNA, 14 nt, Pseudomonas aeruginosa PA01
gauccuggccggcg

SEQ ID NO: 1517276 - RNA, 21 nt, Pseudomonas aeruginosa PA01
aaagccgccgccgcgccggcg

SEQ ID NO: 1517277 - RNA, 16 nt, Pseudomonas aeruginosa PA01
gauccaccgccagggc

SEQ ID NO: 1517278 - RNA, 22 nt, Pseudomonas aeruginosa PA01
gauccacucgcccuugaccagu

SEQ ID NO: 1517279 - RNA, 15 nt, Pseudomonas aeruginosa PA01
gauccacgccuggcc

SEQ ID NO: 1517280 - RNA, 12 nt, Pseudomonas aeruginosa PA01
gauccagcggca

SEQ ID NO: 1517281 - RNA, 21 nt, Pseudomonas aeruginosa PA01
gauccagcgguacuuuggggc

SEQ ID NO: 1517282 - RNA, 22 nt, Pseudomonas aeruginosa PA01
gauccagccggcauccagcauc

SEQ ID NO: 1517283 - RNA, 12 nt, Pseudomonas aeruginosa PA01
gaucccccgccc

SEQ ID NO: 1517284 - RNA, 16 nt, Pseudomonas aeruginosa PA01
gauccgcuccagcgcc

SEQ ID NO: 1517285 - RNA, 15 nt, Pseudomonas aeruginosa PA01
gauccgcuccaggcu

SEQ ID NO: 1517286 - RNA, 17 nt, Pseudomonas aeruginosa PA01
gauccgcuccaggcugu

SEQ ID NO: 1517287 - RNA, 20 nt, Pseudomonas aeruginosa PA01
gauccgcgaauagggcggcg

SEQ ID NO: 1517288 - RNA, 15 nt, Pseudomonas aeruginosa PA01
gauccgcgacgaggg

SEQ ID NO: 1517289 - RNA, 14 nt, Pseudomonas aeruginosa PA01
gauccccuccucca

SEQ ID NO: 1517290 - RNA, 15 nt, Pseudomonas aeruginosa PA01
gauccccuccuccag

SEQ ID NO: 1517291 - RNA, 11 nt, Pseudomonas aeruginosa PA01
gaucccggcgg

SEQ ID NO: 1517292 - RNA, 18 nt, Pseudomonas aeruginosa PA01
gaggagggcgaggucacc

SEQ ID NO: 1517293 - RNA, 21 nt, Pseudomonas aeruginosa PA01
gaggagguuggucugcucggc

SEQ ID NO: 1517294 - RNA, 15 nt, Pseudomonas aeruginosa PA01
gaggaggcgccgggu

SEQ ID NO: 1517295 - RNA, 21 nt, Pseudomonas aeruginosa PA01
gaggagccuuucacuuucagg

SEQ ID NO: 1517296 - RNA, 21 nt, Pseudomonas aeruginosa PA01
gaggccggcaugcagguggcg

SEQ ID NO: 1517297 - RNA, 19 nt, Pseudomonas aeruginosa PA01
gaggccgcccagcgcagcc

SEQ ID NO: 1517298 - RNA, 21 nt, Pseudomonas aeruginosa PA01
gaggccgcccagcgcagccug

SEQ ID NO: 1517299 - RNA, 17 nt, Pseudomonas aeruginosa PA01
gaggccgaaauggcggu

SEQ ID NO: 1517300 - RNA, 16 nt, Pseudomonas aeruginosa PA01
gaggccagcagcagaa

SEQ ID NO: 1517301 - RNA, 13 nt, Pseudomonas aeruginosa PA01
gaggccaggaucg

SEQ ID NO: 1517302 - RNA, 17 nt, Pseudomonas aeruginosa PA01
gaggcccaucaggaugc

SEQ ID NO: 1517303 - RNA, 23 nt, Pseudomonas aeruginosa PA01
gaggaagagcagcgcggcggcgg

SEQ ID NO: 1517304 - RNA, 14 nt, Pseudomonas aeruginosa PA01
gaggaagccgaccg

SEQ ID NO: 1517305 - RNA, 19 nt, Pseudomonas aeruginosa PA01
gaggaagccgaccggcgcc

SEQ ID NO: 1517306 - RNA, 19 nt, Pseudomonas aeruginosa PA01
gaggaagaaaaagcccgcu

SEQ ID NO: 1517307 - RNA, 22 nt, Pseudomonas aeruginosa PA01
gaggaacgccucgcagagcgcc

SEQ ID NO: 1517308 - RNA, 16 nt, Pseudomonas aeruginosa PA01
gaggaacagcaccagc

SEQ ID NO: 1517309 - RNA, 21 nt, Pseudomonas aeruginosa PA01
gaggaacagcgagaggggcgc

SEQ ID NO: 1517310 - RNA, 18 nt, Pseudomonas aeruginosa PA01
gaggaacccaaucacaac

SEQ ID NO: 1517311 - RNA, 16 nt, Pseudomonas aeruginosa PA01
gagcucggccaggcac

SEQ ID NO: 1517312 - RNA, 17 nt, Pseudomonas aeruginosa PA01
gagcucggccaggcaca

SEQ ID NO: 1517313 - RNA, 19 nt, Pseudomonas aeruginosa PA01
gagcugcucgauggcggcc

SEQ ID NO: 1517314 - RNA, 15 nt, Pseudomonas aeruginosa PA01
gagcugccgcaccgc

SEQ ID NO: 1517315 - RNA, 16 nt, Pseudomonas aeruginosa PA01
gagcugccgcaccgcc

SEQ ID NO: 1517316 - RNA, 22 nt, Pseudomonas aeruginosa PA01
gagcugcaugagugucgccauc

SEQ ID NO: 1517317 - RNA, 17 nt, Pseudomonas aeruginosa PA01
gaguaaaugcuugaaaa

SEQ ID NO: 1517318 - RNA, 15 nt, Pseudomonas aeruginosa PA01
gaguaccaccgugcc

SEQ ID NO: 1517319 - RNA, 15 nt, Pseudomonas aeruginosa PA01
gagguagguccaggc

SEQ ID NO: 1517320 - RNA, 18 nt, Pseudomonas aeruginosa PA01
gagguagguccaggcgac

SEQ ID NO: 1517321 - RNA, 15 nt, Pseudomonas aeruginosa PA01
gagguaggccagccc

SEQ ID NO: 1517322 - RNA, 20 nt, Pseudomonas aeruginosa PA01
gaggguugucaccggcaggg

SEQ ID NO: 1517323 - RNA, 23 nt, Pseudomonas aeruginosa PA01
gaggguugucaccggcagggcga

SEQ ID NO: 1517324 - RNA, 19 nt, Pseudomonas aeruginosa PA01
gagggugucguagaggcug

SEQ ID NO: 1517325 - RNA, 20 nt, Pseudomonas aeruginosa PA01
gaggguguugcgauggaagu

SEQ ID NO: 1517326 - RNA, 15 nt, Pseudomonas aeruginosa PA01
gaggguuuccaccug

SEQ ID NO: 1517327 - RNA, 13 nt, Pseudomonas aeruginosa PA01
gagggcugccgcc

SEQ ID NO: 1517328 - RNA, 22 nt, Pseudomonas aeruginosa PA01
gagggcuguaaucgccgcuucg

SEQ ID NO: 1517329 - RNA, 15 nt, Pseudomonas aeruginosa PA01
gaggcgggccagcag

SEQ ID NO: 1517330 - RNA, 21 nt, Pseudomonas aeruginosa PA01
gaggggcgcucguugcgccgc

SEQ ID NO: 1517331 - RNA, 13 nt, Pseudomonas aeruginosa PA01
gagggucgccagc

SEQ ID NO: 1517332 - RNA, 19 nt, Pseudomonas aeruginosa PA01
gagggucagcaggcugccg

SEQ ID NO: 1517333 - RNA, 20 nt, Pseudomonas aeruginosa PA01
gagggucagccgcaggccgu

SEQ ID NO: 1517334 - RNA, 14 nt, Pseudomonas aeruginosa PA01
gagggucagccggc

SEQ ID NO: 1517335 - RNA, 20 nt, Pseudomonas aeruginosa PA01
gagggucaggccgagggcug

SEQ ID NO: 1517336 - RNA, 22 nt, Pseudomonas aeruginosa PA01
gagggucgccuugaccagcggc

SEQ ID NO: 1517337 - RNA, 23 nt, Pseudomonas aeruginosa PA01
gagggucgccuugaccagcggcc

SEQ ID NO: 1517338 - RNA, 19 nt, Pseudomonas aeruginosa PA01
gagggugaacuggccgucg

SEQ ID NO: 1517339 - RNA, 22 nt, Pseudomonas aeruginosa PA01
gaggguggaacccauggcgcga

SEQ ID NO: 1517340 - RNA, 15 nt, Pseudomonas aeruginosa PA01
gaggguggcgcuggc

SEQ ID NO: 1517341 - RNA, 14 nt, Pseudomonas aeruginosa PA01
gaggguggucagcc

SEQ ID NO: 1517342 - RNA, 13 nt, Pseudomonas aeruginosa PA01
gaggcgccgacca

SEQ ID NO: 1517343 - RNA, 16 nt, Pseudomonas aeruginosa PA01
gaggcgccgcgccagg

SEQ ID NO: 1517344 - RNA, 17 nt, Pseudomonas aeruginosa PA01
gaggcgcgccgacagca

SEQ ID NO: 1517345 - RNA, 14 nt, Pseudomonas aeruginosa PA01
gaggcgcagcagcg

SEQ ID NO: 1517346 - RNA, 16 nt, Pseudomonas aeruginosa PA01
gaggcgcagcagcgcc

SEQ ID NO: 1517347 - RNA, 22 nt, Pseudomonas aeruginosa PA01
gaggcgcuucugcucggccugg

SEQ ID NO: 1517348 - RNA, 11 nt, Pseudomonas aeruginosa PA01
gaggcgcucgu

SEQ ID NO: 1517349 - RNA, 20 nt, Pseudomonas aeruginosa PA01
gaggcgcuccaccagggccu

SEQ ID NO: 1517350 - RNA, 19 nt, Pseudomonas aeruginosa PA01
gaggccuucgccgaccagg

SEQ ID NO: 1517351 - RNA, 22 nt, Pseudomonas aeruginosa PA01
gaggccguaccagucgcccgcu

SEQ ID NO: 1517352 - RNA, 14 nt, Pseudomonas aeruginosa PA01
gaggccuuucuucu

SEQ ID NO: 1517353 - RNA, 20 nt, Pseudomonas aeruginosa PA01
gaguuugccgaacugcaggg

SEQ ID NO: 1517354 - RNA, 12 nt, Pseudomonas aeruginosa PA01
gauaaaauccac

SEQ ID NO: 1517355 - RNA, 19 nt, Pseudomonas aeruginosa PA01
gaguuuagccgccagugca

SEQ ID NO: 1517356 - RNA, 23 nt, Pseudomonas aeruginosa PA01
gaguuucaucucggcgcaggcau

SEQ ID NO: 1517357 - RNA, 18 nt, Pseudomonas aeruginosa PA01
gaguucgucaaccagcac

SEQ ID NO: 1517358 - RNA, 22 nt, Pseudomonas aeruginosa PA01
gaguucgucaaccagcaccgca

SEQ ID NO: 1517359 - RNA, 21 nt, Pseudomonas aeruginosa PA01
gaguucgcugaaggucgccgc

SEQ ID NO: 1517360 - RNA, 14 nt, Pseudomonas aeruginosa PA01
gauaacgccaggac

SEQ ID NO: 1517361 - RNA, 16 nt, Pseudomonas aeruginosa PA01
gauaacgccgcuggcg

SEQ ID NO: 1517362 - RNA, 18 nt, Pseudomonas aeruginosa PA01
gagugucgccaucaguga

SEQ ID NO: 1517363 - RNA, 16 nt, Pseudomonas aeruginosa PA01
gaguggcgcagcgccc

SEQ ID NO: 1517364 - RNA, 16 nt, Pseudomonas aeruginosa PA01
gaguggcgcggcugau

SEQ ID NO: 1517365 - RNA, 16 nt, Pseudomonas aeruginosa PA01
gaguucgcccagcucg

SEQ ID NO: 1517366 - RNA, 21 nt, Pseudomonas aeruginosa PA01
gaguucgcgcaggcgguugga

SEQ ID NO: 1517367 - RNA, 18 nt, Pseudomonas aeruginosa PA01
gagugugccggccaugca

SEQ ID NO: 1517368 - RNA, 19 nt, Pseudomonas aeruginosa PA01
gagugcagcgagucgccgu

SEQ ID NO: 1517369 - RNA, 21 nt, Pseudomonas aeruginosa PA01
gaguggccgcgccccacggcg

SEQ ID NO: 1517370 - RNA, 13 nt, Pseudomonas aeruginosa PA01
gagucgacccagg

SEQ ID NO: 1517371 - RNA, 22 nt, Pseudomonas aeruginosa PA01
gaguccuuguccagggccggau

SEQ ID NO: 1517372 - RNA, 14 nt, Pseudomonas aeruginosa PA01
gagucgccgguuca

SEQ ID NO: 1517373 - RNA, 16 nt, Pseudomonas aeruginosa PA01
gagucgaucucggugg

SEQ ID NO: 1517374 - RNA, 14 nt, Pseudomonas aeruginosa PA01
gagccgagcaggcc

SEQ ID NO: 1517375 - RNA, 18 nt, Pseudomonas aeruginosa PA01
gagccacauccaguugca

SEQ ID NO: 1517376 - RNA, 15 nt, Pseudomonas aeruginosa PA01
gagccagcccagcgg

SEQ ID NO: 1517377 - RNA, 16 nt, Pseudomonas aeruginosa PA01
gagcccuugcgcggcg

SEQ ID NO: 1517378 - RNA, 20 nt, Pseudomonas aeruginosa PA01
gagccuggaguugugccagc

SEQ ID NO: 1517379 - RNA, 14 nt, Pseudomonas aeruginosa PA01
gagccuggccaggc

SEQ ID NO: 1517380 - RNA, 15 nt, Pseudomonas aeruginosa PA01
gagccuggccaggcg

SEQ ID NO: 1517381 - RNA, 17 nt, Pseudomonas aeruginosa PA01
gagccuggccaggcgcu

SEQ ID NO: 1517382 - RNA, 21 nt, Pseudomonas aeruginosa PA01
gagccuggccaggcgcuccuc

SEQ ID NO: 1517383 - RNA, 22 nt, Pseudomonas aeruginosa PA01
gagccuggccaggcgcuccucc

SEQ ID NO: 1517384 - RNA, 23 nt, Pseudomonas aeruginosa PA01
gagccuacggaggaaacccaugc

SEQ ID NO: 1517385 - RNA, 20 nt, Pseudomonas aeruginosa PA01
gagccguugaaacgcucggc

SEQ ID NO: 1517386 - RNA, 16 nt, Pseudomonas aeruginosa PA01
gagccgccggggaagc

SEQ ID NO: 1517387 - RNA, 13 nt, Pseudomonas aeruginosa PA01
gagcgcacgugga

SEQ ID NO: 1517388 - RNA, 15 nt, Pseudomonas aeruginosa PA01
gagcgacguggcagg

SEQ ID NO: 1517389 - RNA, 14 nt, Pseudomonas aeruginosa PA01
gagcgccgccaggc

SEQ ID NO: 1517390 - RNA, 15 nt, Pseudomonas aeruginosa PA01
gagcgccgccaggca

SEQ ID NO: 1517391 - RNA, 18 nt, Pseudomonas aeruginosa PA01
gagcgccaugacccgcgg

SEQ ID NO: 1517392 - RNA, 20 nt, Pseudomonas aeruginosa PA01
gagcgccaugacccgcggca

SEQ ID NO: 1517393 - RNA, 13 nt, Pseudomonas aeruginosa PA01
gagcgccaggcgc

SEQ ID NO: 1517394 - RNA, 18 nt, Pseudomonas aeruginosa PA01
gagcgccagggccaggga

SEQ ID NO: 1517395 - RNA, 21 nt, Pseudomonas aeruginosa PA01
gagcgccaggaacgccucugc

SEQ ID NO: 1517396 - RNA, 21 nt, Pseudomonas aeruginosa PA01
gagcgccagcaccagcaggag

SEQ ID NO: 1517397 - RNA, 14 nt, Pseudomonas aeruginosa PA01
gagcgccagcaggu

SEQ ID NO: 1517398 - RNA, 15 nt, Pseudomonas aeruginosa PA01
gagcgccgcggcggc

SEQ ID NO: 1517399 - RNA, 20 nt, Pseudomonas aeruginosa PA01
gagcgccgccuugagcggcg

SEQ ID NO: 1517400 - RNA, 23 nt, Pseudomonas aeruginosa PA01
gagcgccuggcgucgaugccgaa

SEQ ID NO: 1517401 - RNA, 16 nt, Pseudomonas aeruginosa PA01
gagcgcgcccaggcag

SEQ ID NO: 1517402 - RNA, 14 nt, Pseudomonas aeruginosa PA01
gagcgcgcccaggu

SEQ ID NO: 1517403 - RNA, 21 nt, Pseudomonas aeruginosa PA01
gagcgcgagcggcagauccgc

SEQ ID NO: 1517404 - RNA, 15 nt, Pseudomonas aeruginosa PA01
gagcgcgagugcagc

SEQ ID NO: 1517405 - RNA, 18 nt, Pseudomonas aeruginosa PA01
gagcgggucgauggcugg

SEQ ID NO: 1517406 - RNA, 13 nt, Pseudomonas aeruginosa PA01
gagcggcccgcgg

SEQ ID NO: 1517407 - RNA, 13 nt, Pseudomonas aeruginosa PA01
gagcgggcgaggg

SEQ ID NO: 1517408 - RNA, 14 nt, Pseudomonas aeruginosa PA01
gagcgggccgaggg

SEQ ID NO: 1517409 - RNA, 21 nt, Pseudomonas aeruginosa PA01
gagcgguuauucgcccuacgg

SEQ ID NO: 1517410 - RNA, 20 nt, Pseudomonas aeruginosa PA01
gagcggugaaaccggcaagc

SEQ ID NO: 1517411 - RNA, 15 nt, Pseudomonas aeruginosa PA01
gagcggcgcccuggc

SEQ ID NO: 1517412 - RNA, 16 nt, Pseudomonas aeruginosa PA01
gagcggcggcacgacc

SEQ ID NO: 1517413 - RNA, 13 nt, Pseudomonas aeruginosa PA01
gagcgcgcccugc

SEQ ID NO: 1517414 - RNA, 14 nt, Pseudomonas aeruginosa PA01
gagcgcggccggcc

SEQ ID NO: 1517415 - RNA, 15 nt, Pseudomonas aeruginosa PA01
gagcgcggcgcaggc

SEQ ID NO: 1517416 - RNA, 19 nt, Pseudomonas aeruginosa PA01
gagcgcuccaccgcgcucc

SEQ ID NO: 1517417 - RNA, 16 nt, Pseudomonas aeruginosa PA01
gagcgcucgcgcagcc

SEQ ID NO: 1517418 - RNA, 23 nt, Pseudomonas aeruginosa PA01
gagcggaaacccgugguccgcca

SEQ ID NO: 1517419 - RNA, 18 nt, Pseudomonas aeruginosa PA01
gagcggaucgucgcggcg

SEQ ID NO: 1517420 - RNA, 13 nt, Pseudomonas aeruginosa PA01
gagcggcaaggcc

SEQ ID NO: 1517421 - RNA, 13 nt, Pseudomonas aeruginosa PA01
gagcguuccauga

SEQ ID NO: 1517422 - RNA, 19 nt, Pseudomonas aeruginosa PA01
gagcguuccaugaacucuu

SEQ ID NO: 1517423 - RNA, 17 nt, Pseudomonas aeruginosa PA01
gagcgugacccgcgcuu

SEQ ID NO: 1517424 - RNA, 18 nt, Pseudomonas aeruginosa PA01
gagcguccggcagggccu

SEQ ID NO: 1517425 - RNA, 22 nt, Pseudomonas aeruginosa PA01
gagcguaucgaugcgcgcggcg

SEQ ID NO: 1517426 - RNA, 13 nt, Pseudomonas aeruginosa PA01
gagcucccugccg

SEQ ID NO: 1517427 - RNA, 16 nt, Pseudomonas aeruginosa PA01
gagcucccugccgccc

SEQ ID NO: 1517428 - RNA, 23 nt, Pseudomonas aeruginosa PA01
gagcuaguuauugaaguggugau

SEQ ID NO: 1517429 - RNA, 18 nt, Pseudomonas aeruginosa PA01
gagcuacagcgauucagg

SEQ ID NO: 1517430 - RNA, 15 nt, Pseudomonas aeruginosa PA01
gagcaggacagcagg

SEQ ID NO: 1517431 - RNA, 23 nt, Pseudomonas aeruginosa PA01
gagcaggccacgcaccagcuccc

SEQ ID NO: 1517432 - RNA, 24 nt, Pseudomonas aeruginosa PA01
gagcaggcccaugauggucggcac

SEQ ID NO: 1517433 - RNA, 20 nt, Pseudomonas aeruginosa PA01
gagcaggccgacggcgcgcu

SEQ ID NO: 1517434 - RNA, 22 nt, Pseudomonas aeruginosa PA01
gagcaggccgacggcgcgcugc

SEQ ID NO: 1517435 - RNA, 20 nt, Pseudomonas aeruginosa PA01
gagcagcucauucguaauga

SEQ ID NO: 1517436 - RNA, 14 nt, Pseudomonas aeruginosa PA01
gagcagcucgccgg

SEQ ID NO: 1517437 - RNA, 13 nt, Pseudomonas aeruginosa PA01
gagcagcggacgc

SEQ ID NO: 1517438 - RNA, 14 nt, Pseudomonas aeruginosa PA01
gagcagcggcgcgc

SEQ ID NO: 1517439 - RNA, 14 nt, Pseudomonas aeruginosa PA01
gagcagcggcgcuu

SEQ ID NO: 1517440 - RNA, 18 nt, Pseudomonas aeruginosa PA01
gagcagcggcgcuuucca

SEQ ID NO: 1517441 - RNA, 18 nt, Pseudomonas aeruginosa PA01
gagcagcgccagccaggg

SEQ ID NO: 1517442 - RNA, 19 nt, Pseudomonas aeruginosa PA01
gagcagcgccagccagggu

SEQ ID NO: 1517443 - RNA, 18 nt, Pseudomonas aeruginosa PA01
gagcagcgcgcggcucgg

SEQ ID NO: 1517444 - RNA, 13 nt, Pseudomonas aeruginosa PA01
gagcaggaggaua

SEQ ID NO: 1517445 - RNA, 15 nt, Pseudomonas aeruginosa PA01
gagcaacacaugcag

SEQ ID NO: 1517446 - RNA, 14 nt, Pseudomonas aeruginosa PA01
gagcaacagcagga

SEQ ID NO: 1517447 - RNA, 18 nt, Pseudomonas aeruginosa PA01
gagcaagaguguucccuc

SEQ ID NO: 1517448 - RNA, 13 nt, Pseudomonas aeruginosa PA01
gagcaagccuucc

SEQ ID NO: 1517449 - RNA, 24 nt, Pseudomonas aeruginosa PA01
gagcaacucggcggcgagcgccgc

SEQ ID NO: 1517450 - RNA, 14 nt, Pseudomonas aeruginosa PA01
gagcaacugcucgg

SEQ ID NO: 1517451 - RNA, 15 nt, Pseudomonas aeruginosa PA01
gagcagcaccagcac

SEQ ID NO: 1517452 - RNA, 15 nt, Pseudomonas aeruginosa PA01
gagcagcaccaggcu

SEQ ID NO: 1517453 - RNA, 17 nt, Pseudomonas aeruginosa PA01
gagcagcaccaggcugg

SEQ ID NO: 1517454 - RNA, 20 nt, Pseudomonas aeruginosa PA01
gagcagcccgggcaacugcc

SEQ ID NO: 1517455 - RNA, 22 nt, Pseudomonas aeruginosa PA01
gagagggucagcaggcugccgu

SEQ ID NO: 1517456 - RNA, 13 nt, Pseudomonas aeruginosa PA01
gagagggcggcga

SEQ ID NO: 1517457 - RNA, 15 nt, Pseudomonas aeruginosa PA01
gagaggcgugcuggc

SEQ ID NO: 1517458 - RNA, 13 nt, Pseudomonas aeruginosa PA01
gagaggucggcgc

SEQ ID NO: 1517459 - RNA, 15 nt, Pseudomonas aeruginosa PA01
gagaggucggcgcgc

SEQ ID NO: 1517460 - RNA, 20 nt, Pseudomonas aeruginosa PA01
gagaguccuuguccagggcc

SEQ ID NO: 1517461 - RNA, 22 nt, Pseudomonas aeruginosa PA01
gacucagaagaacggacgcgac

SEQ ID NO: 1517462 - RNA, 18 nt, Pseudomonas aeruginosa PA01
gacucagcgcgacaggcu

SEQ ID NO: 1517463 - RNA, 14 nt, Pseudomonas aeruginosa PA01
gagauccugcagca

SEQ ID NO: 1517464 - RNA, 15 nt, Pseudomonas aeruginosa PA01
gagauccuggccggc

SEQ ID NO: 1517465 - RNA, 14 nt, Pseudomonas aeruginosa PA01
gagauccgccagca

SEQ ID NO: 1517466 - RNA, 18 nt, Pseudomonas aeruginosa PA01
gagagucggaagcuucag

SEQ ID NO: 1517467 - RNA, 14 nt, Pseudomonas aeruginosa PA01
gagaucggcggcgc

SEQ ID NO: 1517468 - RNA, 17 nt, Pseudomonas aeruginosa PA01
gagauugaugaagcgcu

SEQ ID NO: 1517469 - RNA, 20 nt, Pseudomonas aeruginosa PA01
gaugauacgcacgcuggugc

SEQ ID NO: 1517470 - RNA, 12 nt, Pseudomonas aeruginosa PA01
gaugaucagccc

SEQ ID NO: 1517471 - RNA, 23 nt, Pseudomonas aeruginosa PA01
gaugauccgcucgaucccggcgc

SEQ ID NO: 1517472 - RNA, 15 nt, Pseudomonas aeruginosa PA01
aaagccuggccggcg

SEQ ID NO: 1517473 - RNA, 22 nt, Pseudomonas aeruginosa PA01
gaugaugacgagggacugaaga

SEQ ID NO: 1517474 - RNA, 21 nt, Pseudomonas aeruginosa PA01
gaugaggcuguccagcaggcg

SEQ ID NO: 1517475 - RNA, 14 nt, Pseudomonas aeruginosa PA01
gaugacgaacugca

SEQ ID NO: 1517476 - RNA, 12 nt, Pseudomonas aeruginosa PA01
gaucuucugcac

SEQ ID NO: 1517477 - RNA, 14 nt, Pseudomonas aeruginosa PA01
gaucuucugcaccc

SEQ ID NO: 1517478 - RNA, 20 nt, Pseudomonas aeruginosa PA01
gaucugucgauaccagcgcc

SEQ ID NO: 1517479 - RNA, 22 nt, Pseudomonas aeruginosa PA01
gaugaacucgacuucuucgcug

SEQ ID NO: 1517480 - RNA, 19 nt, Pseudomonas aeruginosa PA01
gaugaacuggucgcuccag

SEQ ID NO: 1517481 - RNA, 19 nt, Pseudomonas aeruginosa PA01
gaugaaacgcagggccgga

SEQ ID NO: 1517482 - RNA, 12 nt, Pseudomonas aeruginosa PA01
gaugaaauagcu

SEQ ID NO: 1517483 - RNA, 17 nt, Pseudomonas aeruginosa PA01
gaugccggugcuggugc

SEQ ID NO: 1517484 - RNA, 21 nt, Pseudomonas aeruginosa PA01
gaugccggcgucggcgagcag

SEQ ID NO: 1517485 - RNA, 20 nt, Pseudomonas aeruginosa PA01
gaugccgccgccgccccagc

SEQ ID NO: 1517486 - RNA, 16 nt, Pseudomonas aeruginosa PA01
gaugccgcgccaggcg

SEQ ID NO: 1517487 - RNA, 18 nt, Pseudomonas aeruginosa PA01
gaugccgcccugcggcag

SEQ ID NO: 1517488 - RNA, 13 nt, Pseudomonas aeruginosa PA01
gaugcgccgcagg

SEQ ID NO: 1517489 - RNA, 13 nt, Pseudomonas aeruginosa PA01
gaugcgccucagc

SEQ ID NO: 1517490 - RNA, 22 nt, Pseudomonas aeruginosa PA01
gaugccuuucggggugcagggg

SEQ ID NO: 1517491 - RNA, 15 nt, Pseudomonas aeruginosa PA01
gaugcgcaacgggcg

SEQ ID NO: 1517492 - RNA, 12 nt, Pseudomonas aeruginosa PA01
gaugcucggugu

SEQ ID NO: 1517493 - RNA, 19 nt, Pseudomonas aeruginosa PA01
gaugcucgguugccaggcc

SEQ ID NO: 1517494 - RNA, 15 nt, Pseudomonas aeruginosa PA01
gaugcucgcgccagc

SEQ ID NO: 1517495 - RNA, 16 nt, Pseudomonas aeruginosa PA01
gaugcucgcgccagcc

SEQ ID NO: 1517496 - RNA, 18 nt, Pseudomonas aeruginosa PA01
gaugcucaggcgcugcug

SEQ ID NO: 1517497 - RNA, 23 nt, Pseudomonas aeruginosa PA01
gaugcuccagguucggcgccagc

SEQ ID NO: 1517498 - RNA, 14 nt, Pseudomonas aeruginosa PA01
gaugcucccgagca

SEQ ID NO: 1517499 - RNA, 22 nt, Pseudomonas aeruginosa PA01
gaugcguuugucgaccugcccc

SEQ ID NO: 1517500 - RNA, 13 nt, Pseudomonas aeruginosa PA01
gaugcguugcacg

SEQ ID NO: 1517501 - RNA, 20 nt, Pseudomonas aeruginosa PA01
gaugcgcgacucgaagcucu

SEQ ID NO: 1517502 - RNA, 16 nt, Pseudomonas aeruginosa PA01
gaugcgcggcagcagg

SEQ ID NO: 1517503 - RNA, 19 nt, Pseudomonas aeruginosa PA01
gaugcgcggcagguagccg

SEQ ID NO: 1517504 - RNA, 13 nt, Pseudomonas aeruginosa PA01
gaugcggcugugc

SEQ ID NO: 1517505 - RNA, 18 nt, Pseudomonas aeruginosa PA01
gaugcgguaggugcucuu

SEQ ID NO: 1517506 - RNA, 16 nt, Pseudomonas aeruginosa PA01
gaugcggugcgccucc

SEQ ID NO: 1517507 - RNA, 21 nt, Pseudomonas aeruginosa PA01
gaugcagucccgccaggcgcc

SEQ ID NO: 1517508 - RNA, 22 nt, Pseudomonas aeruginosa PA01
gaugccacugacgcgcagcgcc

SEQ ID NO: 1517509 - RNA, 20 nt, Pseudomonas aeruginosa PA01
gaugccaucgaggccaggcc

SEQ ID NO: 1517510 - RNA, 12 nt, Pseudomonas aeruginosa PA01
gaugccauggca

SEQ ID NO: 1517511 - RNA, 15 nt, Pseudomonas aeruginosa PA01
gaugccauggcaucc

SEQ ID NO: 1517512 - RNA, 18 nt, Pseudomonas aeruginosa PA01
gaugccgagguguagaaa

SEQ ID NO: 1517513 - RNA, 21 nt, Pseudomonas aeruginosa PA01
gaugccgagguguagaaaccg

SEQ ID NO: 1517514 - RNA, 15 nt, Pseudomonas aeruginosa PA01
gaugccgcccagcac

SEQ ID NO: 1517515 - RNA, 16 nt, Pseudomonas aeruginosa PA01
gaugccgcccagcacc

SEQ ID NO: 1517516 - RNA, 22 nt, Pseudomonas aeruginosa PA01
gaugcccuggcuuuccagggcc

SEQ ID NO: 1517517 - RNA, 18 nt, Pseudomonas aeruginosa PA01
gaugcccucgcggcggca

SEQ ID NO: 1517518 - RNA, 19 nt, Pseudomonas aeruginosa PA01
gaugcccucgcggcggcag

SEQ ID NO: 1517519 - RNA, 18 nt, Pseudomonas aeruginosa PA01
gaugcccggccgcaggca

SEQ ID NO: 1517520 - RNA, 20 nt, Pseudomonas aeruginosa PA01
gaugcccggccgcaggcagc

SEQ ID NO: 1517521 - RNA, 19 nt, Pseudomonas aeruginosa PA01
gaugcccagccagggccgc

SEQ ID NO: 1517522 - RNA, 21 nt, Pseudomonas aeruginosa PA01
gaugcccagccagggccgcga

SEQ ID NO: 1517523 - RNA, 18 nt, Pseudomonas aeruginosa PA01
gaugcccgccagcaggcg

SEQ ID NO: 1517524 - RNA, 18 nt, Pseudomonas aeruginosa PA01
gaugcacguugggauagc

SEQ ID NO: 1517525 - RNA, 18 nt, Pseudomonas aeruginosa PA01
gaugcagauccagcggca

SEQ ID NO: 1517526 - RNA, 20 nt, Pseudomonas aeruginosa PA01
gauggcggcauugagggcga

SEQ ID NO: 1517527 - RNA, 23 nt, Pseudomonas aeruginosa PA01
gauggcguuugcgucauccgccu

SEQ ID NO: 1517528 - RNA, 15 nt, Pseudomonas aeruginosa PA01
gauggcgauauggcc

SEQ ID NO: 1517529 - RNA, 13 nt, Pseudomonas aeruginosa PA01
gauggccagcgcg

SEQ ID NO: 1517530 - RNA, 17 nt, Pseudomonas aeruginosa PA01
gauggccagccaggaca

SEQ ID NO: 1517531 - RNA, 14 nt, Pseudomonas aeruginosa PA01
gauggccggcagca

SEQ ID NO: 1517532 - RNA, 13 nt, Pseudomonas aeruginosa PA01
gaugcugcgggcg

SEQ ID NO: 1517533 - RNA, 17 nt, Pseudomonas aeruginosa PA01
gaugcuguaguugacgu

SEQ ID NO: 1517534 - RNA, 23 nt, Pseudomonas aeruginosa PA01
gaugcuguaguugacgucgccga

SEQ ID NO: 1517535 - RNA, 19 nt, Pseudomonas aeruginosa PA01
gaugcuguauuccuugcgg

SEQ ID NO: 1517536 - RNA, 17 nt, Pseudomonas aeruginosa PA01
gaugcuuagcccgggau

SEQ ID NO: 1517537 - RNA, 21 nt, Pseudomonas aeruginosa PA01
gauggaaaucggccacuccag

SEQ ID NO: 1517538 - RNA, 23 nt, Pseudomonas aeruginosa PA01
gauggauacccuucaucccuucu

SEQ ID NO: 1517539 - RNA, 24 nt, Pseudomonas aeruginosa PA01
gauggaacgaagaaccccggccau

SEQ ID NO: 1517540 - RNA, 19 nt, Pseudomonas aeruginosa PA01
gauggcuucgaggcgggcg

SEQ ID NO: 1517541 - RNA, 17 nt, Pseudomonas aeruginosa PA01
gauggcuaaacaagcca

SEQ ID NO: 1517542 - RNA, 15 nt, Pseudomonas aeruginosa PA01
gauggucaacaccag

SEQ ID NO: 1517543 - RNA, 19 nt, Pseudomonas aeruginosa PA01
gauggucaacaccagcgcc

SEQ ID NO: 1517544 - RNA, 11 nt, Pseudomonas aeruginosa PA01
gauggucagga

SEQ ID NO: 1517545 - RNA, 16 nt, Pseudomonas aeruginosa PA01
gauggucaggcuggug

SEQ ID NO: 1517546 - RNA, 22 nt, Pseudomonas aeruginosa PA01
gauggucgagagaauccgccgu

SEQ ID NO: 1517547 - RNA, 21 nt, Pseudomonas aeruginosa PA01
gaugguccccggccccgcggu

SEQ ID NO: 1517548 - RNA, 23 nt, Pseudomonas aeruginosa PA01
gauggucgccgcgaccucguugc

SEQ ID NO: 1517549 - RNA, 16 nt, Pseudomonas aeruginosa PA01
gauguaguccagcgcc

SEQ ID NO: 1517550 - RNA, 13 nt, Pseudomonas aeruginosa PA01
gauguaggacagg

SEQ ID NO: 1517551 - RNA, 17 nt, Pseudomonas aeruginosa PA01
gauguagcggaaguuca

SEQ ID NO: 1517552 - RNA, 16 nt, Pseudomonas aeruginosa PA01
gaugucagcguagcug

SEQ ID NO: 1517553 - RNA, 18 nt, Pseudomonas aeruginosa PA01
gauguccccggccagcag

SEQ ID NO: 1517554 - RNA, 19 nt, Pseudomonas aeruginosa PA01
gauggugggcucuaugcaa

SEQ ID NO: 1517555 - RNA, 16 nt, Pseudomonas aeruginosa PA01
gauggugugcagcagc

SEQ ID NO: 1517556 - RNA, 20 nt, Pseudomonas aeruginosa PA01
gauuaucugcgacugacggu

SEQ ID NO: 1517557 - RNA, 14 nt, Pseudomonas aeruginosa PA01
gaugugcaccagca

SEQ ID NO: 1517558 - RNA, 18 nt, Pseudomonas aeruginosa PA01
gaugucgaagcgcaggug

SEQ ID NO: 1517559 - RNA, 16 nt, Pseudomonas aeruginosa PA01
gaugucgaccugggua

SEQ ID NO: 1517560 - RNA, 16 nt, Pseudomonas aeruginosa PA01
gaugucgcgggcaugc

SEQ ID NO: 1517561 - RNA, 21 nt, Pseudomonas aeruginosa PA01
gaugucgucgaacgacucuuc

SEQ ID NO: 1517562 - RNA, 20 nt, Pseudomonas aeruginosa PA01
gaugucggcgaacuggccac

SEQ ID NO: 1517563 - RNA, 19 nt, Pseudomonas aeruginosa PA01
gauguucgccacgcugcug

SEQ ID NO: 1517564 - RNA, 21 nt, Pseudomonas aeruginosa PA01
gauguucgccgaggggcggga

SEQ ID NO: 1517565 - RNA, 14 nt, Pseudomonas aeruginosa PA01
gauguucgccgcca

SEQ ID NO: 1517566 - RNA, 18 nt, Pseudomonas aeruginosa PA01
gauguucgccgccaccac

SEQ ID NO: 1517567 - RNA, 18 nt, Pseudomonas aeruginosa PA01
gauguugacgauggccca

SEQ ID NO: 1517568 - RNA, 13 nt, Pseudomonas aeruginosa PA01
gauugaccucccg

SEQ ID NO: 1517569 - RNA, 12 nt, Pseudomonas aeruginosa PA01
gauugccagcag

SEQ ID NO: 1517570 - RNA, 15 nt, Pseudomonas aeruginosa PA01
gauuggaauugcuga

SEQ ID NO: 1517571 - RNA, 18 nt, Pseudomonas aeruginosa PA01
gauuccgggucgaggcug

SEQ ID NO: 1517572 - RNA, 14 nt, Pseudomonas aeruginosa PA01
gauuccgcgcaccu

SEQ ID NO: 1517573 - RNA, 19 nt, Pseudomonas aeruginosa PA01
gauucgaagguagcggucg

SEQ ID NO: 1517574 - RNA, 17 nt, Pseudomonas aeruginosa PA01
gauucgacgcagcgcgc

SEQ ID NO: 1517575 - RNA, 12 nt, Pseudomonas aeruginosa PA01
gauucggccugc

SEQ ID NO: 1517576 - RNA, 18 nt, Pseudomonas aeruginosa PA01
gauucguucgagcagcuc

SEQ ID NO: 1517577 - RNA, 19 nt, Pseudomonas aeruginosa PA01
gauucguugaggcccauca

SEQ ID NO: 1517578 - RNA, 22 nt, Pseudomonas aeruginosa PA01
gauucaggcggcgaaagccauc

SEQ ID NO: 1517579 - RNA, 19 nt, Pseudomonas aeruginosa PA01
gauucccagugcucccgca

SEQ ID NO: 1517580 - RNA, 12 nt, Pseudomonas aeruginosa PA01
gauucagaugcg

SEQ ID NO: 1517581 - RNA, 12 nt, Pseudomonas aeruginosa PA01
gauugugcaggg

SEQ ID NO: 1517582 - RNA, 12 nt, Pseudomonas aeruginosa PA01
gauuguucggua

SEQ ID NO: 1517583 - RNA, 20 nt, Pseudomonas aeruginosa PA01
gauugucgcgauccaccgcc

SEQ ID NO: 1517584 - RNA, 18 nt, Pseudomonas aeruginosa PA01
gauuuacggauucucucc

SEQ ID NO: 1517585 - RNA, 16 nt, Pseudomonas aeruginosa PA01
gauuuacaggacugug

SEQ ID NO: 1517586 - RNA, 19 nt, Pseudomonas aeruginosa PA01
gauuuacaggacugugcuu

SEQ ID NO: 1517587 - RNA, 14 nt, Pseudomonas aeruginosa PA01
gauuuccgcggccg

SEQ ID NO: 1517588 - RNA, 17 nt, Pseudomonas aeruginosa PA01
gauuucagcuucaucgc

SEQ ID NO: 1517589 - RNA, 15 nt, Pseudomonas aeruginosa PA01
gauuucguuggccca

SEQ ID NO: 1517590 - RNA, 15 nt, Pseudomonas aeruginosa PA01
gcaaaccucccgggc

SEQ ID NO: 1517591 - RNA, 20 nt, Pseudomonas aeruginosa PA01
gcaaacgccauccgccuucu

SEQ ID NO: 1517592 - RNA, 14 nt, Pseudomonas aeruginosa PA01
gcaaacccauuucc

SEQ ID NO: 1517593 - RNA, 18 nt, Pseudomonas aeruginosa PA01
gcaaaugccgcaaacccc

SEQ ID NO: 1517594 - RNA, 13 nt, Pseudomonas aeruginosa PA01
gcaacccugccca

SEQ ID NO: 1517595 - RNA, 22 nt, Pseudomonas aeruginosa PA01
gcaacccaugccgcaagcuccc

SEQ ID NO: 1517596 - RNA, 16 nt, Pseudomonas aeruginosa PA01
gcaacccagggcgcug

SEQ ID NO: 1517597 - RNA, 21 nt, Pseudomonas aeruginosa PA01
gcaaccccgaaggaucgggga

SEQ ID NO: 1517598 - RNA, 17 nt, Pseudomonas aeruginosa PA01
gcaaccagaccagcagg

SEQ ID NO: 1517599 - RNA, 20 nt, Pseudomonas aeruginosa PA01
gcaacagaaguugcuggcga

SEQ ID NO: 1517600 - RNA, 18 nt, Pseudomonas aeruginosa PA01
gcaacagcgccgcgcgcu

SEQ ID NO: 1517601 - RNA, 18 nt, Pseudomonas aeruginosa PA01
gcaacagaucuuccucgg

SEQ ID NO: 1517602 - RNA, 22 nt, Pseudomonas aeruginosa PA01
gcaacaguggguaggccaggca

SEQ ID NO: 1517603 - RNA, 19 nt, Pseudomonas aeruginosa PA01
gcaacaguucugccgcaga

SEQ ID NO: 1517604 - RNA, 18 nt, Pseudomonas aeruginosa PA01
gcaacacccaggccuggg

SEQ ID NO: 1517605 - RNA, 19 nt, Pseudomonas aeruginosa PA01
gcaacacccaggccugggu

SEQ ID NO: 1517606 - RNA, 20 nt, Pseudomonas aeruginosa PA01
gcaacaccgcgcagaugauc

SEQ ID NO: 1517607 - RNA, 20 nt, Pseudomonas aeruginosa PA01
gcccgcuuuccccggcggca

SEQ ID NO: 1517608 - RNA, 16 nt, Pseudomonas aeruginosa PA01
gcccgcugugcgggga

SEQ ID NO: 1517609 - RNA, 15 nt, Pseudomonas aeruginosa PA01
gcccgcuugcgccgc

SEQ ID NO: 1517610 - RNA, 17 nt, Pseudomonas aeruginosa PA01
gcccgcuugcgccgccu

SEQ ID NO: 1517611 - RNA, 18 nt, Pseudomonas aeruginosa PA01
gcccgcuugcgccgccuc

SEQ ID NO: 1517612 - RNA, 23 nt, Pseudomonas aeruginosa PA01
gcccgcuugcgccgccucgcgca

SEQ ID NO: 1517613 - RNA, 21 nt, Pseudomonas aeruginosa PA01
gcccggagaccgugccgccgg

SEQ ID NO: 1517614 - RNA, 21 nt, Pseudomonas aeruginosa PA01
gcccgcugcaugugccaggcc

SEQ ID NO: 1517615 - RNA, 16 nt, Pseudomonas aeruginosa PA01
gcccgcugaccgggcg

SEQ ID NO: 1517616 - RNA, 13 nt, Pseudomonas aeruginosa PA01
gcccgcggcgagc

SEQ ID NO: 1517617 - RNA, 16 nt, Pseudomonas aeruginosa PA01
gcccgcggcgagcagc

SEQ ID NO: 1517618 - RNA, 18 nt, Pseudomonas aeruginosa PA01
gcccgcgucgcgcgcggc

SEQ ID NO: 1517619 - RNA, 23 nt, Pseudomonas aeruginosa PA01
gcccgcgucgcgcgcggcaucca

SEQ ID NO: 1517620 - RNA, 18 nt, Pseudomonas aeruginosa PA01
gcccgcgguauucuccag

SEQ ID NO: 1517621 - RNA, 22 nt, Pseudomonas aeruginosa PA01
gcccgcgguauucuccagcagg

SEQ ID NO: 1517622 - RNA, 19 nt, Pseudomonas aeruginosa PA01
gcccgcggucacucggccu

SEQ ID NO: 1517623 - RNA, 23 nt, Pseudomonas aeruginosa PA01
gcccgccuuguucgccagcaccu

SEQ ID NO: 1517624 - RNA, 13 nt, Pseudomonas aeruginosa PA01
gcccgcgcaugga

SEQ ID NO: 1517625 - RNA, 16 nt, Pseudomonas aeruginosa PA01
gcccgcggcagcagcc

SEQ ID NO: 1517626 - RNA, 17 nt, Pseudomonas aeruginosa PA01
gcccgcggcagcagcca

SEQ ID NO: 1517627 - RNA, 17 nt, Pseudomonas aeruginosa PA01
gcccgcggaucgcgccg

SEQ ID NO: 1517628 - RNA, 15 nt, Pseudomonas aeruginosa PA01
gcccgcgcucggccg

SEQ ID NO: 1517629 - RNA, 23 nt, Pseudomonas aeruginosa PA01
gcccgcgccgccucgauggcggc

SEQ ID NO: 1517630 - RNA, 15 nt, Pseudomonas aeruginosa PA01
gcccgcgcgacagcu

SEQ ID NO: 1517631 - RNA, 20 nt, Pseudomonas aeruginosa PA01
gcccgcgcggcaacgucagg

SEQ ID NO: 1517632 - RNA, 22 nt, Pseudomonas aeruginosa PA01
gcccggcugguugccagcagcg

SEQ ID NO: 1517633 - RNA, 16 nt, Pseudomonas aeruginosa PA01
gcccggcuugccgucg

SEQ ID NO: 1517634 - RNA, 17 nt, Pseudomonas aeruginosa PA01
gcccgggcaacugccga

SEQ ID NO: 1517635 - RNA, 16 nt, Pseudomonas aeruginosa PA01
gcccggcucgccgccg

SEQ ID NO: 1517636 - RNA, 14 nt, Pseudomonas aeruginosa PA01
gcccggcucggccg

SEQ ID NO: 1517637 - RNA, 15 nt, Pseudomonas aeruginosa PA01
gcccggcuccgggua

SEQ ID NO: 1517638 - RNA, 23 nt, Pseudomonas aeruginosa PA01
gcccggcuccggguacuggcgcu

SEQ ID NO: 1517639 - RNA, 19 nt, Pseudomonas aeruginosa PA01
gcccggcuucgcgggugac

SEQ ID NO: 1517640 - RNA, 13 nt, Pseudomonas aeruginosa PA01
gcccggcuggcca

SEQ ID NO: 1517641 - RNA, 18 nt, Pseudomonas aeruginosa PA01
gcccggcgcuccaacagc

SEQ ID NO: 1517642 - RNA, 14 nt, Pseudomonas aeruginosa PA01
gcccggcgcugcuu

SEQ ID NO: 1517643 - RNA, 13 nt, Pseudomonas aeruginosa PA01
gcccggcgcggcg

SEQ ID NO: 1517644 - RNA, 19 nt, Pseudomonas aeruginosa PA01
gcccggcgcgacgcuccag

SEQ ID NO: 1517645 - RNA, 14 nt, Pseudomonas aeruginosa PA01
gcccggcgcgaccg

SEQ ID NO: 1517646 - RNA, 20 nt, Pseudomonas aeruginosa PA01
gcccggcgugagcagggccg

SEQ ID NO: 1517647 - RNA, 16 nt, Pseudomonas aeruginosa PA01
gcccggcguccucgcg

SEQ ID NO: 1517648 - RNA, 19 nt, Pseudomonas aeruginosa PA01
gcccggcguuucgccgggc

SEQ ID NO: 1517649 - RNA, 20 nt, Pseudomonas aeruginosa PA01
gcccggcguuucgccgggcc

SEQ ID NO: 1517650 - RNA, 22 nt, Pseudomonas aeruginosa PA01
gcccggcaggcagugccgggcg

SEQ ID NO: 1517651 - RNA, 14 nt, Pseudomonas aeruginosa PA01
gcccggcagcgccg

SEQ ID NO: 1517652 - RNA, 17 nt, Pseudomonas aeruginosa PA01
gcccggcagcggcuggc

SEQ ID NO: 1517653 - RNA, 18 nt, Pseudomonas aeruginosa PA01
gcccggcagaucucccug

SEQ ID NO: 1517654 - RNA, 16 nt, Pseudomonas aeruginosa PA01
gcccggcagcaggccg

SEQ ID NO: 1517655 - RNA, 20 nt, Pseudomonas aeruginosa PA01
gcccggcaggucgaggacga

SEQ ID NO: 1517656 - RNA, 19 nt, Pseudomonas aeruginosa PA01
gcccggcauaggcgccagc

SEQ ID NO: 1517657 - RNA, 13 nt, Pseudomonas aeruginosa PA01
gcccggagcgcga

SEQ ID NO: 1517658 - RNA, 15 nt, Pseudomonas aeruginosa PA01
gcccggagccaacgc

SEQ ID NO: 1517659 - RNA, 18 nt, Pseudomonas aeruginosa PA01
gcccggauuuugggcagc

SEQ ID NO: 1517660 - RNA, 13 nt, Pseudomonas aeruginosa PA01
gcccggccuggcg

SEQ ID NO: 1517661 - RNA, 14 nt, Pseudomonas aeruginosa PA01
gcccggccugguag

SEQ ID NO: 1517662 - RNA, 14 nt, Pseudomonas aeruginosa PA01
gcccggccuggugc

SEQ ID NO: 1517663 - RNA, 20 nt, Pseudomonas aeruginosa PA01
gcccggccuucaccgcgccg

SEQ ID NO: 1517664 - RNA, 15 nt, Pseudomonas aeruginosa PA01
gcccggccuccccgg

SEQ ID NO: 1517665 - RNA, 19 nt, Pseudomonas aeruginosa PA01
gcccggccuccccggcccg

SEQ ID NO: 1517666 - RNA, 18 nt, Pseudomonas aeruginosa PA01
gcccggccucgccggucg

SEQ ID NO: 1517667 - RNA, 22 nt, Pseudomonas aeruginosa PA01
gcccggcgagagcguccggcag

SEQ ID NO: 1517668 - RNA, 23 nt, Pseudomonas aeruginosa PA01
gcccggcgaacagcgcuuccugg

SEQ ID NO: 1517669 - RNA, 12 nt, Pseudomonas aeruginosa PA01
gcccggcgcaga

SEQ ID NO: 1517670 - RNA, 15 nt, Pseudomonas aeruginosa PA01
gcccggcgcagaacu

SEQ ID NO: 1517671 - RNA, 12 nt, Pseudomonas aeruginosa PA01
gcccggccgccu

SEQ ID NO: 1517672 - RNA, 14 nt, Pseudomonas aeruginosa PA01
gcccggccgcaggc

SEQ ID NO: 1517673 - RNA, 16 nt, Pseudomonas aeruginosa PA01
gcccggccgcaggcag

SEQ ID NO: 1517674 - RNA, 11 nt, Pseudomonas aeruginosa PA01
gcccggccgcu

SEQ ID NO: 1517675 - RNA, 17 nt, Pseudomonas aeruginosa PA01
gcccggccgcuggaugc

SEQ ID NO: 1517676 - RNA, 14 nt, Pseudomonas aeruginosa PA01
gcccggccgccugc

SEQ ID NO: 1517677 - RNA, 16 nt, Pseudomonas aeruginosa PA01
gcccggccgccugccu

SEQ ID NO: 1517678 - RNA, 18 nt, Pseudomonas aeruginosa PA01
gcccggccauccuggccg

SEQ ID NO: 1517679 - RNA, 20 nt, Pseudomonas aeruginosa PA01
gcccggccauccuggccggu

SEQ ID NO: 1517680 - RNA, 14 nt, Pseudomonas aeruginosa PA01
gcccggccaggccg

SEQ ID NO: 1517681 - RNA, 13 nt, Pseudomonas aeruginosa PA01
gcccggccaggcg

SEQ ID NO: 1517682 - RNA, 15 nt, Pseudomonas aeruginosa PA01
gcccggccaggcgau

SEQ ID NO: 1517683 - RNA, 13 nt, Pseudomonas aeruginosa PA01
gcccgagggcggc

SEQ ID NO: 1517684 - RNA, 17 nt, Pseudomonas aeruginosa PA01
gcccgaggugucgccgc

SEQ ID NO: 1517685 - RNA, 24 nt, Pseudomonas aeruginosa PA01
gcccgaggugucgccgcggacggc

SEQ ID NO: 1517686 - RNA, 15 nt, Pseudomonas aeruginosa PA01
gcccgagugccggcg

SEQ ID NO: 1517687 - RNA, 17 nt, Pseudomonas aeruginosa PA01
gcccgagugcgcccagc

SEQ ID NO: 1517688 - RNA, 20 nt, Pseudomonas aeruginosa PA01
gcccgagugcgcccagcagc

SEQ ID NO: 1517689 - RNA, 22 nt, Pseudomonas aeruginosa PA01
gcccgaggcgaccuuggccagc

SEQ ID NO: 1517690 - RNA, 14 nt, Pseudomonas aeruginosa PA01
gcccgaugccgcgc

SEQ ID NO: 1517691 - RNA, 19 nt, Pseudomonas aeruginosa PA01
gcccgaugaucgagcgcac

SEQ ID NO: 1517692 - RNA, 21 nt, Pseudomonas aeruginosa PA01
gcccgccgccggggcgggccg

SEQ ID NO: 1517693 - RNA, 15 nt, Pseudomonas aeruginosa PA01
gcccgcgagccgcgc

SEQ ID NO: 1517694 - RNA, 18 nt, Pseudomonas aeruginosa PA01
gcccgcgagccgcgcagc

SEQ ID NO: 1517695 - RNA, 18 nt, Pseudomonas aeruginosa PA01
gccccguggcgggccagc

SEQ ID NO: 1517696 - RNA, 21 nt, Pseudomonas aeruginosa PA01
gccccguggcgggccagcagg

SEQ ID NO: 1517697 - RNA, 13 nt, Pseudomonas aeruginosa PA01
gccccgugcaccg

SEQ ID NO: 1517698 - RNA, 21 nt, Pseudomonas aeruginosa PA01
gccccgugcaccgaggcgcgc

SEQ ID NO: 1517699 - RNA, 19 nt, Pseudomonas aeruginosa PA01
gccccgucccuaccagcgc

SEQ ID NO: 1517700 - RNA, 18 nt, Pseudomonas aeruginosa PA01
gccccuucagcuccagca

SEQ ID NO: 1517701 - RNA, 18 nt, Pseudomonas aeruginosa PA01
gccccggucucgcgcagc

SEQ ID NO: 1517702 - RNA, 22 nt, Pseudomonas aeruginosa PA01
gccccggucucgcgcagcggcg

SEQ ID NO: 1517703 - RNA, 22 nt, Pseudomonas aeruginosa PA01
gccccggugauguaggccgcuu

SEQ ID NO: 1517704 - RNA, 15 nt, Pseudomonas aeruginosa PA01
gcccgaaggccccuu

SEQ ID NO: 1517705 - RNA, 14 nt, Pseudomonas aeruginosa PA01
gcccgacgccgccc

SEQ ID NO: 1517706 - RNA, 16 nt, Pseudomonas aeruginosa PA01
gccccuuggccagcac

SEQ ID NO: 1517707 - RNA, 22 nt, Pseudomonas aeruginosa PA01
gccccuugcgcuguuccgccgu

SEQ ID NO: 1517708 - RNA, 14 nt, Pseudomonas aeruginosa PA01
gccccggcgucggc

SEQ ID NO: 1517709 - RNA, 12 nt, Pseudomonas aeruginosa PA01
gccccggcgagc

SEQ ID NO: 1517710 - RNA, 22 nt, Pseudomonas aeruginosa PA01
gccccggcccggcgugagcagg

SEQ ID NO: 1517711 - RNA, 19 nt, Pseudomonas aeruginosa PA01
gccccggcccagccgcggc

SEQ ID NO: 1517712 - RNA, 12 nt, Pseudomonas aeruginosa PA01
gccccggccggc

SEQ ID NO: 1517713 - RNA, 12 nt, Pseudomonas aeruginosa PA01
gccccgccgcca

SEQ ID NO: 1517714 - RNA, 15 nt, Pseudomonas aeruginosa PA01
gccccgccgccaggc

SEQ ID NO: 1517715 - RNA, 23 nt, Pseudomonas aeruginosa PA01
gccccgccgggagcggccgugca

SEQ ID NO: 1517716 - RNA, 18 nt, Pseudomonas aeruginosa PA01
gccccgccuaccggggcg

SEQ ID NO: 1517717 - RNA, 12 nt, Pseudomonas aeruginosa PA01
gcccccuggccg

SEQ ID NO: 1517718 - RNA, 14 nt, Pseudomonas aeruginosa PA01
gcccccucgcccuc

SEQ ID NO: 1517719 - RNA, 20 nt, Pseudomonas aeruginosa PA01
gccccgaaaaaaaaggccgc

SEQ ID NO: 1517720 - RNA, 14 nt, Pseudomonas aeruginosa PA01
gccccgccaggagc

SEQ ID NO: 1517721 - RNA, 15 nt, Pseudomonas aeruginosa PA01
gccccauccgggcgg

SEQ ID NO: 1517722 - RNA, 16 nt, Pseudomonas aeruginosa PA01
gccccauccgggcggc

SEQ ID NO: 1517723 - RNA, 19 nt, Pseudomonas aeruginosa PA01
gccccauccgggcggcggg

SEQ ID NO: 1517724 - RNA, 20 nt, Pseudomonas aeruginosa PA01
gccccauccgggcggcgggc

SEQ ID NO: 1517725 - RNA, 19 nt, Pseudomonas aeruginosa PA01
gcccauguagaccaccagc

SEQ ID NO: 1517726 - RNA, 20 nt, Pseudomonas aeruginosa PA01
gcccccggcgcccagaaaaa

SEQ ID NO: 1517727 - RNA, 22 nt, Pseudomonas aeruginosa PA01
gcccccggcaacacccucccua

SEQ ID NO: 1517728 - RNA, 13 nt, Pseudomonas aeruginosa PA01
gcccccgccggcc

SEQ ID NO: 1517729 - RNA, 17 nt, Pseudomonas aeruginosa PA01
gcccccaccgcccccgc

SEQ ID NO: 1517730 - RNA, 22 nt, Pseudomonas aeruginosa PA01
gcccccacgacgcacucauagc

SEQ ID NO: 1517731 - RNA, 17 nt, Pseudomonas aeruginosa PA01
gcccacgcgccuggccg

SEQ ID NO: 1517732 - RNA, 15 nt, Pseudomonas aeruginosa PA01
gcccacgccuugcag

SEQ ID NO: 1517733 - RNA, 17 nt, Pseudomonas aeruginosa PA01
gcccacgccuugcagca

SEQ ID NO: 1517734 - RNA, 18 nt, Pseudomonas aeruginosa PA01
gcccaccugaacgcgccc

SEQ ID NO: 1517735 - RNA, 11 nt, Pseudomonas aeruginosa PA01
gcccacuccaa

SEQ ID NO: 1517736 - RNA, 13 nt, Pseudomonas aeruginosa PA01
gcccacuccagau

SEQ ID NO: 1517737 - RNA, 13 nt, Pseudomonas aeruginosa PA01
gcccacucuucag

SEQ ID NO: 1517738 - RNA, 14 nt, Pseudomonas aeruginosa PA01
gcccacucuucagu

SEQ ID NO: 1517739 - RNA, 12 nt, Pseudomonas aeruginosa PA01
gcccagaaaaaa

SEQ ID NO: 1517740 - RNA, 15 nt, Pseudomonas aeruginosa PA01
gcccacgggcggccg

SEQ ID NO: 1517741 - RNA, 11 nt, Pseudomonas aeruginosa PA01
gcccaccaacg

SEQ ID NO: 1517742 - RNA, 21 nt, Pseudomonas aeruginosa PA01
gcccaccagcgucgccaggcc

SEQ ID NO: 1517743 - RNA, 16 nt, Pseudomonas aeruginosa PA01
gcccaccaggucgccg

SEQ ID NO: 1517744 - RNA, 13 nt, Pseudomonas aeruginosa PA01
gcccacccugcgc

SEQ ID NO: 1517745 - RNA, 19 nt, Pseudomonas aeruginosa PA01
gcccaggcgucgcgccagc

SEQ ID NO: 1517746 - RNA, 21 nt, Pseudomonas aeruginosa PA01
gcccaggcgucgcgccagcac

SEQ ID NO: 1517747 - RNA, 12 nt, Pseudomonas aeruginosa PA01
gcccaggcugcc

SEQ ID NO: 1517748 - RNA, 15 nt, Pseudomonas aeruginosa PA01
gcccaggcagaucgc

SEQ ID NO: 1517749 - RNA, 14 nt, Pseudomonas aeruginosa PA01
gcccaggcagcaga

SEQ ID NO: 1517750 - RNA, 21 nt, Pseudomonas aeruginosa PA01
gcccagggcguggucggcggc

SEQ ID NO: 1517751 - RNA, 16 nt, Pseudomonas aeruginosa PA01
gcccagggccagcggg

SEQ ID NO: 1517752 - RNA, 17 nt, Pseudomonas aeruginosa PA01
gcccagggccagcgggu

SEQ ID NO: 1517753 - RNA, 15 nt, Pseudomonas aeruginosa PA01
gcccagggcccagag

SEQ ID NO: 1517754 - RNA, 15 nt, Pseudomonas aeruginosa PA01
gcccagguacugggc

SEQ ID NO: 1517755 - RNA, 13 nt, Pseudomonas aeruginosa PA01
gcccagcucgccg

SEQ ID NO: 1517756 - RNA, 15 nt, Pseudomonas aeruginosa PA01
gcccagcucgccgcu

SEQ ID NO: 1517757 - RNA, 16 nt, Pseudomonas aeruginosa PA01
gcccagcguggccagc

SEQ ID NO: 1517758 - RNA, 21 nt, Pseudomonas aeruginosa PA01
gcccagaacagcaaagcgcag

SEQ ID NO: 1517759 - RNA, 16 nt, Pseudomonas aeruginosa PA01
gcccagcagggccagc

SEQ ID NO: 1517760 - RNA, 17 nt, Pseudomonas aeruginosa PA01
gcccagcagggccagcc

SEQ ID NO: 1517761 - RNA, 20 nt, Pseudomonas aeruginosa PA01
gcccagcaggccggccagcc

SEQ ID NO: 1517762 - RNA, 15 nt, Pseudomonas aeruginosa PA01
gcccagcaggcgcgc

SEQ ID NO: 1517763 - RNA, 17 nt, Pseudomonas aeruginosa PA01
gcccagcaggcgcgccc

SEQ ID NO: 1517764 - RNA, 15 nt, Pseudomonas aeruginosa PA01
gcccagcaggcugcu

SEQ ID NO: 1517765 - RNA, 14 nt, Pseudomonas aeruginosa PA01
gcccaucaggcuca

SEQ ID NO: 1517766 - RNA, 18 nt, Pseudomonas aeruginosa PA01
gcccaucgacugcaacag

SEQ ID NO: 1517767 - RNA, 14 nt, Pseudomonas aeruginosa PA01
gcccaucgccacca

SEQ ID NO: 1517768 - RNA, 19 nt, Pseudomonas aeruginosa PA01
gcccaucgccaccagcagg

SEQ ID NO: 1517769 - RNA, 18 nt, Pseudomonas aeruginosa PA01
gcccauccgcucggcgag

SEQ ID NO: 1517770 - RNA, 16 nt, Pseudomonas aeruginosa PA01
gcccauccgaggaugg

SEQ ID NO: 1517771 - RNA, 14 nt, Pseudomonas aeruginosa PA01
gcccauccuggcga

SEQ ID NO: 1517772 - RNA, 15 nt, Pseudomonas aeruginosa PA01
gcccaguugcgccgc

SEQ ID NO: 1517773 - RNA, 16 nt, Pseudomonas aeruginosa PA01
gcccaguugcgccgcc

SEQ ID NO: 1517774 - RNA, 19 nt, Pseudomonas aeruginosa PA01
gcccaguugcgccgccugc

SEQ ID NO: 1517775 - RNA, 22 nt, Pseudomonas aeruginosa PA01
gcccauacaccaggccggcggc

SEQ ID NO: 1517776 - RNA, 23 nt, Pseudomonas aeruginosa PA01
gcccauagcgaguaggcgaagcc

SEQ ID NO: 1517777 - RNA, 17 nt, Pseudomonas aeruginosa PA01
gcccaggugcgccgagc

SEQ ID NO: 1517778 - RNA, 17 nt, Pseudomonas aeruginosa PA01
gcccagguggcaggccu

SEQ ID NO: 1517779 - RNA, 20 nt, Pseudomonas aeruginosa PA01
gcccagguggcaggccugga

SEQ ID NO: 1517780 - RNA, 17 nt, Pseudomonas aeruginosa PA01
gcccagggacgcgccgg

SEQ ID NO: 1517781 - RNA, 18 nt, Pseudomonas aeruginosa PA01
gcccagggacgcgccggc

SEQ ID NO: 1517782 - RNA, 21 nt, Pseudomonas aeruginosa PA01
gcccagguagucgcccagcgc

SEQ ID NO: 1517783 - RNA, 23 nt, Pseudomonas aeruginosa PA01
gccauguuggccuugagcaggcg

SEQ ID NO: 1517784 - RNA, 16 nt, Pseudomonas aeruginosa PA01
gccaugcuggcgcucu

SEQ ID NO: 1517785 - RNA, 19 nt, Pseudomonas aeruginosa PA01
gccaugcucuucaggcugu

SEQ ID NO: 1517786 - RNA, 13 nt, Pseudomonas aeruginosa PA01
gccaugugcuccu

SEQ ID NO: 1517787 - RNA, 14 nt, Pseudomonas aeruginosa PA01
gccaugcgcccgcu

SEQ ID NO: 1517788 - RNA, 20 nt, Pseudomonas aeruginosa PA01
gccaugccguucaggccggc

SEQ ID NO: 1517789 - RNA, 16 nt, Pseudomonas aeruginosa PA01
gccaugccggcgccga

SEQ ID NO: 1517790 - RNA, 22 nt, Pseudomonas aeruginosa PA01
gccaucuucucgaagcgcgccu

SEQ ID NO: 1517791 - RNA, 22 nt, Pseudomonas aeruginosa PA01
gccauugcagguaguccagcca

SEQ ID NO: 1517792 - RNA, 15 nt, Pseudomonas aeruginosa PA01
gccauuucaaggcga

SEQ ID NO: 1517793 - RNA, 19 nt, Pseudomonas aeruginosa PA01
gccaggcguuccagcucgg

SEQ ID NO: 1517794 - RNA, 16 nt, Pseudomonas aeruginosa PA01
gccaggcggccgaaga

SEQ ID NO: 1517795 - RNA, 18 nt, Pseudomonas aeruginosa PA01
gccaggcggccgcuggcg

SEQ ID NO: 1517796 - RNA, 12 nt, Pseudomonas aeruginosa PA01
gccaggcggcuc

SEQ ID NO: 1517797 - RNA, 21 nt, Pseudomonas aeruginosa PA01
gccaggcggggauggcgggcu

SEQ ID NO: 1517798 - RNA, 16 nt, Pseudomonas aeruginosa PA01
gccaggcgguccagcc

SEQ ID NO: 1517799 - RNA, 19 nt, Pseudomonas aeruginosa PA01
gccaggcgcucucgccgcc

SEQ ID NO: 1517800 - RNA, 19 nt, Pseudomonas aeruginosa PA01
gccaggcgcaccagcaggc

SEQ ID NO: 1517801 - RNA, 14 nt, Pseudomonas aeruginosa PA01
gccaggcgcagcca

SEQ ID NO: 1517802 - RNA, 16 nt, Pseudomonas aeruginosa PA01
gccaggcgcagccagc

SEQ ID NO: 1517803 - RNA, 23 nt, Pseudomonas aeruginosa PA01
gccaggcgcaguaggccugguag

SEQ ID NO: 1517804 - RNA, 16 nt, Pseudomonas aeruginosa PA01
gccaggcgcagugccu

SEQ ID NO: 1517805 - RNA, 17 nt, Pseudomonas aeruginosa PA01
gccaggcgcagugccug

SEQ ID NO: 1517806 - RNA, 20 nt, Pseudomonas aeruginosa PA01
gccaggcgaggaacagcgag

SEQ ID NO: 1517807 - RNA, 15 nt, Pseudomonas aeruginosa PA01
gccaggcgauccagc

SEQ ID NO: 1517808 - RNA, 21 nt, Pseudomonas aeruginosa PA01
gccaggcgauggugcgcucgc

SEQ ID NO: 1517809 - RNA, 14 nt, Pseudomonas aeruginosa PA01
gccaggcgcggcgc

SEQ ID NO: 1517810 - RNA, 12 nt, Pseudomonas aeruginosa PA01
gccaggcgcggu

SEQ ID NO: 1517811 - RNA, 13 nt, Pseudomonas aeruginosa PA01
gccaggcgcgucu

SEQ ID NO: 1517812 - RNA, 22 nt, Pseudomonas aeruginosa PA01
gccaggcgcgucuccagcucgg

SEQ ID NO: 1517813 - RNA, 17 nt, Pseudomonas aeruginosa PA01
gccaggcgcuccagggc

SEQ ID NO: 1517814 - RNA, 13 nt, Pseudomonas aeruginosa PA01
gccaggcgcuccu

SEQ ID NO: 1517815 - RNA, 15 nt, Pseudomonas aeruginosa PA01
gccaggcgcucgcgc

SEQ ID NO: 1517816 - RNA, 15 nt, Pseudomonas aeruginosa PA01
gccaggcucgccgcc

SEQ ID NO: 1517817 - RNA, 23 nt, Pseudomonas aeruginosa PA01
gccaggcucgccgccagcaggau

SEQ ID NO: 1517818 - RNA, 19 nt, Pseudomonas aeruginosa PA01
gccaggcucgguucugcgc

SEQ ID NO: 1517819 - RNA, 18 nt, Pseudomonas aeruginosa PA01
gccaucaggccgcggccc

SEQ ID NO: 1517820 - RNA, 13 nt, Pseudomonas aeruginosa PA01
gccaucagggucg

SEQ ID NO: 1517821 - RNA, 17 nt, Pseudomonas aeruginosa PA01
gccaucagugccugcac

SEQ ID NO: 1517822 - RNA, 12 nt, Pseudomonas aeruginosa PA01
gccauccuccag

SEQ ID NO: 1517823 - RNA, 13 nt, Pseudomonas aeruginosa PA01
gccauccuccgag

SEQ ID NO: 1517824 - RNA, 15 nt, Pseudomonas aeruginosa PA01
gccaucuggcugccg

SEQ ID NO: 1517825 - RNA, 12 nt, Pseudomonas aeruginosa PA01
gccaucgaccag

SEQ ID NO: 1517826 - RNA, 14 nt, Pseudomonas aeruginosa PA01
gccaucgaccagga

SEQ ID NO: 1517827 - RNA, 23 nt, Pseudomonas aeruginosa PA01
gccaucgagcgcuccaccgcgcu

SEQ ID NO: 1517828 - RNA, 17 nt, Pseudomonas aeruginosa PA01
gccaucgaggccaggcc

SEQ ID NO: 1517829 - RNA, 19 nt, Pseudomonas aeruginosa PA01
gccaucgaugugagcccca

SEQ ID NO: 1517830 - RNA, 17 nt, Pseudomonas aeruginosa PA01
gccaucgcauagccggc

SEQ ID NO: 1517831 - RNA, 18 nt, Pseudomonas aeruginosa PA01
gccaucgcauagccggcg

SEQ ID NO: 1517832 - RNA, 19 nt, Pseudomonas aeruginosa PA01
gccaucgcauagccggcgc

SEQ ID NO: 1517833 - RNA, 16 nt, Pseudomonas aeruginosa PA01
gccgauaccggccucg

SEQ ID NO: 1517834 - RNA, 23 nt, Pseudomonas aeruginosa PA01
gccgauccgcgaauagggcggcg

SEQ ID NO: 1517835 - RNA, 15 nt, Pseudomonas aeruginosa PA01
gccgauacagcgcgc

SEQ ID NO: 1517836 - RNA, 15 nt, Pseudomonas aeruginosa PA01
gccgaucgccucguu

SEQ ID NO: 1517837 - RNA, 22 nt, Pseudomonas aeruginosa PA01
gccgaucggcauguugugcuug

SEQ ID NO: 1517838 - RNA, 14 nt, Pseudomonas aeruginosa PA01
gccgaucgagcggc

SEQ ID NO: 1517839 - RNA, 16 nt, Pseudomonas aeruginosa PA01
gccgaucuccuccgcc

SEQ ID NO: 1517840 - RNA, 14 nt, Pseudomonas aeruginosa PA01
gccgaucuccuggu

SEQ ID NO: 1517841 - RNA, 13 nt, Pseudomonas aeruginosa PA01
gccgaggcggcgc

SEQ ID NO: 1517842 - RNA, 16 nt, Pseudomonas aeruginosa PA01
gccgaggcggcgcagc

SEQ ID NO: 1517843 - RNA, 13 nt, Pseudomonas aeruginosa PA01
gccgaggccgccg

SEQ ID NO: 1517844 - RNA, 13 nt, Pseudomonas aeruginosa PA01
gccgaggccgagg

SEQ ID NO: 1517845 - RNA, 14 nt, Pseudomonas aeruginosa PA01
gccgaggcagccgu

SEQ ID NO: 1517846 - RNA, 22 nt, Pseudomonas aeruginosa PA01
gccgaggaggaucucgcgcccc

SEQ ID NO: 1517847 - RNA, 15 nt, Pseudomonas aeruginosa PA01
gccgaggaggccagc

SEQ ID NO: 1517848 - RNA, 15 nt, Pseudomonas aeruginosa PA01
gccgaggaugcucgc

SEQ ID NO: 1517849 - RNA, 17 nt, Pseudomonas aeruginosa PA01
gccgaggaagccgaccg

SEQ ID NO: 1517850 - RNA, 23 nt, Pseudomonas aeruginosa PA01
gccgaggaagccgaccggcgccg

SEQ ID NO: 1517851 - RNA, 21 nt, Pseudomonas aeruginosa PA01
gccgaggaaggcgcuggcgcu

SEQ ID NO: 1517852 - RNA, 19 nt, Pseudomonas aeruginosa PA01
gccgaggaagucggcggcc

SEQ ID NO: 1517853 - RNA, 21 nt, Pseudomonas aeruginosa PA01
gccgaggaacauccgcggccc

SEQ ID NO: 1517854 - RNA, 14 nt, Pseudomonas aeruginosa PA01
gccgagcuggcgcg

SEQ ID NO: 1517855 - RNA, 17 nt, Pseudomonas aeruginosa PA01
gccgagcuugaccuugc

SEQ ID NO: 1517856 - RNA, 23 nt, Pseudomonas aeruginosa PA01
gccgagcuugaccuugccgccgg

SEQ ID NO: 1517857 - RNA, 11 nt, Pseudomonas aeruginosa PA01
gccgagcagca

SEQ ID NO: 1517858 - RNA, 20 nt, Pseudomonas aeruginosa PA01
gccgagcagcaccaggcugg

SEQ ID NO: 1517859 - RNA, 18 nt, Pseudomonas aeruginosa PA01
gccgagcaggugcaugua

SEQ ID NO: 1517860 - RNA, 14 nt, Pseudomonas aeruginosa PA01
gccgagcaggcgcg

SEQ ID NO: 1517861 - RNA, 16 nt, Pseudomonas aeruginosa PA01
gccgagcaggcgcgcc

SEQ ID NO: 1517862 - RNA, 18 nt, Pseudomonas aeruginosa PA01
gccgagcaggaagaagcc

SEQ ID NO: 1517863 - RNA, 18 nt, Pseudomonas aeruginosa PA01
gccgagcaauccggcgcu

SEQ ID NO: 1517864 - RNA, 19 nt, Pseudomonas aeruginosa PA01
gccgagcaacucggcggcg

SEQ ID NO: 1517865 - RNA, 22 nt, Pseudomonas aeruginosa PA01
gccgagcaacucggcggcgagc

SEQ ID NO: 1517866 - RNA, 17 nt, Pseudomonas aeruginosa PA01
gccgagcaacugcaugu

SEQ ID NO: 1517867 - RNA, 18 nt, Pseudomonas aeruginosa PA01
gccgagcaagccuuccag

SEQ ID NO: 1517868 - RNA, 22 nt, Pseudomonas aeruginosa PA01
gccgagaagcagaacgccccgc

SEQ ID NO: 1517869 - RNA, 21 nt, Pseudomonas aeruginosa PA01
gccgagaagguucucggccac

SEQ ID NO: 1517870 - RNA, 17 nt, Pseudomonas aeruginosa PA01
gccgagauccugcagca

SEQ ID NO: 1517871 - RNA, 16 nt, Pseudomonas aeruginosa PA01
gccgagcaucagcgac

SEQ ID NO: 1517872 - RNA, 22 nt, Pseudomonas aeruginosa PA01
gccgagcccccggcgcccagaa

SEQ ID NO: 1517873 - RNA, 17 nt, Pseudomonas aeruginosa PA01
gccgagcccgagugcgc

SEQ ID NO: 1517874 - RNA, 21 nt, Pseudomonas aeruginosa PA01
gccgagccgacauccugucga

SEQ ID NO: 1517875 - RNA, 13 nt, Pseudomonas aeruginosa PA01
gccgagcgccgcc

SEQ ID NO: 1517876 - RNA, 19 nt, Pseudomonas aeruginosa PA01
gccgagcgccgccaggcag

SEQ ID NO: 1517877 - RNA, 16 nt, Pseudomonas aeruginosa PA01
gccgagcgccuggcaa

SEQ ID NO: 1517878 - RNA, 15 nt, Pseudomonas aeruginosa PA01
gccgagcgccagggc

SEQ ID NO: 1517879 - RNA, 19 nt, Pseudomonas aeruginosa PA01
gccgagcgccagggccagg

SEQ ID NO: 1517880 - RNA, 15 nt, Pseudomonas aeruginosa PA01
gccgagccggcugcc

SEQ ID NO: 1517881 - RNA, 16 nt, Pseudomonas aeruginosa PA01
gccgagccggcugccg

SEQ ID NO: 1517882 - RNA, 19 nt, Pseudomonas aeruginosa PA01
gccgagcgcgagugcagcg

SEQ ID NO: 1517883 - RNA, 22 nt, Pseudomonas aeruginosa PA01
gccgagcgcgagugcagcgagu

SEQ ID NO: 1517884 - RNA, 15 nt, Pseudomonas aeruginosa PA01
gccgagcgcgccgcc

SEQ ID NO: 1517885 - RNA, 17 nt, Pseudomonas aeruginosa PA01
gccgagcgcgccgccga

SEQ ID NO: 1517886 - RNA, 14 nt, Pseudomonas aeruginosa PA01
gccgagcgggaagc

SEQ ID NO: 1517887 - RNA, 15 nt, Pseudomonas aeruginosa PA01
gccgagcgcucgccg

SEQ ID NO: 1517888 - RNA, 18 nt, Pseudomonas aeruginosa PA01
gccgagcggcaaggccaa

SEQ ID NO: 1517889 - RNA, 20 nt, Pseudomonas aeruginosa PA01
gccgagcggcaaggccaagu

SEQ ID NO: 1517890 - RNA, 18 nt, Pseudomonas aeruginosa PA01
gccgagcugaccaccagg

SEQ ID NO: 1517891 - RNA, 18 nt, Pseudomonas aeruginosa PA01
gccgagcuggcgcgcguc

SEQ ID NO: 1517892 - RNA, 21 nt, Pseudomonas aeruginosa PA01
gccgagcugggcguugcccau

SEQ ID NO: 1517893 - RNA, 14 nt, Pseudomonas aeruginosa PA01
gccgcagcagcggc

SEQ ID NO: 1517894 - RNA, 15 nt, Pseudomonas aeruginosa PA01
gccgcagcagcggcg

SEQ ID NO: 1517895 - RNA, 22 nt, Pseudomonas aeruginosa PA01
gccgcagaccagcgaaccgccg

SEQ ID NO: 1517896 - RNA, 15 nt, Pseudomonas aeruginosa PA01
gccgcagagccagcc

SEQ ID NO: 1517897 - RNA, 17 nt, Pseudomonas aeruginosa PA01
gccgcagagccagccgc

SEQ ID NO: 1517898 - RNA, 20 nt, Pseudomonas aeruginosa PA01
gccgcagagccagccgcagc

SEQ ID NO: 1517899 - RNA, 22 nt, Pseudomonas aeruginosa PA01
gccgcaaccagcccuggcgcag

SEQ ID NO: 1517900 - RNA, 14 nt, Pseudomonas aeruginosa PA01
gccgcaaacccccu

SEQ ID NO: 1517901 - RNA, 22 nt, Pseudomonas aeruginosa PA01
gccgaucucgugggccagcagg

SEQ ID NO: 1517902 - RNA, 18 nt, Pseudomonas aeruginosa PA01
gccgaucuucagcagcag

SEQ ID NO: 1517903 - RNA, 23 nt, Pseudomonas aeruginosa PA01
gccgaucuucagcagcaggcgcu

SEQ ID NO: 1517904 - RNA, 23 nt, Pseudomonas aeruginosa PA01
gccgcaucgaccuugcccucggc

SEQ ID NO: 1517905 - RNA, 14 nt, Pseudomonas aeruginosa PA01
gccgcaucgcgggc

SEQ ID NO: 1517906 - RNA, 15 nt, Pseudomonas aeruginosa PA01
gccgcaucgcgggcg

SEQ ID NO: 1517907 - RNA, 11 nt, Pseudomonas aeruginosa PA01
gccgcaugccg

SEQ ID NO: 1517908 - RNA, 17 nt, Pseudomonas aeruginosa PA01
gccgcauuggccaggcc

SEQ ID NO: 1517909 - RNA, 20 nt, Pseudomonas aeruginosa PA01
gccgccagaaagccucaggc

SEQ ID NO: 1517910 - RNA, 19 nt, Pseudomonas aeruginosa PA01
gccgcagcgccccucccag

SEQ ID NO: 1517911 - RNA, 21 nt, Pseudomonas aeruginosa PA01
gccgcagcggcgucugccgcu

SEQ ID NO: 1517912 - RNA, 15 nt, Pseudomonas aeruginosa PA01
gccgcauccgcggcc

SEQ ID NO: 1517913 - RNA, 19 nt, Pseudomonas aeruginosa PA01
gccgcagcggcaugcccug

SEQ ID NO: 1517914 - RNA, 13 nt, Pseudomonas aeruginosa PA01
gcccuuggccagc

SEQ ID NO: 1517915 - RNA, 22 nt, Pseudomonas aeruginosa PA01
gcccuuggaguugaugaagcac

SEQ ID NO: 1517916 - RNA, 16 nt, Pseudomonas aeruginosa PA01
gcccuugcggcgcggc

SEQ ID NO: 1517917 - RNA, 12 nt, Pseudomonas aeruginosa PA01
gccgaaagcacu

SEQ ID NO: 1517918 - RNA, 23 nt, Pseudomonas aeruginosa PA01
gccgaacaccugcaucaccaggc

SEQ ID NO: 1517919 - RNA, 14 nt, Pseudomonas aeruginosa PA01
gccgaacagcaggg

SEQ ID NO: 1517920 - RNA, 21 nt, Pseudomonas aeruginosa PA01
gccgaacagcagggaggcgca

SEQ ID NO: 1517921 - RNA, 19 nt, Pseudomonas aeruginosa PA01
gccgaacagacgcaggcag

SEQ ID NO: 1517922 - RNA, 21 nt, Pseudomonas aeruginosa PA01
gccgaacagacgcaggcaggu

SEQ ID NO: 1517923 - RNA, 20 nt, Pseudomonas aeruginosa PA01
gccgaacagcaacaccgcgc

SEQ ID NO: 1517924 - RNA, 19 nt, Pseudomonas aeruginosa PA01
gcccuugaagcgcuucugc

SEQ ID NO: 1517925 - RNA, 18 nt, Pseudomonas aeruginosa PA01
gcccuugacgucguucag

SEQ ID NO: 1517926 - RNA, 21 nt, Pseudomonas aeruginosa PA01
gcccuugcaaccgccgccgca

SEQ ID NO: 1517927 - RNA, 22 nt, Pseudomonas aeruginosa PA01
gcccuggugcacggcgacccgc

SEQ ID NO: 1517928 - RNA, 23 nt, Pseudomonas aeruginosa PA01
gcccuugagcauggcguuccagu

SEQ ID NO: 1517929 - RNA, 22 nt, Pseudomonas aeruginosa PA01
gcccuugaggaaguugcgcagc

SEQ ID NO: 1517930 - RNA, 18 nt, Pseudomonas aeruginosa PA01
gcccugguugcggaacgg

SEQ ID NO: 1517931 - RNA, 22 nt, Pseudomonas aeruginosa PA01
gcccuggucgacauagcgcagc

SEQ ID NO: 1517932 - RNA, 14 nt, Pseudomonas aeruginosa PA01
gcccugccggcgca

SEQ ID NO: 1517933 - RNA, 16 nt, Pseudomonas aeruginosa PA01
gcccugccggcgcaga

SEQ ID NO: 1517934 - RNA, 23 nt, Pseudomonas aeruginosa PA01
gcccgggcguuggcuccgggccg

SEQ ID NO: 1517935 - RNA, 14 nt, Pseudomonas aeruginosa PA01
gcccgggccuggug

SEQ ID NO: 1517936 - RNA, 16 nt, Pseudomonas aeruginosa PA01
gcccgggccuggugca

SEQ ID NO: 1517937 - RNA, 19 nt, Pseudomonas aeruginosa PA01
gcccugcgcgaucccccgc

SEQ ID NO: 1517938 - RNA, 15 nt, Pseudomonas aeruginosa PA01
gcccugcgccgcagc

SEQ ID NO: 1517939 - RNA, 16 nt, Pseudomonas aeruginosa PA01
gcccugcgccgcagcg

SEQ ID NO: 1517940 - RNA, 21 nt, Pseudomonas aeruginosa PA01
gcccugcgccgcagcggccag

SEQ ID NO: 1517941 - RNA, 16 nt, Pseudomonas aeruginosa PA01
gcccugcggauggcgc

SEQ ID NO: 1517942 - RNA, 21 nt, Pseudomonas aeruginosa PA01
gcccugcguggaaccgcggcg

SEQ ID NO: 1517943 - RNA, 17 nt, Pseudomonas aeruginosa PA01
gcccugcuccuccaggc

SEQ ID NO: 1517944 - RNA, 23 nt, Pseudomonas aeruginosa PA01
gcccugcucgccggcgcgggcgg

SEQ ID NO: 1517945 - RNA, 17 nt, Pseudomonas aeruginosa PA01
gcccugcucuuccagcg

SEQ ID NO: 1517946 - RNA, 12 nt, Pseudomonas aeruginosa PA01
gcccugcugcuc

SEQ ID NO: 1517947 - RNA, 18 nt, Pseudomonas aeruginosa PA01
gcccugcugcucgccaug

SEQ ID NO: 1517948 - RNA, 16 nt, Pseudomonas aeruginosa PA01
gcccugcuggcgcagc

SEQ ID NO: 1517949 - RNA, 24 nt, Pseudomonas aeruginosa PA01
gcccugcuggcgcagccaggcgau

SEQ ID NO: 1517950 - RNA, 20 nt, Pseudomonas aeruginosa PA01
gcccugcugcagggccucgc

SEQ ID NO: 1517951 - RNA, 14 nt, Pseudomonas aeruginosa PA01
gcccugguccaacc

SEQ ID NO: 1517952 - RNA, 16 nt, Pseudomonas aeruginosa PA01
gcccugguccaaccgg

SEQ ID NO: 1517953 - RNA, 15 nt, Pseudomonas aeruginosa PA01
gcccugggguuucug

SEQ ID NO: 1517954 - RNA, 15 nt, Pseudomonas aeruginosa PA01
gcccuggaagccggc

SEQ ID NO: 1517955 - RNA, 17 nt, Pseudomonas aeruginosa PA01
gcccuggaagccggcag

SEQ ID NO: 1517956 - RNA, 17 nt, Pseudomonas aeruginosa PA01
gcccuggauaucugggc

SEQ ID NO: 1517957 - RNA, 16 nt, Pseudomonas aeruginosa PA01
gccgaccgcaccgcca

SEQ ID NO: 1517958 - RNA, 14 nt, Pseudomonas aeruginosa PA01
gccgaccgccaggc

SEQ ID NO: 1517959 - RNA, 15 nt, Pseudomonas aeruginosa PA01
gccgaccgccaggcc

SEQ ID NO: 1517960 - RNA, 19 nt, Pseudomonas aeruginosa PA01
gccgacccgugcgccgcgg

SEQ ID NO: 1517961 - RNA, 18 nt, Pseudomonas aeruginosa PA01
gccgacccuagggucggc

SEQ ID NO: 1517962 - RNA, 12 nt, Pseudomonas aeruginosa PA01
gccgaccgagca

SEQ ID NO: 1517963 - RNA, 15 nt, Pseudomonas aeruginosa PA01
gccgaccagguccgc

SEQ ID NO: 1517964 - RNA, 18 nt, Pseudomonas aeruginosa PA01
gccgacccgcaggccggc

SEQ ID NO: 1517965 - RNA, 23 nt, Pseudomonas aeruginosa PA01
gccgacuuccaggcgcaggcgag

SEQ ID NO: 1517966 - RNA, 17 nt, Pseudomonas aeruginosa PA01
gccgacuggcgguacgc

SEQ ID NO: 1517967 - RNA, 21 nt, Pseudomonas aeruginosa PA01
gccgagaacgcggcgaagggc

SEQ ID NO: 1517968 - RNA, 21 nt, Pseudomonas aeruginosa PA01
gccgacugcaacuggccgaga

SEQ ID NO: 1517969 - RNA, 20 nt, Pseudomonas aeruginosa PA01
gccgacugcgguuuuccugc

SEQ ID NO: 1517970 - RNA, 16 nt, Pseudomonas aeruginosa PA01
gccgaccguccgccug

SEQ ID NO: 1517971 - RNA, 16 nt, Pseudomonas aeruginosa PA01
gccgacgugcacccgc

SEQ ID NO: 1517972 - RNA, 15 nt, Pseudomonas aeruginosa PA01
gccgacguccuccag

SEQ ID NO: 1517973 - RNA, 18 nt, Pseudomonas aeruginosa PA01
gccgacguccuccaggac

SEQ ID NO: 1517974 - RNA, 22 nt, Pseudomonas aeruginosa PA01
gccgacaacgaaaagagccgcg

SEQ ID NO: 1517975 - RNA, 23 nt, Pseudomonas aeruginosa PA01
gccgacaacgaaaagagccgcgc

SEQ ID NO: 1517976 - RNA, 21 nt, Pseudomonas aeruginosa PA01
gccgaccaccuucaggcugcu

SEQ ID NO: 1517977 - RNA, 22 nt, Pseudomonas aeruginosa PA01
gccgaccagccgcaggcugccg

SEQ ID NO: 1517978 - RNA, 19 nt, Pseudomonas aeruginosa PA01
gccgaccagcagggccagc

SEQ ID NO: 1517979 - RNA, 15 nt, Pseudomonas aeruginosa PA01
gccgaacgccccagu

SEQ ID NO: 1517980 - RNA, 15 nt, Pseudomonas aeruginosa PA01
gccgaacuucuccgc

SEQ ID NO: 1517981 - RNA, 17 nt, Pseudomonas aeruginosa PA01
gccgaacgguagguagc

SEQ ID NO: 1517982 - RNA, 22 nt, Pseudomonas aeruginosa PA01
gccgaacuccgccagcaccacc

SEQ ID NO: 1517983 - RNA, 16 nt, Pseudomonas aeruginosa PA01
gccgaaccgccucaga

SEQ ID NO: 1517984 - RNA, 20 nt, Pseudomonas aeruginosa PA01
gccgaacaugccgaagagcu

SEQ ID NO: 1517985 - RNA, 16 nt, Pseudomonas aeruginosa PA01
gccgcugguccagcug

SEQ ID NO: 1517986 - RNA, 19 nt, Pseudomonas aeruginosa PA01
gccgcuggugaucgaccac

SEQ ID NO: 1517987 - RNA, 20 nt, Pseudomonas aeruginosa PA01
gccgcugucguccagcgggu

SEQ ID NO: 1517988 - RNA, 16 nt, Pseudomonas aeruginosa PA01
gccgcuggccuggcca

SEQ ID NO: 1517989 - RNA, 17 nt, Pseudomonas aeruginosa PA01
gccgcuggguuuccugc

SEQ ID NO: 1517990 - RNA, 13 nt, Pseudomonas aeruginosa PA01
gccgcugggcagc

SEQ ID NO: 1517991 - RNA, 15 nt, Pseudomonas aeruginosa PA01
gccgcuggcggcgcu

SEQ ID NO: 1517992 - RNA, 14 nt, Pseudomonas aeruginosa PA01
gccgcuggcggccu

SEQ ID NO: 1517993 - RNA, 23 nt, Pseudomonas aeruginosa PA01
gccgcugccguugcaggcccagc

SEQ ID NO: 1517994 - RNA, 16 nt, Pseudomonas aeruginosa PA01
gccgcugccugucgca

SEQ ID NO: 1517995 - RNA, 18 nt, Pseudomonas aeruginosa PA01
gccgcugccugucgcagc

SEQ ID NO: 1517996 - RNA, 15 nt, Pseudomonas aeruginosa PA01
gccgcugcgcaggcc

SEQ ID NO: 1517997 - RNA, 16 nt, Pseudomonas aeruginosa PA01
gccgcugcgcaggccg

SEQ ID NO: 1517998 - RNA, 20 nt, Pseudomonas aeruginosa PA01
gccgcugcgucgucgcggcg

SEQ ID NO: 1517999 - RNA, 14 nt, Pseudomonas aeruginosa PA01
gccgcugcggcggu

SEQ ID NO: 1518000 - RNA, 17 nt, Pseudomonas aeruginosa PA01
gccgcugcggcucgccg

SEQ ID NO: 1518001 - RNA, 21 nt, Pseudomonas aeruginosa PA01
gccgcuggcauaaccggaagc

SEQ ID NO: 1518002 - RNA, 13 nt, Pseudomonas aeruginosa PA01
gccgcugcccaga

SEQ ID NO: 1518003 - RNA, 14 nt, Pseudomonas aeruginosa PA01
gccgcugccgggcu

SEQ ID NO: 1518004 - RNA, 16 nt, Pseudomonas aeruginosa PA01
gccgcugccgcucugg

SEQ ID NO: 1518005 - RNA, 21 nt, Pseudomonas aeruginosa PA01
gccgcugccgcucuggcugcu

SEQ ID NO: 1518006 - RNA, 18 nt, Pseudomonas aeruginosa PA01
gccgcugcagggcggcgc

SEQ ID NO: 1518007 - RNA, 14 nt, Pseudomonas aeruginosa PA01
gccgcucgcguccg

SEQ ID NO: 1518008 - RNA, 17 nt, Pseudomonas aeruginosa PA01
gccgcucguccaguucc

SEQ ID NO: 1518009 - RNA, 15 nt, Pseudomonas aeruginosa PA01
gccgcucggccgcca

SEQ ID NO: 1518010 - RNA, 18 nt, Pseudomonas aeruginosa PA01
gccgcucggccgccagca

SEQ ID NO: 1518011 - RNA, 17 nt, Pseudomonas aeruginosa PA01
gccgcuccgcgccacgc

SEQ ID NO: 1518012 - RNA, 19 nt, Pseudomonas aeruginosa PA01
gccgcuccgcgccacgcuc

SEQ ID NO: 1518013 - RNA, 21 nt, Pseudomonas aeruginosa PA01
gccgcucgagggcgaccgcca

SEQ ID NO: 1518014 - RNA, 22 nt, Pseudomonas aeruginosa PA01
gccgcucgagggcgaccgccag

SEQ ID NO: 1518015 - RNA, 13 nt, Pseudomonas aeruginosa PA01
gccgcucgcgcac

SEQ ID NO: 1518016 - RNA, 12 nt, Pseudomonas aeruginosa PA01
gccgcucgcgcg

SEQ ID NO: 1518017 - RNA, 15 nt, Pseudomonas aeruginosa PA01
gccgcucgcgcggca

SEQ ID NO: 1518018 - RNA, 23 nt, Pseudomonas aeruginosa PA01
gccgcugaucaguaccggcagcg

SEQ ID NO: 1518019 - RNA, 21 nt, Pseudomonas aeruginosa PA01
gccgcucguuggcggccagca

SEQ ID NO: 1518020 - RNA, 18 nt, Pseudomonas aeruginosa PA01
gccgcucugcccgaccgg

SEQ ID NO: 1518021 - RNA, 13 nt, Pseudomonas aeruginosa PA01
gccgcucuggcug

SEQ ID NO: 1518022 - RNA, 20 nt, Pseudomonas aeruginosa PA01
gccgcugacggucugccagc

SEQ ID NO: 1518023 - RNA, 23 nt, Pseudomonas aeruginosa PA01
gccgcucaggcgucccgcuccag

SEQ ID NO: 1518024 - RNA, 16 nt, Pseudomonas aeruginosa PA01
gccgcucacccugucc

SEQ ID NO: 1518025 - RNA, 15 nt, Pseudomonas aeruginosa PA01
gccgcuccacacccg

SEQ ID NO: 1518026 - RNA, 19 nt, Pseudomonas aeruginosa PA01
gccgcuaucgcuggcgcag

SEQ ID NO: 1518027 - RNA, 20 nt, Pseudomonas aeruginosa PA01
gccgcuaucgcuggcgcagc

SEQ ID NO: 1518028 - RNA, 22 nt, Pseudomonas aeruginosa PA01
gccgcuaucgcuggcgcagccg

SEQ ID NO: 1518029 - RNA, 23 nt, Pseudomonas aeruginosa PA01
gccgcuaucgcuggcgcagccgc

SEQ ID NO: 1518030 - RNA, 20 nt, Pseudomonas aeruginosa PA01
gccgcguucagucccgcggc

SEQ ID NO: 1518031 - RNA, 15 nt, Pseudomonas aeruginosa PA01
gccgcgugcgcgccc

SEQ ID NO: 1518032 - RNA, 17 nt, Pseudomonas aeruginosa PA01
gccgcgugcgcgccgcc

SEQ ID NO: 1518033 - RNA, 23 nt, Pseudomonas aeruginosa PA01
gccgcgucggcucgguuccagcu

SEQ ID NO: 1518034 - RNA, 16 nt, Pseudomonas aeruginosa PA01
gccgcguucgccgagg

SEQ ID NO: 1518035 - RNA, 21 nt, Pseudomonas aeruginosa PA01
gccgcguucgccgaggcggcg

SEQ ID NO: 1518036 - RNA, 24 nt, Pseudomonas aeruginosa PA01
gccgcggucgaugucgcggcccug

SEQ ID NO: 1518037 - RNA, 17 nt, Pseudomonas aeruginosa PA01
gccgcggucgggcagau

SEQ ID NO: 1518038 - RNA, 14 nt, Pseudomonas aeruginosa PA01
gccgcgguccaucc

SEQ ID NO: 1518039 - RNA, 17 nt, Pseudomonas aeruginosa PA01
gccgcguaagcggccuu

SEQ ID NO: 1518040 - RNA, 17 nt, Pseudomonas aeruginosa PA01
gccgcguagcgccaggc

SEQ ID NO: 1518041 - RNA, 14 nt, Pseudomonas aeruginosa PA01
gccgcgucccugca

SEQ ID NO: 1518042 - RNA, 21 nt, Pseudomonas aeruginosa PA01
gccgcgucccugcacagggac

SEQ ID NO: 1518043 - RNA, 17 nt, Pseudomonas aeruginosa PA01
gccgcgcuugccgucgc

SEQ ID NO: 1518044 - RNA, 13 nt, Pseudomonas aeruginosa PA01
gccgcgcuucagg

SEQ ID NO: 1518045 - RNA, 13 nt, Pseudomonas aeruginosa PA01
gccgcggccgggg

SEQ ID NO: 1518046 - RNA, 14 nt, Pseudomonas aeruginosa PA01
gccgcggcggcgug

SEQ ID NO: 1518047 - RNA, 16 nt, Pseudomonas aeruginosa PA01
gccgcgggucaccagc

SEQ ID NO: 1518048 - RNA, 19 nt, Pseudomonas aeruginosa PA01
gccgcgggucaccagcgcc

SEQ ID NO: 1518049 - RNA, 23 nt, Pseudomonas aeruginosa PA01
gccgcggggaggaagcuccccgc

SEQ ID NO: 1518050 - RNA, 21 nt, Pseudomonas aeruginosa PA01
gccgcgggcuauucccgccgc

SEQ ID NO: 1518051 - RNA, 23 nt, Pseudomonas aeruginosa PA01
gccgcgggcuauucccgccgcuc

SEQ ID NO: 1518052 - RNA, 16 nt, Pseudomonas aeruginosa PA01
gccgcgggucugcucg

SEQ ID NO: 1518053 - RNA, 17 nt, Pseudomonas aeruginosa PA01
gccgcgggucuugcgca

SEQ ID NO: 1518054 - RNA, 22 nt, Pseudomonas aeruginosa PA01
gccgcggguuccucacggcgca

SEQ ID NO: 1518055 - RNA, 15 nt, Pseudomonas aeruginosa PA01
gccgcggcuggccau

SEQ ID NO: 1518056 - RNA, 14 nt, Pseudomonas aeruginosa PA01
gccgcgggcaaccg

SEQ ID NO: 1518057 - RNA, 14 nt, Pseudomonas aeruginosa PA01
gccgcgggacgccg

SEQ ID NO: 1518058 - RNA, 17 nt, Pseudomonas aeruginosa PA01
gccgccgcagagccagc

SEQ ID NO: 1518059 - RNA, 20 nt, Pseudomonas aeruginosa PA01
gccgccgcagagccagccgc

SEQ ID NO: 1518060 - RNA, 20 nt, Pseudomonas aeruginosa PA01
gccgcccggcucgccgccgg

SEQ ID NO: 1518061 - RNA, 19 nt, Pseudomonas aeruginosa PA01
aaagcuccucggccuugcu

SEQ ID NO: 1518062 - RNA, 24 nt, Pseudomonas aeruginosa PA01
aaagcuccucggccuugcuggcga

SEQ ID NO: 1518063 - RNA, 21 nt, Pseudomonas aeruginosa PA01
aaagcucgcgcaagcgcccgg

SEQ ID NO: 1518064 - RNA, 23 nt, Pseudomonas aeruginosa PA01
aaagcucgcgcaagcgcccggcg

SEQ ID NO: 1518065 - RNA, 12 nt, Pseudomonas aeruginosa PA01
gccgcccggcca

SEQ ID NO: 1518066 - RNA, 14 nt, Pseudomonas aeruginosa PA01
gccgcccggccgcu

SEQ ID NO: 1518067 - RNA, 14 nt, Pseudomonas aeruginosa PA01
gccgccagcaacag

SEQ ID NO: 1518068 - RNA, 17 nt, Pseudomonas aeruginosa PA01
gccgcccgagccgcugc

SEQ ID NO: 1518069 - RNA, 22 nt, Pseudomonas aeruginosa PA01
gccgccccguuggcgcgggcga

SEQ ID NO: 1518070 - RNA, 15 nt, Pseudomonas aeruginosa PA01
gccgccagcaggccg

SEQ ID NO: 1518071 - RNA, 13 nt, Pseudomonas aeruginosa PA01
gccgccagcaggu

SEQ ID NO: 1518072 - RNA, 14 nt, Pseudomonas aeruginosa PA01
gccgccgccccagc

SEQ ID NO: 1518073 - RNA, 14 nt, Pseudomonas aeruginosa PA01
gccgccgcagccgu

SEQ ID NO: 1518074 - RNA, 16 nt, Pseudomonas aeruginosa PA01
gccgccgccgcgccgg

SEQ ID NO: 1518075 - RNA, 13 nt, Pseudomonas aeruginosa PA01
gccgccgccgcgg

SEQ ID NO: 1518076 - RNA, 13 nt, Pseudomonas aeruginosa PA01
gccgccgccgaga

SEQ ID NO: 1518077 - RNA, 13 nt, Pseudomonas aeruginosa PA01
gccgccgccgccc

SEQ ID NO: 1518078 - RNA, 14 nt, Pseudomonas aeruginosa PA01
gccgccgccgcccc

SEQ ID NO: 1518079 - RNA, 14 nt, Pseudomonas aeruginosa PA01
gccgccgcgccggc

SEQ ID NO: 1518080 - RNA, 13 nt, Pseudomonas aeruginosa PA01
gccgccgcgccuu

SEQ ID NO: 1518081 - RNA, 16 nt, Pseudomonas aeruginosa PA01
gccgccgcgcaggcgg

SEQ ID NO: 1518082 - RNA, 14 nt, Pseudomonas aeruginosa PA01
gccgccgcgcccgg

SEQ ID NO: 1518083 - RNA, 13 nt, Pseudomonas aeruginosa PA01
gccgccgcggcca

SEQ ID NO: 1518084 - RNA, 15 nt, Pseudomonas aeruginosa PA01
gccgccgcggccagc

SEQ ID NO: 1518085 - RNA, 16 nt, Pseudomonas aeruginosa PA01
gccgccgcggccagcc

SEQ ID NO: 1518086 - RNA, 17 nt, Pseudomonas aeruginosa PA01
gccgccgcggcaccggc

SEQ ID NO: 1518087 - RNA, 14 nt, Pseudomonas aeruginosa PA01
gccgccgcgugccg

SEQ ID NO: 1518088 - RNA, 14 nt, Pseudomonas aeruginosa PA01
gccgccgcggcgcg

SEQ ID NO: 1518089 - RNA, 13 nt, Pseudomonas aeruginosa PA01
gccgccggcgccc

SEQ ID NO: 1518090 - RNA, 20 nt, Pseudomonas aeruginosa PA01
gccgccggcgaacagccagc

SEQ ID NO: 1518091 - RNA, 16 nt, Pseudomonas aeruginosa PA01
gccgccggcggccagg

SEQ ID NO: 1518092 - RNA, 16 nt, Pseudomonas aeruginosa PA01
gccgccggcgccgccg

SEQ ID NO: 1518093 - RNA, 13 nt, Pseudomonas aeruginosa PA01
gccgcgcaccagc

SEQ ID NO: 1518094 - RNA, 12 nt, Pseudomonas aeruginosa PA01
gccgcgcccggc

SEQ ID NO: 1518095 - RNA, 21 nt, Pseudomonas aeruginosa PA01
gccgcgcagcaacggcgcauc

SEQ ID NO: 1518096 - RNA, 14 nt, Pseudomonas aeruginosa PA01
gccgcgcagcacca

SEQ ID NO: 1518097 - RNA, 19 nt, Pseudomonas aeruginosa PA01
gccgcgcacuuguagagga

SEQ ID NO: 1518098 - RNA, 16 nt, Pseudomonas aeruginosa PA01
gccgcgcagcgcggcg

SEQ ID NO: 1518099 - RNA, 16 nt, Pseudomonas aeruginosa PA01
gccgcgccgcaagggc

SEQ ID NO: 1518100 - RNA, 14 nt, Pseudomonas aeruginosa PA01
gccgcgccgaaggc

SEQ ID NO: 1518101 - RNA, 23 nt, Pseudomonas aeruginosa PA01
gccgcgccgcucaggcgucccgc

SEQ ID NO: 1518102 - RNA, 13 nt, Pseudomonas aeruginosa PA01
gccgcgccgccga

SEQ ID NO: 1518103 - RNA, 19 nt, Pseudomonas aeruginosa PA01
gccgcgcucggccaguucg

SEQ ID NO: 1518104 - RNA, 12 nt, Pseudomonas aeruginosa PA01
gccgcgcugcaa

SEQ ID NO: 1518105 - RNA, 14 nt, Pseudomonas aeruginosa PA01
gccgcgcugcaggc

SEQ ID NO: 1518106 - RNA, 18 nt, Pseudomonas aeruginosa PA01
gccgcgcugcgccaggcc

SEQ ID NO: 1518107 - RNA, 16 nt, Pseudomonas aeruginosa PA01
gccgccuucgcgggcc

SEQ ID NO: 1518108 - RNA, 21 nt, Pseudomonas aeruginosa PA01
gccgccuggugcccgaugccg

SEQ ID NO: 1518109 - RNA, 17 nt, Pseudomonas aeruginosa PA01
gccgccuuccucggccg

SEQ ID NO: 1518110 - RNA, 23 nt, Pseudomonas aeruginosa PA01
gccgccuuccucggccgccaggc

SEQ ID NO: 1518111 - RNA, 19 nt, Pseudomonas aeruginosa PA01
gccgccuggcgugccgcca

SEQ ID NO: 1518112 - RNA, 13 nt, Pseudomonas aeruginosa PA01
gccgccugggccg

SEQ ID NO: 1518113 - RNA, 23 nt, Pseudomonas aeruginosa PA01
gccgccuggccggccagccaggc

SEQ ID NO: 1518114 - RNA, 15 nt, Pseudomonas aeruginosa PA01
gccgcgaagcccagc

SEQ ID NO: 1518115 - RNA, 13 nt, Pseudomonas aeruginosa PA01
gccgcgacaggau

SEQ ID NO: 1518116 - RNA, 14 nt, Pseudomonas aeruginosa PA01
gccgccguugagga

SEQ ID NO: 1518117 - RNA, 14 nt, Pseudomonas aeruginosa PA01
gccgccgggcgccc

SEQ ID NO: 1518118 - RNA, 15 nt, Pseudomonas aeruginosa PA01
gccagacguccggca

SEQ ID NO: 1518119 - RNA, 18 nt, Pseudomonas aeruginosa PA01
gccagacgaucagcggcc

SEQ ID NO: 1518120 - RNA, 14 nt, Pseudomonas aeruginosa PA01
gccagaccggcagc

SEQ ID NO: 1518121 - RNA, 20 nt, Pseudomonas aeruginosa PA01
gccagaccggcagcgccgcc

SEQ ID NO: 1518122 - RNA, 17 nt, Pseudomonas aeruginosa PA01
gccagaauuccagcagg

SEQ ID NO: 1518123 - RNA, 19 nt, Pseudomonas aeruginosa PA01
gccagaauuccagcagguc

SEQ ID NO: 1518124 - RNA, 21 nt, Pseudomonas aeruginosa PA01
gccagacaggccagcucgccc

SEQ ID NO: 1518125 - RNA, 17 nt, Pseudomonas aeruginosa PA01
gccagaccagccccagu

SEQ ID NO: 1518126 - RNA, 11 nt, Pseudomonas aeruginosa PA01
gccagaagcga

SEQ ID NO: 1518127 - RNA, 13 nt, Pseudomonas aeruginosa PA01
gccagaagcggcc

SEQ ID NO: 1518128 - RNA, 14 nt, Pseudomonas aeruginosa PA01
gccagaaaacccag

SEQ ID NO: 1518129 - RNA, 15 nt, Pseudomonas aeruginosa PA01
gccagaaaacccagc

SEQ ID NO: 1518130 - RNA, 16 nt, Pseudomonas aeruginosa PA01
gccagaaaacccagcg

SEQ ID NO: 1518131 - RNA, 17 nt, Pseudomonas aeruginosa PA01
gccacgcucuccaaccg

SEQ ID NO: 1518132 - RNA, 15 nt, Pseudomonas aeruginosa PA01
gccacgcucuccguc

SEQ ID NO: 1518133 - RNA, 20 nt, Pseudomonas aeruginosa PA01
gccacgcucucgaacagcag

SEQ ID NO: 1518134 - RNA, 22 nt, Pseudomonas aeruginosa PA01
gccacgcugaucaucagcaggg

SEQ ID NO: 1518135 - RNA, 20 nt, Pseudomonas aeruginosa PA01
gccacgcuucugcgccuccu

SEQ ID NO: 1518136 - RNA, 23 nt, Pseudomonas aeruginosa PA01
gccacgcuugucguggcgggcuc

SEQ ID NO: 1518137 - RNA, 17 nt, Pseudomonas aeruginosa PA01
gccacggaaggccacgc

SEQ ID NO: 1518138 - RNA, 21 nt, Pseudomonas aeruginosa PA01
gccacggaaggccacgccgcc

SEQ ID NO: 1518139 - RNA, 17 nt, Pseudomonas aeruginosa PA01
gccacgcugcugccggc

SEQ ID NO: 1518140 - RNA, 18 nt, Pseudomonas aeruginosa PA01
gccacgcugcugccggcc

SEQ ID NO: 1518141 - RNA, 21 nt, Pseudomonas aeruginosa PA01
gccacggaugcagucccgcca

SEQ ID NO: 1518142 - RNA, 19 nt, Pseudomonas aeruginosa PA01
gccacggauaugcgccgcc

SEQ ID NO: 1518143 - RNA, 20 nt, Pseudomonas aeruginosa PA01
gccacggauaugcgccgcca

SEQ ID NO: 1518144 - RNA, 13 nt, Pseudomonas aeruginosa PA01
gccagcaccaccc

SEQ ID NO: 1518145 - RNA, 18 nt, Pseudomonas aeruginosa PA01
gccagcaccacccggccg

SEQ ID NO: 1518146 - RNA, 21 nt, Pseudomonas aeruginosa PA01
gccagcaccacccggccgcgc

SEQ ID NO: 1518147 - RNA, 19 nt, Pseudomonas aeruginosa PA01
gccagcaauacccgccgcu

SEQ ID NO: 1518148 - RNA, 17 nt, Pseudomonas aeruginosa PA01
gccagcaaugcccgcgc

SEQ ID NO: 1518149 - RNA, 16 nt, Pseudomonas aeruginosa PA01
gccagcaaacccgggc

SEQ ID NO: 1518150 - RNA, 16 nt, Pseudomonas aeruginosa PA01
gccagcaacggcuccu

SEQ ID NO: 1518151 - RNA, 16 nt, Pseudomonas aeruginosa PA01
gccagcaccuggcagu

SEQ ID NO: 1518152 - RNA, 14 nt, Pseudomonas aeruginosa PA01
gccagcacggcgca

SEQ ID NO: 1518153 - RNA, 16 nt, Pseudomonas aeruginosa PA01
gccagcacgguacacg

SEQ ID NO: 1518154 - RNA, 20 nt, Pseudomonas aeruginosa PA01
gccagcaccaugcgcggcag

SEQ ID NO: 1518155 - RNA, 15 nt, Pseudomonas aeruginosa PA01
gccagcaccagcagg

SEQ ID NO: 1518156 - RNA, 20 nt, Pseudomonas aeruginosa PA01
gccagcaccagcaggagcau

SEQ ID NO: 1518157 - RNA, 12 nt, Pseudomonas aeruginosa PA01
gccagaggcugc

SEQ ID NO: 1518158 - RNA, 16 nt, Pseudomonas aeruginosa PA01
gccagaggcugcgcuc

SEQ ID NO: 1518159 - RNA, 19 nt, Pseudomonas aeruginosa PA01
gccagaggcugcgcuccag

SEQ ID NO: 1518160 - RNA, 21 nt, Pseudomonas aeruginosa PA01
gccagagcgcgcuacucaggu

SEQ ID NO: 1518161 - RNA, 22 nt, Pseudomonas aeruginosa PA01
gccagagccagucgagagcggg

SEQ ID NO: 1518162 - RNA, 23 nt, Pseudomonas aeruginosa PA01
gccagagcccgucgaagccaggc

SEQ ID NO: 1518163 - RNA, 20 nt, Pseudomonas aeruginosa PA01
gccagagaucgcccagcggc

SEQ ID NO: 1518164 - RNA, 20 nt, Pseudomonas aeruginosa PA01
gccagaguugccuguccagc

SEQ ID NO: 1518165 - RNA, 12 nt, Pseudomonas aeruginosa PA01
gccaccagcgag

SEQ ID NO: 1518166 - RNA, 22 nt, Pseudomonas aeruginosa PA01
gccaccagcgagucgacccagg

SEQ ID NO: 1518167 - RNA, 16 nt, Pseudomonas aeruginosa PA01
gccaccagccaggcgg

SEQ ID NO: 1518168 - RNA, 21 nt, Pseudomonas aeruginosa PA01
gccaccagccaggcggccacc

SEQ ID NO: 1518169 - RNA, 23 nt, Pseudomonas aeruginosa PA01
gccaccagccagucgagacgcca

SEQ ID NO: 1518170 - RNA, 14 nt, Pseudomonas aeruginosa PA01
gccaccagcaugcc

SEQ ID NO: 1518171 - RNA, 15 nt, Pseudomonas aeruginosa PA01
gccaccagcaugccc

SEQ ID NO: 1518172 - RNA, 17 nt, Pseudomonas aeruginosa PA01
gccaccagcaugcccag

SEQ ID NO: 1518173 - RNA, 15 nt, Pseudomonas aeruginosa PA01
gccaccagcagggcc

SEQ ID NO: 1518174 - RNA, 19 nt, Pseudomonas aeruginosa PA01
gccaccagcagggccaggc

SEQ ID NO: 1518175 - RNA, 20 nt, Pseudomonas aeruginosa PA01
gccaccagcagggccaggcc

SEQ ID NO: 1518176 - RNA, 18 nt, Pseudomonas aeruginosa PA01
gccaccagcguggcgcgc

SEQ ID NO: 1518177 - RNA, 19 nt, Pseudomonas aeruginosa PA01
gccaccgcgacgcgcugga

SEQ ID NO: 1518178 - RNA, 21 nt, Pseudomonas aeruginosa PA01
gccaccgcgacgcgcuggacc

SEQ ID NO: 1518179 - RNA, 24 nt, Pseudomonas aeruginosa PA01
gccaccgcggauccacgccuggcc

SEQ ID NO: 1518180 - RNA, 20 nt, Pseudomonas aeruginosa PA01
gccacgcaguucgcgggccg

SEQ ID NO: 1518181 - RNA, 18 nt, Pseudomonas aeruginosa PA01
gccacgcaaacccauuuc

SEQ ID NO: 1518182 - RNA, 14 nt, Pseudomonas aeruginosa PA01
gccacgcaggaaca

SEQ ID NO: 1518183 - RNA, 23 nt, Pseudomonas aeruginosa PA01
gccacgccauucgaauggcgccg

SEQ ID NO: 1518184 - RNA, 13 nt, Pseudomonas aeruginosa PA01
gccacgcccgccg

SEQ ID NO: 1518185 - RNA, 19 nt, Pseudomonas aeruginosa PA01
gccacgccgacgccgaguu

SEQ ID NO: 1518186 - RNA, 15 nt, Pseudomonas aeruginosa PA01
gccacgccggcgcuc

SEQ ID NO: 1518187 - RNA, 20 nt, Pseudomonas aeruginosa PA01
gccacgccggcgcuccuccu

SEQ ID NO: 1518188 - RNA, 21 nt, Pseudomonas aeruginosa PA01
gccacgccggucucgauggca

SEQ ID NO: 1518189 - RNA, 22 nt, Pseudomonas aeruginosa PA01
gccacgccggucucgauggcag

SEQ ID NO: 1518190 - RNA, 18 nt, Pseudomonas aeruginosa PA01
gccacgcgaccagcgcca

SEQ ID NO: 1518191 - RNA, 21 nt, Pseudomonas aeruginosa PA01
gccacgcgaccagcgccaggc

SEQ ID NO: 1518192 - RNA, 19 nt, Pseudomonas aeruginosa PA01
gccacgcgagaagccgccc

SEQ ID NO: 1518193 - RNA, 13 nt, Pseudomonas aeruginosa PA01
gccacacauccag

SEQ ID NO: 1518194 - RNA, 16 nt, Pseudomonas aeruginosa PA01
gccacacauccagugu

SEQ ID NO: 1518195 - RNA, 18 nt, Pseudomonas aeruginosa PA01
gccacacauccagugugg

SEQ ID NO: 1518196 - RNA, 15 nt, Pseudomonas aeruginosa PA01
gccaccagagccagc

SEQ ID NO: 1518197 - RNA, 18 nt, Pseudomonas aeruginosa PA01
gccaccagagccagccgc

SEQ ID NO: 1518198 - RNA, 18 nt, Pseudomonas aeruginosa PA01
gccaccaccgugaccagc

SEQ ID NO: 1518199 - RNA, 19 nt, Pseudomonas aeruginosa PA01
gccacagguggaucgcggc

SEQ ID NO: 1518200 - RNA, 13 nt, Pseudomonas aeruginosa PA01
gccagccuggcca

SEQ ID NO: 1518201 - RNA, 17 nt, Pseudomonas aeruginosa PA01
gccagccugcagccagc

SEQ ID NO: 1518202 - RNA, 20 nt, Pseudomonas aeruginosa PA01
gccagccguggcaggcgccc

SEQ ID NO: 1518203 - RNA, 11 nt, Pseudomonas aeruginosa PA01
gccagcccugg

SEQ ID NO: 1518204 - RNA, 22 nt, Pseudomonas aeruginosa PA01
gccagccggcgaagggcaggcc

SEQ ID NO: 1518205 - RNA, 23 nt, Pseudomonas aeruginosa PA01
gccagccggcgaagggcaggccg

SEQ ID NO: 1518206 - RNA, 14 nt, Pseudomonas aeruginosa PA01
gccagcccggccuc

SEQ ID NO: 1518207 - RNA, 16 nt, Pseudomonas aeruginosa PA01
gccagccccaggcgcg

SEQ ID NO: 1518208 - RNA, 20 nt, Pseudomonas aeruginosa PA01
gccagcccggcggugaugcc

SEQ ID NO: 1518209 - RNA, 14 nt, Pseudomonas aeruginosa PA01
gccagccgcgcgcc

SEQ ID NO: 1518210 - RNA, 15 nt, Pseudomonas aeruginosa PA01
gccagccgcgcgccg

SEQ ID NO: 1518211 - RNA, 15 nt, Pseudomonas aeruginosa PA01
gccagccgcgcggca

SEQ ID NO: 1518212 - RNA, 15 nt, Pseudomonas aeruginosa PA01
gccagccgcgccagu

SEQ ID NO: 1518213 - RNA, 15 nt, Pseudomonas aeruginosa PA01
gccagccgcccuggc

SEQ ID NO: 1518214 - RNA, 22 nt, Pseudomonas aeruginosa PA01
gccagccgcccuggcucugggc

SEQ ID NO: 1518215 - RNA, 16 nt, Pseudomonas aeruginosa PA01
gccagcgccuggcgca

SEQ ID NO: 1518216 - RNA, 14 nt, Pseudomonas aeruginosa PA01
gccagcgccgccgc

SEQ ID NO: 1518217 - RNA, 16 nt, Pseudomonas aeruginosa PA01
gccagcgccgccgcgu

SEQ ID NO: 1518218 - RNA, 12 nt, Pseudomonas aeruginosa PA01
gccagcgccgcc

SEQ ID NO: 1518219 - RNA, 13 nt, Pseudomonas aeruginosa PA01
gccagcgccgcca

SEQ ID NO: 1518220 - RNA, 17 nt, Pseudomonas aeruginosa PA01
gccagcgaacccaggcc

SEQ ID NO: 1518221 - RNA, 21 nt, Pseudomonas aeruginosa PA01
gccagcgaacccaggccgcgc

SEQ ID NO: 1518222 - RNA, 15 nt, Pseudomonas aeruginosa PA01
gccagcgaacgcacu

SEQ ID NO: 1518223 - RNA, 20 nt, Pseudomonas aeruginosa PA01
gccagcgccaccagcagggc

SEQ ID NO: 1518224 - RNA, 15 nt, Pseudomonas aeruginosa PA01
gccagcgccccacca

SEQ ID NO: 1518225 - RNA, 21 nt, Pseudomonas aeruginosa PA01
gccagcgccccaccaggcucg

SEQ ID NO: 1518226 - RNA, 15 nt, Pseudomonas aeruginosa PA01
gccagcgccacggcg

SEQ ID NO: 1518227 - RNA, 22 nt, Pseudomonas aeruginosa PA01
gccagcgccacggcgaucgccg

SEQ ID NO: 1518228 - RNA, 21 nt, Pseudomonas aeruginosa PA01
gccagcaucgcaucggcgacc

SEQ ID NO: 1518229 - RNA, 17 nt, Pseudomonas aeruginosa PA01
gccagcaguugcaacag

SEQ ID NO: 1518230 - RNA, 20 nt, Pseudomonas aeruginosa PA01
gccagcaguugcaacagcgc

SEQ ID NO: 1518231 - RNA, 14 nt, Pseudomonas aeruginosa PA01
gccagcccagcggc

SEQ ID NO: 1518232 - RNA, 14 nt, Pseudomonas aeruginosa PA01
gccagccagggcag

SEQ ID NO: 1518233 - RNA, 12 nt, Pseudomonas aeruginosa PA01
gccagccaggac

SEQ ID NO: 1518234 - RNA, 15 nt, Pseudomonas aeruginosa PA01
gccagccagccgcgc

SEQ ID NO: 1518235 - RNA, 18 nt, Pseudomonas aeruginosa PA01
gccagccagcgcggcucg

SEQ ID NO: 1518236 - RNA, 21 nt, Pseudomonas aeruginosa PA01
gccagccagcgcggcucgggc

SEQ ID NO: 1518237 - RNA, 15 nt, Pseudomonas aeruginosa PA01
gccagccagagcagc

SEQ ID NO: 1518238 - RNA, 14 nt, Pseudomonas aeruginosa PA01
gccagccagcccgg

SEQ ID NO: 1518239 - RNA, 15 nt, Pseudomonas aeruginosa PA01
gccagccagcccggc

SEQ ID NO: 1518240 - RNA, 16 nt, Pseudomonas aeruginosa PA01
gccagccagcccggcg

SEQ ID NO: 1518241 - RNA, 14 nt, Pseudomonas aeruginosa PA01
gccagcagcccggc

SEQ ID NO: 1518242 - RNA, 11 nt, Pseudomonas aeruginosa PA01
gccagcagcac

SEQ ID NO: 1518243 - RNA, 19 nt, Pseudomonas aeruginosa PA01
gccagcaggucgcgcuggg

SEQ ID NO: 1518244 - RNA, 18 nt, Pseudomonas aeruginosa PA01
gccagcaggucggccugc

SEQ ID NO: 1518245 - RNA, 21 nt, Pseudomonas aeruginosa PA01
gccagcagguggucgaugggc

SEQ ID NO: 1518246 - RNA, 20 nt, Pseudomonas aeruginosa PA01
gccagcagcgccuccucuac

SEQ ID NO: 1518247 - RNA, 21 nt, Pseudomonas aeruginosa PA01
gccagcaggcucaugcccagc

SEQ ID NO: 1518248 - RNA, 18 nt, Pseudomonas aeruginosa PA01
gccagcaggcuggcggca

SEQ ID NO: 1518249 - RNA, 13 nt, Pseudomonas aeruginosa PA01
gccagcagggucu

SEQ ID NO: 1518250 - RNA, 22 nt, Pseudomonas aeruginosa PA01
gccagcaggguggccagggucc

SEQ ID NO: 1518251 - RNA, 19 nt, Pseudomonas aeruginosa PA01
gccagcagguacagcagcu

SEQ ID NO: 1518252 - RNA, 15 nt, Pseudomonas aeruginosa PA01
gccagcagguagccu

SEQ ID NO: 1518253 - RNA, 17 nt, Pseudomonas aeruginosa PA01
gccagcagguagccugc

SEQ ID NO: 1518254 - RNA, 22 nt, Pseudomonas aeruginosa PA01
gccagcagcuccgggcuggcca

SEQ ID NO: 1518255 - RNA, 16 nt, Pseudomonas aeruginosa PA01
gccagcaggccgagcc

SEQ ID NO: 1518256 - RNA, 21 nt, Pseudomonas aeruginosa PA01
gccagcaggccgagcccgagu

SEQ ID NO: 1518257 - RNA, 21 nt, Pseudomonas aeruginosa PA01
gccagcaggccgaucagcggc

SEQ ID NO: 1518258 - RNA, 11 nt, Pseudomonas aeruginosa PA01
gccagcaggcu

SEQ ID NO: 1518259 - RNA, 13 nt, Pseudomonas aeruginosa PA01
gccagcaggcgca

SEQ ID NO: 1518260 - RNA, 18 nt, Pseudomonas aeruginosa PA01
gccagcaggcgcagcagc

SEQ ID NO: 1518261 - RNA, 13 nt, Pseudomonas aeruginosa PA01
gccagcaggcgcc

SEQ ID NO: 1518262 - RNA, 19 nt, Pseudomonas aeruginosa PA01
gccagcaggcgcgggcugg

SEQ ID NO: 1518263 - RNA, 23 nt, Pseudomonas aeruginosa PA01
gccagcaggcgcgggcuggccac

SEQ ID NO: 1518264 - RNA, 18 nt, Pseudomonas aeruginosa PA01
gccagcucgucgcccuuc

SEQ ID NO: 1518265 - RNA, 22 nt, Pseudomonas aeruginosa PA01
gccagcucggccggcaggcugu

SEQ ID NO: 1518266 - RNA, 14 nt, Pseudomonas aeruginosa PA01
gccagcucggcgag

SEQ ID NO: 1518267 - RNA, 13 nt, Pseudomonas aeruginosa PA01
gccagcuucagcc

SEQ ID NO: 1518268 - RNA, 14 nt, Pseudomonas aeruginosa PA01
gccagcuucuccag

SEQ ID NO: 1518269 - RNA, 15 nt, Pseudomonas aeruginosa PA01
gccagcuucuccagc

SEQ ID NO: 1518270 - RNA, 12 nt, Pseudomonas aeruginosa PA01
gccaggaccagg

SEQ ID NO: 1518271 - RNA, 13 nt, Pseudomonas aeruginosa PA01
gccaggaccaggg

SEQ ID NO: 1518272 - RNA, 21 nt, Pseudomonas aeruginosa PA01
gccaggaccucgaagcuggcc

SEQ ID NO: 1518273 - RNA, 14 nt, Pseudomonas aeruginosa PA01
gccaggagcacgcc

SEQ ID NO: 1518274 - RNA, 18 nt, Pseudomonas aeruginosa PA01
gccaggagcacgccgugc

SEQ ID NO: 1518275 - RNA, 14 nt, Pseudomonas aeruginosa PA01
gccaggagcagggc

SEQ ID NO: 1518276 - RNA, 23 nt, Pseudomonas aeruginosa PA01
gccaggagcaucggcgcggccuu

SEQ ID NO: 1518277 - RNA, 13 nt, Pseudomonas aeruginosa PA01
gccaggaccagcc

SEQ ID NO: 1518278 - RNA, 16 nt, Pseudomonas aeruginosa PA01
gccaggaaggccgcuu

SEQ ID NO: 1518279 - RNA, 17 nt, Pseudomonas aeruginosa PA01
gccaggaagccgcgccc

SEQ ID NO: 1518280 - RNA, 22 nt, Pseudomonas aeruginosa PA01
gccaggaagccgcgccccagcg

SEQ ID NO: 1518281 - RNA, 13 nt, Pseudomonas aeruginosa PA01
gccaggaagagcc

SEQ ID NO: 1518282 - RNA, 20 nt, Pseudomonas aeruginosa PA01
gccaggaagagcccgccacg

SEQ ID NO: 1518283 - RNA, 19 nt, Pseudomonas aeruginosa PA01
gccagcuugucggccuugg

SEQ ID NO: 1518284 - RNA, 16 nt, Pseudomonas aeruginosa PA01
gccaggccgagcgcgc

SEQ ID NO: 1518285 - RNA, 18 nt, Pseudomonas aeruginosa PA01
gccaggccgagcgcgccg

SEQ ID NO: 1518286 - RNA, 19 nt, Pseudomonas aeruginosa PA01
gccaggccgagcgcgccgc

SEQ ID NO: 1518287 - RNA, 18 nt, Pseudomonas aeruginosa PA01
gccaggcccuuggucagg

SEQ ID NO: 1518288 - RNA, 20 nt, Pseudomonas aeruginosa PA01
gccaggcccuuggucaggcc

SEQ ID NO: 1518289 - RNA, 15 nt, Pseudomonas aeruginosa PA01
gccaggccgacccgc

SEQ ID NO: 1518290 - RNA, 19 nt, Pseudomonas aeruginosa PA01
gccaggccgacccgcaggc

SEQ ID NO: 1518291 - RNA, 13 nt, Pseudomonas aeruginosa PA01
gccaggccgagca

SEQ ID NO: 1518292 - RNA, 12 nt, Pseudomonas aeruginosa PA01
gccaggccgccg

SEQ ID NO: 1518293 - RNA, 14 nt, Pseudomonas aeruginosa PA01
gccaggccgcaagu

SEQ ID NO: 1518294 - RNA, 12 nt, Pseudomonas aeruginosa PA01
gccaggccucag

SEQ ID NO: 1518295 - RNA, 21 nt, Pseudomonas aeruginosa PA01
gccaggccucggcgcgggccu

SEQ ID NO: 1518296 - RNA, 21 nt, Pseudomonas aeruginosa PA01
gccaggccguagaccaccagc

SEQ ID NO: 1518297 - RNA, 16 nt, Pseudomonas aeruginosa PA01
gccaggcauuccucca

SEQ ID NO: 1518298 - RNA, 17 nt, Pseudomonas aeruginosa PA01
gccaggcauuccuccag

SEQ ID NO: 1518299 - RNA, 18 nt, Pseudomonas aeruginosa PA01
gccaggcauuccuccagg

SEQ ID NO: 1518300 - RNA, 14 nt, Pseudomonas aeruginosa PA01
gccaggcauccagc

SEQ ID NO: 1518301 - RNA, 16 nt, Pseudomonas aeruginosa PA01
gccaggcccggcgcug

SEQ ID NO: 1518302 - RNA, 18 nt, Pseudomonas aeruginosa PA01
gccaggccccaggccgcc

SEQ ID NO: 1518303 - RNA, 21 nt, Pseudomonas aeruginosa PA01
gccaggccccaggccgccgcc

SEQ ID NO: 1518304 - RNA, 20 nt, Pseudomonas aeruginosa PA01
gccaggccccagggccggcg

SEQ ID NO: 1518305 - RNA, 12 nt, Pseudomonas aeruginosa PA01
gccaggcagacc

SEQ ID NO: 1518306 - RNA, 17 nt, Pseudomonas aeruginosa PA01
gccaggcagaccaggcc

SEQ ID NO: 1518307 - RNA, 15 nt, Pseudomonas aeruginosa PA01
gccaggcagaccugc

SEQ ID NO: 1518308 - RNA, 12 nt, Pseudomonas aeruginosa PA01
gccaggcaggcc

SEQ ID NO: 1518309 - RNA, 22 nt, Pseudomonas aeruginosa PA01
gccaggcaggccgggcuggcca

SEQ ID NO: 1518310 - RNA, 21 nt, Pseudomonas aeruginosa PA01
gccaggacggcagggucagcc

SEQ ID NO: 1518311 - RNA, 20 nt, Pseudomonas aeruginosa PA01
gccaggacguuauccguccu

SEQ ID NO: 1518312 - RNA, 22 nt, Pseudomonas aeruginosa PA01
gccaggaggcccacgggcggcc

SEQ ID NO: 1518313 - RNA, 19 nt, Pseudomonas aeruginosa PA01
gccaggaugaccaggcuga

SEQ ID NO: 1518314 - RNA, 19 nt, Pseudomonas aeruginosa PA01
gccaggaucgucggcccgc

SEQ ID NO: 1518315 - RNA, 14 nt, Pseudomonas aeruginosa PA01
gccagcgucgccgc

SEQ ID NO: 1518316 - RNA, 16 nt, Pseudomonas aeruginosa PA01
gccagcgucgccgccg

SEQ ID NO: 1518317 - RNA, 22 nt, Pseudomonas aeruginosa PA01
gccagcgucgccgccgcgggcg

SEQ ID NO: 1518318 - RNA, 14 nt, Pseudomonas aeruginosa PA01
gccagcgggcgccg

SEQ ID NO: 1518319 - RNA, 20 nt, Pseudomonas aeruginosa PA01
gccagcgguacccgccggcc

SEQ ID NO: 1518320 - RNA, 11 nt, Pseudomonas aeruginosa PA01
gccagcgggcg

SEQ ID NO: 1518321 - RNA, 20 nt, Pseudomonas aeruginosa PA01
gccagcgguugagcagggcg

SEQ ID NO: 1518322 - RNA, 21 nt, Pseudomonas aeruginosa PA01
gccagcgguugagcagggcgu

SEQ ID NO: 1518323 - RNA, 22 nt, Pseudomonas aeruginosa PA01
gccagcgguugagcagggcguc

SEQ ID NO: 1518324 - RNA, 18 nt, Pseudomonas aeruginosa PA01
gccagcucgcuguccagc

SEQ ID NO: 1518325 - RNA, 15 nt, Pseudomonas aeruginosa PA01
gccagcucgccgcgc

SEQ ID NO: 1518326 - RNA, 20 nt, Pseudomonas aeruginosa PA01
gccagcucgccgcgcuccag

SEQ ID NO: 1518327 - RNA, 21 nt, Pseudomonas aeruginosa PA01
gccagcucgccgcgcuccagu

SEQ ID NO: 1518328 - RNA, 19 nt, Pseudomonas aeruginosa PA01
gccagcucgaccuugcccu

SEQ ID NO: 1518329 - RNA, 14 nt, Pseudomonas aeruginosa PA01
gccagcucgcccgc

SEQ ID NO: 1518330 - RNA, 21 nt, Pseudomonas aeruginosa PA01
gccagcguuucgaagccgccg

SEQ ID NO: 1518331 - RNA, 22 nt, Pseudomonas aeruginosa PA01
gccagcguuucgaagccgccgc

SEQ ID NO: 1518332 - RNA, 18 nt, Pseudomonas aeruginosa PA01
gccagcuaccggcagggu

SEQ ID NO: 1518333 - RNA, 15 nt, Pseudomonas aeruginosa PA01
gccagcggcagcggu

SEQ ID NO: 1518334 - RNA, 17 nt, Pseudomonas aeruginosa PA01
gccagcggcagcgguuc

SEQ ID NO: 1518335 - RNA, 19 nt, Pseudomonas aeruginosa PA01
gccagcggaugcuggcgga

SEQ ID NO: 1518336 - RNA, 16 nt, Pseudomonas aeruginosa PA01
gccagcggccagggcg

SEQ ID NO: 1518337 - RNA, 18 nt, Pseudomonas aeruginosa PA01
gccagcggcccggcaggc

SEQ ID NO: 1518338 - RNA, 21 nt, Pseudomonas aeruginosa PA01
gccagcggcguauccucggcc

SEQ ID NO: 1518339 - RNA, 22 nt, Pseudomonas aeruginosa PA01
gccagcggcguauccucggcca

SEQ ID NO: 1518340 - RNA, 15 nt, Pseudomonas aeruginosa PA01
gccagcgcggccgcc

SEQ ID NO: 1518341 - RNA, 16 nt, Pseudomonas aeruginosa PA01
gccagcgcggccgccg

SEQ ID NO: 1518342 - RNA, 12 nt, Pseudomonas aeruginosa PA01
gccagcgcggcg

SEQ ID NO: 1518343 - RNA, 20 nt, Pseudomonas aeruginosa PA01
gccagcgcucgaacgccgcc

SEQ ID NO: 1518344 - RNA, 21 nt, Pseudomonas aeruginosa PA01
gccagcgcucgaacgccgccc

SEQ ID NO: 1518345 - RNA, 23 nt, Pseudomonas aeruginosa PA01
gccagcgcguagcuuuccgcggc

SEQ ID NO: 1518346 - RNA, 14 nt, Pseudomonas aeruginosa PA01
gcauuggccaggcc

SEQ ID NO: 1518347 - RNA, 16 nt, Pseudomonas aeruginosa PA01
gcauuucagcggaagc

SEQ ID NO: 1518348 - RNA, 12 nt, Pseudomonas aeruginosa PA01
gcauuuccuggg

SEQ ID NO: 1518349 - RNA, 20 nt, Pseudomonas aeruginosa PA01
gcauuuccugggugccgcga

SEQ ID NO: 1518350 - RNA, 21 nt, Pseudomonas aeruginosa PA01
gcauucgcgcugguugcccag

SEQ ID NO: 1518351 - RNA, 19 nt, Pseudomonas aeruginosa PA01
gcauuccagaaacggcugc

SEQ ID NO: 1518352 - RNA, 14 nt, Pseudomonas aeruginosa PA01
gcauucguccagcc

SEQ ID NO: 1518353 - RNA, 16 nt, Pseudomonas aeruginosa PA01
gcauucguccagccgc

SEQ ID NO: 1518354 - RNA, 19 nt, Pseudomonas aeruginosa PA01
gcauucguccagccgccgc

SEQ ID NO: 1518355 - RNA, 14 nt, Pseudomonas aeruginosa PA01
gcaugcaagagguc

SEQ ID NO: 1518356 - RNA, 19 nt, Pseudomonas aeruginosa PA01
gcaugauuucguuggccca

SEQ ID NO: 1518357 - RNA, 21 nt, Pseudomonas aeruginosa PA01
gcaugauuucguuggcccaga

SEQ ID NO: 1518358 - RNA, 13 nt, Pseudomonas aeruginosa PA01
gcaugaugcaggc

SEQ ID NO: 1518359 - RNA, 16 nt, Pseudomonas aeruginosa PA01
gcaugaugcaggcagu

SEQ ID NO: 1518360 - RNA, 15 nt, Pseudomonas aeruginosa PA01
gcaugaugccgaggc

SEQ ID NO: 1518361 - RNA, 16 nt, Pseudomonas aeruginosa PA01
gcaugccaucuuccug

SEQ ID NO: 1518362 - RNA, 20 nt, Pseudomonas aeruginosa PA01
gcaugcccagcguggccagc

SEQ ID NO: 1518363 - RNA, 12 nt, Pseudomonas aeruginosa PA01
gcaugcccaggc

SEQ ID NO: 1518364 - RNA, 17 nt, Pseudomonas aeruginosa PA01
gcaugcccagggccagc

SEQ ID NO: 1518365 - RNA, 12 nt, Pseudomonas aeruginosa PA01
gcaugccagggc

SEQ ID NO: 1518366 - RNA, 21 nt, Pseudomonas aeruginosa PA01
gcaucugcucgaggauggcac

SEQ ID NO: 1518367 - RNA, 19 nt, Pseudomonas aeruginosa PA01
gcaucuucugcgcguugca

SEQ ID NO: 1518368 - RNA, 14 nt, Pseudomonas aeruginosa PA01
gcauguccgcaggc

SEQ ID NO: 1518369 - RNA, 22 nt, Pseudomonas aeruginosa PA01
gcauguccgcaggcaggucgcu

SEQ ID NO: 1518370 - RNA, 13 nt, Pseudomonas aeruginosa PA01
gcauguccucggc

SEQ ID NO: 1518371 - RNA, 15 nt, Pseudomonas aeruginosa PA01
gcaugguuaccucgu

SEQ ID NO: 1518372 - RNA, 18 nt, Pseudomonas aeruginosa PA01
gcaugguuaccucguugc

SEQ ID NO: 1518373 - RNA, 15 nt, Pseudomonas aeruginosa PA01
gcauggccuugccgg

SEQ ID NO: 1518374 - RNA, 15 nt, Pseudomonas aeruginosa PA01
gcauggccggcuacu

SEQ ID NO: 1518375 - RNA, 12 nt, Pseudomonas aeruginosa PA01
gcauggccacgc

SEQ ID NO: 1518376 - RNA, 20 nt, Pseudomonas aeruginosa PA01
gcauggccgaccgccaggcc

SEQ ID NO: 1518377 - RNA, 20 nt, Pseudomonas aeruginosa PA01
gcauggagacggcccgcccc

SEQ ID NO: 1518378 - RNA, 16 nt, Pseudomonas aeruginosa PA01
gcaugcuugccagaau

SEQ ID NO: 1518379 - RNA, 16 nt, Pseudomonas aeruginosa PA01
gcaugcuuuugaacac

SEQ ID NO: 1518380 - RNA, 19 nt, Pseudomonas aeruginosa PA01
gcauagcaggccuggagcg

SEQ ID NO: 1518381 - RNA, 22 nt, Pseudomonas aeruginosa PA01
gcauagccgaacuccgccagca

SEQ ID NO: 1518382 - RNA, 18 nt, Pseudomonas aeruginosa PA01
gcaucaggucggucuggc

SEQ ID NO: 1518383 - RNA, 23 nt, Pseudomonas aeruginosa PA01
gcaucaggucggucuggcggccc

SEQ ID NO: 1518384 - RNA, 15 nt, Pseudomonas aeruginosa PA01
gcaucaggccaaagc

SEQ ID NO: 1518385 - RNA, 13 nt, Pseudomonas aeruginosa PA01
gcaucgaccaggg

SEQ ID NO: 1518386 - RNA, 14 nt, Pseudomonas aeruginosa PA01
gcaucgugcagcca

SEQ ID NO: 1518387 - RNA, 13 nt, Pseudomonas aeruginosa PA01
gcaucuccccacc

SEQ ID NO: 1518388 - RNA, 23 nt, Pseudomonas aeruginosa PA01
gcaucuccccaccaacucagucg

SEQ ID NO: 1518389 - RNA, 16 nt, Pseudomonas aeruginosa PA01
gcaucucggccaggcc

SEQ ID NO: 1518390 - RNA, 18 nt, Pseudomonas aeruginosa PA01
gcaucucuuccucgcugc

SEQ ID NO: 1518391 - RNA, 22 nt, Pseudomonas aeruginosa PA01
gcaucgaggccggcaugcaggu

SEQ ID NO: 1518392 - RNA, 20 nt, Pseudomonas aeruginosa PA01
gcauccucgccccgccggga

SEQ ID NO: 1518393 - RNA, 24 nt, Pseudomonas aeruginosa PA01
gcauccguuuugaacgggcucacc

SEQ ID NO: 1518394 - RNA, 19 nt, Pseudomonas aeruginosa PA01
gcauccagguaaaggccac

SEQ ID NO: 1518395 - RNA, 19 nt, Pseudomonas aeruginosa PA01
gcauccacagggucggcag

SEQ ID NO: 1518396 - RNA, 21 nt, Pseudomonas aeruginosa PA01
gcauccacagggucggcagga

SEQ ID NO: 1518397 - RNA, 18 nt, Pseudomonas aeruginosa PA01
gcagcuccgggcuggcca

SEQ ID NO: 1518398 - RNA, 19 nt, Pseudomonas aeruginosa PA01
gcagcuccgggcuggccac

SEQ ID NO: 1518399 - RNA, 17 nt, Pseudomonas aeruginosa PA01
gcagcgggucgaucagg

SEQ ID NO: 1518400 - RNA, 24 nt, Pseudomonas aeruginosa PA01
gcagcgggucgaucaggcgcaugc

SEQ ID NO: 1518401 - RNA, 13 nt, Pseudomonas aeruginosa PA01
gcagcguccugcc

SEQ ID NO: 1518402 - RNA, 20 nt, Pseudomonas aeruginosa PA01
gcagcgucgacgccgagcug

SEQ ID NO: 1518403 - RNA, 17 nt, Pseudomonas aeruginosa PA01
gcagcuucuccagggaa

SEQ ID NO: 1518404 - RNA, 20 nt, Pseudomonas aeruginosa PA01
gcaggaaguugauggucagg

SEQ ID NO: 1518405 - RNA, 21 nt, Pseudomonas aeruginosa PA01
gcaggaacagguucggcaggc

SEQ ID NO: 1518406 - RNA, 22 nt, Pseudomonas aeruginosa PA01
gcaggaacgcccgcggcagcag

SEQ ID NO: 1518407 - RNA, 14 nt, Pseudomonas aeruginosa PA01
gcagcuugcgcgcc

SEQ ID NO: 1518408 - RNA, 20 nt, Pseudomonas aeruginosa PA01
gcagcuucugcagggcggcu

SEQ ID NO: 1518409 - RNA, 15 nt, Pseudomonas aeruginosa PA01
gcagcuugguaucca

SEQ ID NO: 1518410 - RNA, 12 nt, Pseudomonas aeruginosa PA01
gcaggccgagcc

SEQ ID NO: 1518411 - RNA, 16 nt, Pseudomonas aeruginosa PA01
gcaggccgagcccgag

SEQ ID NO: 1518412 - RNA, 17 nt, Pseudomonas aeruginosa PA01
gcaggccgaggccggcg

SEQ ID NO: 1518413 - RNA, 17 nt, Pseudomonas aeruginosa PA01
gcaggccgaucagcggc

SEQ ID NO: 1518414 - RNA, 20 nt, Pseudomonas aeruginosa PA01
gcaggccgaucucgugggcc

SEQ ID NO: 1518415 - RNA, 15 nt, Pseudomonas aeruginosa PA01
gcaggccgauggccc

SEQ ID NO: 1518416 - RNA, 19 nt, Pseudomonas aeruginosa PA01
gcaggaggaucgcggccuu

SEQ ID NO: 1518417 - RNA, 23 nt, Pseudomonas aeruginosa PA01
gcaggauaucgcccagggccagc

SEQ ID NO: 1518418 - RNA, 19 nt, Pseudomonas aeruginosa PA01
gcaggaucaccugcuucug

SEQ ID NO: 1518419 - RNA, 18 nt, Pseudomonas aeruginosa PA01
gcaggaucgacagcagcg

SEQ ID NO: 1518420 - RNA, 19 nt, Pseudomonas aeruginosa PA01
gcaggaccacgcuggucac

SEQ ID NO: 1518421 - RNA, 13 nt, Pseudomonas aeruginosa PA01
gcaggacccagaa

SEQ ID NO: 1518422 - RNA, 22 nt, Pseudomonas aeruginosa PA01
gcaggacgaggaaggcgcgcac

SEQ ID NO: 1518423 - RNA, 21 nt, Pseudomonas aeruginosa PA01
gcaggacgaugaucaccagga

SEQ ID NO: 1518424 - RNA, 12 nt, Pseudomonas aeruginosa PA01
gcaggagaagcg

SEQ ID NO: 1518425 - RNA, 19 nt, Pseudomonas aeruginosa PA01
gcaggcgaacugccgacgg

SEQ ID NO: 1518426 - RNA, 11 nt, Pseudomonas aeruginosa PA01
gcaggccuggg

SEQ ID NO: 1518427 - RNA, 18 nt, Pseudomonas aeruginosa PA01
gcaggccugggcaagcug

SEQ ID NO: 1518428 - RNA, 20 nt, Pseudomonas aeruginosa PA01
gcaggccuuccacgccuucg

SEQ ID NO: 1518429 - RNA, 16 nt, Pseudomonas aeruginosa PA01
gcaggccuucccacuc

SEQ ID NO: 1518430 - RNA, 19 nt, Pseudomonas aeruginosa PA01
gcaggccuucggcgccgga

SEQ ID NO: 1518431 - RNA, 23 nt, Pseudomonas aeruginosa PA01
gcaggccuucggcgccggagcug

SEQ ID NO: 1518432 - RNA, 15 nt, Pseudomonas aeruginosa PA01
gcaggccgcuggcga

SEQ ID NO: 1518433 - RNA, 14 nt, Pseudomonas aeruginosa PA01
gcaggccgccgcgu

SEQ ID NO: 1518434 - RNA, 23 nt, Pseudomonas aeruginosa PA01
gcaggccgacggcgcgcugcgug

SEQ ID NO: 1518435 - RNA, 15 nt, Pseudomonas aeruginosa PA01
gcaggccggccaggg

SEQ ID NO: 1518436 - RNA, 12 nt, Pseudomonas aeruginosa PA01
gcaggccgggaa

SEQ ID NO: 1518437 - RNA, 23 nt, Pseudomonas aeruginosa PA01
gcaggccgugggccggcgcgccg

SEQ ID NO: 1518438 - RNA, 21 nt, Pseudomonas aeruginosa PA01
gcaggcguugcagugcgccgc

SEQ ID NO: 1518439 - RNA, 17 nt, Pseudomonas aeruginosa PA01
gcaggcucaugcccagc

SEQ ID NO: 1518440 - RNA, 15 nt, Pseudomonas aeruginosa PA01
gcaggcucucgcgca

SEQ ID NO: 1518441 - RNA, 21 nt, Pseudomonas aeruginosa PA01
gcaggcucucgcgcagcagga

SEQ ID NO: 1518442 - RNA, 19 nt, Pseudomonas aeruginosa PA01
gcaggcugccguccaggcg

SEQ ID NO: 1518443 - RNA, 17 nt, Pseudomonas aeruginosa PA01
gcaggcugcgccgcugc

SEQ ID NO: 1518444 - RNA, 16 nt, Pseudomonas aeruginosa PA01
gcaggcgcgccaggcc

SEQ ID NO: 1518445 - RNA, 12 nt, Pseudomonas aeruginosa PA01
gcaggcgccggc

SEQ ID NO: 1518446 - RNA, 13 nt, Pseudomonas aeruginosa PA01
gcaggcgccggcg

SEQ ID NO: 1518447 - RNA, 17 nt, Pseudomonas aeruginosa PA01
gcaggcgcccggucagg

SEQ ID NO: 1518448 - RNA, 20 nt, Pseudomonas aeruginosa PA01
gcaggcgcccggucagguug

SEQ ID NO: 1518449 - RNA, 13 nt, Pseudomonas aeruginosa PA01
gcaggcgcccugg

SEQ ID NO: 1518450 - RNA, 14 nt, Pseudomonas aeruginosa PA01
gcaggcgcacgcgc

SEQ ID NO: 1518451 - RNA, 14 nt, Pseudomonas aeruginosa PA01
gcaggcgcagcagc

SEQ ID NO: 1518452 - RNA, 16 nt, Pseudomonas aeruginosa PA01
gcagggcagccgccgc

SEQ ID NO: 1518453 - RNA, 23 nt, Pseudomonas aeruginosa PA01
gcagggcagccgccgcggcaccg

SEQ ID NO: 1518454 - RNA, 13 nt, Pseudomonas aeruginosa PA01
gcagggcagcggc

SEQ ID NO: 1518455 - RNA, 15 nt, Pseudomonas aeruginosa PA01
gcagggcagcggccc

SEQ ID NO: 1518456 - RNA, 15 nt, Pseudomonas aeruginosa PA01
gcagggcaucgacga

SEQ ID NO: 1518457 - RNA, 24 nt, Pseudomonas aeruginosa PA01
gcaggcuggcguugacugccugca

SEQ ID NO: 1518458 - RNA, 14 nt, Pseudomonas aeruginosa PA01
gcagggcacagcca

SEQ ID NO: 1518459 - RNA, 22 nt, Pseudomonas aeruginosa PA01
gcagggcacagccauagugcug

SEQ ID NO: 1518460 - RNA, 15 nt, Pseudomonas aeruginosa PA01
gcagggccagcggaa

SEQ ID NO: 1518461 - RNA, 14 nt, Pseudomonas aeruginosa PA01
gcagggccagcgcc

SEQ ID NO: 1518462 - RNA, 14 nt, Pseudomonas aeruginosa PA01
gcagggccagcagc

SEQ ID NO: 1518463 - RNA, 18 nt, Pseudomonas aeruginosa PA01
gcagggccagcaacaggc

SEQ ID NO: 1518464 - RNA, 11 nt, Pseudomonas aeruginosa PA01
gcagggccagg

SEQ ID NO: 1518465 - RNA, 18 nt, Pseudomonas aeruginosa PA01
gcagggccaggccgagcg

SEQ ID NO: 1518466 - RNA, 22 nt, Pseudomonas aeruginosa PA01
gcagggccaggccgagcgcgcc

SEQ ID NO: 1518467 - RNA, 20 nt, Pseudomonas aeruginosa PA01
gcagugcggggcgcucgccc

SEQ ID NO: 1518468 - RNA, 15 nt, Pseudomonas aeruginosa PA01
gcaguggcuccgcgc

SEQ ID NO: 1518469 - RNA, 18 nt, Pseudomonas aeruginosa PA01
gcagugcucgaucaggcu

SEQ ID NO: 1518470 - RNA, 14 nt, Pseudomonas aeruginosa PA01
gcagugcgccggca

SEQ ID NO: 1518471 - RNA, 20 nt, Pseudomonas aeruginosa PA01
gcaguuccucgccgcugcug

SEQ ID NO: 1518472 - RNA, 21 nt, Pseudomonas aeruginosa PA01
gcaguucccccagcaccugga

SEQ ID NO: 1518473 - RNA, 15 nt, Pseudomonas aeruginosa PA01
gcaguucgccccgcc

SEQ ID NO: 1518474 - RNA, 16 nt, Pseudomonas aeruginosa PA01
gcaguucgccccgccg

SEQ ID NO: 1518475 - RNA, 19 nt, Pseudomonas aeruginosa PA01
gcaguucgaccuccaggcc

SEQ ID NO: 1518476 - RNA, 15 nt, Pseudomonas aeruginosa PA01
gcagugugccgcccu

SEQ ID NO: 1518477 - RNA, 20 nt, Pseudomonas aeruginosa PA01
gcaguugagucgcgcgcgcu

SEQ ID NO: 1518478 - RNA, 17 nt, Pseudomonas aeruginosa PA01
gcaguucgucgccacgc

SEQ ID NO: 1518479 - RNA, 18 nt, Pseudomonas aeruginosa PA01
gcagguuguccagggcau

SEQ ID NO: 1518480 - RNA, 20 nt, Pseudomonas aeruginosa PA01
gcaggguauuuuccagcagg

SEQ ID NO: 1518481 - RNA, 22 nt, Pseudomonas aeruginosa PA01
gcagggggaagugaagagcucc

SEQ ID NO: 1518482 - RNA, 22 nt, Pseudomonas aeruginosa PA01
gcagggggacgaaaaccgcaga

SEQ ID NO: 1518483 - RNA, 20 nt, Pseudomonas aeruginosa PA01
gcagggucacgccgaucacc

SEQ ID NO: 1518484 - RNA, 22 nt, Pseudomonas aeruginosa PA01
gcagggucacgccgaucacccc

SEQ ID NO: 1518485 - RNA, 15 nt, Pseudomonas aeruginosa PA01
gcagggucacgcugg

SEQ ID NO: 1518486 - RNA, 16 nt, Pseudomonas aeruginosa PA01
gcagggucagcagcgc

SEQ ID NO: 1518487 - RNA, 19 nt, Pseudomonas aeruginosa PA01
gcaggguaccgcuggcgcu

SEQ ID NO: 1518488 - RNA, 22 nt, Pseudomonas aeruginosa PA01
gcaggguaccgcuggcgcuggg

SEQ ID NO: 1518489 - RNA, 16 nt, Pseudomonas aeruginosa PA01
gcaggggcgcgccggc

SEQ ID NO: 1518490 - RNA, 18 nt, Pseudomonas aeruginosa PA01
gcaggggcgcgccggcuu

SEQ ID NO: 1518491 - RNA, 20 nt, Pseudomonas aeruginosa PA01
gcaggggcgcgccggcuugg

SEQ ID NO: 1518492 - RNA, 18 nt, Pseudomonas aeruginosa PA01
gcagggcgauccgcccgc

SEQ ID NO: 1518493 - RNA, 21 nt, Pseudomonas aeruginosa PA01
gcagggcgauccgcccgcaug

SEQ ID NO: 1518494 - RNA, 13 nt, Pseudomonas aeruginosa PA01
gcagggcgcccgc

SEQ ID NO: 1518495 - RNA, 22 nt, Pseudomonas aeruginosa PA01
gcagggcgccgucgggggcgcg

SEQ ID NO: 1518496 - RNA, 17 nt, Pseudomonas aeruginosa PA01
gcagggcgcguccagcu

SEQ ID NO: 1518497 - RNA, 14 nt, Pseudomonas aeruginosa PA01
gcagggcggcgccu

SEQ ID NO: 1518498 - RNA, 19 nt, Pseudomonas aeruginosa PA01
gcagggcgguacgccgcgc

SEQ ID NO: 1518499 - RNA, 22 nt, Pseudomonas aeruginosa PA01
gcagggcugcuguugccaggga

SEQ ID NO: 1518500 - RNA, 15 nt, Pseudomonas aeruginosa PA01
gcagucgccgccagu

SEQ ID NO: 1518501 - RNA, 18 nt, Pseudomonas aeruginosa PA01
gcagucgcggaagcggca

SEQ ID NO: 1518502 - RNA, 21 nt, Pseudomonas aeruginosa PA01
gcagucgcggaagcggcaaug

SEQ ID NO: 1518503 - RNA, 17 nt, Pseudomonas aeruginosa PA01
gcagucgcacagccagg

SEQ ID NO: 1518504 - RNA, 22 nt, Pseudomonas aeruginosa PA01
gcagucgaaaaccggcgggcuc

SEQ ID NO: 1518505 - RNA, 22 nt, Pseudomonas aeruginosa PA01
gcagucccagaaggccagggca

SEQ ID NO: 1518506 - RNA, 12 nt, Pseudomonas aeruginosa PA01
gcaguccaggcc

SEQ ID NO: 1518507 - RNA, 18 nt, Pseudomonas aeruginosa PA01
gcagucguaggucugccc

SEQ ID NO: 1518508 - RNA, 20 nt, Pseudomonas aeruginosa PA01
gcagucgcuuccgcgcggcg

SEQ ID NO: 1518509 - RNA, 18 nt, Pseudomonas aeruginosa PA01
gcgcugcgguaccagcgc

SEQ ID NO: 1518510 - RNA, 14 nt, Pseudomonas aeruginosa PA01
gcgcugcgccaggc

SEQ ID NO: 1518511 - RNA, 15 nt, Pseudomonas aeruginosa PA01
gcgcugcgcggccug

SEQ ID NO: 1518512 - RNA, 13 nt, Pseudomonas aeruginosa PA01
gcgcugcgcggcg

SEQ ID NO: 1518513 - RNA, 15 nt, Pseudomonas aeruginosa PA01
gcgcuggaugcccuc

SEQ ID NO: 1518514 - RNA, 19 nt, Pseudomonas aeruginosa PA01
gcgcuggauuucgccgagu

SEQ ID NO: 1518515 - RNA, 14 nt, Pseudomonas aeruginosa PA01
gcgcuggccagcgc

SEQ ID NO: 1518516 - RNA, 18 nt, Pseudomonas aeruginosa PA01
gcgcuggccagcgcuucc

SEQ ID NO: 1518517 - RNA, 19 nt, Pseudomonas aeruginosa PA01
gcgcuggccaguuccaugu

SEQ ID NO: 1518518 - RNA, 21 nt, Pseudomonas aeruginosa PA01
gcgcuggaguaucgcccuggc

SEQ ID NO: 1518519 - RNA, 21 nt, Pseudomonas aeruginosa PA01
gcgcugcguaguugagcccca

SEQ ID NO: 1518520 - RNA, 23 nt, Pseudomonas aeruginosa PA01
gcgcugcguaguugagccccagg

SEQ ID NO: 1518521 - RNA, 21 nt, Pseudomonas aeruginosa PA01
gcgcugccaaacgccgucugg

SEQ ID NO: 1518522 - RNA, 18 nt, Pseudomonas aeruginosa PA01
gcgcugccaguggcggcg

SEQ ID NO: 1518523 - RNA, 21 nt, Pseudomonas aeruginosa PA01
gcgcugccgaacagcagggag

SEQ ID NO: 1518524 - RNA, 17 nt, Pseudomonas aeruginosa PA01
gcgcugccggccagggu

SEQ ID NO: 1518525 - RNA, 19 nt, Pseudomonas aeruginosa PA01
gcgcugccugcaccgggcc

SEQ ID NO: 1518526 - RNA, 16 nt, Pseudomonas aeruginosa PA01
gcgcugcaucggcgcg

SEQ ID NO: 1518527 - RNA, 18 nt, Pseudomonas aeruginosa PA01
gcgcugcaucggcgcgcc

SEQ ID NO: 1518528 - RNA, 12 nt, Pseudomonas aeruginosa PA01
gcgcugcaggcg

SEQ ID NO: 1518529 - RNA, 18 nt, Pseudomonas aeruginosa PA01
gcgcucgaagcuccagcg

SEQ ID NO: 1518530 - RNA, 21 nt, Pseudomonas aeruginosa PA01
gcgcucgacggucagcggaca

SEQ ID NO: 1518531 - RNA, 13 nt, Pseudomonas aeruginosa PA01
gcgcucgagccgg

SEQ ID NO: 1518532 - RNA, 21 nt, Pseudomonas aeruginosa PA01
gcgcucgauagcguccaggug

SEQ ID NO: 1518533 - RNA, 23 nt, Pseudomonas aeruginosa PA01
gcgcucgcugucgcucagcgggc

SEQ ID NO: 1518534 - RNA, 16 nt, Pseudomonas aeruginosa PA01
gcgcucgccuaccggc

SEQ ID NO: 1518535 - RNA, 12 nt, Pseudomonas aeruginosa PA01
gcgcucgcgcag

SEQ ID NO: 1518536 - RNA, 19 nt, Pseudomonas aeruginosa PA01
gcgcucgcccuugcgccgc

SEQ ID NO: 1518537 - RNA, 14 nt, Pseudomonas aeruginosa PA01
gcgcucgcggaccu

SEQ ID NO: 1518538 - RNA, 18 nt, Pseudomonas aeruginosa PA01
gcgcucggccgccuggcg

SEQ ID NO: 1518539 - RNA, 13 nt, Pseudomonas aeruginosa PA01
gcgcucggccugg

SEQ ID NO: 1518540 - RNA, 14 nt, Pseudomonas aeruginosa PA01
gcgcucggccuggu

SEQ ID NO: 1518541 - RNA, 15 nt, Pseudomonas aeruginosa PA01
gcgcucggccuggug

SEQ ID NO: 1518542 - RNA, 16 nt, Pseudomonas aeruginosa PA01
gcgcucgggauggccc

SEQ ID NO: 1518543 - RNA, 21 nt, Pseudomonas aeruginosa PA01
gcgcucggcuccagccaggcc

SEQ ID NO: 1518544 - RNA, 15 nt, Pseudomonas aeruginosa PA01
gcgcucguagccggc

SEQ ID NO: 1518545 - RNA, 17 nt, Pseudomonas aeruginosa PA01
gcgcucguagccggcgc

SEQ ID NO: 1518546 - RNA, 22 nt, Pseudomonas aeruginosa PA01
gcgcucguagccggcgcggcgc

SEQ ID NO: 1518547 - RNA, 20 nt, Pseudomonas aeruginosa PA01
gcgcucucgaacaccaggcg

SEQ ID NO: 1518548 - RNA, 13 nt, Pseudomonas aeruginosa PA01
gcgcucucgccgc

SEQ ID NO: 1518549 - RNA, 21 nt, Pseudomonas aeruginosa PA01
gcgcucguugauccgcguggc

SEQ ID NO: 1518550 - RNA, 16 nt, Pseudomonas aeruginosa PA01
gcgcucguugcgccgc

SEQ ID NO: 1518551 - RNA, 16 nt, Pseudomonas aeruginosa PA01
gcgcucuggcccagcu

SEQ ID NO: 1518552 - RNA, 17 nt, Pseudomonas aeruginosa PA01
gcgcucuucgccgcggc

SEQ ID NO: 1518553 - RNA, 22 nt, Pseudomonas aeruginosa PA01
gcggaacgcggcuucggucagg

SEQ ID NO: 1518554 - RNA, 19 nt, Pseudomonas aeruginosa PA01
gcggaacuugcgccgaccg

SEQ ID NO: 1518555 - RNA, 19 nt, Pseudomonas aeruginosa PA01
gcggaagcguugcucgagc

SEQ ID NO: 1518556 - RNA, 17 nt, Pseudomonas aeruginosa PA01
gcggaaagcgacgccgc

SEQ ID NO: 1518557 - RNA, 18 nt, Pseudomonas aeruginosa PA01
gcggaaacggaccccaug

SEQ ID NO: 1518558 - RNA, 23 nt, Pseudomonas aeruginosa PA01
gcggaaacccgugguccgccagc

SEQ ID NO: 1518559 - RNA, 18 nt, Pseudomonas aeruginosa PA01
gcggaaacccuuccagcc

SEQ ID NO: 1518560 - RNA, 22 nt, Pseudomonas aeruginosa PA01
gcgcugucucgccagcccggca

SEQ ID NO: 1518561 - RNA, 23 nt, Pseudomonas aeruginosa PA01
gcgcugucucgccagcccggcag

SEQ ID NO: 1518562 - RNA, 17 nt, Pseudomonas aeruginosa PA01
gcgcugucgcccgggcg

SEQ ID NO: 1518563 - RNA, 21 nt, Pseudomonas aeruginosa PA01
gcgcuguuugcggcgcaggcg

SEQ ID NO: 1518564 - RNA, 20 nt, Pseudomonas aeruginosa PA01
gcgcuguuccgccgugggaa

SEQ ID NO: 1518565 - RNA, 17 nt, Pseudomonas aeruginosa PA01
gcgcuguugccgcgcuu

SEQ ID NO: 1518566 - RNA, 16 nt, Pseudomonas aeruginosa PA01
gcgcugggcggcuggc

SEQ ID NO: 1518567 - RNA, 14 nt, Pseudomonas aeruginosa PA01
gcgcuggccgagcu

SEQ ID NO: 1518568 - RNA, 21 nt, Pseudomonas aeruginosa PA01
gcgcugggccuugagcaggcg

SEQ ID NO: 1518569 - RNA, 17 nt, Pseudomonas aeruginosa PA01
gcgcugggcgcagcccu

SEQ ID NO: 1518570 - RNA, 18 nt, Pseudomonas aeruginosa PA01
gcgcugguaccugccggc

SEQ ID NO: 1518571 - RNA, 19 nt, Pseudomonas aeruginosa PA01
gcgcugguaccugccggca

SEQ ID NO: 1518572 - RNA, 22 nt, Pseudomonas aeruginosa PA01
gcgcugguagcgcuccagcucc

SEQ ID NO: 1518573 - RNA, 23 nt, Pseudomonas aeruginosa PA01
gcgcugguagcgcuccagcuccu

SEQ ID NO: 1518574 - RNA, 15 nt, Pseudomonas aeruginosa PA01
gcgcuguagccggcg

SEQ ID NO: 1518575 - RNA, 18 nt, Pseudomonas aeruginosa PA01
gcgcuguagccggcgccg

SEQ ID NO: 1518576 - RNA, 22 nt, Pseudomonas aeruginosa PA01
gcgcuggucguucagugccagc

SEQ ID NO: 1518577 - RNA, 14 nt, Pseudomonas aeruginosa PA01
gcgcuggucucuuc

SEQ ID NO: 1518578 - RNA, 22 nt, Pseudomonas aeruginosa PA01
gcgcuggucucuuccagcaugc

SEQ ID NO: 1518579 - RNA, 14 nt, Pseudomonas aeruginosa PA01
gcgcuggcgccagu

SEQ ID NO: 1518580 - RNA, 13 nt, Pseudomonas aeruginosa PA01
gcgcuggccggca

SEQ ID NO: 1518581 - RNA, 14 nt, Pseudomonas aeruginosa PA01
gcggauuugccgcc

SEQ ID NO: 1518582 - RNA, 22 nt, Pseudomonas aeruginosa PA01
gcggcaacaccacaaggugggc

SEQ ID NO: 1518583 - RNA, 21 nt, Pseudomonas aeruginosa PA01
gcggcaacgacggcaaguucg

SEQ ID NO: 1518584 - RNA, 21 nt, Pseudomonas aeruginosa PA01
gcggcaccccuugcagccagc

SEQ ID NO: 1518585 - RNA, 22 nt, Pseudomonas aeruginosa PA01
gcggcaggaucaggcucgagcc

SEQ ID NO: 1518586 - RNA, 18 nt, Pseudomonas aeruginosa PA01
gcggcaggaaauccgccg

SEQ ID NO: 1518587 - RNA, 22 nt, Pseudomonas aeruginosa PA01
gcggcaggaaauccgccgcgca

SEQ ID NO: 1518588 - RNA, 15 nt, Pseudomonas aeruginosa PA01
gcggcaggccgccga

SEQ ID NO: 1518589 - RNA, 21 nt, Pseudomonas aeruginosa PA01
gcggcagcgucucggcugccg

SEQ ID NO: 1518590 - RNA, 23 nt, Pseudomonas aeruginosa PA01
gcggcagcgucucggcugccgcc

SEQ ID NO: 1518591 - RNA, 21 nt, Pseudomonas aeruginosa PA01
gcggcacgcucuggccguucu

SEQ ID NO: 1518592 - RNA, 22 nt, Pseudomonas aeruginosa PA01
gcggcacgaccacaucggccag

SEQ ID NO: 1518593 - RNA, 14 nt, Pseudomonas aeruginosa PA01
gcggcacuccagga

SEQ ID NO: 1518594 - RNA, 20 nt, Pseudomonas aeruginosa PA01
gcggaccucugcguucugcu

SEQ ID NO: 1518595 - RNA, 21 nt, Pseudomonas aeruginosa PA01
gcggaccucugcguucugcug

SEQ ID NO: 1518596 - RNA, 19 nt, Pseudomonas aeruginosa PA01
gcggaccuugucgccggug

SEQ ID NO: 1518597 - RNA, 21 nt, Pseudomonas aeruginosa PA01
gcggacccaguugggccagga

SEQ ID NO: 1518598 - RNA, 21 nt, Pseudomonas aeruginosa PA01
gcggaccccggccuccaggcu

SEQ ID NO: 1518599 - RNA, 23 nt, Pseudomonas aeruginosa PA01
gcggaccuccagccggccaucca

SEQ ID NO: 1518600 - RNA, 13 nt, Pseudomonas aeruginosa PA01
gcggaccuccgcc

SEQ ID NO: 1518601 - RNA, 16 nt, Pseudomonas aeruginosa PA01
gcggaccuccgccagg

SEQ ID NO: 1518602 - RNA, 14 nt, Pseudomonas aeruginosa PA01
gcggaccgucgggc

SEQ ID NO: 1518603 - RNA, 12 nt, Pseudomonas aeruginosa PA01
gcggaccagcuc

SEQ ID NO: 1518604 - RNA, 14 nt, Pseudomonas aeruginosa PA01
gcggaccagcuccg

SEQ ID NO: 1518605 - RNA, 18 nt, Pseudomonas aeruginosa PA01
gcggaaguaggcggcgga

SEQ ID NO: 1518606 - RNA, 23 nt, Pseudomonas aeruginosa PA01
gcggaagugcggggugaucuuuu

SEQ ID NO: 1518607 - RNA, 14 nt, Pseudomonas aeruginosa PA01
gcggaaggcuuccu

SEQ ID NO: 1518608 - RNA, 20 nt, Pseudomonas aeruginosa PA01
gcggaaggcuuccuggugga

SEQ ID NO: 1518609 - RNA, 13 nt, Pseudomonas aeruginosa PA01
gcggaaggucagg

SEQ ID NO: 1518610 - RNA, 21 nt, Pseudomonas aeruginosa PA01
gcggacgggccgcgccgcaag

SEQ ID NO: 1518611 - RNA, 17 nt, Pseudomonas aeruginosa PA01
gcggauccggguggaga

SEQ ID NO: 1518612 - RNA, 13 nt, Pseudomonas aeruginosa PA01
gcggaucgaggaa

SEQ ID NO: 1518613 - RNA, 17 nt, Pseudomonas aeruginosa PA01
gcggaucgaucagcagc

SEQ ID NO: 1518614 - RNA, 18 nt, Pseudomonas aeruginosa PA01
gcggaucgaucagcagca

SEQ ID NO: 1518615 - RNA, 14 nt, Pseudomonas aeruginosa PA01
gcggaucgccgccu

SEQ ID NO: 1518616 - RNA, 14 nt, Pseudomonas aeruginosa PA01
gcggaucgccuccg

SEQ ID NO: 1518617 - RNA, 22 nt, Pseudomonas aeruginosa PA01
gcggaucucaggaccuuccgcc

SEQ ID NO: 1518618 - RNA, 23 nt, Pseudomonas aeruginosa PA01
gcggaucuggaauucgccgcgcg

SEQ ID NO: 1518619 - RNA, 13 nt, Pseudomonas aeruginosa PA01
gcggaucugcucc

SEQ ID NO: 1518620 - RNA, 18 nt, Pseudomonas aeruginosa PA01
gcggcaucccuuuuucau

SEQ ID NO: 1518621 - RNA, 20 nt, Pseudomonas aeruginosa PA01
gcggcauccgccgcugggga

SEQ ID NO: 1518622 - RNA, 12 nt, Pseudomonas aeruginosa PA01
gcggcaggccag

SEQ ID NO: 1518623 - RNA, 12 nt, Pseudomonas aeruginosa PA01
gcggcaggcgca

SEQ ID NO: 1518624 - RNA, 15 nt, Pseudomonas aeruginosa PA01
gcggcaggcggcggc

SEQ ID NO: 1518625 - RNA, 16 nt, Pseudomonas aeruginosa PA01
gcggcaggcggcggcg

SEQ ID NO: 1518626 - RNA, 13 nt, Pseudomonas aeruginosa PA01
gcggcaggcugcg

SEQ ID NO: 1518627 - RNA, 18 nt, Pseudomonas aeruginosa PA01
gcggcaggcugcgccgcu

SEQ ID NO: 1518628 - RNA, 14 nt, Pseudomonas aeruginosa PA01
gcggcaugccguug

SEQ ID NO: 1518629 - RNA, 21 nt, Pseudomonas aeruginosa PA01
gcggcaugccguugggccagg

SEQ ID NO: 1518630 - RNA, 23 nt, Pseudomonas aeruginosa PA01
gcggcaugccguugggccagggc

SEQ ID NO: 1518631 - RNA, 14 nt, Pseudomonas aeruginosa PA01
gcggcaucgcguag

SEQ ID NO: 1518632 - RNA, 23 nt, Pseudomonas aeruginosa PA01
gcggcaucgcguagggcgacggc

SEQ ID NO: 1518633 - RNA, 21 nt, Pseudomonas aeruginosa PA01
gcggccaaccucuccccagac

SEQ ID NO: 1518634 - RNA, 17 nt, Pseudomonas aeruginosa PA01
gcggcauugagggcgag

SEQ ID NO: 1518635 - RNA, 15 nt, Pseudomonas aeruginosa PA01
gcggcauucgcgcug

SEQ ID NO: 1518636 - RNA, 18 nt, Pseudomonas aeruginosa PA01
gcggcauucgcgcugguu

SEQ ID NO: 1518637 - RNA, 17 nt, Pseudomonas aeruginosa PA01
gcggccagcagcacgcc

SEQ ID NO: 1518638 - RNA, 19 nt, Pseudomonas aeruginosa PA01
gcggccagcagcacggcga

SEQ ID NO: 1518639 - RNA, 18 nt, Pseudomonas aeruginosa PA01
gcggccauugccgcgggc

SEQ ID NO: 1518640 - RNA, 14 nt, Pseudomonas aeruginosa PA01
gcggcccgccggcg

SEQ ID NO: 1518641 - RNA, 16 nt, Pseudomonas aeruginosa PA01
gcggcccggaaugcaa

SEQ ID NO: 1518642 - RNA, 13 nt, Pseudomonas aeruginosa PA01
gcggcccggcagg

SEQ ID NO: 1518643 - RNA, 17 nt, Pseudomonas aeruginosa PA01
gcggcccggcaggcgca

SEQ ID NO: 1518644 - RNA, 14 nt, Pseudomonas aeruginosa PA01
gcggcccugcucgc

SEQ ID NO: 1518645 - RNA, 12 nt, Pseudomonas aeruginosa PA01
gcggcccgccgg

SEQ ID NO: 1518646 - RNA, 12 nt, Pseudomonas aeruginosa PA01
gcggcccgcaca

SEQ ID NO: 1518647 - RNA, 19 nt, Pseudomonas aeruginosa PA01
gcggcccgcacagguagag

SEQ ID NO: 1518648 - RNA, 17 nt, Pseudomonas aeruginosa PA01
gcggccccgagcgggcc

SEQ ID NO: 1518649 - RNA, 14 nt, Pseudomonas aeruginosa PA01
gcgggaaggucggc

SEQ ID NO: 1518650 - RNA, 15 nt, Pseudomonas aeruginosa PA01
gcgggaaggucggca

SEQ ID NO: 1518651 - RNA, 20 nt, Pseudomonas aeruginosa PA01
gcgggaaggucggcagcagc

SEQ ID NO: 1518652 - RNA, 23 nt, Pseudomonas aeruginosa PA01
gcgggaaggucggcagcagcuug

SEQ ID NO: 1518653 - RNA, 14 nt, Pseudomonas aeruginosa PA01
gcgggaggccgccu

SEQ ID NO: 1518654 - RNA, 22 nt, Pseudomonas aeruginosa PA01
gcgggacuuguacucgccggug

SEQ ID NO: 1518655 - RNA, 24 nt, Pseudomonas aeruginosa PA01
gcgggacuuguacucgccggugcg

SEQ ID NO: 1518656 - RNA, 15 nt, Pseudomonas aeruginosa PA01
gcgggacgccgcagg

SEQ ID NO: 1518657 - RNA, 22 nt, Pseudomonas aeruginosa PA01
gcgggacgcguucccccguggc

SEQ ID NO: 1518658 - RNA, 12 nt, Pseudomonas aeruginosa PA01
gcgggccuugcg

SEQ ID NO: 1518659 - RNA, 21 nt, Pseudomonas aeruginosa PA01
gcgggcgagggcggcgcgggc

SEQ ID NO: 1518660 - RNA, 23 nt, Pseudomonas aeruginosa PA01
gcgggccagcagcuccgggcugg

SEQ ID NO: 1518661 - RNA, 13 nt, Pseudomonas aeruginosa PA01
gcgggccagcagg

SEQ ID NO: 1518662 - RNA, 14 nt, Pseudomonas aeruginosa PA01
gcgggccagcaggc

SEQ ID NO: 1518663 - RNA, 14 nt, Pseudomonas aeruginosa PA01
gcgggccagcuggc

SEQ ID NO: 1518664 - RNA, 14 nt, Pseudomonas aeruginosa PA01
gcgggagcacuggg

SEQ ID NO: 1518665 - RNA, 14 nt, Pseudomonas aeruginosa PA01
gcgggcccauggcg

SEQ ID NO: 1518666 - RNA, 15 nt, Pseudomonas aeruginosa PA01
gcgggccauugcagg

SEQ ID NO: 1518667 - RNA, 19 nt, Pseudomonas aeruginosa PA01
gcggcugcccgggguuggc

SEQ ID NO: 1518668 - RNA, 17 nt, Pseudomonas aeruginosa PA01
gcggcugcgcgccgggu

SEQ ID NO: 1518669 - RNA, 20 nt, Pseudomonas aeruginosa PA01
gcggcugcagggccagggag

SEQ ID NO: 1518670 - RNA, 19 nt, Pseudomonas aeruginosa PA01
gcggcucgucaucguccag

SEQ ID NO: 1518671 - RNA, 14 nt, Pseudomonas aeruginosa PA01
gcggcucggcgggc

SEQ ID NO: 1518672 - RNA, 15 nt, Pseudomonas aeruginosa PA01
gcggcucggcgggcu

SEQ ID NO: 1518673 - RNA, 16 nt, Pseudomonas aeruginosa PA01
gcggcucggcuccagg

SEQ ID NO: 1518674 - RNA, 15 nt, Pseudomonas aeruginosa PA01
gcggcucggcugcuu

SEQ ID NO: 1518675 - RNA, 18 nt, Pseudomonas aeruginosa PA01
gcggcucgggcggcaagg

SEQ ID NO: 1518676 - RNA, 14 nt, Pseudomonas aeruginosa PA01
gcggcucggccagg

SEQ ID NO: 1518677 - RNA, 23 nt, Pseudomonas aeruginosa PA01
gcggcucaccgagaaccaguacu

SEQ ID NO: 1518678 - RNA, 14 nt, Pseudomonas aeruginosa PA01
gcggcuucgcgcuc

SEQ ID NO: 1518679 - RNA, 13 nt, Pseudomonas aeruginosa PA01
gcggcuggcgggc

SEQ ID NO: 1518680 - RNA, 21 nt, Pseudomonas aeruginosa PA01
gcggcuggccauccgcccugc

SEQ ID NO: 1518681 - RNA, 15 nt, Pseudomonas aeruginosa PA01
gcggcugcugcgccu

SEQ ID NO: 1518682 - RNA, 17 nt, Pseudomonas aeruginosa PA01
gcggcugcugcgccugg

SEQ ID NO: 1518683 - RNA, 17 nt, Pseudomonas aeruginosa PA01
gcggcuggcgaaccagu

SEQ ID NO: 1518684 - RNA, 21 nt, Pseudomonas aeruginosa PA01
gcggcuggcgaaccaguccag

SEQ ID NO: 1518685 - RNA, 15 nt, Pseudomonas aeruginosa PA01
gcggcuggccgccug

SEQ ID NO: 1518686 - RNA, 15 nt, Pseudomonas aeruginosa PA01
gcgggaacgccgggc

SEQ ID NO: 1518687 - RNA, 19 nt, Pseudomonas aeruginosa PA01
gcgggaacgccgggcaacg

SEQ ID NO: 1518688 - RNA, 22 nt, Pseudomonas aeruginosa PA01
gcggcuuuuuucguugcgccug

SEQ ID NO: 1518689 - RNA, 16 nt, Pseudomonas aeruginosa PA01
gcggcuuucuuccagc

SEQ ID NO: 1518690 - RNA, 20 nt, Pseudomonas aeruginosa PA01
gcggggaaagcuccucggcc

SEQ ID NO: 1518691 - RNA, 18 nt, Pseudomonas aeruginosa PA01
gcgggcugaagugggucg

SEQ ID NO: 1518692 - RNA, 15 nt, Pseudomonas aeruginosa PA01
gcgggcuggccaccg

SEQ ID NO: 1518693 - RNA, 18 nt, Pseudomonas aeruginosa PA01
gcgggcuggaaaacgcca

SEQ ID NO: 1518694 - RNA, 15 nt, Pseudomonas aeruginosa PA01
gcgggcugccgcgga

SEQ ID NO: 1518695 - RNA, 15 nt, Pseudomonas aeruginosa PA01
gcggggauggcgggc

SEQ ID NO: 1518696 - RNA, 20 nt, Pseudomonas aeruginosa PA01
gcggguagagucgcucgcgc

SEQ ID NO: 1518697 - RNA, 22 nt, Pseudomonas aeruginosa PA01
gcgggcgcgaggcgcccgccgg

SEQ ID NO: 1518698 - RNA, 24 nt, Pseudomonas aeruginosa PA01
gcgggcggucgcggaccuccagcc

SEQ ID NO: 1518699 - RNA, 12 nt, Pseudomonas aeruginosa PA01
gcgggcgcccgc

SEQ ID NO: 1518700 - RNA, 11 nt, Pseudomonas aeruginosa PA01
gcgggcgcagg

SEQ ID NO: 1518701 - RNA, 20 nt, Pseudomonas aeruginosa PA01
gcgggcuauucccgccgcuc

SEQ ID NO: 1518702 - RNA, 21 nt, Pseudomonas aeruginosa PA01
gcgggcucgcaaucagcgcga

SEQ ID NO: 1518703 - RNA, 17 nt, Pseudomonas aeruginosa PA01
gcgggcguugcgcgccu

SEQ ID NO: 1518704 - RNA, 22 nt, Pseudomonas aeruginosa PA01
gcgggcguagcgcggcagcgcc

SEQ ID NO: 1518705 - RNA, 14 nt, Pseudomonas aeruginosa PA01
gcgggucugcucgg

SEQ ID NO: 1518706 - RNA, 15 nt, Pseudomonas aeruginosa PA01
gcgggucugcucggc

SEQ ID NO: 1518707 - RNA, 20 nt, Pseudomonas aeruginosa PA01
gcgggucuugccggucugcu

SEQ ID NO: 1518708 - RNA, 16 nt, Pseudomonas aeruginosa PA01
gcgggucuugcgcagg

SEQ ID NO: 1518709 - RNA, 17 nt, Pseudomonas aeruginosa PA01
gcgggucuugcgcaggg

SEQ ID NO: 1518710 - RNA, 19 nt, Pseudomonas aeruginosa PA01
gcgggucuugcgcagggcg

SEQ ID NO: 1518711 - RNA, 22 nt, Pseudomonas aeruginosa PA01
gcgggucuugcgcagggcggcg

SEQ ID NO: 1518712 - RNA, 18 nt, Pseudomonas aeruginosa PA01
gcgggucguacaccgcgc

SEQ ID NO: 1518713 - RNA, 17 nt, Pseudomonas aeruginosa PA01
gcgggucguccuccacc

SEQ ID NO: 1518714 - RNA, 22 nt, Pseudomonas aeruginosa PA01
gcgggucucgaucagcgccggg

SEQ ID NO: 1518715 - RNA, 13 nt, Pseudomonas aeruginosa PA01
gcgggucggcgga

SEQ ID NO: 1518716 - RNA, 17 nt, Pseudomonas aeruginosa PA01
gcggguaguagaucagc

SEQ ID NO: 1518717 - RNA, 23 nt, Pseudomonas aeruginosa PA01
gcggguaguguuugcgcagggcg

SEQ ID NO: 1518718 - RNA, 17 nt, Pseudomonas aeruginosa PA01
gcggguauccgccgggc

SEQ ID NO: 1518719 - RNA, 18 nt, Pseudomonas aeruginosa PA01
gcggguauccgccgggcc

SEQ ID NO: 1518720 - RNA, 15 nt, Pseudomonas aeruginosa PA01
gcgggucagcagugc

SEQ ID NO: 1518721 - RNA, 21 nt, Pseudomonas aeruginosa PA01
gcgggucagcagugcggggcg

SEQ ID NO: 1518722 - RNA, 16 nt, Pseudomonas aeruginosa PA01
gcgggucaccagcgcc

SEQ ID NO: 1518723 - RNA, 21 nt, Pseudomonas aeruginosa PA01
gcgggucacgccgagggcgcg

SEQ ID NO: 1518724 - RNA, 20 nt, Pseudomonas aeruginosa PA01
gcggguggcaaccgacgaga

SEQ ID NO: 1518725 - RNA, 15 nt, Pseudomonas aeruginosa PA01
gcggguggcaacugc

SEQ ID NO: 1518726 - RNA, 22 nt, Pseudomonas aeruginosa PA01
gcgggugcguggugcauccgcc

SEQ ID NO: 1518727 - RNA, 13 nt, Pseudomonas aeruginosa PA01
gcgggugcgcagg

SEQ ID NO: 1518728 - RNA, 17 nt, Pseudomonas aeruginosa PA01
gcgggugaagcgguggg

SEQ ID NO: 1518729 - RNA, 20 nt, Pseudomonas aeruginosa PA01
gcggguuuccgugcgcugcg

SEQ ID NO: 1518730 - RNA, 21 nt, Pseudomonas aeruginosa PA01
gcggguuuccgugcgcugcgc

SEQ ID NO: 1518731 - RNA, 15 nt, Pseudomonas aeruginosa PA01
gcggcgcgggcgcgc

SEQ ID NO: 1518732 - RNA, 21 nt, Pseudomonas aeruginosa PA01
gcggcgcgggcgcgcgccacc

SEQ ID NO: 1518733 - RNA, 16 nt, Pseudomonas aeruginosa PA01
gcggcgcggagauccc

SEQ ID NO: 1518734 - RNA, 16 nt, Pseudomonas aeruginosa PA01
gcggcgcgggucugcu

SEQ ID NO: 1518735 - RNA, 19 nt, Pseudomonas aeruginosa PA01
gcggcgcgggucugcucgc

SEQ ID NO: 1518736 - RNA, 22 nt, Pseudomonas aeruginosa PA01
gcggcgcuguuugcggcgcagg

SEQ ID NO: 1518737 - RNA, 15 nt, Pseudomonas aeruginosa PA01
gcggcgcuccaggcg

SEQ ID NO: 1518738 - RNA, 16 nt, Pseudomonas aeruginosa PA01
gcggcgcguuccgggu

SEQ ID NO: 1518739 - RNA, 17 nt, Pseudomonas aeruginosa PA01
gcggcggauaaccgcga

SEQ ID NO: 1518740 - RNA, 18 nt, Pseudomonas aeruginosa PA01
gcggcggauaacgccugu

SEQ ID NO: 1518741 - RNA, 16 nt, Pseudomonas aeruginosa PA01
gcggcgcuugcgggcg

SEQ ID NO: 1518742 - RNA, 16 nt, Pseudomonas aeruginosa PA01
gcggcggacgcaggcc

SEQ ID NO: 1518743 - RNA, 16 nt, Pseudomonas aeruginosa PA01
gcggcggaccuccgcc

SEQ ID NO: 1518744 - RNA, 20 nt, Pseudomonas aeruginosa PA01
gcggcggaccuccgccaggu

SEQ ID NO: 1518745 - RNA, 20 nt, Pseudomonas aeruginosa PA01
gcggcggcaggccagcuucc

SEQ ID NO: 1518746 - RNA, 15 nt, Pseudomonas aeruginosa PA01
gcggcggccagcagc

SEQ ID NO: 1518747 - RNA, 16 nt, Pseudomonas aeruginosa PA01
gcggcggccgccucgg

SEQ ID NO: 1518748 - RNA, 17 nt, Pseudomonas aeruginosa PA01
gcggcgccccaggcgcc

SEQ ID NO: 1518749 - RNA, 22 nt, Pseudomonas aeruginosa PA01
gcggcgcccgccaagggcgccg

SEQ ID NO: 1518750 - RNA, 18 nt, Pseudomonas aeruginosa PA01
gcggcgcgcagcgaacgg

SEQ ID NO: 1518751 - RNA, 21 nt, Pseudomonas aeruginosa PA01
gcggcgccaacucggccugga

SEQ ID NO: 1518752 - RNA, 13 nt, Pseudomonas aeruginosa PA01
gcggcgccaccgc

SEQ ID NO: 1518753 - RNA, 13 nt, Pseudomonas aeruginosa PA01
gcggcgccagcgc

SEQ ID NO: 1518754 - RNA, 23 nt, Pseudomonas aeruginosa PA01
gcggcgcauaacgccccucuucc

SEQ ID NO: 1518755 - RNA, 19 nt, Pseudomonas aeruginosa PA01
gcggcgcaggcgaugauca

SEQ ID NO: 1518756 - RNA, 11 nt, Pseudomonas aeruginosa PA01
gcggccgccgg

SEQ ID NO: 1518757 - RNA, 12 nt, Pseudomonas aeruginosa PA01
gcggccgccauc

SEQ ID NO: 1518758 - RNA, 18 nt, Pseudomonas aeruginosa PA01
gcggccgcaugccggggu

SEQ ID NO: 1518759 - RNA, 18 nt, Pseudomonas aeruginosa PA01
gcggccgaucaucggcug

SEQ ID NO: 1518760 - RNA, 16 nt, Pseudomonas aeruginosa PA01
gcggccgaggcuuccu

SEQ ID NO: 1518761 - RNA, 15 nt, Pseudomonas aeruginosa PA01
gcggccgagggcgag

SEQ ID NO: 1518762 - RNA, 16 nt, Pseudomonas aeruginosa PA01
gcggccgaauccucca

SEQ ID NO: 1518763 - RNA, 22 nt, Pseudomonas aeruginosa PA01
gcggccgaggaaggcgcuggcg

SEQ ID NO: 1518764 - RNA, 23 nt, Pseudomonas aeruginosa PA01
gcggccgaggaaggcgcuggcgc

SEQ ID NO: 1518765 - RNA, 22 nt, Pseudomonas aeruginosa PA01
gcggccgacgugcacccgcugu

SEQ ID NO: 1518766 - RNA, 20 nt, Pseudomonas aeruginosa PA01
gcggccgagauccugcagca

SEQ ID NO: 1518767 - RNA, 22 nt, Pseudomonas aeruginosa PA01
gcggccgagcaggcgcgccagg

SEQ ID NO: 1518768 - RNA, 21 nt, Pseudomonas aeruginosa PA01
gcggcggggaaggcgucggcu

SEQ ID NO: 1518769 - RNA, 12 nt, Pseudomonas aeruginosa PA01
gcggcgggcgcc

SEQ ID NO: 1518770 - RNA, 13 nt, Pseudomonas aeruginosa PA01
gcggcgggcgccc

SEQ ID NO: 1518771 - RNA, 14 nt, Pseudomonas aeruginosa PA01
gcggcggcgccggc

SEQ ID NO: 1518772 - RNA, 15 nt, Pseudomonas aeruginosa PA01
gcggcggcgcggguc

SEQ ID NO: 1518773 - RNA, 14 nt, Pseudomonas aeruginosa PA01
gcggcggcggacag

SEQ ID NO: 1518774 - RNA, 13 nt, Pseudomonas aeruginosa PA01
gcggcggcggcca

SEQ ID NO: 1518775 - RNA, 16 nt, Pseudomonas aeruginosa PA01
gcggcggcggccgcau

SEQ ID NO: 1518776 - RNA, 16 nt, Pseudomonas aeruginosa PA01
gcggcguaccagccgc

SEQ ID NO: 1518777 - RNA, 20 nt, Pseudomonas aeruginosa PA01
gcggcgguucgccgagcgcc

SEQ ID NO: 1518778 - RNA, 22 nt, Pseudomonas aeruginosa PA01
gcggcgguucgccgagcgccgc

SEQ ID NO: 1518779 - RNA, 22 nt, Pseudomonas aeruginosa PA01
gcggcggucccagaccagcagc

SEQ ID NO: 1518780 - RNA, 17 nt, Pseudomonas aeruginosa PA01
gcggcggucccaucagc

SEQ ID NO: 1518781 - RNA, 15 nt, Pseudomonas aeruginosa PA01
gcggcggugcgccgg

SEQ ID NO: 1518782 - RNA, 19 nt, Pseudomonas aeruginosa PA01
gcggcggucaucgcgccgc

SEQ ID NO: 1518783 - RNA, 18 nt, Pseudomonas aeruginosa PA01
gcggcgugaagccgccgc

SEQ ID NO: 1518784 - RNA, 20 nt, Pseudomonas aeruginosa PA01
gcggcgucccggcgccgccc

SEQ ID NO: 1518785 - RNA, 21 nt, Pseudomonas aeruginosa PA01
gcggcgucccggcgccgcccu

SEQ ID NO: 1518786 - RNA, 13 nt, Pseudomonas aeruginosa PA01
gcggcgucgggcg

SEQ ID NO: 1518787 - RNA, 14 nt, Pseudomonas aeruginosa PA01
gcggcgucaggguc

SEQ ID NO: 1518788 - RNA, 19 nt, Pseudomonas aeruginosa PA01
gcggcguaccuucgagcag

SEQ ID NO: 1518789 - RNA, 15 nt, Pseudomonas aeruginosa PA01
gcggcuccagccgcu

SEQ ID NO: 1518790 - RNA, 18 nt, Pseudomonas aeruginosa PA01
gcggcuccagccgcugca

SEQ ID NO: 1518791 - RNA, 14 nt, Pseudomonas aeruginosa PA01
gcggcuacccucuc

SEQ ID NO: 1518792 - RNA, 18 nt, Pseudomonas aeruginosa PA01
gcggcuacccucucccca

SEQ ID NO: 1518793 - RNA, 21 nt, Pseudomonas aeruginosa PA01
gcggcguugucggccagcagc

SEQ ID NO: 1518794 - RNA, 15 nt, Pseudomonas aeruginosa PA01
gcggcguucgcccug

SEQ ID NO: 1518795 - RNA, 19 nt, Pseudomonas aeruginosa PA01
gcggcguucgcccugcgga

SEQ ID NO: 1518796 - RNA, 17 nt, Pseudomonas aeruginosa PA01
gcggcguucgccgagca

SEQ ID NO: 1518797 - RNA, 16 nt, Pseudomonas aeruginosa PA01
gcggcguucggaccug

SEQ ID NO: 1518798 - RNA, 21 nt, Pseudomonas aeruginosa PA01
gcgcgacgagaaaaagcccgg

SEQ ID NO: 1518799 - RNA, 18 nt, Pseudomonas aeruginosa PA01
gcgcgacgaggcgcggcg

SEQ ID NO: 1518800 - RNA, 20 nt, Pseudomonas aeruginosa PA01
gcgcgaccgcccgccucagg

SEQ ID NO: 1518801 - RNA, 18 nt, Pseudomonas aeruginosa PA01
gcgcgaugaugccgccgu

SEQ ID NO: 1518802 - RNA, 17 nt, Pseudomonas aeruginosa PA01
gcgcgacugucgagcag

SEQ ID NO: 1518803 - RNA, 16 nt, Pseudomonas aeruginosa PA01
gcgcgccaaggccgcc

SEQ ID NO: 1518804 - RNA, 17 nt, Pseudomonas aeruginosa PA01
gcgcgccaaggccgcca

SEQ ID NO: 1518805 - RNA, 12 nt, Pseudomonas aeruginosa PA01
gcgcgccagcgc

SEQ ID NO: 1518806 - RNA, 13 nt, Pseudomonas aeruginosa PA01
gcgcgccagaagc

SEQ ID NO: 1518807 - RNA, 13 nt, Pseudomonas aeruginosa PA01
gcgcgccagcaac

SEQ ID NO: 1518808 - RNA, 17 nt, Pseudomonas aeruginosa PA01
gcgcgaugcucccgagc

SEQ ID NO: 1518809 - RNA, 17 nt, Pseudomonas aeruginosa PA01
gcgcgcaaggccgaaga

SEQ ID NO: 1518810 - RNA, 18 nt, Pseudomonas aeruginosa PA01
gcgccuuuuucauggccu

SEQ ID NO: 1518811 - RNA, 19 nt, Pseudomonas aeruginosa PA01
gcgccuuuuucauggccug

SEQ ID NO: 1518812 - RNA, 21 nt, Pseudomonas aeruginosa PA01
gcgccuuuuucauggccuggc

SEQ ID NO: 1518813 - RNA, 14 nt, Pseudomonas aeruginosa PA01
gcgcgaacaguucc

SEQ ID NO: 1518814 - RNA, 16 nt, Pseudomonas aeruginosa PA01
gcgcgaaagggucagg

SEQ ID NO: 1518815 - RNA, 14 nt, Pseudomonas aeruginosa PA01
gcgcgaccgcggcg

SEQ ID NO: 1518816 - RNA, 16 nt, Pseudomonas aeruginosa PA01
gcgcgaccgcggcgcu

SEQ ID NO: 1518817 - RNA, 15 nt, Pseudomonas aeruginosa PA01
gcgcgacaggcuggc

SEQ ID NO: 1518818 - RNA, 14 nt, Pseudomonas aeruginosa PA01
gcgccuuccaggcg

SEQ ID NO: 1518819 - RNA, 21 nt, Pseudomonas aeruginosa PA01
gcgccuugcgguccagcgagc

SEQ ID NO: 1518820 - RNA, 14 nt, Pseudomonas aeruginosa PA01
gcgccuugcucagg

SEQ ID NO: 1518821 - RNA, 16 nt, Pseudomonas aeruginosa PA01
gcgccuugcgccaggc

SEQ ID NO: 1518822 - RNA, 17 nt, Pseudomonas aeruginosa PA01
gcgccuucagagcaggg

SEQ ID NO: 1518823 - RNA, 18 nt, Pseudomonas aeruginosa PA01
gcgccuucagccccagca

SEQ ID NO: 1518824 - RNA, 19 nt, Pseudomonas aeruginosa PA01
gcgccuucagccccagcac

SEQ ID NO: 1518825 - RNA, 20 nt, Pseudomonas aeruginosa PA01
gcgccuucagcgccagcagg

SEQ ID NO: 1518826 - RNA, 21 nt, Pseudomonas aeruginosa PA01
gcgccuucagcgccgccaggc

SEQ ID NO: 1518827 - RNA, 21 nt, Pseudomonas aeruginosa PA01
gcgccuucaccguucccagca

SEQ ID NO: 1518828 - RNA, 23 nt, Pseudomonas aeruginosa PA01
gcgccuucaccguucccagcagc

SEQ ID NO: 1518829 - RNA, 15 nt, Pseudomonas aeruginosa PA01
gcgccuguuccaggg

SEQ ID NO: 1518830 - RNA, 20 nt, Pseudomonas aeruginosa PA01
gcgccuguuccagggccugc

SEQ ID NO: 1518831 - RNA, 15 nt, Pseudomonas aeruginosa PA01
gcgcgccgagccagg

SEQ ID NO: 1518832 - RNA, 13 nt, Pseudomonas aeruginosa PA01
gcgcgccggcggg

SEQ ID NO: 1518833 - RNA, 15 nt, Pseudomonas aeruginosa PA01
gcgcgcgcgcuccuc

SEQ ID NO: 1518834 - RNA, 15 nt, Pseudomonas aeruginosa PA01
gcgcgcggcauccag

SEQ ID NO: 1518835 - RNA, 21 nt, Pseudomonas aeruginosa PA01
gcgcgcggccagcgcggccgc

SEQ ID NO: 1518836 - RNA, 15 nt, Pseudomonas aeruginosa PA01
gcgcgcggcagcacc

SEQ ID NO: 1518837 - RNA, 17 nt, Pseudomonas aeruginosa PA01
gcgcgcucucgccggcc

SEQ ID NO: 1518838 - RNA, 20 nt, Pseudomonas aeruginosa PA01
gcgcgcucuucgccgcggcg

SEQ ID NO: 1518839 - RNA, 17 nt, Pseudomonas aeruginosa PA01
gcgcgcuguagccggcg

SEQ ID NO: 1518840 - RNA, 24 nt, Pseudomonas aeruginosa PA01
gcgcgcuggucguaggcgcgggcg

SEQ ID NO: 1518841 - RNA, 13 nt, Pseudomonas aeruginosa PA01
gcgcgcuggcgca

SEQ ID NO: 1518842 - RNA, 20 nt, Pseudomonas aeruginosa PA01
gcgcgcuuuccggcgcggcc

SEQ ID NO: 1518843 - RNA, 21 nt, Pseudomonas aeruginosa PA01
gcgcgcuuuccggcgcggccu

SEQ ID NO: 1518844 - RNA, 19 nt, Pseudomonas aeruginosa PA01
gcgcgcuuuuccggcgccg

SEQ ID NO: 1518845 - RNA, 21 nt, Pseudomonas aeruginosa PA01
gcgcgcuuuuccggcgccggc

SEQ ID NO: 1518846 - RNA, 15 nt, Pseudomonas aeruginosa PA01
gcgcggcacaggcgg

SEQ ID NO: 1518847 - RNA, 17 nt, Pseudomonas aeruginosa PA01
gcgcggcacaggcggcu

SEQ ID NO: 1518848 - RNA, 18 nt, Pseudomonas aeruginosa PA01
gcgcggcacaggcggcug

SEQ ID NO: 1518849 - RNA, 19 nt, Pseudomonas aeruginosa PA01
gcgcggcacaggcggcugu

SEQ ID NO: 1518850 - RNA, 13 nt, Pseudomonas aeruginosa PA01
gcgcggcaggacc

SEQ ID NO: 1518851 - RNA, 23 nt, Pseudomonas aeruginosa PA01
gcgcggcagcgccaucaggcccu

SEQ ID NO: 1518852 - RNA, 21 nt, Pseudomonas aeruginosa PA01
gcgcggccuucuugcugccgg

SEQ ID NO: 1518853 - RNA, 23 nt, Pseudomonas aeruginosa PA01
gcgcggcagugcucgaucaggcu

SEQ ID NO: 1518854 - RNA, 14 nt, Pseudomonas aeruginosa PA01
gcgcggcagguggc

SEQ ID NO: 1518855 - RNA, 13 nt, Pseudomonas aeruginosa PA01
gcgcggcgcaggc

SEQ ID NO: 1518856 - RNA, 17 nt, Pseudomonas aeruginosa PA01
gcgcggcgcccugccgg

SEQ ID NO: 1518857 - RNA, 20 nt, Pseudomonas aeruginosa PA01
gcgcggcgccccaggcgccc

SEQ ID NO: 1518858 - RNA, 19 nt, Pseudomonas aeruginosa PA01
gcgccugcuuugggagcag

SEQ ID NO: 1518859 - RNA, 18 nt, Pseudomonas aeruginosa PA01
gcgccuggccuggaacug

SEQ ID NO: 1518860 - RNA, 20 nt, Pseudomonas aeruginosa PA01
gcgccuggcgcaacgccggc

SEQ ID NO: 1518861 - RNA, 22 nt, Pseudomonas aeruginosa PA01
gcgccugcuucagguagugcaa

SEQ ID NO: 1518862 - RNA, 24 nt, Pseudomonas aeruginosa PA01
gcgccuggagcagaaccgccagca

SEQ ID NO: 1518863 - RNA, 12 nt, Pseudomonas aeruginosa PA01
gcgccugcugcg

SEQ ID NO: 1518864 - RNA, 22 nt, Pseudomonas aeruginosa PA01
gcgccuguaccccguagcgcuc

SEQ ID NO: 1518865 - RNA, 18 nt, Pseudomonas aeruginosa PA01
gcgccugguauugcgccc

SEQ ID NO: 1518866 - RNA, 18 nt, Pseudomonas aeruginosa PA01
gcgccuggcuggccagca

SEQ ID NO: 1518867 - RNA, 19 nt, Pseudomonas aeruginosa PA01
gcgccuggcuggccagcag

SEQ ID NO: 1518868 - RNA, 20 nt, Pseudomonas aeruginosa PA01
gcgccuggcuggccagcagg

SEQ ID NO: 1518869 - RNA, 13 nt, Pseudomonas aeruginosa PA01
gcgccuggucggc

SEQ ID NO: 1518870 - RNA, 16 nt, Pseudomonas aeruginosa PA01
gcgccuggucggcggc

SEQ ID NO: 1518871 - RNA, 15 nt, Pseudomonas aeruginosa PA01
gcgccugagcuggcc

SEQ ID NO: 1518872 - RNA, 20 nt, Pseudomonas aeruginosa PA01
gcgccugcaacgccagcagg

SEQ ID NO: 1518873 - RNA, 16 nt, Pseudomonas aeruginosa PA01
gcgccugcaacguccu

SEQ ID NO: 1518874 - RNA, 15 nt, Pseudomonas aeruginosa PA01
gcgccugcagcucgg

SEQ ID NO: 1518875 - RNA, 17 nt, Pseudomonas aeruginosa PA01
gcgccucuucgcaggag

SEQ ID NO: 1518876 - RNA, 15 nt, Pseudomonas aeruginosa PA01
gcgccgucgcuggcg

SEQ ID NO: 1518877 - RNA, 20 nt, Pseudomonas aeruginosa PA01
gcgccguggaucgcccggcu

SEQ ID NO: 1518878 - RNA, 22 nt, Pseudomonas aeruginosa PA01
gcgccguugccgguacucgccg

SEQ ID NO: 1518879 - RNA, 16 nt, Pseudomonas aeruginosa PA01
gcgccguugcggcagc

SEQ ID NO: 1518880 - RNA, 22 nt, Pseudomonas aeruginosa PA01
gcgccguuuucaaugacgggga

SEQ ID NO: 1518881 - RNA, 15 nt, Pseudomonas aeruginosa PA01
gcgccucgaccuggc

SEQ ID NO: 1518882 - RNA, 19 nt, Pseudomonas aeruginosa PA01
gcgccucgccgagcaucca

SEQ ID NO: 1518883 - RNA, 15 nt, Pseudomonas aeruginosa PA01
gcgccucgccgcggc

SEQ ID NO: 1518884 - RNA, 21 nt, Pseudomonas aeruginosa PA01
gcgccucgaccagaucggcau

SEQ ID NO: 1518885 - RNA, 18 nt, Pseudomonas aeruginosa PA01
gcgccucgggccggagca

SEQ ID NO: 1518886 - RNA, 17 nt, Pseudomonas aeruginosa PA01
gcgccucguggaacagc

SEQ ID NO: 1518887 - RNA, 19 nt, Pseudomonas aeruginosa PA01
gcgccucgucgcgccaggc

SEQ ID NO: 1518888 - RNA, 13 nt, Pseudomonas aeruginosa PA01
gcgccuccagcac

SEQ ID NO: 1518889 - RNA, 14 nt, Pseudomonas aeruginosa PA01
gcgccuccagcacc

SEQ ID NO: 1518890 - RNA, 15 nt, Pseudomonas aeruginosa PA01
gcgccuccggcagcg

SEQ ID NO: 1518891 - RNA, 16 nt, Pseudomonas aeruginosa PA01
gcgccuccucggcggc

SEQ ID NO: 1518892 - RNA, 17 nt, Pseudomonas aeruginosa PA01
gcgccuccucggcggcc

SEQ ID NO: 1518893 - RNA, 19 nt, Pseudomonas aeruginosa PA01
gcgccuccucggcggccuu

SEQ ID NO: 1518894 - RNA, 14 nt, Pseudomonas aeruginosa PA01
gcgccuccucuacc

SEQ ID NO: 1518895 - RNA, 16 nt, Pseudomonas aeruginosa PA01
gcgccucccgggccuc

SEQ ID NO: 1518896 - RNA, 16 nt, Pseudomonas aeruginosa PA01
gcgccuccaggaccuu

SEQ ID NO: 1518897 - RNA, 15 nt, Pseudomonas aeruginosa PA01
gcgccuccaggcgcg

SEQ ID NO: 1518898 - RNA, 18 nt, Pseudomonas aeruginosa PA01
gcgccuccaggcgcgccu

SEQ ID NO: 1518899 - RNA, 16 nt, Pseudomonas aeruginosa PA01
gcgccucccagggucg

SEQ ID NO: 1518900 - RNA, 12 nt, Pseudomonas aeruginosa PA01
gcgccgggcgcg

SEQ ID NO: 1518901 - RNA, 18 nt, Pseudomonas aeruginosa PA01
gcgccgguagcggcgcac

SEQ ID NO: 1518902 - RNA, 17 nt, Pseudomonas aeruginosa PA01
gcgccggguugcgccgc

SEQ ID NO: 1518903 - RNA, 16 nt, Pseudomonas aeruginosa PA01
gcgccgguugcugcug

SEQ ID NO: 1518904 - RNA, 18 nt, Pseudomonas aeruginosa PA01
gcgccgguugcugcugcg

SEQ ID NO: 1518905 - RNA, 22 nt, Pseudomonas aeruginosa PA01
gcgccgguugcugcugcggggc

SEQ ID NO: 1518906 - RNA, 20 nt, Pseudomonas aeruginosa PA01
gcgccgguggccaggacgcu

SEQ ID NO: 1518907 - RNA, 18 nt, Pseudomonas aeruginosa PA01
gcgccggugcuggcgagc

SEQ ID NO: 1518908 - RNA, 18 nt, Pseudomonas aeruginosa PA01
gcgccggugaggcgcagc

SEQ ID NO: 1518909 - RNA, 22 nt, Pseudomonas aeruginosa PA01
gcgccggugaucgagccgccgg

SEQ ID NO: 1518910 - RNA, 13 nt, Pseudomonas aeruginosa PA01
gcgccguccugca

SEQ ID NO: 1518911 - RNA, 22 nt, Pseudomonas aeruginosa PA01
gcgccguccugcaacugcucga

SEQ ID NO: 1518912 - RNA, 19 nt, Pseudomonas aeruginosa PA01
gcgccggcauugccgacuu

SEQ ID NO: 1518913 - RNA, 15 nt, Pseudomonas aeruginosa PA01
gcgccggcagcucgg

SEQ ID NO: 1518914 - RNA, 14 nt, Pseudomonas aeruginosa PA01
gcgccggccagagc

SEQ ID NO: 1518915 - RNA, 14 nt, Pseudomonas aeruginosa PA01
gcgccggcccagca

SEQ ID NO: 1518916 - RNA, 20 nt, Pseudomonas aeruginosa PA01
gcgccggcccagcaggccgg

SEQ ID NO: 1518917 - RNA, 14 nt, Pseudomonas aeruginosa PA01
gcgccggccguccc

SEQ ID NO: 1518918 - RNA, 19 nt, Pseudomonas aeruginosa PA01
gcgccggcgaucgccaggc

SEQ ID NO: 1518919 - RNA, 13 nt, Pseudomonas aeruginosa PA01
gcgccggcgcgcu

SEQ ID NO: 1518920 - RNA, 16 nt, Pseudomonas aeruginosa PA01
gcgccggcggccggcg

SEQ ID NO: 1518921 - RNA, 20 nt, Pseudomonas aeruginosa PA01
gcgccggcggccggcgcagu

SEQ ID NO: 1518922 - RNA, 12 nt, Pseudomonas aeruginosa PA01
gcgccggcggcc

SEQ ID NO: 1518923 - RNA, 18 nt, Pseudomonas aeruginosa PA01
gcgccggcggccugcccc

SEQ ID NO: 1518924 - RNA, 20 nt, Pseudomonas aeruginosa PA01
gcgccggcucgcccagcagg

SEQ ID NO: 1518925 - RNA, 13 nt, Pseudomonas aeruginosa PA01
gcgccggcugccg

SEQ ID NO: 1518926 - RNA, 19 nt, Pseudomonas aeruginosa PA01
gcgccggcugacgcuggcg

SEQ ID NO: 1518927 - RNA, 18 nt, Pseudomonas aeruginosa PA01
gcgccgggcucagcgcgc

SEQ ID NO: 1518928 - RNA, 21 nt, Pseudomonas aeruginosa PA01
gcgccggggaucaggucgccg

SEQ ID NO: 1518929 - RNA, 22 nt, Pseudomonas aeruginosa PA01
gcgccggggaucaggucgccgc

SEQ ID NO: 1518930 - RNA, 13 nt, Pseudomonas aeruginosa PA01
gcgccggggcagc

SEQ ID NO: 1518931 - RNA, 19 nt, Pseudomonas aeruginosa PA01
gcgccggggcagcagggcg

SEQ ID NO: 1518932 - RNA, 15 nt, Pseudomonas aeruginosa PA01
gcgccgggaugcuca

SEQ ID NO: 1518933 - RNA, 13 nt, Pseudomonas aeruginosa PA01
gcgccgccgggcg

SEQ ID NO: 1518934 - RNA, 19 nt, Pseudomonas aeruginosa PA01
gcgccgccgggcgcccggc

SEQ ID NO: 1518935 - RNA, 15 nt, Pseudomonas aeruginosa PA01
gcgccgccggcuccu

SEQ ID NO: 1518936 - RNA, 16 nt, Pseudomonas aeruginosa PA01
gcgccgccuggccggu

SEQ ID NO: 1518937 - RNA, 17 nt, Pseudomonas aeruginosa PA01
gcgccgccucgggcagc

SEQ ID NO: 1518938 - RNA, 13 nt, Pseudomonas aeruginosa PA01
gcgccgccugcug

SEQ ID NO: 1518939 - RNA, 12 nt, Pseudomonas aeruginosa PA01
gcgccgcgcagc

SEQ ID NO: 1518940 - RNA, 14 nt, Pseudomonas aeruginosa PA01
gcgccgcgccagca

SEQ ID NO: 1518941 - RNA, 19 nt, Pseudomonas aeruginosa PA01
gcgccgcgccagcaggcgc

SEQ ID NO: 1518942 - RNA, 16 nt, Pseudomonas aeruginosa PA01
gcgccgcgcagcgcgg

SEQ ID NO: 1518943 - RNA, 21 nt, Pseudomonas aeruginosa PA01
gcgccgccuugagcggcgccc

SEQ ID NO: 1518944 - RNA, 22 nt, Pseudomonas aeruginosa PA01
gcgccgccuugagcggcgcccu

SEQ ID NO: 1518945 - RNA, 21 nt, Pseudomonas aeruginosa PA01
gcgccgcgaacacacccugcg

SEQ ID NO: 1518946 - RNA, 20 nt, Pseudomonas aeruginosa PA01
gcgccgcccccggcccgggc

SEQ ID NO: 1518947 - RNA, 21 nt, Pseudomonas aeruginosa PA01
gcgccgcccccggcccgggcg

SEQ ID NO: 1518948 - RNA, 23 nt, Pseudomonas aeruginosa PA01
gcgccgccccguuggcgcgggcg

SEQ ID NO: 1518949 - RNA, 13 nt, Pseudomonas aeruginosa PA01
gcgccgcccuggc

SEQ ID NO: 1518950 - RNA, 15 nt, Pseudomonas aeruginosa PA01
gcgccgcccuggccg

SEQ ID NO: 1518951 - RNA, 13 nt, Pseudomonas aeruginosa PA01
gcgccgccauggu

SEQ ID NO: 1518952 - RNA, 20 nt, Pseudomonas aeruginosa PA01
gcgccgccaugguuuaccag

SEQ ID NO: 1518953 - RNA, 15 nt, Pseudomonas aeruginosa PA01
gcgccgccaggcgcg

SEQ ID NO: 1518954 - RNA, 13 nt, Pseudomonas aeruginosa PA01
gcgccgccaggcg

SEQ ID NO: 1518955 - RNA, 18 nt, Pseudomonas aeruginosa PA01
gcgccgccaggcccuggg

SEQ ID NO: 1518956 - RNA, 16 nt, Pseudomonas aeruginosa PA01
gcgccgccaggcaggc

SEQ ID NO: 1518957 - RNA, 16 nt, Pseudomonas aeruginosa PA01
gcgccgccgcggccag

SEQ ID NO: 1518958 - RNA, 15 nt, Pseudomonas aeruginosa PA01
gcgccgccgaggaua

SEQ ID NO: 1518959 - RNA, 21 nt, Pseudomonas aeruginosa PA01
gcgccgccgaggugcggcuug

SEQ ID NO: 1518960 - RNA, 22 nt, Pseudomonas aeruginosa PA01
gcgccgccgaagccgacgccga

SEQ ID NO: 1518961 - RNA, 14 nt, Pseudomonas aeruginosa PA01
gcgccgcgcuuggc

SEQ ID NO: 1518962 - RNA, 12 nt, Pseudomonas aeruginosa PA01
gcgccgcgcggc

SEQ ID NO: 1518963 - RNA, 16 nt, Pseudomonas aeruginosa PA01
gcgccgcgcggcgccc

SEQ ID NO: 1518964 - RNA, 19 nt, Pseudomonas aeruginosa PA01
gcgccgcggcgaccagcgc

SEQ ID NO: 1518965 - RNA, 20 nt, Pseudomonas aeruginosa PA01
gcgccgcggcggcggacagc

SEQ ID NO: 1518966 - RNA, 20 nt, Pseudomonas aeruginosa PA01
gcgccgcggcggcgugcagg

SEQ ID NO: 1518967 - RNA, 14 nt, Pseudomonas aeruginosa PA01
gcgccgcggcggcg

SEQ ID NO: 1518968 - RNA, 20 nt, Pseudomonas aeruginosa PA01
gcgccgcgggucaccagcgc

SEQ ID NO: 1518969 - RNA, 21 nt, Pseudomonas aeruginosa PA01
gcgccgcgggucaccagcgcc

SEQ ID NO: 1518970 - RNA, 20 nt, Pseudomonas aeruginosa PA01
gcgccgcgggucugcucggc

SEQ ID NO: 1518971 - RNA, 20 nt, Pseudomonas aeruginosa PA01
gcgccgcgguuuccgugcgg

SEQ ID NO: 1518972 - RNA, 22 nt, Pseudomonas aeruginosa PA01
gcgccgcguaguaggcacagga

SEQ ID NO: 1518973 - RNA, 18 nt, Pseudomonas aeruginosa PA01
gcgccgcuaugggcaccg

SEQ ID NO: 1518974 - RNA, 13 nt, Pseudomonas aeruginosa PA01
gcgccgcucaggc

SEQ ID NO: 1518975 - RNA, 21 nt, Pseudomonas aeruginosa PA01
gcgccgcguucgccgagcuga

SEQ ID NO: 1518976 - RNA, 17 nt, Pseudomonas aeruginosa PA01
gcgccgcuagggcgccc

SEQ ID NO: 1518977 - RNA, 19 nt, Pseudomonas aeruginosa PA01
gcgccgcuagggcgcccuc

SEQ ID NO: 1518978 - RNA, 22 nt, Pseudomonas aeruginosa PA01
gcgccgcucggcgagccgccgg

SEQ ID NO: 1518979 - RNA, 16 nt, Pseudomonas aeruginosa PA01
gcgccggcaucgccau

SEQ ID NO: 1518980 - RNA, 23 nt, Pseudomonas aeruginosa PA01
gcgccggacaggccacccgccuc

SEQ ID NO: 1518981 - RNA, 17 nt, Pseudomonas aeruginosa PA01
gcgccggaugggcgagc

SEQ ID NO: 1518982 - RNA, 18 nt, Pseudomonas aeruginosa PA01
gcgccgcuccuggcaggc

SEQ ID NO: 1518983 - RNA, 18 nt, Pseudomonas aeruginosa PA01
gcgccgcugucuaucugc

SEQ ID NO: 1518984 - RNA, 22 nt, Pseudomonas aeruginosa PA01
gcgccgcugcggcugcagggcc

SEQ ID NO: 1518985 - RNA, 17 nt, Pseudomonas aeruginosa PA01
gcgccgcaaguggcggc

SEQ ID NO: 1518986 - RNA, 20 nt, Pseudomonas aeruginosa PA01
gcgccgcaccacguagccgg

SEQ ID NO: 1518987 - RNA, 22 nt, Pseudomonas aeruginosa PA01
gcgccgcaccacguagccggcg

SEQ ID NO: 1518988 - RNA, 22 nt, Pseudomonas aeruginosa PA01
gcgccgauggcugucggcgccc

SEQ ID NO: 1518989 - RNA, 16 nt, Pseudomonas aeruginosa PA01
gcgccgaugcccaggc

SEQ ID NO: 1518990 - RNA, 20 nt, Pseudomonas aeruginosa PA01
gcgccgaggucuuggccagc

SEQ ID NO: 1518991 - RNA, 23 nt, Pseudomonas aeruginosa PA01
gcgccgaggucuuggccagccgc

SEQ ID NO: 1518992 - RNA, 11 nt, Pseudomonas aeruginosa PA01
gcgccgaggua

SEQ ID NO: 1518993 - RNA, 13 nt, Pseudomonas aeruginosa PA01
gcgccgcagcggc

SEQ ID NO: 1518994 - RNA, 21 nt, Pseudomonas aeruginosa PA01
gcgccgcagggugcggcugcu

SEQ ID NO: 1518995 - RNA, 20 nt, Pseudomonas aeruginosa PA01
gcgccgcauuggccaggccc

SEQ ID NO: 1518996 - RNA, 15 nt, Pseudomonas aeruginosa PA01
gcgccgccacgugca

SEQ ID NO: 1518997 - RNA, 22 nt, Pseudomonas aeruginosa PA01
gcgccgccagcaggaucgacag

SEQ ID NO: 1518998 - RNA, 15 nt, Pseudomonas aeruginosa PA01
gcgccgaccagccgc

SEQ ID NO: 1518999 - RNA, 22 nt, Pseudomonas aeruginosa PA01
gcgccgacgccaccagccaggc

SEQ ID NO: 1519000 - RNA, 22 nt, Pseudomonas aeruginosa PA01
gcgccgagcuggcgcgcgucga

SEQ ID NO: 1519001 - RNA, 16 nt, Pseudomonas aeruginosa PA01
gcgccgagcccccggc

SEQ ID NO: 1519002 - RNA, 22 nt, Pseudomonas aeruginosa PA01
gcgccgagcccccggcgcccag

SEQ ID NO: 1519003 - RNA, 16 nt, Pseudomonas aeruginosa PA01
gcgcccucgggcgccg

SEQ ID NO: 1519004 - RNA, 14 nt, Pseudomonas aeruginosa PA01
gcgcccugcaggcc

SEQ ID NO: 1519005 - RNA, 23 nt, Pseudomonas aeruginosa PA01
gcgccgaacagggcgagcagggc

SEQ ID NO: 1519006 - RNA, 19 nt, Pseudomonas aeruginosa PA01
gcgccauauuucgaagggu

SEQ ID NO: 1519007 - RNA, 15 nt, Pseudomonas aeruginosa PA01
gcgccauaggccagc

SEQ ID NO: 1519008 - RNA, 17 nt, Pseudomonas aeruginosa PA01
gcgccaucaggcccuug

SEQ ID NO: 1519009 - RNA, 16 nt, Pseudomonas aeruginosa PA01
gcgccaucaguuccuc

SEQ ID NO: 1519010 - RNA, 23 nt, Pseudomonas aeruginosa PA01
gcgccaugcaagaacgccgaccc

SEQ ID NO: 1519011 - RNA, 16 nt, Pseudomonas aeruginosa PA01
gcgccaugcgcccgcu

SEQ ID NO: 1519012 - RNA, 17 nt, Pseudomonas aeruginosa PA01
gcgccaugccggcgccg

SEQ ID NO: 1519013 - RNA, 17 nt, Pseudomonas aeruginosa PA01
gcgccaucuccucgcug

SEQ ID NO: 1519014 - RNA, 18 nt, Pseudomonas aeruginosa PA01
gcgccauccuccagcgcc

SEQ ID NO: 1519015 - RNA, 21 nt, Pseudomonas aeruginosa PA01
gcgccaucgcuuuccuggccg

SEQ ID NO: 1519016 - RNA, 18 nt, Pseudomonas aeruginosa PA01
gcgccaucgaucagcagc

SEQ ID NO: 1519017 - RNA, 19 nt, Pseudomonas aeruginosa PA01
gcgccaucgaucagcagcg

SEQ ID NO: 1519018 - RNA, 16 nt, Pseudomonas aeruginosa PA01
gcgcccacuccaacca

SEQ ID NO: 1519019 - RNA, 21 nt, Pseudomonas aeruginosa PA01
gcgcccagaguucgcccagcu

SEQ ID NO: 1519020 - RNA, 19 nt, Pseudomonas aeruginosa PA01
gcgccauggcgguuccucc

SEQ ID NO: 1519021 - RNA, 22 nt, Pseudomonas aeruginosa PA01
gcgccagcuccagcgcccaggu

SEQ ID NO: 1519022 - RNA, 18 nt, Pseudomonas aeruginosa PA01
gcgccaggaacgccucug

SEQ ID NO: 1519023 - RNA, 20 nt, Pseudomonas aeruginosa PA01
gcgccaggaacgccucugcg

SEQ ID NO: 1519024 - RNA, 19 nt, Pseudomonas aeruginosa PA01
gcgccaggaagccgcgccc

SEQ ID NO: 1519025 - RNA, 21 nt, Pseudomonas aeruginosa PA01
gcgccagcucgaacagcaccg

SEQ ID NO: 1519026 - RNA, 23 nt, Pseudomonas aeruginosa PA01
gcgccaggcgcgguugccgcugc

SEQ ID NO: 1519027 - RNA, 13 nt, Pseudomonas aeruginosa PA01
gcgccaggccggc

SEQ ID NO: 1519028 - RNA, 14 nt, Pseudomonas aeruginosa PA01
gcgccaggccucag

SEQ ID NO: 1519029 - RNA, 15 nt, Pseudomonas aeruginosa PA01
gcgccaggccucaga

SEQ ID NO: 1519030 - RNA, 14 nt, Pseudomonas aeruginosa PA01
gcgccaggccuugc

SEQ ID NO: 1519031 - RNA, 23 nt, Pseudomonas aeruginosa PA01
gcgccaggcgaagaaagccccug

SEQ ID NO: 1519032 - RNA, 22 nt, Pseudomonas aeruginosa PA01
gcgccaggcuuuccgccgagcg

SEQ ID NO: 1519033 - RNA, 16 nt, Pseudomonas aeruginosa PA01
gcgccagggacgcgca

SEQ ID NO: 1519034 - RNA, 18 nt, Pseudomonas aeruginosa PA01
gcgccagggacgcgcagc

SEQ ID NO: 1519035 - RNA, 19 nt, Pseudomonas aeruginosa PA01
gcgccaggcgugcagaccg

SEQ ID NO: 1519036 - RNA, 22 nt, Pseudomonas aeruginosa PA01
gcgccaggcguuccagcucggc

SEQ ID NO: 1519037 - RNA, 18 nt, Pseudomonas aeruginosa PA01
gcgccaggccggagccgc

SEQ ID NO: 1519038 - RNA, 14 nt, Pseudomonas aeruginosa PA01
gcgccaggagcagg

SEQ ID NO: 1519039 - RNA, 20 nt, Pseudomonas aeruginosa PA01
gcgccaggagcagggcgccg

SEQ ID NO: 1519040 - RNA, 13 nt, Pseudomonas aeruginosa PA01
gcgccagggccgg

SEQ ID NO: 1519041 - RNA, 20 nt, Pseudomonas aeruginosa PA01
gcgccagggccgggucauca

SEQ ID NO: 1519042 - RNA, 15 nt, Pseudomonas aeruginosa PA01
gcgccaggugcagga

SEQ ID NO: 1519043 - RNA, 20 nt, Pseudomonas aeruginosa PA01
gcgccaguacuccgagggcc

SEQ ID NO: 1519044 - RNA, 17 nt, Pseudomonas aeruginosa PA01
gcgccaguuggacgcgg

SEQ ID NO: 1519045 - RNA, 22 nt, Pseudomonas aeruginosa PA01
gcgccagucccgcaaagcccgc

SEQ ID NO: 1519046 - RNA, 14 nt, Pseudomonas aeruginosa PA01
gcgccccgccagga

SEQ ID NO: 1519047 - RNA, 15 nt, Pseudomonas aeruginosa PA01
gcgccccggcccagc

SEQ ID NO: 1519048 - RNA, 12 nt, Pseudomonas aeruginosa PA01
gcgcccgacggc

SEQ ID NO: 1519049 - RNA, 18 nt, Pseudomonas aeruginosa PA01
gcgccccugcgcccaggg

SEQ ID NO: 1519050 - RNA, 17 nt, Pseudomonas aeruginosa PA01
gcgccccugcggcgccg

SEQ ID NO: 1519051 - RNA, 15 nt, Pseudomonas aeruginosa PA01
gcgccccaccaggcu

SEQ ID NO: 1519052 - RNA, 18 nt, Pseudomonas aeruginosa PA01
gcgccccuuggccagcac

SEQ ID NO: 1519053 - RNA, 14 nt, Pseudomonas aeruginosa PA01
gcgccccaggcgcc

SEQ ID NO: 1519054 - RNA, 19 nt, Pseudomonas aeruginosa PA01
gcgccccaggcgcccaggc

SEQ ID NO: 1519055 - RNA, 21 nt, Pseudomonas aeruginosa PA01
gcgccccaggcgcccaggcag

SEQ ID NO: 1519056 - RNA, 13 nt, Pseudomonas aeruginosa PA01
gcgcccccagcgc

SEQ ID NO: 1519057 - RNA, 14 nt, Pseudomonas aeruginosa PA01
gcgcccccagcgcc

SEQ ID NO: 1519058 - RNA, 15 nt, Pseudomonas aeruginosa PA01
gcgcccccaucugca

SEQ ID NO: 1519059 - RNA, 16 nt, Pseudomonas aeruginosa PA01
gcgccccagaucgcca

SEQ ID NO: 1519060 - RNA, 22 nt, Pseudomonas aeruginosa PA01
gcgccccagaucgccagcgcca

SEQ ID NO: 1519061 - RNA, 12 nt, Pseudomonas aeruginosa PA01
gcgccccagcac

SEQ ID NO: 1519062 - RNA, 13 nt, Pseudomonas aeruginosa PA01
gcgccccagcacc

SEQ ID NO: 1519063 - RNA, 13 nt, Pseudomonas aeruginosa PA01
gcgccccagcgcc

SEQ ID NO: 1519064 - RNA, 20 nt, Pseudomonas aeruginosa PA01
gcgccccagcgccugggccg

SEQ ID NO: 1519065 - RNA, 13 nt, Pseudomonas aeruginosa PA01
gcgccccagcggc

SEQ ID NO: 1519066 - RNA, 19 nt, Pseudomonas aeruginosa PA01
gcgccccagcggcaggcac

SEQ ID NO: 1519067 - RNA, 20 nt, Pseudomonas aeruginosa PA01
gcgcccagcagcaggccggc

SEQ ID NO: 1519068 - RNA, 13 nt, Pseudomonas aeruginosa PA01
gcgcccagcacca

SEQ ID NO: 1519069 - RNA, 17 nt, Pseudomonas aeruginosa PA01
gcgcccagccagagcgu

SEQ ID NO: 1519070 - RNA, 20 nt, Pseudomonas aeruginosa PA01
gcgcccaggcccagcgcggc

SEQ ID NO: 1519071 - RNA, 15 nt, Pseudomonas aeruginosa PA01
gcgcccaggccgggu

SEQ ID NO: 1519072 - RNA, 22 nt, Pseudomonas aeruginosa PA01
gcgcccaggccgggucgcagcc

SEQ ID NO: 1519073 - RNA, 17 nt, Pseudomonas aeruginosa PA01
gcgcccaggcgcaccuc

SEQ ID NO: 1519074 - RNA, 20 nt, Pseudomonas aeruginosa PA01
gcgcccagggacgcgccggc

SEQ ID NO: 1519075 - RNA, 13 nt, Pseudomonas aeruginosa PA01
gcgcccgccaggu

SEQ ID NO: 1519076 - RNA, 22 nt, Pseudomonas aeruginosa PA01
gcgcccgccuuguucgccagca

SEQ ID NO: 1519077 - RNA, 18 nt, Pseudomonas aeruginosa PA01
gcgcccgcucgacccggu

SEQ ID NO: 1519078 - RNA, 16 nt, Pseudomonas aeruginosa PA01
gcgcccgcgggcgccu

SEQ ID NO: 1519079 - RNA, 21 nt, Pseudomonas aeruginosa PA01
gcgcccgccaaggcccugcug

SEQ ID NO: 1519080 - RNA, 19 nt, Pseudomonas aeruginosa PA01
gcgcccgccaagggcgccg

SEQ ID NO: 1519081 - RNA, 20 nt, Pseudomonas aeruginosa PA01
gcgcccgccaagggcgccgc

SEQ ID NO: 1519082 - RNA, 17 nt, Pseudomonas aeruginosa PA01
gcgcccgccgcgagcgc

SEQ ID NO: 1519083 - RNA, 19 nt, Pseudomonas aeruginosa PA01
gcgcccgauaggcgccggc

SEQ ID NO: 1519084 - RNA, 20 nt, Pseudomonas aeruginosa PA01
gcgcccgauaggcgccggcg

SEQ ID NO: 1519085 - RNA, 16 nt, Pseudomonas aeruginosa PA01
gcgcccgagggcgccg

SEQ ID NO: 1519086 - RNA, 18 nt, Pseudomonas aeruginosa PA01
gcgcccuacgccaccuga

SEQ ID NO: 1519087 - RNA, 20 nt, Pseudomonas aeruginosa PA01
gcgcccuacgccaccugagc

SEQ ID NO: 1519088 - RNA, 22 nt, Pseudomonas aeruginosa PA01
gcgcccuagucgaggggaaccg

SEQ ID NO: 1519089 - RNA, 13 nt, Pseudomonas aeruginosa PA01
gcgcccggcuggc

SEQ ID NO: 1519090 - RNA, 21 nt, Pseudomonas aeruginosa PA01
gcgcccggcgccaccccgccg

SEQ ID NO: 1519091 - RNA, 22 nt, Pseudomonas aeruginosa PA01
gcgcccggcgccaccccgccgc

SEQ ID NO: 1519092 - RNA, 17 nt, Pseudomonas aeruginosa PA01
gcgcccggcgccaggcu

SEQ ID NO: 1519093 - RNA, 14 nt, Pseudomonas aeruginosa PA01
gcgcccggccuccc

SEQ ID NO: 1519094 - RNA, 17 nt, Pseudomonas aeruginosa PA01
gcgcccggccuccccgg

SEQ ID NO: 1519095 - RNA, 15 nt, Pseudomonas aeruginosa PA01
gcgcccggcgcgacc

SEQ ID NO: 1519096 - RNA, 13 nt, Pseudomonas aeruginosa PA01
gcgcccggccagg

SEQ ID NO: 1519097 - RNA, 15 nt, Pseudomonas aeruginosa PA01
gcgcccggccaggcc

SEQ ID NO: 1519098 - RNA, 19 nt, Pseudomonas aeruginosa PA01
gcgcccggccaggccgccc

SEQ ID NO: 1519099 - RNA, 20 nt, Pseudomonas aeruginosa PA01
gcgcccggaaaaaaaagccc

SEQ ID NO: 1519100 - RNA, 18 nt, Pseudomonas aeruginosa PA01
gcgagaaucgccgaggcg

SEQ ID NO: 1519101 - RNA, 20 nt, Pseudomonas aeruginosa PA01
gcgacucggggcgccuccag

SEQ ID NO: 1519102 - RNA, 22 nt, Pseudomonas aeruginosa PA01
gcgacucggggcgccuccagcg

SEQ ID NO: 1519103 - RNA, 15 nt, Pseudomonas aeruginosa PA01
gcgagaaaggcugcu

SEQ ID NO: 1519104 - RNA, 23 nt, Pseudomonas aeruginosa PA01
gcgagaaaggcugcuucggcagc

SEQ ID NO: 1519105 - RNA, 18 nt, Pseudomonas aeruginosa PA01
gcgacucgcucgcuucag

SEQ ID NO: 1519106 - RNA, 16 nt, Pseudomonas aeruginosa PA01
gcgacucgcugccggc

SEQ ID NO: 1519107 - RNA, 14 nt, Pseudomonas aeruginosa PA01
gcgacucgcugggc

SEQ ID NO: 1519108 - RNA, 21 nt, Pseudomonas aeruginosa PA01
gcgacucgcugggcgccggca

SEQ ID NO: 1519109 - RNA, 15 nt, Pseudomonas aeruginosa PA01
gcgacucgaagcucu

SEQ ID NO: 1519110 - RNA, 22 nt, Pseudomonas aeruginosa PA01
gcgacucgaagcucuucgccag

SEQ ID NO: 1519111 - RNA, 17 nt, Pseudomonas aeruginosa PA01
gcgacuccagccaggcg

SEQ ID NO: 1519112 - RNA, 15 nt, Pseudomonas aeruginosa PA01
gcgagacgccgcccc

SEQ ID NO: 1519113 - RNA, 14 nt, Pseudomonas aeruginosa PA01
gcgagaggggcgcu

SEQ ID NO: 1519114 - RNA, 17 nt, Pseudomonas aeruginosa PA01
gcgagaggucggcgcgc

SEQ ID NO: 1519115 - RNA, 18 nt, Pseudomonas aeruginosa PA01
gcgagaggucggcgcgcc

SEQ ID NO: 1519116 - RNA, 23 nt, Pseudomonas aeruginosa PA01
gcgagaggucggcgcgcccggcg

SEQ ID NO: 1519117 - RNA, 17 nt, Pseudomonas aeruginosa PA01
gcgagagacugaacucg

SEQ ID NO: 1519118 - RNA, 16 nt, Pseudomonas aeruginosa PA01
gcgagccacauccagu

SEQ ID NO: 1519119 - RNA, 15 nt, Pseudomonas aeruginosa PA01
gcgagccgacuucca

SEQ ID NO: 1519120 - RNA, 12 nt, Pseudomonas aeruginosa PA01
gcgagccgagca

SEQ ID NO: 1519121 - RNA, 12 nt, Pseudomonas aeruginosa PA01
gcgagccgcagc

SEQ ID NO: 1519122 - RNA, 15 nt, Pseudomonas aeruginosa PA01
gcgaagggcaggccg

SEQ ID NO: 1519123 - RNA, 19 nt, Pseudomonas aeruginosa PA01
gcgaagggcaggccgauca

SEQ ID NO: 1519124 - RNA, 12 nt, Pseudomonas aeruginosa PA01
gcgaaggcgcuc

SEQ ID NO: 1519125 - RNA, 16 nt, Pseudomonas aeruginosa PA01
gcgaagcggcccuugu

SEQ ID NO: 1519126 - RNA, 17 nt, Pseudomonas aeruginosa PA01
gcgaagcggcucggcca

SEQ ID NO: 1519127 - RNA, 20 nt, Pseudomonas aeruginosa PA01
gcgaagcggcucggccaggg

SEQ ID NO: 1519128 - RNA, 22 nt, Pseudomonas aeruginosa PA01
gcgaagcggcucggccagggcc

SEQ ID NO: 1519129 - RNA, 14 nt, Pseudomonas aeruginosa PA01
gcgaagcuccucga

SEQ ID NO: 1519130 - RNA, 14 nt, Pseudomonas aeruginosa PA01
gcgaagucugccug

SEQ ID NO: 1519131 - RNA, 14 nt, Pseudomonas aeruginosa PA01
gcgaagugggggca

SEQ ID NO: 1519132 - RNA, 17 nt, Pseudomonas aeruginosa PA01
gcgaaguucccgccgcu

SEQ ID NO: 1519133 - RNA, 18 nt, Pseudomonas aeruginosa PA01
gcgaaguucccgccgcuc

SEQ ID NO: 1519134 - RNA, 22 nt, Pseudomonas aeruginosa PA01
gcgaaguucccgccgcucugcu

SEQ ID NO: 1519135 - RNA, 16 nt, Pseudomonas aeruginosa PA01
gcgaaguugccgccgc

SEQ ID NO: 1519136 - RNA, 20 nt, Pseudomonas aeruginosa PA01
gcgaaggcuccgcugcucag

SEQ ID NO: 1519137 - RNA, 12 nt, Pseudomonas aeruginosa PA01
gcgaagggcgcu

SEQ ID NO: 1519138 - RNA, 19 nt, Pseudomonas aeruginosa PA01
gcgaagucggcuuggguca

SEQ ID NO: 1519139 - RNA, 15 nt, Pseudomonas aeruginosa PA01
gcgaaguccaccagg

SEQ ID NO: 1519140 - RNA, 16 nt, Pseudomonas aeruginosa PA01
gcgacggcucuucccc

SEQ ID NO: 1519141 - RNA, 14 nt, Pseudomonas aeruginosa PA01
gcgaauaaccgcau

SEQ ID NO: 1519142 - RNA, 15 nt, Pseudomonas aeruginosa PA01
gcgaauaaccgcauc

SEQ ID NO: 1519143 - RNA, 20 nt, Pseudomonas aeruginosa PA01
gcgauaucccgccgccgcgc

SEQ ID NO: 1519144 - RNA, 17 nt, Pseudomonas aeruginosa PA01
gcgauauccgccaggcg

SEQ ID NO: 1519145 - RNA, 20 nt, Pseudomonas aeruginosa PA01
gcgaguucggcgagcaggua

SEQ ID NO: 1519146 - RNA, 21 nt, Pseudomonas aeruginosa PA01
gcgaguucggcguuguccagg

SEQ ID NO: 1519147 - RNA, 23 nt, Pseudomonas aeruginosa PA01
gcgaguucggcguuguccaggcu

SEQ ID NO: 1519148 - RNA, 15 nt, Pseudomonas aeruginosa PA01
gcgagccgccgggcg

SEQ ID NO: 1519149 - RNA, 13 nt, Pseudomonas aeruginosa PA01
gcgagcuggcgcc

SEQ ID NO: 1519150 - RNA, 21 nt, Pseudomonas aeruginosa PA01
gcgagcuggaucggcaggcug

SEQ ID NO: 1519151 - RNA, 19 nt, Pseudomonas aeruginosa PA01
gcgagcuucgccgcgcaag

SEQ ID NO: 1519152 - RNA, 19 nt, Pseudomonas aeruginosa PA01
gcgaggaacacccagaagc

SEQ ID NO: 1519153 - RNA, 23 nt, Pseudomonas aeruginosa PA01
gcgaggagccuuucacuuucagg

SEQ ID NO: 1519154 - RNA, 13 nt, Pseudomonas aeruginosa PA01
gcgaggacgccgg

SEQ ID NO: 1519155 - RNA, 15 nt, Pseudomonas aeruginosa PA01
gcgaggacgccgggc

SEQ ID NO: 1519156 - RNA, 16 nt, Pseudomonas aeruginosa PA01
gcgaggacgccgggcu

SEQ ID NO: 1519157 - RNA, 16 nt, Pseudomonas aeruginosa PA01
gcgaucaccgcgucca

SEQ ID NO: 1519158 - RNA, 15 nt, Pseudomonas aeruginosa PA01
gcgaucacggcgccc

SEQ ID NO: 1519159 - RNA, 17 nt, Pseudomonas aeruginosa PA01
gcgauaucgcaggccag

SEQ ID NO: 1519160 - RNA, 18 nt, Pseudomonas aeruginosa PA01
gcgauauucgcccuacga

SEQ ID NO: 1519161 - RNA, 19 nt, Pseudomonas aeruginosa PA01
gcgaucggguagagcgcgg

SEQ ID NO: 1519162 - RNA, 16 nt, Pseudomonas aeruginosa PA01
gcgaucugcugguuga

SEQ ID NO: 1519163 - RNA, 16 nt, Pseudomonas aeruginosa PA01
gcgaucuccgccaggc

SEQ ID NO: 1519164 - RNA, 17 nt, Pseudomonas aeruginosa PA01
gcgaucuugaucgccag

SEQ ID NO: 1519165 - RNA, 19 nt, Pseudomonas aeruginosa PA01
gcgaucuucuccgccgcgu

SEQ ID NO: 1519166 - RNA, 22 nt, Pseudomonas aeruginosa PA01
gcgaucuucuccgccgcgugcg

SEQ ID NO: 1519167 - RNA, 24 nt, Pseudomonas aeruginosa PA01
gcgaucuucagguaggcgcgggcg

SEQ ID NO: 1519168 - RNA, 19 nt, Pseudomonas aeruginosa PA01
gcgaugcccuggcuuucca

SEQ ID NO: 1519169 - RNA, 15 nt, Pseudomonas aeruginosa PA01
gcgaugccgccgggc

SEQ ID NO: 1519170 - RNA, 16 nt, Pseudomonas aeruginosa PA01
gcgaugccgccgggca

SEQ ID NO: 1519171 - RNA, 18 nt, Pseudomonas aeruginosa PA01
gcgaugccgcgccaggcg

SEQ ID NO: 1519172 - RNA, 14 nt, Pseudomonas aeruginosa PA01
gcgaugaucggcag

SEQ ID NO: 1519173 - RNA, 23 nt, Pseudomonas aeruginosa PA01
gcgaugaucggcagccguccgcc

SEQ ID NO: 1519174 - RNA, 16 nt, Pseudomonas aeruginosa PA01
gcgaugaucagcccuu

SEQ ID NO: 1519175 - RNA, 19 nt, Pseudomonas aeruginosa PA01
gcgauggcccagaugauca

SEQ ID NO: 1519176 - RNA, 17 nt, Pseudomonas aeruginosa PA01
gcgauggccgccugcag

SEQ ID NO: 1519177 - RNA, 13 nt, Pseudomonas aeruginosa PA01
gcgauggccuggu

SEQ ID NO: 1519178 - RNA, 19 nt, Pseudomonas aeruginosa PA01
gcgauggccuggucggcgc

SEQ ID NO: 1519179 - RNA, 16 nt, Pseudomonas aeruginosa PA01
gcgaugcucccgagca

SEQ ID NO: 1519180 - RNA, 20 nt, Pseudomonas aeruginosa PA01
gcgaugcgguuccuggcugg

SEQ ID NO: 1519181 - RNA, 19 nt, Pseudomonas aeruginosa PA01
gcgauggaugcgcggcagg

SEQ ID NO: 1519182 - RNA, 22 nt, Pseudomonas aeruginosa PA01
gcgaugguccccggccccgcgg

SEQ ID NO: 1519183 - RNA, 18 nt, Pseudomonas aeruginosa PA01
gcgauguagcugccggcg

SEQ ID NO: 1519184 - RNA, 19 nt, Pseudomonas aeruginosa PA01
gcgauguaggucaccgcgc

SEQ ID NO: 1519185 - RNA, 16 nt, Pseudomonas aeruginosa PA01
gcgaugggugccgcgc

SEQ ID NO: 1519186 - RNA, 14 nt, Pseudomonas aeruginosa PA01
gcgcaaaccggcag

SEQ ID NO: 1519187 - RNA, 15 nt, Pseudomonas aeruginosa PA01
gcgcaaaccggcagc

SEQ ID NO: 1519188 - RNA, 14 nt, Pseudomonas aeruginosa PA01
gcgcaaaaaaaggg

SEQ ID NO: 1519189 - RNA, 15 nt, Pseudomonas aeruginosa PA01
gcgcaaaaaaagggg

SEQ ID NO: 1519190 - RNA, 15 nt, Pseudomonas aeruginosa PA01
gcgauucgccgggcu

SEQ ID NO: 1519191 - RNA, 13 nt, Pseudomonas aeruginosa PA01
gcgauucccagug

SEQ ID NO: 1519192 - RNA, 15 nt, Pseudomonas aeruginosa PA01
gcgaugugcggcgug

SEQ ID NO: 1519193 - RNA, 15 nt, Pseudomonas aeruginosa PA01
gcgaugucgcgggca

SEQ ID NO: 1519194 - RNA, 20 nt, Pseudomonas aeruginosa PA01
gcgaugucggccugcagccu

SEQ ID NO: 1519195 - RNA, 20 nt, Pseudomonas aeruginosa PA01
gcgauguucaccgcggccuu

SEQ ID NO: 1519196 - RNA, 19 nt, Pseudomonas aeruginosa PA01
gcgauguugcgcagggugc

SEQ ID NO: 1519197 - RNA, 23 nt, Pseudomonas aeruginosa PA01
gcgaugguaguccgcugcgagca

SEQ ID NO: 1519198 - RNA, 21 nt, Pseudomonas aeruginosa PA01
gcgcaaucagggcugggcgcc

SEQ ID NO: 1519199 - RNA, 22 nt, Pseudomonas aeruginosa PA01
gcgcaaucagggcugggcgccc

SEQ ID NO: 1519200 - RNA, 21 nt, Pseudomonas aeruginosa PA01
gcgcaacugccggucggccuu

SEQ ID NO: 1519201 - RNA, 16 nt, Pseudomonas aeruginosa PA01
gcgcaacuggucgcgg

SEQ ID NO: 1519202 - RNA, 22 nt, Pseudomonas aeruginosa PA01
gcgcaagccagccaugugcucc

SEQ ID NO: 1519203 - RNA, 16 nt, Pseudomonas aeruginosa PA01
gcgcaagcgguugagu

SEQ ID NO: 1519204 - RNA, 17 nt, Pseudomonas aeruginosa PA01
gcgcaaggugccgaggu

SEQ ID NO: 1519205 - RNA, 16 nt, Pseudomonas aeruginosa PA01
gcgcaaggcagcgucc

SEQ ID NO: 1519206 - RNA, 13 nt, Pseudomonas aeruginosa PA01
gcgcaacgcgcgc

SEQ ID NO: 1519207 - RNA, 14 nt, Pseudomonas aeruginosa PA01
gcgcaacgcgcgca

SEQ ID NO: 1519208 - RNA, 17 nt, Pseudomonas aeruginosa PA01
gcgcaacgcgcgcagga

SEQ ID NO: 1519209 - RNA, 17 nt, Pseudomonas aeruginosa PA01
gcgcaaccguuccagcg

SEQ ID NO: 1519210 - RNA, 18 nt, Pseudomonas aeruginosa PA01
gcgcaaccguuccagcgc

SEQ ID NO: 1519211 - RNA, 22 nt, Pseudomonas aeruginosa PA01
gcgcaacaccuugcgcaccgcc

SEQ ID NO: 1519212 - RNA, 15 nt, Pseudomonas aeruginosa PA01
gcgcaaccagccgga

SEQ ID NO: 1519213 - RNA, 15 nt, Pseudomonas aeruginosa PA01
gcgcaaccagcgcuc

SEQ ID NO: 1519214 - RNA, 14 nt, Pseudomonas aeruginosa PA01
gcgcaacaggcgca

SEQ ID NO: 1519215 - RNA, 22 nt, Pseudomonas aeruginosa PA01
gcgcacaaaaaagcccgccagg

SEQ ID NO: 1519216 - RNA, 13 nt, Pseudomonas aeruginosa PA01
gcgcaccaccugc

SEQ ID NO: 1519217 - RNA, 17 nt, Pseudomonas aeruginosa PA01
gcgcacacggucgagac

SEQ ID NO: 1519218 - RNA, 15 nt, Pseudomonas aeruginosa PA01
gcgcaccgccaagga

SEQ ID NO: 1519219 - RNA, 14 nt, Pseudomonas aeruginosa PA01
gcgcacccgcucgg

SEQ ID NO: 1519220 - RNA, 16 nt, Pseudomonas aeruginosa PA01
gcgcaccauagcgagc

SEQ ID NO: 1519221 - RNA, 20 nt, Pseudomonas aeruginosa PA01
gcgcaccauagcgagccgcg

SEQ ID NO: 1519222 - RNA, 22 nt, Pseudomonas aeruginosa PA01
gcgcaccauagcgagccgcgcu

SEQ ID NO: 1519223 - RNA, 14 nt, Pseudomonas aeruginosa PA01
gcgcaccagcaggc

SEQ ID NO: 1519224 - RNA, 15 nt, Pseudomonas aeruginosa PA01
gcgcaccagcaggcg

SEQ ID NO: 1519225 - RNA, 14 nt, Pseudomonas aeruginosa PA01
gcgcaccaggccag

SEQ ID NO: 1519226 - RNA, 16 nt, Pseudomonas aeruginosa PA01
gcgcacaugccgagcg

SEQ ID NO: 1519227 - RNA, 14 nt, Pseudomonas aeruginosa PA01
gcgcaccacugcaa

SEQ ID NO: 1519228 - RNA, 20 nt, Pseudomonas aeruginosa PA01
gcgcaccagggccaggagca

SEQ ID NO: 1519229 - RNA, 17 nt, Pseudomonas aeruginosa PA01
gcgcaccagggucgggc

SEQ ID NO: 1519230 - RNA, 22 nt, Pseudomonas aeruginosa PA01
gcgcaguucgucuuccagcggc

SEQ ID NO: 1519231 - RNA, 13 nt, Pseudomonas aeruginosa PA01
gcgcaguucgccg

SEQ ID NO: 1519232 - RNA, 17 nt, Pseudomonas aeruginosa PA01
gcgcaguucgccgccga

SEQ ID NO: 1519233 - RNA, 20 nt, Pseudomonas aeruginosa PA01
gcgcaguucgccgccgagcg

SEQ ID NO: 1519234 - RNA, 22 nt, Pseudomonas aeruginosa PA01
gcgcaguucgccgccgagcgcc

SEQ ID NO: 1519235 - RNA, 19 nt, Pseudomonas aeruginosa PA01
gcgcaguccgguagcgcgc

SEQ ID NO: 1519236 - RNA, 14 nt, Pseudomonas aeruginosa PA01
gcgcagugccugcu

SEQ ID NO: 1519237 - RNA, 22 nt, Pseudomonas aeruginosa PA01
gcgcaguacgaucagccagggc

SEQ ID NO: 1519238 - RNA, 14 nt, Pseudomonas aeruginosa PA01
gcgcaguaggcgcu

SEQ ID NO: 1519239 - RNA, 14 nt, Pseudomonas aeruginosa PA01
gcgcaggucggccu

SEQ ID NO: 1519240 - RNA, 21 nt, Pseudomonas aeruginosa PA01
gcgcaggugcaccgcgcugga

SEQ ID NO: 1519241 - RNA, 16 nt, Pseudomonas aeruginosa PA01
gcgcagguacucgccg

SEQ ID NO: 1519242 - RNA, 18 nt, Pseudomonas aeruginosa PA01
gcgcagguacucgccggc

SEQ ID NO: 1519243 - RNA, 15 nt, Pseudomonas aeruginosa PA01
gcgcagguagcggcg

SEQ ID NO: 1519244 - RNA, 14 nt, Pseudomonas aeruginosa PA01
gcgcaggcugucgg

SEQ ID NO: 1519245 - RNA, 19 nt, Pseudomonas aeruginosa PA01
gcgcaggcugucggccagc

SEQ ID NO: 1519246 - RNA, 16 nt, Pseudomonas aeruginosa PA01
gcgcagggccagcaac

SEQ ID NO: 1519247 - RNA, 18 nt, Pseudomonas aeruginosa PA01
gcgcagggccgcggcguu

SEQ ID NO: 1519248 - RNA, 14 nt, Pseudomonas aeruginosa PA01
gcgcagggcggcga

SEQ ID NO: 1519249 - RNA, 16 nt, Pseudomonas aeruginosa PA01
gcgcagggcggcgagc

SEQ ID NO: 1519250 - RNA, 17 nt, Pseudomonas aeruginosa PA01
gcgcagggucaggcccu

SEQ ID NO: 1519251 - RNA, 16 nt, Pseudomonas aeruginosa PA01
gcgcaggcgaggaugg

SEQ ID NO: 1519252 - RNA, 15 nt, Pseudomonas aeruginosa PA01
gcgcaggggcgcgcc

SEQ ID NO: 1519253 - RNA, 14 nt, Pseudomonas aeruginosa PA01
gcgcaggccgggcg

SEQ ID NO: 1519254 - RNA, 18 nt, Pseudomonas aeruginosa PA01
gcgcaggccgccggcggc

SEQ ID NO: 1519255 - RNA, 15 nt, Pseudomonas aeruginosa PA01
gcgcaggcggcuggc

SEQ ID NO: 1519256 - RNA, 16 nt, Pseudomonas aeruginosa PA01
gcgcaggcggcuggcg

SEQ ID NO: 1519257 - RNA, 19 nt, Pseudomonas aeruginosa PA01
gcgcaggcgcuggcgggcg

SEQ ID NO: 1519258 - RNA, 20 nt, Pseudomonas aeruginosa PA01
gcgcaggcggaucgcccggc

SEQ ID NO: 1519259 - RNA, 11 nt, Pseudomonas aeruginosa PA01
gcgcaggcugg

SEQ ID NO: 1519260 - RNA, 20 nt, Pseudomonas aeruginosa PA01
gcgcaggcuggccgagcgcc

SEQ ID NO: 1519261 - RNA, 14 nt, Pseudomonas aeruginosa PA01
gcgcaggcgggcgg

SEQ ID NO: 1519262 - RNA, 17 nt, Pseudomonas aeruginosa PA01
gcgcaggcgggcggcgu

SEQ ID NO: 1519263 - RNA, 17 nt, Pseudomonas aeruginosa PA01
gcgcagccguccaucug

SEQ ID NO: 1519264 - RNA, 18 nt, Pseudomonas aeruginosa PA01
gcgcagccucgcgcucgg

SEQ ID NO: 1519265 - RNA, 16 nt, Pseudomonas aeruginosa PA01
gcgcagccgcugggcc

SEQ ID NO: 1519266 - RNA, 14 nt, Pseudomonas aeruginosa PA01
gcgcagccugcugg

SEQ ID NO: 1519267 - RNA, 18 nt, Pseudomonas aeruginosa PA01
gcgcagccugcuggccug

SEQ ID NO: 1519268 - RNA, 15 nt, Pseudomonas aeruginosa PA01
gcgcagcgccgccgc

SEQ ID NO: 1519269 - RNA, 11 nt, Pseudomonas aeruginosa PA01
gcgcagcggcg

SEQ ID NO: 1519270 - RNA, 12 nt, Pseudomonas aeruginosa PA01
gcgcagcggcgc

SEQ ID NO: 1519271 - RNA, 13 nt, Pseudomonas aeruginosa PA01
gcgcagcggcgcc

SEQ ID NO: 1519272 - RNA, 17 nt, Pseudomonas aeruginosa PA01
gcgcagcggcgccgagg

SEQ ID NO: 1519273 - RNA, 18 nt, Pseudomonas aeruginosa PA01
gcgcagcgguacaggcgg

SEQ ID NO: 1519274 - RNA, 18 nt, Pseudomonas aeruginosa PA01
gcgcagcgguaguucagu

SEQ ID NO: 1519275 - RNA, 13 nt, Pseudomonas aeruginosa PA01
gcgcagcggcagg

SEQ ID NO: 1519276 - RNA, 16 nt, Pseudomonas aeruginosa PA01
gcgcagcggcaggcca

SEQ ID NO: 1519277 - RNA, 13 nt, Pseudomonas aeruginosa PA01
gcgcagcgcggcg

SEQ ID NO: 1519278 - RNA, 15 nt, Pseudomonas aeruginosa PA01
gcgcagcgcggcgcu

SEQ ID NO: 1519279 - RNA, 21 nt, Pseudomonas aeruginosa PA01
gcgcaggauguugaacaggcu

SEQ ID NO: 1519280 - RNA, 22 nt, Pseudomonas aeruginosa PA01
gcgcagcuugccuuccaggcug

SEQ ID NO: 1519281 - RNA, 15 nt, Pseudomonas aeruginosa PA01
gcgcagcguccugcc

SEQ ID NO: 1519282 - RNA, 17 nt, Pseudomonas aeruginosa PA01
gcgcagcuucugcaggg

SEQ ID NO: 1519283 - RNA, 14 nt, Pseudomonas aeruginosa PA01
gcgcaggaagaagg

SEQ ID NO: 1519284 - RNA, 20 nt, Pseudomonas aeruginosa PA01
gcgcaggaagcugcgcucgg

SEQ ID NO: 1519285 - RNA, 16 nt, Pseudomonas aeruginosa PA01
gcgcaggaccacgcug

SEQ ID NO: 1519286 - RNA, 22 nt, Pseudomonas aeruginosa PA01
gcgcaggacgaggaaggcgcgc

SEQ ID NO: 1519287 - RNA, 23 nt, Pseudomonas aeruginosa PA01
gcgcaggacggauaacggcagcc

SEQ ID NO: 1519288 - RNA, 17 nt, Pseudomonas aeruginosa PA01
gcgcagcuaggcgagga

SEQ ID NO: 1519289 - RNA, 13 nt, Pseudomonas aeruginosa PA01
gcgcagcggcucc

SEQ ID NO: 1519290 - RNA, 16 nt, Pseudomonas aeruginosa PA01
gcgcagcuccggcagc

SEQ ID NO: 1519291 - RNA, 17 nt, Pseudomonas aeruginosa PA01
gcgcagcuccggcagca

SEQ ID NO: 1519292 - RNA, 16 nt, Pseudomonas aeruginosa PA01
gcgcagaugaucgcca

SEQ ID NO: 1519293 - RNA, 16 nt, Pseudomonas aeruginosa PA01
gcgcagaucgcggcgc

SEQ ID NO: 1519294 - RNA, 21 nt, Pseudomonas aeruginosa PA01
gcgcagaucgcggcgcaggcu

SEQ ID NO: 1519295 - RNA, 22 nt, Pseudomonas aeruginosa PA01
gcgcagaucgcggcgcaggcug

SEQ ID NO: 1519296 - RNA, 13 nt, Pseudomonas aeruginosa PA01
gcgcagaucgccg

SEQ ID NO: 1519297 - RNA, 22 nt, Pseudomonas aeruginosa PA01
gcgcagacaggccuccagcaac

SEQ ID NO: 1519298 - RNA, 15 nt, Pseudomonas aeruginosa PA01
gcgcagaccaucagc

SEQ ID NO: 1519299 - RNA, 19 nt, Pseudomonas aeruginosa PA01
gcgcagagcggugaaaccg

SEQ ID NO: 1519300 - RNA, 13 nt, Pseudomonas aeruginosa PA01
gcgcagaggcgcu

SEQ ID NO: 1519301 - RNA, 19 nt, Pseudomonas aeruginosa PA01
gcgcagcaacuggucgccg

SEQ ID NO: 1519302 - RNA, 13 nt, Pseudomonas aeruginosa PA01
gcgcagccacccg

SEQ ID NO: 1519303 - RNA, 13 nt, Pseudomonas aeruginosa PA01
gcgcagccaggcg

SEQ ID NO: 1519304 - RNA, 13 nt, Pseudomonas aeruginosa PA01
gcgcagccagagc

SEQ ID NO: 1519305 - RNA, 13 nt, Pseudomonas aeruginosa PA01
gcgcagccagcac

SEQ ID NO: 1519306 - RNA, 19 nt, Pseudomonas aeruginosa PA01
gcgcagccgcucggccgcc

SEQ ID NO: 1519307 - RNA, 17 nt, Pseudomonas aeruginosa PA01
gcgcagcccagccgcuc

SEQ ID NO: 1519308 - RNA, 17 nt, Pseudomonas aeruginosa PA01
gcgcagcaucuucucgg

SEQ ID NO: 1519309 - RNA, 17 nt, Pseudomonas aeruginosa PA01
gcgcagcagggcgucgg

SEQ ID NO: 1519310 - RNA, 16 nt, Pseudomonas aeruginosa PA01
gcgcagcagguagugc

SEQ ID NO: 1519311 - RNA, 12 nt, Pseudomonas aeruginosa PA01
gcgcagcagggc

SEQ ID NO: 1519312 - RNA, 21 nt, Pseudomonas aeruginosa PA01
gcgcagcagcgucgcgucggc

SEQ ID NO: 1519313 - RNA, 14 nt, Pseudomonas aeruginosa PA01
gcgcagcaggcggc

SEQ ID NO: 1519314 - RNA, 16 nt, Pseudomonas aeruginosa PA01
gcgcagcaggcggccc

SEQ ID NO: 1519315 - RNA, 18 nt, Pseudomonas aeruginosa PA01
gcgcaccuguuucagcgg

SEQ ID NO: 1519316 - RNA, 13 nt, Pseudomonas aeruginosa PA01
gcgcaccuccuug

SEQ ID NO: 1519317 - RNA, 20 nt, Pseudomonas aeruginosa PA01
gcgcacgccguggaccagga

SEQ ID NO: 1519318 - RNA, 15 nt, Pseudomonas aeruginosa PA01
gcgcacgccggccuc

SEQ ID NO: 1519319 - RNA, 22 nt, Pseudomonas aeruginosa PA01
gcgcacgcaauggcgcagccgc

SEQ ID NO: 1519320 - RNA, 23 nt, Pseudomonas aeruginosa PA01
gcgcacgcaauggcgcagccgcu

SEQ ID NO: 1519321 - RNA, 24 nt, Pseudomonas aeruginosa PA01
gcgcaccuuggcuugcagguagcu

SEQ ID NO: 1519322 - RNA, 15 nt, Pseudomonas aeruginosa PA01
gcgcacugccaggag

SEQ ID NO: 1519323 - RNA, 16 nt, Pseudomonas aeruginosa PA01
gcgcacugccaggagc

SEQ ID NO: 1519324 - RNA, 20 nt, Pseudomonas aeruginosa PA01
gcgcacugccaggagcacgc

SEQ ID NO: 1519325 - RNA, 10 nt, Pseudomonas aeruginosa PA01
gcgcacugcg

SEQ ID NO: 1519326 - RNA, 19 nt, Pseudomonas aeruginosa PA01
gcgcagaacugccgggcca

SEQ ID NO: 1519327 - RNA, 13 nt, Pseudomonas aeruginosa PA01
gcgcacggucucc

SEQ ID NO: 1519328 - RNA, 14 nt, Pseudomonas aeruginosa PA01
gcgcacggaggcgc

SEQ ID NO: 1519329 - RNA, 17 nt, Pseudomonas aeruginosa PA01
gcgccaccgcgacgcgc

SEQ ID NO: 1519330 - RNA, 14 nt, Pseudomonas aeruginosa PA01
gcgccacgcaggaa

SEQ ID NO: 1519331 - RNA, 21 nt, Pseudomonas aeruginosa PA01
gcgccacgcaggaacagcucc

SEQ ID NO: 1519332 - RNA, 19 nt, Pseudomonas aeruginosa PA01
gcgccaccaccgucacggc

SEQ ID NO: 1519333 - RNA, 20 nt, Pseudomonas aeruginosa PA01
gcgccaccagcguggcgcgc

SEQ ID NO: 1519334 - RNA, 16 nt, Pseudomonas aeruginosa PA01
gcgccaccagcagggc

SEQ ID NO: 1519335 - RNA, 20 nt, Pseudomonas aeruginosa PA01
gcgccaccagcagggccagg

SEQ ID NO: 1519336 - RNA, 21 nt, Pseudomonas aeruginosa PA01
gcgccaccagcagggccaggc

SEQ ID NO: 1519337 - RNA, 22 nt, Pseudomonas aeruginosa PA01
gcgccaccagcagggccaggcc

SEQ ID NO: 1519338 - RNA, 15 nt, Pseudomonas aeruginosa PA01
gcgccaccagcaugc

SEQ ID NO: 1519339 - RNA, 17 nt, Pseudomonas aeruginosa PA01
gcgccacggccagcagg

SEQ ID NO: 1519340 - RNA, 18 nt, Pseudomonas aeruginosa PA01
gcgccacggcgaucgccg

SEQ ID NO: 1519341 - RNA, 21 nt, Pseudomonas aeruginosa PA01
gcgccacgcgagaagccgccc

SEQ ID NO: 1519342 - RNA, 20 nt, Pseudomonas aeruginosa PA01
gcgccacgcgcaucgugcag

SEQ ID NO: 1519343 - RNA, 17 nt, Pseudomonas aeruginosa PA01
gcgccacgggcagaccu

SEQ ID NO: 1519344 - RNA, 22 nt, Pseudomonas aeruginosa PA01
gcgccacgcugaucaucagcag

SEQ ID NO: 1519345 - RNA, 14 nt, Pseudomonas aeruginosa PA01
gcgccagagcgcgc

SEQ ID NO: 1519346 - RNA, 15 nt, Pseudomonas aeruginosa PA01
gcgccacuuccagcu

SEQ ID NO: 1519347 - RNA, 13 nt, Pseudomonas aeruginosa PA01
gcgccagcggcag

SEQ ID NO: 1519348 - RNA, 20 nt, Pseudomonas aeruginosa PA01
gcgccagcggcccggcaggc

SEQ ID NO: 1519349 - RNA, 23 nt, Pseudomonas aeruginosa PA01
gcgccagcggcccggcaggcgca

SEQ ID NO: 1519350 - RNA, 15 nt, Pseudomonas aeruginosa PA01
gcgccagcgccgcca

SEQ ID NO: 1519351 - RNA, 15 nt, Pseudomonas aeruginosa PA01
gcgccagcgccccac

SEQ ID NO: 1519352 - RNA, 21 nt, Pseudomonas aeruginosa PA01
gcgccagccuacugggcgugg

SEQ ID NO: 1519353 - RNA, 21 nt, Pseudomonas aeruginosa PA01
gcgccagcgagacgggcgagg

SEQ ID NO: 1519354 - RNA, 18 nt, Pseudomonas aeruginosa PA01
gcgccagccccaggcgcg

SEQ ID NO: 1519355 - RNA, 16 nt, Pseudomonas aeruginosa PA01
gcgccagccgacuggc

SEQ ID NO: 1519356 - RNA, 18 nt, Pseudomonas aeruginosa PA01
gcgccagcacggcgcagg

SEQ ID NO: 1519357 - RNA, 23 nt, Pseudomonas aeruginosa PA01
gcgccagcacggcgcagggcauc

SEQ ID NO: 1519358 - RNA, 14 nt, Pseudomonas aeruginosa PA01
gcgccagcaccagc

SEQ ID NO: 1519359 - RNA, 17 nt, Pseudomonas aeruginosa PA01
gcgccagcaccagcagg

SEQ ID NO: 1519360 - RNA, 18 nt, Pseudomonas aeruginosa PA01
gcgccagccacucccggc

SEQ ID NO: 1519361 - RNA, 12 nt, Pseudomonas aeruginosa PA01
gcgccagccagc

SEQ ID NO: 1519362 - RNA, 13 nt, Pseudomonas aeruginosa PA01
gcgccagccagcc

SEQ ID NO: 1519363 - RNA, 15 nt, Pseudomonas aeruginosa PA01
gcgccagccagcccg

SEQ ID NO: 1519364 - RNA, 17 nt, Pseudomonas aeruginosa PA01
gcgccagccagcccggc

SEQ ID NO: 1519365 - RNA, 14 nt, Pseudomonas aeruginosa PA01
gcgccagccagcgc

SEQ ID NO: 1519366 - RNA, 11 nt, Pseudomonas aeruginosa PA01
gcgccagcagg

SEQ ID NO: 1519367 - RNA, 18 nt, Pseudomonas aeruginosa PA01
gcgccagcaggcgcagca

SEQ ID NO: 1519368 - RNA, 20 nt, Pseudomonas aeruginosa PA01
gcgccagcaucgcaucggcg

SEQ ID NO: 1519369 - RNA, 22 nt, Pseudomonas aeruginosa PA01
gcgccacacggcuaucagguga

SEQ ID NO: 1519370 - RNA, 20 nt, Pseudomonas aeruginosa PA01
gcgccaagguuccagccccg

SEQ ID NO: 1519371 - RNA, 21 nt, Pseudomonas aeruginosa PA01
gcgccaaccgggcagcagccg

SEQ ID NO: 1519372 - RNA, 14 nt, Pseudomonas aeruginosa PA01
gcgcauggcggcga

SEQ ID NO: 1519373 - RNA, 14 nt, Pseudomonas aeruginosa PA01
gcgcauggcgaccu

SEQ ID NO: 1519374 - RNA, 22 nt, Pseudomonas aeruginosa PA01
gcgcauggcgaccugguggcgc

SEQ ID NO: 1519375 - RNA, 15 nt, Pseudomonas aeruginosa PA01
gcgcauagcaggccu

SEQ ID NO: 1519376 - RNA, 22 nt, Pseudomonas aeruginosa PA01
gcgcauagcaggccuggagcgc

SEQ ID NO: 1519377 - RNA, 16 nt, Pseudomonas aeruginosa PA01
gcgcaguugccaggau

SEQ ID NO: 1519378 - RNA, 13 nt, Pseudomonas aeruginosa PA01
gcgcauaaccgcu

SEQ ID NO: 1519379 - RNA, 21 nt, Pseudomonas aeruginosa PA01
gcgcaucaggccaaagccgca

SEQ ID NO: 1519380 - RNA, 16 nt, Pseudomonas aeruginosa PA01
gcgcaucgaggccggc

SEQ ID NO: 1519381 - RNA, 16 nt, Pseudomonas aeruginosa PA01
gcgcaucggcgccucc

SEQ ID NO: 1519382 - RNA, 19 nt, Pseudomonas aeruginosa PA01
gcgcaucgccugggccggc

SEQ ID NO: 1519383 - RNA, 20 nt, Pseudomonas aeruginosa PA01
gcgcaucgugcagccagacc

SEQ ID NO: 1519384 - RNA, 16 nt, Pseudomonas aeruginosa PA01
gcgcaugaggccuggu

SEQ ID NO: 1519385 - RNA, 19 nt, Pseudomonas aeruginosa PA01
gcgcaucuggugcgcgucc

SEQ ID NO: 1519386 - RNA, 17 nt, Pseudomonas aeruginosa PA01
gcgcaugcagggcgucc

SEQ ID NO: 1519387 - RNA, 15 nt, Pseudomonas aeruginosa PA01
gcgcaugcgccggcu

SEQ ID NO: 1519388 - RNA, 21 nt, Pseudomonas aeruginosa PA01
gcgcauggagacggcccgccc

SEQ ID NO: 1519389 - RNA, 14 nt, Pseudomonas aeruginosa PA01
gcgcaugcccgcgu

SEQ ID NO: 1519390 - RNA, 13 nt, Pseudomonas aeruginosa PA01
gcgcaugcugggu

SEQ ID NO: 1519391 - RNA, 23 nt, Pseudomonas aeruginosa PA01
gcgcaugcugggucuccgcucgg

SEQ ID NO: 1519392 - RNA, 17 nt, Pseudomonas aeruginosa PA01
gccggaaagccuggccg

SEQ ID NO: 1519393 - RNA, 20 nt, Pseudomonas aeruginosa PA01
gccggaaagccuggccggcg

SEQ ID NO: 1519394 - RNA, 15 nt, Pseudomonas aeruginosa PA01
gccgucaccagcagc

SEQ ID NO: 1519395 - RNA, 16 nt, Pseudomonas aeruginosa PA01
gccgucaccagcagcc

SEQ ID NO: 1519396 - RNA, 22 nt, Pseudomonas aeruginosa PA01
gccgucaccagcagccccgagg

SEQ ID NO: 1519397 - RNA, 20 nt, Pseudomonas aeruginosa PA01
gccgcuuggagcgggcgccg

SEQ ID NO: 1519398 - RNA, 19 nt, Pseudomonas aeruginosa PA01
gccgcuugaucuuguccug

SEQ ID NO: 1519399 - RNA, 15 nt, Pseudomonas aeruginosa PA01
gccgcuuacccaggu

SEQ ID NO: 1519400 - RNA, 15 nt, Pseudomonas aeruginosa PA01
gccgcuuacgcggcc

SEQ ID NO: 1519401 - RNA, 16 nt, Pseudomonas aeruginosa PA01
gccgcuuccgccaggc

SEQ ID NO: 1519402 - RNA, 20 nt, Pseudomonas aeruginosa PA01
gccgcuuccgccaggcgcag

SEQ ID NO: 1519403 - RNA, 16 nt, Pseudomonas aeruginosa PA01
gccgcuucgcgguaga

SEQ ID NO: 1519404 - RNA, 13 nt, Pseudomonas aeruginosa PA01
gccgcuucuuccc

SEQ ID NO: 1519405 - RNA, 15 nt, Pseudomonas aeruginosa PA01
gccgcuucgccgccc

SEQ ID NO: 1519406 - RNA, 16 nt, Pseudomonas aeruginosa PA01
gccgcuucgccgcccu

SEQ ID NO: 1519407 - RNA, 14 nt, Pseudomonas aeruginosa PA01
gccgucgggcuucg

SEQ ID NO: 1519408 - RNA, 17 nt, Pseudomonas aeruginosa PA01
gccgucgggcauggcga

SEQ ID NO: 1519409 - RNA, 15 nt, Pseudomonas aeruginosa PA01
gccgucgcgccgcgg

SEQ ID NO: 1519410 - RNA, 16 nt, Pseudomonas aeruginosa PA01
gccgucgcgccgcgga

SEQ ID NO: 1519411 - RNA, 23 nt, Pseudomonas aeruginosa PA01
gccgucggcgaucgccaguuccg

SEQ ID NO: 1519412 - RNA, 14 nt, Pseudomonas aeruginosa PA01
gccguccgcgggcg

SEQ ID NO: 1519413 - RNA, 17 nt, Pseudomonas aeruginosa PA01
gccguccaguucuucca

SEQ ID NO: 1519414 - RNA, 17 nt, Pseudomonas aeruginosa PA01
gccgucacggccuccgg

SEQ ID NO: 1519415 - RNA, 21 nt, Pseudomonas aeruginosa PA01
gccguccugcaacugcucgau

SEQ ID NO: 1519416 - RNA, 18 nt, Pseudomonas aeruginosa PA01
gccguccugcggccgcaa

SEQ ID NO: 1519417 - RNA, 23 nt, Pseudomonas aeruginosa PA01
gccguccuugaguagcuggcgca

SEQ ID NO: 1519418 - RNA, 15 nt, Pseudomonas aeruginosa PA01
gccguccgucggcag

SEQ ID NO: 1519419 - RNA, 15 nt, Pseudomonas aeruginosa PA01
gccgucccagucggc

SEQ ID NO: 1519420 - RNA, 18 nt, Pseudomonas aeruginosa PA01
gccguccuucaggacgaa

SEQ ID NO: 1519421 - RNA, 15 nt, Pseudomonas aeruginosa PA01
gccguuggccagcag

SEQ ID NO: 1519422 - RNA, 16 nt, Pseudomonas aeruginosa PA01
gccguuggcgucgcgc

SEQ ID NO: 1519423 - RNA, 19 nt, Pseudomonas aeruginosa PA01
gccguuguugaccgcagga

SEQ ID NO: 1519424 - RNA, 20 nt, Pseudomonas aeruginosa PA01
gccguuguagaucggcagca

SEQ ID NO: 1519425 - RNA, 14 nt, Pseudomonas aeruginosa PA01
gccuacuugaucag

SEQ ID NO: 1519426 - RNA, 18 nt, Pseudomonas aeruginosa PA01
gccguggaucgcccggcu

SEQ ID NO: 1519427 - RNA, 19 nt, Pseudomonas aeruginosa PA01
gccguggaucgcccggcug

SEQ ID NO: 1519428 - RNA, 14 nt, Pseudomonas aeruginosa PA01
gccguggcaccagg

SEQ ID NO: 1519429 - RNA, 14 nt, Pseudomonas aeruginosa PA01
gccguggcacccag

SEQ ID NO: 1519430 - RNA, 19 nt, Pseudomonas aeruginosa PA01
gccguggcacccaggccac

SEQ ID NO: 1519431 - RNA, 16 nt, Pseudomonas aeruginosa PA01
gccguucgcccgcggc

SEQ ID NO: 1519432 - RNA, 13 nt, Pseudomonas aeruginosa PA01
gccguugcggccc

SEQ ID NO: 1519433 - RNA, 15 nt, Pseudomonas aeruginosa PA01
gccgugcgcuccgcc

SEQ ID NO: 1519434 - RNA, 14 nt, Pseudomonas aeruginosa PA01
gccucccgccgcgg

SEQ ID NO: 1519435 - RNA, 15 nt, Pseudomonas aeruginosa PA01
gccucccgccgcggc

SEQ ID NO: 1519436 - RNA, 18 nt, Pseudomonas aeruginosa PA01
gccuccccggcccgcgcc

SEQ ID NO: 1519437 - RNA, 22 nt, Pseudomonas aeruginosa PA01
gccuccccggcccgcgccgccu

SEQ ID NO: 1519438 - RNA, 22 nt, Pseudomonas aeruginosa PA01
gccuccagcgucugccgcuggc

SEQ ID NO: 1519439 - RNA, 13 nt, Pseudomonas aeruginosa PA01
gccuccagcgggc

SEQ ID NO: 1519440 - RNA, 12 nt, Pseudomonas aeruginosa PA01
gccuccagcgcc

SEQ ID NO: 1519441 - RNA, 14 nt, Pseudomonas aeruginosa PA01
gccuccagcgccgc

SEQ ID NO: 1519442 - RNA, 16 nt, Pseudomonas aeruginosa PA01
gccuccagcgccgccu

SEQ ID NO: 1519443 - RNA, 16 nt, Pseudomonas aeruginosa PA01
gccuccagcgccuggc

SEQ ID NO: 1519444 - RNA, 19 nt, Pseudomonas aeruginosa PA01
gccuccaggaauccuccgc

SEQ ID NO: 1519445 - RNA, 21 nt, Pseudomonas aeruginosa PA01
gccuccaggaauccuccgcca

SEQ ID NO: 1519446 - RNA, 23 nt, Pseudomonas aeruginosa PA01
gccuccaggaauccuccgccagc

SEQ ID NO: 1519447 - RNA, 14 nt, Pseudomonas aeruginosa PA01
gccuccaggcgcgc

SEQ ID NO: 1519448 - RNA, 14 nt, Pseudomonas aeruginosa PA01
gccuccucggcggc

SEQ ID NO: 1519449 - RNA, 16 nt, Pseudomonas aeruginosa PA01
gccuccucggcggccu

SEQ ID NO: 1519450 - RNA, 22 nt, Pseudomonas aeruginosa PA01
gccuccucguaggcguccuggc

SEQ ID NO: 1519451 - RNA, 16 nt, Pseudomonas aeruginosa PA01
gccuccuccggcucgc

SEQ ID NO: 1519452 - RNA, 18 nt, Pseudomonas aeruginosa PA01
gccuccgcucugcuggcc

SEQ ID NO: 1519453 - RNA, 21 nt, Pseudomonas aeruginosa PA01
gccuccgcucugcuggccacc

SEQ ID NO: 1519454 - RNA, 22 nt, Pseudomonas aeruginosa PA01
gccuccgcucugcuggccaccc

SEQ ID NO: 1519455 - RNA, 23 nt, Pseudomonas aeruginosa PA01
gccuccgcucugcuggccacccu

SEQ ID NO: 1519456 - RNA, 13 nt, Pseudomonas aeruginosa PA01
gccuccggcacgc

SEQ ID NO: 1519457 - RNA, 21 nt, Pseudomonas aeruginosa PA01
gccuccggcacgcugccgccg

SEQ ID NO: 1519458 - RNA, 20 nt, Pseudomonas aeruginosa PA01
gccucgaaggccggcaaagu

SEQ ID NO: 1519459 - RNA, 15 nt, Pseudomonas aeruginosa PA01
gccucgaaggucagc

SEQ ID NO: 1519460 - RNA, 20 nt, Pseudomonas aeruginosa PA01
gccuccuucaucuuggccca

SEQ ID NO: 1519461 - RNA, 18 nt, Pseudomonas aeruginosa PA01
gccuccucuaccaggcgg

SEQ ID NO: 1519462 - RNA, 20 nt, Pseudomonas aeruginosa PA01
gccuccagcaacgccgcccc

SEQ ID NO: 1519463 - RNA, 19 nt, Pseudomonas aeruginosa PA01
gccuccagcacucgcuccu

SEQ ID NO: 1519464 - RNA, 22 nt, Pseudomonas aeruginosa PA01
gccuccacccgcgaagccugcu

SEQ ID NO: 1519465 - RNA, 16 nt, Pseudomonas aeruginosa PA01
gccucacccugcuggg

SEQ ID NO: 1519466 - RNA, 19 nt, Pseudomonas aeruginosa PA01
gccucacccugcugggcgg

SEQ ID NO: 1519467 - RNA, 17 nt, Pseudomonas aeruginosa PA01
gccucagcggcuggcga

SEQ ID NO: 1519468 - RNA, 19 nt, Pseudomonas aeruginosa PA01
gccucaggccuggcgcaac

SEQ ID NO: 1519469 - RNA, 17 nt, Pseudomonas aeruginosa PA01
gccucagggcgcgaagu

SEQ ID NO: 1519470 - RNA, 16 nt, Pseudomonas aeruginosa PA01
gccucaggcgcugcgc

SEQ ID NO: 1519471 - RNA, 19 nt, Pseudomonas aeruginosa PA01
gccucaggcgcugcgcggc

SEQ ID NO: 1519472 - RNA, 20 nt, Pseudomonas aeruginosa PA01
gccucgaggucggccuggcu

SEQ ID NO: 1519473 - RNA, 16 nt, Pseudomonas aeruginosa PA01
gccucgaucucguccu

SEQ ID NO: 1519474 - RNA, 22 nt, Pseudomonas aeruginosa PA01
gccucgcaauugaucauccagg

SEQ ID NO: 1519475 - RNA, 20 nt, Pseudomonas aeruginosa PA01
gccucgcagagcgccagcca

SEQ ID NO: 1519476 - RNA, 21 nt, Pseudomonas aeruginosa PA01
gccucgaccaucggcggcggc

SEQ ID NO: 1519477 - RNA, 23 nt, Pseudomonas aeruginosa PA01
gccucgaccaucggcggcggccc

SEQ ID NO: 1519478 - RNA, 15 nt, Pseudomonas aeruginosa PA01
gccucgaggaacagg

SEQ ID NO: 1519479 - RNA, 18 nt, Pseudomonas aeruginosa PA01
gccucgacgcagagcgcc

SEQ ID NO: 1519480 - RNA, 13 nt, Pseudomonas aeruginosa PA01
gccucgaccuggc

SEQ ID NO: 1519481 - RNA, 15 nt, Pseudomonas aeruginosa PA01
gccucgaccuggcca

SEQ ID NO: 1519482 - RNA, 19 nt, Pseudomonas aeruginosa PA01
gccucgaccuggccacgcc

SEQ ID NO: 1519483 - RNA, 22 nt, Pseudomonas aeruginosa PA01
gccucgacgagguugcucuggg

SEQ ID NO: 1519484 - RNA, 15 nt, Pseudomonas aeruginosa PA01
gccucgccaaccagg

SEQ ID NO: 1519485 - RNA, 13 nt, Pseudomonas aeruginosa PA01
gccucgccccaga

SEQ ID NO: 1519486 - RNA, 16 nt, Pseudomonas aeruginosa PA01
gccucgccccagaccc

SEQ ID NO: 1519487 - RNA, 20 nt, Pseudomonas aeruginosa PA01
gccucgccccagacccaggu

SEQ ID NO: 1519488 - RNA, 18 nt, Pseudomonas aeruginosa PA01
gccucgccgagcauccag

SEQ ID NO: 1519489 - RNA, 12 nt, Pseudomonas aeruginosa PA01
gccucgccggcc

SEQ ID NO: 1519490 - RNA, 14 nt, Pseudomonas aeruginosa PA01
gccucgcgccagag

SEQ ID NO: 1519491 - RNA, 21 nt, Pseudomonas aeruginosa PA01
gccucgcgcguggccgccagg

SEQ ID NO: 1519492 - RNA, 14 nt, Pseudomonas aeruginosa PA01
gccucgcggcgcuc

SEQ ID NO: 1519493 - RNA, 17 nt, Pseudomonas aeruginosa PA01
gccucgcggaccucggg

SEQ ID NO: 1519494 - RNA, 18 nt, Pseudomonas aeruginosa PA01
gccucgcgcucggcggcc

SEQ ID NO: 1519495 - RNA, 19 nt, Pseudomonas aeruginosa PA01
gccucgcgcucggcggccu

SEQ ID NO: 1519496 - RNA, 21 nt, Pseudomonas aeruginosa PA01
gccucggcauccucgccccgc

SEQ ID NO: 1519497 - RNA, 18 nt, Pseudomonas aeruginosa PA01
gccucggcaucgaccagg

SEQ ID NO: 1519498 - RNA, 15 nt, Pseudomonas aeruginosa PA01
gccucggccagcgcc

SEQ ID NO: 1519499 - RNA, 16 nt, Pseudomonas aeruginosa PA01
gccucggccaucgagc

SEQ ID NO: 1519500 - RNA, 21 nt, Pseudomonas aeruginosa PA01
gccucggcggacagcccgcgc

SEQ ID NO: 1519501 - RNA, 21 nt, Pseudomonas aeruginosa PA01
gccucgggccaugagcagggc

SEQ ID NO: 1519502 - RNA, 12 nt, Pseudomonas aeruginosa PA01
gccucggcggcg

SEQ ID NO: 1519503 - RNA, 23 nt, Pseudomonas aeruginosa PA01
gccucggcggcgcgaaccagcag

SEQ ID NO: 1519504 - RNA, 18 nt, Pseudomonas aeruginosa PA01
gccucgcguucgcggucg

SEQ ID NO: 1519505 - RNA, 12 nt, Pseudomonas aeruginosa PA01
gccucgcuggcg

SEQ ID NO: 1519506 - RNA, 19 nt, Pseudomonas aeruginosa PA01
gccucggcagggcgcccgc

SEQ ID NO: 1519507 - RNA, 18 nt, Pseudomonas aeruginosa PA01
gccucggagaacagcagc

SEQ ID NO: 1519508 - RNA, 13 nt, Pseudomonas aeruginosa PA01
gccucgcuggcga

SEQ ID NO: 1519509 - RNA, 20 nt, Pseudomonas aeruginosa PA01
gccucgcuggcguucuccag

SEQ ID NO: 1519510 - RNA, 17 nt, Pseudomonas aeruginosa PA01
gccucgcugccugggga

SEQ ID NO: 1519511 - RNA, 13 nt, Pseudomonas aeruginosa PA01
gccucgcugcgca

SEQ ID NO: 1519512 - RNA, 15 nt, Pseudomonas aeruginosa PA01
gccucgcugcgcaga

SEQ ID NO: 1519513 - RNA, 19 nt, Pseudomonas aeruginosa PA01
gccucgcuagucuuccugc

SEQ ID NO: 1519514 - RNA, 20 nt, Pseudomonas aeruginosa PA01
gccucgcuagucuuccugca

SEQ ID NO: 1519515 - RNA, 22 nt, Pseudomonas aeruginosa PA01
gccucgcuagucuuccugcacg

SEQ ID NO: 1519516 - RNA, 14 nt, Pseudomonas aeruginosa PA01
gccucguucagcag

SEQ ID NO: 1519517 - RNA, 18 nt, Pseudomonas aeruginosa PA01
gccucgucgcgccaggcg

SEQ ID NO: 1519518 - RNA, 13 nt, Pseudomonas aeruginosa PA01
gccucgggcgagc

SEQ ID NO: 1519519 - RNA, 16 nt, Pseudomonas aeruginosa PA01
gccucgggcgagcgca

SEQ ID NO: 1519520 - RNA, 17 nt, Pseudomonas aeruginosa PA01
gccucggggccguccgc

SEQ ID NO: 1519521 - RNA, 20 nt, Pseudomonas aeruginosa PA01
gccucggggccguccgccag

SEQ ID NO: 1519522 - RNA, 21 nt, Pseudomonas aeruginosa PA01
gccucggucaggcgcugguga

SEQ ID NO: 1519523 - RNA, 16 nt, Pseudomonas aeruginosa PA01
gccucgguggcccacu

SEQ ID NO: 1519524 - RNA, 21 nt, Pseudomonas aeruginosa PA01
gccucgguuuccggccaggcg

SEQ ID NO: 1519525 - RNA, 23 nt, Pseudomonas aeruginosa PA01
gccucgguuuccggccaggcgcg

SEQ ID NO: 1519526 - RNA, 17 nt, Pseudomonas aeruginosa PA01
gccucgucgagcgcagc

SEQ ID NO: 1519527 - RNA, 19 nt, Pseudomonas aeruginosa PA01
gccucuccgagacgcugca

SEQ ID NO: 1519528 - RNA, 17 nt, Pseudomonas aeruginosa PA01
gccucuuccuggaccuc

SEQ ID NO: 1519529 - RNA, 18 nt, Pseudomonas aeruginosa PA01
gccugcgcgcaccaggcc

SEQ ID NO: 1519530 - RNA, 16 nt, Pseudomonas aeruginosa PA01
gccugcgcuuccggca

SEQ ID NO: 1519531 - RNA, 22 nt, Pseudomonas aeruginosa PA01
gccugcgcuuccggcagccagc

SEQ ID NO: 1519532 - RNA, 19 nt, Pseudomonas aeruginosa PA01
gccugcggccagcgccagg

SEQ ID NO: 1519533 - RNA, 20 nt, Pseudomonas aeruginosa PA01
gccugcggccagcgccagga

SEQ ID NO: 1519534 - RNA, 22 nt, Pseudomonas aeruginosa PA01
gccugcggccagcgccaggagc

SEQ ID NO: 1519535 - RNA, 21 nt, Pseudomonas aeruginosa PA01
gccugcggcguuauccgcccu

SEQ ID NO: 1519536 - RNA, 18 nt, Pseudomonas aeruginosa PA01
gccugcggcuugcccugc

SEQ ID NO: 1519537 - RNA, 20 nt, Pseudomonas aeruginosa PA01
gccugcucuucggcggccag

SEQ ID NO: 1519538 - RNA, 22 nt, Pseudomonas aeruginosa PA01
gccugcucuucggcggccagcg

SEQ ID NO: 1519539 - RNA, 22 nt, Pseudomonas aeruginosa PA01
gccugcgggcggguaaagcgcc

SEQ ID NO: 1519540 - RNA, 16 nt, Pseudomonas aeruginosa PA01
gccuggcccuggcgca

SEQ ID NO: 1519541 - RNA, 18 nt, Pseudomonas aeruginosa PA01
gccuggcccuggcgcagg

SEQ ID NO: 1519542 - RNA, 14 nt, Pseudomonas aeruginosa PA01
gccuggccggccag

SEQ ID NO: 1519543 - RNA, 19 nt, Pseudomonas aeruginosa PA01
gccuggcgcaaggugccga

SEQ ID NO: 1519544 - RNA, 19 nt, Pseudomonas aeruginosa PA01
gccugcuguguccggcgga

SEQ ID NO: 1519545 - RNA, 17 nt, Pseudomonas aeruginosa PA01
gccugcuuggcggcggu

SEQ ID NO: 1519546 - RNA, 13 nt, Pseudomonas aeruginosa PA01
gccugcuucaggu

SEQ ID NO: 1519547 - RNA, 18 nt, Pseudomonas aeruginosa PA01
gccugcuucagguagugc

SEQ ID NO: 1519548 - RNA, 20 nt, Pseudomonas aeruginosa PA01
gccugcuucaggucgucggg

SEQ ID NO: 1519549 - RNA, 23 nt, Pseudomonas aeruginosa PA01
gccugcuucaggucgucgggcag

SEQ ID NO: 1519550 - RNA, 13 nt, Pseudomonas aeruginosa PA01
gccugcuggccug

SEQ ID NO: 1519551 - RNA, 15 nt, Pseudomonas aeruginosa PA01
gccugcuggccuggg

SEQ ID NO: 1519552 - RNA, 16 nt, Pseudomonas aeruginosa PA01
gccugcugguggguga

SEQ ID NO: 1519553 - RNA, 18 nt, Pseudomonas aeruginosa PA01
gccuguuuccagaaggcu

SEQ ID NO: 1519554 - RNA, 13 nt, Pseudomonas aeruginosa PA01
gccugucgcuccg

SEQ ID NO: 1519555 - RNA, 16 nt, Pseudomonas aeruginosa PA01
gccugucgcuccggca

SEQ ID NO: 1519556 - RNA, 17 nt, Pseudomonas aeruginosa PA01
gccuguucgcccaaggc

SEQ ID NO: 1519557 - RNA, 22 nt, Pseudomonas aeruginosa PA01
gccuguugagugggaugacgau

SEQ ID NO: 1519558 - RNA, 14 nt, Pseudomonas aeruginosa PA01
gccugggcgcaggc

SEQ ID NO: 1519559 - RNA, 13 nt, Pseudomonas aeruginosa PA01
gccugggcgccgc

SEQ ID NO: 1519560 - RNA, 20 nt, Pseudomonas aeruginosa PA01
gccugggcggucggcucagc

SEQ ID NO: 1519561 - RNA, 22 nt, Pseudomonas aeruginosa PA01
gccugggcggucggcucagccg

SEQ ID NO: 1519562 - RNA, 18 nt, Pseudomonas aeruginosa PA01
gccuggggcucggcuucc

SEQ ID NO: 1519563 - RNA, 21 nt, Pseudomonas aeruginosa PA01
gccuggggcucggcuuccauc

SEQ ID NO: 1519564 - RNA, 22 nt, Pseudomonas aeruginosa PA01
gccugggugauuucuucagccu

SEQ ID NO: 1519565 - RNA, 14 nt, Pseudomonas aeruginosa PA01
gccuggggugcagc

SEQ ID NO: 1519566 - RNA, 21 nt, Pseudomonas aeruginosa PA01
gccuggggugcagcagguucc

SEQ ID NO: 1519567 - RNA, 15 nt, Pseudomonas aeruginosa PA01
gccugggucaccagc

SEQ ID NO: 1519568 - RNA, 14 nt, Pseudomonas aeruginosa PA01
gccugggguagccg

SEQ ID NO: 1519569 - RNA, 19 nt, Pseudomonas aeruginosa PA01
gccugggguagccggccga

SEQ ID NO: 1519570 - RNA, 14 nt, Pseudomonas aeruginosa PA01
gccugguccagcag

SEQ ID NO: 1519571 - RNA, 21 nt, Pseudomonas aeruginosa PA01
gccuggucauccuggcccugg

SEQ ID NO: 1519572 - RNA, 20 nt, Pseudomonas aeruginosa PA01
gccugguauugcgcccagag

SEQ ID NO: 1519573 - RNA, 18 nt, Pseudomonas aeruginosa PA01
gccugggugaacagcggc

SEQ ID NO: 1519574 - RNA, 19 nt, Pseudomonas aeruginosa PA01
gccugggugaacagcggcc

SEQ ID NO: 1519575 - RNA, 14 nt, Pseudomonas aeruginosa PA01
gccuggcuggccag

SEQ ID NO: 1519576 - RNA, 15 nt, Pseudomonas aeruginosa PA01
gccuggcuggccagc

SEQ ID NO: 1519577 - RNA, 20 nt, Pseudomonas aeruginosa PA01
gccuggcuggccagcaggcu

SEQ ID NO: 1519578 - RNA, 15 nt, Pseudomonas aeruginosa PA01
gccuggcuggccuug

SEQ ID NO: 1519579 - RNA, 19 nt, Pseudomonas aeruginosa PA01
gccugggccgaaggccagg

SEQ ID NO: 1519580 - RNA, 20 nt, Pseudomonas aeruginosa PA01
gccugggccgaaggccaggc

SEQ ID NO: 1519581 - RNA, 21 nt, Pseudomonas aeruginosa PA01
gccugggccgaaggccaggcc

SEQ ID NO: 1519582 - RNA, 18 nt, Pseudomonas aeruginosa PA01
gccugggcggcuuccugc

SEQ ID NO: 1519583 - RNA, 12 nt, Pseudomonas aeruginosa PA01
gccuggcggcug

SEQ ID NO: 1519584 - RNA, 14 nt, Pseudomonas aeruginosa PA01
gccuggcggcuggc

SEQ ID NO: 1519585 - RNA, 18 nt, Pseudomonas aeruginosa PA01
gccuggcgucgcacugcu

SEQ ID NO: 1519586 - RNA, 21 nt, Pseudomonas aeruginosa PA01
gccuggcgucgcacugcugcu

SEQ ID NO: 1519587 - RNA, 19 nt, Pseudomonas aeruginosa PA01
gccuggcgcucagcgccgc

SEQ ID NO: 1519588 - RNA, 13 nt, Pseudomonas aeruginosa PA01
gccuggcgcgcgc

SEQ ID NO: 1519589 - RNA, 14 nt, Pseudomonas aeruginosa PA01
gccuggcgcauggc

SEQ ID NO: 1519590 - RNA, 18 nt, Pseudomonas aeruginosa PA01
gccuggcgcauggcgcuc

SEQ ID NO: 1519591 - RNA, 15 nt, Pseudomonas aeruginosa PA01
gccuggcgcagcggc

SEQ ID NO: 1519592 - RNA, 14 nt, Pseudomonas aeruginosa PA01
gcgaacaccgggcc

SEQ ID NO: 1519593 - RNA, 21 nt, Pseudomonas aeruginosa PA01
gcgaacaccgggccgccggcg

SEQ ID NO: 1519594 - RNA, 15 nt, Pseudomonas aeruginosa PA01
gcgaacaucauccac

SEQ ID NO: 1519595 - RNA, 13 nt, Pseudomonas aeruginosa PA01
gcgaacagggugg

SEQ ID NO: 1519596 - RNA, 17 nt, Pseudomonas aeruginosa PA01
gcgaacagcgccgcggc

SEQ ID NO: 1519597 - RNA, 13 nt, Pseudomonas aeruginosa PA01
gcgaaaucggcag

SEQ ID NO: 1519598 - RNA, 22 nt, Pseudomonas aeruginosa PA01
gcgaaauugccuccgcucugcu

SEQ ID NO: 1519599 - RNA, 15 nt, Pseudomonas aeruginosa PA01
gcgaaauggcagaac

SEQ ID NO: 1519600 - RNA, 20 nt, Pseudomonas aeruginosa PA01
gcgaaagggucaggccuuga

SEQ ID NO: 1519601 - RNA, 16 nt, Pseudomonas aeruginosa PA01
gcgaaagcgccccggg

SEQ ID NO: 1519602 - RNA, 21 nt, Pseudomonas aeruginosa PA01
gcgaaacggcgcugaacagcu

SEQ ID NO: 1519603 - RNA, 16 nt, Pseudomonas aeruginosa PA01
gcgaaacggcaggcca

SEQ ID NO: 1519604 - RNA, 21 nt, Pseudomonas aeruginosa PA01
gcgaaacggcaggccagcagg

SEQ ID NO: 1519605 - RNA, 20 nt, Pseudomonas aeruginosa PA01
gccuuuucggcggccaggcg

SEQ ID NO: 1519606 - RNA, 13 nt, Pseudomonas aeruginosa PA01
gcgaaccagcagc

SEQ ID NO: 1519607 - RNA, 22 nt, Pseudomonas aeruginosa PA01
gcgaacccgaaucccuuggcug

SEQ ID NO: 1519608 - RNA, 16 nt, Pseudomonas aeruginosa PA01
gcgaaccaguccagca

SEQ ID NO: 1519609 - RNA, 15 nt, Pseudomonas aeruginosa PA01
gcgaacgcucccagc

SEQ ID NO: 1519610 - RNA, 15 nt, Pseudomonas aeruginosa PA01
gcgaacggcaggugg

SEQ ID NO: 1519611 - RNA, 16 nt, Pseudomonas aeruginosa PA01
gcgaagcccagcgagc

SEQ ID NO: 1519612 - RNA, 14 nt, Pseudomonas aeruginosa PA01
gcgaagccgcgccc

SEQ ID NO: 1519613 - RNA, 16 nt, Pseudomonas aeruginosa PA01
gcgaagccgcgcccgg

SEQ ID NO: 1519614 - RNA, 19 nt, Pseudomonas aeruginosa PA01
gcgaacuccgccagcuugu

SEQ ID NO: 1519615 - RNA, 16 nt, Pseudomonas aeruginosa PA01
gcgaacugccgacggc

SEQ ID NO: 1519616 - RNA, 20 nt, Pseudomonas aeruginosa PA01
gcgaacuucaggccggcgcc

SEQ ID NO: 1519617 - RNA, 17 nt, Pseudomonas aeruginosa PA01
gccuuggcaucgccgcc

SEQ ID NO: 1519618 - RNA, 21 nt, Pseudomonas aeruginosa PA01
gccuuggcaucgccgcccagu

SEQ ID NO: 1519619 - RNA, 21 nt, Pseudomonas aeruginosa PA01
gccuuucuuuucugccacccg

SEQ ID NO: 1519620 - RNA, 13 nt, Pseudomonas aeruginosa PA01
gccuuucgcucag

SEQ ID NO: 1519621 - RNA, 16 nt, Pseudomonas aeruginosa PA01
gccuuucugcccggcu

SEQ ID NO: 1519622 - RNA, 16 nt, Pseudomonas aeruginosa PA01
gccuucuuuucuuccg

SEQ ID NO: 1519623 - RNA, 15 nt, Pseudomonas aeruginosa PA01
gccuugaccagcggc

SEQ ID NO: 1519624 - RNA, 21 nt, Pseudomonas aeruginosa PA01
gccuugaccagcggcccggcg

SEQ ID NO: 1519625 - RNA, 20 nt, Pseudomonas aeruginosa PA01
gccuugaccaccgccaggcu

SEQ ID NO: 1519626 - RNA, 12 nt, Pseudomonas aeruginosa PA01
gccuugaccugc

SEQ ID NO: 1519627 - RNA, 21 nt, Pseudomonas aeruginosa PA01
gccuugagcggcgcccuggcu

SEQ ID NO: 1519628 - RNA, 23 nt, Pseudomonas aeruginosa PA01
gccuugcagcaacucgccgccga

SEQ ID NO: 1519629 - RNA, 18 nt, Pseudomonas aeruginosa PA01
gccuugcagcaccgccug

SEQ ID NO: 1519630 - RNA, 22 nt, Pseudomonas aeruginosa PA01
gccuucgccgucgagccagccc

SEQ ID NO: 1519631 - RNA, 21 nt, Pseudomonas aeruginosa PA01
gccuucgcgggccaggccgag

SEQ ID NO: 1519632 - RNA, 23 nt, Pseudomonas aeruginosa PA01
gccuucgggagagcccgggcgca

SEQ ID NO: 1519633 - RNA, 22 nt, Pseudomonas aeruginosa PA01
gccuucggagaacagcgagacc

SEQ ID NO: 1519634 - RNA, 17 nt, Pseudomonas aeruginosa PA01
gccuucggcgacacaga

SEQ ID NO: 1519635 - RNA, 18 nt, Pseudomonas aeruginosa PA01
gccuucgcguucgcuccg

SEQ ID NO: 1519636 - RNA, 17 nt, Pseudomonas aeruginosa PA01
gccuucagcgccagcag

SEQ ID NO: 1519637 - RNA, 16 nt, Pseudomonas aeruginosa PA01
gccuucagcgccgcca

SEQ ID NO: 1519638 - RNA, 18 nt, Pseudomonas aeruginosa PA01
gccuucagcgccuccagc

SEQ ID NO: 1519639 - RNA, 23 nt, Pseudomonas aeruginosa PA01
gccuucgcaaagcgagcgcccgc

SEQ ID NO: 1519640 - RNA, 16 nt, Pseudomonas aeruginosa PA01
ggcgcgaaccagcagc

SEQ ID NO: 1519641 - RNA, 22 nt, Pseudomonas aeruginosa PA01
ggcgcgaaucuucggcgcgccg

SEQ ID NO: 1519642 - RNA, 16 nt, Pseudomonas aeruginosa PA01
ggcgcgaccgucggcc

SEQ ID NO: 1519643 - RNA, 17 nt, Pseudomonas aeruginosa PA01
ggcgcgaccgcccgccu

SEQ ID NO: 1519644 - RNA, 18 nt, Pseudomonas aeruginosa PA01
ggcgcgaccgcccgccuc

SEQ ID NO: 1519645 - RNA, 19 nt, Pseudomonas aeruginosa PA01
ggcgcgcaguagcuggauc

SEQ ID NO: 1519646 - RNA, 14 nt, Pseudomonas aeruginosa PA01
ggcgcgagaaaaac

SEQ ID NO: 1519647 - RNA, 17 nt, Pseudomonas aeruginosa PA01
ggcgcgcagggccagca

SEQ ID NO: 1519648 - RNA, 19 nt, Pseudomonas aeruginosa PA01
ggcgcgcagggccagcaac

SEQ ID NO: 1519649 - RNA, 17 nt, Pseudomonas aeruginosa PA01
ggcgcgcagggccgcgg

SEQ ID NO: 1519650 - RNA, 19 nt, Pseudomonas aeruginosa PA01
ggcgcgacgaggcgcggcg

SEQ ID NO: 1519651 - RNA, 15 nt, Pseudomonas aeruginosa PA01
ggcgcgacggcccac

SEQ ID NO: 1519652 - RNA, 15 nt, Pseudomonas aeruginosa PA01
ggcgcgcaucuggug

SEQ ID NO: 1519653 - RNA, 23 nt, Pseudomonas aeruginosa PA01
ggcgcgcaucggugccggcaggc

SEQ ID NO: 1519654 - RNA, 15 nt, Pseudomonas aeruginosa PA01
ggcgccggcucgccc

SEQ ID NO: 1519655 - RNA, 14 nt, Pseudomonas aeruginosa PA01
ggcgccggcugacg

SEQ ID NO: 1519656 - RNA, 20 nt, Pseudomonas aeruginosa PA01
ggcgccgcgggucugcucgg

SEQ ID NO: 1519657 - RNA, 22 nt, Pseudomonas aeruginosa PA01
ggcgccgcgggucugcucggcg

SEQ ID NO: 1519658 - RNA, 18 nt, Pseudomonas aeruginosa PA01
ggcgccgggucgaugggc

SEQ ID NO: 1519659 - RNA, 22 nt, Pseudomonas aeruginosa PA01
ggcgccggguagcguuaucgcc

SEQ ID NO: 1519660 - RNA, 14 nt, Pseudomonas aeruginosa PA01
ggcgccgggcugcc

SEQ ID NO: 1519661 - RNA, 22 nt, Pseudomonas aeruginosa PA01
ggcgccgucaucgcugaccugg

SEQ ID NO: 1519662 - RNA, 17 nt, Pseudomonas aeruginosa PA01
ggcgccgucgaucaggu

SEQ ID NO: 1519663 - RNA, 13 nt, Pseudomonas aeruginosa PA01
ggcgccgguugcu

SEQ ID NO: 1519664 - RNA, 19 nt, Pseudomonas aeruginosa PA01
ggcgccgguugcugcuggg

SEQ ID NO: 1519665 - RNA, 19 nt, Pseudomonas aeruginosa PA01
ggcgccuugcgccaggccu

SEQ ID NO: 1519666 - RNA, 20 nt, Pseudomonas aeruginosa PA01
ggcgccgccgcuggcgagga

SEQ ID NO: 1519667 - RNA, 15 nt, Pseudomonas aeruginosa PA01
ggcgccgcgcaccug

SEQ ID NO: 1519668 - RNA, 17 nt, Pseudomonas aeruginosa PA01
ggcgccgcgcaccuggg

SEQ ID NO: 1519669 - RNA, 18 nt, Pseudomonas aeruginosa PA01
ggcgccauaccggcaagg

SEQ ID NO: 1519670 - RNA, 17 nt, Pseudomonas aeruginosa PA01
ggcgccauaggccagca

SEQ ID NO: 1519671 - RNA, 22 nt, Pseudomonas aeruginosa PA01
ggcgccagcuccagcgcccagg

SEQ ID NO: 1519672 - RNA, 13 nt, Pseudomonas aeruginosa PA01
ggcgccaggccgg

SEQ ID NO: 1519673 - RNA, 12 nt, Pseudomonas aeruginosa PA01
ggcgccaggcug

SEQ ID NO: 1519674 - RNA, 20 nt, Pseudomonas aeruginosa PA01
ggcgccaggugcaggaagcg

SEQ ID NO: 1519675 - RNA, 23 nt, Pseudomonas aeruginosa PA01
ggcgccaggcugaccgcgugggc

SEQ ID NO: 1519676 - RNA, 11 nt, Pseudomonas aeruginosa PA01
ggcgccaggga

SEQ ID NO: 1519677 - RNA, 19 nt, Pseudomonas aeruginosa PA01
ggcgccagggacgcgcagc

SEQ ID NO: 1519678 - RNA, 15 nt, Pseudomonas aeruginosa PA01
ggcgccaguucgccg

SEQ ID NO: 1519679 - RNA, 14 nt, Pseudomonas aeruginosa PA01
ggcgcgccgaaggc

SEQ ID NO: 1519680 - RNA, 17 nt, Pseudomonas aeruginosa PA01
ggcgcgcgucguccagg

SEQ ID NO: 1519681 - RNA, 15 nt, Pseudomonas aeruginosa PA01
ggcgcgccggacagg

SEQ ID NO: 1519682 - RNA, 15 nt, Pseudomonas aeruginosa PA01
ggcgcgcccggcgcc

SEQ ID NO: 1519683 - RNA, 17 nt, Pseudomonas aeruginosa PA01
ggcgcgcccaggcccag

SEQ ID NO: 1519684 - RNA, 18 nt, Pseudomonas aeruginosa PA01
ggcgcgcccaggcccagc

SEQ ID NO: 1519685 - RNA, 20 nt, Pseudomonas aeruginosa PA01
ggcgcgccaaggccgccagg

SEQ ID NO: 1519686 - RNA, 22 nt, Pseudomonas aeruginosa PA01
ggcgcgccaaggccgccaggcc

SEQ ID NO: 1519687 - RNA, 14 nt, Pseudomonas aeruginosa PA01
ggcgcgccagaagc

SEQ ID NO: 1519688 - RNA, 18 nt, Pseudomonas aeruginosa PA01
ggcgcgccagaagcggcc

SEQ ID NO: 1519689 - RNA, 19 nt, Pseudomonas aeruginosa PA01
ggcgcggcgcuccaggcgg

SEQ ID NO: 1519690 - RNA, 15 nt, Pseudomonas aeruginosa PA01
ggcgcggcggaggcc

SEQ ID NO: 1519691 - RNA, 21 nt, Pseudomonas aeruginosa PA01
ggcgcggcgccagcgccccac

SEQ ID NO: 1519692 - RNA, 24 nt, Pseudomonas aeruginosa PA01
ggcgcggcgcagccagagcuccag

SEQ ID NO: 1519693 - RNA, 15 nt, Pseudomonas aeruginosa PA01
ggcgcggccugcagc

SEQ ID NO: 1519694 - RNA, 14 nt, Pseudomonas aeruginosa PA01
ggcgcggcgcagcg

SEQ ID NO: 1519695 - RNA, 16 nt, Pseudomonas aeruginosa PA01
ggcgcggcgcagcggc

SEQ ID NO: 1519696 - RNA, 17 nt, Pseudomonas aeruginosa PA01
ggcgcggcgcagcggcg

SEQ ID NO: 1519697 - RNA, 13 nt, Pseudomonas aeruginosa PA01
ggcgcggccggcg

SEQ ID NO: 1519698 - RNA, 19 nt, Pseudomonas aeruginosa PA01
ggcgcggaauacguacucg

SEQ ID NO: 1519699 - RNA, 22 nt, Pseudomonas aeruginosa PA01
ggcgcgcugguuuagcucggcg

SEQ ID NO: 1519700 - RNA, 18 nt, Pseudomonas aeruginosa PA01
ggcgcgcuuuccggcgcg

SEQ ID NO: 1519701 - RNA, 21 nt, Pseudomonas aeruginosa PA01
ggcgcgcuuuccggcgcggcc

SEQ ID NO: 1519702 - RNA, 21 nt, Pseudomonas aeruginosa PA01
ggcgcgcucagcgcuucucgg

SEQ ID NO: 1519703 - RNA, 18 nt, Pseudomonas aeruginosa PA01
ggcgcgcuccggcgcgcc

SEQ ID NO: 1519704 - RNA, 17 nt, Pseudomonas aeruginosa PA01
ggcgcgcucgaucaggu

SEQ ID NO: 1519705 - RNA, 19 nt, Pseudomonas aeruginosa PA01
ggcgcugcaugggcucgcg

SEQ ID NO: 1519706 - RNA, 14 nt, Pseudomonas aeruginosa PA01
ggcgcugcccgggu

SEQ ID NO: 1519707 - RNA, 19 nt, Pseudomonas aeruginosa PA01
ggcgcugcaaucgcugccg

SEQ ID NO: 1519708 - RNA, 16 nt, Pseudomonas aeruginosa PA01
ggcgcugcagccacug

SEQ ID NO: 1519709 - RNA, 14 nt, Pseudomonas aeruginosa PA01
ggcgcugcgcggcc

SEQ ID NO: 1519710 - RNA, 15 nt, Pseudomonas aeruginosa PA01
ggcgcugccgaucag

SEQ ID NO: 1519711 - RNA, 13 nt, Pseudomonas aeruginosa PA01
ggcgcugccuucg

SEQ ID NO: 1519712 - RNA, 14 nt, Pseudomonas aeruginosa PA01
ggcgcugcgagcgc

SEQ ID NO: 1519713 - RNA, 15 nt, Pseudomonas aeruginosa PA01
ggcggacacgcaggc

SEQ ID NO: 1519714 - RNA, 20 nt, Pseudomonas aeruginosa PA01
ggcgcugcucgauggccuug

SEQ ID NO: 1519715 - RNA, 17 nt, Pseudomonas aeruginosa PA01
ggcggaacuugucgccg

SEQ ID NO: 1519716 - RNA, 20 nt, Pseudomonas aeruginosa PA01
ggcggaacuugucgccgcug

SEQ ID NO: 1519717 - RNA, 17 nt, Pseudomonas aeruginosa PA01
ggcggaagaagcccuug

SEQ ID NO: 1519718 - RNA, 12 nt, Pseudomonas aeruginosa PA01
ggcggaagaauc

SEQ ID NO: 1519719 - RNA, 19 nt, Pseudomonas aeruginosa PA01
ggcggacaacccggcgcug

SEQ ID NO: 1519720 - RNA, 14 nt, Pseudomonas aeruginosa PA01
ggcggaaggcggcg

SEQ ID NO: 1519721 - RNA, 20 nt, Pseudomonas aeruginosa PA01
ggcgcguccggagugaugcc

SEQ ID NO: 1519722 - RNA, 20 nt, Pseudomonas aeruginosa PA01
ggcgcguccaccuggcggcu

SEQ ID NO: 1519723 - RNA, 20 nt, Pseudomonas aeruginosa PA01
ggcgcgucgcucauccgcga

SEQ ID NO: 1519724 - RNA, 15 nt, Pseudomonas aeruginosa PA01
ggcgcgucgcugccg

SEQ ID NO: 1519725 - RNA, 22 nt, Pseudomonas aeruginosa PA01
ggcgcgucgcugcgcaacugcc

SEQ ID NO: 1519726 - RNA, 16 nt, Pseudomonas aeruginosa PA01
ggcgcgucgcggccuc

SEQ ID NO: 1519727 - RNA, 14 nt, Pseudomonas aeruginosa PA01
ggcgcgucggcggu

SEQ ID NO: 1519728 - RNA, 15 nt, Pseudomonas aeruginosa PA01
ggcgcgucggcggug

SEQ ID NO: 1519729 - RNA, 13 nt, Pseudomonas aeruginosa PA01
ggcgcgucuccag

SEQ ID NO: 1519730 - RNA, 19 nt, Pseudomonas aeruginosa PA01
ggcgcgguuucgcagcgcu

SEQ ID NO: 1519731 - RNA, 18 nt, Pseudomonas aeruginosa PA01
ggcgcguacgcccgcagc

SEQ ID NO: 1519732 - RNA, 22 nt, Pseudomonas aeruginosa PA01
ggcgcguacuugccagggcagg

SEQ ID NO: 1519733 - RNA, 18 nt, Pseudomonas aeruginosa PA01
ggcgcggucggguccggg

SEQ ID NO: 1519734 - RNA, 17 nt, Pseudomonas aeruginosa PA01
ggcgcggcggccgccuc

SEQ ID NO: 1519735 - RNA, 24 nt, Pseudomonas aeruginosa PA01
ggcggccugcucgcgcagccaggc

SEQ ID NO: 1519736 - RNA, 14 nt, Pseudomonas aeruginosa PA01
ggcggccugagccg

SEQ ID NO: 1519737 - RNA, 16 nt, Pseudomonas aeruginosa PA01
ggcggccugagccggc

SEQ ID NO: 1519738 - RNA, 23 nt, Pseudomonas aeruginosa PA01
ggcggccggugccuucggcggcg

SEQ ID NO: 1519739 - RNA, 15 nt, Pseudomonas aeruginosa PA01
ggcggccggccaggu

SEQ ID NO: 1519740 - RNA, 16 nt, Pseudomonas aeruginosa PA01
ggcggccaucaggcgc

SEQ ID NO: 1519741 - RNA, 12 nt, Pseudomonas aeruginosa PA01
ggcggccaggcg

SEQ ID NO: 1519742 - RNA, 12 nt, Pseudomonas aeruginosa PA01
ggcggccagggc

SEQ ID NO: 1519743 - RNA, 17 nt, Pseudomonas aeruginosa PA01
ggcggcaucgcguaggg

SEQ ID NO: 1519744 - RNA, 16 nt, Pseudomonas aeruginosa PA01
ggcggcaucggcgccg

SEQ ID NO: 1519745 - RNA, 23 nt, Pseudomonas aeruginosa PA01
ggcggccaaccucuccccagacc

SEQ ID NO: 1519746 - RNA, 13 nt, Pseudomonas aeruginosa PA01
ggcggccagcagc

SEQ ID NO: 1519747 - RNA, 11 nt, Pseudomonas aeruginosa PA01
ggcggaggcga

SEQ ID NO: 1519748 - RNA, 16 nt, Pseudomonas aeruginosa PA01
ggcggacaggcagccg

SEQ ID NO: 1519749 - RNA, 18 nt, Pseudomonas aeruginosa PA01
ggcggauaaccgcgagcg

SEQ ID NO: 1519750 - RNA, 16 nt, Pseudomonas aeruginosa PA01
ggcggauaacgcccgc

SEQ ID NO: 1519751 - RNA, 19 nt, Pseudomonas aeruginosa PA01
ggcggauaacgccuguggc

SEQ ID NO: 1519752 - RNA, 20 nt, Pseudomonas aeruginosa PA01
ggcggauaacgccuguggcg

SEQ ID NO: 1519753 - RNA, 13 nt, Pseudomonas aeruginosa PA01
ggcggacgcuggg

SEQ ID NO: 1519754 - RNA, 18 nt, Pseudomonas aeruginosa PA01
ggcggacgcugggcuggg

SEQ ID NO: 1519755 - RNA, 13 nt, Pseudomonas aeruginosa PA01
ggcggacgcaggc

SEQ ID NO: 1519756 - RNA, 16 nt, Pseudomonas aeruginosa PA01
ggcggacugcucgccg

SEQ ID NO: 1519757 - RNA, 12 nt, Pseudomonas aeruginosa PA01
ggcggagcagcc

SEQ ID NO: 1519758 - RNA, 15 nt, Pseudomonas aeruginosa PA01
ggcggagcagccuca

SEQ ID NO: 1519759 - RNA, 17 nt, Pseudomonas aeruginosa PA01
ggcggauagcgcgcagg

SEQ ID NO: 1519760 - RNA, 16 nt, Pseudomonas aeruginosa PA01
ggcggauaucggccuc

SEQ ID NO: 1519761 - RNA, 17 nt, Pseudomonas aeruginosa PA01
ggcggaucaccggcugg

SEQ ID NO: 1519762 - RNA, 15 nt, Pseudomonas aeruginosa PA01
ggcggaucagcccgc

SEQ ID NO: 1519763 - RNA, 16 nt, Pseudomonas aeruginosa PA01
ggcggaucagcccgcu

SEQ ID NO: 1519764 - RNA, 14 nt, Pseudomonas aeruginosa PA01
ggcggaggcgaggu

SEQ ID NO: 1519765 - RNA, 19 nt, Pseudomonas aeruginosa PA01
ggcggaggcgaggucgccg

SEQ ID NO: 1519766 - RNA, 16 nt, Pseudomonas aeruginosa PA01
ggcggaguagccggcg

SEQ ID NO: 1519767 - RNA, 20 nt, Pseudomonas aeruginosa PA01
ggcggauaaucgcagcgcgg

SEQ ID NO: 1519768 - RNA, 21 nt, Pseudomonas aeruginosa PA01
ggcggauacaggcgcagcagc

SEQ ID NO: 1519769 - RNA, 23 nt, Pseudomonas aeruginosa PA01
ggcggauacaggcgcagcagcau

SEQ ID NO: 1519770 - RNA, 18 nt, Pseudomonas aeruginosa PA01
ggcggaucgcccggcgcu

SEQ ID NO: 1519771 - RNA, 18 nt, Pseudomonas aeruginosa PA01
ggcggauucaggcgcgcu

SEQ ID NO: 1519772 - RNA, 19 nt, Pseudomonas aeruginosa PA01
ggcggauucaggcgcgcuc

SEQ ID NO: 1519773 - RNA, 17 nt, Pseudomonas aeruginosa PA01
ggcggaucugcucgacg

SEQ ID NO: 1519774 - RNA, 21 nt, Pseudomonas aeruginosa PA01
ggcggaugaacucgacuucuu

SEQ ID NO: 1519775 - RNA, 17 nt, Pseudomonas aeruginosa PA01
ggcggaugaccugucca

SEQ ID NO: 1519776 - RNA, 15 nt, Pseudomonas aeruginosa PA01
ggcgggacgcgcaug

SEQ ID NO: 1519777 - RNA, 14 nt, Pseudomonas aeruginosa PA01
ggcgggacggcgca

SEQ ID NO: 1519778 - RNA, 19 nt, Pseudomonas aeruginosa PA01
ggcgggaucgacgccgcug

SEQ ID NO: 1519779 - RNA, 13 nt, Pseudomonas aeruginosa PA01
ggcgggccagcag

SEQ ID NO: 1519780 - RNA, 21 nt, Pseudomonas aeruginosa PA01
ggcgggccagcaggcgcucgg

SEQ ID NO: 1519781 - RNA, 15 nt, Pseudomonas aeruginosa PA01
ggcgggccagcaggg

SEQ ID NO: 1519782 - RNA, 14 nt, Pseudomonas aeruginosa PA01
ggcgggccagcugg

SEQ ID NO: 1519783 - RNA, 23 nt, Pseudomonas aeruginosa PA01
ggcgggccaugcgcucggggucg

SEQ ID NO: 1519784 - RNA, 12 nt, Pseudomonas aeruginosa PA01
ggcgggcggccc

SEQ ID NO: 1519785 - RNA, 21 nt, Pseudomonas aeruginosa PA01
ggcggcuuuuuucauggcggu

SEQ ID NO: 1519786 - RNA, 15 nt, Pseudomonas aeruginosa PA01
ggcggcgggccggcg

SEQ ID NO: 1519787 - RNA, 18 nt, Pseudomonas aeruginosa PA01
ggcggcgggccggcgucc

SEQ ID NO: 1519788 - RNA, 14 nt, Pseudomonas aeruginosa PA01
ggcggcggccugcu

SEQ ID NO: 1519789 - RNA, 15 nt, Pseudomonas aeruginosa PA01
ggcggcgcugugggu

SEQ ID NO: 1519790 - RNA, 19 nt, Pseudomonas aeruginosa PA01
ggcggcggaagaagcccuu

SEQ ID NO: 1519791 - RNA, 20 nt, Pseudomonas aeruginosa PA01
ggcggcgcguuccacguccu

SEQ ID NO: 1519792 - RNA, 16 nt, Pseudomonas aeruginosa PA01
ggcggcgcucacccac

SEQ ID NO: 1519793 - RNA, 13 nt, Pseudomonas aeruginosa PA01
ggcggcgcggcgu

SEQ ID NO: 1519794 - RNA, 14 nt, Pseudomonas aeruginosa PA01
ggcggcgcggcgca

SEQ ID NO: 1519795 - RNA, 14 nt, Pseudomonas aeruginosa PA01
ggcggcgcggcggg

SEQ ID NO: 1519796 - RNA, 12 nt, Pseudomonas aeruginosa PA01
ggcggcgcggcg

SEQ ID NO: 1519797 - RNA, 21 nt, Pseudomonas aeruginosa PA01
ggcggggucgcgccgguggcg

SEQ ID NO: 1519798 - RNA, 16 nt, Pseudomonas aeruginosa PA01
ggcgggcgucgucggg

SEQ ID NO: 1519799 - RNA, 14 nt, Pseudomonas aeruginosa PA01
ggcgggcuccgccg

SEQ ID NO: 1519800 - RNA, 21 nt, Pseudomonas aeruginosa PA01
ggcgggugaacucaugcaggc

SEQ ID NO: 1519801 - RNA, 18 nt, Pseudomonas aeruginosa PA01
ggcgguagcccggcagcu

SEQ ID NO: 1519802 - RNA, 16 nt, Pseudomonas aeruginosa PA01
ggcgguuaccaggucu

SEQ ID NO: 1519803 - RNA, 23 nt, Pseudomonas aeruginosa PA01
ggcgguuaccaggucuguggagg

SEQ ID NO: 1519804 - RNA, 15 nt, Pseudomonas aeruginosa PA01
ggcgguucugggugg

SEQ ID NO: 1519805 - RNA, 22 nt, Pseudomonas aeruginosa PA01
ggcgguguagaccaccagcagg

SEQ ID NO: 1519806 - RNA, 23 nt, Pseudomonas aeruginosa PA01
ggcgguguagaccaccagcagga

SEQ ID NO: 1519807 - RNA, 12 nt, Pseudomonas aeruginosa PA01
ggcgguggggcc

SEQ ID NO: 1519808 - RNA, 16 nt, Pseudomonas aeruginosa PA01
ggcgguggggccgccg

SEQ ID NO: 1519809 - RNA, 21 nt, Pseudomonas aeruginosa PA01
ggcgccacucggcgugccggg

SEQ ID NO: 1519810 - RNA, 14 nt, Pseudomonas aeruginosa PA01
ggcgccagccagcc

SEQ ID NO: 1519811 - RNA, 17 nt, Pseudomonas aeruginosa PA01
ggcgccagccagcccgg

SEQ ID NO: 1519812 - RNA, 12 nt, Pseudomonas aeruginosa PA01
ggcgcagggaga

SEQ ID NO: 1519813 - RNA, 20 nt, Pseudomonas aeruginosa PA01
ggcgcaggcugucggccagc

SEQ ID NO: 1519814 - RNA, 21 nt, Pseudomonas aeruginosa PA01
ggcgcaggcggaucgcccggc

SEQ ID NO: 1519815 - RNA, 13 nt, Pseudomonas aeruginosa PA01
ggcgcaggccggg

SEQ ID NO: 1519816 - RNA, 14 nt, Pseudomonas aeruginosa PA01
ggcgcaggccgagg

SEQ ID NO: 1519817 - RNA, 19 nt, Pseudomonas aeruginosa PA01
ggcgcagcggcagcgccag

SEQ ID NO: 1519818 - RNA, 13 nt, Pseudomonas aeruginosa PA01
ggcgcagcggguc

SEQ ID NO: 1519819 - RNA, 18 nt, Pseudomonas aeruginosa PA01
ggcgcagcguccugcccu

SEQ ID NO: 1519820 - RNA, 14 nt, Pseudomonas aeruginosa PA01
ggcgcaccaggcca

SEQ ID NO: 1519821 - RNA, 17 nt, Pseudomonas aeruginosa PA01
ggcgcaccgacgccgcc

SEQ ID NO: 1519822 - RNA, 20 nt, Pseudomonas aeruginosa PA01
ggcgcaccgacgccgccugc

SEQ ID NO: 1519823 - RNA, 18 nt, Pseudomonas aeruginosa PA01
ggcgauucguucgagcag

SEQ ID NO: 1519824 - RNA, 20 nt, Pseudomonas aeruginosa PA01
ggcgauucguucgagcagcu

SEQ ID NO: 1519825 - RNA, 17 nt, Pseudomonas aeruginosa PA01
ggcgauguugcgcaggg

SEQ ID NO: 1519826 - RNA, 20 nt, Pseudomonas aeruginosa PA01
ggcgauguugcgcagggugc

SEQ ID NO: 1519827 - RNA, 21 nt, Pseudomonas aeruginosa PA01
ggcgauguugcgcagggugcc

SEQ ID NO: 1519828 - RNA, 15 nt, Pseudomonas aeruginosa PA01
ggcgaugaucuggcc

SEQ ID NO: 1519829 - RNA, 14 nt, Pseudomonas aeruginosa PA01
ggcgaugccgaugg

SEQ ID NO: 1519830 - RNA, 17 nt, Pseudomonas aeruginosa PA01
ggcgaugccgcccagca

SEQ ID NO: 1519831 - RNA, 18 nt, Pseudomonas aeruginosa PA01
ggcgaugccgcccagcac

SEQ ID NO: 1519832 - RNA, 20 nt, Pseudomonas aeruginosa PA01
ggcgaugccggagagcagca

SEQ ID NO: 1519833 - RNA, 17 nt, Pseudomonas aeruginosa PA01
ggcgaugccgccgggca

SEQ ID NO: 1519834 - RNA, 17 nt, Pseudomonas aeruginosa PA01
ggcgaucugugcgagcg

SEQ ID NO: 1519835 - RNA, 18 nt, Pseudomonas aeruginosa PA01
ggcgaucuucuccgccgc

SEQ ID NO: 1519836 - RNA, 19 nt, Pseudomonas aeruginosa PA01
ggcgaugaccagcucggcg

SEQ ID NO: 1519837 - RNA, 22 nt, Pseudomonas aeruginosa PA01
ggcgaugaccgccccggcagcc

SEQ ID NO: 1519838 - RNA, 16 nt, Pseudomonas aeruginosa PA01
ggcgauaucccgccgc

SEQ ID NO: 1519839 - RNA, 14 nt, Pseudomonas aeruginosa PA01
ggcgauagccgacc

SEQ ID NO: 1519840 - RNA, 19 nt, Pseudomonas aeruginosa PA01
ggcgacagcuuccagugcu

SEQ ID NO: 1519841 - RNA, 22 nt, Pseudomonas aeruginosa PA01
ggcgacauagccggcgaaccag

SEQ ID NO: 1519842 - RNA, 18 nt, Pseudomonas aeruginosa PA01
ggcgacauagcggcugcu

SEQ ID NO: 1519843 - RNA, 17 nt, Pseudomonas aeruginosa PA01
ggcgaacagcgcuuccu

SEQ ID NO: 1519844 - RNA, 13 nt, Pseudomonas aeruginosa PA01
ggcgaacaggcag

SEQ ID NO: 1519845 - RNA, 22 nt, Pseudomonas aeruginosa PA01
ggcgaacaggcagcgggccagg

SEQ ID NO: 1519846 - RNA, 22 nt, Pseudomonas aeruginosa PA01
ggcgaacaugaagccgcgcgcc

SEQ ID NO: 1519847 - RNA, 23 nt, Pseudomonas aeruginosa PA01
ggcgaacaugaagccgcgcgccg

SEQ ID NO: 1519848 - RNA, 17 nt, Pseudomonas aeruginosa PA01
ggcgaacagcgccgcgg

SEQ ID NO: 1519849 - RNA, 20 nt, Pseudomonas aeruginosa PA01
ggcgaacagcgccgcggcug

SEQ ID NO: 1519850 - RNA, 14 nt, Pseudomonas aeruginosa PA01
ggcgaacagggugg

SEQ ID NO: 1519851 - RNA, 14 nt, Pseudomonas aeruginosa PA01
ggcgaacagcaccu

SEQ ID NO: 1519852 - RNA, 17 nt, Pseudomonas aeruginosa PA01
ggcgaaccacaccaggu

SEQ ID NO: 1519853 - RNA, 21 nt, Pseudomonas aeruginosa PA01
ggcgaccaccgcgaauccgcg

SEQ ID NO: 1519854 - RNA, 22 nt, Pseudomonas aeruginosa PA01
ggcgaccaccgcgaauccgcgg

SEQ ID NO: 1519855 - RNA, 14 nt, Pseudomonas aeruginosa PA01
ggcgaccagcgcgg

SEQ ID NO: 1519856 - RNA, 21 nt, Pseudomonas aeruginosa PA01
ggcgacccagaccugccgccc

SEQ ID NO: 1519857 - RNA, 11 nt, Pseudomonas aeruginosa PA01
ggcgacccagg

SEQ ID NO: 1519858 - RNA, 18 nt, Pseudomonas aeruginosa PA01
ggcgaccugcucgcgcac

SEQ ID NO: 1519859 - RNA, 22 nt, Pseudomonas aeruginosa PA01
ggcgaccugcucgcgcaccgcg

SEQ ID NO: 1519860 - RNA, 16 nt, Pseudomonas aeruginosa PA01
ggcgaccugggcgucg

SEQ ID NO: 1519861 - RNA, 12 nt, Pseudomonas aeruginosa PA01
ggcgaccugcuc

SEQ ID NO: 1519862 - RNA, 22 nt, Pseudomonas aeruginosa PA01
ggcgacccgccguucgcccgcc

SEQ ID NO: 1519863 - RNA, 16 nt, Pseudomonas aeruginosa PA01
ggcgacccgggucagg

SEQ ID NO: 1519864 - RNA, 22 nt, Pseudomonas aeruginosa PA01
ggcgaccgguuccgcgucgccu

SEQ ID NO: 1519865 - RNA, 19 nt, Pseudomonas aeruginosa PA01
ggccuuuuucaugggugcu

SEQ ID NO: 1519866 - RNA, 13 nt, Pseudomonas aeruginosa PA01
ggccuuucuucug

SEQ ID NO: 1519867 - RNA, 17 nt, Pseudomonas aeruginosa PA01
ggccuuuucucugcauc

SEQ ID NO: 1519868 - RNA, 22 nt, Pseudomonas aeruginosa PA01
ggccuuuugguuuucgcuccuc

SEQ ID NO: 1519869 - RNA, 17 nt, Pseudomonas aeruginosa PA01
ggccuuguucagggugg

SEQ ID NO: 1519870 - RNA, 12 nt, Pseudomonas aeruginosa PA01
ggcgaaauccuc

SEQ ID NO: 1519871 - RNA, 15 nt, Pseudomonas aeruginosa PA01
ggcgaaaccggccag

SEQ ID NO: 1519872 - RNA, 17 nt, Pseudomonas aeruginosa PA01
ggcgaaaaucgaagggu

SEQ ID NO: 1519873 - RNA, 17 nt, Pseudomonas aeruginosa PA01
ggcgaaacggcaggcca

SEQ ID NO: 1519874 - RNA, 18 nt, Pseudomonas aeruginosa PA01
ggcgaaacggcaggccag

SEQ ID NO: 1519875 - RNA, 16 nt, Pseudomonas aeruginosa PA01
ggcgaacaccgggccg

SEQ ID NO: 1519876 - RNA, 22 nt, Pseudomonas aeruginosa PA01
ggcgaacaccgggccgccggcg

SEQ ID NO: 1519877 - RNA, 23 nt, Pseudomonas aeruginosa PA01
ggcgaacaaucggucgcccucgg

SEQ ID NO: 1519878 - RNA, 17 nt, Pseudomonas aeruginosa PA01
ggcgaacaaccgcucgc

SEQ ID NO: 1519879 - RNA, 18 nt, Pseudomonas aeruginosa PA01
ggcgaacaaccgcucgcg

SEQ ID NO: 1519880 - RNA, 17 nt, Pseudomonas aeruginosa PA01
ggcgaacaacgccgccg

SEQ ID NO: 1519881 - RNA, 20 nt, Pseudomonas aeruginosa PA01
ggcgaacaacgccgccggcg

SEQ ID NO: 1519882 - RNA, 23 nt, Pseudomonas aeruginosa PA01
ggccgacaccucgaucagcgggu

SEQ ID NO: 1519883 - RNA, 19 nt, Pseudomonas aeruginosa PA01
ggccgacagagcggccggc

SEQ ID NO: 1519884 - RNA, 20 nt, Pseudomonas aeruginosa PA01
ggccgacagagcggccggcg

SEQ ID NO: 1519885 - RNA, 17 nt, Pseudomonas aeruginosa PA01
ggccgacagcggcuggc

SEQ ID NO: 1519886 - RNA, 14 nt, Pseudomonas aeruginosa PA01
ggccgaccagcagg

SEQ ID NO: 1519887 - RNA, 14 nt, Pseudomonas aeruginosa PA01
ggccgaccagcgcc

SEQ ID NO: 1519888 - RNA, 14 nt, Pseudomonas aeruginosa PA01
ggccgaccaggccg

SEQ ID NO: 1519889 - RNA, 15 nt, Pseudomonas aeruginosa PA01
ggccgaccgccaggc

SEQ ID NO: 1519890 - RNA, 16 nt, Pseudomonas aeruginosa PA01
ggccgaccgccaggcc

SEQ ID NO: 1519891 - RNA, 13 nt, Pseudomonas aeruginosa PA01
ggccgacgaaggc

SEQ ID NO: 1519892 - RNA, 18 nt, Pseudomonas aeruginosa PA01
ggccgacggcccuccggc

SEQ ID NO: 1519893 - RNA, 16 nt, Pseudomonas aeruginosa PA01
ggccgacggcgcgcug

SEQ ID NO: 1519894 - RNA, 18 nt, Pseudomonas aeruginosa PA01
ggccgacggcgcgcugcg

SEQ ID NO: 1519895 - RNA, 17 nt, Pseudomonas aeruginosa PA01
ggccgagcacaggguga

SEQ ID NO: 1519896 - RNA, 19 nt, Pseudomonas aeruginosa PA01
ggccuuguccgcgcgcuuc

SEQ ID NO: 1519897 - RNA, 14 nt, Pseudomonas aeruginosa PA01
ggccuuguccggca

SEQ ID NO: 1519898 - RNA, 15 nt, Pseudomonas aeruginosa PA01
ggccgacggguucuu

SEQ ID NO: 1519899 - RNA, 17 nt, Pseudomonas aeruginosa PA01
ggcgacgguaccaggga

SEQ ID NO: 1519900 - RNA, 20 nt, Pseudomonas aeruginosa PA01
ggcgacggucagcaggcccg

SEQ ID NO: 1519901 - RNA, 20 nt, Pseudomonas aeruginosa PA01
ggcgacggucaggccgagca

SEQ ID NO: 1519902 - RNA, 18 nt, Pseudomonas aeruginosa PA01
ggcgacguucugcucgcu

SEQ ID NO: 1519903 - RNA, 18 nt, Pseudomonas aeruginosa PA01
ggcgacgucgccccagcc

SEQ ID NO: 1519904 - RNA, 18 nt, Pseudomonas aeruginosa PA01
ggcgagaucuucaggccg

SEQ ID NO: 1519905 - RNA, 12 nt, Pseudomonas aeruginosa PA01
ggcgagagcgcc

SEQ ID NO: 1519906 - RNA, 19 nt, Pseudomonas aeruginosa PA01
ggcgagagcgccgaccagc

SEQ ID NO: 1519907 - RNA, 19 nt, Pseudomonas aeruginosa PA01
ggcgagaggucggcgcgcc

SEQ ID NO: 1519908 - RNA, 20 nt, Pseudomonas aeruginosa PA01
ggcgacuuccuugcgcgggc

SEQ ID NO: 1519909 - RNA, 21 nt, Pseudomonas aeruginosa PA01
ggcgagacuaccgaucggcug

SEQ ID NO: 1519910 - RNA, 22 nt, Pseudomonas aeruginosa PA01
ggcgagcaucucggccaggccc

SEQ ID NO: 1519911 - RNA, 13 nt, Pseudomonas aeruginosa PA01
ggcgagcagcggc

SEQ ID NO: 1519912 - RNA, 15 nt, Pseudomonas aeruginosa PA01
ggcgagcagcggcac

SEQ ID NO: 1519913 - RNA, 13 nt, Pseudomonas aeruginosa PA01
ggcgagcaggcgg

SEQ ID NO: 1519914 - RNA, 18 nt, Pseudomonas aeruginosa PA01
ggcgagcagggcgcugag

SEQ ID NO: 1519915 - RNA, 23 nt, Pseudomonas aeruginosa PA01
ggcgagcagggcgcugagcgcgg

SEQ ID NO: 1519916 - RNA, 14 nt, Pseudomonas aeruginosa PA01
ggcgagccgcagcg

SEQ ID NO: 1519917 - RNA, 12 nt, Pseudomonas aeruginosa PA01
ggcgagccgccg

SEQ ID NO: 1519918 - RNA, 16 nt, Pseudomonas aeruginosa PA01
ggcgagccgccgggcg

SEQ ID NO: 1519919 - RNA, 20 nt, Pseudomonas aeruginosa PA01
ggcgagcuggaucggcaggc

SEQ ID NO: 1519920 - RNA, 21 nt, Pseudomonas aeruginosa PA01
ggcgacgcccuguucggcggg

SEQ ID NO: 1519921 - RNA, 15 nt, Pseudomonas aeruginosa PA01
ggcgacgcucuucag

SEQ ID NO: 1519922 - RNA, 20 nt, Pseudomonas aeruginosa PA01
ggcgacgcucuucagcgguc

SEQ ID NO: 1519923 - RNA, 11 nt, Pseudomonas aeruginosa PA01
ggcgacgcugg

SEQ ID NO: 1519924 - RNA, 22 nt, Pseudomonas aeruginosa PA01
ggcgacgccgcgcugcaagggc

SEQ ID NO: 1519925 - RNA, 15 nt, Pseudomonas aeruginosa PA01
ggcgacgcgcaggcc

SEQ ID NO: 1519926 - RNA, 17 nt, Pseudomonas aeruginosa PA01
ggcgacgcgcaggccgg

SEQ ID NO: 1519927 - RNA, 23 nt, Pseudomonas aeruginosa PA01
ggcgacggaaacgacaggcugga

SEQ ID NO: 1519928 - RNA, 19 nt, Pseudomonas aeruginosa PA01
ggcgacgaucagcccgccg

SEQ ID NO: 1519929 - RNA, 22 nt, Pseudomonas aeruginosa PA01
ggcgacgaucagcccgccggcg

SEQ ID NO: 1519930 - RNA, 21 nt, Pseudomonas aeruginosa PA01
ggcgacgacgaucccggcggu

SEQ ID NO: 1519931 - RNA, 16 nt, Pseudomonas aeruginosa PA01
ggcgacgacgggagcg

SEQ ID NO: 1519932 - RNA, 22 nt, Pseudomonas aeruginosa PA01
ggcgacgacgggagcgcgaggc

SEQ ID NO: 1519933 - RNA, 17 nt, Pseudomonas aeruginosa PA01
ggcgacgaagacgcugc

SEQ ID NO: 1519934 - RNA, 16 nt, Pseudomonas aeruginosa PA01
ggcgaccuucagcggg

SEQ ID NO: 1519935 - RNA, 22 nt, Pseudomonas aeruginosa PA01
ggcgaccuugacgaagccggcg

SEQ ID NO: 1519936 - RNA, 20 nt, Pseudomonas aeruginosa PA01
ggcgaccuuguccaggcgcu

SEQ ID NO: 1519937 - RNA, 22 nt, Pseudomonas aeruginosa PA01
ggcgaccuuguccugcggccgg

SEQ ID NO: 1519938 - RNA, 20 nt, Pseudomonas aeruginosa PA01
ggcgaccuugucgauggucu

SEQ ID NO: 1519939 - RNA, 20 nt, Pseudomonas aeruginosa PA01
ggcgacgaaacggcucugcu

SEQ ID NO: 1519940 - RNA, 19 nt, Pseudomonas aeruginosa PA01
ggcugccgggcucugguag

SEQ ID NO: 1519941 - RNA, 19 nt, Pseudomonas aeruginosa PA01
ggcugccgccagcucaugg

SEQ ID NO: 1519942 - RNA, 17 nt, Pseudomonas aeruginosa PA01
ggcugccguugcggccc

SEQ ID NO: 1519943 - RNA, 18 nt, Pseudomonas aeruginosa PA01
ggcugccguugcggcccu

SEQ ID NO: 1519944 - RNA, 19 nt, Pseudomonas aeruginosa PA01
ggcugcgcucggcgcucgg

SEQ ID NO: 1519945 - RNA, 17 nt, Pseudomonas aeruginosa PA01
ggcugcgcuccaggcgg

SEQ ID NO: 1519946 - RNA, 14 nt, Pseudomonas aeruginosa PA01
ggcugcgcgccggg

SEQ ID NO: 1519947 - RNA, 19 nt, Pseudomonas aeruginosa PA01
ggcugcgcgccaccaccgu

SEQ ID NO: 1519948 - RNA, 23 nt, Pseudomonas aeruginosa PA01
ggcugcgccgcguucgccgagcu

SEQ ID NO: 1519949 - RNA, 21 nt, Pseudomonas aeruginosa PA01
ggcugccccucacaccaccag

SEQ ID NO: 1519950 - RNA, 17 nt, Pseudomonas aeruginosa PA01
ggcugcccaagggccug

SEQ ID NO: 1519951 - RNA, 14 nt, Pseudomonas aeruginosa PA01
ggcugcccaccacc

SEQ ID NO: 1519952 - RNA, 12 nt, Pseudomonas aeruginosa PA01
ggcugccgagca

SEQ ID NO: 1519953 - RNA, 13 nt, Pseudomonas aeruginosa PA01
ggcugccagcaua

SEQ ID NO: 1519954 - RNA, 16 nt, Pseudomonas aeruginosa PA01
ggcugagacgcugccg

SEQ ID NO: 1519955 - RNA, 12 nt, Pseudomonas aeruginosa PA01
ggcugaggcugg

SEQ ID NO: 1519956 - RNA, 15 nt, Pseudomonas aeruginosa PA01
ggcugaucagcccgc

SEQ ID NO: 1519957 - RNA, 17 nt, Pseudomonas aeruginosa PA01
ggcugaucggccgccag

SEQ ID NO: 1519958 - RNA, 16 nt, Pseudomonas aeruginosa PA01
ggcugcaacgccggcc

SEQ ID NO: 1519959 - RNA, 19 nt, Pseudomonas aeruginosa PA01
ggcugaagugggucgccgu

SEQ ID NO: 1519960 - RNA, 17 nt, Pseudomonas aeruginosa PA01
ggcugaagcggccgccg

SEQ ID NO: 1519961 - RNA, 19 nt, Pseudomonas aeruginosa PA01
ggcugacgcuggcgaaggc

SEQ ID NO: 1519962 - RNA, 16 nt, Pseudomonas aeruginosa PA01
ggcugaaggccgaacg

SEQ ID NO: 1519963 - RNA, 14 nt, Pseudomonas aeruginosa PA01
ggcguagcgcaggg

SEQ ID NO: 1519964 - RNA, 20 nt, Pseudomonas aeruginosa PA01
ggcguagaggcucggcggcc

SEQ ID NO: 1519965 - RNA, 15 nt, Pseudomonas aeruginosa PA01
ggcucauggcauggc

SEQ ID NO: 1519966 - RNA, 16 nt, Pseudomonas aeruginosa PA01
ggcucauggccggggu

SEQ ID NO: 1519967 - RNA, 15 nt, Pseudomonas aeruginosa PA01
ggcucaugcccagcu

SEQ ID NO: 1519968 - RNA, 21 nt, Pseudomonas aeruginosa PA01
ggcuccuugaaggcuuccugg

SEQ ID NO: 1519969 - RNA, 16 nt, Pseudomonas aeruginosa PA01
ggcucgaggccgagcc

SEQ ID NO: 1519970 - RNA, 12 nt, Pseudomonas aeruginosa PA01
ggcucgagccga

SEQ ID NO: 1519971 - RNA, 21 nt, Pseudomonas aeruginosa PA01
ggcuccagccgggcuccgccg

SEQ ID NO: 1519972 - RNA, 21 nt, Pseudomonas aeruginosa PA01
ggcucugguagccgcagucca

SEQ ID NO: 1519973 - RNA, 16 nt, Pseudomonas aeruginosa PA01
ggcucuggcgcaggga

SEQ ID NO: 1519974 - RNA, 22 nt, Pseudomonas aeruginosa PA01
ggcucugcuccagcaaugccag

SEQ ID NO: 1519975 - RNA, 20 nt, Pseudomonas aeruginosa PA01
ggcucgguuccagcucgucg

SEQ ID NO: 1519976 - RNA, 23 nt, Pseudomonas aeruginosa PA01
ggcucucgcgcagcaggauccag

SEQ ID NO: 1519977 - RNA, 20 nt, Pseudomonas aeruginosa PA01
ggcucgucaucguccagcuc

SEQ ID NO: 1519978 - RNA, 18 nt, Pseudomonas aeruginosa PA01
ggcucggcgggcugccgc

SEQ ID NO: 1519979 - RNA, 19 nt, Pseudomonas aeruginosa PA01
ggcucggcgggcugccgcg

SEQ ID NO: 1519980 - RNA, 22 nt, Pseudomonas aeruginosa PA01
ggcucggcugcuugccggugcc

SEQ ID NO: 1519981 - RNA, 13 nt, Pseudomonas aeruginosa PA01
ggcucggcuucca

SEQ ID NO: 1519982 - RNA, 12 nt, Pseudomonas aeruginosa PA01
ggcucggcggca

SEQ ID NO: 1519983 - RNA, 15 nt, Pseudomonas aeruginosa PA01
ggcucgccgaaaggc

SEQ ID NO: 1519984 - RNA, 16 nt, Pseudomonas aeruginosa PA01
ggcucgccggguuguc

SEQ ID NO: 1519985 - RNA, 15 nt, Pseudomonas aeruginosa PA01
ggcucgcgcggggcg

SEQ ID NO: 1519986 - RNA, 19 nt, Pseudomonas aeruginosa PA01
ggcucgaucagccggcgcg

SEQ ID NO: 1519987 - RNA, 17 nt, Pseudomonas aeruginosa PA01
ggcucgaucggcagggc

SEQ ID NO: 1519988 - RNA, 18 nt, Pseudomonas aeruginosa PA01
ggcuccucugccugcgcc

SEQ ID NO: 1519989 - RNA, 16 nt, Pseudomonas aeruginosa PA01
ggcucgcccagcaggc

SEQ ID NO: 1519990 - RNA, 19 nt, Pseudomonas aeruginosa PA01
ggcucgcccaugcgcggcg

SEQ ID NO: 1519991 - RNA, 15 nt, Pseudomonas aeruginosa PA01
ggcucgccccggcgg

SEQ ID NO: 1519992 - RNA, 20 nt, Pseudomonas aeruginosa PA01
ggcuugugcagagaggcugg

SEQ ID NO: 1519993 - RNA, 21 nt, Pseudomonas aeruginosa PA01
ggcuugcgcgccaccagcgug

SEQ ID NO: 1519994 - RNA, 14 nt, Pseudomonas aeruginosa PA01
ggcuugccgggguc

SEQ ID NO: 1519995 - RNA, 17 nt, Pseudomonas aeruginosa PA01
ggcuucggcgcgcuggu

SEQ ID NO: 1519996 - RNA, 23 nt, Pseudomonas aeruginosa PA01
ggcuucguccagcgaggcgugga

SEQ ID NO: 1519997 - RNA, 22 nt, Pseudomonas aeruginosa PA01
ggcuucguccugcugcuggccu

SEQ ID NO: 1519998 - RNA, 14 nt, Pseudomonas aeruginosa PA01
ggcuugaccgccgc

SEQ ID NO: 1519999 - RNA, 15 nt, Pseudomonas aeruginosa PA01
ggcuugacuggcagu

SEQ ID NO: 1520000 - RNA, 18 nt, Pseudomonas aeruginosa PA01
ggcuugaggaaaaagaca

SEQ ID NO: 1520001 - RNA, 19 nt, Pseudomonas aeruginosa PA01
ggcuugaggaaguggccgg

SEQ ID NO: 1520002 - RNA, 14 nt, Pseudomonas aeruginosa PA01
ggcuucuugagccc

SEQ ID NO: 1520003 - RNA, 11 nt, Pseudomonas aeruginosa PA01
ggcuucuucag

SEQ ID NO: 1520004 - RNA, 11 nt, Pseudomonas aeruginosa PA01
ggcuucaacgc

SEQ ID NO: 1520005 - RNA, 12 nt, Pseudomonas aeruginosa PA01
ggcuuccaucac

SEQ ID NO: 1520006 - RNA, 20 nt, Pseudomonas aeruginosa PA01
ggcuucgaugcuuagcccgg

SEQ ID NO: 1520007 - RNA, 16 nt, Pseudomonas aeruginosa PA01
ggcuucgcgcuccagg

SEQ ID NO: 1520008 - RNA, 12 nt, Pseudomonas aeruginosa PA01
ggcuucgcugau

SEQ ID NO: 1520009 - RNA, 14 nt, Pseudomonas aeruginosa PA01
ggcuuccggcucca

SEQ ID NO: 1520010 - RNA, 16 nt, Pseudomonas aeruginosa PA01
ggcuuccuccaucgcc

SEQ ID NO: 1520011 - RNA, 19 nt, Pseudomonas aeruginosa PA01
ggcuuccuggcgccgguaa

SEQ ID NO: 1520012 - RNA, 14 nt, Pseudomonas aeruginosa PA01
ggcuguugcccugg

SEQ ID NO: 1520013 - RNA, 16 nt, Pseudomonas aeruginosa PA01
ggcuguuucaggccgg

SEQ ID NO: 1520014 - RNA, 22 nt, Pseudomonas aeruginosa PA01
ggcuuacccgcgaccacaggcg

SEQ ID NO: 1520015 - RNA, 17 nt, Pseudomonas aeruginosa PA01
ggcuguccagcaggcgu

SEQ ID NO: 1520016 - RNA, 18 nt, Pseudomonas aeruginosa PA01
ggcugguucagcggguuc

SEQ ID NO: 1520017 - RNA, 15 nt, Pseudomonas aeruginosa PA01
ggcugguugccagca

SEQ ID NO: 1520018 - RNA, 14 nt, Pseudomonas aeruginosa PA01
ggcuguacagcagg

SEQ ID NO: 1520019 - RNA, 23 nt, Pseudomonas aeruginosa PA01
ggcuguagccacggcgagagcgc

SEQ ID NO: 1520020 - RNA, 15 nt, Pseudomonas aeruginosa PA01
ggcugucguccuggg

SEQ ID NO: 1520021 - RNA, 13 nt, Pseudomonas aeruginosa PA01
ggcugugcagggc

SEQ ID NO: 1520022 - RNA, 14 nt, Pseudomonas aeruginosa PA01
ggcugugcaucugc

SEQ ID NO: 1520023 - RNA, 16 nt, Pseudomonas aeruginosa PA01
ggcugugcgccaggcc

SEQ ID NO: 1520024 - RNA, 14 nt, Pseudomonas aeruginosa PA01
ggcugggcgcccuu

SEQ ID NO: 1520025 - RNA, 15 nt, Pseudomonas aeruginosa PA01
ggcuggucggcuucc

SEQ ID NO: 1520026 - RNA, 14 nt, Pseudomonas aeruginosa PA01
ggcuggucaggcug

SEQ ID NO: 1520027 - RNA, 15 nt, Pseudomonas aeruginosa PA01
ggcuggucaggcuga

SEQ ID NO: 1520028 - RNA, 18 nt, Pseudomonas aeruginosa PA01
ggcuggucaguucggccc

SEQ ID NO: 1520029 - RNA, 20 nt, Pseudomonas aeruginosa PA01
ggcugguaugcagcaacccg

SEQ ID NO: 1520030 - RNA, 17 nt, Pseudomonas aeruginosa PA01
ggcugggguugcggcgc

SEQ ID NO: 1520031 - RNA, 22 nt, Pseudomonas aeruginosa PA01
ggcugggguugcggcgcccgcc

SEQ ID NO: 1520032 - RNA, 21 nt, Pseudomonas aeruginosa PA01
ggcuggcugaagccgggcacc

SEQ ID NO: 1520033 - RNA, 17 nt, Pseudomonas aeruginosa PA01
ggcuggcggccagggca

SEQ ID NO: 1520034 - RNA, 17 nt, Pseudomonas aeruginosa PA01
ggcuggcuccccccugg

SEQ ID NO: 1520035 - RNA, 13 nt, Pseudomonas aeruginosa PA01
ggcugggccagga

SEQ ID NO: 1520036 - RNA, 19 nt, Pseudomonas aeruginosa PA01
ggcugcuugccgcucaggc

SEQ ID NO: 1520037 - RNA, 16 nt, Pseudomonas aeruginosa PA01
ggcugcuucggcagcc

SEQ ID NO: 1520038 - RNA, 17 nt, Pseudomonas aeruginosa PA01
ggcugcuucggcagccu

SEQ ID NO: 1520039 - RNA, 18 nt, Pseudomonas aeruginosa PA01
ggcugcuguccagcgcuc

SEQ ID NO: 1520040 - RNA, 19 nt, Pseudomonas aeruginosa PA01
ggcugcuggcgaagcuggg

SEQ ID NO: 1520041 - RNA, 16 nt, Pseudomonas aeruginosa PA01
ggcugcugcgccuggc

SEQ ID NO: 1520042 - RNA, 16 nt, Pseudomonas aeruginosa PA01
ggcugcugcugcggcg

SEQ ID NO: 1520043 - RNA, 22 nt, Pseudomonas aeruginosa PA01
ggcugcugcugcggcgguugga

SEQ ID NO: 1520044 - RNA, 20 nt, Pseudomonas aeruginosa PA01
ggcugcggcggaaggcggcg

SEQ ID NO: 1520045 - RNA, 10 nt, Pseudomonas aeruginosa PA01
ggcugcucgc

SEQ ID NO: 1520046 - RNA, 15 nt, Pseudomonas aeruginosa PA01
ggcuggaccuccugg

SEQ ID NO: 1520047 - RNA, 15 nt, Pseudomonas aeruginosa PA01
ggcuggccaccagca

SEQ ID NO: 1520048 - RNA, 14 nt, Pseudomonas aeruginosa PA01
ggcuggccaccgcc

SEQ ID NO: 1520049 - RNA, 21 nt, Pseudomonas aeruginosa PA01
ggcuggccaccgccaggaccu

SEQ ID NO: 1520050 - RNA, 22 nt, Pseudomonas aeruginosa PA01
ggcuggaucgaucucgucggcg

SEQ ID NO: 1520051 - RNA, 12 nt, Pseudomonas aeruginosa PA01
ggcuggcccucc

SEQ ID NO: 1520052 - RNA, 15 nt, Pseudomonas aeruginosa PA01
ggcuggccgagggcg

SEQ ID NO: 1520053 - RNA, 15 nt, Pseudomonas aeruginosa PA01
ggcuggccagcaggc

SEQ ID NO: 1520054 - RNA, 18 nt, Pseudomonas aeruginosa PA01
ggcuggccagcaggcugg

SEQ ID NO: 1520055 - RNA, 19 nt, Pseudomonas aeruginosa PA01
ggcuggccagcaggcuggc

SEQ ID NO: 1520056 - RNA, 17 nt, Pseudomonas aeruginosa PA01
ggcuggccagaauucca

SEQ ID NO: 1520057 - RNA, 23 nt, Pseudomonas aeruginosa PA01
ggcuggccagaauuccagcaggu

SEQ ID NO: 1520058 - RNA, 19 nt, Pseudomonas aeruginosa PA01
ggcuggcgcgaucggggca

SEQ ID NO: 1520059 - RNA, 13 nt, Pseudomonas aeruginosa PA01
ggcuggcgggguc

SEQ ID NO: 1520060 - RNA, 20 nt, Pseudomonas aeruginosa PA01
ggcuggcggggucgcgccgg

SEQ ID NO: 1520061 - RNA, 16 nt, Pseudomonas aeruginosa PA01
ggcuggccgcgguggg

SEQ ID NO: 1520062 - RNA, 12 nt, Pseudomonas aeruginosa PA01
ggcuggccucgg

SEQ ID NO: 1520063 - RNA, 13 nt, Pseudomonas aeruginosa PA01
ggcuggccuuggc

SEQ ID NO: 1520064 - RNA, 17 nt, Pseudomonas aeruginosa PA01
gggcagggaguccgcca

SEQ ID NO: 1520065 - RNA, 14 nt, Pseudomonas aeruginosa PA01
gggcaggcgcaggc

SEQ ID NO: 1520066 - RNA, 12 nt, Pseudomonas aeruginosa PA01
gggcaggcaugc

SEQ ID NO: 1520067 - RNA, 14 nt, Pseudomonas aeruginosa PA01
gggcagguggacgg

SEQ ID NO: 1520068 - RNA, 15 nt, Pseudomonas aeruginosa PA01
gggcagaacacccgg

SEQ ID NO: 1520069 - RNA, 14 nt, Pseudomonas aeruginosa PA01
gggcagcagucgca

SEQ ID NO: 1520070 - RNA, 20 nt, Pseudomonas aeruginosa PA01
gggcagcagucgcagcucgg

SEQ ID NO: 1520071 - RNA, 14 nt, Pseudomonas aeruginosa PA01
gggcagcacgcugg

SEQ ID NO: 1520072 - RNA, 13 nt, Pseudomonas aeruginosa PA01
gggcacgccgcuc

SEQ ID NO: 1520073 - RNA, 19 nt, Pseudomonas aeruginosa PA01
gggcacgccgguggccagg

SEQ ID NO: 1520074 - RNA, 20 nt, Pseudomonas aeruginosa PA01
gggcacgccgguggccaggc

SEQ ID NO: 1520075 - RNA, 12 nt, Pseudomonas aeruginosa PA01
gggcacggccag

SEQ ID NO: 1520076 - RNA, 19 nt, Pseudomonas aeruginosa PA01
gggcaccaguggcgccgcc

SEQ ID NO: 1520077 - RNA, 19 nt, Pseudomonas aeruginosa PA01
gggcagacaccaccagguu

SEQ ID NO: 1520078 - RNA, 21 nt, Pseudomonas aeruginosa PA01
gggcagaccuggugggcggcg

SEQ ID NO: 1520079 - RNA, 15 nt, Pseudomonas aeruginosa PA01
gggcacgugcagcgg

SEQ ID NO: 1520080 - RNA, 12 nt, Pseudomonas aeruginosa PA01
gggcaccacgga

SEQ ID NO: 1520081 - RNA, 14 nt, Pseudomonas aeruginosa PA01
gggcaagcucgacg

SEQ ID NO: 1520082 - RNA, 15 nt, Pseudomonas aeruginosa PA01
gggcaagcugcacgg

SEQ ID NO: 1520083 - RNA, 19 nt, Pseudomonas aeruginosa PA01
gggcaaaggcgcgcagggc

SEQ ID NO: 1520084 - RNA, 13 nt, Pseudomonas aeruginosa PA01
gggcaacaggccg

SEQ ID NO: 1520085 - RNA, 13 nt, Pseudomonas aeruginosa PA01
gggcaacgccagg

SEQ ID NO: 1520086 - RNA, 14 nt, Pseudomonas aeruginosa PA01
gggcaacgccaggc

SEQ ID NO: 1520087 - RNA, 23 nt, Pseudomonas aeruginosa PA01
gggcaacgccaggcugucagggc

SEQ ID NO: 1520088 - RNA, 14 nt, Pseudomonas aeruginosa PA01
gggcaacggcuggg

SEQ ID NO: 1520089 - RNA, 19 nt, Pseudomonas aeruginosa PA01
gggcaacugaucagccggg

SEQ ID NO: 1520090 - RNA, 17 nt, Pseudomonas aeruginosa PA01
gggauuguugcggcggg

SEQ ID NO: 1520091 - RNA, 22 nt, Pseudomonas aeruginosa PA01
gggauuccgggucgaggcugcc

SEQ ID NO: 1520092 - RNA, 19 nt, Pseudomonas aeruginosa PA01
gggauggucggugacccgc

SEQ ID NO: 1520093 - RNA, 23 nt, Pseudomonas aeruginosa PA01
gggaugccuucgggagagcccgg

SEQ ID NO: 1520094 - RNA, 20 nt, Pseudomonas aeruginosa PA01
gggauggggcugccggcccu

SEQ ID NO: 1520095 - RNA, 17 nt, Pseudomonas aeruginosa PA01
gggauguuccaggcccg

SEQ ID NO: 1520096 - RNA, 12 nt, Pseudomonas aeruginosa PA01
gggauggcgggc

SEQ ID NO: 1520097 - RNA, 15 nt, Pseudomonas aeruginosa PA01
gggauguccgccgcc

SEQ ID NO: 1520098 - RNA, 15 nt, Pseudomonas aeruginosa PA01
gggaugccggcggca

SEQ ID NO: 1520099 - RNA, 19 nt, Pseudomonas aeruginosa PA01
gggaugcccggccgcaggc

SEQ ID NO: 1520100 - RNA, 15 nt, Pseudomonas aeruginosa PA01
gggaugccgccggca

SEQ ID NO: 1520101 - RNA, 16 nt, Pseudomonas aeruginosa PA01
gggaucguaggcgcgc

SEQ ID NO: 1520102 - RNA, 18 nt, Pseudomonas aeruginosa PA01
gggaucuggcccugcaac

SEQ ID NO: 1520103 - RNA, 18 nt, Pseudomonas aeruginosa PA01
gggaggucgcacgcagcg

SEQ ID NO: 1520104 - RNA, 16 nt, Pseudomonas aeruginosa PA01
gggaggugcggcggug

SEQ ID NO: 1520105 - RNA, 22 nt, Pseudomonas aeruginosa PA01
gggaguccagguacaccagggu

SEQ ID NO: 1520106 - RNA, 17 nt, Pseudomonas aeruginosa PA01
gggauagcuuuccaggg

SEQ ID NO: 1520107 - RNA, 24 nt, Pseudomonas aeruginosa PA01
gggauaccggccaucagcaccagg

SEQ ID NO: 1520108 - RNA, 15 nt, Pseudomonas aeruginosa PA01
gggaucagcggcggg

SEQ ID NO: 1520109 - RNA, 17 nt, Pseudomonas aeruginosa PA01
gggaucagcggcggggc

SEQ ID NO: 1520110 - RNA, 22 nt, Pseudomonas aeruginosa PA01
gggaucgacgccgcuggcggcg

SEQ ID NO: 1520111 - RNA, 19 nt, Pseudomonas aeruginosa PA01
gggaucgccacgccggcgc

SEQ ID NO: 1520112 - RNA, 16 nt, Pseudomonas aeruginosa PA01
gggaucgcgcggcugg

SEQ ID NO: 1520113 - RNA, 20 nt, Pseudomonas aeruginosa PA01
gggaaaauggaacagucgcg

SEQ ID NO: 1520114 - RNA, 23 nt, Pseudomonas aeruginosa PA01
gggaaaagcccagguggcaggcc

SEQ ID NO: 1520115 - RNA, 21 nt, Pseudomonas aeruginosa PA01
gggaaaaaagggagccaggcg

SEQ ID NO: 1520116 - RNA, 22 nt, Pseudomonas aeruginosa PA01
gggaaaucccggagaucggcug

SEQ ID NO: 1520117 - RNA, 22 nt, Pseudomonas aeruginosa PA01
gggaaccaggcgccgcccccgg

SEQ ID NO: 1520118 - RNA, 14 nt, Pseudomonas aeruginosa PA01
gggaacagcgccag

SEQ ID NO: 1520119 - RNA, 23 nt, Pseudomonas aeruginosa PA01
gggaagcugccuuccagcagguc

SEQ ID NO: 1520120 - RNA, 15 nt, Pseudomonas aeruginosa PA01
gggaagcgcaggccg

SEQ ID NO: 1520121 - RNA, 20 nt, Pseudomonas aeruginosa PA01
gggaagcgcgcgccaguccc

SEQ ID NO: 1520122 - RNA, 16 nt, Pseudomonas aeruginosa PA01
gggaagcgcggcucgg

SEQ ID NO: 1520123 - RNA, 16 nt, Pseudomonas aeruginosa PA01
gggaagauguucgccg

SEQ ID NO: 1520124 - RNA, 18 nt, Pseudomonas aeruginosa PA01
ggcuuuccagcaggcgcu

SEQ ID NO: 1520125 - RNA, 15 nt, Pseudomonas aeruginosa PA01
ggcuuguuuagccau

SEQ ID NO: 1520126 - RNA, 23 nt, Pseudomonas aeruginosa PA01
ggcuuuuucgacaaggagacuca

SEQ ID NO: 1520127 - RNA, 18 nt, Pseudomonas aeruginosa PA01
gggaauggagaugccgaa

SEQ ID NO: 1520128 - RNA, 20 nt, Pseudomonas aeruginosa PA01
gggaaucgccagcaggcugu

SEQ ID NO: 1520129 - RNA, 15 nt, Pseudomonas aeruginosa PA01
gggaaggucggcagc

SEQ ID NO: 1520130 - RNA, 17 nt, Pseudomonas aeruginosa PA01
gggaaggucggcagcag

SEQ ID NO: 1520131 - RNA, 14 nt, Pseudomonas aeruginosa PA01
gggaauucuuccgg

SEQ ID NO: 1520132 - RNA, 20 nt, Pseudomonas aeruginosa PA01
gggacaggaagagcaggcgg

SEQ ID NO: 1520133 - RNA, 20 nt, Pseudomonas aeruginosa PA01
gggacagguuucgcaagggu

SEQ ID NO: 1520134 - RNA, 21 nt, Pseudomonas aeruginosa PA01
gggaccacgcucaggucgguc

SEQ ID NO: 1520135 - RNA, 21 nt, Pseudomonas aeruginosa PA01
gggacaugucgagggccgggu

SEQ ID NO: 1520136 - RNA, 21 nt, Pseudomonas aeruginosa PA01
gggaccggcugcuuggccagg

SEQ ID NO: 1520137 - RNA, 22 nt, Pseudomonas aeruginosa PA01
gggaccggcugcuuggccaggu

SEQ ID NO: 1520138 - RNA, 22 nt, Pseudomonas aeruginosa PA01
gggaccugucggcucgcgccgg

SEQ ID NO: 1520139 - RNA, 20 nt, Pseudomonas aeruginosa PA01
gggacggaacgucggccugg

SEQ ID NO: 1520140 - RNA, 13 nt, Pseudomonas aeruginosa PA01
gggacggcagccu

SEQ ID NO: 1520141 - RNA, 15 nt, Pseudomonas aeruginosa PA01
gggacggcagccugg

SEQ ID NO: 1520142 - RNA, 14 nt, Pseudomonas aeruginosa PA01
gggacggcggcugg

SEQ ID NO: 1520143 - RNA, 19 nt, Pseudomonas aeruginosa PA01
gggacgaagcggaagccgg

SEQ ID NO: 1520144 - RNA, 20 nt, Pseudomonas aeruginosa PA01
gggacgaagcggaagccggg

SEQ ID NO: 1520145 - RNA, 15 nt, Pseudomonas aeruginosa PA01
gggacgcaugcgcgg

SEQ ID NO: 1520146 - RNA, 15 nt, Pseudomonas aeruginosa PA01
gggacgccaggcguc

SEQ ID NO: 1520147 - RNA, 14 nt, Pseudomonas aeruginosa PA01
gggagcgccggcgc

SEQ ID NO: 1520148 - RNA, 22 nt, Pseudomonas aeruginosa PA01
gggagcgacaccaugcuccgcc

SEQ ID NO: 1520149 - RNA, 14 nt, Pseudomonas aeruginosa PA01
gggagcaggacgcc

SEQ ID NO: 1520150 - RNA, 21 nt, Pseudomonas aeruginosa PA01
gggagaacagcagggucaggg

SEQ ID NO: 1520151 - RNA, 15 nt, Pseudomonas aeruginosa PA01
gggagaaccaggcgg

SEQ ID NO: 1520152 - RNA, 22 nt, Pseudomonas aeruginosa PA01
ggggcggcgucccggcgccgcc

SEQ ID NO: 1520153 - RNA, 13 nt, Pseudomonas aeruginosa PA01
ggggcggccggcg

SEQ ID NO: 1520154 - RNA, 17 nt, Pseudomonas aeruginosa PA01
ggggcggauucaggcgc

SEQ ID NO: 1520155 - RNA, 15 nt, Pseudomonas aeruginosa PA01
ggggcucggcuucca

SEQ ID NO: 1520156 - RNA, 16 nt, Pseudomonas aeruginosa PA01
ggggcucggcuuccau

SEQ ID NO: 1520157 - RNA, 20 nt, Pseudomonas aeruginosa PA01
ggggcuagucgcgcagcgcc

SEQ ID NO: 1520158 - RNA, 17 nt, Pseudomonas aeruginosa PA01
gggggccucggccagcg

SEQ ID NO: 1520159 - RNA, 14 nt, Pseudomonas aeruginosa PA01
ggggcuuugcggcc

SEQ ID NO: 1520160 - RNA, 24 nt, Pseudomonas aeruginosa PA01
ggggcuuuuuuaugcgcagcgcgg

SEQ ID NO: 1520161 - RNA, 22 nt, Pseudomonas aeruginosa PA01
ggggcucuuucguuucagcgcc

SEQ ID NO: 1520162 - RNA, 13 nt, Pseudomonas aeruginosa PA01
ggggcugagcgca

SEQ ID NO: 1520163 - RNA, 21 nt, Pseudomonas aeruginosa PA01
ggggcugaucucggccauggu

SEQ ID NO: 1520164 - RNA, 21 nt, Pseudomonas aeruginosa PA01
ggggccggacgcgacugcugc

SEQ ID NO: 1520165 - RNA, 16 nt, Pseudomonas aeruginosa PA01
ggggccguccgccagg

SEQ ID NO: 1520166 - RNA, 13 nt, Pseudomonas aeruginosa PA01
ggggcgcaccgcc

SEQ ID NO: 1520167 - RNA, 19 nt, Pseudomonas aeruginosa PA01
ggggcgacauagcggcugc

SEQ ID NO: 1520168 - RNA, 22 nt, Pseudomonas aeruginosa PA01
ggggccuggcucgaucggcagg

SEQ ID NO: 1520169 - RNA, 16 nt, Pseudomonas aeruginosa PA01
ggggccuucaggcgcu

SEQ ID NO: 1520170 - RNA, 14 nt, Pseudomonas aeruginosa PA01
ggggccucggccag

SEQ ID NO: 1520171 - RNA, 18 nt, Pseudomonas aeruginosa PA01
ggggccucggccagcgcc

SEQ ID NO: 1520172 - RNA, 12 nt, Pseudomonas aeruginosa PA01
ggggcgcucgcc

SEQ ID NO: 1520173 - RNA, 14 nt, Pseudomonas aeruginosa PA01
ggggcgcucagggu

SEQ ID NO: 1520174 - RNA, 17 nt, Pseudomonas aeruginosa PA01
ggggcgccuguccggga

SEQ ID NO: 1520175 - RNA, 17 nt, Pseudomonas aeruginosa PA01
ggggcauguccaccgcc

SEQ ID NO: 1520176 - RNA, 17 nt, Pseudomonas aeruginosa PA01
ggggcauucguccagcc

SEQ ID NO: 1520177 - RNA, 21 nt, Pseudomonas aeruginosa PA01
ggggcauucguccagccgccg

SEQ ID NO: 1520178 - RNA, 20 nt, Pseudomonas aeruginosa PA01
ggggccgaggucgaccagcc

SEQ ID NO: 1520179 - RNA, 17 nt, Pseudomonas aeruginosa PA01
ggggcccggcuccagcc

SEQ ID NO: 1520180 - RNA, 20 nt, Pseudomonas aeruginosa PA01
ggggcccggcuccagccggg

SEQ ID NO: 1520181 - RNA, 19 nt, Pseudomonas aeruginosa PA01
ggggcccggcaggcagugc

SEQ ID NO: 1520182 - RNA, 17 nt, Pseudomonas aeruginosa PA01
ggggaucacucgccgcc

SEQ ID NO: 1520183 - RNA, 16 nt, Pseudomonas aeruginosa PA01
ggggauguccgccgcc

SEQ ID NO: 1520184 - RNA, 23 nt, Pseudomonas aeruginosa PA01
ggggagauguccaucagccgcgc

SEQ ID NO: 1520185 - RNA, 17 nt, Pseudomonas aeruginosa PA01
ggggaaucugcgccagg

SEQ ID NO: 1520186 - RNA, 13 nt, Pseudomonas aeruginosa PA01
ggggaacagcgcc

SEQ ID NO: 1520187 - RNA, 17 nt, Pseudomonas aeruginosa PA01
ggggaacagcgccagcg

SEQ ID NO: 1520188 - RNA, 16 nt, Pseudomonas aeruginosa PA01
ggggaacacgcgcugg

SEQ ID NO: 1520189 - RNA, 18 nt, Pseudomonas aeruginosa PA01
ggggaaacccucaggucg

SEQ ID NO: 1520190 - RNA, 20 nt, Pseudomonas aeruginosa PA01
gggcuuuuucguauccgcgg

SEQ ID NO: 1520191 - RNA, 14 nt, Pseudomonas aeruginosa PA01
gggcuugcgcgcca

SEQ ID NO: 1520192 - RNA, 16 nt, Pseudomonas aeruginosa PA01
gggcuucccaggccag

SEQ ID NO: 1520193 - RNA, 17 nt, Pseudomonas aeruginosa PA01
gggcugcgugccagcac

SEQ ID NO: 1520194 - RNA, 18 nt, Pseudomonas aeruginosa PA01
gggcugcgcaucgccugg

SEQ ID NO: 1520195 - RNA, 20 nt, Pseudomonas aeruginosa PA01
gggcuggccaccgccaggac

SEQ ID NO: 1520196 - RNA, 23 nt, Pseudomonas aeruginosa PA01
gggcugggcagcgccgccgggcg

SEQ ID NO: 1520197 - RNA, 21 nt, Pseudomonas aeruginosa PA01
gggcuguagggcgaauaacgc

SEQ ID NO: 1520198 - RNA, 21 nt, Pseudomonas aeruginosa PA01
gggcuguagugcuccggggcg

SEQ ID NO: 1520199 - RNA, 19 nt, Pseudomonas aeruginosa PA01
gggcuggucguagcagcgg

SEQ ID NO: 1520200 - RNA, 16 nt, Pseudomonas aeruginosa PA01
gggcuguugcugggcu

SEQ ID NO: 1520201 - RNA, 20 nt, Pseudomonas aeruginosa PA01
ggguaauccaucgcuuucag

SEQ ID NO: 1520202 - RNA, 19 nt, Pseudomonas aeruginosa PA01
ggguaacgguagcggcagg

SEQ ID NO: 1520203 - RNA, 20 nt, Pseudomonas aeruginosa PA01
ggguaacgguagcggcagga

SEQ ID NO: 1520204 - RNA, 16 nt, Pseudomonas aeruginosa PA01
gggguugaguugcagg

SEQ ID NO: 1520205 - RNA, 17 nt, Pseudomonas aeruginosa PA01
gggguugcccagcaggc

SEQ ID NO: 1520206 - RNA, 19 nt, Pseudomonas aeruginosa PA01
gggguuuuuuuugccugga

SEQ ID NO: 1520207 - RNA, 22 nt, Pseudomonas aeruginosa PA01
ggguaguagaucagcuucucuu

SEQ ID NO: 1520208 - RNA, 15 nt, Pseudomonas aeruginosa PA01
ggguagccgcccacc

SEQ ID NO: 1520209 - RNA, 12 nt, Pseudomonas aeruginosa PA01
ggguagcugcug

SEQ ID NO: 1520210 - RNA, 22 nt, Pseudomonas aeruginosa PA01
ggguacagcgccacggccagca

SEQ ID NO: 1520211 - RNA, 18 nt, Pseudomonas aeruginosa PA01
ggguaccguugcgcaggc

SEQ ID NO: 1520212 - RNA, 17 nt, Pseudomonas aeruginosa PA01
ggguagagucgcucgcg

SEQ ID NO: 1520213 - RNA, 14 nt, Pseudomonas aeruginosa PA01
ggguacgguuggcc

SEQ ID NO: 1520214 - RNA, 19 nt, Pseudomonas aeruginosa PA01
ggguacgguuggccagcga

SEQ ID NO: 1520215 - RNA, 14 nt, Pseudomonas aeruginosa PA01
ggggugggcauagg

SEQ ID NO: 1520216 - RNA, 21 nt, Pseudomonas aeruginosa PA01
ggggugggcauaggaauacgg

SEQ ID NO: 1520217 - RNA, 12 nt, Pseudomonas aeruginosa PA01
ggggucggccug

SEQ ID NO: 1520218 - RNA, 14 nt, Pseudomonas aeruginosa PA01
ggggugaagcgcag

SEQ ID NO: 1520219 - RNA, 18 nt, Pseudomonas aeruginosa PA01
ggggugaagcgcaggcgg

SEQ ID NO: 1520220 - RNA, 22 nt, Pseudomonas aeruginosa PA01
ggggugcgcuggaacggccagg

SEQ ID NO: 1520221 - RNA, 15 nt, Pseudomonas aeruginosa PA01
ggggugauccagcug

SEQ ID NO: 1520222 - RNA, 17 nt, Pseudomonas aeruginosa PA01
ggggucaggccgaggcg

SEQ ID NO: 1520223 - RNA, 16 nt, Pseudomonas aeruginosa PA01
ggggucgagguuggag

SEQ ID NO: 1520224 - RNA, 20 nt, Pseudomonas aeruginosa PA01
ggggucaguuccaggucggc

SEQ ID NO: 1520225 - RNA, 17 nt, Pseudomonas aeruginosa PA01
gggggugaagcgcaggc

SEQ ID NO: 1520226 - RNA, 19 nt, Pseudomonas aeruginosa PA01
gggggugaagcgcaggcgg

SEQ ID NO: 1520227 - RNA, 17 nt, Pseudomonas aeruginosa PA01
gggggugcccaucaggc

SEQ ID NO: 1520228 - RNA, 14 nt, Pseudomonas aeruginosa PA01
gggucagcagcgcc

SEQ ID NO: 1520229 - RNA, 16 nt, Pseudomonas aeruginosa PA01
gggucagcagcgccag

SEQ ID NO: 1520230 - RNA, 15 nt, Pseudomonas aeruginosa PA01
gggucagcaggcugc

SEQ ID NO: 1520231 - RNA, 19 nt, Pseudomonas aeruginosa PA01
gggucacgccgagggcgcg

SEQ ID NO: 1520232 - RNA, 15 nt, Pseudomonas aeruginosa PA01
gggucacggucagcu

SEQ ID NO: 1520233 - RNA, 18 nt, Pseudomonas aeruginosa PA01
gggucaccagcgccgggu

SEQ ID NO: 1520234 - RNA, 19 nt, Pseudomonas aeruginosa PA01
ggguauucagugaaaggga

SEQ ID NO: 1520235 - RNA, 11 nt, Pseudomonas aeruginosa PA01
ggguccaugga

SEQ ID NO: 1520236 - RNA, 22 nt, Pseudomonas aeruginosa PA01
ggguccugcagauaaagcugga

SEQ ID NO: 1520237 - RNA, 13 nt, Pseudomonas aeruginosa PA01
ggguccaggcgcc

SEQ ID NO: 1520238 - RNA, 20 nt, Pseudomonas aeruginosa PA01
ggguccaggcgccagagcgc

SEQ ID NO: 1520239 - RNA, 15 nt, Pseudomonas aeruginosa PA01
gggucaugagguuca

SEQ ID NO: 1520240 - RNA, 14 nt, Pseudomonas aeruginosa PA01
gggucagucgagca

SEQ ID NO: 1520241 - RNA, 12 nt, Pseudomonas aeruginosa PA01
gggucagcuggc

SEQ ID NO: 1520242 - RNA, 20 nt, Pseudomonas aeruginosa PA01
gggucaguuccaggucggcg

SEQ ID NO: 1520243 - RNA, 14 nt, Pseudomonas aeruginosa PA01
gggucagaccagcc

SEQ ID NO: 1520244 - RNA, 15 nt, Pseudomonas aeruginosa PA01
gggucaggccgaggc

SEQ ID NO: 1520245 - RNA, 16 nt, Pseudomonas aeruginosa PA01
gggucgcagccgagcc

SEQ ID NO: 1520246 - RNA, 18 nt, Pseudomonas aeruginosa PA01
gggucgcagccgggguug

SEQ ID NO: 1520247 - RNA, 16 nt, Pseudomonas aeruginosa PA01
gggucgaucaggcgca

SEQ ID NO: 1520248 - RNA, 22 nt, Pseudomonas aeruginosa PA01
gggucgaggcaaucugcccggc

SEQ ID NO: 1520249 - RNA, 12 nt, Pseudomonas aeruginosa PA01
gggucgccagca

SEQ ID NO: 1520250 - RNA, 19 nt, Pseudomonas aeruginosa PA01
gggucgacgcagggcggcg

SEQ ID NO: 1520251 - RNA, 19 nt, Pseudomonas aeruginosa PA01
gggucgacuucgcaccagc

SEQ ID NO: 1520252 - RNA, 22 nt, Pseudomonas aeruginosa PA01
gggucgacuucgcaccagccgg

SEQ ID NO: 1520253 - RNA, 13 nt, Pseudomonas aeruginosa PA01
gggucgagccagg

SEQ ID NO: 1520254 - RNA, 15 nt, Pseudomonas aeruginosa PA01
ggguccgguacugcu

SEQ ID NO: 1520255 - RNA, 21 nt, Pseudomonas aeruginosa PA01
gggucgucgaagcgcagcagg

SEQ ID NO: 1520256 - RNA, 14 nt, Pseudomonas aeruginosa PA01
gggucgggucggcg

SEQ ID NO: 1520257 - RNA, 17 nt, Pseudomonas aeruginosa PA01
gggucggaugcagcgcu

SEQ ID NO: 1520258 - RNA, 17 nt, Pseudomonas aeruginosa PA01
gggucggcuggcagggc

SEQ ID NO: 1520259 - RNA, 20 nt, Pseudomonas aeruginosa PA01
gggucggcuggcagggcgcg

SEQ ID NO: 1520260 - RNA, 19 nt, Pseudomonas aeruginosa PA01
gggucgcugcucagggccg

SEQ ID NO: 1520261 - RNA, 13 nt, Pseudomonas aeruginosa PA01
gggucgcgcagcg

SEQ ID NO: 1520262 - RNA, 18 nt, Pseudomonas aeruginosa PA01
gggucugcucggcgcccu

SEQ ID NO: 1520263 - RNA, 14 nt, Pseudomonas aeruginosa PA01
gggucuggccggcg

SEQ ID NO: 1520264 - RNA, 19 nt, Pseudomonas aeruginosa PA01
gggucgucggucggccagg

SEQ ID NO: 1520265 - RNA, 19 nt, Pseudomonas aeruginosa PA01
gggucucgaucagcgccgg

SEQ ID NO: 1520266 - RNA, 15 nt, Pseudomonas aeruginosa PA01
gggugaagcgcaggc

SEQ ID NO: 1520267 - RNA, 24 nt, Pseudomonas aeruginosa PA01
gggugaagcgcaggcggcuggcgc

SEQ ID NO: 1520268 - RNA, 12 nt, Pseudomonas aeruginosa PA01
gggugaagcugc

SEQ ID NO: 1520269 - RNA, 23 nt, Pseudomonas aeruginosa PA01
gggucuucgaaggucugcccgug

SEQ ID NO: 1520270 - RNA, 15 nt, Pseudomonas aeruginosa PA01
gggucuucggguguc

SEQ ID NO: 1520271 - RNA, 17 nt, Pseudomonas aeruginosa PA01
gggugacgcucuucacc

SEQ ID NO: 1520272 - RNA, 20 nt, Pseudomonas aeruginosa PA01
gggcauucguccagccgccg

SEQ ID NO: 1520273 - RNA, 13 nt, Pseudomonas aeruginosa PA01
gggcaugggcgcg

SEQ ID NO: 1520274 - RNA, 16 nt, Pseudomonas aeruginosa PA01
gggcaugggcgcgggu

SEQ ID NO: 1520275 - RNA, 18 nt, Pseudomonas aeruginosa PA01
gggcaugcucggccaggu

SEQ ID NO: 1520276 - RNA, 15 nt, Pseudomonas aeruginosa PA01
gggcaugcugcucgg

SEQ ID NO: 1520277 - RNA, 12 nt, Pseudomonas aeruginosa PA01
gggcauggcugg

SEQ ID NO: 1520278 - RNA, 23 nt, Pseudomonas aeruginosa PA01
gggcaucagccccucggccagga

SEQ ID NO: 1520279 - RNA, 17 nt, Pseudomonas aeruginosa PA01
gggcaucaugccgagca

SEQ ID NO: 1520280 - RNA, 16 nt, Pseudomonas aeruginosa PA01
gggcaucgaugaccuu

SEQ ID NO: 1520281 - RNA, 18 nt, Pseudomonas aeruginosa PA01
gggcaucgccgacagguc

SEQ ID NO: 1520282 - RNA, 13 nt, Pseudomonas aeruginosa PA01
gggcaucgcgcau

SEQ ID NO: 1520283 - RNA, 17 nt, Pseudomonas aeruginosa PA01
gggcauccugccgccug

SEQ ID NO: 1520284 - RNA, 21 nt, Pseudomonas aeruginosa PA01
gggcauugucccugcgggacc

SEQ ID NO: 1520285 - RNA, 14 nt, Pseudomonas aeruginosa PA01
gggcauuuccuggg

SEQ ID NO: 1520286 - RNA, 18 nt, Pseudomonas aeruginosa PA01
gggccacguucugcagga

SEQ ID NO: 1520287 - RNA, 16 nt, Pseudomonas aeruginosa PA01
gggccaccuggcucug

SEQ ID NO: 1520288 - RNA, 15 nt, Pseudomonas aeruginosa PA01
gggccccggccaggu

SEQ ID NO: 1520289 - RNA, 13 nt, Pseudomonas aeruginosa PA01
gggccccggccgg

SEQ ID NO: 1520290 - RNA, 19 nt, Pseudomonas aeruginosa PA01
gggcccaagccgagcggca

SEQ ID NO: 1520291 - RNA, 21 nt, Pseudomonas aeruginosa PA01
gggccaugaccucggccagcc

SEQ ID NO: 1520292 - RNA, 16 nt, Pseudomonas aeruginosa PA01
gggccaugagcagggc

SEQ ID NO: 1520293 - RNA, 22 nt, Pseudomonas aeruginosa PA01
gggccagcuggcgacggcucug

SEQ ID NO: 1520294 - RNA, 14 nt, Pseudomonas aeruginosa PA01
gggccagcgccugg

SEQ ID NO: 1520295 - RNA, 13 nt, Pseudomonas aeruginosa PA01
gggccagcagcgg

SEQ ID NO: 1520296 - RNA, 17 nt, Pseudomonas aeruginosa PA01
gggccagcagcggcggc

SEQ ID NO: 1520297 - RNA, 18 nt, Pseudomonas aeruginosa PA01
gggccagcagcggcggcg

SEQ ID NO: 1520298 - RNA, 13 nt, Pseudomonas aeruginosa PA01
gggccagcagggc

SEQ ID NO: 1520299 - RNA, 17 nt, Pseudomonas aeruginosa PA01
gggccagcagggccgcc

SEQ ID NO: 1520300 - RNA, 20 nt, Pseudomonas aeruginosa PA01
gggccagcaggguggccagg

SEQ ID NO: 1520301 - RNA, 15 nt, Pseudomonas aeruginosa PA01
gggccaggccgagca

SEQ ID NO: 1520302 - RNA, 15 nt, Pseudomonas aeruginosa PA01
gggccaggccgagcg

SEQ ID NO: 1520303 - RNA, 16 nt, Pseudomonas aeruginosa PA01
gggccaggaaaucgag

SEQ ID NO: 1520304 - RNA, 17 nt, Pseudomonas aeruginosa PA01
gggccagggcggcggcg

SEQ ID NO: 1520305 - RNA, 16 nt, Pseudomonas aeruginosa PA01
gggccagggaaaucag

SEQ ID NO: 1520306 - RNA, 17 nt, Pseudomonas aeruginosa PA01
gggccagggaggcgcug

SEQ ID NO: 1520307 - RNA, 19 nt, Pseudomonas aeruginosa PA01
gggccgccguacaggccac

SEQ ID NO: 1520308 - RNA, 17 nt, Pseudomonas aeruginosa PA01
gggccgcgccgagccgg

SEQ ID NO: 1520309 - RNA, 21 nt, Pseudomonas aeruginosa PA01
gggccgcgcacaaaaaagccc

SEQ ID NO: 1520310 - RNA, 18 nt, Pseudomonas aeruginosa PA01
gggccgcgagguccggcu

SEQ ID NO: 1520311 - RNA, 21 nt, Pseudomonas aeruginosa PA01
gggccgcguauggcuuccugu

SEQ ID NO: 1520312 - RNA, 14 nt, Pseudomonas aeruginosa PA01
gggccgcgcugcug

SEQ ID NO: 1520313 - RNA, 16 nt, Pseudomonas aeruginosa PA01
gggccgccggcgacga

SEQ ID NO: 1520314 - RNA, 21 nt, Pseudomonas aeruginosa PA01
gggccgcagguuggccccgcc

SEQ ID NO: 1520315 - RNA, 20 nt, Pseudomonas aeruginosa PA01
gggccgccagccgccaggac

SEQ ID NO: 1520316 - RNA, 13 nt, Pseudomonas aeruginosa PA01
gggccgagcgcag

SEQ ID NO: 1520317 - RNA, 15 nt, Pseudomonas aeruginosa PA01
gggccgagcgcagcg

SEQ ID NO: 1520318 - RNA, 19 nt, Pseudomonas aeruginosa PA01
gggccgaugccgggcaacg

SEQ ID NO: 1520319 - RNA, 14 nt, Pseudomonas aeruginosa PA01
gggccgaugcgcga

SEQ ID NO: 1520320 - RNA, 16 nt, Pseudomonas aeruginosa PA01
gggccgcagcgcagcc

SEQ ID NO: 1520321 - RNA, 17 nt, Pseudomonas aeruginosa PA01
gggccgcagcgcagccg

SEQ ID NO: 1520322 - RNA, 15 nt, Pseudomonas aeruginosa PA01
gggccgaaggccagg

SEQ ID NO: 1520323 - RNA, 13 nt, Pseudomonas aeruginosa PA01
gggccggcgccag

SEQ ID NO: 1520324 - RNA, 12 nt, Pseudomonas aeruginosa PA01
gggccggccagg

SEQ ID NO: 1520325 - RNA, 22 nt, Pseudomonas aeruginosa PA01
gggccggcaugcucagccgcgc

SEQ ID NO: 1520326 - RNA, 12 nt, Pseudomonas aeruginosa PA01
gggccgggggcg

SEQ ID NO: 1520327 - RNA, 22 nt, Pseudomonas aeruginosa PA01
gggccguccgccagguccaggc

SEQ ID NO: 1520328 - RNA, 18 nt, Pseudomonas aeruginosa PA01
gggccugcucagcguccu

SEQ ID NO: 1520329 - RNA, 15 nt, Pseudomonas aeruginosa PA01
gggccugcuccucgg

SEQ ID NO: 1520330 - RNA, 22 nt, Pseudomonas aeruginosa PA01
gggccugcuccucggcagcgcu

SEQ ID NO: 1520331 - RNA, 15 nt, Pseudomonas aeruginosa PA01
gggccucggcgggug

SEQ ID NO: 1520332 - RNA, 14 nt, Pseudomonas aeruginosa PA01
gggccgugagcacg

SEQ ID NO: 1520333 - RNA, 17 nt, Pseudomonas aeruginosa PA01
gggccgucgggcauggc

SEQ ID NO: 1520334 - RNA, 23 nt, Pseudomonas aeruginosa PA01
gggccuuuuccguuguggcggcg

SEQ ID NO: 1520335 - RNA, 14 nt, Pseudomonas aeruginosa PA01
gggcgaagccggcg

SEQ ID NO: 1520336 - RNA, 20 nt, Pseudomonas aeruginosa PA01
gggcgaaggucugccccggc

SEQ ID NO: 1520337 - RNA, 19 nt, Pseudomonas aeruginosa PA01
gggcgaagucggcgcgcca

SEQ ID NO: 1520338 - RNA, 23 nt, Pseudomonas aeruginosa PA01
gggcgaauaaccauugcgcggga

SEQ ID NO: 1520339 - RNA, 20 nt, Pseudomonas aeruginosa PA01
gggcgaauaacgccgcaggc

SEQ ID NO: 1520340 - RNA, 22 nt, Pseudomonas aeruginosa PA01
gggcgaauaccagugccgcggu

SEQ ID NO: 1520341 - RNA, 17 nt, Pseudomonas aeruginosa PA01
gggcgaauaucgcggcg

SEQ ID NO: 1520342 - RNA, 16 nt, Pseudomonas aeruginosa PA01
gggcgaaacggcaggc

SEQ ID NO: 1520343 - RNA, 21 nt, Pseudomonas aeruginosa PA01
gggcgaaacggcaggccagca

SEQ ID NO: 1520344 - RNA, 17 nt, Pseudomonas aeruginosa PA01
gggccuugaccaccgcc

SEQ ID NO: 1520345 - RNA, 20 nt, Pseudomonas aeruginosa PA01
gggccuuguucaggguggcg

SEQ ID NO: 1520346 - RNA, 14 nt, Pseudomonas aeruginosa PA01
gggccuugagcacg

SEQ ID NO: 1520347 - RNA, 21 nt, Pseudomonas aeruginosa PA01
gggccuucgccagcggccagg

SEQ ID NO: 1520348 - RNA, 12 nt, Pseudomonas aeruginosa PA01
gggcgacccagg

SEQ ID NO: 1520349 - RNA, 13 nt, Pseudomonas aeruginosa PA01
gggcgacccaggc

SEQ ID NO: 1520350 - RNA, 16 nt, Pseudomonas aeruginosa PA01
gggcgacgcccgaggc

SEQ ID NO: 1520351 - RNA, 15 nt, Pseudomonas aeruginosa PA01
gggcgaccgccaggc

SEQ ID NO: 1520352 - RNA, 17 nt, Pseudomonas aeruginosa PA01
gggcgaccgccaggcgg

SEQ ID NO: 1520353 - RNA, 18 nt, Pseudomonas aeruginosa PA01
gggcgagucgaucagguc

SEQ ID NO: 1520354 - RNA, 13 nt, Pseudomonas aeruginosa PA01
gggcgauccgccc

SEQ ID NO: 1520355 - RNA, 14 nt, Pseudomonas aeruginosa PA01
gggcgagggcgcgc

SEQ ID NO: 1520356 - RNA, 23 nt, Pseudomonas aeruginosa PA01
gggcgagggcggcgcgggcgcgc

SEQ ID NO: 1520357 - RNA, 14 nt, Pseudomonas aeruginosa PA01
gggcgagcagggcg

SEQ ID NO: 1520358 - RNA, 18 nt, Pseudomonas aeruginosa PA01
gggcgagcagggcgcuga

SEQ ID NO: 1520359 - RNA, 16 nt, Pseudomonas aeruginosa PA01
gggcgagcgcagacgg

SEQ ID NO: 1520360 - RNA, 23 nt, Pseudomonas aeruginosa PA01
gggcgagcgcagacgggugcuga

SEQ ID NO: 1520361 - RNA, 20 nt, Pseudomonas aeruginosa PA01
gggcgaugcggucaugcccu

SEQ ID NO: 1520362 - RNA, 15 nt, Pseudomonas aeruginosa PA01
gggcgaugcgccggu

SEQ ID NO: 1520363 - RNA, 16 nt, Pseudomonas aeruginosa PA01
gggcgcaccgccucga

SEQ ID NO: 1520364 - RNA, 22 nt, Pseudomonas aeruginosa PA01
gggcgauguugaacagcgccgg

SEQ ID NO: 1520365 - RNA, 21 nt, Pseudomonas aeruginosa PA01
gggcgcagcccuugcaaccgc

SEQ ID NO: 1520366 - RNA, 16 nt, Pseudomonas aeruginosa PA01
gggcgcaggccgaggu

SEQ ID NO: 1520367 - RNA, 23 nt, Pseudomonas aeruginosa PA01
gggcgcagguugagggccgcgcu

SEQ ID NO: 1520368 - RNA, 15 nt, Pseudomonas aeruginosa PA01
gggcgccagccgcca

SEQ ID NO: 1520369 - RNA, 22 nt, Pseudomonas aeruginosa PA01
gggcgcccgccaaggcccugcu

SEQ ID NO: 1520370 - RNA, 12 nt, Pseudomonas aeruginosa PA01
gggcgccgaugc

SEQ ID NO: 1520371 - RNA, 15 nt, Pseudomonas aeruginosa PA01
gggcgccgccagcca

SEQ ID NO: 1520372 - RNA, 19 nt, Pseudomonas aeruginosa PA01
gggcgccgucgggggcgcg

SEQ ID NO: 1520373 - RNA, 21 nt, Pseudomonas aeruginosa PA01
gggcgccguggaucgcccggc

SEQ ID NO: 1520374 - RNA, 19 nt, Pseudomonas aeruginosa PA01
gggcgccuccagcgggccu

SEQ ID NO: 1520375 - RNA, 12 nt, Pseudomonas aeruginosa PA01
gggcgccgggcu

SEQ ID NO: 1520376 - RNA, 17 nt, Pseudomonas aeruginosa PA01
gggcgccgggcugccga

SEQ ID NO: 1520377 - RNA, 14 nt, Pseudomonas aeruginosa PA01
gggcgcgccccguc

SEQ ID NO: 1520378 - RNA, 14 nt, Pseudomonas aeruginosa PA01
gggcgcgcagcagg

SEQ ID NO: 1520379 - RNA, 21 nt, Pseudomonas aeruginosa PA01
gggcgcgcgccgggcucagcg

SEQ ID NO: 1520380 - RNA, 20 nt, Pseudomonas aeruginosa PA01
gggcgcguacuugccagggc

SEQ ID NO: 1520381 - RNA, 16 nt, Pseudomonas aeruginosa PA01
gggcgcgggcguuguc

SEQ ID NO: 1520382 - RNA, 15 nt, Pseudomonas aeruginosa PA01
gggcgcucagggugg

SEQ ID NO: 1520383 - RNA, 12 nt, Pseudomonas aeruginosa PA01
gggcgcucgccc

SEQ ID NO: 1520384 - RNA, 15 nt, Pseudomonas aeruginosa PA01
gggcgcucgcccuug

SEQ ID NO: 1520385 - RNA, 13 nt, Pseudomonas aeruginosa PA01
gggcgcggcgcca

SEQ ID NO: 1520386 - RNA, 15 nt, Pseudomonas aeruginosa PA01
gggcgcugagcgcgg

SEQ ID NO: 1520387 - RNA, 19 nt, Pseudomonas aeruginosa PA01
gggcgcugccgaucagcca

SEQ ID NO: 1520388 - RNA, 18 nt, Pseudomonas aeruginosa PA01
gggcgcugcaugggcucg

SEQ ID NO: 1520389 - RNA, 22 nt, Pseudomonas aeruginosa PA01
gggcggauugcguacgcccagc

SEQ ID NO: 1520390 - RNA, 21 nt, Pseudomonas aeruginosa PA01
gggcggauaaucgcagcgcgg

SEQ ID NO: 1520391 - RNA, 20 nt, Pseudomonas aeruginosa PA01
gggcggaucgagcagcggcg

SEQ ID NO: 1520392 - RNA, 18 nt, Pseudomonas aeruginosa PA01
gggcguggucggcggccu

SEQ ID NO: 1520393 - RNA, 18 nt, Pseudomonas aeruginosa PA01
gggcguuggccagcgcca

SEQ ID NO: 1520394 - RNA, 21 nt, Pseudomonas aeruginosa PA01
gggcguuuucguuggcggcca

SEQ ID NO: 1520395 - RNA, 19 nt, Pseudomonas aeruginosa PA01
gggcuacaucgucugcgcg

SEQ ID NO: 1520396 - RNA, 11 nt, Pseudomonas aeruginosa PA01
gggcugccgca

SEQ ID NO: 1520397 - RNA, 15 nt, Pseudomonas aeruginosa PA01
gggcugccgcggaag

SEQ ID NO: 1520398 - RNA, 18 nt, Pseudomonas aeruginosa PA01
gggcugccaccgagggca

SEQ ID NO: 1520399 - RNA, 18 nt, Pseudomonas aeruginosa PA01
gggcucugguagccgcag

SEQ ID NO: 1520400 - RNA, 17 nt, Pseudomonas aeruginosa PA01
gggcucacucccgucca

SEQ ID NO: 1520401 - RNA, 20 nt, Pseudomonas aeruginosa PA01
gggcucacucccguccagcg

SEQ ID NO: 1520402 - RNA, 15 nt, Pseudomonas aeruginosa PA01
gggcucgacgaggaa

SEQ ID NO: 1520403 - RNA, 18 nt, Pseudomonas aeruginosa PA01
gggcucgcgcggggcgcg

SEQ ID NO: 1520404 - RNA, 14 nt, Pseudomonas aeruginosa PA01
gggcgucuccugcc

SEQ ID NO: 1520405 - RNA, 14 nt, Pseudomonas aeruginosa PA01
gggcgucugcccgg

SEQ ID NO: 1520406 - RNA, 18 nt, Pseudomonas aeruginosa PA01
gggcguccuugcccggcg

SEQ ID NO: 1520407 - RNA, 13 nt, Pseudomonas aeruginosa PA01
gggcgugccagga

SEQ ID NO: 1520408 - RNA, 22 nt, Pseudomonas aeruginosa PA01
gggcguggcaaaaaugcccuug

SEQ ID NO: 1520409 - RNA, 14 nt, Pseudomonas aeruginosa PA01
gggcguggcggccg

SEQ ID NO: 1520410 - RNA, 17 nt, Pseudomonas aeruginosa PA01
gggcggucggcgagggc

SEQ ID NO: 1520411 - RNA, 16 nt, Pseudomonas aeruginosa PA01
gggcggucucggcggg

SEQ ID NO: 1520412 - RNA, 21 nt, Pseudomonas aeruginosa PA01
gggcguagaccuugcggccgu

SEQ ID NO: 1520413 - RNA, 15 nt, Pseudomonas aeruginosa PA01
gggcguaaagcaagc

SEQ ID NO: 1520414 - RNA, 18 nt, Pseudomonas aeruginosa PA01
gggcguacaggccccagg

SEQ ID NO: 1520415 - RNA, 19 nt, Pseudomonas aeruginosa PA01
gggcguacaggccccaggc

SEQ ID NO: 1520416 - RNA, 21 nt, Pseudomonas aeruginosa PA01
gggcguagugcaucagccugg

SEQ ID NO: 1520417 - RNA, 21 nt, Pseudomonas aeruginosa PA01
gggcggcgcgggcgcgcgcca

SEQ ID NO: 1520418 - RNA, 20 nt, Pseudomonas aeruginosa PA01
gggcggcucggcuccaggac

SEQ ID NO: 1520419 - RNA, 22 nt, Pseudomonas aeruginosa PA01
gggcggcucggcuccaggaccg

SEQ ID NO: 1520420 - RNA, 15 nt, Pseudomonas aeruginosa PA01
gggcggcuuccaggu

SEQ ID NO: 1520421 - RNA, 12 nt, Pseudomonas aeruginosa PA01
gggcggccaggu

SEQ ID NO: 1520422 - RNA, 23 nt, Pseudomonas aeruginosa PA01
gggcggccccuucagcuccagca

SEQ ID NO: 1520423 - RNA, 19 nt, Pseudomonas aeruginosa PA01
gggcggccucaggccuggc

SEQ ID NO: 1520424 - RNA, 14 nt, Pseudomonas aeruginosa PA01
gggcggccggcgcg

SEQ ID NO: 1520425 - RNA, 12 nt, Pseudomonas aeruginosa PA01
gggcggccgccg

SEQ ID NO: 1520426 - RNA, 20 nt, Pseudomonas aeruginosa PA01
ggguuuccgugcgcugcgcg

SEQ ID NO: 1520427 - RNA, 21 nt, Pseudomonas aeruginosa PA01
ggguuuccgugugcagcaggg

SEQ ID NO: 1520428 - RNA, 19 nt, Pseudomonas aeruginosa PA01
gguaaggauguccggguga

SEQ ID NO: 1520429 - RNA, 15 nt, Pseudomonas aeruginosa PA01
gguaaggcaugccca

SEQ ID NO: 1520430 - RNA, 18 nt, Pseudomonas aeruginosa PA01
gguaaggcaugcccaggc

SEQ ID NO: 1520431 - RNA, 19 nt, Pseudomonas aeruginosa PA01
gguaauaggcuucgaugcu

SEQ ID NO: 1520432 - RNA, 16 nt, Pseudomonas aeruginosa PA01
gguaauuggccaggcu

SEQ ID NO: 1520433 - RNA, 22 nt, Pseudomonas aeruginosa PA01
gggugucguagaggcuguagcg

SEQ ID NO: 1520434 - RNA, 13 nt, Pseudomonas aeruginosa PA01
gggugggcggugc

SEQ ID NO: 1520435 - RNA, 16 nt, Pseudomonas aeruginosa PA01
gggugggcggugcggc

SEQ ID NO: 1520436 - RNA, 22 nt, Pseudomonas aeruginosa PA01
ggguggcgucgaucaggcgggc

SEQ ID NO: 1520437 - RNA, 15 nt, Pseudomonas aeruginosa PA01
ggguggucugcacgg

SEQ ID NO: 1520438 - RNA, 11 nt, Pseudomonas aeruginosa PA01
ggguuccucua

SEQ ID NO: 1520439 - RNA, 15 nt, Pseudomonas aeruginosa PA01
ggguucccagcagca

SEQ ID NO: 1520440 - RNA, 15 nt, Pseudomonas aeruginosa PA01
ggguucccaguugcu

SEQ ID NO: 1520441 - RNA, 16 nt, Pseudomonas aeruginosa PA01
ggguugguggccgcgc

SEQ ID NO: 1520442 - RNA, 15 nt, Pseudomonas aeruginosa PA01
ggguuggccgcagca

SEQ ID NO: 1520443 - RNA, 17 nt, Pseudomonas aeruginosa PA01
ggguugcggcgcccgcc

SEQ ID NO: 1520444 - RNA, 18 nt, Pseudomonas aeruginosa PA01
ggguugcgccuccgggcg

SEQ ID NO: 1520445 - RNA, 16 nt, Pseudomonas aeruginosa PA01
ggguugcccggcucca

SEQ ID NO: 1520446 - RNA, 21 nt, Pseudomonas aeruginosa PA01
ggguugcccucgcagccggcg

SEQ ID NO: 1520447 - RNA, 16 nt, Pseudomonas aeruginosa PA01
ggguucgauuccucua

SEQ ID NO: 1520448 - RNA, 12 nt, Pseudomonas aeruginosa PA01
ggguucuccggg

SEQ ID NO: 1520449 - RNA, 20 nt, Pseudomonas aeruginosa PA01
gggugcgccggggaucaggu

SEQ ID NO: 1520450 - RNA, 20 nt, Pseudomonas aeruginosa PA01
gggugccuuccgcgcccagg

SEQ ID NO: 1520451 - RNA, 21 nt, Pseudomonas aeruginosa PA01
gggugccuuccgcgcccaggc

SEQ ID NO: 1520452 - RNA, 16 nt, Pseudomonas aeruginosa PA01
gggugccuugccaagg

SEQ ID NO: 1520453 - RNA, 22 nt, Pseudomonas aeruginosa PA01
gggugcggugggcgagggcgcg

SEQ ID NO: 1520454 - RNA, 22 nt, Pseudomonas aeruginosa PA01
gggugcguccauccaggcuuuc

SEQ ID NO: 1520455 - RNA, 22 nt, Pseudomonas aeruginosa PA01
gggugcugcccagggcccagag

SEQ ID NO: 1520456 - RNA, 13 nt, Pseudomonas aeruginosa PA01
ggguggccaggcg

SEQ ID NO: 1520457 - RNA, 23 nt, Pseudomonas aeruginosa PA01
gggugcguggugcauccgccgca

SEQ ID NO: 1520458 - RNA, 15 nt, Pseudomonas aeruginosa PA01
ggguggcgcccaugc

SEQ ID NO: 1520459 - RNA, 12 nt, Pseudomonas aeruginosa PA01
ggguggcggcgg

SEQ ID NO: 1520460 - RNA, 17 nt, Pseudomonas aeruginosa PA01
ggguggcgccgagcagc

SEQ ID NO: 1520461 - RNA, 19 nt, Pseudomonas aeruginosa PA01
gggugccgccagucggccu

SEQ ID NO: 1520462 - RNA, 20 nt, Pseudomonas aeruginosa PA01
gggugauuucuucagccugg

SEQ ID NO: 1520463 - RNA, 13 nt, Pseudomonas aeruginosa PA01
gggugcagagcag

SEQ ID NO: 1520464 - RNA, 14 nt, Pseudomonas aeruginosa PA01
gggugcagcccugg

SEQ ID NO: 1520465 - RNA, 16 nt, Pseudomonas aeruginosa PA01
gggugcaggggcgcag

SEQ ID NO: 1520466 - RNA, 23 nt, Pseudomonas aeruginosa PA01
gggugaucacccagagcaccagg

SEQ ID NO: 1520467 - RNA, 20 nt, Pseudomonas aeruginosa PA01
gggugaucuugaucugcaug

SEQ ID NO: 1520468 - RNA, 20 nt, Pseudomonas aeruginosa PA01
gguagccgaucaacgcggcc

SEQ ID NO: 1520469 - RNA, 12 nt, Pseudomonas aeruginosa PA01
gguagccgcagu

SEQ ID NO: 1520470 - RNA, 22 nt, Pseudomonas aeruginosa PA01
gguagccgccccacgggucguc

SEQ ID NO: 1520471 - RNA, 18 nt, Pseudomonas aeruginosa PA01
gguagccaggggucaggc

SEQ ID NO: 1520472 - RNA, 14 nt, Pseudomonas aeruginosa PA01
gguagcgcucgccu

SEQ ID NO: 1520473 - RNA, 15 nt, Pseudomonas aeruginosa PA01
gguagcgcugcgccc

SEQ ID NO: 1520474 - RNA, 18 nt, Pseudomonas aeruginosa PA01
gguagcggaucagccggc

SEQ ID NO: 1520475 - RNA, 16 nt, Pseudomonas aeruginosa PA01
gguagcggcaggagca

SEQ ID NO: 1520476 - RNA, 14 nt, Pseudomonas aeruginosa PA01
gguagcgggccagc

SEQ ID NO: 1520477 - RNA, 15 nt, Pseudomonas aeruginosa PA01
gguagcgggccagca

SEQ ID NO: 1520478 - RNA, 16 nt, Pseudomonas aeruginosa PA01
gguagcggucggguuc

SEQ ID NO: 1520479 - RNA, 13 nt, Pseudomonas aeruginosa PA01
gguagcugcggcc

SEQ ID NO: 1520480 - RNA, 14 nt, Pseudomonas aeruginosa PA01
gguagcugcggccg

SEQ ID NO: 1520481 - RNA, 18 nt, Pseudomonas aeruginosa PA01
gguagcugcggccgagca

SEQ ID NO: 1520482 - RNA, 15 nt, Pseudomonas aeruginosa PA01
gguagcuggaaagcu

SEQ ID NO: 1520483 - RNA, 17 nt, Pseudomonas aeruginosa PA01
gguagcugagcaggccg

SEQ ID NO: 1520484 - RNA, 15 nt, Pseudomonas aeruginosa PA01
gguagaucugugcgg

SEQ ID NO: 1520485 - RNA, 23 nt, Pseudomonas aeruginosa PA01
gguagaugaacuggucgcuccag

SEQ ID NO: 1520486 - RNA, 19 nt, Pseudomonas aeruginosa PA01
gguagagcgcggcgcaggc

SEQ ID NO: 1520487 - RNA, 18 nt, Pseudomonas aeruginosa PA01
gguagagaugcagcaggu

SEQ ID NO: 1520488 - RNA, 20 nt, Pseudomonas aeruginosa PA01
gguagagaugcagcagguag

SEQ ID NO: 1520489 - RNA, 21 nt, Pseudomonas aeruginosa PA01
gguagcagccguccagcuuga

SEQ ID NO: 1520490 - RNA, 17 nt, Pseudomonas aeruginosa PA01
gguagaaacgcuugagc

SEQ ID NO: 1520491 - RNA, 15 nt, Pseudomonas aeruginosa PA01
gguagaaauggugga

SEQ ID NO: 1520492 - RNA, 23 nt, Pseudomonas aeruginosa PA01
gguacgccgcgcugcgccaggcc

SEQ ID NO: 1520493 - RNA, 15 nt, Pseudomonas aeruginosa PA01
gguacgcccccuccc

SEQ ID NO: 1520494 - RNA, 16 nt, Pseudomonas aeruginosa PA01
gguaccucgugggugc

SEQ ID NO: 1520495 - RNA, 12 nt, Pseudomonas aeruginosa PA01
gguacagccccc

SEQ ID NO: 1520496 - RNA, 22 nt, Pseudomonas aeruginosa PA01
gguacagcgccacggccagcag

SEQ ID NO: 1520497 - RNA, 21 nt, Pseudomonas aeruginosa PA01
gguaguucagucgguuagaau

SEQ ID NO: 1520498 - RNA, 19 nt, Pseudomonas aeruginosa PA01
gguaguucuccaggcccau

SEQ ID NO: 1520499 - RNA, 19 nt, Pseudomonas aeruginosa PA01
gguaggcucugcuccagca

SEQ ID NO: 1520500 - RNA, 15 nt, Pseudomonas aeruginosa PA01
gguaggccagcaggg

SEQ ID NO: 1520501 - RNA, 18 nt, Pseudomonas aeruginosa PA01
gguaggccagcagggucu

SEQ ID NO: 1520502 - RNA, 21 nt, Pseudomonas aeruginosa PA01
gguaggccagccccagauggg

SEQ ID NO: 1520503 - RNA, 20 nt, Pseudomonas aeruginosa PA01
gguaggacagggccaggccg

SEQ ID NO: 1520504 - RNA, 15 nt, Pseudomonas aeruginosa PA01
gguagugcggcgggc

SEQ ID NO: 1520505 - RNA, 21 nt, Pseudomonas aeruginosa PA01
gguaguccagcagguggcgca

SEQ ID NO: 1520506 - RNA, 17 nt, Pseudomonas aeruginosa PA01
gguaguccagcgagugc

SEQ ID NO: 1520507 - RNA, 20 nt, Pseudomonas aeruginosa PA01
gguauucagccagagcccgu

SEQ ID NO: 1520508 - RNA, 14 nt, Pseudomonas aeruginosa PA01
gguauuggucgcga

SEQ ID NO: 1520509 - RNA, 15 nt, Pseudomonas aeruginosa PA01
gguauggcagcucug

SEQ ID NO: 1520510 - RNA, 16 nt, Pseudomonas aeruginosa PA01
gguauggcagcucugc

SEQ ID NO: 1520511 - RNA, 22 nt, Pseudomonas aeruginosa PA01
ggucaccagcgugggcaacagg

SEQ ID NO: 1520512 - RNA, 14 nt, Pseudomonas aeruginosa PA01
ggucaccacccagc

SEQ ID NO: 1520513 - RNA, 18 nt, Pseudomonas aeruginosa PA01
ggucaccacccagccgcg

SEQ ID NO: 1520514 - RNA, 13 nt, Pseudomonas aeruginosa PA01
ggucaccagcgcc

SEQ ID NO: 1520515 - RNA, 18 nt, Pseudomonas aeruginosa PA01
ggucacgccgcggcugau

SEQ ID NO: 1520516 - RNA, 21 nt, Pseudomonas aeruginosa PA01
ggucacgccgaaguucuucag

SEQ ID NO: 1520517 - RNA, 23 nt, Pseudomonas aeruginosa PA01
ggucacgccgaaguucuucagca

SEQ ID NO: 1520518 - RNA, 17 nt, Pseudomonas aeruginosa PA01
ggucacgccgagggcgc

SEQ ID NO: 1520519 - RNA, 19 nt, Pseudomonas aeruginosa PA01
ggucacgccgagggcgcgg

SEQ ID NO: 1520520 - RNA, 17 nt, Pseudomonas aeruginosa PA01
ggucacggucagcucgg

SEQ ID NO: 1520521 - RNA, 22 nt, Pseudomonas aeruginosa PA01
ggucagaccacgaagcgaccga

SEQ ID NO: 1520522 - RNA, 18 nt, Pseudomonas aeruginosa PA01
ggucacuggcgaggcugc

SEQ ID NO: 1520523 - RNA, 22 nt, Pseudomonas aeruginosa PA01
ggucagcccguguucggccagc

SEQ ID NO: 1520524 - RNA, 23 nt, Pseudomonas aeruginosa PA01
ggucagcccguguucggccagcc

SEQ ID NO: 1520525 - RNA, 11 nt, Pseudomonas aeruginosa PA01
ggucagccagc

SEQ ID NO: 1520526 - RNA, 15 nt, Pseudomonas aeruginosa PA01
ggucagcgccagcaa

SEQ ID NO: 1520527 - RNA, 16 nt, Pseudomonas aeruginosa PA01
ggucagcgccagcaac

SEQ ID NO: 1520528 - RNA, 15 nt, Pseudomonas aeruginosa PA01
ggucagcaggcugcc

SEQ ID NO: 1520529 - RNA, 13 nt, Pseudomonas aeruginosa PA01
ggucagcaccagg

SEQ ID NO: 1520530 - RNA, 21 nt, Pseudomonas aeruginosa PA01
ggucagcaccagggccagggc

SEQ ID NO: 1520531 - RNA, 23 nt, Pseudomonas aeruginosa PA01
ggucagagacagguacucggccc

SEQ ID NO: 1520532 - RNA, 23 nt, Pseudomonas aeruginosa PA01
ggucagagggugaucagcuccgc

SEQ ID NO: 1520533 - RNA, 12 nt, Pseudomonas aeruginosa PA01
ggucagggugcc

SEQ ID NO: 1520534 - RNA, 24 nt, Pseudomonas aeruginosa PA01
ggucagguaggcaucgacgccagc

SEQ ID NO: 1520535 - RNA, 19 nt, Pseudomonas aeruginosa PA01
ggucaggucgacgccgccg

SEQ ID NO: 1520536 - RNA, 17 nt, Pseudomonas aeruginosa PA01
ggucaggcugcggcgga

SEQ ID NO: 1520537 - RNA, 20 nt, Pseudomonas aeruginosa PA01
ggucaggcugcggcggaagg

SEQ ID NO: 1520538 - RNA, 12 nt, Pseudomonas aeruginosa PA01
ggucaggcugau

SEQ ID NO: 1520539 - RNA, 21 nt, Pseudomonas aeruginosa PA01
ggucaggcugaucggcgcgcc

SEQ ID NO: 1520540 - RNA, 14 nt, Pseudomonas aeruginosa PA01
ggucagcgguaggu

SEQ ID NO: 1520541 - RNA, 21 nt, Pseudomonas aeruginosa PA01
ggucagcgguaugccgcaggc

SEQ ID NO: 1520542 - RNA, 20 nt, Pseudomonas aeruginosa PA01
ggucagcucgacagcgucgu

SEQ ID NO: 1520543 - RNA, 11 nt, Pseudomonas aeruginosa PA01
ggucagcuggc

SEQ ID NO: 1520544 - RNA, 21 nt, Pseudomonas aeruginosa PA01
ggucaggccgaccagcgccga

SEQ ID NO: 1520545 - RNA, 16 nt, Pseudomonas aeruginosa PA01
ggucaggccgagcagc

SEQ ID NO: 1520546 - RNA, 17 nt, Pseudomonas aeruginosa PA01
ggucaggccgagcagcg

SEQ ID NO: 1520547 - RNA, 15 nt, Pseudomonas aeruginosa PA01
ggucaggcgccagga

SEQ ID NO: 1520548 - RNA, 17 nt, Pseudomonas aeruginosa PA01
gguccagcggccgcgcc

SEQ ID NO: 1520549 - RNA, 16 nt, Pseudomonas aeruginosa PA01
gguccagcgagcgggc

SEQ ID NO: 1520550 - RNA, 14 nt, Pseudomonas aeruginosa PA01
gguccaggcgccag

SEQ ID NO: 1520551 - RNA, 19 nt, Pseudomonas aeruginosa PA01
gguccagcuggcgcagccg

SEQ ID NO: 1520552 - RNA, 20 nt, Pseudomonas aeruginosa PA01
gguccagcuggcgcagccgu

SEQ ID NO: 1520553 - RNA, 16 nt, Pseudomonas aeruginosa PA01
ggucccaucagcaguc

SEQ ID NO: 1520554 - RNA, 18 nt, Pseudomonas aeruginosa PA01
gguccccuccagguaggg

SEQ ID NO: 1520555 - RNA, 18 nt, Pseudomonas aeruginosa PA01
ggucccuucgugggccug

SEQ ID NO: 1520556 - RNA, 20 nt, Pseudomonas aeruginosa PA01
gguccguucggcgcccaggu

SEQ ID NO: 1520557 - RNA, 21 nt, Pseudomonas aeruginosa PA01
gguccggcuccggcugcguga

SEQ ID NO: 1520558 - RNA, 22 nt, Pseudomonas aeruginosa PA01
gguccggcugucgacgcagccg

SEQ ID NO: 1520559 - RNA, 23 nt, Pseudomonas aeruginosa PA01
gguccggcugucgacgcagccgg

SEQ ID NO: 1520560 - RNA, 21 nt, Pseudomonas aeruginosa PA01
gguccguccagcgcgcccggc

SEQ ID NO: 1520561 - RNA, 20 nt, Pseudomonas aeruginosa PA01
gguccggguuggcgcaggcc

SEQ ID NO: 1520562 - RNA, 19 nt, Pseudomonas aeruginosa PA01
gguccgccggucaccacug

SEQ ID NO: 1520563 - RNA, 19 nt, Pseudomonas aeruginosa PA01
gguccgcguggugagcacg

SEQ ID NO: 1520564 - RNA, 20 nt, Pseudomonas aeruginosa PA01
gguccgcgucacggacccgc

SEQ ID NO: 1520565 - RNA, 14 nt, Pseudomonas aeruginosa PA01
gguccggagggccc

SEQ ID NO: 1520566 - RNA, 20 nt, Pseudomonas aeruginosa PA01
gguccgcaccguagcggcug

SEQ ID NO: 1520567 - RNA, 20 nt, Pseudomonas aeruginosa PA01
gguccgccacuucaagcugg

SEQ ID NO: 1520568 - RNA, 17 nt, Pseudomonas aeruginosa PA01
gguccgccagcaggcgu

SEQ ID NO: 1520569 - RNA, 12 nt, Pseudomonas aeruginosa PA01
ggucaugcccag

SEQ ID NO: 1520570 - RNA, 23 nt, Pseudomonas aeruginosa PA01
ggucaugccgaacuucuccgcca

SEQ ID NO: 1520571 - RNA, 16 nt, Pseudomonas aeruginosa PA01
ggucauggccagcucg

SEQ ID NO: 1520572 - RNA, 17 nt, Pseudomonas aeruginosa PA01
ggucauggugccgagca

SEQ ID NO: 1520573 - RNA, 21 nt, Pseudomonas aeruginosa PA01
gguccaaccgggcaucgccga

SEQ ID NO: 1520574 - RNA, 23 nt, Pseudomonas aeruginosa PA01
gguccacguugcaguccaggccg

SEQ ID NO: 1520575 - RNA, 19 nt, Pseudomonas aeruginosa PA01
ggucaguccuuguccggga

SEQ ID NO: 1520576 - RNA, 20 nt, Pseudomonas aeruginosa PA01
ggucaguucggcccagcagc

SEQ ID NO: 1520577 - RNA, 18 nt, Pseudomonas aeruginosa PA01
ggucaucgccggcgccga

SEQ ID NO: 1520578 - RNA, 20 nt, Pseudomonas aeruginosa PA01
ggucguugcgcgccagcgcc

SEQ ID NO: 1520579 - RNA, 12 nt, Pseudomonas aeruginosa PA01
ggucgugcagcc

SEQ ID NO: 1520580 - RNA, 18 nt, Pseudomonas aeruginosa PA01
ggucgucgaagcgcagca

SEQ ID NO: 1520581 - RNA, 22 nt, Pseudomonas aeruginosa PA01
ggucguacaccgcgcggcacag

SEQ ID NO: 1520582 - RNA, 15 nt, Pseudomonas aeruginosa PA01
ggucgucggucggcc

SEQ ID NO: 1520583 - RNA, 22 nt, Pseudomonas aeruginosa PA01
ggucguagcagguccgcgccuc

SEQ ID NO: 1520584 - RNA, 15 nt, Pseudomonas aeruginosa PA01
ggucgggcagcuucu

SEQ ID NO: 1520585 - RNA, 12 nt, Pseudomonas aeruginosa PA01
ggucgggcgccg

SEQ ID NO: 1520586 - RNA, 14 nt, Pseudomonas aeruginosa PA01
ggucgguugcggcc

SEQ ID NO: 1520587 - RNA, 16 nt, Pseudomonas aeruginosa PA01
ggucggucuggcggcc

SEQ ID NO: 1520588 - RNA, 18 nt, Pseudomonas aeruginosa PA01
ggucgggucgagcuugcc

SEQ ID NO: 1520589 - RNA, 18 nt, Pseudomonas aeruginosa PA01
ggucggcgaaguccacca

SEQ ID NO: 1520590 - RNA, 21 nt, Pseudomonas aeruginosa PA01
ggucggccugcgguucgccuu

SEQ ID NO: 1520591 - RNA, 12 nt, Pseudomonas aeruginosa PA01
ggucggccuggg

SEQ ID NO: 1520592 - RNA, 12 nt, Pseudomonas aeruginosa PA01
ggucggcgaggg

SEQ ID NO: 1520593 - RNA, 21 nt, Pseudomonas aeruginosa PA01
ggucggcggucucgaacgcca

SEQ ID NO: 1520594 - RNA, 12 nt, Pseudomonas aeruginosa PA01
ggucggcucagc

SEQ ID NO: 1520595 - RNA, 15 nt, Pseudomonas aeruginosa PA01
ggucggcgggcaccg

SEQ ID NO: 1520596 - RNA, 17 nt, Pseudomonas aeruginosa PA01
ggucggcggcagcugcg

SEQ ID NO: 1520597 - RNA, 14 nt, Pseudomonas aeruginosa PA01
ggucuagccgggcc

SEQ ID NO: 1520598 - RNA, 19 nt, Pseudomonas aeruginosa PA01
ggucucaccgcccugcgcg

SEQ ID NO: 1520599 - RNA, 21 nt, Pseudomonas aeruginosa PA01
ggucucgaacgccaggcaggc

SEQ ID NO: 1520600 - RNA, 16 nt, Pseudomonas aeruginosa PA01
ggucucgaucagcgcc

SEQ ID NO: 1520601 - RNA, 18 nt, Pseudomonas aeruginosa PA01
ggucugccagcucuggcc

SEQ ID NO: 1520602 - RNA, 18 nt, Pseudomonas aeruginosa PA01
ggucugccucgccgaggc

SEQ ID NO: 1520603 - RNA, 17 nt, Pseudomonas aeruginosa PA01
ggucuugaucccaggga

SEQ ID NO: 1520604 - RNA, 20 nt, Pseudomonas aeruginosa PA01
ggucuucccguaaggccagg

SEQ ID NO: 1520605 - RNA, 15 nt, Pseudomonas aeruginosa PA01
ggucuucaggccgca

SEQ ID NO: 1520606 - RNA, 11 nt, Pseudomonas aeruginosa PA01
ggucuucagug

SEQ ID NO: 1520607 - RNA, 23 nt, Pseudomonas aeruginosa PA01
ggucugcucggcgcccugggugg

SEQ ID NO: 1520608 - RNA, 17 nt, Pseudomonas aeruginosa PA01
ggucugcuugcgcuggc

SEQ ID NO: 1520609 - RNA, 14 nt, Pseudomonas aeruginosa PA01
ggucggcagcagcu

SEQ ID NO: 1520610 - RNA, 19 nt, Pseudomonas aeruginosa PA01
ggucggccaggggagcgcc

SEQ ID NO: 1520611 - RNA, 18 nt, Pseudomonas aeruginosa PA01
ggucggcaucgcguaggg

SEQ ID NO: 1520612 - RNA, 14 nt, Pseudomonas aeruginosa PA01
ggucgcuuccucgg

SEQ ID NO: 1520613 - RNA, 18 nt, Pseudomonas aeruginosa PA01
ggucgcuguccuccagcg

SEQ ID NO: 1520614 - RNA, 12 nt, Pseudomonas aeruginosa PA01
ggucgcugcuca

SEQ ID NO: 1520615 - RNA, 22 nt, Pseudomonas aeruginosa PA01
ggucgcugcucagggccgcgcc

SEQ ID NO: 1520616 - RNA, 16 nt, Pseudomonas aeruginosa PA01
ggucgcguacagcggg

SEQ ID NO: 1520617 - RNA, 19 nt, Pseudomonas aeruginosa PA01
ggucgcguagaccaucgcc

SEQ ID NO: 1520618 - RNA, 16 nt, Pseudomonas aeruginosa PA01
ggucgcgggccaggcc

SEQ ID NO: 1520619 - RNA, 17 nt, Pseudomonas aeruginosa PA01
ggucgcugcccaucgcc

SEQ ID NO: 1520620 - RNA, 16 nt, Pseudomonas aeruginosa PA01
ggucgcugaccagccc

SEQ ID NO: 1520621 - RNA, 13 nt, Pseudomonas aeruginosa PA01
ggucgcuccagcc

SEQ ID NO: 1520622 - RNA, 13 nt, Pseudomonas aeruginosa PA01
ggucgccugggua

SEQ ID NO: 1520623 - RNA, 20 nt, Pseudomonas aeruginosa PA01
ggucgccuugaccagcggcc

SEQ ID NO: 1520624 - RNA, 21 nt, Pseudomonas aeruginosa PA01
ggucgcgcgccuucagcccca

SEQ ID NO: 1520625 - RNA, 22 nt, Pseudomonas aeruginosa PA01
ggucgcgcgccuucagccccag

SEQ ID NO: 1520626 - RNA, 14 nt, Pseudomonas aeruginosa PA01
ggucgcgcggcgcc

SEQ ID NO: 1520627 - RNA, 14 nt, Pseudomonas aeruginosa PA01
ggucgcgcucaggc

SEQ ID NO: 1520628 - RNA, 15 nt, Pseudomonas aeruginosa PA01
ggucgcgcucaggcg

SEQ ID NO: 1520629 - RNA, 15 nt, Pseudomonas aeruginosa PA01
ggucgcgccccgcca

SEQ ID NO: 1520630 - RNA, 18 nt, Pseudomonas aeruginosa PA01
ggucgcggaccuccagcc

SEQ ID NO: 1520631 - RNA, 13 nt, Pseudomonas aeruginosa PA01
ggucgcggcgacc

SEQ ID NO: 1520632 - RNA, 14 nt, Pseudomonas aeruginosa PA01
ggucgcggcuggcc

SEQ ID NO: 1520633 - RNA, 21 nt, Pseudomonas aeruginosa PA01
ggucgccagcagguagccagg

SEQ ID NO: 1520634 - RNA, 13 nt, Pseudomonas aeruginosa PA01
ggucgccggggcc

SEQ ID NO: 1520635 - RNA, 22 nt, Pseudomonas aeruginosa PA01
ggucgccguagaacagcacguc

SEQ ID NO: 1520636 - RNA, 18 nt, Pseudomonas aeruginosa PA01
ggucgcccugcagcgcgc

SEQ ID NO: 1520637 - RNA, 15 nt, Pseudomonas aeruginosa PA01
ggucgccgacacgug

SEQ ID NO: 1520638 - RNA, 22 nt, Pseudomonas aeruginosa PA01
ggucgccgcacaccgcgcgcgc

SEQ ID NO: 1520639 - RNA, 20 nt, Pseudomonas aeruginosa PA01
ggucgaggcaaucugcccgg

SEQ ID NO: 1520640 - RNA, 12 nt, Pseudomonas aeruginosa PA01
ggucgaggcccu

SEQ ID NO: 1520641 - RNA, 13 nt, Pseudomonas aeruginosa PA01
ggucgaggcccuc

SEQ ID NO: 1520642 - RNA, 14 nt, Pseudomonas aeruginosa PA01
ggucgagggcgcgu

SEQ ID NO: 1520643 - RNA, 15 nt, Pseudomonas aeruginosa PA01
ggucgagcucggcca

SEQ ID NO: 1520644 - RNA, 21 nt, Pseudomonas aeruginosa PA01
ggucgagcucggccaggcaca

SEQ ID NO: 1520645 - RNA, 19 nt, Pseudomonas aeruginosa PA01
ggucgagguucuccaggcu

SEQ ID NO: 1520646 - RNA, 12 nt, Pseudomonas aeruginosa PA01
ggucgagucggg

SEQ ID NO: 1520647 - RNA, 16 nt, Pseudomonas aeruginosa PA01
ggucgauauagcccug

SEQ ID NO: 1520648 - RNA, 23 nt, Pseudomonas aeruginosa PA01
ggucgaucuccuccucggcggcu

SEQ ID NO: 1520649 - RNA, 15 nt, Pseudomonas aeruginosa PA01
ggucgcagcuccagc

SEQ ID NO: 1520650 - RNA, 13 nt, Pseudomonas aeruginosa PA01
ggucgcacgcagc

SEQ ID NO: 1520651 - RNA, 17 nt, Pseudomonas aeruginosa PA01
ggucgauugcugggugc

SEQ ID NO: 1520652 - RNA, 18 nt, Pseudomonas aeruginosa PA01
ggucgauugcugggugcg

SEQ ID NO: 1520653 - RNA, 19 nt, Pseudomonas aeruginosa PA01
gguccuggaucacgcugag

SEQ ID NO: 1520654 - RNA, 20 nt, Pseudomonas aeruginosa PA01
gguccuggguauagaccagc

SEQ ID NO: 1520655 - RNA, 23 nt, Pseudomonas aeruginosa PA01
gguccuggugaucaucguccugc

SEQ ID NO: 1520656 - RNA, 12 nt, Pseudomonas aeruginosa PA01
gguccuugggcc

SEQ ID NO: 1520657 - RNA, 15 nt, Pseudomonas aeruginosa PA01
gguccuuguccgggu

SEQ ID NO: 1520658 - RNA, 13 nt, Pseudomonas aeruginosa PA01
ggucgacugcugg

SEQ ID NO: 1520659 - RNA, 16 nt, Pseudomonas aeruginosa PA01
ggucgacugcugggua

SEQ ID NO: 1520660 - RNA, 13 nt, Pseudomonas aeruginosa PA01
ggucgacggcggc

SEQ ID NO: 1520661 - RNA, 20 nt, Pseudomonas aeruginosa PA01
ggucgacauagcgcagcacc

SEQ ID NO: 1520662 - RNA, 22 nt, Pseudomonas aeruginosa PA01
ggucgaaccccuuccccccgcg

SEQ ID NO: 1520663 - RNA, 19 nt, Pseudomonas aeruginosa PA01
ggaacacacgcuucugcug

SEQ ID NO: 1520664 - RNA, 14 nt, Pseudomonas aeruginosa PA01
ggaacaccaggccg

SEQ ID NO: 1520665 - RNA, 17 nt, Pseudomonas aeruginosa PA01
gcuuucgaagcgcuccc

SEQ ID NO: 1520666 - RNA, 14 nt, Pseudomonas aeruginosa PA01
gcuuuccucggcca

SEQ ID NO: 1520667 - RNA, 23 nt, Pseudomonas aeruginosa PA01
gcuuuccugcuccagcagggcca

SEQ ID NO: 1520668 - RNA, 20 nt, Pseudomonas aeruginosa PA01
gcuuuccuggccgacccgca

SEQ ID NO: 1520669 - RNA, 14 nt, Pseudomonas aeruginosa PA01
gcuuuccgcggcgu

SEQ ID NO: 1520670 - RNA, 19 nt, Pseudomonas aeruginosa PA01
ggaacagguucggcaggcc

SEQ ID NO: 1520671 - RNA, 17 nt, Pseudomonas aeruginosa PA01
ggaacauccgcggcccc

SEQ ID NO: 1520672 - RNA, 21 nt, Pseudomonas aeruginosa PA01
ggaacagcccgucgcgcgccg

SEQ ID NO: 1520673 - RNA, 21 nt, Pseudomonas aeruginosa PA01
ggaacaggagccaucgcucca

SEQ ID NO: 1520674 - RNA, 12 nt, Pseudomonas aeruginosa PA01
ggaacagcuccu

SEQ ID NO: 1520675 - RNA, 14 nt, Pseudomonas aeruginosa PA01
ggaagccguggcgg

SEQ ID NO: 1520676 - RNA, 20 nt, Pseudomonas aeruginosa PA01
ggaagcggcgguacauggcc

SEQ ID NO: 1520677 - RNA, 21 nt, Pseudomonas aeruginosa PA01
ggaagcggcgguacauggccu

SEQ ID NO: 1520678 - RNA, 20 nt, Pseudomonas aeruginosa PA01
ggaagcgguagugggcgagg

SEQ ID NO: 1520679 - RNA, 19 nt, Pseudomonas aeruginosa PA01
ggaagguccuugggccagg

SEQ ID NO: 1520680 - RNA, 22 nt, Pseudomonas aeruginosa PA01
ggaagcgucagccgcggccggg

SEQ ID NO: 1520681 - RNA, 18 nt, Pseudomonas aeruginosa PA01
ggaagcguuccuggaagc

SEQ ID NO: 1520682 - RNA, 15 nt, Pseudomonas aeruginosa PA01
ggaagcugacgaaca

SEQ ID NO: 1520683 - RNA, 16 nt, Pseudomonas aeruginosa PA01
ggaaguagugcagcug

SEQ ID NO: 1520684 - RNA, 18 nt, Pseudomonas aeruginosa PA01
ggaaguagugcagcugcg

SEQ ID NO: 1520685 - RNA, 15 nt, Pseudomonas aeruginosa PA01
ggaacgucuggccag

SEQ ID NO: 1520686 - RNA, 22 nt, Pseudomonas aeruginosa PA01
ggaacggcguaccaggaugccc

SEQ ID NO: 1520687 - RNA, 18 nt, Pseudomonas aeruginosa PA01
ggaacgggacgccuggcg

SEQ ID NO: 1520688 - RNA, 23 nt, Pseudomonas aeruginosa PA01
ggaacucgaugaaaccggccucg

SEQ ID NO: 1520689 - RNA, 17 nt, Pseudomonas aeruginosa PA01
ggaagccgcgccccagc

SEQ ID NO: 1520690 - RNA, 20 nt, Pseudomonas aeruginosa PA01
ggaagccgcgccccagcggc

SEQ ID NO: 1520691 - RNA, 20 nt, Pseudomonas aeruginosa PA01
ggaagccgaccggcgccggg

SEQ ID NO: 1520692 - RNA, 20 nt, Pseudomonas aeruginosa PA01
ggacaccucccgggccagcu

SEQ ID NO: 1520693 - RNA, 23 nt, Pseudomonas aeruginosa PA01
ggacaccccgaaacgguccacca

SEQ ID NO: 1520694 - RNA, 13 nt, Pseudomonas aeruginosa PA01
ggacaacaggccg

SEQ ID NO: 1520695 - RNA, 16 nt, Pseudomonas aeruginosa PA01
ggacaacaggccgggc

SEQ ID NO: 1520696 - RNA, 17 nt, Pseudomonas aeruginosa PA01
ggacaacgacagccccg

SEQ ID NO: 1520697 - RNA, 14 nt, Pseudomonas aeruginosa PA01
ggaagucggcggcc

SEQ ID NO: 1520698 - RNA, 15 nt, Pseudomonas aeruginosa PA01
ggaagucguccagca

SEQ ID NO: 1520699 - RNA, 18 nt, Pseudomonas aeruginosa PA01
ggaagucguccagcaggu

SEQ ID NO: 1520700 - RNA, 21 nt, Pseudomonas aeruginosa PA01
ggaaguucacauuggcuuccg

SEQ ID NO: 1520701 - RNA, 15 nt, Pseudomonas aeruginosa PA01
ggaaguggcagcgcc

SEQ ID NO: 1520702 - RNA, 22 nt, Pseudomonas aeruginosa PA01
ggaauggaugcgcggcagcagg

SEQ ID NO: 1520703 - RNA, 23 nt, Pseudomonas aeruginosa PA01
ggaauggaugcgcggcagcaggc

SEQ ID NO: 1520704 - RNA, 18 nt, Pseudomonas aeruginosa PA01
ggaauggcgaugccgagg

SEQ ID NO: 1520705 - RNA, 22 nt, Pseudomonas aeruginosa PA01
ggaauggcgaugccgaggagga

SEQ ID NO: 1520706 - RNA, 17 nt, Pseudomonas aeruginosa PA01
ggacagcccgcgcucgg

SEQ ID NO: 1520707 - RNA, 17 nt, Pseudomonas aeruginosa PA01
ggacagcacgcucaggc

SEQ ID NO: 1520708 - RNA, 18 nt, Pseudomonas aeruginosa PA01
ggacagcacgcucaggca

SEQ ID NO: 1520709 - RNA, 17 nt, Pseudomonas aeruginosa PA01
ggacacgguccaggauc

SEQ ID NO: 1520710 - RNA, 18 nt, Pseudomonas aeruginosa PA01
ggacagcuugccguccag

SEQ ID NO: 1520711 - RNA, 16 nt, Pseudomonas aeruginosa PA01
ggacagggccaggccg

SEQ ID NO: 1520712 - RNA, 19 nt, Pseudomonas aeruginosa PA01
ggacaggcgucccuggagc

SEQ ID NO: 1520713 - RNA, 20 nt, Pseudomonas aeruginosa PA01
ggacagcucgcgggacagcu

SEQ ID NO: 1520714 - RNA, 18 nt, Pseudomonas aeruginosa PA01
ggaccgaaggcaacagcc

SEQ ID NO: 1520715 - RNA, 20 nt, Pseudomonas aeruginosa PA01
ggacccguugccgaccgagc

SEQ ID NO: 1520716 - RNA, 22 nt, Pseudomonas aeruginosa PA01
ggacccguugccgaccgagcag

SEQ ID NO: 1520717 - RNA, 22 nt, Pseudomonas aeruginosa PA01
ggaccuggcugaggcguuccag

SEQ ID NO: 1520718 - RNA, 19 nt, Pseudomonas aeruginosa PA01
ggaccuuccgccagcaggc

SEQ ID NO: 1520719 - RNA, 20 nt, Pseudomonas aeruginosa PA01
ggaccuucgacggcaggugg

SEQ ID NO: 1520720 - RNA, 21 nt, Pseudomonas aeruginosa PA01
ggacgaccucagaccacgccc

SEQ ID NO: 1520721 - RNA, 15 nt, Pseudomonas aeruginosa PA01
ggacgaagucgccgg

SEQ ID NO: 1520722 - RNA, 20 nt, Pseudomonas aeruginosa PA01
ggacgacgcuggccugccga

SEQ ID NO: 1520723 - RNA, 16 nt, Pseudomonas aeruginosa PA01
ggacgaggauggucag

SEQ ID NO: 1520724 - RNA, 18 nt, Pseudomonas aeruginosa PA01
ggacgcgcagggucaggc

SEQ ID NO: 1520725 - RNA, 20 nt, Pseudomonas aeruginosa PA01
ggacgcggcuggcgcaggac

SEQ ID NO: 1520726 - RNA, 22 nt, Pseudomonas aeruginosa PA01
ggacgcuuguccuucggccagu

SEQ ID NO: 1520727 - RNA, 12 nt, Pseudomonas aeruginosa PA01
aaaggggaugcc

SEQ ID NO: 1520728 - RNA, 14 nt, Pseudomonas aeruginosa PA01
ggagacggcccgcc

SEQ ID NO: 1520729 - RNA, 13 nt, Pseudomonas aeruginosa PA01
ggacuuuucgcuu

SEQ ID NO: 1520730 - RNA, 21 nt, Pseudomonas aeruginosa PA01
ggagcacggcauagccacggc

SEQ ID NO: 1520731 - RNA, 20 nt, Pseudomonas aeruginosa PA01
ggagcaucggcgcggccuuc

SEQ ID NO: 1520732 - RNA, 17 nt, Pseudomonas aeruginosa PA01
ggagcacgccgugcagg

SEQ ID NO: 1520733 - RNA, 23 nt, Pseudomonas aeruginosa PA01
ggagcaccgcgccuuccagcccu

SEQ ID NO: 1520734 - RNA, 16 nt, Pseudomonas aeruginosa PA01
ggagagcccgggcgca

SEQ ID NO: 1520735 - RNA, 15 nt, Pseudomonas aeruginosa PA01
ggagagguggccgag

SEQ ID NO: 1520736 - RNA, 16 nt, Pseudomonas aeruginosa PA01
ggacugguaggacagg

SEQ ID NO: 1520737 - RNA, 15 nt, Pseudomonas aeruginosa PA01
ggacugccaacuggc

SEQ ID NO: 1520738 - RNA, 14 nt, Pseudomonas aeruginosa PA01
ggacggcaggcccc

SEQ ID NO: 1520739 - RNA, 19 nt, Pseudomonas aeruginosa PA01
ggaucaacuccgccaggcg

SEQ ID NO: 1520740 - RNA, 20 nt, Pseudomonas aeruginosa PA01
ggauacgcuuggccaggucg

SEQ ID NO: 1520741 - RNA, 17 nt, Pseudomonas aeruginosa PA01
ggauaccacccgcagcc

SEQ ID NO: 1520742 - RNA, 17 nt, Pseudomonas aeruginosa PA01
ggauaacgccgguggcg

SEQ ID NO: 1520743 - RNA, 13 nt, Pseudomonas aeruginosa PA01
ggauaagccgcgc

SEQ ID NO: 1520744 - RNA, 20 nt, Pseudomonas aeruginosa PA01
ggauacggcaggguagccac

SEQ ID NO: 1520745 - RNA, 20 nt, Pseudomonas aeruginosa PA01
ggauaccgagggugcagagc

SEQ ID NO: 1520746 - RNA, 11 nt, Pseudomonas aeruginosa PA01
ggagccaggcg

SEQ ID NO: 1520747 - RNA, 16 nt, Pseudomonas aeruginosa PA01
ggagccaucgcuccag

SEQ ID NO: 1520748 - RNA, 13 nt, Pseudomonas aeruginosa PA01
ggagccggccagg

SEQ ID NO: 1520749 - RNA, 15 nt, Pseudomonas aeruginosa PA01
ggagccggccaggcg

SEQ ID NO: 1520750 - RNA, 16 nt, Pseudomonas aeruginosa PA01
ggagccggugccggcg

SEQ ID NO: 1520751 - RNA, 16 nt, Pseudomonas aeruginosa PA01
ggagccgucgccggcg

SEQ ID NO: 1520752 - RNA, 13 nt, Pseudomonas aeruginosa PA01
ggauaaaauccac

SEQ ID NO: 1520753 - RNA, 12 nt, Pseudomonas aeruginosa PA01
ggaguuccagcg

SEQ ID NO: 1520754 - RNA, 21 nt, Pseudomonas aeruginosa PA01
ggaguucgaaucucucuaccc

SEQ ID NO: 1520755 - RNA, 15 nt, Pseudomonas aeruginosa PA01
ggaguucgacccaug

SEQ ID NO: 1520756 - RNA, 13 nt, Pseudomonas aeruginosa PA01
ggaucgcugagca

SEQ ID NO: 1520757 - RNA, 14 nt, Pseudomonas aeruginosa PA01
ggaucggcaggcug

SEQ ID NO: 1520758 - RNA, 18 nt, Pseudomonas aeruginosa PA01
ggaucggccaacugagcg

SEQ ID NO: 1520759 - RNA, 11 nt, Pseudomonas aeruginosa PA01
ggauccaggug

SEQ ID NO: 1520760 - RNA, 17 nt, Pseudomonas aeruginosa PA01
ggaucagcggcggggcc

SEQ ID NO: 1520761 - RNA, 15 nt, Pseudomonas aeruginosa PA01
ggaucaggucgccag

SEQ ID NO: 1520762 - RNA, 16 nt, Pseudomonas aeruginosa PA01
ggaucaggucgccagc

SEQ ID NO: 1520763 - RNA, 19 nt, Pseudomonas aeruginosa PA01
ggaucaggucgccagcgcc

SEQ ID NO: 1520764 - RNA, 19 nt, Pseudomonas aeruginosa PA01
ggaucagguugaagagcag

SEQ ID NO: 1520765 - RNA, 20 nt, Pseudomonas aeruginosa PA01
ggaucaggaagguccaggcc

SEQ ID NO: 1520766 - RNA, 19 nt, Pseudomonas aeruginosa PA01
ggaucagucccuugaucag

SEQ ID NO: 1520767 - RNA, 17 nt, Pseudomonas aeruginosa PA01
ggaucagucgcugcucg

SEQ ID NO: 1520768 - RNA, 13 nt, Pseudomonas aeruginosa PA01
ggaucggccccac

SEQ ID NO: 1520769 - RNA, 15 nt, Pseudomonas aeruginosa PA01
ggaucggccccaccu

SEQ ID NO: 1520770 - RNA, 17 nt, Pseudomonas aeruginosa PA01
ggaucggccucgcggcg

SEQ ID NO: 1520771 - RNA, 18 nt, Pseudomonas aeruginosa PA01
ggaucggcgcccagcacc

SEQ ID NO: 1520772 - RNA, 22 nt, Pseudomonas aeruginosa PA01
ggaucgucgcggcgcgagauga

SEQ ID NO: 1520773 - RNA, 14 nt, Pseudomonas aeruginosa PA01
ggaucguccgggcg

SEQ ID NO: 1520774 - RNA, 19 nt, Pseudomonas aeruginosa PA01
ggaucgucgccaagcccgg

SEQ ID NO: 1520775 - RNA, 23 nt, Pseudomonas aeruginosa PA01
ggaugaucgcgugggccaccauc

SEQ ID NO: 1520776 - RNA, 23 nt, Pseudomonas aeruginosa PA01
ggaugaugacgagggacugaaga

SEQ ID NO: 1520777 - RNA, 15 nt, Pseudomonas aeruginosa PA01
ggaugacccgcucgc

SEQ ID NO: 1520778 - RNA, 15 nt, Pseudomonas aeruginosa PA01
ggaugaccaggcuga

SEQ ID NO: 1520779 - RNA, 14 nt, Pseudomonas aeruginosa PA01
ggaugaaguacugg

SEQ ID NO: 1520780 - RNA, 15 nt, Pseudomonas aeruginosa PA01
ggaucugcuccugca

SEQ ID NO: 1520781 - RNA, 16 nt, Pseudomonas aeruginosa PA01
ggaucugcuccugcag

SEQ ID NO: 1520782 - RNA, 19 nt, Pseudomonas aeruginosa PA01
ggaucugcugcaacauggc

SEQ ID NO: 1520783 - RNA, 15 nt, Pseudomonas aeruginosa PA01
ggaucuccucggcca

SEQ ID NO: 1520784 - RNA, 12 nt, Pseudomonas aeruginosa PA01
ggaucucgccac

SEQ ID NO: 1520785 - RNA, 15 nt, Pseudomonas aeruginosa PA01
ggauguccgccgccc

SEQ ID NO: 1520786 - RNA, 13 nt, Pseudomonas aeruginosa PA01
ggauguaguagac

SEQ ID NO: 1520787 - RNA, 22 nt, Pseudomonas aeruginosa PA01
ggauggucggugacccgcacgg

SEQ ID NO: 1520788 - RNA, 21 nt, Pseudomonas aeruginosa PA01
ggaugcgaugcugucagcgcc

SEQ ID NO: 1520789 - RNA, 18 nt, Pseudomonas aeruginosa PA01
ggaugcaaccgcccuggu

SEQ ID NO: 1520790 - RNA, 12 nt, Pseudomonas aeruginosa PA01
ggaugccgccgg

SEQ ID NO: 1520791 - RNA, 14 nt, Pseudomonas aeruginosa PA01
ggaugccgccggca

SEQ ID NO: 1520792 - RNA, 21 nt, Pseudomonas aeruginosa PA01
ggaugccgggcgagucgauca

SEQ ID NO: 1520793 - RNA, 12 nt, Pseudomonas aeruginosa PA01
ggaugccgcaca

SEQ ID NO: 1520794 - RNA, 18 nt, Pseudomonas aeruginosa PA01
ggaugccgcacaggcugg

SEQ ID NO: 1520795 - RNA, 15 nt, Pseudomonas aeruginosa PA01
ggauggacagcuugg

SEQ ID NO: 1520796 - RNA, 22 nt, Pseudomonas aeruginosa PA01
ggauggacagcuuggccagcag

SEQ ID NO: 1520797 - RNA, 13 nt, Pseudomonas aeruginosa PA01
ggauggagcacag

SEQ ID NO: 1520798 - RNA, 15 nt, Pseudomonas aeruginosa PA01
ggauggccggcgcgg

SEQ ID NO: 1520799 - RNA, 19 nt, Pseudomonas aeruginosa PA01
ggauggccguccaggcugc

SEQ ID NO: 1520800 - RNA, 22 nt, Pseudomonas aeruginosa PA01
ggauggcccccacggaggccuu

SEQ ID NO: 1520801 - RNA, 17 nt, Pseudomonas aeruginosa PA01
ggauuuccugcggcacg

SEQ ID NO: 1520802 - RNA, 18 nt, Pseudomonas aeruginosa PA01
ggauucguugaggcccau

SEQ ID NO: 1520803 - RNA, 12 nt, Pseudomonas aeruginosa PA01
ggauucgccagc

SEQ ID NO: 1520804 - RNA, 23 nt, Pseudomonas aeruginosa PA01
ggauucagugggucgaugcccuc

SEQ ID NO: 1520805 - RNA, 19 nt, Pseudomonas aeruginosa PA01
ggauucaucggcggcaggc

SEQ ID NO: 1520806 - RNA, 21 nt, Pseudomonas aeruginosa PA01
ggauucaucggcggcaggccg

SEQ ID NO: 1520807 - RNA, 13 nt, Pseudomonas aeruginosa PA01
ggauguucuucac

SEQ ID NO: 1520808 - RNA, 12 nt, Pseudomonas aeruginosa PA01
ggauuagcucag

SEQ ID NO: 1520809 - RNA, 13 nt, Pseudomonas aeruginosa PA01
ggcaacagcccgc

SEQ ID NO: 1520810 - RNA, 21 nt, Pseudomonas aeruginosa PA01
ggcaagcaccuugagggccuu

SEQ ID NO: 1520811 - RNA, 20 nt, Pseudomonas aeruginosa PA01
ggcaagacgaaagagcccgg

SEQ ID NO: 1520812 - RNA, 17 nt, Pseudomonas aeruginosa PA01
ggcaaccgcggcggccu

SEQ ID NO: 1520813 - RNA, 14 nt, Pseudomonas aeruginosa PA01
ggcaacugccgccc

SEQ ID NO: 1520814 - RNA, 18 nt, Pseudomonas aeruginosa PA01
ggccauaccuccagccag

SEQ ID NO: 1520815 - RNA, 19 nt, Pseudomonas aeruginosa PA01
ggccauaccuccagccagc

SEQ ID NO: 1520816 - RNA, 18 nt, Pseudomonas aeruginosa PA01
ggccauagcgcgccgggu

SEQ ID NO: 1520817 - RNA, 14 nt, Pseudomonas aeruginosa PA01
ggccaggucgccca

SEQ ID NO: 1520818 - RNA, 15 nt, Pseudomonas aeruginosa PA01
ggccaguucgcugac

SEQ ID NO: 1520819 - RNA, 22 nt, Pseudomonas aeruginosa PA01
ggccaguucgcugacccagcgc

SEQ ID NO: 1520820 - RNA, 16 nt, Pseudomonas aeruginosa PA01
ggccaguucgcggcgc

SEQ ID NO: 1520821 - RNA, 15 nt, Pseudomonas aeruginosa PA01
ggccaguucgcggcg

SEQ ID NO: 1520822 - RNA, 22 nt, Pseudomonas aeruginosa PA01
ggccaguugcgcuccgguggcg

SEQ ID NO: 1520823 - RNA, 23 nt, Pseudomonas aeruginosa PA01
ggccagguagcggcguucgccga

SEQ ID NO: 1520824 - RNA, 21 nt, Pseudomonas aeruginosa PA01
ggccagguauucgcgcucggc

SEQ ID NO: 1520825 - RNA, 16 nt, Pseudomonas aeruginosa PA01
ggccagggucgccagc

SEQ ID NO: 1520826 - RNA, 17 nt, Pseudomonas aeruginosa PA01
ggccagggucgccagca

SEQ ID NO: 1520827 - RNA, 15 nt, Pseudomonas aeruginosa PA01
ggccauggccgagcc

SEQ ID NO: 1520828 - RNA, 18 nt, Pseudomonas aeruginosa PA01
ggccauggccgagcccag

SEQ ID NO: 1520829 - RNA, 19 nt, Pseudomonas aeruginosa PA01
ggccaugcuggcgcucucg

SEQ ID NO: 1520830 - RNA, 20 nt, Pseudomonas aeruginosa PA01
ggccaugccggccaggaagg

SEQ ID NO: 1520831 - RNA, 14 nt, Pseudomonas aeruginosa PA01
ggccaugcgcucgg

SEQ ID NO: 1520832 - RNA, 19 nt, Pseudomonas aeruginosa PA01
ggccaugcgcucggggucg

SEQ ID NO: 1520833 - RNA, 19 nt, Pseudomonas aeruginosa PA01
ggccaucuucucgaagcgc

SEQ ID NO: 1520834 - RNA, 23 nt, Pseudomonas aeruginosa PA01
ggccaugagguuggccacguagg

SEQ ID NO: 1520835 - RNA, 21 nt, Pseudomonas aeruginosa PA01
ggccaugaucaucgccugcug

SEQ ID NO: 1520836 - RNA, 13 nt, Pseudomonas aeruginosa PA01
ggccaugccgccg

SEQ ID NO: 1520837 - RNA, 15 nt, Pseudomonas aeruginosa PA01
ggccaugcaggccag

SEQ ID NO: 1520838 - RNA, 18 nt, Pseudomonas aeruginosa PA01
ggccaugcaggccagggc

SEQ ID NO: 1520839 - RNA, 22 nt, Pseudomonas aeruginosa PA01
ggccaugaugugcgcaggcugg

SEQ ID NO: 1520840 - RNA, 15 nt, Pseudomonas aeruginosa PA01
ggccagcucgcccgc

SEQ ID NO: 1520841 - RNA, 13 nt, Pseudomonas aeruginosa PA01
ggccagcucgccg

SEQ ID NO: 1520842 - RNA, 20 nt, Pseudomonas aeruginosa PA01
ggccagcucgccgaacagga

SEQ ID NO: 1520843 - RNA, 16 nt, Pseudomonas aeruginosa PA01
ggccagcaccaguccc

SEQ ID NO: 1520844 - RNA, 23 nt, Pseudomonas aeruginosa PA01
ggccagcaaugcccgcgccuggg

SEQ ID NO: 1520845 - RNA, 21 nt, Pseudomonas aeruginosa PA01
ggccagcuuccaggcgcgcug

SEQ ID NO: 1520846 - RNA, 22 nt, Pseudomonas aeruginosa PA01
ggccagcuuccaggcgcgcugg

SEQ ID NO: 1520847 - RNA, 17 nt, Pseudomonas aeruginosa PA01
ggccagcuucuccagca

SEQ ID NO: 1520848 - RNA, 19 nt, Pseudomonas aeruginosa PA01
ggccagcuucuccagcagg

SEQ ID NO: 1520849 - RNA, 23 nt, Pseudomonas aeruginosa PA01
ggccagcuucuccagcagggucg

SEQ ID NO: 1520850 - RNA, 18 nt, Pseudomonas aeruginosa PA01
ggccagcuugucggccuu

SEQ ID NO: 1520851 - RNA, 13 nt, Pseudomonas aeruginosa PA01
ggccaggaagcgg

SEQ ID NO: 1520852 - RNA, 16 nt, Pseudomonas aeruginosa PA01
ggccaggcggccgacg

SEQ ID NO: 1520853 - RNA, 13 nt, Pseudomonas aeruginosa PA01
ggccaggcgcggc

SEQ ID NO: 1520854 - RNA, 13 nt, Pseudomonas aeruginosa PA01
ggccaggcucgcg

SEQ ID NO: 1520855 - RNA, 13 nt, Pseudomonas aeruginosa PA01
ggccagggcgagg

SEQ ID NO: 1520856 - RNA, 18 nt, Pseudomonas aeruginosa PA01
ggccagggucacgccaga

SEQ ID NO: 1520857 - RNA, 19 nt, Pseudomonas aeruginosa PA01
ggccaggggagcgccggcg

SEQ ID NO: 1520858 - RNA, 16 nt, Pseudomonas aeruginosa PA01
ggccagggggccuggc

SEQ ID NO: 1520859 - RNA, 20 nt, Pseudomonas aeruginosa PA01
ggccagggggccuggcucga

SEQ ID NO: 1520860 - RNA, 20 nt, Pseudomonas aeruginosa PA01
ggccagggcggugagguugc

SEQ ID NO: 1520861 - RNA, 14 nt, Pseudomonas aeruginosa PA01
ggcccagcagcgcu

SEQ ID NO: 1520862 - RNA, 20 nt, Pseudomonas aeruginosa PA01
ggcccagcaggccggccagc

SEQ ID NO: 1520863 - RNA, 15 nt, Pseudomonas aeruginosa PA01
ggcccagaccuugga

SEQ ID NO: 1520864 - RNA, 23 nt, Pseudomonas aeruginosa PA01
ggcccagaugaucaggccgagca

SEQ ID NO: 1520865 - RNA, 16 nt, Pseudomonas aeruginosa PA01
ggcccagagcagcacc

SEQ ID NO: 1520866 - RNA, 19 nt, Pseudomonas aeruginosa PA01
ggcccagauauccagggcc

SEQ ID NO: 1520867 - RNA, 14 nt, Pseudomonas aeruginosa PA01
ggcccagcgcggcg

SEQ ID NO: 1520868 - RNA, 14 nt, Pseudomonas aeruginosa PA01
ggcccaggccgggu

SEQ ID NO: 1520869 - RNA, 13 nt, Pseudomonas aeruginosa PA01
ggcccaggcuggc

SEQ ID NO: 1520870 - RNA, 16 nt, Pseudomonas aeruginosa PA01
ggcccaggcuggcggc

SEQ ID NO: 1520871 - RNA, 22 nt, Pseudomonas aeruginosa PA01
ggcccaggcuggcggccagggc

SEQ ID NO: 1520872 - RNA, 16 nt, Pseudomonas aeruginosa PA01
ggcccaguugcccggc

SEQ ID NO: 1520873 - RNA, 14 nt, Pseudomonas aeruginosa PA01
ggccccaggcugcc

SEQ ID NO: 1520874 - RNA, 17 nt, Pseudomonas aeruginosa PA01
ggcccccacggaggccu

SEQ ID NO: 1520875 - RNA, 18 nt, Pseudomonas aeruginosa PA01
ggcccccacggaggccuu

SEQ ID NO: 1520876 - RNA, 22 nt, Pseudomonas aeruginosa PA01
ggccccggugauguaggccgcu

SEQ ID NO: 1520877 - RNA, 13 nt, Pseudomonas aeruginosa PA01
ggccccuccaccu

SEQ ID NO: 1520878 - RNA, 16 nt, Pseudomonas aeruginosa PA01
ggccccugggccggcu

SEQ ID NO: 1520879 - RNA, 20 nt, Pseudomonas aeruginosa PA01
ggccccuucagcuccagcag

SEQ ID NO: 1520880 - RNA, 14 nt, Pseudomonas aeruginosa PA01
ggccccggccaggu

SEQ ID NO: 1520881 - RNA, 20 nt, Pseudomonas aeruginosa PA01
ggccccggcaagggccugcu

SEQ ID NO: 1520882 - RNA, 21 nt, Pseudomonas aeruginosa PA01
ggccccggcaagggccugcuc

SEQ ID NO: 1520883 - RNA, 13 nt, Pseudomonas aeruginosa PA01
ggccccggccagg

SEQ ID NO: 1520884 - RNA, 14 nt, Pseudomonas aeruginosa PA01
ggcccgccacagau

SEQ ID NO: 1520885 - RNA, 23 nt, Pseudomonas aeruginosa PA01
ggcccgccacagaucgccagcuc

SEQ ID NO: 1520886 - RNA, 14 nt, Pseudomonas aeruginosa PA01
ggcccgccgcggcg

SEQ ID NO: 1520887 - RNA, 12 nt, Pseudomonas aeruginosa PA01
ggcccgcgcggc

SEQ ID NO: 1520888 - RNA, 14 nt, Pseudomonas aeruginosa PA01
ggcccgcgccgccg

SEQ ID NO: 1520889 - RNA, 17 nt, Pseudomonas aeruginosa PA01
ggcccgccucggcggcu

SEQ ID NO: 1520890 - RNA, 21 nt, Pseudomonas aeruginosa PA01
ggcccgcggucacucggccuc

SEQ ID NO: 1520891 - RNA, 23 nt, Pseudomonas aeruginosa PA01
ggcccggaaugcaaaaagcccac

SEQ ID NO: 1520892 - RNA, 14 nt, Pseudomonas aeruginosa PA01
ggcccggcaggcag

SEQ ID NO: 1520893 - RNA, 15 nt, Pseudomonas aeruginosa PA01
ggcccggcaggcagu

SEQ ID NO: 1520894 - RNA, 19 nt, Pseudomonas aeruginosa PA01
ggcccggagcgcgaggcga

SEQ ID NO: 1520895 - RNA, 20 nt, Pseudomonas aeruginosa PA01
ggcccgcaaucagcgggccu

SEQ ID NO: 1520896 - RNA, 15 nt, Pseudomonas aeruginosa PA01
ggcccgagggcggca

SEQ ID NO: 1520897 - RNA, 18 nt, Pseudomonas aeruginosa PA01
ggcccgacgccgcccggc

SEQ ID NO: 1520898 - RNA, 18 nt, Pseudomonas aeruginosa PA01
ggcccucggcgccgagca

SEQ ID NO: 1520899 - RNA, 15 nt, Pseudomonas aeruginosa PA01
ggcccuacaaugaug

SEQ ID NO: 1520900 - RNA, 14 nt, Pseudomonas aeruginosa PA01
ggcccgugcggcac

SEQ ID NO: 1520901 - RNA, 17 nt, Pseudomonas aeruginosa PA01
ggcccgugcggcacgcu

SEQ ID NO: 1520902 - RNA, 16 nt, Pseudomonas aeruginosa PA01
ggcccguuccaccgcc

SEQ ID NO: 1520903 - RNA, 18 nt, Pseudomonas aeruginosa PA01
ggcccguauggcgggccu

SEQ ID NO: 1520904 - RNA, 19 nt, Pseudomonas aeruginosa PA01
ggcccguauggcgggccuu

SEQ ID NO: 1520905 - RNA, 21 nt, Pseudomonas aeruginosa PA01
ggcccguauggcgggccuugc

SEQ ID NO: 1520906 - RNA, 13 nt, Pseudomonas aeruginosa PA01
ggcccggccgccu

SEQ ID NO: 1520907 - RNA, 13 nt, Pseudomonas aeruginosa PA01
ggcccggcgcggc

SEQ ID NO: 1520908 - RNA, 16 nt, Pseudomonas aeruginosa PA01
ggcccggcgcggcggc

SEQ ID NO: 1520909 - RNA, 21 nt, Pseudomonas aeruginosa PA01
ggcccggcgcggcggccgccu

SEQ ID NO: 1520910 - RNA, 17 nt, Pseudomonas aeruginosa PA01
ggcccggcgcugcccgg

SEQ ID NO: 1520911 - RNA, 17 nt, Pseudomonas aeruginosa PA01
ggcccggcguccucgcg

SEQ ID NO: 1520912 - RNA, 14 nt, Pseudomonas aeruginosa PA01
ggcccgggccuggu

SEQ ID NO: 1520913 - RNA, 23 nt, Pseudomonas aeruginosa PA01
ggcccggcuccagccgggcuccg

SEQ ID NO: 1520914 - RNA, 17 nt, Pseudomonas aeruginosa PA01
ggcccggggcucugccg

SEQ ID NO: 1520915 - RNA, 19 nt, Pseudomonas aeruginosa PA01
ggcccggucagcuucgccg

SEQ ID NO: 1520916 - RNA, 22 nt, Pseudomonas aeruginosa PA01
ggcccugcucgccggcgcgggc

SEQ ID NO: 1520917 - RNA, 11 nt, Pseudomonas aeruginosa PA01
ggcccugcugc

SEQ ID NO: 1520918 - RNA, 18 nt, Pseudomonas aeruginosa PA01
ggcccuggauaucugggc

SEQ ID NO: 1520919 - RNA, 20 nt, Pseudomonas aeruginosa PA01
ggcccuggauaucugggcca

SEQ ID NO: 1520920 - RNA, 21 nt, Pseudomonas aeruginosa PA01
ggcccuggaucaccgcggcgc

SEQ ID NO: 1520921 - RNA, 12 nt, Pseudomonas aeruginosa PA01
ggcccugacauc

SEQ ID NO: 1520922 - RNA, 17 nt, Pseudomonas aeruginosa PA01
ggcccugcgccgcagcg

SEQ ID NO: 1520923 - RNA, 20 nt, Pseudomonas aeruginosa PA01
ggcccugcgccgcagcggcc

SEQ ID NO: 1520924 - RNA, 21 nt, Pseudomonas aeruginosa PA01
ggcccugcgccgcagcggcca

SEQ ID NO: 1520925 - RNA, 15 nt, Pseudomonas aeruginosa PA01
ggcccuggccuuggc

SEQ ID NO: 1520926 - RNA, 16 nt, Pseudomonas aeruginosa PA01
ggcccuggccuuggcc

SEQ ID NO: 1520927 - RNA, 13 nt, Pseudomonas aeruginosa PA01
ggcccugggcggc

SEQ ID NO: 1520928 - RNA, 17 nt, Pseudomonas aeruginosa PA01
ggcccugggcggcgacc

SEQ ID NO: 1520929 - RNA, 17 nt, Pseudomonas aeruginosa PA01
ggcccugggcggcgggc

SEQ ID NO: 1520930 - RNA, 18 nt, Pseudomonas aeruginosa PA01
ggcccuggcgcaggcggc

SEQ ID NO: 1520931 - RNA, 23 nt, Pseudomonas aeruginosa PA01
ggcccuugaggaaguugcgcagc

SEQ ID NO: 1520932 - RNA, 19 nt, Pseudomonas aeruginosa PA01
ggcccuugagggccucggc

SEQ ID NO: 1520933 - RNA, 21 nt, Pseudomonas aeruginosa PA01
ggcccugggccccggccggca

SEQ ID NO: 1520934 - RNA, 17 nt, Pseudomonas aeruginosa PA01
ggcccugguacagcgcc

SEQ ID NO: 1520935 - RNA, 18 nt, Pseudomonas aeruginosa PA01
ggcccugguacagcgccu

SEQ ID NO: 1520936 - RNA, 20 nt, Pseudomonas aeruginosa PA01
ggcccuugugaaagggcggc

SEQ ID NO: 1520937 - RNA, 21 nt, Pseudomonas aeruginosa PA01
ggcccuugugaaagggcggca

SEQ ID NO: 1520938 - RNA, 22 nt, Pseudomonas aeruginosa PA01
ggccgaaaucgaugucgcggcg

SEQ ID NO: 1520939 - RNA, 21 nt, Pseudomonas aeruginosa PA01
ggccgaaagcacugcggcggu

SEQ ID NO: 1520940 - RNA, 22 nt, Pseudomonas aeruginosa PA01
ggccgaaagcacugcggcgguc

SEQ ID NO: 1520941 - RNA, 19 nt, Pseudomonas aeruginosa PA01
ggccgaaauggcgguggcc

SEQ ID NO: 1520942 - RNA, 19 nt, Pseudomonas aeruginosa PA01
ggccgaagaggcccucggc

SEQ ID NO: 1520943 - RNA, 22 nt, Pseudomonas aeruginosa PA01
ggccgaagaggcccucggcgcc

SEQ ID NO: 1520944 - RNA, 12 nt, Pseudomonas aeruginosa PA01
ggccgaagccgc

SEQ ID NO: 1520945 - RNA, 15 nt, Pseudomonas aeruginosa PA01
ggccgaagccgccgg

SEQ ID NO: 1520946 - RNA, 16 nt, Pseudomonas aeruginosa PA01
ggccgaagccgccggg

SEQ ID NO: 1520947 - RNA, 18 nt, Pseudomonas aeruginosa PA01
ggccgaagccgccgggaa

SEQ ID NO: 1520948 - RNA, 14 nt, Pseudomonas aeruginosa PA01
ggccgaagcguggg

SEQ ID NO: 1520949 - RNA, 21 nt, Pseudomonas aeruginosa PA01
ggccgaagcgugggcggccgg

SEQ ID NO: 1520950 - RNA, 20 nt, Pseudomonas aeruginosa PA01
ggccgaaggcgcuccccugc

SEQ ID NO: 1520951 - RNA, 13 nt, Pseudomonas aeruginosa PA01
ggccgaaguagcc

SEQ ID NO: 1520952 - RNA, 16 nt, Pseudomonas aeruginosa PA01
ggccgaauccgccggc

SEQ ID NO: 1520953 - RNA, 17 nt, Pseudomonas aeruginosa PA01
ggccgaauccgccggcg

SEQ ID NO: 1520954 - RNA, 13 nt, Pseudomonas aeruginosa PA01
ggcagccguccgc

SEQ ID NO: 1520955 - RNA, 17 nt, Pseudomonas aeruginosa PA01
ggcagccugggggucua

SEQ ID NO: 1520956 - RNA, 19 nt, Pseudomonas aeruginosa PA01
ggcagccccuugagcgcgu

SEQ ID NO: 1520957 - RNA, 16 nt, Pseudomonas aeruginosa PA01
ggcagccggccaugcu

SEQ ID NO: 1520958 - RNA, 22 nt, Pseudomonas aeruginosa PA01
ggcagagcuggaagucguccag

SEQ ID NO: 1520959 - RNA, 18 nt, Pseudomonas aeruginosa PA01
ggcagaguggcgcggcug

SEQ ID NO: 1520960 - RNA, 21 nt, Pseudomonas aeruginosa PA01
ggcagaguuucucggucgccg

SEQ ID NO: 1520961 - RNA, 20 nt, Pseudomonas aeruginosa PA01
ggcagauuccuggaccccgc

SEQ ID NO: 1520962 - RNA, 15 nt, Pseudomonas aeruginosa PA01
ggcagccagccgccg

SEQ ID NO: 1520963 - RNA, 20 nt, Pseudomonas aeruginosa PA01
ggcagccauuuuagaaaaau

SEQ ID NO: 1520964 - RNA, 22 nt, Pseudomonas aeruginosa PA01
ggcagccaucgcauagccggcg

SEQ ID NO: 1520965 - RNA, 19 nt, Pseudomonas aeruginosa PA01
ggcaaguaaugccgaaggc

SEQ ID NO: 1520966 - RNA, 21 nt, Pseudomonas aeruginosa PA01
ggcaagggcacgugcagcggc

SEQ ID NO: 1520967 - RNA, 14 nt, Pseudomonas aeruginosa PA01
ggcaaggcggccuc

SEQ ID NO: 1520968 - RNA, 22 nt, Pseudomonas aeruginosa PA01
ggcaagcgcaugaggcuggcca

SEQ ID NO: 1520969 - RNA, 18 nt, Pseudomonas aeruginosa PA01
ggcaagcugaagcgccgc

SEQ ID NO: 1520970 - RNA, 22 nt, Pseudomonas aeruginosa PA01
ggcaagcugaagcgccgcggcc

SEQ ID NO: 1520971 - RNA, 15 nt, Pseudomonas aeruginosa PA01
ggcaaggcgaucccg

SEQ ID NO: 1520972 - RNA, 15 nt, Pseudomonas aeruginosa PA01
ggcaagcugcacggc

SEQ ID NO: 1520973 - RNA, 21 nt, Pseudomonas aeruginosa PA01
ggcaaguucgcauaggcggcc

SEQ ID NO: 1520974 - RNA, 17 nt, Pseudomonas aeruginosa PA01
ggcagaacaucgcccau

SEQ ID NO: 1520975 - RNA, 14 nt, Pseudomonas aeruginosa PA01
ggcagaccagcagc

SEQ ID NO: 1520976 - RNA, 22 nt, Pseudomonas aeruginosa PA01
ggcagaccaggccgagcaggaa

SEQ ID NO: 1520977 - RNA, 14 nt, Pseudomonas aeruginosa PA01
ggcagacaccacca

SEQ ID NO: 1520978 - RNA, 18 nt, Pseudomonas aeruginosa PA01
ggcagacgcugcucgacg

SEQ ID NO: 1520979 - RNA, 23 nt, Pseudomonas aeruginosa PA01
ggcagaccuggugggcggcggcu

SEQ ID NO: 1520980 - RNA, 19 nt, Pseudomonas aeruginosa PA01
ggcagcgaccaccaccagg

SEQ ID NO: 1520981 - RNA, 22 nt, Pseudomonas aeruginosa PA01
ggcagcgccagguaguccagcg

SEQ ID NO: 1520982 - RNA, 19 nt, Pseudomonas aeruginosa PA01
ggcagcgccaucaggcccu

SEQ ID NO: 1520983 - RNA, 13 nt, Pseudomonas aeruginosa PA01
ggcagcgccgagg

SEQ ID NO: 1520984 - RNA, 15 nt, Pseudomonas aeruginosa PA01
ggcagcgccgccagc

SEQ ID NO: 1520985 - RNA, 18 nt, Pseudomonas aeruginosa PA01
ggcagcgccgccagcagg

SEQ ID NO: 1520986 - RNA, 22 nt, Pseudomonas aeruginosa PA01
ggcaggaacgcccgcggcagca

SEQ ID NO: 1520987 - RNA, 17 nt, Pseudomonas aeruginosa PA01
ggcaggaaauccgccgc

SEQ ID NO: 1520988 - RNA, 22 nt, Pseudomonas aeruginosa PA01
ggcagcuggauccgugccaggc

SEQ ID NO: 1520989 - RNA, 22 nt, Pseudomonas aeruginosa PA01
ggcagcucgcuaugcagcaggu

SEQ ID NO: 1520990 - RNA, 16 nt, Pseudomonas aeruginosa PA01
ggcagcucggccgagg

SEQ ID NO: 1520991 - RNA, 19 nt, Pseudomonas aeruginosa PA01
ggcagcucggccgagggca

SEQ ID NO: 1520992 - RNA, 19 nt, Pseudomonas aeruginosa PA01
ggcagcucccuugccgccg

SEQ ID NO: 1520993 - RNA, 20 nt, Pseudomonas aeruginosa PA01
ggcaggcagugccgggcguc

SEQ ID NO: 1520994 - RNA, 19 nt, Pseudomonas aeruginosa PA01
ggcaggaucaggcucgagc

SEQ ID NO: 1520995 - RNA, 21 nt, Pseudomonas aeruginosa PA01
ggcaggaggaucgcggccuuc

SEQ ID NO: 1520996 - RNA, 17 nt, Pseudomonas aeruginosa PA01
ggcaggaaggccuggaa

SEQ ID NO: 1520997 - RNA, 22 nt, Pseudomonas aeruginosa PA01
ggcaggauaucgcccagggcca

SEQ ID NO: 1520998 - RNA, 14 nt, Pseudomonas aeruginosa PA01
ggcaggccagcagg

SEQ ID NO: 1520999 - RNA, 15 nt, Pseudomonas aeruginosa PA01
ggcaggccagcaggu

SEQ ID NO: 1521000 - RNA, 20 nt, Pseudomonas aeruginosa PA01
ggcaggcacgcugccagcag

SEQ ID NO: 1521001 - RNA, 24 nt, Pseudomonas aeruginosa PA01
ggcaggccuucccacuccguccag

SEQ ID NO: 1521002 - RNA, 13 nt, Pseudomonas aeruginosa PA01
ggcaggcgcggca

SEQ ID NO: 1521003 - RNA, 12 nt, Pseudomonas aeruginosa PA01
ggcaggcgcggg

SEQ ID NO: 1521004 - RNA, 23 nt, Pseudomonas aeruginosa PA01
ggcaggcgcuccuggugcggcac

SEQ ID NO: 1521005 - RNA, 13 nt, Pseudomonas aeruginosa PA01
ggcaggcucaccg

SEQ ID NO: 1521006 - RNA, 13 nt, Pseudomonas aeruginosa PA01
ggcaggcggcggc

SEQ ID NO: 1521007 - RNA, 17 nt, Pseudomonas aeruginosa PA01
ggcagggcgcccgcccg

SEQ ID NO: 1521008 - RNA, 22 nt, Pseudomonas aeruginosa PA01
ggcagggcgccgaccagcuuca

SEQ ID NO: 1521009 - RNA, 18 nt, Pseudomonas aeruginosa PA01
ggcagggaguccgccagc

SEQ ID NO: 1521010 - RNA, 13 nt, Pseudomonas aeruginosa PA01
ggcagggccagcg

SEQ ID NO: 1521011 - RNA, 17 nt, Pseudomonas aeruginosa PA01
ggcaggcuguuuuuccu

SEQ ID NO: 1521012 - RNA, 15 nt, Pseudomonas aeruginosa PA01
ggcaggcugcaucgg

SEQ ID NO: 1521013 - RNA, 19 nt, Pseudomonas aeruginosa PA01
ggcaucaccggcgggaugu

SEQ ID NO: 1521014 - RNA, 15 nt, Pseudomonas aeruginosa PA01
ggcagguagccgccu

SEQ ID NO: 1521015 - RNA, 16 nt, Pseudomonas aeruginosa PA01
ggcagguagccgccuu

SEQ ID NO: 1521016 - RNA, 16 nt, Pseudomonas aeruginosa PA01
ggcagguaguggcccu

SEQ ID NO: 1521017 - RNA, 20 nt, Pseudomonas aeruginosa PA01
ggcaggugccgcucguccag

SEQ ID NO: 1521018 - RNA, 14 nt, Pseudomonas aeruginosa PA01
ggcagguggcuggc

SEQ ID NO: 1521019 - RNA, 16 nt, Pseudomonas aeruginosa PA01
ggcagguggguaccga

SEQ ID NO: 1521020 - RNA, 21 nt, Pseudomonas aeruginosa PA01
ggcaggugguaagcgagcaga

SEQ ID NO: 1521021 - RNA, 22 nt, Pseudomonas aeruginosa PA01
ggcagguggucguugcgcgcca

SEQ ID NO: 1521022 - RNA, 16 nt, Pseudomonas aeruginosa PA01
ggcagguucagcaggu

SEQ ID NO: 1521023 - RNA, 15 nt, Pseudomonas aeruginosa PA01
ggcaugcugcucggc

SEQ ID NO: 1521024 - RNA, 19 nt, Pseudomonas aeruginosa PA01
ggcaugccguugggccagg

SEQ ID NO: 1521025 - RNA, 23 nt, Pseudomonas aeruginosa PA01
ggcaugccguugggccagggccu

SEQ ID NO: 1521026 - RNA, 18 nt, Pseudomonas aeruginosa PA01
ggcaucggagaccacggu

SEQ ID NO: 1521027 - RNA, 15 nt, Pseudomonas aeruginosa PA01
ggcaucgcguagggc

SEQ ID NO: 1521028 - RNA, 15 nt, Pseudomonas aeruginosa PA01
ggcauucgacccgcc

SEQ ID NO: 1521029 - RNA, 17 nt, Pseudomonas aeruginosa PA01
ggcauucucucuucagc

SEQ ID NO: 1521030 - RNA, 19 nt, Pseudomonas aeruginosa PA01
ggcauuccugguccagcca

SEQ ID NO: 1521031 - RNA, 14 nt, Pseudomonas aeruginosa PA01
ggcauggccacgcu

SEQ ID NO: 1521032 - RNA, 17 nt, Pseudomonas aeruginosa PA01
ggcaugcucggccaggu

SEQ ID NO: 1521033 - RNA, 13 nt, Pseudomonas aeruginosa PA01
ggccaauccacaa

SEQ ID NO: 1521034 - RNA, 16 nt, Pseudomonas aeruginosa PA01
ggcauuuccugggugc

SEQ ID NO: 1521035 - RNA, 22 nt, Pseudomonas aeruginosa PA01
ggccaagcuguugcuccaacca

SEQ ID NO: 1521036 - RNA, 20 nt, Pseudomonas aeruginosa PA01
ggccaccgcggcguccgcgu

SEQ ID NO: 1521037 - RNA, 13 nt, Pseudomonas aeruginosa PA01
ggccagaagcgcu

SEQ ID NO: 1521038 - RNA, 20 nt, Pseudomonas aeruginosa PA01
ggccacgcucucgaacagca

SEQ ID NO: 1521039 - RNA, 21 nt, Pseudomonas aeruginosa PA01
ggccacgcucucgaacagcag

SEQ ID NO: 1521040 - RNA, 22 nt, Pseudomonas aeruginosa PA01
ggccacgcucucgaacagcagc

SEQ ID NO: 1521041 - RNA, 17 nt, Pseudomonas aeruginosa PA01
ggccacgccgacgccga

SEQ ID NO: 1521042 - RNA, 19 nt, Pseudomonas aeruginosa PA01
ggccacgccgacgccgagu

SEQ ID NO: 1521043 - RNA, 22 nt, Pseudomonas aeruginosa PA01
ggccacgcgaccagcgccaggc

SEQ ID NO: 1521044 - RNA, 19 nt, Pseudomonas aeruginosa PA01
ggccacgcaccagcucccg

SEQ ID NO: 1521045 - RNA, 22 nt, Pseudomonas aeruginosa PA01
ggccacgcaccagcucccggcu

SEQ ID NO: 1521046 - RNA, 17 nt, Pseudomonas aeruginosa PA01
ggccacgacccugcugg

SEQ ID NO: 1521047 - RNA, 20 nt, Pseudomonas aeruginosa PA01
ggccacgacccugcuggccg

SEQ ID NO: 1521048 - RNA, 14 nt, Pseudomonas aeruginosa PA01
ggccaccuggcucu

SEQ ID NO: 1521049 - RNA, 11 nt, Pseudomonas aeruginosa PA01
ggccaccugcg

SEQ ID NO: 1521050 - RNA, 22 nt, Pseudomonas aeruginosa PA01
ggccaccgggaucagcggcggg

SEQ ID NO: 1521051 - RNA, 17 nt, Pseudomonas aeruginosa PA01
gcuggcacagguccagc

SEQ ID NO: 1521052 - RNA, 16 nt, Pseudomonas aeruginosa PA01
gcuggcaacggcgggc

SEQ ID NO: 1521053 - RNA, 13 nt, Pseudomonas aeruginosa PA01
gcuggucaggcug

SEQ ID NO: 1521054 - RNA, 17 nt, Pseudomonas aeruginosa PA01
gcuggucggcuuccgcc

SEQ ID NO: 1521055 - RNA, 21 nt, Pseudomonas aeruginosa PA01
gcuggucggcauccggcaggc

SEQ ID NO: 1521056 - RNA, 19 nt, Pseudomonas aeruginosa PA01
gcuggucucuuccagcaug

SEQ ID NO: 1521057 - RNA, 21 nt, Pseudomonas aeruginosa PA01
gcugucagcgcccggcugugc

SEQ ID NO: 1521058 - RNA, 15 nt, Pseudomonas aeruginosa PA01
gcuguaggacagguu

SEQ ID NO: 1521059 - RNA, 15 nt, Pseudomonas aeruginosa PA01
gcuguagugcuccgg

SEQ ID NO: 1521060 - RNA, 16 nt, Pseudomonas aeruginosa PA01
gcuguagggacaggcu

SEQ ID NO: 1521061 - RNA, 13 nt, Pseudomonas aeruginosa PA01
gcuguagcggcuc

SEQ ID NO: 1521062 - RNA, 13 nt, Pseudomonas aeruginosa PA01
gcuguagcggcuu

SEQ ID NO: 1521063 - RNA, 18 nt, Pseudomonas aeruginosa PA01
gcugugguuguggguaug

SEQ ID NO: 1521064 - RNA, 15 nt, Pseudomonas aeruginosa PA01
gcugugugccucuga

SEQ ID NO: 1521065 - RNA, 23 nt, Pseudomonas aeruginosa PA01
gcugucccggccauuccuuccag

SEQ ID NO: 1521066 - RNA, 13 nt, Pseudomonas aeruginosa PA01
gcuguccagcagg

SEQ ID NO: 1521067 - RNA, 14 nt, Pseudomonas aeruginosa PA01
gcuguugcccuggg

SEQ ID NO: 1521068 - RNA, 19 nt, Pseudomonas aeruginosa PA01
gcuguugccguggcggcgc

SEQ ID NO: 1521069 - RNA, 15 nt, Pseudomonas aeruginosa PA01
gcuguugccagggau

SEQ ID NO: 1521070 - RNA, 14 nt, Pseudomonas aeruginosa PA01
gcuguucagcagga

SEQ ID NO: 1521071 - RNA, 21 nt, Pseudomonas aeruginosa PA01
gcuuacccgcgaccacaggcg

SEQ ID NO: 1521072 - RNA, 12 nt, Pseudomonas aeruginosa PA01
gcuuagcccggg

SEQ ID NO: 1521073 - RNA, 18 nt, Pseudomonas aeruginosa PA01
gcuucacucauccucgcc

SEQ ID NO: 1521074 - RNA, 13 nt, Pseudomonas aeruginosa PA01
gcuucaccagagc

SEQ ID NO: 1521075 - RNA, 19 nt, Pseudomonas aeruginosa PA01
gcuucaacgcgacgguuga

SEQ ID NO: 1521076 - RNA, 19 nt, Pseudomonas aeruginosa PA01
gcuuccggcagccagccgc

SEQ ID NO: 1521077 - RNA, 15 nt, Pseudomonas aeruginosa PA01
gcuuccgccgccagg

SEQ ID NO: 1521078 - RNA, 22 nt, Pseudomonas aeruginosa PA01
gcuuccgccaggcgcagccagc

SEQ ID NO: 1521079 - RNA, 23 nt, Pseudomonas aeruginosa PA01
gcuuccgccaggcgcagccagca

SEQ ID NO: 1521080 - RNA, 14 nt, Pseudomonas aeruginosa PA01
gcuucgaagcucuc

SEQ ID NO: 1521081 - RNA, 21 nt, Pseudomonas aeruginosa PA01
gcuuccugguggaacagccgc

SEQ ID NO: 1521082 - RNA, 19 nt, Pseudomonas aeruginosa PA01
gcuuccuguuguuccacgu

SEQ ID NO: 1521083 - RNA, 18 nt, Pseudomonas aeruginosa PA01
gcuuccugggcuucgucc

SEQ ID NO: 1521084 - RNA, 13 nt, Pseudomonas aeruginosa PA01
gcuuccucgcucg

SEQ ID NO: 1521085 - RNA, 22 nt, Pseudomonas aeruginosa PA01
gcuuccucggcacucagccagc

SEQ ID NO: 1521086 - RNA, 16 nt, Pseudomonas aeruginosa PA01
gcuucccgcggcucca

SEQ ID NO: 1521087 - RNA, 19 nt, Pseudomonas aeruginosa PA01
gcuucccgcggcuccagcc

SEQ ID NO: 1521088 - RNA, 21 nt, Pseudomonas aeruginosa PA01
gcuucccaggccagcgggcug

SEQ ID NO: 1521089 - RNA, 13 nt, Pseudomonas aeruginosa PA01
gcuuccagccagc

SEQ ID NO: 1521090 - RNA, 14 nt, Pseudomonas aeruginosa PA01
gcuuccagccagcc

SEQ ID NO: 1521091 - RNA, 18 nt, Pseudomonas aeruginosa PA01
gcuuccagccagcccucg

SEQ ID NO: 1521092 - RNA, 12 nt, Pseudomonas aeruginosa PA01
gcuuccagcacc

SEQ ID NO: 1521093 - RNA, 15 nt, Pseudomonas aeruginosa PA01
gcuuccagugcuuga

SEQ ID NO: 1521094 - RNA, 12 nt, Pseudomonas aeruginosa PA01
gcuuccaggcac

SEQ ID NO: 1521095 - RNA, 20 nt, Pseudomonas aeruginosa PA01
gcuuccaggcgcgcuggaug

SEQ ID NO: 1521096 - RNA, 19 nt, Pseudomonas aeruginosa PA01
gcuuccagaccucgagcag

SEQ ID NO: 1521097 - RNA, 21 nt, Pseudomonas aeruginosa PA01
gcuuccacgcugaggcucagc

SEQ ID NO: 1521098 - RNA, 15 nt, Pseudomonas aeruginosa PA01
gcuuccaccgccugc

SEQ ID NO: 1521099 - RNA, 18 nt, Pseudomonas aeruginosa PA01
gcuuccaccgccugcccc

SEQ ID NO: 1521100 - RNA, 17 nt, Pseudomonas aeruginosa PA01
gcuucaggcucggccug

SEQ ID NO: 1521101 - RNA, 19 nt, Pseudomonas aeruginosa PA01
gcuucaggucgucgggcag

SEQ ID NO: 1521102 - RNA, 16 nt, Pseudomonas aeruginosa PA01
gcuucagcuccgagcc

SEQ ID NO: 1521103 - RNA, 13 nt, Pseudomonas aeruginosa PA01
gcuucaggcgcgc

SEQ ID NO: 1521104 - RNA, 18 nt, Pseudomonas aeruginosa PA01
gcuucaggcgcgcggcca

SEQ ID NO: 1521105 - RNA, 17 nt, Pseudomonas aeruginosa PA01
gcuucagcgcgccgagc

SEQ ID NO: 1521106 - RNA, 20 nt, Pseudomonas aeruginosa PA01
gcuucaggcaguccuugagc

SEQ ID NO: 1521107 - RNA, 23 nt, Pseudomonas aeruginosa PA01
gcuucgggagucaacgccuggcc

SEQ ID NO: 1521108 - RNA, 21 nt, Pseudomonas aeruginosa PA01
gcuucgggaucguaggcgcgc

SEQ ID NO: 1521109 - RNA, 19 nt, Pseudomonas aeruginosa PA01
gcuucguccugcugcuggc

SEQ ID NO: 1521110 - RNA, 16 nt, Pseudomonas aeruginosa PA01
gcuucgcuggguuuuc

SEQ ID NO: 1521111 - RNA, 17 nt, Pseudomonas aeruginosa PA01
gcuucggcgcgcugguu

SEQ ID NO: 1521112 - RNA, 13 nt, Pseudomonas aeruginosa PA01
gcuucggcggcuu

SEQ ID NO: 1521113 - RNA, 20 nt, Pseudomonas aeruginosa PA01
gcuucgcgggugaccuggcc

SEQ ID NO: 1521114 - RNA, 14 nt, Pseudomonas aeruginosa PA01
gcuucgccgcgcaa

SEQ ID NO: 1521115 - RNA, 17 nt, Pseudomonas aeruginosa PA01
gcuucgagcacuuccca

SEQ ID NO: 1521116 - RNA, 18 nt, Pseudomonas aeruginosa PA01
gcuucugucccugggcca

SEQ ID NO: 1521117 - RNA, 18 nt, Pseudomonas aeruginosa PA01
gcuucugcuggccgcgca

SEQ ID NO: 1521118 - RNA, 16 nt, Pseudomonas aeruginosa PA01
gcuucguugccauagc

SEQ ID NO: 1521119 - RNA, 17 nt, Pseudomonas aeruginosa PA01
gcuucguugcuccugcg

SEQ ID NO: 1521120 - RNA, 13 nt, Pseudomonas aeruginosa PA01
gcuucuccucggc

SEQ ID NO: 1521121 - RNA, 18 nt, Pseudomonas aeruginosa PA01
gcuucucgucgccgccgu

SEQ ID NO: 1521122 - RNA, 15 nt, Pseudomonas aeruginosa PA01
gcuucuccaccggau

SEQ ID NO: 1521123 - RNA, 16 nt, Pseudomonas aeruginosa PA01
gcuugccggcagcgac

SEQ ID NO: 1521124 - RNA, 17 nt, Pseudomonas aeruginosa PA01
gcuugccggcggcgcug

SEQ ID NO: 1521125 - RNA, 15 nt, Pseudomonas aeruginosa PA01
gcuugccgguagggc

SEQ ID NO: 1521126 - RNA, 18 nt, Pseudomonas aeruginosa PA01
gcuugccuuccaggcugu

SEQ ID NO: 1521127 - RNA, 15 nt, Pseudomonas aeruginosa PA01
gcuugcgcaccuccu

SEQ ID NO: 1521128 - RNA, 19 nt, Pseudomonas aeruginosa PA01
gcuugcgcagcaucuucuc

SEQ ID NO: 1521129 - RNA, 14 nt, Pseudomonas aeruginosa PA01
gcuugccuuccugg

SEQ ID NO: 1521130 - RNA, 19 nt, Pseudomonas aeruginosa PA01
gcuugcgguuauccgccgu

SEQ ID NO: 1521131 - RNA, 15 nt, Pseudomonas aeruginosa PA01
gcuugcgccguggca

SEQ ID NO: 1521132 - RNA, 16 nt, Pseudomonas aeruginosa PA01
gcuugcgcgccgccgc

SEQ ID NO: 1521133 - RNA, 16 nt, Pseudomonas aeruginosa PA01
gcuugcacaccugguc

SEQ ID NO: 1521134 - RNA, 22 nt, Pseudomonas aeruginosa PA01
gcuugaucacgccgaagcccgu

SEQ ID NO: 1521135 - RNA, 21 nt, Pseudomonas aeruginosa PA01
gcuugaggucgugcagcacau

SEQ ID NO: 1521136 - RNA, 17 nt, Pseudomonas aeruginosa PA01
gcuugagguaggccagc

SEQ ID NO: 1521137 - RNA, 16 nt, Pseudomonas aeruginosa PA01
gcuugagccccggcag

SEQ ID NO: 1521138 - RNA, 21 nt, Pseudomonas aeruginosa PA01
gcuugagccauucggcuuccu

SEQ ID NO: 1521139 - RNA, 19 nt, Pseudomonas aeruginosa PA01
gcuugacccguugcgccuc

SEQ ID NO: 1521140 - RNA, 20 nt, Pseudomonas aeruginosa PA01
gcuugacgaugccguucagg

SEQ ID NO: 1521141 - RNA, 16 nt, Pseudomonas aeruginosa PA01
gcuucuucaccaggcc

SEQ ID NO: 1521142 - RNA, 16 nt, Pseudomonas aeruginosa PA01
gcuucuucagcagcgg

SEQ ID NO: 1521143 - RNA, 16 nt, Pseudomonas aeruginosa PA01
gcuucuugccuuccac

SEQ ID NO: 1521144 - RNA, 13 nt, Pseudomonas aeruginosa PA01
gcuugggcgccuc

SEQ ID NO: 1521145 - RNA, 20 nt, Pseudomonas aeruginosa PA01
gcuugcugccauggcggcgg

SEQ ID NO: 1521146 - RNA, 15 nt, Pseudomonas aeruginosa PA01
gcuugcugaagcccc

SEQ ID NO: 1521147 - RNA, 13 nt, Pseudomonas aeruginosa PA01
gcuuggcgcgcug

SEQ ID NO: 1521148 - RNA, 17 nt, Pseudomonas aeruginosa PA01
gcuuggcgcgcuggcag

SEQ ID NO: 1521149 - RNA, 22 nt, Pseudomonas aeruginosa PA01
gcuuggcgaaaucgagcugcuc

SEQ ID NO: 1521150 - RNA, 16 nt, Pseudomonas aeruginosa PA01
gcuuggcccuggccuu

SEQ ID NO: 1521151 - RNA, 14 nt, Pseudomonas aeruginosa PA01
gcuuguagcccagg

SEQ ID NO: 1521152 - RNA, 15 nt, Pseudomonas aeruginosa PA01
gcuugucggccuugg

SEQ ID NO: 1521153 - RNA, 17 nt, Pseudomonas aeruginosa PA01
gcuuguccagggcgccc

SEQ ID NO: 1521154 - RNA, 21 nt, Pseudomonas aeruginosa PA01
aaaggccgcguaagcggccuu

SEQ ID NO: 1521155 - RNA, 23 nt, Pseudomonas aeruginosa PA01
aaaggccuguccgaagacaggcc

SEQ ID NO: 1521156 - RNA, 12 nt, Pseudomonas aeruginosa PA01
aaaggcggauga

SEQ ID NO: 1521157 - RNA, 14 nt, Pseudomonas aeruginosa PA01
gcuugguguagaga

SEQ ID NO: 1521158 - RNA, 18 nt, Pseudomonas aeruginosa PA01
gcuugguguagagauucu

SEQ ID NO: 1521159 - RNA, 17 nt, Pseudomonas aeruginosa PA01
gcuugguucgcgcgcug

SEQ ID NO: 1521160 - RNA, 19 nt, Pseudomonas aeruginosa PA01
gcuuuccaccgccagcacc

SEQ ID NO: 1521161 - RNA, 17 nt, Pseudomonas aeruginosa PA01
gcuuuccagcccggcgu

SEQ ID NO: 1521162 - RNA, 14 nt, Pseudomonas aeruginosa PA01
gcuuuccgccgagc

SEQ ID NO: 1521163 - RNA, 21 nt, Pseudomonas aeruginosa PA01
gcuuguugaugguuucuuccc

SEQ ID NO: 1521164 - RNA, 13 nt, Pseudomonas aeruginosa PA01
gcucccggcuugc

SEQ ID NO: 1521165 - RNA, 16 nt, Pseudomonas aeruginosa PA01
gcuccaguugcagcac

SEQ ID NO: 1521166 - RNA, 23 nt, Pseudomonas aeruginosa PA01
gcuccaguugcagcacccccagc

SEQ ID NO: 1521167 - RNA, 14 nt, Pseudomonas aeruginosa PA01
gcucccugccgccc

SEQ ID NO: 1521168 - RNA, 23 nt, Pseudomonas aeruginosa PA01
gcucccuggcggauaucgcgccg

SEQ ID NO: 1521169 - RNA, 23 nt, Pseudomonas aeruginosa PA01
gcuccgaagggaacccgcggcgc

SEQ ID NO: 1521170 - RNA, 14 nt, Pseudomonas aeruginosa PA01
gcuccgagcaggcc

SEQ ID NO: 1521171 - RNA, 15 nt, Pseudomonas aeruginosa PA01
gcuccgagcaggccu

SEQ ID NO: 1521172 - RNA, 14 nt, Pseudomonas aeruginosa PA01
gcuccgccaggccg

SEQ ID NO: 1521173 - RNA, 23 nt, Pseudomonas aeruginosa PA01
gcuccgccaggccgcgcaguccc

SEQ ID NO: 1521174 - RNA, 14 nt, Pseudomonas aeruginosa PA01
gcuccuccgggaag

SEQ ID NO: 1521175 - RNA, 18 nt, Pseudomonas aeruginosa PA01
gcuccuccagcaggaccu

SEQ ID NO: 1521176 - RNA, 18 nt, Pseudomonas aeruginosa PA01
gcuccuccagcgccgcca

SEQ ID NO: 1521177 - RNA, 13 nt, Pseudomonas aeruginosa PA01
gcuccuccaggcu

SEQ ID NO: 1521178 - RNA, 19 nt, Pseudomonas aeruginosa PA01
gcuccuccaggcucuucag

SEQ ID NO: 1521179 - RNA, 20 nt, Pseudomonas aeruginosa PA01
gcuccuccucgcucugcgcc

SEQ ID NO: 1521180 - RNA, 16 nt, Pseudomonas aeruginosa PA01
gcuccgugucggcggc

SEQ ID NO: 1521181 - RNA, 17 nt, Pseudomonas aeruginosa PA01
gcuccgugucggcggcg

SEQ ID NO: 1521182 - RNA, 24 nt, Pseudomonas aeruginosa PA01
gcuccguugaacucggcgcccagg

SEQ ID NO: 1521183 - RNA, 16 nt, Pseudomonas aeruginosa PA01
gcuccgcggccggcuu

SEQ ID NO: 1521184 - RNA, 12 nt, Pseudomonas aeruginosa PA01
gcuccgccgccg

SEQ ID NO: 1521185 - RNA, 14 nt, Pseudomonas aeruginosa PA01
gcuccgcgcacgga

SEQ ID NO: 1521186 - RNA, 22 nt, Pseudomonas aeruginosa PA01
gcuccgcgcacggaucgcgcug

SEQ ID NO: 1521187 - RNA, 15 nt, Pseudomonas aeruginosa PA01
gcuccggauggcuga

SEQ ID NO: 1521188 - RNA, 20 nt, Pseudomonas aeruginosa PA01
gcuccggcagcagggucagc

SEQ ID NO: 1521189 - RNA, 23 nt, Pseudomonas aeruginosa PA01
gcuccgcuaagcgucacucccag

SEQ ID NO: 1521190 - RNA, 23 nt, Pseudomonas aeruginosa PA01
gcuccgcucagucgaccgucgcc

SEQ ID NO: 1521191 - RNA, 23 nt, Pseudomonas aeruginosa PA01
gcuccgguucggcaaggcgcagc

SEQ ID NO: 1521192 - RNA, 13 nt, Pseudomonas aeruginosa PA01
gcuccgggcggcu

SEQ ID NO: 1521193 - RNA, 17 nt, Pseudomonas aeruginosa PA01
gcuccggggucaguucc

SEQ ID NO: 1521194 - RNA, 20 nt, Pseudomonas aeruginosa PA01
gcuccggguacuggcgcugc

SEQ ID NO: 1521195 - RNA, 23 nt, Pseudomonas aeruginosa PA01
gcuccggcgggcgguagcgggcc

SEQ ID NO: 1521196 - RNA, 20 nt, Pseudomonas aeruginosa PA01
gcuccagcaccguggcgcca

SEQ ID NO: 1521197 - RNA, 12 nt, Pseudomonas aeruginosa PA01
gcuccagcaggg

SEQ ID NO: 1521198 - RNA, 14 nt, Pseudomonas aeruginosa PA01
gcuccagcagggcc

SEQ ID NO: 1521199 - RNA, 21 nt, Pseudomonas aeruginosa PA01
gcuccagcagggccagcgccu

SEQ ID NO: 1521200 - RNA, 22 nt, Pseudomonas aeruginosa PA01
gcuccagcagggccagcgccug

SEQ ID NO: 1521201 - RNA, 11 nt, Pseudomonas aeruginosa PA01
gcuccagcagu

SEQ ID NO: 1521202 - RNA, 18 nt, Pseudomonas aeruginosa PA01
gcuccagccaggcccggu

SEQ ID NO: 1521203 - RNA, 11 nt, Pseudomonas aeruginosa PA01
gcuccagcagg

SEQ ID NO: 1521204 - RNA, 15 nt, Pseudomonas aeruginosa PA01
gcuccagcgcccagg

SEQ ID NO: 1521205 - RNA, 21 nt, Pseudomonas aeruginosa PA01
gcuccagccgggcuccgccgc

SEQ ID NO: 1521206 - RNA, 19 nt, Pseudomonas aeruginosa PA01
gcuccaacaggcauugccg

SEQ ID NO: 1521207 - RNA, 23 nt, Pseudomonas aeruginosa PA01
gcuccaauccgauuccgcgcagg

SEQ ID NO: 1521208 - RNA, 14 nt, Pseudomonas aeruginosa PA01
gcuccaacgcaggc

SEQ ID NO: 1521209 - RNA, 22 nt, Pseudomonas aeruginosa PA01
gcuccaacggcccuuccacuuc

SEQ ID NO: 1521210 - RNA, 18 nt, Pseudomonas aeruginosa PA01
gcuccaauucgacgccga

SEQ ID NO: 1521211 - RNA, 16 nt, Pseudomonas aeruginosa PA01
gcucaucuucucguuc

SEQ ID NO: 1521212 - RNA, 15 nt, Pseudomonas aeruginosa PA01
gcucaucgcccgccc

SEQ ID NO: 1521213 - RNA, 21 nt, Pseudomonas aeruginosa PA01
gcucauaccgguaauccggca

SEQ ID NO: 1521214 - RNA, 17 nt, Pseudomonas aeruginosa PA01
gcgguaugccgcaggca

SEQ ID NO: 1521215 - RNA, 21 nt, Pseudomonas aeruginosa PA01
gcgguaguguugaagccgcca

SEQ ID NO: 1521216 - RNA, 12 nt, Pseudomonas aeruginosa PA01
gcgguaguucag

SEQ ID NO: 1521217 - RNA, 15 nt, Pseudomonas aeruginosa PA01
gcgguacccagcuug

SEQ ID NO: 1521218 - RNA, 13 nt, Pseudomonas aeruginosa PA01
gcgguacccgccg

SEQ ID NO: 1521219 - RNA, 19 nt, Pseudomonas aeruginosa PA01
gcgguacccgccggccaug

SEQ ID NO: 1521220 - RNA, 18 nt, Pseudomonas aeruginosa PA01
gcgguacagcucguccuu

SEQ ID NO: 1521221 - RNA, 14 nt, Pseudomonas aeruginosa PA01
gcgguacaggcgca

SEQ ID NO: 1521222 - RNA, 19 nt, Pseudomonas aeruginosa PA01
gcgguaccagcagcgccga

SEQ ID NO: 1521223 - RNA, 17 nt, Pseudomonas aeruginosa PA01
gcgguauucuccagcag

SEQ ID NO: 1521224 - RNA, 20 nt, Pseudomonas aeruginosa PA01
gcuccucgauaaacggcgcu

SEQ ID NO: 1521225 - RNA, 16 nt, Pseudomonas aeruginosa PA01
gcuccucugccugcgc

SEQ ID NO: 1521226 - RNA, 19 nt, Pseudomonas aeruginosa PA01
gcuccugaaggaccagcuu

SEQ ID NO: 1521227 - RNA, 19 nt, Pseudomonas aeruginosa PA01
gcuccucggcagcgcuggc

SEQ ID NO: 1521228 - RNA, 20 nt, Pseudomonas aeruginosa PA01
gcuccucggcagcgcuggcg

SEQ ID NO: 1521229 - RNA, 17 nt, Pseudomonas aeruginosa PA01
gcuccucggccuugcug

SEQ ID NO: 1521230 - RNA, 15 nt, Pseudomonas aeruginosa PA01
gcuccucgcgcugcc

SEQ ID NO: 1521231 - RNA, 19 nt, Pseudomonas aeruginosa PA01
gcuccucgcgcugcccggc

SEQ ID NO: 1521232 - RNA, 14 nt, Pseudomonas aeruginosa PA01
gcuccugcgccggc

SEQ ID NO: 1521233 - RNA, 21 nt, Pseudomonas aeruginosa PA01
gcuccuggaugcuccgcgccu

SEQ ID NO: 1521234 - RNA, 19 nt, Pseudomonas aeruginosa PA01
gcucgaaagccuccagcag

SEQ ID NO: 1521235 - RNA, 22 nt, Pseudomonas aeruginosa PA01
gcucgaacagcaccgagcaggc

SEQ ID NO: 1521236 - RNA, 16 nt, Pseudomonas aeruginosa PA01
gcuccuugcgccaggc

SEQ ID NO: 1521237 - RNA, 21 nt, Pseudomonas aeruginosa PA01
gcuccuugcucucgcgcacgc

SEQ ID NO: 1521238 - RNA, 18 nt, Pseudomonas aeruginosa PA01
gcuccuuggcuggccagc

SEQ ID NO: 1521239 - RNA, 23 nt, Pseudomonas aeruginosa PA01
gcuccuuggcuggccagcccugg

SEQ ID NO: 1521240 - RNA, 19 nt, Pseudomonas aeruginosa PA01
gcucgaaacgaagcuucau

SEQ ID NO: 1521241 - RNA, 15 nt, Pseudomonas aeruginosa PA01
gcucgaccgccugcu

SEQ ID NO: 1521242 - RNA, 22 nt, Pseudomonas aeruginosa PA01
gcucgaccgccugcucgcggcu

SEQ ID NO: 1521243 - RNA, 14 nt, Pseudomonas aeruginosa PA01
gcucgacgagccgc

SEQ ID NO: 1521244 - RNA, 23 nt, Pseudomonas aeruginosa PA01
gcucgaauaaaaaaccggccaau

SEQ ID NO: 1521245 - RNA, 15 nt, Pseudomonas aeruginosa PA01
gcucgaagccgccgu

SEQ ID NO: 1521246 - RNA, 19 nt, Pseudomonas aeruginosa PA01
gcucgaacggcggaucgau

SEQ ID NO: 1521247 - RNA, 12 nt, Pseudomonas aeruginosa PA01
gcucgaacgggc

SEQ ID NO: 1521248 - RNA, 16 nt, Pseudomonas aeruginosa PA01
gcucgagggcgaccgc

SEQ ID NO: 1521249 - RNA, 14 nt, Pseudomonas aeruginosa PA01
gcucgacgaucagg

SEQ ID NO: 1521250 - RNA, 21 nt, Pseudomonas aeruginosa PA01
gcucgaccuugccgagcgcga

SEQ ID NO: 1521251 - RNA, 23 nt, Pseudomonas aeruginosa PA01
gcucgaccuugccgagcgcgauc

SEQ ID NO: 1521252 - RNA, 19 nt, Pseudomonas aeruginosa PA01
gcucgacggucagcggaca

SEQ ID NO: 1521253 - RNA, 20 nt, Pseudomonas aeruginosa PA01
gcucgaugcccgccagcagg

SEQ ID NO: 1521254 - RNA, 13 nt, Pseudomonas aeruginosa PA01
gcucgccaccugu

SEQ ID NO: 1521255 - RNA, 16 nt, Pseudomonas aeruginosa PA01
gcucgcaccaggccag

SEQ ID NO: 1521256 - RNA, 21 nt, Pseudomonas aeruginosa PA01
gcucgcagagggcgaugcccu

SEQ ID NO: 1521257 - RNA, 18 nt, Pseudomonas aeruginosa PA01
gcucgcccaugcgcggcg

SEQ ID NO: 1521258 - RNA, 18 nt, Pseudomonas aeruginosa PA01
gcucgcgguaggccagcu

SEQ ID NO: 1521259 - RNA, 17 nt, Pseudomonas aeruginosa PA01
gcucgccuaccggcgcc

SEQ ID NO: 1521260 - RNA, 20 nt, Pseudomonas aeruginosa PA01
gcucgccgggucgccgcagc

SEQ ID NO: 1521261 - RNA, 14 nt, Pseudomonas aeruginosa PA01
gcucgccggcgucc

SEQ ID NO: 1521262 - RNA, 13 nt, Pseudomonas aeruginosa PA01
gcucgccgccagc

SEQ ID NO: 1521263 - RNA, 20 nt, Pseudomonas aeruginosa PA01
gcucgccgccagcaggaucg

SEQ ID NO: 1521264 - RNA, 14 nt, Pseudomonas aeruginosa PA01
gcucgcuccgagca

SEQ ID NO: 1521265 - RNA, 16 nt, Pseudomonas aeruginosa PA01
gcucgcucucgaacac

SEQ ID NO: 1521266 - RNA, 18 nt, Pseudomonas aeruginosa PA01
gcucgcuacagccgggau

SEQ ID NO: 1521267 - RNA, 19 nt, Pseudomonas aeruginosa PA01
gcucgcgguuauccgccgc

SEQ ID NO: 1521268 - RNA, 18 nt, Pseudomonas aeruginosa PA01
gcucgcugucgccgagca

SEQ ID NO: 1521269 - RNA, 16 nt, Pseudomonas aeruginosa PA01
gcucgcuucagcgagc

SEQ ID NO: 1521270 - RNA, 17 nt, Pseudomonas aeruginosa PA01
gcucggggugcgcggcg

SEQ ID NO: 1521271 - RNA, 20 nt, Pseudomonas aeruginosa PA01
gcucggggauguccgccgcc

SEQ ID NO: 1521272 - RNA, 13 nt, Pseudomonas aeruginosa PA01
gcucgggcgucuc

SEQ ID NO: 1521273 - RNA, 18 nt, Pseudomonas aeruginosa PA01
gcucgggcgucuccugcc

SEQ ID NO: 1521274 - RNA, 17 nt, Pseudomonas aeruginosa PA01
gcucgggcugccgcaga

SEQ ID NO: 1521275 - RNA, 22 nt, Pseudomonas aeruginosa PA01
gcucgggcugccgcagaucauc

SEQ ID NO: 1521276 - RNA, 23 nt, Pseudomonas aeruginosa PA01
gcucgucuuucaggugggccacu

SEQ ID NO: 1521277 - RNA, 21 nt, Pseudomonas aeruginosa PA01
gcucguggaaaaagaagaaaa

SEQ ID NO: 1521278 - RNA, 16 nt, Pseudomonas aeruginosa PA01
gcucgucgagcugcuc

SEQ ID NO: 1521279 - RNA, 20 nt, Pseudomonas aeruginosa PA01
gcucguggcuggcgccgcgg

SEQ ID NO: 1521280 - RNA, 21 nt, Pseudomonas aeruginosa PA01
gcucuccgucaaugcggccug

SEQ ID NO: 1521281 - RNA, 15 nt, Pseudomonas aeruginosa PA01
gcucuccgucagggc

SEQ ID NO: 1521282 - RNA, 14 nt, Pseudomonas aeruginosa PA01
gcugccuuccagca

SEQ ID NO: 1521283 - RNA, 15 nt, Pseudomonas aeruginosa PA01
gcugccuuccuuuuc

SEQ ID NO: 1521284 - RNA, 20 nt, Pseudomonas aeruginosa PA01
gcugccuuccuuuucgaaca

SEQ ID NO: 1521285 - RNA, 22 nt, Pseudomonas aeruginosa PA01
gcugccuaccgucacgcggacc

SEQ ID NO: 1521286 - RNA, 22 nt, Pseudomonas aeruginosa PA01
gcugccucgguuuccggccagg

SEQ ID NO: 1521287 - RNA, 23 nt, Pseudomonas aeruginosa PA01
gcugccucgguuuccggccaggc

SEQ ID NO: 1521288 - RNA, 18 nt, Pseudomonas aeruginosa PA01
gcugccguucgcccgcgg

SEQ ID NO: 1521289 - RNA, 21 nt, Pseudomonas aeruginosa PA01
gcugccguucgcccgcggcgg

SEQ ID NO: 1521290 - RNA, 20 nt, Pseudomonas aeruginosa PA01
gcugccguugcaggcccagc

SEQ ID NO: 1521291 - RNA, 19 nt, Pseudomonas aeruginosa PA01
gcugccgggcgagcugcac

SEQ ID NO: 1521292 - RNA, 22 nt, Pseudomonas aeruginosa PA01
gcugccguacagcccccgccgg

SEQ ID NO: 1521293 - RNA, 19 nt, Pseudomonas aeruginosa PA01
gcugccguagaggucgccg

SEQ ID NO: 1521294 - RNA, 13 nt, Pseudomonas aeruginosa PA01
gcugcgccaggcc

SEQ ID NO: 1521295 - RNA, 13 nt, Pseudomonas aeruginosa PA01
gcugcgccaggcu

SEQ ID NO: 1521296 - RNA, 13 nt, Pseudomonas aeruginosa PA01
gcugcgcaggccg

SEQ ID NO: 1521297 - RNA, 16 nt, Pseudomonas aeruginosa PA01
gcugcgcagggcgccg

SEQ ID NO: 1521298 - RNA, 20 nt, Pseudomonas aeruginosa PA01
gcugcgcaggugcuugucac

SEQ ID NO: 1521299 - RNA, 19 nt, Pseudomonas aeruginosa PA01
gcugcgaaucgucgccgga

SEQ ID NO: 1521300 - RNA, 19 nt, Pseudomonas aeruginosa PA01
gcugcgcaacugccggucg

SEQ ID NO: 1521301 - RNA, 14 nt, Pseudomonas aeruginosa PA01
gcugccggccaggg

SEQ ID NO: 1521302 - RNA, 17 nt, Pseudomonas aeruginosa PA01
gcugccggccagggucg

SEQ ID NO: 1521303 - RNA, 17 nt, Pseudomonas aeruginosa PA01
gcugccgcuucggcugc

SEQ ID NO: 1521304 - RNA, 14 nt, Pseudomonas aeruginosa PA01
gcugccgccgccgu

SEQ ID NO: 1521305 - RNA, 13 nt, Pseudomonas aeruginosa PA01
gcugccgccgccg

SEQ ID NO: 1521306 - RNA, 17 nt, Pseudomonas aeruginosa PA01
gcugccgcguuccuugu

SEQ ID NO: 1521307 - RNA, 15 nt, Pseudomonas aeruginosa PA01
gcugccgcucuggcu

SEQ ID NO: 1521308 - RNA, 21 nt, Pseudomonas aeruginosa PA01
gcugccgcucuggcugcuggc

SEQ ID NO: 1521309 - RNA, 16 nt, Pseudomonas aeruginosa PA01
gcugccgcgcguggcu

SEQ ID NO: 1521310 - RNA, 23 nt, Pseudomonas aeruginosa PA01
gcugccgcgcguggcuucgucca

SEQ ID NO: 1521311 - RNA, 17 nt, Pseudomonas aeruginosa PA01
gcugccaccgagggcag

SEQ ID NO: 1521312 - RNA, 22 nt, Pseudomonas aeruginosa PA01
gcugccaccgagggcaggaacc

SEQ ID NO: 1521313 - RNA, 15 nt, Pseudomonas aeruginosa PA01
gcugccagcaggccg

SEQ ID NO: 1521314 - RNA, 18 nt, Pseudomonas aeruginosa PA01
gcugccagcaggccgagc

SEQ ID NO: 1521315 - RNA, 19 nt, Pseudomonas aeruginosa PA01
gcugccagcaggccgagcc

SEQ ID NO: 1521316 - RNA, 21 nt, Pseudomonas aeruginosa PA01
gcugccgagaaucugcccggc

SEQ ID NO: 1521317 - RNA, 23 nt, Pseudomonas aeruginosa PA01
gcugccgcagaucaucgcacggu

SEQ ID NO: 1521318 - RNA, 12 nt, Pseudomonas aeruginosa PA01
gcugcgccgccu

SEQ ID NO: 1521319 - RNA, 19 nt, Pseudomonas aeruginosa PA01
gcugcgccggcgcugcgag

SEQ ID NO: 1521320 - RNA, 16 nt, Pseudomonas aeruginosa PA01
gcugcgcgccgggucg

SEQ ID NO: 1521321 - RNA, 17 nt, Pseudomonas aeruginosa PA01
gcugcgcgcaccauagc

SEQ ID NO: 1521322 - RNA, 14 nt, Pseudomonas aeruginosa PA01
gcugcucagcgcgc

SEQ ID NO: 1521323 - RNA, 15 nt, Pseudomonas aeruginosa PA01
gcugcucagggccgc

SEQ ID NO: 1521324 - RNA, 14 nt, Pseudomonas aeruginosa PA01
gcugcucagggcuc

SEQ ID NO: 1521325 - RNA, 23 nt, Pseudomonas aeruginosa PA01
gcugcuagguucuaucgacagga

SEQ ID NO: 1521326 - RNA, 14 nt, Pseudomonas aeruginosa PA01
gcugcgcgccgcaa

SEQ ID NO: 1521327 - RNA, 16 nt, Pseudomonas aeruginosa PA01
gcugcgcucggcgcuc

SEQ ID NO: 1521328 - RNA, 14 nt, Pseudomonas aeruginosa PA01
gcugcgcugccagc

SEQ ID NO: 1521329 - RNA, 14 nt, Pseudomonas aeruginosa PA01
gcugcgcuugcugc

SEQ ID NO: 1521330 - RNA, 20 nt, Pseudomonas aeruginosa PA01
gcugcgcuugcugccauggc

SEQ ID NO: 1521331 - RNA, 15 nt, Pseudomonas aeruginosa PA01
gcugcgugccagggc

SEQ ID NO: 1521332 - RNA, 17 nt, Pseudomonas aeruginosa PA01
gcugcgugccagggcuu

SEQ ID NO: 1521333 - RNA, 22 nt, Pseudomonas aeruginosa PA01
gcugcgugccagggcuucccag

SEQ ID NO: 1521334 - RNA, 18 nt, Pseudomonas aeruginosa PA01
gcugcguucuuccccugc

SEQ ID NO: 1521335 - RNA, 21 nt, Pseudomonas aeruginosa PA01
gcuggaaguuguacagcgagg

SEQ ID NO: 1521336 - RNA, 22 nt, Pseudomonas aeruginosa PA01
gcuggaaguuguacagcgaggc

SEQ ID NO: 1521337 - RNA, 16 nt, Pseudomonas aeruginosa PA01
gcuggaacggccaggu

SEQ ID NO: 1521338 - RNA, 16 nt, Pseudomonas aeruginosa PA01
gcuggaaauggcgguc

SEQ ID NO: 1521339 - RNA, 15 nt, Pseudomonas aeruginosa PA01
gcuggauccuggaag

SEQ ID NO: 1521340 - RNA, 14 nt, Pseudomonas aeruginosa PA01
gcuggaucggcagg

SEQ ID NO: 1521341 - RNA, 19 nt, Pseudomonas aeruginosa PA01
gcuggaucggcaggcuggc

SEQ ID NO: 1521342 - RNA, 18 nt, Pseudomonas aeruginosa PA01
gcugcugcucagcgcgcu

SEQ ID NO: 1521343 - RNA, 19 nt, Pseudomonas aeruginosa PA01
gcugcugcucagcgcgcuc

SEQ ID NO: 1521344 - RNA, 17 nt, Pseudomonas aeruginosa PA01
gcugcucgaccgccugc

SEQ ID NO: 1521345 - RNA, 20 nt, Pseudomonas aeruginosa PA01
gcugcugccgcguuccuugu

SEQ ID NO: 1521346 - RNA, 17 nt, Pseudomonas aeruginosa PA01
gcugcugccggcuugcu

SEQ ID NO: 1521347 - RNA, 16 nt, Pseudomonas aeruginosa PA01
gcugcugcggggccug

SEQ ID NO: 1521348 - RNA, 15 nt, Pseudomonas aeruginosa PA01
gcugcuggcgccgcu

SEQ ID NO: 1521349 - RNA, 13 nt, Pseudomonas aeruginosa PA01
gcucucguugugg

SEQ ID NO: 1521350 - RNA, 15 nt, Pseudomonas aeruginosa PA01
gcugaaacgcgcguc

SEQ ID NO: 1521351 - RNA, 23 nt, Pseudomonas aeruginosa PA01
gcugaacagcgccaccagcaugc

SEQ ID NO: 1521352 - RNA, 18 nt, Pseudomonas aeruginosa PA01
gcugaaauccaccagcac

SEQ ID NO: 1521353 - RNA, 13 nt, Pseudomonas aeruginosa PA01
gcucucgccgccu

SEQ ID NO: 1521354 - RNA, 15 nt, Pseudomonas aeruginosa PA01
gcucucgagcaugcc

SEQ ID NO: 1521355 - RNA, 15 nt, Pseudomonas aeruginosa PA01
gcugaagcggccgcc

SEQ ID NO: 1521356 - RNA, 14 nt, Pseudomonas aeruginosa PA01
gcugaagcccaggc

SEQ ID NO: 1521357 - RNA, 15 nt, Pseudomonas aeruginosa PA01
gcugaagcgccgcgg

SEQ ID NO: 1521358 - RNA, 20 nt, Pseudomonas aeruginosa PA01
gcugaaguccuggccgagca

SEQ ID NO: 1521359 - RNA, 15 nt, Pseudomonas aeruginosa PA01
gcugaagaucgccac

SEQ ID NO: 1521360 - RNA, 14 nt, Pseudomonas aeruginosa PA01
gcugaagacccugc

SEQ ID NO: 1521361 - RNA, 23 nt, Pseudomonas aeruginosa PA01
gcugaagacccugcacaucaccu

SEQ ID NO: 1521362 - RNA, 20 nt, Pseudomonas aeruginosa PA01
gcugagaccgauccagcagu

SEQ ID NO: 1521363 - RNA, 16 nt, Pseudomonas aeruginosa PA01
gcugagaccuuccugc

SEQ ID NO: 1521364 - RNA, 20 nt, Pseudomonas aeruginosa PA01
gcugagaccuuccugccagc

SEQ ID NO: 1521365 - RNA, 14 nt, Pseudomonas aeruginosa PA01
gcugaccucgagcu

SEQ ID NO: 1521366 - RNA, 15 nt, Pseudomonas aeruginosa PA01
gcugaccucgagcug

SEQ ID NO: 1521367 - RNA, 16 nt, Pseudomonas aeruginosa PA01
gcugcaacgccggccc

SEQ ID NO: 1521368 - RNA, 22 nt, Pseudomonas aeruginosa PA01
gcugcaaucgcugccggucagg

SEQ ID NO: 1521369 - RNA, 14 nt, Pseudomonas aeruginosa PA01
gcugcagccacugu

SEQ ID NO: 1521370 - RNA, 20 nt, Pseudomonas aeruginosa PA01
gcugcacguuguugcccacc

SEQ ID NO: 1521371 - RNA, 23 nt, Pseudomonas aeruginosa PA01
gcugcacguuguugcccaccucc

SEQ ID NO: 1521372 - RNA, 15 nt, Pseudomonas aeruginosa PA01
gcugcagggccaggg

SEQ ID NO: 1521373 - RNA, 12 nt, Pseudomonas aeruginosa PA01
gcugcaggccac

SEQ ID NO: 1521374 - RNA, 12 nt, Pseudomonas aeruginosa PA01
gcugaucuucug

SEQ ID NO: 1521375 - RNA, 15 nt, Pseudomonas aeruginosa PA01
gcugaucuucugucc

SEQ ID NO: 1521376 - RNA, 18 nt, Pseudomonas aeruginosa PA01
gcugaucucggccauggu

SEQ ID NO: 1521377 - RNA, 21 nt, Pseudomonas aeruginosa PA01
gcugaucaggaggaucgccag

SEQ ID NO: 1521378 - RNA, 15 nt, Pseudomonas aeruginosa PA01
gcugagcgccaggcg

SEQ ID NO: 1521379 - RNA, 17 nt, Pseudomonas aeruginosa PA01
gcugaucaucagcaggg

SEQ ID NO: 1521380 - RNA, 21 nt, Pseudomonas aeruginosa PA01
gcugaucaucagcagggucag

SEQ ID NO: 1521381 - RNA, 16 nt, Pseudomonas aeruginosa PA01
gcugagcaggccgacg

SEQ ID NO: 1521382 - RNA, 22 nt, Pseudomonas aeruginosa PA01
gcugagcagucgccuggcccug

SEQ ID NO: 1521383 - RNA, 12 nt, Pseudomonas aeruginosa PA01
uaacggcagccg

SEQ ID NO: 1521384 - RNA, 17 nt, Pseudomonas aeruginosa PA01
uaacgccccucuuccac

SEQ ID NO: 1521385 - RNA, 20 nt, Pseudomonas aeruginosa PA01
uaacgccacaggcguuaucc

SEQ ID NO: 1521386 - RNA, 16 nt, Pseudomonas aeruginosa PA01
uaacgccaccggcguu

SEQ ID NO: 1521387 - RNA, 21 nt, Pseudomonas aeruginosa PA01
uaacaagucgaaucaagcaau

SEQ ID NO: 1521388 - RNA, 18 nt, Pseudomonas aeruginosa PA01
uaaaugcuugaaaaucaa

SEQ ID NO: 1521389 - RNA, 11 nt, Pseudomonas aeruginosa PA01
uaaggccaggc

SEQ ID NO: 1521390 - RNA, 22 nt, Pseudomonas aeruginosa PA01
uaagcggccuuuucucugcauc

SEQ ID NO: 1521391 - RNA, 12 nt, Pseudomonas aeruginosa PA01
uaagagaaugcg

SEQ ID NO: 1521392 - RNA, 13 nt, Pseudomonas aeruginosa PA01
uaacguuacgcag

SEQ ID NO: 1521393 - RNA, 21 nt, Pseudomonas aeruginosa PA01
uaaucaccuuccucgcgccuu

SEQ ID NO: 1521394 - RNA, 22 nt, Pseudomonas aeruginosa PA01
uaauccacgcugugcggcagca

SEQ ID NO: 1521395 - RNA, 19 nt, Pseudomonas aeruginosa PA01
uaauccagggagaacagca

SEQ ID NO: 1521396 - RNA, 22 nt, Pseudomonas aeruginosa PA01
uaaucgaaggucaggucgaggg

SEQ ID NO: 1521397 - RNA, 16 nt, Pseudomonas aeruginosa PA01
uacaaagcauuucuuc

SEQ ID NO: 1521398 - RNA, 22 nt, Pseudomonas aeruginosa PA01
uaauugcgagcgagcuugcaau

SEQ ID NO: 1521399 - RNA, 23 nt, Pseudomonas aeruginosa PA01
uaauugcgagcgagcuugcaauc

SEQ ID NO: 1521400 - RNA, 13 nt, Pseudomonas aeruginosa PA01
uaauuuugcuacc

SEQ ID NO: 1521401 - RNA, 18 nt, Pseudomonas aeruginosa PA01
uaccaacuuucccucucu

SEQ ID NO: 1521402 - RNA, 14 nt, Pseudomonas aeruginosa PA01
uaccagaagccggc

SEQ ID NO: 1521403 - RNA, 17 nt, Pseudomonas aeruginosa PA01
uaccacccgcagccccg

SEQ ID NO: 1521404 - RNA, 13 nt, Pseudomonas aeruginosa PA01
uaccagcgccgcu

SEQ ID NO: 1521405 - RNA, 22 nt, Pseudomonas aeruginosa PA01
uaccagcgccgcuccuccucgc

SEQ ID NO: 1521406 - RNA, 12 nt, Pseudomonas aeruginosa PA01
uaccagcuuguc

SEQ ID NO: 1521407 - RNA, 20 nt, Pseudomonas aeruginosa PA01
uaccaggaagcucggcagca

SEQ ID NO: 1521408 - RNA, 22 nt, Pseudomonas aeruginosa PA01
uaccaggaagcucggcagcacg

SEQ ID NO: 1521409 - RNA, 14 nt, Pseudomonas aeruginosa PA01
uaccagcggcuggc

SEQ ID NO: 1521410 - RNA, 15 nt, Pseudomonas aeruginosa PA01
uaccagcaauuccac

SEQ ID NO: 1521411 - RNA, 22 nt, Pseudomonas aeruginosa PA01
uacccacaggguggcgggcggc

SEQ ID NO: 1521412 - RNA, 18 nt, Pseudomonas aeruginosa PA01
uacccaggccgucgaggg

SEQ ID NO: 1521413 - RNA, 14 nt, Pseudomonas aeruginosa PA01
uacccagggugcgc

SEQ ID NO: 1521414 - RNA, 15 nt, Pseudomonas aeruginosa PA01
uaccauuagaggaac

SEQ ID NO: 1521415 - RNA, 20 nt, Pseudomonas aeruginosa PA01
uaccaggaugcccugcucuu

SEQ ID NO: 1521416 - RNA, 20 nt, Pseudomonas aeruginosa PA01
uaccagguucugccagagcg

SEQ ID NO: 1521417 - RNA, 20 nt, Pseudomonas aeruginosa PA01
uaccaguagcgacagcaucu

SEQ ID NO: 1521418 - RNA, 22 nt, Pseudomonas aeruginosa PA01
uaccagugccgcggugcgggcc

SEQ ID NO: 1521419 - RNA, 15 nt, Pseudomonas aeruginosa PA01
uacccguacgcugcc

SEQ ID NO: 1521420 - RNA, 21 nt, Pseudomonas aeruginosa PA01
uacccggcggacaaccaccau

SEQ ID NO: 1521421 - RNA, 19 nt, Pseudomonas aeruginosa PA01
uacccgcgccuucaguucg

SEQ ID NO: 1521422 - RNA, 20 nt, Pseudomonas aeruginosa PA01
uaccccguuguacccggcgg

SEQ ID NO: 1521423 - RNA, 13 nt, Pseudomonas aeruginosa PA01
uacccuggccggc

SEQ ID NO: 1521424 - RNA, 12 nt, Pseudomonas aeruginosa PA01
uacccugggagc

SEQ ID NO: 1521425 - RNA, 18 nt, Pseudomonas aeruginosa PA01
uacccucaggggugcagc

SEQ ID NO: 1521426 - RNA, 13 nt, Pseudomonas aeruginosa PA01
uacccucucccca

SEQ ID NO: 1521427 - RNA, 15 nt, Pseudomonas aeruginosa PA01
uaccgcuggccaggu

SEQ ID NO: 1521428 - RNA, 16 nt, Pseudomonas aeruginosa PA01
uaccgcuggccagguc

SEQ ID NO: 1521429 - RNA, 14 nt, Pseudomonas aeruginosa PA01
uaccgcugcggccg

SEQ ID NO: 1521430 - RNA, 18 nt, Pseudomonas aeruginosa PA01
uaccggcaaggcggccuc

SEQ ID NO: 1521431 - RNA, 21 nt, Pseudomonas aeruginosa PA01
uacuugaucagccgcaggcag

SEQ ID NO: 1521432 - RNA, 19 nt, Pseudomonas aeruginosa PA01
uacucguguuccggcagga

SEQ ID NO: 1521433 - RNA, 17 nt, Pseudomonas aeruginosa PA01
uacugcacgcccaggcg

SEQ ID NO: 1521434 - RNA, 22 nt, Pseudomonas aeruginosa PA01
uacgccuugcagggggcuuugc

SEQ ID NO: 1521435 - RNA, 19 nt, Pseudomonas aeruginosa PA01
uacgccuugcggcgccgag

SEQ ID NO: 1521436 - RNA, 21 nt, Pseudomonas aeruginosa PA01
uaccguggaaccgauggccag

SEQ ID NO: 1521437 - RNA, 14 nt, Pseudomonas aeruginosa PA01
uaccggcagcgccg

SEQ ID NO: 1521438 - RNA, 17 nt, Pseudomonas aeruginosa PA01
uaccggcagcgccgagg

SEQ ID NO: 1521439 - RNA, 22 nt, Pseudomonas aeruginosa PA01
uacgccagggugcugcccaggg

SEQ ID NO: 1521440 - RNA, 20 nt, Pseudomonas aeruginosa PA01
uacgcccuccagcacccagg

SEQ ID NO: 1521441 - RNA, 19 nt, Pseudomonas aeruginosa PA01
guccaucaccgcgguuggc

SEQ ID NO: 1521442 - RNA, 23 nt, Pseudomonas aeruginosa PA01
guccaucccugcuucgaccaggg

SEQ ID NO: 1521443 - RNA, 20 nt, Pseudomonas aeruginosa PA01
guccaucccuucgugcuggc

SEQ ID NO: 1521444 - RNA, 16 nt, Pseudomonas aeruginosa PA01
gucccagaaggccagg

SEQ ID NO: 1521445 - RNA, 16 nt, Pseudomonas aeruginosa PA01
gucccagaccacccgg

SEQ ID NO: 1521446 - RNA, 15 nt, Pseudomonas aeruginosa PA01
gucccagaccagcag

SEQ ID NO: 1521447 - RNA, 17 nt, Pseudomonas aeruginosa PA01
guccaggcgccagagcg

SEQ ID NO: 1521448 - RNA, 19 nt, Pseudomonas aeruginosa PA01
guccagcucggccaucagc

SEQ ID NO: 1521449 - RNA, 14 nt, Pseudomonas aeruginosa PA01
guccagcuccucga

SEQ ID NO: 1521450 - RNA, 22 nt, Pseudomonas aeruginosa PA01
guccaccaccgggggaagaacc

SEQ ID NO: 1521451 - RNA, 19 nt, Pseudomonas aeruginosa PA01
guccagcgcgcccggcgcc

SEQ ID NO: 1521452 - RNA, 19 nt, Pseudomonas aeruginosa PA01
guccagcggguagaugcca

SEQ ID NO: 1521453 - RNA, 19 nt, Pseudomonas aeruginosa PA01
guccagcgguaccagcagc

SEQ ID NO: 1521454 - RNA, 12 nt, Pseudomonas aeruginosa PA01
guccagcgccga

SEQ ID NO: 1521455 - RNA, 21 nt, Pseudomonas aeruginosa PA01
guccagccgguaggggccgac

SEQ ID NO: 1521456 - RNA, 18 nt, Pseudomonas aeruginosa PA01
guccagcgagcgggcgag

SEQ ID NO: 1521457 - RNA, 15 nt, Pseudomonas aeruginosa PA01
guccaccggcccgga

SEQ ID NO: 1521458 - RNA, 18 nt, Pseudomonas aeruginosa PA01
guccaccgccgccagcaa

SEQ ID NO: 1521459 - RNA, 19 nt, Pseudomonas aeruginosa PA01
gucauggccagucaucgcg

SEQ ID NO: 1521460 - RNA, 14 nt, Pseudomonas aeruginosa PA01
gucaucguccagcu

SEQ ID NO: 1521461 - RNA, 23 nt, Pseudomonas aeruginosa PA01
gucauggugcguuaccgaaagaa

SEQ ID NO: 1521462 - RNA, 22 nt, Pseudomonas aeruginosa PA01
gucauguuguucgcgcaccuug

SEQ ID NO: 1521463 - RNA, 19 nt, Pseudomonas aeruginosa PA01
gucaucgaggccauccccg

SEQ ID NO: 1521464 - RNA, 15 nt, Pseudomonas aeruginosa PA01
gucaucgagcaguuc

SEQ ID NO: 1521465 - RNA, 20 nt, Pseudomonas aeruginosa PA01
gucagcgagcuaucgccucc

SEQ ID NO: 1521466 - RNA, 18 nt, Pseudomonas aeruginosa PA01
gucagcgaguugaccuug

SEQ ID NO: 1521467 - RNA, 13 nt, Pseudomonas aeruginosa PA01
gucaggcccugcu

SEQ ID NO: 1521468 - RNA, 16 nt, Pseudomonas aeruginosa PA01
gucaggccgaccagcg

SEQ ID NO: 1521469 - RNA, 16 nt, Pseudomonas aeruginosa PA01
gucaggccgaggcgcu

SEQ ID NO: 1521470 - RNA, 21 nt, Pseudomonas aeruginosa PA01
gucaggccgaucaccaccagc

SEQ ID NO: 1521471 - RNA, 22 nt, Pseudomonas aeruginosa PA01
gucaggccgaucaccaccagcg

SEQ ID NO: 1521472 - RNA, 19 nt, Pseudomonas aeruginosa PA01
gucagcgccuugaccucga

SEQ ID NO: 1521473 - RNA, 19 nt, Pseudomonas aeruginosa PA01
gucagcgcgccagcacggc

SEQ ID NO: 1521474 - RNA, 15 nt, Pseudomonas aeruginosa PA01
gucagguacaggcgg

SEQ ID NO: 1521475 - RNA, 13 nt, Pseudomonas aeruginosa PA01
gucaggcgccggc

SEQ ID NO: 1521476 - RNA, 12 nt, Pseudomonas aeruginosa PA01
gucaggccuuga

SEQ ID NO: 1521477 - RNA, 19 nt, Pseudomonas aeruginosa PA01
gucaggccuugcgcggcgc

SEQ ID NO: 1521478 - RNA, 14 nt, Pseudomonas aeruginosa PA01
gucaggcuguagcc

SEQ ID NO: 1521479 - RNA, 23 nt, Pseudomonas aeruginosa PA01
gucaggcuguagccucccgccgc

SEQ ID NO: 1521480 - RNA, 21 nt, Pseudomonas aeruginosa PA01
gucaggcugcgcaccucggcc

SEQ ID NO: 1521481 - RNA, 16 nt, Pseudomonas aeruginosa PA01
gucaggcugcggcgga

SEQ ID NO: 1521482 - RNA, 13 nt, Pseudomonas aeruginosa PA01
gucacggucagcu

SEQ ID NO: 1521483 - RNA, 16 nt, Pseudomonas aeruginosa PA01
gucacucgacaggcca

SEQ ID NO: 1521484 - RNA, 14 nt, Pseudomonas aeruginosa PA01
gucacucggccucg

SEQ ID NO: 1521485 - RNA, 12 nt, Pseudomonas aeruginosa PA01
gucagccaggcu

SEQ ID NO: 1521486 - RNA, 17 nt, Pseudomonas aeruginosa PA01
gucagccaggcuggcug

SEQ ID NO: 1521487 - RNA, 14 nt, Pseudomonas aeruginosa PA01
gucagcaggcugcc

SEQ ID NO: 1521488 - RNA, 13 nt, Pseudomonas aeruginosa PA01
gucagccaccugc

SEQ ID NO: 1521489 - RNA, 13 nt, Pseudomonas aeruginosa PA01
ggugaagcgcagg

SEQ ID NO: 1521490 - RNA, 17 nt, Pseudomonas aeruginosa PA01
ggugaagcgcggcggcg

SEQ ID NO: 1521491 - RNA, 14 nt, Pseudomonas aeruginosa PA01
ggugaagcccaggc

SEQ ID NO: 1521492 - RNA, 16 nt, Pseudomonas aeruginosa PA01
ggugaagcccaggcgc

SEQ ID NO: 1521493 - RNA, 14 nt, Pseudomonas aeruginosa PA01
ggugaaccugacca

SEQ ID NO: 1521494 - RNA, 19 nt, Pseudomonas aeruginosa PA01
ggugaacgagcccaggcag

SEQ ID NO: 1521495 - RNA, 13 nt, Pseudomonas aeruginosa PA01
ggugaacgccagg

SEQ ID NO: 1521496 - RNA, 15 nt, Pseudomonas aeruginosa PA01
ggugaacgccaggca

SEQ ID NO: 1521497 - RNA, 20 nt, Pseudomonas aeruginosa PA01
gucaccgauugcgcccuccc

SEQ ID NO: 1521498 - RNA, 16 nt, Pseudomonas aeruginosa PA01
gucacccgcgccugca

SEQ ID NO: 1521499 - RNA, 18 nt, Pseudomonas aeruginosa PA01
gucacccgcgccugcagg

SEQ ID NO: 1521500 - RNA, 19 nt, Pseudomonas aeruginosa PA01
gucacccgcgccugcaggu

SEQ ID NO: 1521501 - RNA, 22 nt, Pseudomonas aeruginosa PA01
gucacccgcgccugcaggucga

SEQ ID NO: 1521502 - RNA, 19 nt, Pseudomonas aeruginosa PA01
gucacggccuccgguggcg

SEQ ID NO: 1521503 - RNA, 22 nt, Pseudomonas aeruginosa PA01
gucacggcgaagcggcccuugu

SEQ ID NO: 1521504 - RNA, 20 nt, Pseudomonas aeruginosa PA01
gucacggcgugccgcaggcc

SEQ ID NO: 1521505 - RNA, 17 nt, Pseudomonas aeruginosa PA01
gucacggauaggcggcg

SEQ ID NO: 1521506 - RNA, 16 nt, Pseudomonas aeruginosa PA01
gucacgccgaaguucu

SEQ ID NO: 1521507 - RNA, 14 nt, Pseudomonas aeruginosa PA01
gucacgccgagggc

SEQ ID NO: 1521508 - RNA, 18 nt, Pseudomonas aeruginosa PA01
gucacgccgcggcugaug

SEQ ID NO: 1521509 - RNA, 22 nt, Pseudomonas aeruginosa PA01
gucacgccguucagggucaggu

SEQ ID NO: 1521510 - RNA, 17 nt, Pseudomonas aeruginosa PA01
gucacgcaggcgcuggc

SEQ ID NO: 1521511 - RNA, 15 nt, Pseudomonas aeruginosa PA01
gucaccgccagcggg

SEQ ID NO: 1521512 - RNA, 17 nt, Pseudomonas aeruginosa PA01
gucccgaguaggcgcug

SEQ ID NO: 1521513 - RNA, 15 nt, Pseudomonas aeruginosa PA01
gucccgcgcggcccu

SEQ ID NO: 1521514 - RNA, 13 nt, Pseudomonas aeruginosa PA01
gucccgccgcgcc

SEQ ID NO: 1521515 - RNA, 15 nt, Pseudomonas aeruginosa PA01
gucccgccaggcgcc

SEQ ID NO: 1521516 - RNA, 22 nt, Pseudomonas aeruginosa PA01
gucccaugaccgucagccaggc

SEQ ID NO: 1521517 - RNA, 16 nt, Pseudomonas aeruginosa PA01
gucccaucacggcccc

SEQ ID NO: 1521518 - RNA, 16 nt, Pseudomonas aeruginosa PA01
gucccaucagcagucc

SEQ ID NO: 1521519 - RNA, 18 nt, Pseudomonas aeruginosa PA01
gucccggacgacgaaaga

SEQ ID NO: 1521520 - RNA, 14 nt, Pseudomonas aeruginosa PA01
guccggccagccug

SEQ ID NO: 1521521 - RNA, 13 nt, Pseudomonas aeruginosa PA01
guccggcaggucu

SEQ ID NO: 1521522 - RNA, 13 nt, Pseudomonas aeruginosa PA01
guccggcagcacg

SEQ ID NO: 1521523 - RNA, 17 nt, Pseudomonas aeruginosa PA01
guccggauugccgcggg

SEQ ID NO: 1521524 - RNA, 20 nt, Pseudomonas aeruginosa PA01
guccggcaccgcucugcagu

SEQ ID NO: 1521525 - RNA, 15 nt, Pseudomonas aeruginosa PA01
guccugcaacugcuc

SEQ ID NO: 1521526 - RNA, 14 nt, Pseudomonas aeruginosa PA01
guccugcaacugga

SEQ ID NO: 1521527 - RNA, 22 nt, Pseudomonas aeruginosa PA01
guccugcaggcucagcaccuug

SEQ ID NO: 1521528 - RNA, 15 nt, Pseudomonas aeruginosa PA01
guccuccuccaguuc

SEQ ID NO: 1521529 - RNA, 22 nt, Pseudomonas aeruginosa PA01
guccuccuggauacgcucggcc

SEQ ID NO: 1521530 - RNA, 13 nt, Pseudomonas aeruginosa PA01
guccuccagcggc

SEQ ID NO: 1521531 - RNA, 20 nt, Pseudomonas aeruginosa PA01
guccuccagcugcgccugca

SEQ ID NO: 1521532 - RNA, 13 nt, Pseudomonas aeruginosa PA01
guccuccaggcuc

SEQ ID NO: 1521533 - RNA, 19 nt, Pseudomonas aeruginosa PA01
guccggcugucgacgcagc

SEQ ID NO: 1521534 - RNA, 18 nt, Pseudomonas aeruginosa PA01
guccggcgugguggcggg

SEQ ID NO: 1521535 - RNA, 20 nt, Pseudomonas aeruginosa PA01
guccggguugacccagagcc

SEQ ID NO: 1521536 - RNA, 15 nt, Pseudomonas aeruginosa PA01
guccggguuggcgca

SEQ ID NO: 1521537 - RNA, 18 nt, Pseudomonas aeruginosa PA01
guccggguuggcgcaggc

SEQ ID NO: 1521538 - RNA, 19 nt, Pseudomonas aeruginosa PA01
guccggguuggcgcaggcc

SEQ ID NO: 1521539 - RNA, 20 nt, Pseudomonas aeruginosa PA01
guccgggcgguacaggcgca

SEQ ID NO: 1521540 - RNA, 18 nt, Pseudomonas aeruginosa PA01
guccucagccucacccug

SEQ ID NO: 1521541 - RNA, 15 nt, Pseudomonas aeruginosa PA01
gucgagcagcgccgc

SEQ ID NO: 1521542 - RNA, 17 nt, Pseudomonas aeruginosa PA01
gucgagcagcgccgcgg

SEQ ID NO: 1521543 - RNA, 19 nt, Pseudomonas aeruginosa PA01
gucgagcagcgcgcggcuc

SEQ ID NO: 1521544 - RNA, 11 nt, Pseudomonas aeruginosa PA01
gucgagcagcg

SEQ ID NO: 1521545 - RNA, 22 nt, Pseudomonas aeruginosa PA01
gucgagcagaguuuagccgcca

SEQ ID NO: 1521546 - RNA, 13 nt, Pseudomonas aeruginosa PA01
gucgagccaggcg

SEQ ID NO: 1521547 - RNA, 17 nt, Pseudomonas aeruginosa PA01
gucgacgccgccgagca

SEQ ID NO: 1521548 - RNA, 16 nt, Pseudomonas aeruginosa PA01
gucgagcugcucggcg

SEQ ID NO: 1521549 - RNA, 17 nt, Pseudomonas aeruginosa PA01
gucgaucaggaacgcgc

SEQ ID NO: 1521550 - RNA, 14 nt, Pseudomonas aeruginosa PA01
gucgaucagcagca

SEQ ID NO: 1521551 - RNA, 15 nt, Pseudomonas aeruginosa PA01
gucgaucagcgcgcg

SEQ ID NO: 1521552 - RNA, 22 nt, Pseudomonas aeruginosa PA01
gucgaucuccuccucggcggcu

SEQ ID NO: 1521553 - RNA, 17 nt, Pseudomonas aeruginosa PA01
gucgaucaggucgccgc

SEQ ID NO: 1521554 - RNA, 15 nt, Pseudomonas aeruginosa PA01
guccugcccuccugc

SEQ ID NO: 1521555 - RNA, 10 nt, Pseudomonas aeruginosa PA01
guccugcugc

SEQ ID NO: 1521556 - RNA, 21 nt, Pseudomonas aeruginosa PA01
guccuugaguagcuggcgcag

SEQ ID NO: 1521557 - RNA, 13 nt, Pseudomonas aeruginosa PA01
guccuugaucuug

SEQ ID NO: 1521558 - RNA, 22 nt, Pseudomonas aeruginosa PA01
guccuucuuguauaccagcggc

SEQ ID NO: 1521559 - RNA, 13 nt, Pseudomonas aeruginosa PA01
guccuucggccag

SEQ ID NO: 1521560 - RNA, 13 nt, Pseudomonas aeruginosa PA01
guccuuugccuga

SEQ ID NO: 1521561 - RNA, 14 nt, Pseudomonas aeruginosa PA01
gucgaccagcggcg

SEQ ID NO: 1521562 - RNA, 16 nt, Pseudomonas aeruginosa PA01
gucgaccagcggcggu

SEQ ID NO: 1521563 - RNA, 22 nt, Pseudomonas aeruginosa PA01
gucgaccauucccacgacccgc

SEQ ID NO: 1521564 - RNA, 14 nt, Pseudomonas aeruginosa PA01
gucgaccggaauca

SEQ ID NO: 1521565 - RNA, 17 nt, Pseudomonas aeruginosa PA01
gucgacgaccggaaggu

SEQ ID NO: 1521566 - RNA, 17 nt, Pseudomonas aeruginosa PA01
gucgcaccgccagcagu

SEQ ID NO: 1521567 - RNA, 18 nt, Pseudomonas aeruginosa PA01
gucgcaccgggaggcgcc

SEQ ID NO: 1521568 - RNA, 11 nt, Pseudomonas aeruginosa PA01
gucgcacugcu

SEQ ID NO: 1521569 - RNA, 14 nt, Pseudomonas aeruginosa PA01
gucgcacucuuccu

SEQ ID NO: 1521570 - RNA, 14 nt, Pseudomonas aeruginosa PA01
gucgcagcaggccg

SEQ ID NO: 1521571 - RNA, 17 nt, Pseudomonas aeruginosa PA01
gucgcagcaggccgcug

SEQ ID NO: 1521572 - RNA, 13 nt, Pseudomonas aeruginosa PA01
gucgcacuggucg

SEQ ID NO: 1521573 - RNA, 18 nt, Pseudomonas aeruginosa PA01
gucgcccucggccaggca

SEQ ID NO: 1521574 - RNA, 16 nt, Pseudomonas aeruginosa PA01
gucgcccucggcgcug

SEQ ID NO: 1521575 - RNA, 12 nt, Pseudomonas aeruginosa PA01
gucgcccgccgg

SEQ ID NO: 1521576 - RNA, 23 nt, Pseudomonas aeruginosa PA01
gucgcccgcuucgccaucgaugg

SEQ ID NO: 1521577 - RNA, 18 nt, Pseudomonas aeruginosa PA01
gucgcccugcagcgcgcg

SEQ ID NO: 1521578 - RNA, 14 nt, Pseudomonas aeruginosa PA01
gucgcagccgagcc

SEQ ID NO: 1521579 - RNA, 22 nt, Pseudomonas aeruginosa PA01
gucgccgcccggcagcggcugg

SEQ ID NO: 1521580 - RNA, 14 nt, Pseudomonas aeruginosa PA01
gucgccgcaggucc

SEQ ID NO: 1521581 - RNA, 15 nt, Pseudomonas aeruginosa PA01
gucgccgcagguccg

SEQ ID NO: 1521582 - RNA, 15 nt, Pseudomonas aeruginosa PA01
gucgccgaucugcag

SEQ ID NO: 1521583 - RNA, 16 nt, Pseudomonas aeruginosa PA01
gucgccgccgcgggcg

SEQ ID NO: 1521584 - RNA, 22 nt, Pseudomonas aeruginosa PA01
gucgccggagucguagcgcgcg

SEQ ID NO: 1521585 - RNA, 14 nt, Pseudomonas aeruginosa PA01
gucgccgcugggca

SEQ ID NO: 1521586 - RNA, 16 nt, Pseudomonas aeruginosa PA01
gucgccgcugggcagc

SEQ ID NO: 1521587 - RNA, 17 nt, Pseudomonas aeruginosa PA01
gucgccgcugggcagca

SEQ ID NO: 1521588 - RNA, 18 nt, Pseudomonas aeruginosa PA01
gucgcugaccacccggug

SEQ ID NO: 1521589 - RNA, 20 nt, Pseudomonas aeruginosa PA01
gucgcugaccggccgcagca

SEQ ID NO: 1521590 - RNA, 17 nt, Pseudomonas aeruginosa PA01
gucgcugagcggcuggu

SEQ ID NO: 1521591 - RNA, 22 nt, Pseudomonas aeruginosa PA01
gucgcugaggccgcccuggccg

SEQ ID NO: 1521592 - RNA, 21 nt, Pseudomonas aeruginosa PA01
gucgcugcccaucgccuccac

SEQ ID NO: 1521593 - RNA, 13 nt, Pseudomonas aeruginosa PA01
gucgcgggccugg

SEQ ID NO: 1521594 - RNA, 16 nt, Pseudomonas aeruginosa PA01
gucgcgggccugggca

SEQ ID NO: 1521595 - RNA, 17 nt, Pseudomonas aeruginosa PA01
gucgcggcugcgcgccg

SEQ ID NO: 1521596 - RNA, 16 nt, Pseudomonas aeruginosa PA01
gucgcggcaggcggcg

SEQ ID NO: 1521597 - RNA, 19 nt, Pseudomonas aeruginosa PA01
gucgcggacuccggaggcg

SEQ ID NO: 1521598 - RNA, 19 nt, Pseudomonas aeruginosa PA01
gucgcggacccgcgccggc

SEQ ID NO: 1521599 - RNA, 15 nt, Pseudomonas aeruginosa PA01
gucgcgauccaccgc

SEQ ID NO: 1521600 - RNA, 21 nt, Pseudomonas aeruginosa PA01
gucgcgauccaccgccagggc

SEQ ID NO: 1521601 - RNA, 16 nt, Pseudomonas aeruginosa PA01
gucgcgaucugcuggu

SEQ ID NO: 1521602 - RNA, 14 nt, Pseudomonas aeruginosa PA01
gucgcgacugacca

SEQ ID NO: 1521603 - RNA, 15 nt, Pseudomonas aeruginosa PA01
gucgcgagcagggcg

SEQ ID NO: 1521604 - RNA, 17 nt, Pseudomonas aeruginosa PA01
gucgcgagcagggcgau

SEQ ID NO: 1521605 - RNA, 12 nt, Pseudomonas aeruginosa PA01
gucgccuuccac

SEQ ID NO: 1521606 - RNA, 18 nt, Pseudomonas aeruginosa PA01
gucgccucgaacauggcc

SEQ ID NO: 1521607 - RNA, 16 nt, Pseudomonas aeruginosa PA01
gucgccguccugugga

SEQ ID NO: 1521608 - RNA, 22 nt, Pseudomonas aeruginosa PA01
gucgccguccuugucgcagcgg

SEQ ID NO: 1521609 - RNA, 22 nt, Pseudomonas aeruginosa PA01
gucgccgguucaguucagccgg

SEQ ID NO: 1521610 - RNA, 23 nt, Pseudomonas aeruginosa PA01
gucgccggucaggcugcggcgga

SEQ ID NO: 1521611 - RNA, 16 nt, Pseudomonas aeruginosa PA01
gucgguucgcggcgca

SEQ ID NO: 1521612 - RNA, 18 nt, Pseudomonas aeruginosa PA01
gucgucgggcagaguggc

SEQ ID NO: 1521613 - RNA, 20 nt, Pseudomonas aeruginosa PA01
gucgucguccaucgccgcgg

SEQ ID NO: 1521614 - RNA, 20 nt, Pseudomonas aeruginosa PA01
gucggugaugaagaagccau

SEQ ID NO: 1521615 - RNA, 13 nt, Pseudomonas aeruginosa PA01
gucggugacccgc

SEQ ID NO: 1521616 - RNA, 14 nt, Pseudomonas aeruginosa PA01
gucggugacccgca

SEQ ID NO: 1521617 - RNA, 17 nt, Pseudomonas aeruginosa PA01
gucgggcucgacgagga

SEQ ID NO: 1521618 - RNA, 17 nt, Pseudomonas aeruginosa PA01
gucgggcguagaccuug

SEQ ID NO: 1521619 - RNA, 18 nt, Pseudomonas aeruginosa PA01
gucgggcguagaccuugc

SEQ ID NO: 1521620 - RNA, 23 nt, Pseudomonas aeruginosa PA01
gucgggaucgagcaacagcagga

SEQ ID NO: 1521621 - RNA, 17 nt, Pseudomonas aeruginosa PA01
gucgggcaacggcuggg

SEQ ID NO: 1521622 - RNA, 18 nt, Pseudomonas aeruginosa PA01
gucgcuggcaccggccag

SEQ ID NO: 1521623 - RNA, 21 nt, Pseudomonas aeruginosa PA01
gucgcuggcaccggccaggcg

SEQ ID NO: 1521624 - RNA, 16 nt, Pseudomonas aeruginosa PA01
gucgcuuccgcgcggc

SEQ ID NO: 1521625 - RNA, 20 nt, Pseudomonas aeruginosa PA01
gucgcuguccuccagcggcg

SEQ ID NO: 1521626 - RNA, 20 nt, Pseudomonas aeruginosa PA01
gucggcaauucuucaagguc

SEQ ID NO: 1521627 - RNA, 15 nt, Pseudomonas aeruginosa PA01
gucggcaccagggcu

SEQ ID NO: 1521628 - RNA, 23 nt, Pseudomonas aeruginosa PA01
gucggcaccagggcuucgcgcag

SEQ ID NO: 1521629 - RNA, 15 nt, Pseudomonas aeruginosa PA01
gucggcaagcaggcc

SEQ ID NO: 1521630 - RNA, 18 nt, Pseudomonas aeruginosa PA01
gucggcagcgucgagcug

SEQ ID NO: 1521631 - RNA, 22 nt, Pseudomonas aeruginosa PA01
gucggcacgaugucgaccuggg

SEQ ID NO: 1521632 - RNA, 15 nt, Pseudomonas aeruginosa PA01
gucggcagucgccgc

SEQ ID NO: 1521633 - RNA, 17 nt, Pseudomonas aeruginosa PA01
gucggcaucgaacucac

SEQ ID NO: 1521634 - RNA, 12 nt, Pseudomonas aeruginosa PA01
gucggcuggucg

SEQ ID NO: 1521635 - RNA, 14 nt, Pseudomonas aeruginosa PA01
gucggcgugcuggg

SEQ ID NO: 1521636 - RNA, 17 nt, Pseudomonas aeruginosa PA01
gucggcucagccgacca

SEQ ID NO: 1521637 - RNA, 22 nt, Pseudomonas aeruginosa PA01
gucggcucagccgaccaccuuc

SEQ ID NO: 1521638 - RNA, 16 nt, Pseudomonas aeruginosa PA01
gucggcgucggcugcg

SEQ ID NO: 1521639 - RNA, 12 nt, Pseudomonas aeruginosa PA01
gucggccaggcg

SEQ ID NO: 1521640 - RNA, 15 nt, Pseudomonas aeruginosa PA01
gucggcguagcgcag

SEQ ID NO: 1521641 - RNA, 15 nt, Pseudomonas aeruginosa PA01
gucggccaacugggc

SEQ ID NO: 1521642 - RNA, 18 nt, Pseudomonas aeruginosa PA01
gucugcuuguccuuccag

SEQ ID NO: 1521643 - RNA, 21 nt, Pseudomonas aeruginosa PA01
gucuggaugaacgacuccagc

SEQ ID NO: 1521644 - RNA, 18 nt, Pseudomonas aeruginosa PA01
gucugccgcuggcggccu

SEQ ID NO: 1521645 - RNA, 19 nt, Pseudomonas aeruginosa PA01
gucugggugaccagcaggu

SEQ ID NO: 1521646 - RNA, 17 nt, Pseudomonas aeruginosa PA01
gucuggcgccuggccug

SEQ ID NO: 1521647 - RNA, 23 nt, Pseudomonas aeruginosa PA01
gucugcaccgcccuuucgaacug

SEQ ID NO: 1521648 - RNA, 18 nt, Pseudomonas aeruginosa PA01
gucucggugcucaggcgg

SEQ ID NO: 1521649 - RNA, 15 nt, Pseudomonas aeruginosa PA01
gucucguagcagcca

SEQ ID NO: 1521650 - RNA, 19 nt, Pseudomonas aeruginosa PA01
gucucuacgccauacuggg

SEQ ID NO: 1521651 - RNA, 22 nt, Pseudomonas aeruginosa PA01
gucucgcgggcgacgaagcccu

SEQ ID NO: 1521652 - RNA, 18 nt, Pseudomonas aeruginosa PA01
gucucgcgggcguuggcc

SEQ ID NO: 1521653 - RNA, 19 nt, Pseudomonas aeruginosa PA01
gucucgaucggcccgggcg

SEQ ID NO: 1521654 - RNA, 20 nt, Pseudomonas aeruginosa PA01
gucucgccgaugcccgggcg

SEQ ID NO: 1521655 - RNA, 13 nt, Pseudomonas aeruginosa PA01
gucucgccgccga

SEQ ID NO: 1521656 - RNA, 15 nt, Pseudomonas aeruginosa PA01
gucucgccgccgagc

SEQ ID NO: 1521657 - RNA, 13 nt, Pseudomonas aeruginosa PA01
gucucgccgccgg

SEQ ID NO: 1521658 - RNA, 20 nt, Pseudomonas aeruginosa PA01
gucucgaacgccaggcaggc

SEQ ID NO: 1521659 - RNA, 17 nt, Pseudomonas aeruginosa PA01
gucuccagcaacccaug

SEQ ID NO: 1521660 - RNA, 19 nt, Pseudomonas aeruginosa PA01
gucucauggaacagcagcc

SEQ ID NO: 1521661 - RNA, 17 nt, Pseudomonas aeruginosa PA01
gucucaggcgccaggcc

SEQ ID NO: 1521662 - RNA, 18 nt, Pseudomonas aeruginosa PA01
gucguucagugccagcag

SEQ ID NO: 1521663 - RNA, 13 nt, Pseudomonas aeruginosa PA01
gucguuagcucag

SEQ ID NO: 1521664 - RNA, 14 nt, Pseudomonas aeruginosa PA01
gucgugguccagcu

SEQ ID NO: 1521665 - RNA, 14 nt, Pseudomonas aeruginosa PA01
gucgugcagcagcg

SEQ ID NO: 1521666 - RNA, 19 nt, Pseudomonas aeruginosa PA01
gucgugcagcagcgccuuc

SEQ ID NO: 1521667 - RNA, 15 nt, Pseudomonas aeruginosa PA01
gucuugccggcugcg

SEQ ID NO: 1521668 - RNA, 16 nt, Pseudomonas aeruginosa PA01
gucuuccggcucgccg

SEQ ID NO: 1521669 - RNA, 19 nt, Pseudomonas aeruginosa PA01
gucuucccguaaggccagg

SEQ ID NO: 1521670 - RNA, 20 nt, Pseudomonas aeruginosa PA01
gucuucccguaaggccaggc

SEQ ID NO: 1521671 - RNA, 21 nt, Pseudomonas aeruginosa PA01
gucuucccguaaggccaggcu

SEQ ID NO: 1521672 - RNA, 19 nt, Pseudomonas aeruginosa PA01
gucuucgaugcgccgcagg

SEQ ID NO: 1521673 - RNA, 22 nt, Pseudomonas aeruginosa PA01
gucuucgauggcggccgccauu

SEQ ID NO: 1521674 - RNA, 18 nt, Pseudomonas aeruginosa PA01
gucuucagcacauagcug

SEQ ID NO: 1521675 - RNA, 20 nt, Pseudomonas aeruginosa PA01
gucuucaguaggccagcggc

SEQ ID NO: 1521676 - RNA, 22 nt, Pseudomonas aeruginosa PA01
gucugugaucaggcuguccacg

SEQ ID NO: 1521677 - RNA, 14 nt, Pseudomonas aeruginosa PA01
gucuguucggccag

SEQ ID NO: 1521678 - RNA, 23 nt, Pseudomonas aeruginosa PA01
gucuguucggccagggagucgcu

SEQ ID NO: 1521679 - RNA, 12 nt, Pseudomonas aeruginosa PA01
gucuuuccuuuc

SEQ ID NO: 1521680 - RNA, 21 nt, Pseudomonas aeruginosa PA01
gucuuguccucaucggggcug

SEQ ID NO: 1521681 - RNA, 16 nt, Pseudomonas aeruginosa PA01
gucuugucgaagcccg

SEQ ID NO: 1521682 - RNA, 15 nt, Pseudomonas aeruginosa PA01
gucuuuuugcaggga

SEQ ID NO: 1521683 - RNA, 14 nt, Pseudomonas aeruginosa PA01
gugaaagggcggca

SEQ ID NO: 1521684 - RNA, 19 nt, Pseudomonas aeruginosa PA01
gugcagggcguccaguagc

SEQ ID NO: 1521685 - RNA, 13 nt, Pseudomonas aeruginosa PA01
gugcagggcagcg

SEQ ID NO: 1521686 - RNA, 16 nt, Pseudomonas aeruginosa PA01
gugcagggcagcggcc

SEQ ID NO: 1521687 - RNA, 17 nt, Pseudomonas aeruginosa PA01
gugcagggcagcggccc

SEQ ID NO: 1521688 - RNA, 14 nt, Pseudomonas aeruginosa PA01
gugcaggcgcccug

SEQ ID NO: 1521689 - RNA, 14 nt, Pseudomonas aeruginosa PA01
gugcaggccgauca

SEQ ID NO: 1521690 - RNA, 16 nt, Pseudomonas aeruginosa PA01
gugcaggaucaccugc

SEQ ID NO: 1521691 - RNA, 18 nt, Pseudomonas aeruginosa PA01
gugcagcaagccgcagcg

SEQ ID NO: 1521692 - RNA, 21 nt, Pseudomonas aeruginosa PA01
gugcagcaagccgcagcgccc

SEQ ID NO: 1521693 - RNA, 22 nt, Pseudomonas aeruginosa PA01
gugcagcucggcacgcagcagc

SEQ ID NO: 1521694 - RNA, 14 nt, Pseudomonas aeruginosa PA01
gugcagcuccaccg

SEQ ID NO: 1521695 - RNA, 14 nt, Pseudomonas aeruginosa PA01
gugcacggccaggc

SEQ ID NO: 1521696 - RNA, 15 nt, Pseudomonas aeruginosa PA01
gugcacggccaggcc

SEQ ID NO: 1521697 - RNA, 18 nt, Pseudomonas aeruginosa PA01
gugcacggcgacccgccg

SEQ ID NO: 1521698 - RNA, 20 nt, Pseudomonas aeruginosa PA01
gugcacgcugaagaucgcca

SEQ ID NO: 1521699 - RNA, 14 nt, Pseudomonas aeruginosa PA01
gugauccgcaggua

SEQ ID NO: 1521700 - RNA, 20 nt, Pseudomonas aeruginosa PA01
gugaucgaccacacaugcag

SEQ ID NO: 1521701 - RNA, 19 nt, Pseudomonas aeruginosa PA01
gugaucgaccucgcgggcg

SEQ ID NO: 1521702 - RNA, 20 nt, Pseudomonas aeruginosa PA01
gugaucagucgucguccagc

SEQ ID NO: 1521703 - RNA, 24 nt, Pseudomonas aeruginosa PA01
gugaucgagggaggucgcacgcag

SEQ ID NO: 1521704 - RNA, 22 nt, Pseudomonas aeruginosa PA01
gugauucguccggagccgggca

SEQ ID NO: 1521705 - RNA, 17 nt, Pseudomonas aeruginosa PA01
gugauuucuucagccug

SEQ ID NO: 1521706 - RNA, 15 nt, Pseudomonas aeruginosa PA01
gugaggugggcgcgc

SEQ ID NO: 1521707 - RNA, 20 nt, Pseudomonas aeruginosa PA01
gugaggugggcgcgccgcag

SEQ ID NO: 1521708 - RNA, 13 nt, Pseudomonas aeruginosa PA01
gugaggaccuggc

SEQ ID NO: 1521709 - RNA, 14 nt, Pseudomonas aeruginosa PA01
gugagcugggcagg

SEQ ID NO: 1521710 - RNA, 19 nt, Pseudomonas aeruginosa PA01
gugagcugggcaggcugaa

SEQ ID NO: 1521711 - RNA, 21 nt, Pseudomonas aeruginosa PA01
gugagggcgacguugcgcagg

SEQ ID NO: 1521712 - RNA, 23 nt, Pseudomonas aeruginosa PA01
gugaggccgagccgacauccugu

SEQ ID NO: 1521713 - RNA, 14 nt, Pseudomonas aeruginosa PA01
gugaggaucacgca

SEQ ID NO: 1521714 - RNA, 22 nt, Pseudomonas aeruginosa PA01
gugagauggucgaaccagcuca

SEQ ID NO: 1521715 - RNA, 15 nt, Pseudomonas aeruginosa PA01
gugagcacgccgcga

SEQ ID NO: 1521716 - RNA, 13 nt, Pseudomonas aeruginosa PA01
gugagcaggcgcc

SEQ ID NO: 1521717 - RNA, 19 nt, Pseudomonas aeruginosa PA01
gugagcauggcguugaggu

SEQ ID NO: 1521718 - RNA, 13 nt, Pseudomonas aeruginosa PA01
gugagcaggguga

SEQ ID NO: 1521719 - RNA, 21 nt, Pseudomonas aeruginosa PA01
gugacaggcugaaaaaagggg

SEQ ID NO: 1521720 - RNA, 18 nt, Pseudomonas aeruginosa PA01
gugacauucgacagcagg

SEQ ID NO: 1521721 - RNA, 20 nt, Pseudomonas aeruginosa PA01
gugacccacuccggcaggcg

SEQ ID NO: 1521722 - RNA, 14 nt, Pseudomonas aeruginosa PA01
gugacccgcgcuuc

SEQ ID NO: 1521723 - RNA, 19 nt, Pseudomonas aeruginosa PA01
gugaccgagauucugcagg

SEQ ID NO: 1521724 - RNA, 14 nt, Pseudomonas aeruginosa PA01
gugaccgcgcgcca

SEQ ID NO: 1521725 - RNA, 22 nt, Pseudomonas aeruginosa PA01
gugaccgcccagggggccgggc

SEQ ID NO: 1521726 - RNA, 16 nt, Pseudomonas aeruginosa PA01
gugaccguuucgccgc

SEQ ID NO: 1521727 - RNA, 19 nt, Pseudomonas aeruginosa PA01
gugaccguuucgccgccgg

SEQ ID NO: 1521728 - RNA, 21 nt, Pseudomonas aeruginosa PA01
gugacgucgaggaaggccagg

SEQ ID NO: 1521729 - RNA, 23 nt, Pseudomonas aeruginosa PA01
gugacggugcagccacccagcag

SEQ ID NO: 1521730 - RNA, 20 nt, Pseudomonas aeruginosa PA01
gugacggcguucggggcccu

SEQ ID NO: 1521731 - RNA, 16 nt, Pseudomonas aeruginosa PA01
gugacggccggggcgg

SEQ ID NO: 1521732 - RNA, 20 nt, Pseudomonas aeruginosa PA01
gugacgcugcucaccaggug

SEQ ID NO: 1521733 - RNA, 14 nt, Pseudomonas aeruginosa PA01
gugaccuucaacgg

SEQ ID NO: 1521734 - RNA, 19 nt, Pseudomonas aeruginosa PA01
gugacgacgugcccauuuu

SEQ ID NO: 1521735 - RNA, 15 nt, Pseudomonas aeruginosa PA01
gugaagccgccgccc

SEQ ID NO: 1521736 - RNA, 17 nt, Pseudomonas aeruginosa PA01
gugaagccgccgcccag

SEQ ID NO: 1521737 - RNA, 22 nt, Pseudomonas aeruginosa PA01
gugaagccgccgcccagcagca

SEQ ID NO: 1521738 - RNA, 23 nt, Pseudomonas aeruginosa PA01
gugaagcccuucugucuuguccu

SEQ ID NO: 1521739 - RNA, 22 nt, Pseudomonas aeruginosa PA01
gugaagcuggagcagcagcgcc

SEQ ID NO: 1521740 - RNA, 14 nt, Pseudomonas aeruginosa PA01
gugaagcugcggcu

SEQ ID NO: 1521741 - RNA, 14 nt, Pseudomonas aeruginosa PA01
gugaacgagcccag

SEQ ID NO: 1521742 - RNA, 15 nt, Pseudomonas aeruginosa PA01
gugaacgagcccagg

SEQ ID NO: 1521743 - RNA, 14 nt, Pseudomonas aeruginosa PA01
gugaagcacgguga

SEQ ID NO: 1521744 - RNA, 17 nt, Pseudomonas aeruginosa PA01
gugaagcccaggcgcuc

SEQ ID NO: 1521745 - RNA, 23 nt, Pseudomonas aeruginosa PA01
gugaagccccuggcgcugggccu

SEQ ID NO: 1521746 - RNA, 14 nt, Pseudomonas aeruginosa PA01
gugaacgccaggca

SEQ ID NO: 1521747 - RNA, 15 nt, Pseudomonas aeruginosa PA01
gugaacucaugcagg

SEQ ID NO: 1521748 - RNA, 15 nt, Pseudomonas aeruginosa PA01
guuuccgaacuguau

SEQ ID NO: 1521749 - RNA, 16 nt, Pseudomonas aeruginosa PA01
guuuccagcagcaccc

SEQ ID NO: 1521750 - RNA, 23 nt, Pseudomonas aeruginosa PA01
aaaucaaaaccagccuugagccu

SEQ ID NO: 1521751 - RNA, 15 nt, Pseudomonas aeruginosa PA01
guuuccggccaggcg

SEQ ID NO: 1521752 - RNA, 18 nt, Pseudomonas aeruginosa PA01
guuuccgugugcagcagg

SEQ ID NO: 1521753 - RNA, 20 nt, Pseudomonas aeruginosa PA01
guuuccucgaugauccgcuc

SEQ ID NO: 1521754 - RNA, 18 nt, Pseudomonas aeruginosa PA01
guuucgccaccuguucca

SEQ ID NO: 1521755 - RNA, 16 nt, Pseudomonas aeruginosa PA01
guuucgaccggcgcgc

SEQ ID NO: 1521756 - RNA, 17 nt, Pseudomonas aeruginosa PA01
guuucggguccaggcgc

SEQ ID NO: 1521757 - RNA, 17 nt, Pseudomonas aeruginosa PA01
guuucgcugcugccgcg

SEQ ID NO: 1521758 - RNA, 21 nt, Pseudomonas aeruginosa PA01
guuucggccgcugccguugca

SEQ ID NO: 1521759 - RNA, 16 nt, Pseudomonas aeruginosa PA01
guuucucggucgccgc

SEQ ID NO: 1521760 - RNA, 14 nt, Pseudomonas aeruginosa PA01
guuucugcuggcca

SEQ ID NO: 1521761 - RNA, 15 nt, Pseudomonas aeruginosa PA01
guuucugcuggccac

SEQ ID NO: 1521762 - RNA, 22 nt, Pseudomonas aeruginosa PA01
aaauccaccuugccgcgcccgg

SEQ ID NO: 1521763 - RNA, 20 nt, Pseudomonas aeruginosa PA01
guuuucuuuuugcgccaggu

SEQ ID NO: 1521764 - RNA, 20 nt, Pseudomonas aeruginosa PA01
guuucagcggguagcugcug

SEQ ID NO: 1521765 - RNA, 15 nt, Pseudomonas aeruginosa PA01
guugucggccagcag

SEQ ID NO: 1521766 - RNA, 11 nt, Pseudomonas aeruginosa PA01
guuguccaggg

SEQ ID NO: 1521767 - RNA, 19 nt, Pseudomonas aeruginosa PA01
guuguccagggcauccauc

SEQ ID NO: 1521768 - RNA, 22 nt, Pseudomonas aeruginosa PA01
guuguccagggcauccaucgcc

SEQ ID NO: 1521769 - RNA, 22 nt, Pseudomonas aeruginosa PA01
guugcguuuccggucacgcagg

SEQ ID NO: 1521770 - RNA, 19 nt, Pseudomonas aeruginosa PA01
guugcuggccggucugcuu

SEQ ID NO: 1521771 - RNA, 17 nt, Pseudomonas aeruginosa PA01
guugcucgaaugcuguu

SEQ ID NO: 1521772 - RNA, 18 nt, Pseudomonas aeruginosa PA01
guugcucugggcauggcu

SEQ ID NO: 1521773 - RNA, 18 nt, Pseudomonas aeruginosa PA01
guugcgcuccacccaggc

SEQ ID NO: 1521774 - RNA, 21 nt, Pseudomonas aeruginosa PA01
guugcgcuccacccaggcgcc

SEQ ID NO: 1521775 - RNA, 18 nt, Pseudomonas aeruginosa PA01
guugcgcgccucgcccca

SEQ ID NO: 1521776 - RNA, 19 nt, Pseudomonas aeruginosa PA01
guugcgcagcuucugcagg

SEQ ID NO: 1521777 - RNA, 18 nt, Pseudomonas aeruginosa PA01
guugcgccgcuccuggca

SEQ ID NO: 1521778 - RNA, 19 nt, Pseudomonas aeruginosa PA01
guugcgccgcagcggcguc

SEQ ID NO: 1521779 - RNA, 22 nt, Pseudomonas aeruginosa PA01
guugcggcgccgguugcugcug

SEQ ID NO: 1521780 - RNA, 18 nt, Pseudomonas aeruginosa PA01
guugcggucgauguccug

SEQ ID NO: 1521781 - RNA, 15 nt, Pseudomonas aeruginosa PA01
guuggcuacccgcag

SEQ ID NO: 1521782 - RNA, 14 nt, Pseudomonas aeruginosa PA01
guuggucugcucgg

SEQ ID NO: 1521783 - RNA, 15 nt, Pseudomonas aeruginosa PA01
guuggccggcugcuc

SEQ ID NO: 1521784 - RNA, 17 nt, Pseudomonas aeruginosa PA01
guuggacagguccugga

SEQ ID NO: 1521785 - RNA, 16 nt, Pseudomonas aeruginosa PA01
guuggccgcagcagcg

SEQ ID NO: 1521786 - RNA, 15 nt, Pseudomonas aeruginosa PA01
guuggccuggcccgg

SEQ ID NO: 1521787 - RNA, 14 nt, Pseudomonas aeruginosa PA01
guuggcgccccaga

SEQ ID NO: 1521788 - RNA, 14 nt, Pseudomonas aeruginosa PA01
guuggccccgccga

SEQ ID NO: 1521789 - RNA, 16 nt, Pseudomonas aeruginosa PA01
guugcgcacccgcucg

SEQ ID NO: 1521790 - RNA, 15 nt, Pseudomonas aeruginosa PA01
guugccuguccagcu

SEQ ID NO: 1521791 - RNA, 12 nt, Pseudomonas aeruginosa PA01
guugccugcugu

SEQ ID NO: 1521792 - RNA, 15 nt, Pseudomonas aeruginosa PA01
guugccggacuuccu

SEQ ID NO: 1521793 - RNA, 20 nt, Pseudomonas aeruginosa PA01
guugccgcgcaccaccgaga

SEQ ID NO: 1521794 - RNA, 14 nt, Pseudomonas aeruginosa PA01
guugcaggcuggga

SEQ ID NO: 1521795 - RNA, 16 nt, Pseudomonas aeruginosa PA01
guugcaggcugggaaa

SEQ ID NO: 1521796 - RNA, 19 nt, Pseudomonas aeruginosa PA01
guugcagggcuugugcaga

SEQ ID NO: 1521797 - RNA, 19 nt, Pseudomonas aeruginosa PA01
guugcaguaccugcucacg

SEQ ID NO: 1521798 - RNA, 17 nt, Pseudomonas aeruginosa PA01
guugcaauugcaggccc

SEQ ID NO: 1521799 - RNA, 16 nt, Pseudomonas aeruginosa PA01
guugcaggccagcgcc

SEQ ID NO: 1521800 - RNA, 22 nt, Pseudomonas aeruginosa PA01
guugcagcacccccagcaggcc

SEQ ID NO: 1521801 - RNA, 15 nt, Pseudomonas aeruginosa PA01
guugagcugugguug

SEQ ID NO: 1521802 - RNA, 16 nt, Pseudomonas aeruginosa PA01
guugaggcccaucagg

SEQ ID NO: 1521803 - RNA, 23 nt, Pseudomonas aeruginosa PA01
guugagguagagcacgccgucgc

SEQ ID NO: 1521804 - RNA, 18 nt, Pseudomonas aeruginosa PA01
guucuccaggcccauccu

SEQ ID NO: 1521805 - RNA, 13 nt, Pseudomonas aeruginosa PA01
guucuccgggucg

SEQ ID NO: 1521806 - RNA, 15 nt, Pseudomonas aeruginosa PA01
guucucguccucggc

SEQ ID NO: 1521807 - RNA, 17 nt, Pseudomonas aeruginosa PA01
guuaacaguugagcugu

SEQ ID NO: 1521808 - RNA, 18 nt, Pseudomonas aeruginosa PA01
guuaugcgcccuaccugu

SEQ ID NO: 1521809 - RNA, 15 nt, Pseudomonas aeruginosa PA01
guuaccuuggccacg

SEQ ID NO: 1521810 - RNA, 22 nt, Pseudomonas aeruginosa PA01
guuccgacccggccgaccaggu

SEQ ID NO: 1521811 - RNA, 23 nt, Pseudomonas aeruginosa PA01
guuccaugucgcuggccugcagg

SEQ ID NO: 1521812 - RNA, 13 nt, Pseudomonas aeruginosa PA01
guuccaugaacuc

SEQ ID NO: 1521813 - RNA, 14 nt, Pseudomonas aeruginosa PA01
guuccaugaacucu

SEQ ID NO: 1521814 - RNA, 23 nt, Pseudomonas aeruginosa PA01
guuccaguucggccgcggcuggc

SEQ ID NO: 1521815 - RNA, 18 nt, Pseudomonas aeruginosa PA01
guuccgcgauagcucagu

SEQ ID NO: 1521816 - RNA, 14 nt, Pseudomonas aeruginosa PA01
guuccggcaggacc

SEQ ID NO: 1521817 - RNA, 17 nt, Pseudomonas aeruginosa PA01
guuccgcggagucgccg

SEQ ID NO: 1521818 - RNA, 18 nt, Pseudomonas aeruginosa PA01
guuccgcggagucgccgg

SEQ ID NO: 1521819 - RNA, 17 nt, Pseudomonas aeruginosa PA01
guuccugcuccuccgac

SEQ ID NO: 1521820 - RNA, 17 nt, Pseudomonas aeruginosa PA01
guuccgcucaccaggcc

SEQ ID NO: 1521821 - RNA, 16 nt, Pseudomonas aeruginosa PA01
guuccuguaccagggg

SEQ ID NO: 1521822 - RNA, 16 nt, Pseudomonas aeruginosa PA01
guucggcgagaggucg

SEQ ID NO: 1521823 - RNA, 19 nt, Pseudomonas aeruginosa PA01
guucgcggcgcagcuucuc

SEQ ID NO: 1521824 - RNA, 17 nt, Pseudomonas aeruginosa PA01
guucggcggcgugcagg

SEQ ID NO: 1521825 - RNA, 17 nt, Pseudomonas aeruginosa PA01
guucggcgcugaccucg

SEQ ID NO: 1521826 - RNA, 13 nt, Pseudomonas aeruginosa PA01
guucggcgcuggc

SEQ ID NO: 1521827 - RNA, 19 nt, Pseudomonas aeruginosa PA01
guucggcggaaauccuuuc

SEQ ID NO: 1521828 - RNA, 14 nt, Pseudomonas aeruginosa PA01
guucggcugggcca

SEQ ID NO: 1521829 - RNA, 17 nt, Pseudomonas aeruginosa PA01
guucggcuguuucaggc

SEQ ID NO: 1521830 - RNA, 14 nt, Pseudomonas aeruginosa PA01
guucgaaggccagu

SEQ ID NO: 1521831 - RNA, 22 nt, Pseudomonas aeruginosa PA01
guucgaaguucuccagcaagcc

SEQ ID NO: 1521832 - RNA, 14 nt, Pseudomonas aeruginosa PA01
guucgccacgcugc

SEQ ID NO: 1521833 - RNA, 17 nt, Pseudomonas aeruginosa PA01
guucgcccagaccugca

SEQ ID NO: 1521834 - RNA, 22 nt, Pseudomonas aeruginosa PA01
guuccuuuuccucgaucaggcc

SEQ ID NO: 1521835 - RNA, 15 nt, Pseudomonas aeruginosa PA01
guucgcaggccaggc

SEQ ID NO: 1521836 - RNA, 20 nt, Pseudomonas aeruginosa PA01
guucgccccgccgccaggcg

SEQ ID NO: 1521837 - RNA, 14 nt, Pseudomonas aeruginosa PA01
guucgccgcgggcg

SEQ ID NO: 1521838 - RNA, 23 nt, Pseudomonas aeruginosa PA01
guucgccgagcgccgccaggcag

SEQ ID NO: 1521839 - RNA, 14 nt, Pseudomonas aeruginosa PA01
guucgccggccagg

SEQ ID NO: 1521840 - RNA, 15 nt, Pseudomonas aeruginosa PA01
guucgccguucagcu

SEQ ID NO: 1521841 - RNA, 19 nt, Pseudomonas aeruginosa PA01
guucgcgcaggcgcuggcg

SEQ ID NO: 1521842 - RNA, 14 nt, Pseudomonas aeruginosa PA01
guuauggccgaccc

SEQ ID NO: 1521843 - RNA, 20 nt, Pseudomonas aeruginosa PA01
guucaccguccacuggccca

SEQ ID NO: 1521844 - RNA, 20 nt, Pseudomonas aeruginosa PA01
guucagccgguacugcgcca

SEQ ID NO: 1521845 - RNA, 14 nt, Pseudomonas aeruginosa PA01
guucagccacugcc

SEQ ID NO: 1521846 - RNA, 21 nt, Pseudomonas aeruginosa PA01
guucagcaggucgcggcccca

SEQ ID NO: 1521847 - RNA, 21 nt, Pseudomonas aeruginosa PA01
guuccaccgccuggaccaggu

SEQ ID NO: 1521848 - RNA, 22 nt, Pseudomonas aeruginosa PA01
guuccacucccaugccaggaga

SEQ ID NO: 1521849 - RNA, 22 nt, Pseudomonas aeruginosa PA01
guucaggguggcgaucacgucg

SEQ ID NO: 1521850 - RNA, 13 nt, Pseudomonas aeruginosa PA01
guucaggcugggc

SEQ ID NO: 1521851 - RNA, 18 nt, Pseudomonas aeruginosa PA01
guucagggcgagcagggc

SEQ ID NO: 1521852 - RNA, 18 nt, Pseudomonas aeruginosa PA01
guucaucgccgccaggca

SEQ ID NO: 1521853 - RNA, 19 nt, Pseudomonas aeruginosa PA01
guucaucgccgccaggcag

SEQ ID NO: 1521854 - RNA, 23 nt, Pseudomonas aeruginosa PA01
guguagaucaggcuggcguacuu

SEQ ID NO: 1521855 - RNA, 17 nt, Pseudomonas aeruginosa PA01
gugucggcgaucaggcc

SEQ ID NO: 1521856 - RNA, 12 nt, Pseudomonas aeruginosa PA01
guggggcggcgc

SEQ ID NO: 1521857 - RNA, 11 nt, Pseudomonas aeruginosa PA01
guggguagccg

SEQ ID NO: 1521858 - RNA, 17 nt, Pseudomonas aeruginosa PA01
guguaccacgcccgcgg

SEQ ID NO: 1521859 - RNA, 18 nt, Pseudomonas aeruginosa PA01
gugguugggcaggcgcau

SEQ ID NO: 1521860 - RNA, 14 nt, Pseudomonas aeruginosa PA01
gugguuccaggagg

SEQ ID NO: 1521861 - RNA, 15 nt, Pseudomonas aeruginosa PA01
gugugccgucaggca

SEQ ID NO: 1521862 - RNA, 17 nt, Pseudomonas aeruginosa PA01
gugugccggccaugcag

SEQ ID NO: 1521863 - RNA, 21 nt, Pseudomonas aeruginosa PA01
gugugccgcccugcucuugcc

SEQ ID NO: 1521864 - RNA, 14 nt, Pseudomonas aeruginosa PA01
gugugaucaccagc

SEQ ID NO: 1521865 - RNA, 18 nt, Pseudomonas aeruginosa PA01
gugugaucaccagccacu

SEQ ID NO: 1521866 - RNA, 21 nt, Pseudomonas aeruginosa PA01
guguggcgaaacuccagcagg

SEQ ID NO: 1521867 - RNA, 12 nt, Pseudomonas aeruginosa PA01
guguggccuggg

SEQ ID NO: 1521868 - RNA, 16 nt, Pseudomonas aeruginosa PA01
guguucggccccggcc

SEQ ID NO: 1521869 - RNA, 23 nt, Pseudomonas aeruginosa PA01
gugcuggucgugguccagcucgg

SEQ ID NO: 1521870 - RNA, 20 nt, Pseudomonas aeruginosa PA01
gugcuggguggaggcccaga

SEQ ID NO: 1521871 - RNA, 17 nt, Pseudomonas aeruginosa PA01
gugcuggcgagcagggu

SEQ ID NO: 1521872 - RNA, 17 nt, Pseudomonas aeruginosa PA01
gugcuggccggcagcag

SEQ ID NO: 1521873 - RNA, 18 nt, Pseudomonas aeruginosa PA01
guggagccggugccggcg

SEQ ID NO: 1521874 - RNA, 16 nt, Pseudomonas aeruginosa PA01
guggaggucugccacc

SEQ ID NO: 1521875 - RNA, 20 nt, Pseudomonas aeruginosa PA01
guggaacgaggcgacccggg

SEQ ID NO: 1521876 - RNA, 14 nt, Pseudomonas aeruginosa PA01
guggaacgcagggg

SEQ ID NO: 1521877 - RNA, 13 nt, Pseudomonas aeruginosa PA01
guggaacagccgc

SEQ ID NO: 1521878 - RNA, 19 nt, Pseudomonas aeruginosa PA01
guggaacagccgcagcggc

SEQ ID NO: 1521879 - RNA, 15 nt, Pseudomonas aeruginosa PA01
guggaacagcgcguc

SEQ ID NO: 1521880 - RNA, 23 nt, Pseudomonas aeruginosa PA01
guggauugcagcgucgacgccga

SEQ ID NO: 1521881 - RNA, 17 nt, Pseudomonas aeruginosa PA01
guggaucgcggcguagg

SEQ ID NO: 1521882 - RNA, 18 nt, Pseudomonas aeruginosa PA01
guggauaacucugugggc

SEQ ID NO: 1521883 - RNA, 15 nt, Pseudomonas aeruginosa PA01
guggauaggcggcgg

SEQ ID NO: 1521884 - RNA, 22 nt, Pseudomonas aeruginosa PA01
guggcaugguguccggcggcga

SEQ ID NO: 1521885 - RNA, 13 nt, Pseudomonas aeruginosa PA01
guggcaggcgcug

SEQ ID NO: 1521886 - RNA, 18 nt, Pseudomonas aeruginosa PA01
guggcacguacguccagg

SEQ ID NO: 1521887 - RNA, 15 nt, Pseudomonas aeruginosa PA01
guggcgaagccagca

SEQ ID NO: 1521888 - RNA, 16 nt, Pseudomonas aeruginosa PA01
guggcgaaacuccagc

SEQ ID NO: 1521889 - RNA, 17 nt, Pseudomonas aeruginosa PA01
guggcgaaacuccagca

SEQ ID NO: 1521890 - RNA, 18 nt, Pseudomonas aeruginosa PA01
guggcgaaacuccagcag

SEQ ID NO: 1521891 - RNA, 14 nt, Pseudomonas aeruginosa PA01
guggcgaacagcac

SEQ ID NO: 1521892 - RNA, 15 nt, Pseudomonas aeruginosa PA01
gugggacugagccgc

SEQ ID NO: 1521893 - RNA, 15 nt, Pseudomonas aeruginosa PA01
gugggaguccaggua

SEQ ID NO: 1521894 - RNA, 15 nt, Pseudomonas aeruginosa PA01
gugggccagcccaga

SEQ ID NO: 1521895 - RNA, 22 nt, Pseudomonas aeruginosa PA01
gugggccagcccagaacagcaa

SEQ ID NO: 1521896 - RNA, 11 nt, Pseudomonas aeruginosa PA01
gugggccaggg

SEQ ID NO: 1521897 - RNA, 16 nt, Pseudomonas aeruginosa PA01
guggcguuauccgccc

SEQ ID NO: 1521898 - RNA, 15 nt, Pseudomonas aeruginosa PA01
guggcguugcagggu

SEQ ID NO: 1521899 - RNA, 13 nt, Pseudomonas aeruginosa PA01
guggcggcggcga

SEQ ID NO: 1521900 - RNA, 15 nt, Pseudomonas aeruginosa PA01
guggcgccagccagc

SEQ ID NO: 1521901 - RNA, 12 nt, Pseudomonas aeruginosa PA01
guggcgcagcau

SEQ ID NO: 1521902 - RNA, 13 nt, Pseudomonas aeruginosa PA01
guggcgacgcagc

SEQ ID NO: 1521903 - RNA, 15 nt, Pseudomonas aeruginosa PA01
guggcgagcgcgauc

SEQ ID NO: 1521904 - RNA, 18 nt, Pseudomonas aeruginosa PA01
ucagccaccugcucgcug

SEQ ID NO: 1521905 - RNA, 17 nt, Pseudomonas aeruginosa PA01
ucagcccaggcgccgcu

SEQ ID NO: 1521906 - RNA, 20 nt, Pseudomonas aeruginosa PA01
ucagccccucggccaggacc

SEQ ID NO: 1521907 - RNA, 18 nt, Pseudomonas aeruginosa PA01
ucagcccgccgugcgcuc

SEQ ID NO: 1521908 - RNA, 23 nt, Pseudomonas aeruginosa PA01
ucagcccgccgugcgcuccgcca

SEQ ID NO: 1521909 - RNA, 17 nt, Pseudomonas aeruginosa PA01
ucagccccgaucgccuc

SEQ ID NO: 1521910 - RNA, 20 nt, Pseudomonas aeruginosa PA01
ucagcccguguucggccagc

SEQ ID NO: 1521911 - RNA, 13 nt, Pseudomonas aeruginosa PA01
ucagcccgcugag

SEQ ID NO: 1521912 - RNA, 17 nt, Pseudomonas aeruginosa PA01
ucagccgaccaccuuca

SEQ ID NO: 1521913 - RNA, 17 nt, Pseudomonas aeruginosa PA01
ucagcgcauaggccugg

SEQ ID NO: 1521914 - RNA, 13 nt, Pseudomonas aeruginosa PA01
ucagcgccagggc

SEQ ID NO: 1521915 - RNA, 15 nt, Pseudomonas aeruginosa PA01
ucagcgccagggcau

SEQ ID NO: 1521916 - RNA, 13 nt, Pseudomonas aeruginosa PA01
ucagcgcccggcu

SEQ ID NO: 1521917 - RNA, 15 nt, Pseudomonas aeruginosa PA01
ucagcgccagcaggc

SEQ ID NO: 1521918 - RNA, 19 nt, Pseudomonas aeruginosa PA01
ucagcucgaucagcccgcc

SEQ ID NO: 1521919 - RNA, 22 nt, Pseudomonas aeruginosa PA01
ucagcucgaucucauggucggg

SEQ ID NO: 1521920 - RNA, 20 nt, Pseudomonas aeruginosa PA01
ucagcucgcgguaggccagc

SEQ ID NO: 1521921 - RNA, 19 nt, Pseudomonas aeruginosa PA01
ucagcucgcguagcgcuuc

SEQ ID NO: 1521922 - RNA, 13 nt, Pseudomonas aeruginosa PA01
ucagcuccagcag

SEQ ID NO: 1521923 - RNA, 13 nt, Pseudomonas aeruginosa PA01
ucagcucccaggc

SEQ ID NO: 1521924 - RNA, 19 nt, Pseudomonas aeruginosa PA01
ucagcguagcuguucucuu

SEQ ID NO: 1521925 - RNA, 22 nt, Pseudomonas aeruginosa PA01
ucagcgggccuuuucuuuggcg

SEQ ID NO: 1521926 - RNA, 21 nt, Pseudomonas aeruginosa PA01
ucagcggguuggcuuccagcc

SEQ ID NO: 1521927 - RNA, 17 nt, Pseudomonas aeruginosa PA01
ucagcggguagcugcug

SEQ ID NO: 1521928 - RNA, 14 nt, Pseudomonas aeruginosa PA01
ucagcggcgcagcc

SEQ ID NO: 1521929 - RNA, 15 nt, Pseudomonas aeruginosa PA01
ucagcggcgcagccu

SEQ ID NO: 1521930 - RNA, 22 nt, Pseudomonas aeruginosa PA01
ucagcggcacggucauggccag

SEQ ID NO: 1521931 - RNA, 23 nt, Pseudomonas aeruginosa PA01
ucagcggcacggucauggccagc

SEQ ID NO: 1521932 - RNA, 15 nt, Pseudomonas aeruginosa PA01
ucagcggaagcccag

SEQ ID NO: 1521933 - RNA, 15 nt, Pseudomonas aeruginosa PA01
ucagcggaccgguga

SEQ ID NO: 1521934 - RNA, 16 nt, Pseudomonas aeruginosa PA01
ucagcggaccggugag

SEQ ID NO: 1521935 - RNA, 21 nt, Pseudomonas aeruginosa PA01
ucagcgcuucucggcagcgcu

SEQ ID NO: 1521936 - RNA, 18 nt, Pseudomonas aeruginosa PA01
ucagcaccugcgccgaag

SEQ ID NO: 1521937 - RNA, 18 nt, Pseudomonas aeruginosa PA01
ucagcaccaggaagcccc

SEQ ID NO: 1521938 - RNA, 14 nt, Pseudomonas aeruginosa PA01
ucagcaccagggcc

SEQ ID NO: 1521939 - RNA, 18 nt, Pseudomonas aeruginosa PA01
ucagcaccagggccaggg

SEQ ID NO: 1521940 - RNA, 22 nt, Pseudomonas aeruginosa PA01
ucagcacgccuuccagaucguc

SEQ ID NO: 1521941 - RNA, 17 nt, Pseudomonas aeruginosa PA01
ucagcaggucgcggccc

SEQ ID NO: 1521942 - RNA, 18 nt, Pseudomonas aeruginosa PA01
ucagcagugcggggcgcu

SEQ ID NO: 1521943 - RNA, 14 nt, Pseudomonas aeruginosa PA01
ucagcagggucagg

SEQ ID NO: 1521944 - RNA, 14 nt, Pseudomonas aeruginosa PA01
ucaggcgacgccgc

SEQ ID NO: 1521945 - RNA, 11 nt, Pseudomonas aeruginosa PA01
ucaggccuggc

SEQ ID NO: 1521946 - RNA, 19 nt, Pseudomonas aeruginosa PA01
ucaggccuugacgcgggac

SEQ ID NO: 1521947 - RNA, 15 nt, Pseudomonas aeruginosa PA01
ucaggccgaguccgc

SEQ ID NO: 1521948 - RNA, 17 nt, Pseudomonas aeruginosa PA01
ucaggccgaccagcgcc

SEQ ID NO: 1521949 - RNA, 16 nt, Pseudomonas aeruginosa PA01
ucaggcccuugaggaa

SEQ ID NO: 1521950 - RNA, 20 nt, Pseudomonas aeruginosa PA01
ucaggccggaguccacggug

SEQ ID NO: 1521951 - RNA, 20 nt, Pseudomonas aeruginosa PA01
ucaggccggcgccgccgaac

SEQ ID NO: 1521952 - RNA, 21 nt, Pseudomonas aeruginosa PA01
ucaggccgaggcgcuucugcu

SEQ ID NO: 1521953 - RNA, 20 nt, Pseudomonas aeruginosa PA01
ucagcucuuccaggugaucc

SEQ ID NO: 1521954 - RNA, 23 nt, Pseudomonas aeruginosa PA01
ucagcucugucuccugugccuug

SEQ ID NO: 1521955 - RNA, 17 nt, Pseudomonas aeruginosa PA01
ucagcucguugcccggc

SEQ ID NO: 1521956 - RNA, 22 nt, Pseudomonas aeruginosa PA01
ucaggacgcuacgcucggggug

SEQ ID NO: 1521957 - RNA, 22 nt, Pseudomonas aeruginosa PA01
ucaggaccuuccgccagcaggc

SEQ ID NO: 1521958 - RNA, 17 nt, Pseudomonas aeruginosa PA01
ucaggaggaucgccagg

SEQ ID NO: 1521959 - RNA, 20 nt, Pseudomonas aeruginosa PA01
ucaggaguuucaucucggcg

SEQ ID NO: 1521960 - RNA, 22 nt, Pseudomonas aeruginosa PA01
ucaggcugcggcggaaggcggc

SEQ ID NO: 1521961 - RNA, 21 nt, Pseudomonas aeruginosa PA01
ucaggcugccgagcaggguca

SEQ ID NO: 1521962 - RNA, 17 nt, Pseudomonas aeruginosa PA01
ucaggcugaagcggccg

SEQ ID NO: 1521963 - RNA, 18 nt, Pseudomonas aeruginosa PA01
ucaggcugaagcggccgc

SEQ ID NO: 1521964 - RNA, 20 nt, Pseudomonas aeruginosa PA01
ucaggcuggcguacuugggc

SEQ ID NO: 1521965 - RNA, 15 nt, Pseudomonas aeruginosa PA01
ucaggcugugcagga

SEQ ID NO: 1521966 - RNA, 22 nt, Pseudomonas aeruginosa PA01
ucaggcugugcaggaaggcgac

SEQ ID NO: 1521967 - RNA, 20 nt, Pseudomonas aeruginosa PA01
ucaggcuguugcccugggcc

SEQ ID NO: 1521968 - RNA, 18 nt, Pseudomonas aeruginosa PA01
ucaggcggcgaaagccau

SEQ ID NO: 1521969 - RNA, 13 nt, Pseudomonas aeruginosa PA01
ucaggcgcugucc

SEQ ID NO: 1521970 - RNA, 16 nt, Pseudomonas aeruginosa PA01
ucaggucgacgccgcc

SEQ ID NO: 1521971 - RNA, 15 nt, Pseudomonas aeruginosa PA01
ucaggucgccagcgc

SEQ ID NO: 1521972 - RNA, 16 nt, Pseudomonas aeruginosa PA01
ucaggucgccagcgcc

SEQ ID NO: 1521973 - RNA, 15 nt, Pseudomonas aeruginosa PA01
ucaggucggcgccug

SEQ ID NO: 1521974 - RNA, 18 nt, Pseudomonas aeruginosa PA01
ucaguaccugcaaggcgg

SEQ ID NO: 1521975 - RNA, 16 nt, Pseudomonas aeruginosa PA01
ucagguccuugaucac

SEQ ID NO: 1521976 - RNA, 21 nt, Pseudomonas aeruginosa PA01
ucaggucgaacugcacccgcc

SEQ ID NO: 1521977 - RNA, 17 nt, Pseudomonas aeruginosa PA01
ucaggucgaugcccagc

SEQ ID NO: 1521978 - RNA, 16 nt, Pseudomonas aeruginosa PA01
ucagguagaugaacug

SEQ ID NO: 1521979 - RNA, 14 nt, Pseudomonas aeruginosa PA01
ucagugaaagggaa

SEQ ID NO: 1521980 - RNA, 23 nt, Pseudomonas aeruginosa PA01
ucaguagcggcaggguacggguc

SEQ ID NO: 1521981 - RNA, 13 nt, Pseudomonas aeruginosa PA01
ucagugcucauca

SEQ ID NO: 1521982 - RNA, 19 nt, Pseudomonas aeruginosa PA01
ucagaggcgaccagccggg

SEQ ID NO: 1521983 - RNA, 14 nt, Pseudomonas aeruginosa PA01
ucagaccacgcccu

SEQ ID NO: 1521984 - RNA, 20 nt, Pseudomonas aeruginosa PA01
ucagaacacacgaauggcuu

SEQ ID NO: 1521985 - RNA, 17 nt, Pseudomonas aeruginosa PA01
ucagaacagcggcagcu

SEQ ID NO: 1521986 - RNA, 21 nt, Pseudomonas aeruginosa PA01
ucacuucgcgcgggguggccg

SEQ ID NO: 1521987 - RNA, 18 nt, Pseudomonas aeruginosa PA01
ucacuuccgucacgcccu

SEQ ID NO: 1521988 - RNA, 12 nt, Pseudomonas aeruginosa PA01
ucacugcgggcc

SEQ ID NO: 1521989 - RNA, 12 nt, Pseudomonas aeruginosa PA01
ucacgccgaggg

SEQ ID NO: 1521990 - RNA, 18 nt, Pseudomonas aeruginosa PA01
ucacgccagagaacgaag

SEQ ID NO: 1521991 - RNA, 14 nt, Pseudomonas aeruginosa PA01
ucacccugcugggc

SEQ ID NO: 1521992 - RNA, 21 nt, Pseudomonas aeruginosa PA01
ucacccugcugggcgggaucu

SEQ ID NO: 1521993 - RNA, 18 nt, Pseudomonas aeruginosa PA01
ucacccgcgaaugcuccg

SEQ ID NO: 1521994 - RNA, 23 nt, Pseudomonas aeruginosa PA01
ucacguugaacacaucgaccagg

SEQ ID NO: 1521995 - RNA, 15 nt, Pseudomonas aeruginosa PA01
ucacgucgcgcaccu

SEQ ID NO: 1521996 - RNA, 18 nt, Pseudomonas aeruginosa PA01
ucacggcgcgagaaaaac

SEQ ID NO: 1521997 - RNA, 15 nt, Pseudomonas aeruginosa PA01
ucacggcgugccgca

SEQ ID NO: 1521998 - RNA, 13 nt, Pseudomonas aeruginosa PA01
ucacggcgcagcc

SEQ ID NO: 1521999 - RNA, 18 nt, Pseudomonas aeruginosa PA01
ucacggccccgagaaaac

SEQ ID NO: 1522000 - RNA, 22 nt, Pseudomonas aeruginosa PA01
ucacggcgaaaccggccagcgc

SEQ ID NO: 1522001 - RNA, 17 nt, Pseudomonas aeruginosa PA01
ucaacgaccgcccaggc

SEQ ID NO: 1522002 - RNA, 18 nt, Pseudomonas aeruginosa PA01
ucaacgcggccagcagca

SEQ ID NO: 1522003 - RNA, 12 nt, Pseudomonas aeruginosa PA01
ucaacaccagcg

SEQ ID NO: 1522004 - RNA, 22 nt, Pseudomonas aeruginosa PA01
ucaacaccagcgccgccaggca

SEQ ID NO: 1522005 - RNA, 16 nt, Pseudomonas aeruginosa PA01
ucaacaagaauaggaa

SEQ ID NO: 1522006 - RNA, 15 nt, Pseudomonas aeruginosa PA01
aaaucgagcugcucg

SEQ ID NO: 1522007 - RNA, 20 nt, Pseudomonas aeruginosa PA01
aaaucggcaggcugcaucgg

SEQ ID NO: 1522008 - RNA, 22 nt, Pseudomonas aeruginosa PA01
ucaccagcggguaguagaucag

SEQ ID NO: 1522009 - RNA, 13 nt, Pseudomonas aeruginosa PA01
ucaccaggcugcc

SEQ ID NO: 1522010 - RNA, 12 nt, Pseudomonas aeruginosa PA01
ucaccagcgcca

SEQ ID NO: 1522011 - RNA, 16 nt, Pseudomonas aeruginosa PA01
ucaccaccuggauggu

SEQ ID NO: 1522012 - RNA, 13 nt, Pseudomonas aeruginosa PA01
ucaccaccccaca

SEQ ID NO: 1522013 - RNA, 21 nt, Pseudomonas aeruginosa PA01
ucacauggugggcgccgcugu

SEQ ID NO: 1522014 - RNA, 21 nt, Pseudomonas aeruginosa PA01
ucaccaccaccgcgccgaugu

SEQ ID NO: 1522015 - RNA, 19 nt, Pseudomonas aeruginosa PA01
ucaccaccagcaucagcag

SEQ ID NO: 1522016 - RNA, 20 nt, Pseudomonas aeruginosa PA01
ucaccaccagcaucagcagg

SEQ ID NO: 1522017 - RNA, 15 nt, Pseudomonas aeruginosa PA01
ucaccaccagcgccg

SEQ ID NO: 1522018 - RNA, 15 nt, Pseudomonas aeruginosa PA01
ucaauucgcggacgc

SEQ ID NO: 1522019 - RNA, 17 nt, Pseudomonas aeruginosa PA01
uauucggcgaccagccc

SEQ ID NO: 1522020 - RNA, 20 nt, Pseudomonas aeruginosa PA01
uaucucgcugucuaucccgu

SEQ ID NO: 1522021 - RNA, 13 nt, Pseudomonas aeruginosa PA01
uauggguggcccu

SEQ ID NO: 1522022 - RNA, 23 nt, Pseudomonas aeruginosa PA01
uaugccugugcaccgaagggaau

SEQ ID NO: 1522023 - RNA, 13 nt, Pseudomonas aeruginosa PA01
uaugcgccgccac

SEQ ID NO: 1522024 - RNA, 23 nt, Pseudomonas aeruginosa PA01
uaugcgccgccacgugcacgccg

SEQ ID NO: 1522025 - RNA, 20 nt, Pseudomonas aeruginosa PA01
uaugcgcggucaccaggguc

SEQ ID NO: 1522026 - RNA, 13 nt, Pseudomonas aeruginosa PA01
uauccccccaccc

SEQ ID NO: 1522027 - RNA, 13 nt, Pseudomonas aeruginosa PA01
uauccuccaggcc

SEQ ID NO: 1522028 - RNA, 14 nt, Pseudomonas aeruginosa PA01
uauccuccaggccg

SEQ ID NO: 1522029 - RNA, 13 nt, Pseudomonas aeruginosa PA01
uaucgcuuucagc

SEQ ID NO: 1522030 - RNA, 17 nt, Pseudomonas aeruginosa PA01
uaucgaucacugccugg

SEQ ID NO: 1522031 - RNA, 13 nt, Pseudomonas aeruginosa PA01
uauagcuggucaa

SEQ ID NO: 1522032 - RNA, 22 nt, Pseudomonas aeruginosa PA01
uauaggagccugcgugagcugg

SEQ ID NO: 1522033 - RNA, 17 nt, Pseudomonas aeruginosa PA01
uauaggguuucucgcuc

SEQ ID NO: 1522034 - RNA, 22 nt, Pseudomonas aeruginosa PA01
uaguccuccgcgcccaggcgca

SEQ ID NO: 1522035 - RNA, 16 nt, Pseudomonas aeruginosa PA01
uaggugcgcuggcgcc

SEQ ID NO: 1522036 - RNA, 22 nt, Pseudomonas aeruginosa PA01
uagugaaaguccuucuucgcua

SEQ ID NO: 1522037 - RNA, 13 nt, Pseudomonas aeruginosa PA01
uagucgaccggaa

SEQ ID NO: 1522038 - RNA, 18 nt, Pseudomonas aeruginosa PA01
uccuuccagcucucgcug

SEQ ID NO: 1522039 - RNA, 15 nt, Pseudomonas aeruginosa PA01
uccuuccaggguuuc

SEQ ID NO: 1522040 - RNA, 21 nt, Pseudomonas aeruginosa PA01
uccuucgagccuggccaggcg

SEQ ID NO: 1522041 - RNA, 16 nt, Pseudomonas aeruginosa PA01
uccuucggccaguccu

SEQ ID NO: 1522042 - RNA, 14 nt, Pseudomonas aeruginosa PA01
uccuucucgaagcc

SEQ ID NO: 1522043 - RNA, 20 nt, Pseudomonas aeruginosa PA01
uccuugaaggcuuccuggaa

SEQ ID NO: 1522044 - RNA, 20 nt, Pseudomonas aeruginosa PA01
uccuugacccucugguuggc

SEQ ID NO: 1522045 - RNA, 22 nt, Pseudomonas aeruginosa PA01
uccuuguucggcuggaccuccu

SEQ ID NO: 1522046 - RNA, 15 nt, Pseudomonas aeruginosa PA01
uccuuggccuccgga

SEQ ID NO: 1522047 - RNA, 16 nt, Pseudomonas aeruginosa PA01
uccuuguccagggccg

SEQ ID NO: 1522048 - RNA, 13 nt, Pseudomonas aeruginosa PA01
uccuuucacaugc

SEQ ID NO: 1522049 - RNA, 15 nt, Pseudomonas aeruginosa PA01
uccuugcgccaggcc

SEQ ID NO: 1522050 - RNA, 20 nt, Pseudomonas aeruginosa PA01
uccuugcgggaacuggcguu

SEQ ID NO: 1522051 - RNA, 16 nt, Pseudomonas aeruginosa PA01
uccuuggucagggugc

SEQ ID NO: 1522052 - RNA, 22 nt, Pseudomonas aeruginosa PA01
uccuugggccaggcauccagca

SEQ ID NO: 1522053 - RNA, 18 nt, Pseudomonas aeruginosa PA01
uccuuucgaucuggcugc

SEQ ID NO: 1522054 - RNA, 18 nt, Pseudomonas aeruginosa PA01
ucgaacaccggcgccgcc

SEQ ID NO: 1522055 - RNA, 14 nt, Pseudomonas aeruginosa PA01
ucgaacagcagcaa

SEQ ID NO: 1522056 - RNA, 17 nt, Pseudomonas aeruginosa PA01
ucgaacacuugaccguc

SEQ ID NO: 1522057 - RNA, 21 nt, Pseudomonas aeruginosa PA01
ucgaacagguggcuuuccagc

SEQ ID NO: 1522058 - RNA, 13 nt, Pseudomonas aeruginosa PA01
ucgaacagcagcu

SEQ ID NO: 1522059 - RNA, 17 nt, Pseudomonas aeruginosa PA01
ucgaaacggaacaggaa

SEQ ID NO: 1522060 - RNA, 23 nt, Pseudomonas aeruginosa PA01
ucgaaacggaacaggaaacucac

SEQ ID NO: 1522061 - RNA, 19 nt, Pseudomonas aeruginosa PA01
ucgaaagccuccagcagcu

SEQ ID NO: 1522062 - RNA, 13 nt, Pseudomonas aeruginosa PA01
ucgaaagccugcc

SEQ ID NO: 1522063 - RNA, 20 nt, Pseudomonas aeruginosa PA01
ucgaaggguuccucucguca

SEQ ID NO: 1522064 - RNA, 19 nt, Pseudomonas aeruginosa PA01
ucgaaggguuggccgcagc

SEQ ID NO: 1522065 - RNA, 23 nt, Pseudomonas aeruginosa PA01
ucgaaggguuggccgcagcagcg

SEQ ID NO: 1522066 - RNA, 16 nt, Pseudomonas aeruginosa PA01
ucgaaguucuccagca

SEQ ID NO: 1522067 - RNA, 18 nt, Pseudomonas aeruginosa PA01
ucgaagcuccagcgugcc

SEQ ID NO: 1522068 - RNA, 12 nt, Pseudomonas aeruginosa PA01
ucgaagcgcgcc

SEQ ID NO: 1522069 - RNA, 20 nt, Pseudomonas aeruginosa PA01
ucgaagcggaucucgucgcc

SEQ ID NO: 1522070 - RNA, 16 nt, Pseudomonas aeruginosa PA01
ucgaagccgagcugcc

SEQ ID NO: 1522071 - RNA, 12 nt, Pseudomonas aeruginosa PA01
ucgaagccgagg

SEQ ID NO: 1522072 - RNA, 17 nt, Pseudomonas aeruginosa PA01
ucgaagccgaggcuuuc

SEQ ID NO: 1522073 - RNA, 15 nt, Pseudomonas aeruginosa PA01
ucgaagccgccgccg

SEQ ID NO: 1522074 - RNA, 22 nt, Pseudomonas aeruginosa PA01
ucgaagccggauucgcgcagca

SEQ ID NO: 1522075 - RNA, 21 nt, Pseudomonas aeruginosa PA01
ucgaagauuccgcugaggaug

SEQ ID NO: 1522076 - RNA, 12 nt, Pseudomonas aeruginosa PA01
ucgaagcccugc

SEQ ID NO: 1522077 - RNA, 23 nt, Pseudomonas aeruginosa PA01
ucgaagcccgaauguuccaaggu

SEQ ID NO: 1522078 - RNA, 16 nt, Pseudomonas aeruginosa PA01
ucgaagcccagcgccu

SEQ ID NO: 1522079 - RNA, 21 nt, Pseudomonas aeruginosa PA01
ucgaagcagcccagcgcuucc

SEQ ID NO: 1522080 - RNA, 19 nt, Pseudomonas aeruginosa PA01
ucgaagaccagcggagcgu

SEQ ID NO: 1522081 - RNA, 16 nt, Pseudomonas aeruginosa PA01
ucgaacugcacccgcc

SEQ ID NO: 1522082 - RNA, 17 nt, Pseudomonas aeruginosa PA01
ucgaacgcgugaagcug

SEQ ID NO: 1522083 - RNA, 14 nt, Pseudomonas aeruginosa PA01
ucgaaccguggcgg

SEQ ID NO: 1522084 - RNA, 23 nt, Pseudomonas aeruginosa PA01
ucgaacgggacuuuccgaagccc

SEQ ID NO: 1522085 - RNA, 22 nt, Pseudomonas aeruginosa PA01
ucgaauggcgccggccagagcu

SEQ ID NO: 1522086 - RNA, 15 nt, Pseudomonas aeruginosa PA01
ucgaaugcugcccgg

SEQ ID NO: 1522087 - RNA, 22 nt, Pseudomonas aeruginosa PA01
ucgacaggucggcgaaauccuc

SEQ ID NO: 1522088 - RNA, 23 nt, Pseudomonas aeruginosa PA01
ucgacaggccauucuucuccaga

SEQ ID NO: 1522089 - RNA, 17 nt, Pseudomonas aeruginosa PA01
ucgaccacacaugcagg

SEQ ID NO: 1522090 - RNA, 16 nt, Pseudomonas aeruginosa PA01
ucgacaugcaccaggc

SEQ ID NO: 1522091 - RNA, 23 nt, Pseudomonas aeruginosa PA01
ucgacccgccgaccagcacggcg

SEQ ID NO: 1522092 - RNA, 20 nt, Pseudomonas aeruginosa PA01
ucgacccgcucgaggguguc

SEQ ID NO: 1522093 - RNA, 18 nt, Pseudomonas aeruginosa PA01
ucgaccgccugccagacc

SEQ ID NO: 1522094 - RNA, 15 nt, Pseudomonas aeruginosa PA01
ucgaccacgcucuug

SEQ ID NO: 1522095 - RNA, 22 nt, Pseudomonas aeruginosa PA01
ucgaccacggccuucggcagga

SEQ ID NO: 1522096 - RNA, 19 nt, Pseudomonas aeruginosa PA01
ucgaccagacgcagcagcu

SEQ ID NO: 1522097 - RNA, 23 nt, Pseudomonas aeruginosa PA01
ucgaccccgccggggcgugcagg

SEQ ID NO: 1522098 - RNA, 18 nt, Pseudomonas aeruginosa PA01
ucgaccagggcauccagg

SEQ ID NO: 1522099 - RNA, 14 nt, Pseudomonas aeruginosa PA01
ucgaccaucaccag

SEQ ID NO: 1522100 - RNA, 16 nt, Pseudomonas aeruginosa PA01
ucgaccaucaccagcg

SEQ ID NO: 1522101 - RNA, 11 nt, Pseudomonas aeruginosa PA01
ucgacccaugc

SEQ ID NO: 1522102 - RNA, 20 nt, Pseudomonas aeruginosa PA01
ucgacccaugccgcuagccc

SEQ ID NO: 1522103 - RNA, 14 nt, Pseudomonas aeruginosa PA01
ucgaccuggccacg

SEQ ID NO: 1522104 - RNA, 23 nt, Pseudomonas aeruginosa PA01
ucgacgaagggcucagcccaggc

SEQ ID NO: 1522105 - RNA, 20 nt, Pseudomonas aeruginosa PA01
ucgacgccagcucggccggc

SEQ ID NO: 1522106 - RNA, 13 nt, Pseudomonas aeruginosa PA01
ucgacgcccuggg

SEQ ID NO: 1522107 - RNA, 12 nt, Pseudomonas aeruginosa PA01
ucgacgccgaag

SEQ ID NO: 1522108 - RNA, 23 nt, Pseudomonas aeruginosa PA01
ucgacgaugcucgguugccaggc

SEQ ID NO: 1522109 - RNA, 19 nt, Pseudomonas aeruginosa PA01
ucgacgaugcugaacuguu

SEQ ID NO: 1522110 - RNA, 23 nt, Pseudomonas aeruginosa PA01
ucgacgaucaggugcaggaacag

SEQ ID NO: 1522111 - RNA, 15 nt, Pseudomonas aeruginosa PA01
ucgacgguuucaggc

SEQ ID NO: 1522112 - RNA, 22 nt, Pseudomonas aeruginosa PA01
ucgacgcugcuaggcuggaagc

SEQ ID NO: 1522113 - RNA, 13 nt, Pseudomonas aeruginosa PA01
ucgagcaccagca

SEQ ID NO: 1522114 - RNA, 16 nt, Pseudomonas aeruginosa PA01
ucgagcaccagcaggu

SEQ ID NO: 1522115 - RNA, 22 nt, Pseudomonas aeruginosa PA01
ucgagcaauugccagaggcugc

SEQ ID NO: 1522116 - RNA, 21 nt, Pseudomonas aeruginosa PA01
ucgagacccgcaacaccugua

SEQ ID NO: 1522117 - RNA, 20 nt, Pseudomonas aeruginosa PA01
ucgagacgccguagcgcagu

SEQ ID NO: 1522118 - RNA, 18 nt, Pseudomonas aeruginosa PA01
ucgagaaauaggcgcugc

SEQ ID NO: 1522119 - RNA, 22 nt, Pseudomonas aeruginosa PA01
ucgagaaagcgcaggaagcugc

SEQ ID NO: 1522120 - RNA, 22 nt, Pseudomonas aeruginosa PA01
ucgagaaggaagucgagcuggu

SEQ ID NO: 1522121 - RNA, 17 nt, Pseudomonas aeruginosa PA01
ucgacugcaugaccucc

SEQ ID NO: 1522122 - RNA, 20 nt, Pseudomonas aeruginosa PA01
ucgacugcuggguacgguug

SEQ ID NO: 1522123 - RNA, 17 nt, Pseudomonas aeruginosa PA01
ucgaggaaggccagcag

SEQ ID NO: 1522124 - RNA, 23 nt, Pseudomonas aeruginosa PA01
ucgagcuuguuggccagcagcca

SEQ ID NO: 1522125 - RNA, 20 nt, Pseudomonas aeruginosa PA01
ucgagcuggcgcaggccuuc

SEQ ID NO: 1522126 - RNA, 21 nt, Pseudomonas aeruginosa PA01
ucgagcacggcgcuggucucu

SEQ ID NO: 1522127 - RNA, 13 nt, Pseudomonas aeruginosa PA01
ucgagcagcgccg

SEQ ID NO: 1522128 - RNA, 13 nt, Pseudomonas aeruginosa PA01
ucgagcagcgcgc

SEQ ID NO: 1522129 - RNA, 18 nt, Pseudomonas aeruginosa PA01
ucgagcaguuccaggcgu

SEQ ID NO: 1522130 - RNA, 22 nt, Pseudomonas aeruginosa PA01
ucgagcaguucccccagcaccu

SEQ ID NO: 1522131 - RNA, 13 nt, Pseudomonas aeruginosa PA01
ucgagcaguuccg

SEQ ID NO: 1522132 - RNA, 18 nt, Pseudomonas aeruginosa PA01
ucgagcaguugcuggaug

SEQ ID NO: 1522133 - RNA, 17 nt, Pseudomonas aeruginosa PA01
ucgagcaucuccggcac

SEQ ID NO: 1522134 - RNA, 14 nt, Pseudomonas aeruginosa PA01
ucgagccuggccag

SEQ ID NO: 1522135 - RNA, 16 nt, Pseudomonas aeruginosa PA01
ucgagccuggccaggc

SEQ ID NO: 1522136 - RNA, 21 nt, Pseudomonas aeruginosa PA01
ucgagccuggccaggcgcucc

SEQ ID NO: 1522137 - RNA, 17 nt, Pseudomonas aeruginosa PA01
ucgaggucgacggcggc

SEQ ID NO: 1522138 - RNA, 22 nt, Pseudomonas aeruginosa PA01
ucgagggugucguagaggcugu

SEQ ID NO: 1522139 - RNA, 17 nt, Pseudomonas aeruginosa PA01
ucgagguagguccaggc

SEQ ID NO: 1522140 - RNA, 14 nt, Pseudomonas aeruginosa PA01
ucgaggccgcccag

SEQ ID NO: 1522141 - RNA, 19 nt, Pseudomonas aeruginosa PA01
ucgaggccgcccagcgcag

SEQ ID NO: 1522142 - RNA, 22 nt, Pseudomonas aeruginosa PA01
ucgagggcguccuugcccggcg

SEQ ID NO: 1522143 - RNA, 19 nt, Pseudomonas aeruginosa PA01
ucgagggcgaccgccaggc

SEQ ID NO: 1522144 - RNA, 19 nt, Pseudomonas aeruginosa PA01
ucgagggcgcguugcccag

SEQ ID NO: 1522145 - RNA, 18 nt, Pseudomonas aeruginosa PA01
ucgaguaagugccgacca

SEQ ID NO: 1522146 - RNA, 23 nt, Pseudomonas aeruginosa PA01
ucgagguuguagcccugggcgau

SEQ ID NO: 1522147 - RNA, 20 nt, Pseudomonas aeruginosa PA01
ucgaguaauuuuguggagua

SEQ ID NO: 1522148 - RNA, 23 nt, Pseudomonas aeruginosa PA01
ucgaucaccuuaguuaucacaac

SEQ ID NO: 1522149 - RNA, 16 nt, Pseudomonas aeruginosa PA01
ucgaucaccuugcccu

SEQ ID NO: 1522150 - RNA, 15 nt, Pseudomonas aeruginosa PA01
ucgaucacugccugg

SEQ ID NO: 1522151 - RNA, 22 nt, Pseudomonas aeruginosa PA01
ucgaucagcggguaacccaggg

SEQ ID NO: 1522152 - RNA, 21 nt, Pseudomonas aeruginosa PA01
ucgaucagccggcgcgcuucc

SEQ ID NO: 1522153 - RNA, 13 nt, Pseudomonas aeruginosa PA01
ucgaucagcagca

SEQ ID NO: 1522154 - RNA, 17 nt, Pseudomonas aeruginosa PA01
ucgaucaggaacacccg

SEQ ID NO: 1522155 - RNA, 23 nt, Pseudomonas aeruginosa PA01
ucgauauagcccugggcgccgcc

SEQ ID NO: 1522156 - RNA, 16 nt, Pseudomonas aeruginosa PA01
ucgauauccagcggca

SEQ ID NO: 1522157 - RNA, 19 nt, Pseudomonas aeruginosa PA01
ucgauggcagccuuggcca

SEQ ID NO: 1522158 - RNA, 23 nt, Pseudomonas aeruginosa PA01
ucgauggcagccuuggccacggc

SEQ ID NO: 1522159 - RNA, 17 nt, Pseudomonas aeruginosa PA01
ucgaugcuuagcccggg

SEQ ID NO: 1522160 - RNA, 15 nt, Pseudomonas aeruginosa PA01
ucgaugccgcgcgcc

SEQ ID NO: 1522161 - RNA, 18 nt, Pseudomonas aeruginosa PA01
ucgaugagccagccugca

SEQ ID NO: 1522162 - RNA, 14 nt, Pseudomonas aeruginosa PA01
ucgaugaauggcuu

SEQ ID NO: 1522163 - RNA, 21 nt, Pseudomonas aeruginosa PA01
ucgaugacguugcugcccugg

SEQ ID NO: 1522164 - RNA, 18 nt, Pseudomonas aeruginosa PA01
ucgaugaguugcagggcu

SEQ ID NO: 1522165 - RNA, 16 nt, Pseudomonas aeruginosa PA01
ucgaugcccgccagca

SEQ ID NO: 1522166 - RNA, 22 nt, Pseudomonas aeruginosa PA01
ucgaugcccgccagcaggcgcc

SEQ ID NO: 1522167 - RNA, 18 nt, Pseudomonas aeruginosa PA01
ucgaucucgaagaccagc

SEQ ID NO: 1522168 - RNA, 23 nt, Pseudomonas aeruginosa PA01
ucgaucugcucguccaggccgca

SEQ ID NO: 1522169 - RNA, 14 nt, Pseudomonas aeruginosa PA01
ucgaucuccuccuc

SEQ ID NO: 1522170 - RNA, 18 nt, Pseudomonas aeruginosa PA01
ucgaugaaacgcagggcc

SEQ ID NO: 1522171 - RNA, 18 nt, Pseudomonas aeruginosa PA01
ucgaucuggcugcccagg

SEQ ID NO: 1522172 - RNA, 17 nt, Pseudomonas aeruginosa PA01
ucgaucuugcccaugug

SEQ ID NO: 1522173 - RNA, 17 nt, Pseudomonas aeruginosa PA01
ucgauccgcuccagcag

SEQ ID NO: 1522174 - RNA, 18 nt, Pseudomonas aeruginosa PA01
ucgauggucaggcuggcc

SEQ ID NO: 1522175 - RNA, 20 nt, Pseudomonas aeruginosa PA01
ucgauggcgaagcgcuugcc

SEQ ID NO: 1522176 - RNA, 14 nt, Pseudomonas aeruginosa PA01
ucgauggcggccug

SEQ ID NO: 1522177 - RNA, 17 nt, Pseudomonas aeruginosa PA01
ucgcacggcgggacagg

SEQ ID NO: 1522178 - RNA, 18 nt, Pseudomonas aeruginosa PA01
ucgcaccuguuccagcaa

SEQ ID NO: 1522179 - RNA, 15 nt, Pseudomonas aeruginosa PA01
ucgcaccgccagcag

SEQ ID NO: 1522180 - RNA, 16 nt, Pseudomonas aeruginosa PA01
ucgcaccgccagcagu

SEQ ID NO: 1522181 - RNA, 16 nt, Pseudomonas aeruginosa PA01
ucgcaccaggccaggu

SEQ ID NO: 1522182 - RNA, 20 nt, Pseudomonas aeruginosa PA01
ucgcaccagccggccgcguc

SEQ ID NO: 1522183 - RNA, 21 nt, Pseudomonas aeruginosa PA01
ucgcaaguuacgcgcagcggu

SEQ ID NO: 1522184 - RNA, 20 nt, Pseudomonas aeruginosa PA01
ucgcagagaucggcggcgcg

SEQ ID NO: 1522185 - RNA, 15 nt, Pseudomonas aeruginosa PA01
ucgcagagcgccagc

SEQ ID NO: 1522186 - RNA, 16 nt, Pseudomonas aeruginosa PA01
ucgcagagcgccagcc

SEQ ID NO: 1522187 - RNA, 18 nt, Pseudomonas aeruginosa PA01
ucgcauagccggcgcgcc

SEQ ID NO: 1522188 - RNA, 22 nt, Pseudomonas aeruginosa PA01
ucgcagcggccccgagcgggcc

SEQ ID NO: 1522189 - RNA, 15 nt, Pseudomonas aeruginosa PA01
ucgcaggcagcgcgc

SEQ ID NO: 1522190 - RNA, 18 nt, Pseudomonas aeruginosa PA01
ucgcagcgcggucauccg

SEQ ID NO: 1522191 - RNA, 21 nt, Pseudomonas aeruginosa PA01
ucgcagcgcggucauccgccc

SEQ ID NO: 1522192 - RNA, 22 nt, Pseudomonas aeruginosa PA01
ucgcagcgcuccuuucccagcg

SEQ ID NO: 1522193 - RNA, 18 nt, Pseudomonas aeruginosa PA01
ucgcagcuccagcggaau

SEQ ID NO: 1522194 - RNA, 14 nt, Pseudomonas aeruginosa PA01
ucgcaggccaggcc

SEQ ID NO: 1522195 - RNA, 23 nt, Pseudomonas aeruginosa PA01
ucgcaggccaggccccagggccg

SEQ ID NO: 1522196 - RNA, 18 nt, Pseudomonas aeruginosa PA01
ucgcaggcucaguucggc

SEQ ID NO: 1522197 - RNA, 16 nt, Pseudomonas aeruginosa PA01
uccggcucagccgcug

SEQ ID NO: 1522198 - RNA, 22 nt, Pseudomonas aeruginosa PA01
uccggcuggacgugcaggauca

SEQ ID NO: 1522199 - RNA, 13 nt, Pseudomonas aeruginosa PA01
uccggcuggcgcc

SEQ ID NO: 1522200 - RNA, 18 nt, Pseudomonas aeruginosa PA01
uccggcgaaguccggguu

SEQ ID NO: 1522201 - RNA, 14 nt, Pseudomonas aeruginosa PA01
uccggcgccaggcc

SEQ ID NO: 1522202 - RNA, 21 nt, Pseudomonas aeruginosa PA01
uccggcgcugccgaacagcag

SEQ ID NO: 1522203 - RNA, 15 nt, Pseudomonas aeruginosa PA01
uccggcgcggccugc

SEQ ID NO: 1522204 - RNA, 15 nt, Pseudomonas aeruginosa PA01
uccggcgccgggcug

SEQ ID NO: 1522205 - RNA, 14 nt, Pseudomonas aeruginosa PA01
uccggcgccgaggu

SEQ ID NO: 1522206 - RNA, 19 nt, Pseudomonas aeruginosa PA01
uccggcgccgagguaguag

SEQ ID NO: 1522207 - RNA, 20 nt, Pseudomonas aeruginosa PA01
uccggucccagguagcgcug

SEQ ID NO: 1522208 - RNA, 19 nt, Pseudomonas aeruginosa PA01
uccggucagcagcaggguc

SEQ ID NO: 1522209 - RNA, 17 nt, Pseudomonas aeruginosa PA01
uccgguacugcugggcc

SEQ ID NO: 1522210 - RNA, 17 nt, Pseudomonas aeruginosa PA01
uccgggucgaggcugcc

SEQ ID NO: 1522211 - RNA, 15 nt, Pseudomonas aeruginosa PA01
uccgggucgcugccc

SEQ ID NO: 1522212 - RNA, 19 nt, Pseudomonas aeruginosa PA01
uccggguugacccagagcc

SEQ ID NO: 1522213 - RNA, 15 nt, Pseudomonas aeruginosa PA01
uccggguugaccgcc

SEQ ID NO: 1522214 - RNA, 14 nt, Pseudomonas aeruginosa PA01
uccggguccagcgg

SEQ ID NO: 1522215 - RNA, 17 nt, Pseudomonas aeruginosa PA01
uccgggcccgugcggca

SEQ ID NO: 1522216 - RNA, 14 nt, Pseudomonas aeruginosa PA01
uccgggcagcggcg

SEQ ID NO: 1522217 - RNA, 21 nt, Pseudomonas aeruginosa PA01
uccggcuugccgaugucgccg

SEQ ID NO: 1522218 - RNA, 18 nt, Pseudomonas aeruginosa PA01
uccgggcugcgcucggcg

SEQ ID NO: 1522219 - RNA, 20 nt, Pseudomonas aeruginosa PA01
uccgggcuccaccaguagcc

SEQ ID NO: 1522220 - RNA, 19 nt, Pseudomonas aeruginosa PA01
uccgggcuggccaccagca

SEQ ID NO: 1522221 - RNA, 16 nt, Pseudomonas aeruginosa PA01
uccgggccgagggcug

SEQ ID NO: 1522222 - RNA, 17 nt, Pseudomonas aeruginosa PA01
uccgggccgagggcuga

SEQ ID NO: 1522223 - RNA, 19 nt, Pseudomonas aeruginosa PA01
uccgcuucagcgcgccgag

SEQ ID NO: 1522224 - RNA, 13 nt, Pseudomonas aeruginosa PA01
uccgcuggccugc

SEQ ID NO: 1522225 - RNA, 18 nt, Pseudomonas aeruginosa PA01
uccgcugguagcccaggc

SEQ ID NO: 1522226 - RNA, 14 nt, Pseudomonas aeruginosa PA01
uccgcucugcuggc

SEQ ID NO: 1522227 - RNA, 16 nt, Pseudomonas aeruginosa PA01
uccggacgcugcaugc

SEQ ID NO: 1522228 - RNA, 18 nt, Pseudomonas aeruginosa PA01
uccggaguucgcccgccc

SEQ ID NO: 1522229 - RNA, 16 nt, Pseudomonas aeruginosa PA01
uccggacugcccagcg

SEQ ID NO: 1522230 - RNA, 20 nt, Pseudomonas aeruginosa PA01
uccggaugcagauccagcgg

SEQ ID NO: 1522231 - RNA, 17 nt, Pseudomonas aeruginosa PA01
uccggauggcugacccg

SEQ ID NO: 1522232 - RNA, 15 nt, Pseudomonas aeruginosa PA01
uccggcaugcuugcc

SEQ ID NO: 1522233 - RNA, 16 nt, Pseudomonas aeruginosa PA01
uccggcccggccaggc

SEQ ID NO: 1522234 - RNA, 16 nt, Pseudomonas aeruginosa PA01
uccggcccggccaggu

SEQ ID NO: 1522235 - RNA, 12 nt, Pseudomonas aeruginosa PA01
uccggccaggcg

SEQ ID NO: 1522236 - RNA, 15 nt, Pseudomonas aeruginosa PA01
uccggcagccagccg

SEQ ID NO: 1522237 - RNA, 21 nt, Pseudomonas aeruginosa PA01
uccggcagcacccgcaccagc

SEQ ID NO: 1522238 - RNA, 19 nt, Pseudomonas aeruginosa PA01
uccggcaccgcucugcagu

SEQ ID NO: 1522239 - RNA, 19 nt, Pseudomonas aeruginosa PA01
uccggcacgaacgaggcuc

SEQ ID NO: 1522240 - RNA, 14 nt, Pseudomonas aeruginosa PA01
uccggcacgcugcc

SEQ ID NO: 1522241 - RNA, 19 nt, Pseudomonas aeruginosa PA01
uccgucucaggcgccaggc

SEQ ID NO: 1522242 - RNA, 21 nt, Pseudomonas aeruginosa PA01
uccgucuguucggccagggag

SEQ ID NO: 1522243 - RNA, 22 nt, Pseudomonas aeruginosa PA01
uccgugcgccgggcuugcaauc

SEQ ID NO: 1522244 - RNA, 18 nt, Pseudomonas aeruginosa PA01
uccgguucggcaaggcgc

SEQ ID NO: 1522245 - RNA, 15 nt, Pseudomonas aeruginosa PA01
uccggugccagggcg

SEQ ID NO: 1522246 - RNA, 18 nt, Pseudomonas aeruginosa PA01
uccuacacgacccaccau

SEQ ID NO: 1522247 - RNA, 18 nt, Pseudomonas aeruginosa PA01
uccugcaacgccuggugc

SEQ ID NO: 1522248 - RNA, 14 nt, Pseudomonas aeruginosa PA01
uccugcaacugacg

SEQ ID NO: 1522249 - RNA, 13 nt, Pseudomonas aeruginosa PA01
uccugcaacugga

SEQ ID NO: 1522250 - RNA, 14 nt, Pseudomonas aeruginosa PA01
uccugcaacuggaa

SEQ ID NO: 1522251 - RNA, 20 nt, Pseudomonas aeruginosa PA01
uccugaugaaucgccucccu

SEQ ID NO: 1522252 - RNA, 17 nt, Pseudomonas aeruginosa PA01
uccugaccccggccugg

SEQ ID NO: 1522253 - RNA, 18 nt, Pseudomonas aeruginosa PA01
uccugaccccggccuggc

SEQ ID NO: 1522254 - RNA, 15 nt, Pseudomonas aeruginosa PA01
uccugaggcucccag

SEQ ID NO: 1522255 - RNA, 16 nt, Pseudomonas aeruginosa PA01
uccugaaggaccagcu

SEQ ID NO: 1522256 - RNA, 20 nt, Pseudomonas aeruginosa PA01
uccugaaggcgcggggcgag

SEQ ID NO: 1522257 - RNA, 16 nt, Pseudomonas aeruginosa PA01
uccucgcccucauggc

SEQ ID NO: 1522258 - RNA, 19 nt, Pseudomonas aeruginosa PA01
uccucgccgcuccgcgcca

SEQ ID NO: 1522259 - RNA, 13 nt, Pseudomonas aeruginosa PA01
uccucgaucaggc

SEQ ID NO: 1522260 - RNA, 22 nt, Pseudomonas aeruginosa PA01
uccucgcggaagcguugcucga

SEQ ID NO: 1522261 - RNA, 18 nt, Pseudomonas aeruginosa PA01
uccucgcuccagaggaac

SEQ ID NO: 1522262 - RNA, 14 nt, Pseudomonas aeruginosa PA01
uccucggagagcag

SEQ ID NO: 1522263 - RNA, 16 nt, Pseudomonas aeruginosa PA01
uccucggagagcagcc

SEQ ID NO: 1522264 - RNA, 15 nt, Pseudomonas aeruginosa PA01
uccucgaacaacugg

SEQ ID NO: 1522265 - RNA, 20 nt, Pseudomonas aeruginosa PA01
uccucgacauggaucaccgc

SEQ ID NO: 1522266 - RNA, 22 nt, Pseudomonas aeruginosa PA01
uccucgacauggaucaccgcca

SEQ ID NO: 1522267 - RNA, 16 nt, Pseudomonas aeruginosa PA01
uccuccuccaguuccu

SEQ ID NO: 1522268 - RNA, 19 nt, Pseudomonas aeruginosa PA01
uccucguggcgcgccgcua

SEQ ID NO: 1522269 - RNA, 22 nt, Pseudomonas aeruginosa PA01
uccucguccagcaggcccagcc

SEQ ID NO: 1522270 - RNA, 18 nt, Pseudomonas aeruginosa PA01
uccucggccgacaggcug

SEQ ID NO: 1522271 - RNA, 13 nt, Pseudomonas aeruginosa PA01
uccucggccgcca

SEQ ID NO: 1522272 - RNA, 17 nt, Pseudomonas aeruginosa PA01
uccucggccgccaggcg

SEQ ID NO: 1522273 - RNA, 20 nt, Pseudomonas aeruginosa PA01
uccucggcggccuuuucggc

SEQ ID NO: 1522274 - RNA, 18 nt, Pseudomonas aeruginosa PA01
uccucggcguagccggcc

SEQ ID NO: 1522275 - RNA, 16 nt, Pseudomonas aeruginosa PA01
uccucggccugggcgc

SEQ ID NO: 1522276 - RNA, 16 nt, Pseudomonas aeruginosa PA01
uccucggugucggcca

SEQ ID NO: 1522277 - RNA, 14 nt, Pseudomonas aeruginosa PA01
uccucggccaugcc

SEQ ID NO: 1522278 - RNA, 12 nt, Pseudomonas aeruginosa PA01
uccuccugggcc

SEQ ID NO: 1522279 - RNA, 20 nt, Pseudomonas aeruginosa PA01
uccuccugggccgacgcuuc

SEQ ID NO: 1522280 - RNA, 16 nt, Pseudomonas aeruginosa PA01
uccucccaugaaaaau

SEQ ID NO: 1522281 - RNA, 15 nt, Pseudomonas aeruginosa PA01
uccuccagcgccgca

SEQ ID NO: 1522282 - RNA, 16 nt, Pseudomonas aeruginosa PA01
uccuccaggaccagga

SEQ ID NO: 1522283 - RNA, 13 nt, Pseudomonas aeruginosa PA01
uccuccaguuccu

SEQ ID NO: 1522284 - RNA, 18 nt, Pseudomonas aeruginosa PA01
uccucccgccccuccagu

SEQ ID NO: 1522285 - RNA, 22 nt, Pseudomonas aeruginosa PA01
uccucccgccccuccaguuccu

SEQ ID NO: 1522286 - RNA, 18 nt, Pseudomonas aeruginosa PA01
uccuccgacgccccccac

SEQ ID NO: 1522287 - RNA, 14 nt, Pseudomonas aeruginosa PA01
uccuccgccccggc

SEQ ID NO: 1522288 - RNA, 23 nt, Pseudomonas aeruginosa PA01
uccuccagcagacggcuguuguc

SEQ ID NO: 1522289 - RNA, 10 nt, Pseudomonas aeruginosa PA01
uccucagugc

SEQ ID NO: 1522290 - RNA, 14 nt, Pseudomonas aeruginosa PA01
uccugcacgcugcg

SEQ ID NO: 1522291 - RNA, 18 nt, Pseudomonas aeruginosa PA01
uccugcagauaaagcugg

SEQ ID NO: 1522292 - RNA, 19 nt, Pseudomonas aeruginosa PA01
uccugcaggcucagcaccu

SEQ ID NO: 1522293 - RNA, 21 nt, Pseudomonas aeruginosa PA01
uccugcaggcucagcaccuug

SEQ ID NO: 1522294 - RNA, 23 nt, Pseudomonas aeruginosa PA01
uccugcggauucaucggcggcag

SEQ ID NO: 1522295 - RNA, 22 nt, Pseudomonas aeruginosa PA01
uccugcggccggguguuguucu

SEQ ID NO: 1522296 - RNA, 21 nt, Pseudomonas aeruginosa PA01
uccugcggcuggcgaaccagu

SEQ ID NO: 1522297 - RNA, 23 nt, Pseudomonas aeruginosa PA01
uccugcggcuggcgaaccagucc

SEQ ID NO: 1522298 - RNA, 15 nt, Pseudomonas aeruginosa PA01
uccugcggcuugccc

SEQ ID NO: 1522299 - RNA, 12 nt, Pseudomonas aeruginosa PA01
uccugccgccga

SEQ ID NO: 1522300 - RNA, 16 nt, Pseudomonas aeruginosa PA01
uccugcuuccagaccu

SEQ ID NO: 1522301 - RNA, 13 nt, Pseudomonas aeruginosa PA01
uccugcuugaccu

SEQ ID NO: 1522302 - RNA, 14 nt, Pseudomonas aeruginosa PA01
uccuggaaagaccg

SEQ ID NO: 1522303 - RNA, 19 nt, Pseudomonas aeruginosa PA01
uccuggaccccgcccuagc

SEQ ID NO: 1522304 - RNA, 16 nt, Pseudomonas aeruginosa PA01
uccugcuggcuggcag

SEQ ID NO: 1522305 - RNA, 19 nt, Pseudomonas aeruginosa PA01
uccugcugggcgucgaaca

SEQ ID NO: 1522306 - RNA, 11 nt, Pseudomonas aeruginosa PA01
uccugcugcug

SEQ ID NO: 1522307 - RNA, 20 nt, Pseudomonas aeruginosa PA01
uccugcugagcagucgccug

SEQ ID NO: 1522308 - RNA, 15 nt, Pseudomonas aeruginosa PA01
uccuggcccuggaua

SEQ ID NO: 1522309 - RNA, 12 nt, Pseudomonas aeruginosa PA01
uccuggcaggcu

SEQ ID NO: 1522310 - RNA, 13 nt, Pseudomonas aeruginosa PA01
uccuggccgaccc

SEQ ID NO: 1522311 - RNA, 12 nt, Pseudomonas aeruginosa PA01
uccuggccggcg

SEQ ID NO: 1522312 - RNA, 13 nt, Pseudomonas aeruginosa PA01
uccuggccggcgu

SEQ ID NO: 1522313 - RNA, 23 nt, Pseudomonas aeruginosa PA01
uccuggagguagcugcgccgccu

SEQ ID NO: 1522314 - RNA, 17 nt, Pseudomonas aeruginosa PA01
uccuggcgcaugucgcg

SEQ ID NO: 1522315 - RNA, 21 nt, Pseudomonas aeruginosa PA01
uccuggcgcguacgcccgcag

SEQ ID NO: 1522316 - RNA, 16 nt, Pseudomonas aeruginosa PA01
uccuggcgguucuggg

SEQ ID NO: 1522317 - RNA, 21 nt, Pseudomonas aeruginosa PA01
uccuucaucuuggcccauucg

SEQ ID NO: 1522318 - RNA, 18 nt, Pseudomonas aeruginosa PA01
uccuuauucggcccaugc

SEQ ID NO: 1522319 - RNA, 20 nt, Pseudomonas aeruginosa PA01
uccuguuucugcuguggagc

SEQ ID NO: 1522320 - RNA, 22 nt, Pseudomonas aeruginosa PA01
uccuguucgcugccuuccuuuu

SEQ ID NO: 1522321 - RNA, 20 nt, Pseudomonas aeruginosa PA01
uccuguggauaaaaaggccc

SEQ ID NO: 1522322 - RNA, 15 nt, Pseudomonas aeruginosa PA01
uccuguccauuucca

SEQ ID NO: 1522323 - RNA, 20 nt, Pseudomonas aeruginosa PA01
uccuguaguacaugacgaag

SEQ ID NO: 1522324 - RNA, 16 nt, Pseudomonas aeruginosa PA01
uccugggcggucucgg

SEQ ID NO: 1522325 - RNA, 17 nt, Pseudomonas aeruginosa PA01
uccugggcgugcuuggc

SEQ ID NO: 1522326 - RNA, 21 nt, Pseudomonas aeruginosa PA01
uccugggagaacuuuucccag

SEQ ID NO: 1522327 - RNA, 23 nt, Pseudomonas aeruginosa PA01
uccugggagaacuuuucccagcg

SEQ ID NO: 1522328 - RNA, 21 nt, Pseudomonas aeruginosa PA01
uccuggguccgguacugcugg

SEQ ID NO: 1522329 - RNA, 18 nt, Pseudomonas aeruginosa PA01
uccugggucgacugcugg

SEQ ID NO: 1522330 - RNA, 20 nt, Pseudomonas aeruginosa PA01
uccugguggaacagccgcag

SEQ ID NO: 1522331 - RNA, 22 nt, Pseudomonas aeruginosa PA01
uccugguggaacagccgcagcg

SEQ ID NO: 1522332 - RNA, 19 nt, Pseudomonas aeruginosa PA01
uccuggucgcguuccagcu

SEQ ID NO: 1522333 - RNA, 15 nt, Pseudomonas aeruginosa PA01
ucccagaaaaucggc

SEQ ID NO: 1522334 - RNA, 22 nt, Pseudomonas aeruginosa PA01
ucccagaagucgcuggccuggg

SEQ ID NO: 1522335 - RNA, 17 nt, Pseudomonas aeruginosa PA01
ucccagaccagcagcgg

SEQ ID NO: 1522336 - RNA, 15 nt, Pseudomonas aeruginosa PA01
ucccagaccuggccg

SEQ ID NO: 1522337 - RNA, 20 nt, Pseudomonas aeruginosa PA01
ucccagaccuggccgcugug

SEQ ID NO: 1522338 - RNA, 18 nt, Pseudomonas aeruginosa PA01
ucccagacguccagcgcc

SEQ ID NO: 1522339 - RNA, 17 nt, Pseudomonas aeruginosa PA01
ucccagauaccggcguu

SEQ ID NO: 1522340 - RNA, 11 nt, Pseudomonas aeruginosa PA01
ucccagcagca

SEQ ID NO: 1522341 - RNA, 14 nt, Pseudomonas aeruginosa PA01
ucccagcagcgccu

SEQ ID NO: 1522342 - RNA, 16 nt, Pseudomonas aeruginosa PA01
ucccagccgaggcagc

SEQ ID NO: 1522343 - RNA, 23 nt, Pseudomonas aeruginosa PA01
ucccagguagcgcugcgccaggc

SEQ ID NO: 1522344 - RNA, 16 nt, Pseudomonas aeruginosa PA01
ucccaggugcccugga

SEQ ID NO: 1522345 - RNA, 17 nt, Pseudomonas aeruginosa PA01
ucccaggccagcgggcu

SEQ ID NO: 1522346 - RNA, 13 nt, Pseudomonas aeruginosa PA01
ucccaucagcagu

SEQ ID NO: 1522347 - RNA, 21 nt, Pseudomonas aeruginosa PA01
ucccaugaccgucagccaggc

SEQ ID NO: 1522348 - RNA, 21 nt, Pseudomonas aeruginosa PA01
ucccaugagcgacccaacggg

SEQ ID NO: 1522349 - RNA, 16 nt, Pseudomonas aeruginosa PA01
ucccauauggaaguuc

SEQ ID NO: 1522350 - RNA, 13 nt, Pseudomonas aeruginosa PA01
ucccccagcaccu

SEQ ID NO: 1522351 - RNA, 14 nt, Pseudomonas aeruginosa PA01
ucccccgccccuca

SEQ ID NO: 1522352 - RNA, 12 nt, Pseudomonas aeruginosa PA01
ucccccgcgccg

SEQ ID NO: 1522353 - RNA, 17 nt, Pseudomonas aeruginosa PA01
uccccaacccggccagc

SEQ ID NO: 1522354 - RNA, 15 nt, Pseudomonas aeruginosa PA01
uccccagacccucuc

SEQ ID NO: 1522355 - RNA, 16 nt, Pseudomonas aeruginosa PA01
uccccagacccucucc

SEQ ID NO: 1522356 - RNA, 17 nt, Pseudomonas aeruginosa PA01
uccccagacccucuccc

SEQ ID NO: 1522357 - RNA, 18 nt, Pseudomonas aeruginosa PA01
uccccagacccucucccu

SEQ ID NO: 1522358 - RNA, 16 nt, Pseudomonas aeruginosa PA01
uccccaaggcacgccc

SEQ ID NO: 1522359 - RNA, 20 nt, Pseudomonas aeruginosa PA01
uccccaaggcacgccccauc

SEQ ID NO: 1522360 - RNA, 14 nt, Pseudomonas aeruginosa PA01
uccccaaccuucuc

SEQ ID NO: 1522361 - RNA, 15 nt, Pseudomonas aeruginosa PA01
uccccaaccuucucc

SEQ ID NO: 1522362 - RNA, 14 nt, Pseudomonas aeruginosa PA01
uccccgucccucag

SEQ ID NO: 1522363 - RNA, 17 nt, Pseudomonas aeruginosa PA01
uccccgcaccugccguc

SEQ ID NO: 1522364 - RNA, 22 nt, Pseudomonas aeruginosa PA01
ucccgaggcgaucgccgcggcg

SEQ ID NO: 1522365 - RNA, 22 nt, Pseudomonas aeruginosa PA01
ucccgaggguggcgcuggccaa

SEQ ID NO: 1522366 - RNA, 15 nt, Pseudomonas aeruginosa PA01
ucccgaguucaccac

SEQ ID NO: 1522367 - RNA, 20 nt, Pseudomonas aeruginosa PA01
uccccucaggcgccgcuguc

SEQ ID NO: 1522368 - RNA, 14 nt, Pseudomonas aeruginosa PA01
uccccuccagguag

SEQ ID NO: 1522369 - RNA, 14 nt, Pseudomonas aeruginosa PA01
uccccuggcccugc

SEQ ID NO: 1522370 - RNA, 22 nt, Pseudomonas aeruginosa PA01
uccccuguggucaggcgccagg

SEQ ID NO: 1522371 - RNA, 23 nt, Pseudomonas aeruginosa PA01
uccccuguggucaggcgccagga

SEQ ID NO: 1522372 - RNA, 18 nt, Pseudomonas aeruginosa PA01
uccccuucgucuaguggc

SEQ ID NO: 1522373 - RNA, 14 nt, Pseudomonas aeruginosa PA01
uccccuuuuuucag

SEQ ID NO: 1522374 - RNA, 17 nt, Pseudomonas aeruginosa PA01
ucccgugccgggccagc

SEQ ID NO: 1522375 - RNA, 23 nt, Pseudomonas aeruginosa PA01
ucccgugggucguugagggcacg

SEQ ID NO: 1522376 - RNA, 16 nt, Pseudomonas aeruginosa PA01
ucccguaaggccaggc

SEQ ID NO: 1522377 - RNA, 17 nt, Pseudomonas aeruginosa PA01
ucccguaaggccaggcu

SEQ ID NO: 1522378 - RNA, 16 nt, Pseudomonas aeruginosa PA01
ucccguaccagcgcga

SEQ ID NO: 1522379 - RNA, 15 nt, Pseudomonas aeruginosa PA01
ucccggguucugcuc

SEQ ID NO: 1522380 - RNA, 19 nt, Pseudomonas aeruginosa PA01
ucccgggccagcuccgccu

SEQ ID NO: 1522381 - RNA, 21 nt, Pseudomonas aeruginosa PA01
ucccgggguugcccagcaggc

SEQ ID NO: 1522382 - RNA, 22 nt, Pseudomonas aeruginosa PA01
ucccgggguugcccagcaggcu

SEQ ID NO: 1522383 - RNA, 19 nt, Pseudomonas aeruginosa PA01
ucccgggaaaccaccagga

SEQ ID NO: 1522384 - RNA, 23 nt, Pseudomonas aeruginosa PA01
ucccggcgcggcuacccucuccc

SEQ ID NO: 1522385 - RNA, 16 nt, Pseudomonas aeruginosa PA01
ucccggacgggugcgc

SEQ ID NO: 1522386 - RNA, 13 nt, Pseudomonas aeruginosa PA01
ucccgcgcggccc

SEQ ID NO: 1522387 - RNA, 22 nt, Pseudomonas aeruginosa PA01
ucccgcgauaucacgccccucc

SEQ ID NO: 1522388 - RNA, 22 nt, Pseudomonas aeruginosa PA01
ucccgcaguagcucgccgaggu

SEQ ID NO: 1522389 - RNA, 19 nt, Pseudomonas aeruginosa PA01
ucccgccccuccaguuccu

SEQ ID NO: 1522390 - RNA, 18 nt, Pseudomonas aeruginosa PA01
ucccgcaccggcgcgccg

SEQ ID NO: 1522391 - RNA, 18 nt, Pseudomonas aeruginosa PA01
ucccgccgcucugcuggc

SEQ ID NO: 1522392 - RNA, 12 nt, Pseudomonas aeruginosa PA01
ucccgcccccuc

SEQ ID NO: 1522393 - RNA, 11 nt, Pseudomonas aeruginosa PA01
ucccgccgccg

SEQ ID NO: 1522394 - RNA, 13 nt, Pseudomonas aeruginosa PA01
ucccgccgcggcg

SEQ ID NO: 1522395 - RNA, 15 nt, Pseudomonas aeruginosa PA01
ucccucaaccggcgu

SEQ ID NO: 1522396 - RNA, 19 nt, Pseudomonas aeruginosa PA01
ucccucgucaucauccuga

SEQ ID NO: 1522397 - RNA, 12 nt, Pseudomonas aeruginosa PA01
ucccugaaggga

SEQ ID NO: 1522398 - RNA, 17 nt, Pseudomonas aeruginosa PA01
ucccuucagggagagga

SEQ ID NO: 1522399 - RNA, 12 nt, Pseudomonas aeruginosa PA01
ucccuucuuuua

SEQ ID NO: 1522400 - RNA, 19 nt, Pseudomonas aeruginosa PA01
ucccuggcgacgucccuuc

SEQ ID NO: 1522401 - RNA, 23 nt, Pseudomonas aeruginosa PA01
ucccuggccggcgauggccgccu

SEQ ID NO: 1522402 - RNA, 17 nt, Pseudomonas aeruginosa PA01
ucccugggccugcaggu

SEQ ID NO: 1522403 - RNA, 16 nt, Pseudomonas aeruginosa PA01
ucccuguacgcaggag

SEQ ID NO: 1522404 - RNA, 13 nt, Pseudomonas aeruginosa PA01
ucccugucccgcc

SEQ ID NO: 1522405 - RNA, 19 nt, Pseudomonas aeruginosa PA01
ucccugcucgcgcaggguc

SEQ ID NO: 1522406 - RNA, 22 nt, Pseudomonas aeruginosa PA01
ucccugcaauggggcggccggc

SEQ ID NO: 1522407 - RNA, 23 nt, Pseudomonas aeruginosa PA01
ucccugcacagggacgcggcguu

SEQ ID NO: 1522408 - RNA, 21 nt, Pseudomonas aeruginosa PA01
uccgacaaggagcgcgagcgg

SEQ ID NO: 1522409 - RNA, 22 nt, Pseudomonas aeruginosa PA01
uccgaauacugcacgcccaggc

SEQ ID NO: 1522410 - RNA, 13 nt, Pseudomonas aeruginosa PA01
uccgaaucgccua

SEQ ID NO: 1522411 - RNA, 12 nt, Pseudomonas aeruginosa PA01
ucccuuuuucau

SEQ ID NO: 1522412 - RNA, 19 nt, Pseudomonas aeruginosa PA01
uccgaacagggcgaaggcc

SEQ ID NO: 1522413 - RNA, 12 nt, Pseudomonas aeruginosa PA01
ucccuucuuuuu

SEQ ID NO: 1522414 - RNA, 19 nt, Pseudomonas aeruginosa PA01
ucccuuguuuuccuggccc

SEQ ID NO: 1522415 - RNA, 14 nt, Pseudomonas aeruginosa PA01
ucccuuggcugcuc

SEQ ID NO: 1522416 - RNA, 14 nt, Pseudomonas aeruginosa PA01
uccgagacgcugca

SEQ ID NO: 1522417 - RNA, 12 nt, Pseudomonas aeruginosa PA01
uccgagcaggcc

SEQ ID NO: 1522418 - RNA, 13 nt, Pseudomonas aeruginosa PA01
uccgagcaggccu

SEQ ID NO: 1522419 - RNA, 22 nt, Pseudomonas aeruginosa PA01
uccgagcaggccuugcagggcc

SEQ ID NO: 1522420 - RNA, 20 nt, Pseudomonas aeruginosa PA01
uccgaggauaccgcacggcc

SEQ ID NO: 1522421 - RNA, 16 nt, Pseudomonas aeruginosa PA01
uccgccucgcugagca

SEQ ID NO: 1522422 - RNA, 12 nt, Pseudomonas aeruginosa PA01
uccgccugggac

SEQ ID NO: 1522423 - RNA, 17 nt, Pseudomonas aeruginosa PA01
uccgccugguccagcag

SEQ ID NO: 1522424 - RNA, 18 nt, Pseudomonas aeruginosa PA01
uccgccugguccagcagg

SEQ ID NO: 1522425 - RNA, 21 nt, Pseudomonas aeruginosa PA01
uccgccggucaccacuggaaa

SEQ ID NO: 1522426 - RNA, 14 nt, Pseudomonas aeruginosa PA01
uccgccgggccgcc

SEQ ID NO: 1522427 - RNA, 13 nt, Pseudomonas aeruginosa PA01
uccgccgcucacc

SEQ ID NO: 1522428 - RNA, 15 nt, Pseudomonas aeruginosa PA01
uccgccgcuggggac

SEQ ID NO: 1522429 - RNA, 22 nt, Pseudomonas aeruginosa PA01
uccgccggcgaugcccaggccg

SEQ ID NO: 1522430 - RNA, 16 nt, Pseudomonas aeruginosa PA01
uccgccggcgccgccu

SEQ ID NO: 1522431 - RNA, 17 nt, Pseudomonas aeruginosa PA01
uccgccggcgccgccuc

SEQ ID NO: 1522432 - RNA, 19 nt, Pseudomonas aeruginosa PA01
uccgccggcugugcagggc

SEQ ID NO: 1522433 - RNA, 20 nt, Pseudomonas aeruginosa PA01
uccgccggcugugcagggca

SEQ ID NO: 1522434 - RNA, 21 nt, Pseudomonas aeruginosa PA01
uccgccgaaaagaaaaggcca

SEQ ID NO: 1522435 - RNA, 19 nt, Pseudomonas aeruginosa PA01
uccgccgauugugcagggc

SEQ ID NO: 1522436 - RNA, 20 nt, Pseudomonas aeruginosa PA01
uccgccgauugugcagggcc

SEQ ID NO: 1522437 - RNA, 18 nt, Pseudomonas aeruginosa PA01
uccgccgaauauuuccca

SEQ ID NO: 1522438 - RNA, 15 nt, Pseudomonas aeruginosa PA01
uccgccgccguggcu

SEQ ID NO: 1522439 - RNA, 13 nt, Pseudomonas aeruginosa PA01
uccgccgccgacg

SEQ ID NO: 1522440 - RNA, 22 nt, Pseudomonas aeruginosa PA01
uccgcccaguucgccggccagc

SEQ ID NO: 1522441 - RNA, 22 nt, Pseudomonas aeruginosa PA01
uccgcccaguucuucgccgccc

SEQ ID NO: 1522442 - RNA, 15 nt, Pseudomonas aeruginosa PA01
uccgcgcccaggcug

SEQ ID NO: 1522443 - RNA, 16 nt, Pseudomonas aeruginosa PA01
uccgcgcaacccuuca

SEQ ID NO: 1522444 - RNA, 22 nt, Pseudomonas aeruginosa PA01
uccgcgcaggcggucgccgaac

SEQ ID NO: 1522445 - RNA, 17 nt, Pseudomonas aeruginosa PA01
uccgcgauagcucaguc

SEQ ID NO: 1522446 - RNA, 14 nt, Pseudomonas aeruginosa PA01
uccgcgccgcggcg

SEQ ID NO: 1522447 - RNA, 14 nt, Pseudomonas aeruginosa PA01
uccgcgccacgcuc

SEQ ID NO: 1522448 - RNA, 20 nt, Pseudomonas aeruginosa PA01
uccgcgcgaucgaggccuac

SEQ ID NO: 1522449 - RNA, 19 nt, Pseudomonas aeruginosa PA01
uccgcgcggcgcccugccg

SEQ ID NO: 1522450 - RNA, 19 nt, Pseudomonas aeruginosa PA01
uccgcggaucguccgggcg

SEQ ID NO: 1522451 - RNA, 16 nt, Pseudomonas aeruginosa PA01
uccgcggccccggcgu

SEQ ID NO: 1522452 - RNA, 22 nt, Pseudomonas aeruginosa PA01
uccgcggcccugcucgccggcg

SEQ ID NO: 1522453 - RNA, 10 nt, Pseudomonas aeruginosa PA01
uccgcggccg

SEQ ID NO: 1522454 - RNA, 12 nt, Pseudomonas aeruginosa PA01
uccgcguggcgu

SEQ ID NO: 1522455 - RNA, 15 nt, Pseudomonas aeruginosa PA01
uccgcuccagcgccu

SEQ ID NO: 1522456 - RNA, 14 nt, Pseudomonas aeruginosa PA01
uccgcuccaggcug

SEQ ID NO: 1522457 - RNA, 22 nt, Pseudomonas aeruginosa PA01
uccgcgguagcugcgcagggcg

SEQ ID NO: 1522458 - RNA, 21 nt, Pseudomonas aeruginosa PA01
uccgccaguuccggggucagc

SEQ ID NO: 1522459 - RNA, 19 nt, Pseudomonas aeruginosa PA01
uccgccaggcgcagccagc

SEQ ID NO: 1522460 - RNA, 15 nt, Pseudomonas aeruginosa PA01
uccgccaggcggccg

SEQ ID NO: 1522461 - RNA, 14 nt, Pseudomonas aeruginosa PA01
uccgccagcuuguc

SEQ ID NO: 1522462 - RNA, 18 nt, Pseudomonas aeruginosa PA01
uccgccagguccaggcuc

SEQ ID NO: 1522463 - RNA, 17 nt, Pseudomonas aeruginosa PA01
uccgccagccccaggcc

SEQ ID NO: 1522464 - RNA, 19 nt, Pseudomonas aeruginosa PA01
uccgccagcaccacccggc

SEQ ID NO: 1522465 - RNA, 16 nt, Pseudomonas aeruginosa PA01
uccgccaccagccagu

SEQ ID NO: 1522466 - RNA, 18 nt, Pseudomonas aeruginosa PA01
uccgcagucuucucggug

SEQ ID NO: 1522467 - RNA, 19 nt, Pseudomonas aeruginosa PA01
uccgcaucuccccaccaac

SEQ ID NO: 1522468 - RNA, 16 nt, Pseudomonas aeruginosa PA01
uccgcaggcaggucgc

SEQ ID NO: 1522469 - RNA, 20 nt, Pseudomonas aeruginosa PA01
uccgcaggcaggucgcugcc

SEQ ID NO: 1522470 - RNA, 15 nt, Pseudomonas aeruginosa PA01
uccgcagcacagccc

SEQ ID NO: 1522471 - RNA, 22 nt, Pseudomonas aeruginosa PA01
uccaucgacagggucgucuggg

SEQ ID NO: 1522472 - RNA, 15 nt, Pseudomonas aeruginosa PA01
uccaugucgcuggcc

SEQ ID NO: 1522473 - RNA, 21 nt, Pseudomonas aeruginosa PA01
uccauguagcguugcaggcag

SEQ ID NO: 1522474 - RNA, 23 nt, Pseudomonas aeruginosa PA01
uccauguagcguugcaggcaguc

SEQ ID NO: 1522475 - RNA, 22 nt, Pseudomonas aeruginosa PA01
uccauuagcgucgcgcggccag

SEQ ID NO: 1522476 - RNA, 13 nt, Pseudomonas aeruginosa PA01
uccaugggcagac

SEQ ID NO: 1522477 - RNA, 20 nt, Pseudomonas aeruginosa PA01
ucccaccgcuuucagcgccg

SEQ ID NO: 1522478 - RNA, 16 nt, Pseudomonas aeruginosa PA01
uccagaaacggcugcc

SEQ ID NO: 1522479 - RNA, 15 nt, Pseudomonas aeruginosa PA01
uccagcagguucggc

SEQ ID NO: 1522480 - RNA, 20 nt, Pseudomonas aeruginosa PA01
uccagcagggucgccugggu

SEQ ID NO: 1522481 - RNA, 15 nt, Pseudomonas aeruginosa PA01
uccagcagguacagc

SEQ ID NO: 1522482 - RNA, 15 nt, Pseudomonas aeruginosa PA01
uccagcagggccagc

SEQ ID NO: 1522483 - RNA, 17 nt, Pseudomonas aeruginosa PA01
uccagcagggccagcgc

SEQ ID NO: 1522484 - RNA, 11 nt, Pseudomonas aeruginosa PA01
uccagcaggcu

SEQ ID NO: 1522485 - RNA, 17 nt, Pseudomonas aeruginosa PA01
uccagcgccucgggccg

SEQ ID NO: 1522486 - RNA, 17 nt, Pseudomonas aeruginosa PA01
uccagcgccgcgcugcg

SEQ ID NO: 1522487 - RNA, 16 nt, Pseudomonas aeruginosa PA01
uccagcgccacuucca

SEQ ID NO: 1522488 - RNA, 18 nt, Pseudomonas aeruginosa PA01
uccagcgccacuuccagg

SEQ ID NO: 1522489 - RNA, 14 nt, Pseudomonas aeruginosa PA01
uccagcgcccaggu

SEQ ID NO: 1522490 - RNA, 21 nt, Pseudomonas aeruginosa PA01
uccagcgcuugaacgcgcgcc

SEQ ID NO: 1522491 - RNA, 19 nt, Pseudomonas aeruginosa PA01
uccagcggacgcuuguccu

SEQ ID NO: 1522492 - RNA, 18 nt, Pseudomonas aeruginosa PA01
uccagcggguagaugcca

SEQ ID NO: 1522493 - RNA, 18 nt, Pseudomonas aeruginosa PA01
uccagcgguaccagcagc

SEQ ID NO: 1522494 - RNA, 19 nt, Pseudomonas aeruginosa PA01
uccagcgguaccagcagcg

SEQ ID NO: 1522495 - RNA, 21 nt, Pseudomonas aeruginosa PA01
uccagcggcuccuggaugcuc

SEQ ID NO: 1522496 - RNA, 16 nt, Pseudomonas aeruginosa PA01
uccagcggcacuuccc

SEQ ID NO: 1522497 - RNA, 14 nt, Pseudomonas aeruginosa PA01
uccagcggccgcga

SEQ ID NO: 1522498 - RNA, 22 nt, Pseudomonas aeruginosa PA01
uccagcggccgcgagcgcggcc

SEQ ID NO: 1522499 - RNA, 17 nt, Pseudomonas aeruginosa PA01
uccagcggccgcgagga

SEQ ID NO: 1522500 - RNA, 17 nt, Pseudomonas aeruginosa PA01
uccagucggggcaggcg

SEQ ID NO: 1522501 - RNA, 16 nt, Pseudomonas aeruginosa PA01
uccaggcgguugcgga

SEQ ID NO: 1522502 - RNA, 23 nt, Pseudomonas aeruginosa PA01
uccaggcguccgcuggccugcag

SEQ ID NO: 1522503 - RNA, 15 nt, Pseudomonas aeruginosa PA01
uccaggcgugcugca

SEQ ID NO: 1522504 - RNA, 22 nt, Pseudomonas aeruginosa PA01
uccaggcgaaggucgaaggcgc

SEQ ID NO: 1522505 - RNA, 17 nt, Pseudomonas aeruginosa PA01
uccaggcgaaagucggc

SEQ ID NO: 1522506 - RNA, 18 nt, Pseudomonas aeruginosa PA01
uccaggucgaucagcagc

SEQ ID NO: 1522507 - RNA, 18 nt, Pseudomonas aeruginosa PA01
uccaggucaugcccuggc

SEQ ID NO: 1522508 - RNA, 16 nt, Pseudomonas aeruginosa PA01
uccaggugcgcggcag

SEQ ID NO: 1522509 - RNA, 15 nt, Pseudomonas aeruginosa PA01
uccaguuggccgggc

SEQ ID NO: 1522510 - RNA, 17 nt, Pseudomonas aeruginosa PA01
uccaguuggccgggcag

SEQ ID NO: 1522511 - RNA, 16 nt, Pseudomonas aeruginosa PA01
uccaguucggccgcgg

SEQ ID NO: 1522512 - RNA, 21 nt, Pseudomonas aeruginosa PA01
uccaguucagggcgagcaggg

SEQ ID NO: 1522513 - RNA, 21 nt, Pseudomonas aeruginosa PA01
uccaacgcaggcgcauggcgu

SEQ ID NO: 1522514 - RNA, 21 nt, Pseudomonas aeruginosa PA01
uccaccaggccauagcgcgcc

SEQ ID NO: 1522515 - RNA, 12 nt, Pseudomonas aeruginosa PA01
uccacccaggcg

SEQ ID NO: 1522516 - RNA, 23 nt, Pseudomonas aeruginosa PA01
uccacaccgagacgugaagcccc

SEQ ID NO: 1522517 - RNA, 17 nt, Pseudomonas aeruginosa PA01
uccacuuccaccggcuu

SEQ ID NO: 1522518 - RNA, 22 nt, Pseudomonas aeruginosa PA01
uccacgucgagcgggcggucgu

SEQ ID NO: 1522519 - RNA, 19 nt, Pseudomonas aeruginosa PA01
uccacguugcaguccaggc

SEQ ID NO: 1522520 - RNA, 20 nt, Pseudomonas aeruginosa PA01
uccacguugcaguccaggcc

SEQ ID NO: 1522521 - RNA, 16 nt, Pseudomonas aeruginosa PA01
uccacgucgccgacca

SEQ ID NO: 1522522 - RNA, 23 nt, Pseudomonas aeruginosa PA01
uccacgcugugcggcagcaggcu

SEQ ID NO: 1522523 - RNA, 22 nt, Pseudomonas aeruginosa PA01
uccacgcgguuccacucccaug

SEQ ID NO: 1522524 - RNA, 15 nt, Pseudomonas aeruginosa PA01
uccacgccuggcccu

SEQ ID NO: 1522525 - RNA, 18 nt, Pseudomonas aeruginosa PA01
uccacgccuucgcggccg

SEQ ID NO: 1522526 - RNA, 12 nt, Pseudomonas aeruginosa PA01
uccaaagaaaag

SEQ ID NO: 1522527 - RNA, 14 nt, Pseudomonas aeruginosa PA01
uccaaagaaaagcc

SEQ ID NO: 1522528 - RNA, 12 nt, Pseudomonas aeruginosa PA01
uccaacagcagg

SEQ ID NO: 1522529 - RNA, 13 nt, Pseudomonas aeruginosa PA01
uccaacagcaggu

SEQ ID NO: 1522530 - RNA, 13 nt, Pseudomonas aeruginosa PA01
ucaguugcgcgcg

SEQ ID NO: 1522531 - RNA, 14 nt, Pseudomonas aeruginosa PA01
ucaguucugggcgg

SEQ ID NO: 1522532 - RNA, 15 nt, Pseudomonas aeruginosa PA01
ugaugcaauggaugu

SEQ ID NO: 1522533 - RNA, 20 nt, Pseudomonas aeruginosa PA01
ugaugacgagggacugaaga

SEQ ID NO: 1522534 - RNA, 16 nt, Pseudomonas aeruginosa PA01
ugcaaacgggguaaag

SEQ ID NO: 1522535 - RNA, 19 nt, Pseudomonas aeruginosa PA01
ugcaauggauguugccgcc

SEQ ID NO: 1522536 - RNA, 15 nt, Pseudomonas aeruginosa PA01
ugcacaaacucaggg

SEQ ID NO: 1522537 - RNA, 18 nt, Pseudomonas aeruginosa PA01
ugcacaaacucagggugg

SEQ ID NO: 1522538 - RNA, 16 nt, Pseudomonas aeruginosa PA01
ugcaacgccagcaggc

SEQ ID NO: 1522539 - RNA, 19 nt, Pseudomonas aeruginosa PA01
ugcaacgccagcaggcgca

SEQ ID NO: 1522540 - RNA, 20 nt, Pseudomonas aeruginosa PA01
ugcaacgccggcccgugccc

SEQ ID NO: 1522541 - RNA, 21 nt, Pseudomonas aeruginosa PA01
ugcaacuggccgagaucgguc

SEQ ID NO: 1522542 - RNA, 16 nt, Pseudomonas aeruginosa PA01
ugcaacacccaggccu

SEQ ID NO: 1522543 - RNA, 16 nt, Pseudomonas aeruginosa PA01
ugcaacaccuggcgcu

SEQ ID NO: 1522544 - RNA, 21 nt, Pseudomonas aeruginosa PA01
ugcaacaguggguaggccagg

SEQ ID NO: 1522545 - RNA, 22 nt, Pseudomonas aeruginosa PA01
ugcaacaguggguaggccaggc

SEQ ID NO: 1522546 - RNA, 16 nt, Pseudomonas aeruginosa PA01
ugcaacaggacccagc

SEQ ID NO: 1522547 - RNA, 14 nt, Pseudomonas aeruginosa PA01
ugcaacagaaguug

SEQ ID NO: 1522548 - RNA, 17 nt, Pseudomonas aeruginosa PA01
ugcaacccgccgcugau

SEQ ID NO: 1522549 - RNA, 21 nt, Pseudomonas aeruginosa PA01
ugcagcacauagagggucagc

SEQ ID NO: 1522550 - RNA, 21 nt, Pseudomonas aeruginosa PA01
ugcagcacccccagcaggcca

SEQ ID NO: 1522551 - RNA, 14 nt, Pseudomonas aeruginosa PA01
ugcagcaccaccuc

SEQ ID NO: 1522552 - RNA, 19 nt, Pseudomonas aeruginosa PA01
ugcagcaagccgcagcgcc

SEQ ID NO: 1522553 - RNA, 18 nt, Pseudomonas aeruginosa PA01
ugcagcaacucgccgccg

SEQ ID NO: 1522554 - RNA, 19 nt, Pseudomonas aeruginosa PA01
ugcagcccuggcguggccg

SEQ ID NO: 1522555 - RNA, 20 nt, Pseudomonas aeruginosa PA01
ugcagcccuggcguggccgg

SEQ ID NO: 1522556 - RNA, 14 nt, Pseudomonas aeruginosa PA01
ugcacuugccgcac

SEQ ID NO: 1522557 - RNA, 14 nt, Pseudomonas aeruginosa PA01
ugcagaugaccagc

SEQ ID NO: 1522558 - RNA, 18 nt, Pseudomonas aeruginosa PA01
ugcagaugaccagcgcau

SEQ ID NO: 1522559 - RNA, 15 nt, Pseudomonas aeruginosa PA01
ugcaccagccagucc

SEQ ID NO: 1522560 - RNA, 14 nt, Pseudomonas aeruginosa PA01
ugcaccaggccgcc

SEQ ID NO: 1522561 - RNA, 15 nt, Pseudomonas aeruginosa PA01
ugcaccaggccgcca

SEQ ID NO: 1522562 - RNA, 20 nt, Pseudomonas aeruginosa PA01
ugcaccgggccgaccugccc

SEQ ID NO: 1522563 - RNA, 19 nt, Pseudomonas aeruginosa PA01
ugcaccgugcgcgcggccu

SEQ ID NO: 1522564 - RNA, 14 nt, Pseudomonas aeruginosa PA01
ugcaccggccacuc

SEQ ID NO: 1522565 - RNA, 20 nt, Pseudomonas aeruginosa PA01
ugcaccggccacucgcagcc

SEQ ID NO: 1522566 - RNA, 17 nt, Pseudomonas aeruginosa PA01
ugcaccgcuugccagcc

SEQ ID NO: 1522567 - RNA, 20 nt, Pseudomonas aeruginosa PA01
ugcaccgcuugccagccgcu

SEQ ID NO: 1522568 - RNA, 12 nt, Pseudomonas aeruginosa PA01
ugcaccuggcga

SEQ ID NO: 1522569 - RNA, 20 nt, Pseudomonas aeruginosa PA01
ugcacgucguagcccuucuc

SEQ ID NO: 1522570 - RNA, 15 nt, Pseudomonas aeruginosa PA01
ugcacagcgcccaga

SEQ ID NO: 1522571 - RNA, 15 nt, Pseudomonas aeruginosa PA01
ugcacaggcguacca

SEQ ID NO: 1522572 - RNA, 12 nt, Pseudomonas aeruginosa PA01
ugcacagggacg

SEQ ID NO: 1522573 - RNA, 17 nt, Pseudomonas aeruginosa PA01
ugcaucaccggcagcag

SEQ ID NO: 1522574 - RNA, 23 nt, Pseudomonas aeruginosa PA01
ugcaucaccuugucgcaccagcc

SEQ ID NO: 1522575 - RNA, 15 nt, Pseudomonas aeruginosa PA01
ugcagucgaaaaccg

SEQ ID NO: 1522576 - RNA, 22 nt, Pseudomonas aeruginosa PA01
ugcagguucaccgccucggaga

SEQ ID NO: 1522577 - RNA, 18 nt, Pseudomonas aeruginosa PA01
ugcagguuguccagggca

SEQ ID NO: 1522578 - RNA, 24 nt, Pseudomonas aeruginosa PA01
ugcagguuguccagggcauccauc

SEQ ID NO: 1522579 - RNA, 16 nt, Pseudomonas aeruginosa PA01
ugcagcucggcacgca

SEQ ID NO: 1522580 - RNA, 20 nt, Pseudomonas aeruginosa PA01
ugcaggucgcgcggcgccug

SEQ ID NO: 1522581 - RNA, 24 nt, Pseudomonas aeruginosa PA01
ugcaggucgcgcggcgccugcugc

SEQ ID NO: 1522582 - RNA, 14 nt, Pseudomonas aeruginosa PA01
ugcagguagcagcc

SEQ ID NO: 1522583 - RNA, 16 nt, Pseudomonas aeruginosa PA01
ugcagguagcagccgu

SEQ ID NO: 1522584 - RNA, 16 nt, Pseudomonas aeruginosa PA01
ugcagguagcgcugcg

SEQ ID NO: 1522585 - RNA, 18 nt, Pseudomonas aeruginosa PA01
ugcagguaguccagccag

SEQ ID NO: 1522586 - RNA, 19 nt, Pseudomonas aeruginosa PA01
ugcagguaguccagccagu

SEQ ID NO: 1522587 - RNA, 16 nt, Pseudomonas aeruginosa PA01
ugcaggucgaggcgcu

SEQ ID NO: 1522588 - RNA, 23 nt, Pseudomonas aeruginosa PA01
ugcaucggccgggauacagcagc

SEQ ID NO: 1522589 - RNA, 16 nt, Pseudomonas aeruginosa PA01
ugcaucuucucccaga

SEQ ID NO: 1522590 - RNA, 16 nt, Pseudomonas aeruginosa PA01
ugagcggcgcccuggc

SEQ ID NO: 1522591 - RNA, 18 nt, Pseudomonas aeruginosa PA01
ugaggaaguagugcagcu

SEQ ID NO: 1522592 - RNA, 17 nt, Pseudomonas aeruginosa PA01
ugaggcgcgcgccgaac

SEQ ID NO: 1522593 - RNA, 13 nt, Pseudomonas aeruginosa PA01
ugaggcgcagcag

SEQ ID NO: 1522594 - RNA, 14 nt, Pseudomonas aeruginosa PA01
ugaggcgggccagc

SEQ ID NO: 1522595 - RNA, 20 nt, Pseudomonas aeruginosa PA01
ugaggcgggccagcagggug

SEQ ID NO: 1522596 - RNA, 20 nt, Pseudomonas aeruginosa PA01
ugaggaucacgauggccggc

SEQ ID NO: 1522597 - RNA, 16 nt, Pseudomonas aeruginosa PA01
ugaggaucagccagcc

SEQ ID NO: 1522598 - RNA, 21 nt, Pseudomonas aeruginosa PA01
ugaggucgcagcguuccagcg

SEQ ID NO: 1522599 - RNA, 21 nt, Pseudomonas aeruginosa PA01
ugaggucguugaaagucugca

SEQ ID NO: 1522600 - RNA, 13 nt, Pseudomonas aeruginosa PA01
ugaggucggccuc

SEQ ID NO: 1522601 - RNA, 20 nt, Pseudomonas aeruginosa PA01
ugaggcuguccagcaggcgu

SEQ ID NO: 1522602 - RNA, 13 nt, Pseudomonas aeruginosa PA01
ugaggcucccagg

SEQ ID NO: 1522603 - RNA, 19 nt, Pseudomonas aeruginosa PA01
ugaggcucccagguggaaa

SEQ ID NO: 1522604 - RNA, 20 nt, Pseudomonas aeruginosa PA01
ugagggucagcuugccgcag

SEQ ID NO: 1522605 - RNA, 19 nt, Pseudomonas aeruginosa PA01
ugagggcgacccagcgcug

SEQ ID NO: 1522606 - RNA, 20 nt, Pseudomonas aeruginosa PA01
ugagggcgacguugcgcagg

SEQ ID NO: 1522607 - RNA, 17 nt, Pseudomonas aeruginosa PA01
ugauaccgcuggccagg

SEQ ID NO: 1522608 - RNA, 22 nt, Pseudomonas aeruginosa PA01
ugauaagcucggcuugacuggc

SEQ ID NO: 1522609 - RNA, 14 nt, Pseudomonas aeruginosa PA01
ugauaacuuuagua

SEQ ID NO: 1522610 - RNA, 18 nt, Pseudomonas aeruginosa PA01
ugauaucgauacggaaca

SEQ ID NO: 1522611 - RNA, 16 nt, Pseudomonas aeruginosa PA01
ugauagcgcggccuuc

SEQ ID NO: 1522612 - RNA, 23 nt, Pseudomonas aeruginosa PA01
ugaucggcuccagcuugucgucg

SEQ ID NO: 1522613 - RNA, 19 nt, Pseudomonas aeruginosa PA01
ugaucggccgccagugcau

SEQ ID NO: 1522614 - RNA, 18 nt, Pseudomonas aeruginosa PA01
ugaucgccgcgaggugga

SEQ ID NO: 1522615 - RNA, 14 nt, Pseudomonas aeruginosa PA01
ugaucgccgcgccg

SEQ ID NO: 1522616 - RNA, 18 nt, Pseudomonas aeruginosa PA01
ugaucgcgccggaugggc

SEQ ID NO: 1522617 - RNA, 23 nt, Pseudomonas aeruginosa PA01
ugaucgagcccuugcgcggcgca

SEQ ID NO: 1522618 - RNA, 22 nt, Pseudomonas aeruginosa PA01
ugaucgccaccgcguccuugag

SEQ ID NO: 1522619 - RNA, 23 nt, Pseudomonas aeruginosa PA01
ugaucgccaccgcguccuugagu

SEQ ID NO: 1522620 - RNA, 19 nt, Pseudomonas aeruginosa PA01
ugaucgaccacacaugcag

SEQ ID NO: 1522621 - RNA, 20 nt, Pseudomonas aeruginosa PA01
ugaucagcuucuucagcagc

SEQ ID NO: 1522622 - RNA, 22 nt, Pseudomonas aeruginosa PA01
ugacguugccgcgcgggccggc

SEQ ID NO: 1522623 - RNA, 18 nt, Pseudomonas aeruginosa PA01
ugacggcaaggaccugcu

SEQ ID NO: 1522624 - RNA, 12 nt, Pseudomonas aeruginosa PA01
ugacggugaucg

SEQ ID NO: 1522625 - RNA, 19 nt, Pseudomonas aeruginosa PA01
ugacgggcauugucccugc

SEQ ID NO: 1522626 - RNA, 20 nt, Pseudomonas aeruginosa PA01
ugacgggcgguaugccggag

SEQ ID NO: 1522627 - RNA, 15 nt, Pseudomonas aeruginosa PA01
ugacgucgccgaugc

SEQ ID NO: 1522628 - RNA, 18 nt, Pseudomonas aeruginosa PA01
ugacuuccaucagcucca

SEQ ID NO: 1522629 - RNA, 16 nt, Pseudomonas aeruginosa PA01
ugagaccgauccagca

SEQ ID NO: 1522630 - RNA, 14 nt, Pseudomonas aeruginosa PA01
ugagaccuuccugc

SEQ ID NO: 1522631 - RNA, 16 nt, Pseudomonas aeruginosa PA01
ugacgaucuucugcac

SEQ ID NO: 1522632 - RNA, 22 nt, Pseudomonas aeruginosa PA01
ugacgaugaagccccagccucc

SEQ ID NO: 1522633 - RNA, 18 nt, Pseudomonas aeruginosa PA01
ugacgauggccgccgccg

SEQ ID NO: 1522634 - RNA, 15 nt, Pseudomonas aeruginosa PA01
ugacgauggcgccuu

SEQ ID NO: 1522635 - RNA, 17 nt, Pseudomonas aeruginosa PA01
ugacgagggacugaaga

SEQ ID NO: 1522636 - RNA, 20 nt, Pseudomonas aeruginosa PA01
ugaccgagcaugcgcggcag

SEQ ID NO: 1522637 - RNA, 16 nt, Pseudomonas aeruginosa PA01
ugaccgucagccaggc

SEQ ID NO: 1522638 - RNA, 17 nt, Pseudomonas aeruginosa PA01
ugaccgucagccaggcu

SEQ ID NO: 1522639 - RNA, 17 nt, Pseudomonas aeruginosa PA01
ugaccgugaugcccagc

SEQ ID NO: 1522640 - RNA, 21 nt, Pseudomonas aeruginosa PA01
ugaccgugcgggucgaggccg

SEQ ID NO: 1522641 - RNA, 18 nt, Pseudomonas aeruginosa PA01
ugaccguccacggcgcgu

SEQ ID NO: 1522642 - RNA, 15 nt, Pseudomonas aeruginosa PA01
ugaccucccgcgcca

SEQ ID NO: 1522643 - RNA, 15 nt, Pseudomonas aeruginosa PA01
ugacgaagcgcaccg

SEQ ID NO: 1522644 - RNA, 17 nt, Pseudomonas aeruginosa PA01
ugaccguuucgccgccg

SEQ ID NO: 1522645 - RNA, 16 nt, Pseudomonas aeruginosa PA01
ugaccaccgccaggcu

SEQ ID NO: 1522646 - RNA, 17 nt, Pseudomonas aeruginosa PA01
ugaccacgcucagccgu

SEQ ID NO: 1522647 - RNA, 15 nt, Pseudomonas aeruginosa PA01
ugacccgggugccuu

SEQ ID NO: 1522648 - RNA, 19 nt, Pseudomonas aeruginosa PA01
ugacccgcugcuggauggg

SEQ ID NO: 1522649 - RNA, 21 nt, Pseudomonas aeruginosa PA01
ugacccgcugcuggauggggc

SEQ ID NO: 1522650 - RNA, 15 nt, Pseudomonas aeruginosa PA01
ugacccucugguugg

SEQ ID NO: 1522651 - RNA, 20 nt, Pseudomonas aeruginosa PA01
ugacccgcaccuugcccugc

SEQ ID NO: 1522652 - RNA, 16 nt, Pseudomonas aeruginosa PA01
ugacauccucccugcc

SEQ ID NO: 1522653 - RNA, 13 nt, Pseudomonas aeruginosa PA01
ucucguagagggg

SEQ ID NO: 1522654 - RNA, 15 nt, Pseudomonas aeruginosa PA01
ucucggucgccgcca

SEQ ID NO: 1522655 - RNA, 16 nt, Pseudomonas aeruginosa PA01
ucucgguuuccaggau

SEQ ID NO: 1522656 - RNA, 17 nt, Pseudomonas aeruginosa PA01
ucgccaaaaaaagcccc

SEQ ID NO: 1522657 - RNA, 13 nt, Pseudomonas aeruginosa PA01
ucugcguaacguu

SEQ ID NO: 1522658 - RNA, 21 nt, Pseudomonas aeruginosa PA01
ucugcucggcgcccugggugg

SEQ ID NO: 1522659 - RNA, 23 nt, Pseudomonas aeruginosa PA01
ucugcuccagcaaugccagcgcc

SEQ ID NO: 1522660 - RNA, 12 nt, Pseudomonas aeruginosa PA01
ucugcuggccac

SEQ ID NO: 1522661 - RNA, 19 nt, Pseudomonas aeruginosa PA01
ucugcuggccgcccuugcg

SEQ ID NO: 1522662 - RNA, 12 nt, Pseudomonas aeruginosa PA01
ucugcugguuga

SEQ ID NO: 1522663 - RNA, 15 nt, Pseudomonas aeruginosa PA01
ucuggcggcccuggu

SEQ ID NO: 1522664 - RNA, 15 nt, Pseudomonas aeruginosa PA01
ucugggucuggcgau

SEQ ID NO: 1522665 - RNA, 20 nt, Pseudomonas aeruginosa PA01
ucugggucuuggucacggcg

SEQ ID NO: 1522666 - RNA, 16 nt, Pseudomonas aeruginosa PA01
ucuggggugaggccga

SEQ ID NO: 1522667 - RNA, 13 nt, Pseudomonas aeruginosa PA01
ucuggccauagaa

SEQ ID NO: 1522668 - RNA, 15 nt, Pseudomonas aeruginosa PA01
ucuggcgccuggccu

SEQ ID NO: 1522669 - RNA, 18 nt, Pseudomonas aeruginosa PA01
ucuggcgccuggccugga

SEQ ID NO: 1522670 - RNA, 17 nt, Pseudomonas aeruginosa PA01
ucugcugguagcugcug

SEQ ID NO: 1522671 - RNA, 13 nt, Pseudomonas aeruginosa PA01
ucugcgccaggcg

SEQ ID NO: 1522672 - RNA, 14 nt, Pseudomonas aeruginosa PA01
ucugcgaguaguag

SEQ ID NO: 1522673 - RNA, 16 nt, Pseudomonas aeruginosa PA01
ucugcgccgcggcguu

SEQ ID NO: 1522674 - RNA, 14 nt, Pseudomonas aeruginosa PA01
ucugcgccuccucg

SEQ ID NO: 1522675 - RNA, 17 nt, Pseudomonas aeruginosa PA01
ucugauugcguaacguu

SEQ ID NO: 1522676 - RNA, 14 nt, Pseudomonas aeruginosa PA01
ucugcccgccggcg

SEQ ID NO: 1522677 - RNA, 17 nt, Pseudomonas aeruginosa PA01
ucugcccggcuucgcug

SEQ ID NO: 1522678 - RNA, 13 nt, Pseudomonas aeruginosa PA01
ucuucagccuggg

SEQ ID NO: 1522679 - RNA, 12 nt, Pseudomonas aeruginosa PA01
ucuucagcuugg

SEQ ID NO: 1522680 - RNA, 22 nt, Pseudomonas aeruginosa PA01
ucuucuggaaaucggcguccug

SEQ ID NO: 1522681 - RNA, 17 nt, Pseudomonas aeruginosa PA01
ucuucuucaaccgcugg

SEQ ID NO: 1522682 - RNA, 18 nt, Pseudomonas aeruginosa PA01
ucuucugguaggccagca

SEQ ID NO: 1522683 - RNA, 20 nt, Pseudomonas aeruginosa PA01
ucuucgaaguuguagguaua

SEQ ID NO: 1522684 - RNA, 19 nt, Pseudomonas aeruginosa PA01
ucuucgauggcggccgcca

SEQ ID NO: 1522685 - RNA, 14 nt, Pseudomonas aeruginosa PA01
ucuucgaugcgccg

SEQ ID NO: 1522686 - RNA, 19 nt, Pseudomonas aeruginosa PA01
ucuucuccgauuccugcgg

SEQ ID NO: 1522687 - RNA, 17 nt, Pseudomonas aeruginosa PA01
ucuucuaccuggcgcug

SEQ ID NO: 1522688 - RNA, 21 nt, Pseudomonas aeruginosa PA01
ucuugaagaagcugccggcau

SEQ ID NO: 1522689 - RNA, 19 nt, Pseudomonas aeruginosa PA01
ucuucuuucgacaugcagu

SEQ ID NO: 1522690 - RNA, 15 nt, Pseudomonas aeruginosa PA01
ucuugaucgccagcg

SEQ ID NO: 1522691 - RNA, 14 nt, Pseudomonas aeruginosa PA01
ucuugcgcagggcg

SEQ ID NO: 1522692 - RNA, 20 nt, Pseudomonas aeruginosa PA01
ucuugccgcgagcuuggccc

SEQ ID NO: 1522693 - RNA, 21 nt, Pseudomonas aeruginosa PA01
ucuugcggcaauucuugaucc

SEQ ID NO: 1522694 - RNA, 14 nt, Pseudomonas aeruginosa PA01
ucuugcgcccggcg

SEQ ID NO: 1522695 - RNA, 14 nt, Pseudomonas aeruginosa PA01
ucuuguugagcugg

SEQ ID NO: 1522696 - RNA, 20 nt, Pseudomonas aeruginosa PA01
ucuugucgcgggucugcgag

SEQ ID NO: 1522697 - RNA, 23 nt, Pseudomonas aeruginosa PA01
ucuuggcccauucguagaggcug

SEQ ID NO: 1522698 - RNA, 10 nt, Pseudomonas aeruginosa PA01
ucuuggccag

SEQ ID NO: 1522699 - RNA, 15 nt, Pseudomonas aeruginosa PA01
ucuuuggccaauugc

SEQ ID NO: 1522700 - RNA, 13 nt, Pseudomonas aeruginosa PA01
ucuuugccuggaa

SEQ ID NO: 1522701 - RNA, 17 nt, Pseudomonas aeruginosa PA01
ucuuugccuggaaaaag

SEQ ID NO: 1522702 - RNA, 11 nt, Pseudomonas aeruginosa PA01
ucuuuccuuuc

SEQ ID NO: 1522703 - RNA, 23 nt, Pseudomonas aeruginosa PA01
ucuuucagcugagucgcuucacu

SEQ ID NO: 1522704 - RNA, 15 nt, Pseudomonas aeruginosa PA01
ucuuuuuaagagaau

SEQ ID NO: 1522705 - RNA, 22 nt, Pseudomonas aeruginosa PA01
ucuuuuugcgccagguagccug

SEQ ID NO: 1522706 - RNA, 18 nt, Pseudomonas aeruginosa PA01
ugaacagcgccaccagca

SEQ ID NO: 1522707 - RNA, 23 nt, Pseudomonas aeruginosa PA01
ugaacagcuggcgcgucgcugcc

SEQ ID NO: 1522708 - RNA, 14 nt, Pseudomonas aeruginosa PA01
ugaacagguagcug

SEQ ID NO: 1522709 - RNA, 18 nt, Pseudomonas aeruginosa PA01
ugaacagguagcuggaaa

SEQ ID NO: 1522710 - RNA, 14 nt, Pseudomonas aeruginosa PA01
ugaacgcggcgaga

SEQ ID NO: 1522711 - RNA, 16 nt, Pseudomonas aeruginosa PA01
ugaacggcgucacgcc

SEQ ID NO: 1522712 - RNA, 18 nt, Pseudomonas aeruginosa PA01
ugaacgcuguagaaugcg

SEQ ID NO: 1522713 - RNA, 17 nt, Pseudomonas aeruginosa PA01
ugaacucaugcaggccg

SEQ ID NO: 1522714 - RNA, 21 nt, Pseudomonas aeruginosa PA01
ugaacucgguguagcugaggc

SEQ ID NO: 1522715 - RNA, 21 nt, Pseudomonas aeruginosa PA01
ugaaggcgaaguaucuggguc

SEQ ID NO: 1522716 - RNA, 22 nt, Pseudomonas aeruginosa PA01
ugaaggaccagcuuguggccgg

SEQ ID NO: 1522717 - RNA, 14 nt, Pseudomonas aeruginosa PA01
ugaaggacugugcc

SEQ ID NO: 1522718 - RNA, 18 nt, Pseudomonas aeruginosa PA01
ugaaggaaaccggccagc

SEQ ID NO: 1522719 - RNA, 16 nt, Pseudomonas aeruginosa PA01
ugaagcacaccuccag

SEQ ID NO: 1522720 - RNA, 11 nt, Pseudomonas aeruginosa PA01
ugaagcccagg

SEQ ID NO: 1522721 - RNA, 23 nt, Pseudomonas aeruginosa PA01
ugaacuggucgcuccagccccac

SEQ ID NO: 1522722 - RNA, 20 nt, Pseudomonas aeruginosa PA01
ugaagaaguaaucaccuucc

SEQ ID NO: 1522723 - RNA, 12 nt, Pseudomonas aeruginosa PA01
ugaaaaaagggg

SEQ ID NO: 1522724 - RNA, 14 nt, Pseudomonas aeruginosa PA01
ugaaaaucaaggau

SEQ ID NO: 1522725 - RNA, 16 nt, Pseudomonas aeruginosa PA01
ugaaaaucaaggauuu

SEQ ID NO: 1522726 - RNA, 14 nt, Pseudomonas aeruginosa PA01
ugaaaaucauccac

SEQ ID NO: 1522727 - RNA, 13 nt, Pseudomonas aeruginosa PA01
ugaaacaguugga

SEQ ID NO: 1522728 - RNA, 13 nt, Pseudomonas aeruginosa PA01
ugcucgaggaagc

SEQ ID NO: 1522729 - RNA, 15 nt, Pseudomonas aeruginosa PA01
ugcucgaggauggca

SEQ ID NO: 1522730 - RNA, 16 nt, Pseudomonas aeruginosa PA01
ugcucgagccguucca

SEQ ID NO: 1522731 - RNA, 18 nt, Pseudomonas aeruginosa PA01
ugcucgaucaaccccugg

SEQ ID NO: 1522732 - RNA, 18 nt, Pseudomonas aeruginosa PA01
ugcucgauggcggccugg

SEQ ID NO: 1522733 - RNA, 17 nt, Pseudomonas aeruginosa PA01
ugcucgcaccaggccag

SEQ ID NO: 1522734 - RNA, 19 nt, Pseudomonas aeruginosa PA01
ugcucgcaccaggccaggu

SEQ ID NO: 1522735 - RNA, 14 nt, Pseudomonas aeruginosa PA01
ugcucgcgccagcc

SEQ ID NO: 1522736 - RNA, 18 nt, Pseudomonas aeruginosa PA01
ugcucgcgccagccccag

SEQ ID NO: 1522737 - RNA, 14 nt, Pseudomonas aeruginosa PA01
ugcucgcgcuucuc

SEQ ID NO: 1522738 - RNA, 19 nt, Pseudomonas aeruginosa PA01
ugcucgcggaccagcuccg

SEQ ID NO: 1522739 - RNA, 21 nt, Pseudomonas aeruginosa PA01
ugcucgccuuggauaccaggg

SEQ ID NO: 1522740 - RNA, 19 nt, Pseudomonas aeruginosa PA01
ugcucgcgcaccgcggcca

SEQ ID NO: 1522741 - RNA, 17 nt, Pseudomonas aeruginosa PA01
ugcucggccugaucauc

SEQ ID NO: 1522742 - RNA, 20 nt, Pseudomonas aeruginosa PA01
ugcucgcgggucaccaccgg

SEQ ID NO: 1522743 - RNA, 13 nt, Pseudomonas aeruginosa PA01
ugcucgcuccgag

SEQ ID NO: 1522744 - RNA, 17 nt, Pseudomonas aeruginosa PA01
ugcucgguugccaggcc

SEQ ID NO: 1522745 - RNA, 20 nt, Pseudomonas aeruginosa PA01
ugcucgguauggcugcugug

SEQ ID NO: 1522746 - RNA, 14 nt, Pseudomonas aeruginosa PA01
ugcucguccaggcc

SEQ ID NO: 1522747 - RNA, 17 nt, Pseudomonas aeruginosa PA01
ugcucguccaggccgca

SEQ ID NO: 1522748 - RNA, 16 nt, Pseudomonas aeruginosa PA01
ugcucgugcagguagc

SEQ ID NO: 1522749 - RNA, 17 nt, Pseudomonas aeruginosa PA01
ugcucugggcauggcug

SEQ ID NO: 1522750 - RNA, 19 nt, Pseudomonas aeruginosa PA01
ugcucugguucggcgucuu

SEQ ID NO: 1522751 - RNA, 13 nt, Pseudomonas aeruginosa PA01
ugcucuuccagcg

SEQ ID NO: 1522752 - RNA, 12 nt, Pseudomonas aeruginosa PA01
ugcucuuuuccc

SEQ ID NO: 1522753 - RNA, 20 nt, Pseudomonas aeruginosa PA01
ugcucuucgauugucuccag

SEQ ID NO: 1522754 - RNA, 17 nt, Pseudomonas aeruginosa PA01
ugcugaagccccagucc

SEQ ID NO: 1522755 - RNA, 19 nt, Pseudomonas aeruginosa PA01
ugcugagcagucgccuggc

SEQ ID NO: 1522756 - RNA, 17 nt, Pseudomonas aeruginosa PA01
ugcugccggcuugcugc

SEQ ID NO: 1522757 - RNA, 20 nt, Pseudomonas aeruginosa PA01
ugcugccauccgcgccgacc

SEQ ID NO: 1522758 - RNA, 22 nt, Pseudomonas aeruginosa PA01
ugcugcaaccgauauggcuggc

SEQ ID NO: 1522759 - RNA, 20 nt, Pseudomonas aeruginosa PA01
ugcugcacggagugggccgc

SEQ ID NO: 1522760 - RNA, 15 nt, Pseudomonas aeruginosa PA01
ugcugcaggccgaga

SEQ ID NO: 1522761 - RNA, 13 nt, Pseudomonas aeruginosa PA01
ugcugcagggccu

SEQ ID NO: 1522762 - RNA, 14 nt, Pseudomonas aeruginosa PA01
ugcuggcugcccag

SEQ ID NO: 1522763 - RNA, 15 nt, Pseudomonas aeruginosa PA01
ugcuggcugcccagu

SEQ ID NO: 1522764 - RNA, 22 nt, Pseudomonas aeruginosa PA01
ugcuggcguucucggccaggua

SEQ ID NO: 1522765 - RNA, 14 nt, Pseudomonas aeruginosa PA01
ugcuggccggcagc

SEQ ID NO: 1522766 - RNA, 15 nt, Pseudomonas aeruginosa PA01
ugcuggccggcagca

SEQ ID NO: 1522767 - RNA, 16 nt, Pseudomonas aeruginosa PA01
ugcuggccggcagcag

SEQ ID NO: 1522768 - RNA, 17 nt, Pseudomonas aeruginosa PA01
ugcuggccggcagcagc

SEQ ID NO: 1522769 - RNA, 18 nt, Pseudomonas aeruginosa PA01
ugcuggccggugccgccc

SEQ ID NO: 1522770 - RNA, 20 nt, Pseudomonas aeruginosa PA01
ugcuggccggugccgcccug

SEQ ID NO: 1522771 - RNA, 12 nt, Pseudomonas aeruginosa PA01
ugcuggccuggg

SEQ ID NO: 1522772 - RNA, 12 nt, Pseudomonas aeruginosa PA01
ugcuggccgccc

SEQ ID NO: 1522773 - RNA, 19 nt, Pseudomonas aeruginosa PA01
ugcuggccacccuugcgcc

SEQ ID NO: 1522774 - RNA, 20 nt, Pseudomonas aeruginosa PA01
ugcuggccacccuugcgucc

SEQ ID NO: 1522775 - RNA, 15 nt, Pseudomonas aeruginosa PA01
ugcuggccaccgcgg

SEQ ID NO: 1522776 - RNA, 13 nt, Pseudomonas aeruginosa PA01
ugcugcuggccuu

SEQ ID NO: 1522777 - RNA, 13 nt, Pseudomonas aeruginosa PA01
ugcugcuggguga

SEQ ID NO: 1522778 - RNA, 15 nt, Pseudomonas aeruginosa PA01
ugcuggagcuugccg

SEQ ID NO: 1522779 - RNA, 20 nt, Pseudomonas aeruginosa PA01
ugcuggcaacggcgggccgc

SEQ ID NO: 1522780 - RNA, 13 nt, Pseudomonas aeruginosa PA01
ugcugcucggcau

SEQ ID NO: 1522781 - RNA, 19 nt, Pseudomonas aeruginosa PA01
ugcugcugaucaggaggau

SEQ ID NO: 1522782 - RNA, 12 nt, Pseudomonas aeruginosa PA01
ugcugcgggcgc

SEQ ID NO: 1522783 - RNA, 21 nt, Pseudomonas aeruginosa PA01
ugcugcgggcgccgccgcugg

SEQ ID NO: 1522784 - RNA, 15 nt, Pseudomonas aeruginosa PA01
ugcugcggggccgga

SEQ ID NO: 1522785 - RNA, 18 nt, Pseudomonas aeruginosa PA01
ugcugcggggccugcugc

SEQ ID NO: 1522786 - RNA, 19 nt, Pseudomonas aeruginosa PA01
ugcugcggggccugcugcg

SEQ ID NO: 1522787 - RNA, 20 nt, Pseudomonas aeruginosa PA01
ugcugcgccuggccgcgcag

SEQ ID NO: 1522788 - RNA, 13 nt, Pseudomonas aeruginosa PA01
ugcugcgccggca

SEQ ID NO: 1522789 - RNA, 17 nt, Pseudomonas aeruginosa PA01
ugcugccguagcgcuuc

SEQ ID NO: 1522790 - RNA, 15 nt, Pseudomonas aeruginosa PA01
ugcugguugaccagg

SEQ ID NO: 1522791 - RNA, 18 nt, Pseudomonas aeruginosa PA01
ugcugguggacgucgucg

SEQ ID NO: 1522792 - RNA, 19 nt, Pseudomonas aeruginosa PA01
ugcuggugggugaucucgc

SEQ ID NO: 1522793 - RNA, 21 nt, Pseudomonas aeruginosa PA01
ugcuggugggugaucucgcug

SEQ ID NO: 1522794 - RNA, 17 nt, Pseudomonas aeruginosa PA01
ugcugguccuggcgcga

SEQ ID NO: 1522795 - RNA, 14 nt, Pseudomonas aeruginosa PA01
ugcugggucuccuc

SEQ ID NO: 1522796 - RNA, 13 nt, Pseudomonas aeruginosa PA01
ugcugggcggcga

SEQ ID NO: 1522797 - RNA, 23 nt, Pseudomonas aeruginosa PA01
ugcuguuguugccggucuugccg

SEQ ID NO: 1522798 - RNA, 17 nt, Pseudomonas aeruginosa PA01
ugcuguugccagggaua

SEQ ID NO: 1522799 - RNA, 23 nt, Pseudomonas aeruginosa PA01
ugcuguccagcgcuccuugcgcc

SEQ ID NO: 1522800 - RNA, 23 nt, Pseudomonas aeruginosa PA01
ugcugucccaaccguucugccgc

SEQ ID NO: 1522801 - RNA, 22 nt, Pseudomonas aeruginosa PA01
ugcuucagcccggcaccaggcc

SEQ ID NO: 1522802 - RNA, 16 nt, Pseudomonas aeruginosa PA01
ugcuucagguagugca

SEQ ID NO: 1522803 - RNA, 12 nt, Pseudomonas aeruginosa PA01
ugcuuccagacc

SEQ ID NO: 1522804 - RNA, 21 nt, Pseudomonas aeruginosa PA01
ugcuucugguugcucaccaau

SEQ ID NO: 1522805 - RNA, 12 nt, Pseudomonas aeruginosa PA01
ugcuucucggcu

SEQ ID NO: 1522806 - RNA, 16 nt, Pseudomonas aeruginosa PA01
ugcuuugggagcagga

SEQ ID NO: 1522807 - RNA, 19 nt, Pseudomonas aeruginosa PA01
ugcuuuccugcuccagcag

SEQ ID NO: 1522808 - RNA, 21 nt, Pseudomonas aeruginosa PA01
ugcuuggcggcgguguagucg

SEQ ID NO: 1522809 - RNA, 13 nt, Pseudomonas aeruginosa PA01
ugcuuggccaggc

SEQ ID NO: 1522810 - RNA, 16 nt, Pseudomonas aeruginosa PA01
ugcuuggcgcgcuggc

SEQ ID NO: 1522811 - RNA, 18 nt, Pseudomonas aeruginosa PA01
uggaaaccccggccuggc

SEQ ID NO: 1522812 - RNA, 24 nt, Pseudomonas aeruginosa PA01
uggaaaccccggccuggcgccggg

SEQ ID NO: 1522813 - RNA, 18 nt, Pseudomonas aeruginosa PA01
uggaaacgccagcccucg

SEQ ID NO: 1522814 - RNA, 17 nt, Pseudomonas aeruginosa PA01
uggaacagcaucagagg

SEQ ID NO: 1522815 - RNA, 22 nt, Pseudomonas aeruginosa PA01
uggaacuagcccucgaccuggc

SEQ ID NO: 1522816 - RNA, 19 nt, Pseudomonas aeruginosa PA01
uggaacgcggguugcccgg

SEQ ID NO: 1522817 - RNA, 21 nt, Pseudomonas aeruginosa PA01
uggaaccgaggguacguucca

SEQ ID NO: 1522818 - RNA, 17 nt, Pseudomonas aeruginosa PA01
uggaaccgauggccagg

SEQ ID NO: 1522819 - RNA, 19 nt, Pseudomonas aeruginosa PA01
uggaaccgauggccagggg

SEQ ID NO: 1522820 - RNA, 18 nt, Pseudomonas aeruginosa PA01
uggaaggaucgagccagc

SEQ ID NO: 1522821 - RNA, 13 nt, Pseudomonas aeruginosa PA01
uggaccuccgcca

SEQ ID NO: 1522822 - RNA, 19 nt, Pseudomonas aeruginosa PA01
uggaccuccgccaggaccu

SEQ ID NO: 1522823 - RNA, 15 nt, Pseudomonas aeruginosa PA01
uggacgaaggccucc

SEQ ID NO: 1522824 - RNA, 13 nt, Pseudomonas aeruginosa PA01
uggacgaaccaga

SEQ ID NO: 1522825 - RNA, 18 nt, Pseudomonas aeruginosa PA01
uggacgaacgagaagccg

SEQ ID NO: 1522826 - RNA, 17 nt, Pseudomonas aeruginosa PA01
uggacccgugcgcccca

SEQ ID NO: 1522827 - RNA, 18 nt, Pseudomonas aeruginosa PA01
uggacccgggccuccugg

SEQ ID NO: 1522828 - RNA, 14 nt, Pseudomonas aeruginosa PA01
uggaccaggaucac

SEQ ID NO: 1522829 - RNA, 13 nt, Pseudomonas aeruginosa PA01
uggaccagcgccg

SEQ ID NO: 1522830 - RNA, 16 nt, Pseudomonas aeruginosa PA01
uggaccagcgccgcca

SEQ ID NO: 1522831 - RNA, 20 nt, Pseudomonas aeruginosa PA01
uggacaccgaugccgaaggc

SEQ ID NO: 1522832 - RNA, 21 nt, Pseudomonas aeruginosa PA01
uggacacccugcugcugcuca

SEQ ID NO: 1522833 - RNA, 11 nt, Pseudomonas aeruginosa PA01
uggacaagguu

SEQ ID NO: 1522834 - RNA, 23 nt, Pseudomonas aeruginosa PA01
uggacaucccgggguugcccagc

SEQ ID NO: 1522835 - RNA, 21 nt, Pseudomonas aeruginosa PA01
uggacaggcgccccugguccu

SEQ ID NO: 1522836 - RNA, 17 nt, Pseudomonas aeruginosa PA01
uggacagcuuggccagc

SEQ ID NO: 1522837 - RNA, 20 nt, Pseudomonas aeruginosa PA01
uggacagcuuggccagcagg

SEQ ID NO: 1522838 - RNA, 16 nt, Pseudomonas aeruginosa PA01
uggaauccagggccga

SEQ ID NO: 1522839 - RNA, 15 nt, Pseudomonas aeruginosa PA01
uggaagucguccagc

SEQ ID NO: 1522840 - RNA, 17 nt, Pseudomonas aeruginosa PA01
ugcgugagcugggcagg

SEQ ID NO: 1522841 - RNA, 13 nt, Pseudomonas aeruginosa PA01
ugcguccauccag

SEQ ID NO: 1522842 - RNA, 20 nt, Pseudomonas aeruginosa PA01
ugcgugccagggcuucccag

SEQ ID NO: 1522843 - RNA, 18 nt, Pseudomonas aeruginosa PA01
ugcguggguagccauggc

SEQ ID NO: 1522844 - RNA, 20 nt, Pseudomonas aeruginosa PA01
ugcgguuauccgccguggaa

SEQ ID NO: 1522845 - RNA, 18 nt, Pseudomonas aeruginosa PA01
ugcgcuggcgcagcagca

SEQ ID NO: 1522846 - RNA, 15 nt, Pseudomonas aeruginosa PA01
ugcgccggcgcugcg

SEQ ID NO: 1522847 - RNA, 23 nt, Pseudomonas aeruginosa PA01
ugcgcuggucguucagugccagc

SEQ ID NO: 1522848 - RNA, 12 nt, Pseudomonas aeruginosa PA01
ugcgcugguugg

SEQ ID NO: 1522849 - RNA, 15 nt, Pseudomonas aeruginosa PA01
ugcggaaaccgggau

SEQ ID NO: 1522850 - RNA, 17 nt, Pseudomonas aeruginosa PA01
ugcggaaaccgcggccg

SEQ ID NO: 1522851 - RNA, 19 nt, Pseudomonas aeruginosa PA01
ugcggaaaccgcggccggc

SEQ ID NO: 1522852 - RNA, 21 nt, Pseudomonas aeruginosa PA01
ugcggaaaccgcggccggcuu

SEQ ID NO: 1522853 - RNA, 15 nt, Pseudomonas aeruginosa PA01
ugcgcuugccggccg

SEQ ID NO: 1522854 - RNA, 14 nt, Pseudomonas aeruginosa PA01
ugcgcuugcugcca

SEQ ID NO: 1522855 - RNA, 22 nt, Pseudomonas aeruginosa PA01
ugcggaagaaacugcgguugaa

SEQ ID NO: 1522856 - RNA, 20 nt, Pseudomonas aeruginosa PA01
ugcggcguucgccgcgggcg

SEQ ID NO: 1522857 - RNA, 18 nt, Pseudomonas aeruginosa PA01
ugcggcugcagggccagg

SEQ ID NO: 1522858 - RNA, 19 nt, Pseudomonas aeruginosa PA01
ugcggcugcagggccaggg

SEQ ID NO: 1522859 - RNA, 16 nt, Pseudomonas aeruginosa PA01
ugcggcugggugucga

SEQ ID NO: 1522860 - RNA, 22 nt, Pseudomonas aeruginosa PA01
ugcggcggcaggucggacaggc

SEQ ID NO: 1522861 - RNA, 15 nt, Pseudomonas aeruginosa PA01
ugcggcgcugccaca

SEQ ID NO: 1522862 - RNA, 20 nt, Pseudomonas aeruginosa PA01
ugcggcgccgguugcugcug

SEQ ID NO: 1522863 - RNA, 13 nt, Pseudomonas aeruginosa PA01
ugcggcgcggccc

SEQ ID NO: 1522864 - RNA, 18 nt, Pseudomonas aeruginosa PA01
ugcggcacgcugcuugcg

SEQ ID NO: 1522865 - RNA, 22 nt, Pseudomonas aeruginosa PA01
ugcggcaaggcgaucccggcgu

SEQ ID NO: 1522866 - RNA, 13 nt, Pseudomonas aeruginosa PA01
ugcggcaccagcc

SEQ ID NO: 1522867 - RNA, 17 nt, Pseudomonas aeruginosa PA01
ugcggcgaugucggccu

SEQ ID NO: 1522868 - RNA, 16 nt, Pseudomonas aeruginosa PA01
ugcggcgcaggcggau

SEQ ID NO: 1522869 - RNA, 18 nt, Pseudomonas aeruginosa PA01
ugcuaugcgccgggccuc

SEQ ID NO: 1522870 - RNA, 15 nt, Pseudomonas aeruginosa PA01
ugcucagccgcgccg

SEQ ID NO: 1522871 - RNA, 19 nt, Pseudomonas aeruginosa PA01
ugcucagcgcgcucggccu

SEQ ID NO: 1522872 - RNA, 22 nt, Pseudomonas aeruginosa PA01
ugcucagcgcgcucggccuggu

SEQ ID NO: 1522873 - RNA, 18 nt, Pseudomonas aeruginosa PA01
ugcucagcguccucagcc

SEQ ID NO: 1522874 - RNA, 19 nt, Pseudomonas aeruginosa PA01
ugcucagcguccucagccu

SEQ ID NO: 1522875 - RNA, 19 nt, Pseudomonas aeruginosa PA01
ugcucaggcgcugcuggug

SEQ ID NO: 1522876 - RNA, 20 nt, Pseudomonas aeruginosa PA01
ugcucaggacguccuggccg

SEQ ID NO: 1522877 - RNA, 22 nt, Pseudomonas aeruginosa PA01
ugcucagggccgcgccgagccg

SEQ ID NO: 1522878 - RNA, 19 nt, Pseudomonas aeruginosa PA01
ugcucacugcgagcaccau

SEQ ID NO: 1522879 - RNA, 23 nt, Pseudomonas aeruginosa PA01
ugcucacgccgaacuuguagggc

SEQ ID NO: 1522880 - RNA, 15 nt, Pseudomonas aeruginosa PA01
ugcucgaacugcucc

SEQ ID NO: 1522881 - RNA, 20 nt, Pseudomonas aeruginosa PA01
ugcucgaacgggcacuucuc

SEQ ID NO: 1522882 - RNA, 15 nt, Pseudomonas aeruginosa PA01
ugcuccuccaggcuc

SEQ ID NO: 1522883 - RNA, 16 nt, Pseudomonas aeruginosa PA01
ugcuccuccaggcucu

SEQ ID NO: 1522884 - RNA, 18 nt, Pseudomonas aeruginosa PA01
ugcuccuccaggcucuuc

SEQ ID NO: 1522885 - RNA, 19 nt, Pseudomonas aeruginosa PA01
ugcuccagguucggcgcca

SEQ ID NO: 1522886 - RNA, 15 nt, Pseudomonas aeruginosa PA01
ugcuccagcccggcu

SEQ ID NO: 1522887 - RNA, 15 nt, Pseudomonas aeruginosa PA01
ugcgcaccucggcca

SEQ ID NO: 1522888 - RNA, 18 nt, Pseudomonas aeruginosa PA01
ugcgcaccucggccaggc

SEQ ID NO: 1522889 - RNA, 21 nt, Pseudomonas aeruginosa PA01
ugcgcaaugaaagagccccuc

SEQ ID NO: 1522890 - RNA, 18 nt, Pseudomonas aeruginosa PA01
ugcgcacccgcucggccu

SEQ ID NO: 1522891 - RNA, 15 nt, Pseudomonas aeruginosa PA01
ugcgcaccgccugca

SEQ ID NO: 1522892 - RNA, 14 nt, Pseudomonas aeruginosa PA01
ugcgcaccgcgccg

SEQ ID NO: 1522893 - RNA, 17 nt, Pseudomonas aeruginosa PA01
ugcgcaccagggccagg

SEQ ID NO: 1522894 - RNA, 18 nt, Pseudomonas aeruginosa PA01
ugcgcaccagggccagga

SEQ ID NO: 1522895 - RNA, 19 nt, Pseudomonas aeruginosa PA01
ugcgcaccagggccaggag

SEQ ID NO: 1522896 - RNA, 15 nt, Pseudomonas aeruginosa PA01
ugcgcaccacucccg

SEQ ID NO: 1522897 - RNA, 15 nt, Pseudomonas aeruginosa PA01
ugcgcccggagcuuu

SEQ ID NO: 1522898 - RNA, 14 nt, Pseudomonas aeruginosa PA01
ugcgccauugccgc

SEQ ID NO: 1522899 - RNA, 22 nt, Pseudomonas aeruginosa PA01
ugcgccaguuccuucgccgaaa

SEQ ID NO: 1522900 - RNA, 13 nt, Pseudomonas aeruginosa PA01
ugcgccagcggcc

SEQ ID NO: 1522901 - RNA, 21 nt, Pseudomonas aeruginosa PA01
ugcgccaggaccauuugcgcc

SEQ ID NO: 1522902 - RNA, 17 nt, Pseudomonas aeruginosa PA01
ugcgccagcucggccug

SEQ ID NO: 1522903 - RNA, 18 nt, Pseudomonas aeruginosa PA01
ugcgccagcucggccugu

SEQ ID NO: 1522904 - RNA, 18 nt, Pseudomonas aeruginosa PA01
ugcgccgaauccaggccg

SEQ ID NO: 1522905 - RNA, 15 nt, Pseudomonas aeruginosa PA01
ugcgcccuacgccac

SEQ ID NO: 1522906 - RNA, 13 nt, Pseudomonas aeruginosa PA01
ugcgccgagcgcu

SEQ ID NO: 1522907 - RNA, 18 nt, Pseudomonas aeruginosa PA01
ugcgccgacgccaccagc

SEQ ID NO: 1522908 - RNA, 21 nt, Pseudomonas aeruginosa PA01
ugcgccgccuuucugcccggc

SEQ ID NO: 1522909 - RNA, 23 nt, Pseudomonas aeruginosa PA01
ugcgccgcggcguugcgcggaau

SEQ ID NO: 1522910 - RNA, 21 nt, Pseudomonas aeruginosa PA01
ugcgccgcgguuccagcucgu

SEQ ID NO: 1522911 - RNA, 18 nt, Pseudomonas aeruginosa PA01
ugcgccgccucgcgcaac

SEQ ID NO: 1522912 - RNA, 22 nt, Pseudomonas aeruginosa PA01
ugcgccgccggcuccuugcgcc

SEQ ID NO: 1522913 - RNA, 13 nt, Pseudomonas aeruginosa PA01
ugcgaaaagcccg

SEQ ID NO: 1522914 - RNA, 20 nt, Pseudomonas aeruginosa PA01
ugcgagcgcacaacgccuuc

SEQ ID NO: 1522915 - RNA, 17 nt, Pseudomonas aeruginosa PA01
ugcgagggauguuccag

SEQ ID NO: 1522916 - RNA, 22 nt, Pseudomonas aeruginosa PA01
ugccgggguccgccggucacca

SEQ ID NO: 1522917 - RNA, 18 nt, Pseudomonas aeruginosa PA01
ugccggucaggcuggugc

SEQ ID NO: 1522918 - RNA, 13 nt, Pseudomonas aeruginosa PA01
ugccgguagggcg

SEQ ID NO: 1522919 - RNA, 23 nt, Pseudomonas aeruginosa PA01
ugccgguaucgcgcuuggacagc

SEQ ID NO: 1522920 - RNA, 17 nt, Pseudomonas aeruginosa PA01
ugccgguaauuggccag

SEQ ID NO: 1522921 - RNA, 20 nt, Pseudomonas aeruginosa PA01
ugccgguaauuggccaggcu

SEQ ID NO: 1522922 - RNA, 19 nt, Pseudomonas aeruginosa PA01
ugccggucgcgcagcaccg

SEQ ID NO: 1522923 - RNA, 20 nt, Pseudomonas aeruginosa PA01
ugccggugcuggugcggccg

SEQ ID NO: 1522924 - RNA, 19 nt, Pseudomonas aeruginosa PA01
ugccguccgucggcagugg

SEQ ID NO: 1522925 - RNA, 17 nt, Pseudomonas aeruginosa PA01
ugccguacuucagggug

SEQ ID NO: 1522926 - RNA, 18 nt, Pseudomonas aeruginosa PA01
ugccguacuucaggguga

SEQ ID NO: 1522927 - RNA, 17 nt, Pseudomonas aeruginosa PA01
ugccguacuugaaggug

SEQ ID NO: 1522928 - RNA, 21 nt, Pseudomonas aeruginosa PA01
ugccgguggcgcccagccaga

SEQ ID NO: 1522929 - RNA, 20 nt, Pseudomonas aeruginosa PA01
ugccgguuuguugcaggcug

SEQ ID NO: 1522930 - RNA, 14 nt, Pseudomonas aeruginosa PA01
ugccagaaaaccca

SEQ ID NO: 1522931 - RNA, 17 nt, Pseudomonas aeruginosa PA01
ugccagaaaacccagcg

SEQ ID NO: 1522932 - RNA, 17 nt, Pseudomonas aeruginosa PA01
ugccagacgaucagcgg

SEQ ID NO: 1522933 - RNA, 22 nt, Pseudomonas aeruginosa PA01
ugccggcgcgcacggaggcgcu

SEQ ID NO: 1522934 - RNA, 20 nt, Pseudomonas aeruginosa PA01
ugccggcgcagaucgcggcg

SEQ ID NO: 1522935 - RNA, 17 nt, Pseudomonas aeruginosa PA01
ugccggccgccagcagg

SEQ ID NO: 1522936 - RNA, 17 nt, Pseudomonas aeruginosa PA01
ugccggccaugcaggcc

SEQ ID NO: 1522937 - RNA, 14 nt, Pseudomonas aeruginosa PA01
ugccuuccaccggg

SEQ ID NO: 1522938 - RNA, 12 nt, Pseudomonas aeruginosa PA01
ugccuuccagca

SEQ ID NO: 1522939 - RNA, 20 nt, Pseudomonas aeruginosa PA01
ugccuuccgcgcccaggcug

SEQ ID NO: 1522940 - RNA, 12 nt, Pseudomonas aeruginosa PA01
ugccuuccaggc

SEQ ID NO: 1522941 - RNA, 14 nt, Pseudomonas aeruginosa PA01
ugccuuccaggcug

SEQ ID NO: 1522942 - RNA, 20 nt, Pseudomonas aeruginosa PA01
ugccuugaggccuuucuucu

SEQ ID NO: 1522943 - RNA, 23 nt, Pseudomonas aeruginosa PA01
ugccuucguuggccuugaugccg

SEQ ID NO: 1522944 - RNA, 12 nt, Pseudomonas aeruginosa PA01
ugccuuccuuuu

SEQ ID NO: 1522945 - RNA, 15 nt, Pseudomonas aeruginosa PA01
ugccuucggcggccg

SEQ ID NO: 1522946 - RNA, 16 nt, Pseudomonas aeruginosa PA01
ugccuucggcggcgcc

SEQ ID NO: 1522947 - RNA, 17 nt, Pseudomonas aeruginosa PA01
ugccuguuccuccgcca

SEQ ID NO: 1522948 - RNA, 15 nt, Pseudomonas aeruginosa PA01
ugccuguccagcucc

SEQ ID NO: 1522949 - RNA, 13 nt, Pseudomonas aeruginosa PA01
ugccugagcuggc

SEQ ID NO: 1522950 - RNA, 22 nt, Pseudomonas aeruginosa PA01
ugccugcaccacgcaggcgcgu

SEQ ID NO: 1522951 - RNA, 14 nt, Pseudomonas aeruginosa PA01
ugccucgccgaggc

SEQ ID NO: 1522952 - RNA, 15 nt, Pseudomonas aeruginosa PA01
ugccuccgcucugcu

SEQ ID NO: 1522953 - RNA, 19 nt, Pseudomonas aeruginosa PA01
ugccucggcggcggccugc

SEQ ID NO: 1522954 - RNA, 23 nt, Pseudomonas aeruginosa PA01
ugccgucuucgaugaaggucagc

SEQ ID NO: 1522955 - RNA, 18 nt, Pseudomonas aeruginosa PA01
ugccucugaccgcgcccg

SEQ ID NO: 1522956 - RNA, 21 nt, Pseudomonas aeruginosa PA01
ugccucgguuuccggccaggc

SEQ ID NO: 1522957 - RNA, 21 nt, Pseudomonas aeruginosa PA01
ugguuccaggagggcugcugu

SEQ ID NO: 1522958 - RNA, 12 nt, Pseudomonas aeruginosa PA01
ugguuucuuccc

SEQ ID NO: 1522959 - RNA, 17 nt, Pseudomonas aeruginosa PA01
ugguugccagcagcgcu

SEQ ID NO: 1522960 - RNA, 12 nt, Pseudomonas aeruginosa PA01
ugguugcccagg

SEQ ID NO: 1522961 - RNA, 19 nt, Pseudomonas aeruginosa PA01
uguacagcaggagcgccau

SEQ ID NO: 1522962 - RNA, 14 nt, Pseudomonas aeruginosa PA01
uguacggcaccacc

SEQ ID NO: 1522963 - RNA, 15 nt, Pseudomonas aeruginosa PA01
uguacggcaccacca

SEQ ID NO: 1522964 - RNA, 18 nt, Pseudomonas aeruginosa PA01
uguacagcuucaggcgca

SEQ ID NO: 1522965 - RNA, 14 nt, Pseudomonas aeruginosa PA01
ugguguugaugguc

SEQ ID NO: 1522966 - RNA, 23 nt, Pseudomonas aeruginosa PA01
uggugucgugccgacaggcgucu

SEQ ID NO: 1522967 - RNA, 23 nt, Pseudomonas aeruginosa PA01
uggugugauccugcugguugaag

SEQ ID NO: 1522968 - RNA, 14 nt, Pseudomonas aeruginosa PA01
ugguggucggcagc

SEQ ID NO: 1522969 - RNA, 18 nt, Pseudomonas aeruginosa PA01
ugguggacacccugcugc

SEQ ID NO: 1522970 - RNA, 14 nt, Pseudomonas aeruginosa PA01
ugguggaacagcau

SEQ ID NO: 1522971 - RNA, 13 nt, Pseudomonas aeruginosa PA01
ugguggccguggc

SEQ ID NO: 1522972 - RNA, 15 nt, Pseudomonas aeruginosa PA01
ugguggcgaacagca

SEQ ID NO: 1522973 - RNA, 16 nt, Pseudomonas aeruginosa PA01
ugguggcgaacagcac

SEQ ID NO: 1522974 - RNA, 17 nt, Pseudomonas aeruginosa PA01
ugguggcgaacagcacc

SEQ ID NO: 1522975 - RNA, 18 nt, Pseudomonas aeruginosa PA01
uggugcugccgaugcuga

SEQ ID NO: 1522976 - RNA, 13 nt, Pseudomonas aeruginosa PA01
uggugcguuaccg

SEQ ID NO: 1522977 - RNA, 22 nt, Pseudomonas aeruginosa PA01
uggugcggccgaugaucuccgc

SEQ ID NO: 1522978 - RNA, 20 nt, Pseudomonas aeruginosa PA01
uggugaugccgcggacggca

SEQ ID NO: 1522979 - RNA, 13 nt, Pseudomonas aeruginosa PA01
ugggucaccagca

SEQ ID NO: 1522980 - RNA, 16 nt, Pseudomonas aeruginosa PA01
ugggucacggugagga

SEQ ID NO: 1522981 - RNA, 22 nt, Pseudomonas aeruginosa PA01
ugggucacggugaggaccuggc

SEQ ID NO: 1522982 - RNA, 22 nt, Pseudomonas aeruginosa PA01
ugggucagcggguuggcuucca

SEQ ID NO: 1522983 - RNA, 16 nt, Pseudomonas aeruginosa PA01
uggguaccgacggucg

SEQ ID NO: 1522984 - RNA, 14 nt, Pseudomonas aeruginosa PA01
uggucgguucgucg

SEQ ID NO: 1522985 - RNA, 19 nt, Pseudomonas aeruginosa PA01
uggucgucguaguggccgu

SEQ ID NO: 1522986 - RNA, 18 nt, Pseudomonas aeruginosa PA01
uggucucgcugacccagg

SEQ ID NO: 1522987 - RNA, 12 nt, Pseudomonas aeruginosa PA01
uguauuccuugc

SEQ ID NO: 1522988 - RNA, 18 nt, Pseudomonas aeruginosa PA01
uguauccguacuggcgcc

SEQ ID NO: 1522989 - RNA, 16 nt, Pseudomonas aeruginosa PA01
ugucccggguguccuu

SEQ ID NO: 1522990 - RNA, 20 nt, Pseudomonas aeruginosa PA01
ugucccggccauuccuucca

SEQ ID NO: 1522991 - RNA, 14 nt, Pseudomonas aeruginosa PA01
ugucccuucuuuuu

SEQ ID NO: 1522992 - RNA, 22 nt, Pseudomonas aeruginosa PA01
ugucccgccgcgccgcucaggc

SEQ ID NO: 1522993 - RNA, 20 nt, Pseudomonas aeruginosa PA01
uguccaugaagacguacagc

SEQ ID NO: 1522994 - RNA, 19 nt, Pseudomonas aeruginosa PA01
uguccaugaaugccuugag

SEQ ID NO: 1522995 - RNA, 19 nt, Pseudomonas aeruginosa PA01
ugucagggguugcaauaga

SEQ ID NO: 1522996 - RNA, 21 nt, Pseudomonas aeruginosa PA01
ugucagggguugcaauagaaa

SEQ ID NO: 1522997 - RNA, 17 nt, Pseudomonas aeruginosa PA01
uguccuggaucggcagc

SEQ ID NO: 1522998 - RNA, 16 nt, Pseudomonas aeruginosa PA01
uguccugggccaccug

SEQ ID NO: 1522999 - RNA, 17 nt, Pseudomonas aeruginosa PA01
uguccugggccaccugg

SEQ ID NO: 1523000 - RNA, 16 nt, Pseudomonas aeruginosa PA01
uguccugcuccugaag

SEQ ID NO: 1523001 - RNA, 17 nt, Pseudomonas aeruginosa PA01
uguccgagaccggcagc

SEQ ID NO: 1523002 - RNA, 16 nt, Pseudomonas aeruginosa PA01
uguccgauucuuggcu

SEQ ID NO: 1523003 - RNA, 15 nt, Pseudomonas aeruginosa PA01
uguccgccaguuccg

SEQ ID NO: 1523004 - RNA, 12 nt, Pseudomonas aeruginosa PA01
uguccgccgccc

SEQ ID NO: 1523005 - RNA, 18 nt, Pseudomonas aeruginosa PA01
uguccgcgcgcuuccagg

SEQ ID NO: 1523006 - RNA, 22 nt, Pseudomonas aeruginosa PA01
uguccgcgcgcuuccaggcacg

SEQ ID NO: 1523007 - RNA, 19 nt, Pseudomonas aeruginosa PA01
uguccgggaugccggugcu

SEQ ID NO: 1523008 - RNA, 21 nt, Pseudomonas aeruginosa PA01
uguccggcaccaccagcgcgc

SEQ ID NO: 1523009 - RNA, 16 nt, Pseudomonas aeruginosa PA01
ugucgaggaaggccag

SEQ ID NO: 1523010 - RNA, 18 nt, Pseudomonas aeruginosa PA01
ugucgagguagguccagg

SEQ ID NO: 1523011 - RNA, 20 nt, Pseudomonas aeruginosa PA01
ugucgagguugcgcuccauc

SEQ ID NO: 1523012 - RNA, 22 nt, Pseudomonas aeruginosa PA01
ugucgagguugcgcuccaucca

SEQ ID NO: 1523013 - RNA, 14 nt, Pseudomonas aeruginosa PA01
ugucgcuggccagc

SEQ ID NO: 1523014 - RNA, 23 nt, Pseudomonas aeruginosa PA01
ugucgacgacgaaaggccgcgcc

SEQ ID NO: 1523015 - RNA, 12 nt, Pseudomonas aeruginosa PA01
uguccuuguucg

SEQ ID NO: 1523016 - RNA, 13 nt, Pseudomonas aeruginosa PA01
ugucguccaggcu

SEQ ID NO: 1523017 - RNA, 12 nt, Pseudomonas aeruginosa PA01
ugucggccuugg

SEQ ID NO: 1523018 - RNA, 15 nt, Pseudomonas aeruginosa PA01
ugucggccgccaggg

SEQ ID NO: 1523019 - RNA, 13 nt, Pseudomonas aeruginosa PA01
ugucucgccagcc

SEQ ID NO: 1523020 - RNA, 16 nt, Pseudomonas aeruginosa PA01
ugugauuggguuccuc

SEQ ID NO: 1523021 - RNA, 14 nt, Pseudomonas aeruginosa PA01
ugugccgcccugcu

SEQ ID NO: 1523022 - RNA, 12 nt, Pseudomonas aeruginosa PA01
ugugcaccagca

SEQ ID NO: 1523023 - RNA, 21 nt, Pseudomonas aeruginosa PA01
ugugcaacggaaacacagcac

SEQ ID NO: 1523024 - RNA, 14 nt, Pseudomonas aeruginosa PA01
ugggcucuaugcaa

SEQ ID NO: 1523025 - RNA, 22 nt, Pseudomonas aeruginosa PA01
ugggcuccagcgggaaggucgg

SEQ ID NO: 1523026 - RNA, 21 nt, Pseudomonas aeruginosa PA01
ugggcugggucggcuggcagg

SEQ ID NO: 1523027 - RNA, 18 nt, Pseudomonas aeruginosa PA01
ugggcgaagccggcggcg

SEQ ID NO: 1523028 - RNA, 16 nt, Pseudomonas aeruginosa PA01
ugggccugucgggggc

SEQ ID NO: 1523029 - RNA, 16 nt, Pseudomonas aeruginosa PA01
ugggcgagggcgcgca

SEQ ID NO: 1523030 - RNA, 21 nt, Pseudomonas aeruginosa PA01
ugggcgaucacgccgcgcacc

SEQ ID NO: 1523031 - RNA, 18 nt, Pseudomonas aeruginosa PA01
ugggguucgacagcgcgg

SEQ ID NO: 1523032 - RNA, 18 nt, Pseudomonas aeruginosa PA01
ugggguugcggcgcccgc

SEQ ID NO: 1523033 - RNA, 13 nt, Pseudomonas aeruginosa PA01
uggggaaaucggu

SEQ ID NO: 1523034 - RNA, 17 nt, Pseudomonas aeruginosa PA01
ugggcauggcuggcgcu

SEQ ID NO: 1523035 - RNA, 23 nt, Pseudomonas aeruginosa PA01
ugggcaucagcucgucuuucagg

SEQ ID NO: 1523036 - RNA, 12 nt, Pseudomonas aeruginosa PA01
ugggccagccca

SEQ ID NO: 1523037 - RNA, 22 nt, Pseudomonas aeruginosa PA01
ugggccacuucgcgguccaggg

SEQ ID NO: 1523038 - RNA, 16 nt, Pseudomonas aeruginosa PA01
ugggccucgcugcgca

SEQ ID NO: 1523039 - RNA, 19 nt, Pseudomonas aeruginosa PA01
ugggccgugaaaagcggcg

SEQ ID NO: 1523040 - RNA, 13 nt, Pseudomonas aeruginosa PA01
ugggccugcaggu

SEQ ID NO: 1523041 - RNA, 20 nt, Pseudomonas aeruginosa PA01
ugggccggaacggcuugcug

SEQ ID NO: 1523042 - RNA, 11 nt, Pseudomonas aeruginosa PA01
ugggccgccga

SEQ ID NO: 1523043 - RNA, 17 nt, Pseudomonas aeruginosa PA01
ugggccgaaggccaggc

SEQ ID NO: 1523044 - RNA, 21 nt, Pseudomonas aeruginosa PA01
ugggccaggcauccagcaccg

SEQ ID NO: 1523045 - RNA, 20 nt, Pseudomonas aeruginosa PA01
ugggccagggauuccuuggu

SEQ ID NO: 1523046 - RNA, 13 nt, Pseudomonas aeruginosa PA01
ugggccagggccu

SEQ ID NO: 1523047 - RNA, 14 nt, Pseudomonas aeruginosa PA01
ugggccaggaucag

SEQ ID NO: 1523048 - RNA, 12 nt, Pseudomonas aeruginosa PA01
uggcuggccagc

SEQ ID NO: 1523049 - RNA, 18 nt, Pseudomonas aeruginosa PA01
uggcuggccagcccuggu

SEQ ID NO: 1523050 - RNA, 22 nt, Pseudomonas aeruginosa PA01
uggcugcucgccucgggccaug

SEQ ID NO: 1523051 - RNA, 16 nt, Pseudomonas aeruginosa PA01
uggcugcgcgccacca

SEQ ID NO: 1523052 - RNA, 18 nt, Pseudomonas aeruginosa PA01
uggcugcgcgccaccacc

SEQ ID NO: 1523053 - RNA, 13 nt, Pseudomonas aeruginosa PA01
uggcugaagcccc

SEQ ID NO: 1523054 - RNA, 17 nt, Pseudomonas aeruginosa PA01
uggcuccgggccgaggg

SEQ ID NO: 1523055 - RNA, 23 nt, Pseudomonas aeruginosa PA01
uggcucauggcauggccauggca

SEQ ID NO: 1523056 - RNA, 14 nt, Pseudomonas aeruginosa PA01
uggcuccccccugg

SEQ ID NO: 1523057 - RNA, 14 nt, Pseudomonas aeruginosa PA01
uggcuguagggaca

SEQ ID NO: 1523058 - RNA, 21 nt, Pseudomonas aeruginosa PA01
uggcugucgccgaucugcagg

SEQ ID NO: 1523059 - RNA, 16 nt, Pseudomonas aeruginosa PA01
ugggaaccucggcagg

SEQ ID NO: 1523060 - RNA, 14 nt, Pseudomonas aeruginosa PA01
ugggacggcguggu

SEQ ID NO: 1523061 - RNA, 14 nt, Pseudomonas aeruginosa PA01
ugggacggcugccc

SEQ ID NO: 1523062 - RNA, 15 nt, Pseudomonas aeruginosa PA01
ugggacgaccucaga

SEQ ID NO: 1523063 - RNA, 22 nt, Pseudomonas aeruginosa PA01
ugggacggaacgucggccuggg

SEQ ID NO: 1523064 - RNA, 16 nt, Pseudomonas aeruginosa PA01
ugggacggcagccugg

SEQ ID NO: 1523065 - RNA, 15 nt, Pseudomonas aeruginosa PA01
ugggacggcggcugg

SEQ ID NO: 1523066 - RNA, 23 nt, Pseudomonas aeruginosa PA01
uggcgcgcuuuccggcgcggccu

SEQ ID NO: 1523067 - RNA, 18 nt, Pseudomonas aeruginosa PA01
uggcgcgcgcgccagguc

SEQ ID NO: 1523068 - RNA, 19 nt, Pseudomonas aeruginosa PA01
uggcgcgggcgaaggccuc

SEQ ID NO: 1523069 - RNA, 21 nt, Pseudomonas aeruginosa PA01
uggcgccauugugcgcgcgca

SEQ ID NO: 1523070 - RNA, 14 nt, Pseudomonas aeruginosa PA01
uggcgcgcaccacc

SEQ ID NO: 1523071 - RNA, 19 nt, Pseudomonas aeruginosa PA01
uggcgcgcaaaaaaagggg

SEQ ID NO: 1523072 - RNA, 20 nt, Pseudomonas aeruginosa PA01
uggcgcgcaaaaaaagggga

SEQ ID NO: 1523073 - RNA, 17 nt, Pseudomonas aeruginosa PA01
uggcgcgagaagccagc

SEQ ID NO: 1523074 - RNA, 21 nt, Pseudomonas aeruginosa PA01
uggcgcgauccgcgcggcaac

SEQ ID NO: 1523075 - RNA, 20 nt, Pseudomonas aeruginosa PA01
uggcggcgacgaagcccagg

SEQ ID NO: 1523076 - RNA, 19 nt, Pseudomonas aeruginosa PA01
uggcggcgacgaaggucgg

SEQ ID NO: 1523077 - RNA, 18 nt, Pseudomonas aeruginosa PA01
uggcggccgccgcgcagc

SEQ ID NO: 1523078 - RNA, 21 nt, Pseudomonas aeruginosa PA01
uggcggccgccggcgcccugc

SEQ ID NO: 1523079 - RNA, 15 nt, Pseudomonas aeruginosa PA01
uggcgcgucgcugcc

SEQ ID NO: 1523080 - RNA, 16 nt, Pseudomonas aeruginosa PA01
uggcgcgucgcugccg

SEQ ID NO: 1523081 - RNA, 17 nt, Pseudomonas aeruginosa PA01
uggcggccagggcaugg

SEQ ID NO: 1523082 - RNA, 15 nt, Pseudomonas aeruginosa PA01
uggcgguuccuccau

SEQ ID NO: 1523083 - RNA, 15 nt, Pseudomonas aeruginosa PA01
uggcguuuucccagg

SEQ ID NO: 1523084 - RNA, 19 nt, Pseudomonas aeruginosa PA01
uggcguccccaugcccggc

SEQ ID NO: 1523085 - RNA, 20 nt, Pseudomonas aeruginosa PA01
uggcguacuugggcaucagc

SEQ ID NO: 1523086 - RNA, 16 nt, Pseudomonas aeruginosa PA01
uggcgccauccuccag

SEQ ID NO: 1523087 - RNA, 22 nt, Pseudomonas aeruginosa PA01
uggcgccauccuccagcgccgc

SEQ ID NO: 1523088 - RNA, 16 nt, Pseudomonas aeruginosa PA01
uggcgcagacaggccu

SEQ ID NO: 1523089 - RNA, 14 nt, Pseudomonas aeruginosa PA01
uggcgcagcggcag

SEQ ID NO: 1523090 - RNA, 15 nt, Pseudomonas aeruginosa PA01
uggcgcagcggcagc

SEQ ID NO: 1523091 - RNA, 13 nt, Pseudomonas aeruginosa PA01
uggcgcagcgggu

SEQ ID NO: 1523092 - RNA, 12 nt, Pseudomonas aeruginosa PA01
uggcgcaggccg

SEQ ID NO: 1523093 - RNA, 16 nt, Pseudomonas aeruginosa PA01
uggcgauucuccuggg

SEQ ID NO: 1523094 - RNA, 18 nt, Pseudomonas aeruginosa PA01
uggcgauguucaccgcgg

SEQ ID NO: 1523095 - RNA, 20 nt, Pseudomonas aeruginosa PA01
uggcgacgucgccccagccu

SEQ ID NO: 1523096 - RNA, 18 nt, Pseudomonas aeruginosa PA01
uggcgacgaugcgcccca

SEQ ID NO: 1523097 - RNA, 13 nt, Pseudomonas aeruginosa PA01
uggccuggccacc

SEQ ID NO: 1523098 - RNA, 14 nt, Pseudomonas aeruginosa PA01
uggccuggccaccc

SEQ ID NO: 1523099 - RNA, 21 nt, Pseudomonas aeruginosa PA01
uggccgaaucgaacagggcga

SEQ ID NO: 1523100 - RNA, 14 nt, Pseudomonas aeruginosa PA01
uggccuugauggug

SEQ ID NO: 1523101 - RNA, 17 nt, Pseudomonas aeruginosa PA01
uggcccgguuggccagg

SEQ ID NO: 1523102 - RNA, 12 nt, Pseudomonas aeruginosa PA01
uggcccugggcg

SEQ ID NO: 1523103 - RNA, 16 nt, Pseudomonas aeruginosa PA01
uggcccuucgcccugc

SEQ ID NO: 1523104 - RNA, 21 nt, Pseudomonas aeruginosa PA01
uggcccuugacgucguucagc

SEQ ID NO: 1523105 - RNA, 15 nt, Pseudomonas aeruginosa PA01
uggcccugcaacagg

SEQ ID NO: 1523106 - RNA, 12 nt, Pseudomonas aeruginosa PA01
uggcccuggccu

SEQ ID NO: 1523107 - RNA, 13 nt, Pseudomonas aeruginosa PA01
uggcccuggccuu

SEQ ID NO: 1523108 - RNA, 18 nt, Pseudomonas aeruginosa PA01
uggcccuggauaucuggg

SEQ ID NO: 1523109 - RNA, 20 nt, Pseudomonas aeruginosa PA01
uggcccuggauaucugggcc

SEQ ID NO: 1523110 - RNA, 12 nt, Pseudomonas aeruginosa PA01
uggacuucgguc

SEQ ID NO: 1523111 - RNA, 20 nt, Pseudomonas aeruginosa PA01
uggacgcgcuuguccuccag

SEQ ID NO: 1523112 - RNA, 23 nt, Pseudomonas aeruginosa PA01
uggacggacagggaaagccccgc

SEQ ID NO: 1523113 - RNA, 22 nt, Pseudomonas aeruginosa PA01
uggacgguaucucuccaucccc

SEQ ID NO: 1523114 - RNA, 14 nt, Pseudomonas aeruginosa PA01
uggagaugcucagg

SEQ ID NO: 1523115 - RNA, 21 nt, Pseudomonas aeruginosa PA01
uggagcagaaccgccagcagu

SEQ ID NO: 1523116 - RNA, 12 nt, Pseudomonas aeruginosa PA01
uggaggcccaga

SEQ ID NO: 1523117 - RNA, 18 nt, Pseudomonas aeruginosa PA01
uggaggaucgagccuugc

SEQ ID NO: 1523118 - RNA, 21 nt, Pseudomonas aeruginosa PA01
uggagcugcgcgcgaucacau

SEQ ID NO: 1523119 - RNA, 12 nt, Pseudomonas aeruginosa PA01
uggagcgcugcg

SEQ ID NO: 1523120 - RNA, 12 nt, Pseudomonas aeruginosa PA01
uggaucaggaag

SEQ ID NO: 1523121 - RNA, 17 nt, Pseudomonas aeruginosa PA01
uggauccgugccaggcg

SEQ ID NO: 1523122 - RNA, 17 nt, Pseudomonas aeruginosa PA01
uggaucggccccaccug

SEQ ID NO: 1523123 - RNA, 13 nt, Pseudomonas aeruginosa PA01
uggaucggcccuu

SEQ ID NO: 1523124 - RNA, 16 nt, Pseudomonas aeruginosa PA01
uggaucggcccuucga

SEQ ID NO: 1523125 - RNA, 23 nt, Pseudomonas aeruginosa PA01
uggaucgccauaggaugccgagg

SEQ ID NO: 1523126 - RNA, 17 nt, Pseudomonas aeruginosa PA01
uggaucgcccggcugca

SEQ ID NO: 1523127 - RNA, 17 nt, Pseudomonas aeruginosa PA01
uggaguaucgcccuggc

SEQ ID NO: 1523128 - RNA, 16 nt, Pseudomonas aeruginosa PA01
uggaguaggggcagac

SEQ ID NO: 1523129 - RNA, 14 nt, Pseudomonas aeruginosa PA01
uggaguuggaacug

SEQ ID NO: 1523130 - RNA, 23 nt, Pseudomonas aeruginosa PA01
uggcagggcgcguccagcuccac

SEQ ID NO: 1523131 - RNA, 19 nt, Pseudomonas aeruginosa PA01
uggcaggugccgcucgucc

SEQ ID NO: 1523132 - RNA, 14 nt, Pseudomonas aeruginosa PA01
uggcaggccuggaa

SEQ ID NO: 1523133 - RNA, 19 nt, Pseudomonas aeruginosa PA01
uggcaggccuggaauaccc

SEQ ID NO: 1523134 - RNA, 17 nt, Pseudomonas aeruginosa PA01
uggcaggcgcccgguca

SEQ ID NO: 1523135 - RNA, 21 nt, Pseudomonas aeruginosa PA01
uggcaaaaaugcccuuggcuu

SEQ ID NO: 1523136 - RNA, 14 nt, Pseudomonas aeruginosa PA01
uggauggugcccgg

SEQ ID NO: 1523137 - RNA, 14 nt, Pseudomonas aeruginosa PA01
uggcaucgccgccc

SEQ ID NO: 1523138 - RNA, 23 nt, Pseudomonas aeruginosa PA01
uggcauuggugcugcgcgcggcc

SEQ ID NO: 1523139 - RNA, 16 nt, Pseudomonas aeruginosa PA01
uggcauggcuuuccag

SEQ ID NO: 1523140 - RNA, 19 nt, Pseudomonas aeruginosa PA01
uggcccaguugcccggccu

SEQ ID NO: 1523141 - RNA, 16 nt, Pseudomonas aeruginosa PA01
uggcccagaccuugga

SEQ ID NO: 1523142 - RNA, 16 nt, Pseudomonas aeruginosa PA01
uggcccagauauccag

SEQ ID NO: 1523143 - RNA, 18 nt, Pseudomonas aeruginosa PA01
uggcccagauauccaggg

SEQ ID NO: 1523144 - RNA, 13 nt, Pseudomonas aeruginosa PA01
uggccccgccgag

SEQ ID NO: 1523145 - RNA, 15 nt, Pseudomonas aeruginosa PA01
uggcccacuccagau

SEQ ID NO: 1523146 - RNA, 17 nt, Pseudomonas aeruginosa PA01
uggcccaauccgcgccg

SEQ ID NO: 1523147 - RNA, 18 nt, Pseudomonas aeruginosa PA01
uggccacgacccugcugg

SEQ ID NO: 1523148 - RNA, 16 nt, Pseudomonas aeruginosa PA01
uggccacuccgggcug

SEQ ID NO: 1523149 - RNA, 18 nt, Pseudomonas aeruginosa PA01
uggccagaauuccagcag

SEQ ID NO: 1523150 - RNA, 20 nt, Pseudomonas aeruginosa PA01
uggccagaauuccagcaggu

SEQ ID NO: 1523151 - RNA, 20 nt, Pseudomonas aeruginosa PA01
uggccacccuugcgcccggc

SEQ ID NO: 1523152 - RNA, 21 nt, Pseudomonas aeruginosa PA01
uggccacccuuggagccgccc

SEQ ID NO: 1523153 - RNA, 20 nt, Pseudomonas aeruginosa PA01
uguggagccggugccggcgg

SEQ ID NO: 1523154 - RNA, 16 nt, Pseudomonas aeruginosa PA01
uuaccccgaccagguc

SEQ ID NO: 1523155 - RNA, 15 nt, Pseudomonas aeruginosa PA01
uuagaggcucagccg

SEQ ID NO: 1523156 - RNA, 17 nt, Pseudomonas aeruginosa PA01
uuagaauaccggccugu

SEQ ID NO: 1523157 - RNA, 11 nt, Pseudomonas aeruginosa PA01
uucaaccaggc

SEQ ID NO: 1523158 - RNA, 13 nt, Pseudomonas aeruginosa PA01
uucaaccguggcu

SEQ ID NO: 1523159 - RNA, 17 nt, Pseudomonas aeruginosa PA01
uucacccgcagcggcag

SEQ ID NO: 1523160 - RNA, 20 nt, Pseudomonas aeruginosa PA01
uucaccgcggccuuggucuc

SEQ ID NO: 1523161 - RNA, 18 nt, Pseudomonas aeruginosa PA01
uucacgucgagcacgccg

SEQ ID NO: 1523162 - RNA, 13 nt, Pseudomonas aeruginosa PA01
uucagcaggggga

SEQ ID NO: 1523163 - RNA, 20 nt, Pseudomonas aeruginosa PA01
uucagcagggggacgaaaac

SEQ ID NO: 1523164 - RNA, 15 nt, Pseudomonas aeruginosa PA01
uucagccagagcccg

SEQ ID NO: 1523165 - RNA, 20 nt, Pseudomonas aeruginosa PA01
uucagccgaccguccgccug

SEQ ID NO: 1523166 - RNA, 14 nt, Pseudomonas aeruginosa PA01
uucagcuccagcag

SEQ ID NO: 1523167 - RNA, 14 nt, Pseudomonas aeruginosa PA01
uuauccgccgccga

SEQ ID NO: 1523168 - RNA, 22 nt, Pseudomonas aeruginosa PA01
uucuauuucccgugcggccuac

SEQ ID NO: 1523169 - RNA, 16 nt, Pseudomonas aeruginosa PA01
uucucgaacagcuccu

SEQ ID NO: 1523170 - RNA, 17 nt, Pseudomonas aeruginosa PA01
uucucgccucccggcuc

SEQ ID NO: 1523171 - RNA, 15 nt, Pseudomonas aeruginosa PA01
uucucggucgccgcc

SEQ ID NO: 1523172 - RNA, 19 nt, Pseudomonas aeruginosa PA01
uucucggugaccaccuuga

SEQ ID NO: 1523173 - RNA, 20 nt, Pseudomonas aeruginosa PA01
uucucggugaccaccuugau

SEQ ID NO: 1523174 - RNA, 22 nt, Pseudomonas aeruginosa PA01
uucugcaccuuggccacgcugc

SEQ ID NO: 1523175 - RNA, 23 nt, Pseudomonas aeruginosa PA01
uucugcaggcgcuccagacucuc

SEQ ID NO: 1523176 - RNA, 14 nt, Pseudomonas aeruginosa PA01
uucggaguugcauu

SEQ ID NO: 1523177 - RNA, 19 nt, Pseudomonas aeruginosa PA01
uucguaaugcacgcucaug

SEQ ID NO: 1523178 - RNA, 16 nt, Pseudomonas aeruginosa PA01
uucguaggucaugcgu

SEQ ID NO: 1523179 - RNA, 17 nt, Pseudomonas aeruginosa PA01
uucgugccaggcggcag

SEQ ID NO: 1523180 - RNA, 15 nt, Pseudomonas aeruginosa PA01
uucgccggccaggug

SEQ ID NO: 1523181 - RNA, 23 nt, Pseudomonas aeruginosa PA01
uucgccggccugcgcgcaccagg

SEQ ID NO: 1523182 - RNA, 15 nt, Pseudomonas aeruginosa PA01
uucgccgaccagguc

SEQ ID NO: 1523183 - RNA, 23 nt, Pseudomonas aeruginosa PA01
uucgcugcugccgcguuccuugu

SEQ ID NO: 1523184 - RNA, 19 nt, Pseudomonas aeruginosa PA01
uucgcugucgagcagggag

SEQ ID NO: 1523185 - RNA, 13 nt, Pseudomonas aeruginosa PA01
uucgcugucgucg

SEQ ID NO: 1523186 - RNA, 22 nt, Pseudomonas aeruginosa PA01
uucgcugagaccgauccagcag

SEQ ID NO: 1523187 - RNA, 15 nt, Pseudomonas aeruginosa PA01
uuccuugcgcggcag

SEQ ID NO: 1523188 - RNA, 18 nt, Pseudomonas aeruginosa PA01
uucgaacaaucccagcuc

SEQ ID NO: 1523189 - RNA, 20 nt, Pseudomonas aeruginosa PA01
uuccaguuccuucuugaccc

SEQ ID NO: 1523190 - RNA, 23 nt, Pseudomonas aeruginosa PA01
uuccaggggcauguccaccgccg

SEQ ID NO: 1523191 - RNA, 18 nt, Pseudomonas aeruginosa PA01
uuccaggguuuccagcag

SEQ ID NO: 1523192 - RNA, 18 nt, Pseudomonas aeruginosa PA01
uuccagguagcccaccuc

SEQ ID NO: 1523193 - RNA, 23 nt, Pseudomonas aeruginosa PA01
uuccaggucggcggcacgcucca

SEQ ID NO: 1523194 - RNA, 20 nt, Pseudomonas aeruginosa PA01
uuccagcggcuccuggaugc

SEQ ID NO: 1523195 - RNA, 12 nt, Pseudomonas aeruginosa PA01
uuccagcggcac

SEQ ID NO: 1523196 - RNA, 20 nt, Pseudomonas aeruginosa PA01
uuccagcggcacuucccgcc

SEQ ID NO: 1523197 - RNA, 19 nt, Pseudomonas aeruginosa PA01
uuccaggaugcaaccgccc

SEQ ID NO: 1523198 - RNA, 13 nt, Pseudomonas aeruginosa PA01
uuccagcugccag

SEQ ID NO: 1523199 - RNA, 17 nt, Pseudomonas aeruginosa PA01
uuccaucgcaggcagcg

SEQ ID NO: 1523200 - RNA, 19 nt, Pseudomonas aeruginosa PA01
uucaggccggcgccgccga

SEQ ID NO: 1523201 - RNA, 21 nt, Pseudomonas aeruginosa PA01
uucagggcuccgaugaagcag

SEQ ID NO: 1523202 - RNA, 21 nt, Pseudomonas aeruginosa PA01
uucagggcgagcagggcacag

SEQ ID NO: 1523203 - RNA, 11 nt, Pseudomonas aeruginosa PA01
uuccaccgccu

SEQ ID NO: 1523204 - RNA, 16 nt, Pseudomonas aeruginosa PA01
uuccaccgccugcccc

SEQ ID NO: 1523205 - RNA, 23 nt, Pseudomonas aeruginosa PA01
uuccacgagagaaaugaaauagu

SEQ ID NO: 1523206 - RNA, 13 nt, Pseudomonas aeruginosa PA01
uuccagcaggcag

SEQ ID NO: 1523207 - RNA, 13 nt, Pseudomonas aeruginosa PA01
uuccagcccuucg

SEQ ID NO: 1523208 - RNA, 15 nt, Pseudomonas aeruginosa PA01
uuccgcuuccacgcu

SEQ ID NO: 1523209 - RNA, 13 nt, Pseudomonas aeruginosa PA01
uuccgcgcaggac

SEQ ID NO: 1523210 - RNA, 22 nt, Pseudomonas aeruginosa PA01
uuccgcggcgacggcucuuccc

SEQ ID NO: 1523211 - RNA, 15 nt, Pseudomonas aeruginosa PA01
uuccgcgcccaggcu

SEQ ID NO: 1523212 - RNA, 16 nt, Pseudomonas aeruginosa PA01
uuccgcgcccaggcug

SEQ ID NO: 1523213 - RNA, 17 nt, Pseudomonas aeruginosa PA01
uuccgcgcccaggcugc

SEQ ID NO: 1523214 - RNA, 19 nt, Pseudomonas aeruginosa PA01
uuccgcgcccggcuggcca

SEQ ID NO: 1523215 - RNA, 13 nt, Pseudomonas aeruginosa PA01
uuccuccagaguc

SEQ ID NO: 1523216 - RNA, 21 nt, Pseudomonas aeruginosa PA01
uuccuccagagugcgcagcag

SEQ ID NO: 1523217 - RNA, 22 nt, Pseudomonas aeruginosa PA01
uuccuccagggugccgaccaac

SEQ ID NO: 1523218 - RNA, 16 nt, Pseudomonas aeruginosa PA01
uuccuccgagggagga

SEQ ID NO: 1523219 - RNA, 17 nt, Pseudomonas aeruginosa PA01
uuccucgaaggucgcga

SEQ ID NO: 1523220 - RNA, 13 nt, Pseudomonas aeruginosa PA01
uuccucagcgccg

SEQ ID NO: 1523221 - RNA, 15 nt, Pseudomonas aeruginosa PA01
uuccucgcccucaug

SEQ ID NO: 1523222 - RNA, 14 nt, Pseudomonas aeruginosa PA01
uuccucgggcagcu

SEQ ID NO: 1523223 - RNA, 23 nt, Pseudomonas aeruginosa PA01
uuccugcccgaccgguuccagcg

SEQ ID NO: 1523224 - RNA, 21 nt, Pseudomonas aeruginosa PA01
uuccugcggcuugcccaucuu

SEQ ID NO: 1523225 - RNA, 16 nt, Pseudomonas aeruginosa PA01
uuccugcuugucgaug

SEQ ID NO: 1523226 - RNA, 15 nt, Pseudomonas aeruginosa PA01
uuccuugauccacuc

SEQ ID NO: 1523227 - RNA, 13 nt, Pseudomonas aeruginosa PA01
uuccuguucgcug

SEQ ID NO: 1523228 - RNA, 18 nt, Pseudomonas aeruginosa PA01
uuccuguucgcugccuuc

SEQ ID NO: 1523229 - RNA, 15 nt, Pseudomonas aeruginosa PA01
uuccuguaccagggg

SEQ ID NO: 1523230 - RNA, 21 nt, Pseudomonas aeruginosa PA01
uuccugggcuucguccgccug

SEQ ID NO: 1523231 - RNA, 11 nt, Pseudomonas aeruginosa PA01
uuccuggcccu

SEQ ID NO: 1523232 - RNA, 17 nt, Pseudomonas aeruginosa PA01
uuccugcuggcuggcag

SEQ ID NO: 1523233 - RNA, 19 nt, Pseudomonas aeruginosa PA01
uucccagaaaaucggcagu

SEQ ID NO: 1523234 - RNA, 18 nt, Pseudomonas aeruginosa PA01
uucccagaccuggccgcu

SEQ ID NO: 1523235 - RNA, 21 nt, Pseudomonas aeruginosa PA01
uucccagcagcaacagcgccg

SEQ ID NO: 1523236 - RNA, 12 nt, Pseudomonas aeruginosa PA01
uucccagcagcg

SEQ ID NO: 1523237 - RNA, 17 nt, Pseudomonas aeruginosa PA01
uucccagugcucccgca

SEQ ID NO: 1523238 - RNA, 19 nt, Pseudomonas aeruginosa PA01
uucccgcaccggcgcgccg

SEQ ID NO: 1523239 - RNA, 14 nt, Pseudomonas aeruginosa PA01
uuccgauccuccug

SEQ ID NO: 1523240 - RNA, 12 nt, Pseudomonas aeruginosa PA01
uugccuguccag

SEQ ID NO: 1523241 - RNA, 16 nt, Pseudomonas aeruginosa PA01
uugccuuccaggcugu

SEQ ID NO: 1523242 - RNA, 22 nt, Pseudomonas aeruginosa PA01
uugcgccccgggucgcugcuca

SEQ ID NO: 1523243 - RNA, 15 nt, Pseudomonas aeruginosa PA01
uugcgucccugggcc

SEQ ID NO: 1523244 - RNA, 21 nt, Pseudomonas aeruginosa PA01
uugcucaccaaugccagugcc

SEQ ID NO: 1523245 - RNA, 21 nt, Pseudomonas aeruginosa PA01
uugcucgcaccaggccaggug

SEQ ID NO: 1523246 - RNA, 21 nt, Pseudomonas aeruginosa PA01
uugcucugugcgauuucgcug

SEQ ID NO: 1523247 - RNA, 18 nt, Pseudomonas aeruginosa PA01
uugcccgguggccuccug

SEQ ID NO: 1523248 - RNA, 13 nt, Pseudomonas aeruginosa PA01
uugccgaacugca

SEQ ID NO: 1523249 - RNA, 17 nt, Pseudomonas aeruginosa PA01
uugccgcagcagcggcg

SEQ ID NO: 1523250 - RNA, 20 nt, Pseudomonas aeruginosa PA01
uugccgcgagcuuggcccug

SEQ ID NO: 1523251 - RNA, 16 nt, Pseudomonas aeruginosa PA01
uugcccagcaggcuca

SEQ ID NO: 1523252 - RNA, 15 nt, Pseudomonas aeruginosa PA01
uugcccaugugcagc

SEQ ID NO: 1523253 - RNA, 13 nt, Pseudomonas aeruginosa PA01
uugcacagcgccc

SEQ ID NO: 1523254 - RNA, 19 nt, Pseudomonas aeruginosa PA01
uugcaaacgggguaaagau

SEQ ID NO: 1523255 - RNA, 16 nt, Pseudomonas aeruginosa PA01
uugaucaccaccggcu

SEQ ID NO: 1523256 - RNA, 13 nt, Pseudomonas aeruginosa PA01
uugaugaagcccg

SEQ ID NO: 1523257 - RNA, 19 nt, Pseudomonas aeruginosa PA01
uucugcagggcggcuucca

SEQ ID NO: 1523258 - RNA, 19 nt, Pseudomonas aeruginosa PA01
uugaagacgcucacguagc

SEQ ID NO: 1523259 - RNA, 15 nt, Pseudomonas aeruginosa PA01
uugaagcggccguac

SEQ ID NO: 1523260 - RNA, 23 nt, Pseudomonas aeruginosa PA01
uugacgaugaagcgguucucguc

SEQ ID NO: 1523261 - RNA, 15 nt, Pseudomonas aeruginosa PA01
uugacgauggcccag

SEQ ID NO: 1523262 - RNA, 19 nt, Pseudomonas aeruginosa PA01
uugaccgucggcaagcagg

SEQ ID NO: 1523263 - RNA, 12 nt, Pseudomonas aeruginosa PA01
uugacuggcagu

SEQ ID NO: 1523264 - RNA, 16 nt, Pseudomonas aeruginosa PA01
uugacguucaggcugu

SEQ ID NO: 1523265 - RNA, 16 nt, Pseudomonas aeruginosa PA01
uugaauugcugccacu

SEQ ID NO: 1523266 - RNA, 22 nt, Pseudomonas aeruginosa PA01
uugaccaguuucuucgcguggg

SEQ ID NO: 1523267 - RNA, 14 nt, Pseudomonas aeruginosa PA01
uuuagggauggaua

SEQ ID NO: 1523268 - RNA, 21 nt, Pseudomonas aeruginosa PA01
uuguuggccagcagccaggcc

SEQ ID NO: 1523269 - RNA, 16 nt, Pseudomonas aeruginosa PA01
uuucauuuuccauuga

SEQ ID NO: 1523270 - RNA, 21 nt, Pseudomonas aeruginosa PA01
uuucagcccacgcgccuggcc

SEQ ID NO: 1523271 - RNA, 17 nt, Pseudomonas aeruginosa PA01
uuugaacgcuguagaau

SEQ ID NO: 1523272 - RNA, 18 nt, Pseudomonas aeruginosa PA01
uuugaacgggcucaccca

SEQ ID NO: 1523273 - RNA, 22 nt, Pseudomonas aeruginosa PA01
uuuccagcggcuccuggaugcu

SEQ ID NO: 1523274 - RNA, 16 nt, Pseudomonas aeruginosa PA01
uuuccagggccuggcg

SEQ ID NO: 1523275 - RNA, 11 nt, Pseudomonas aeruginosa PA01
uuucccauugu

SEQ ID NO: 1523276 - RNA, 14 nt, Pseudomonas aeruginosa PA01
uuucccgcaccggc

SEQ ID NO: 1523277 - RNA, 19 nt, Pseudomonas aeruginosa PA01
uuuccgccggacccugccg

SEQ ID NO: 1523278 - RNA, 12 nt, Pseudomonas aeruginosa PA01
uuuccugcgccu

SEQ ID NO: 1523279 - RNA, 16 nt, Pseudomonas aeruginosa PA01
uuuccuugaccaucuu

SEQ ID NO: 1523280 - RNA, 22 nt, Pseudomonas aeruginosa PA01
uuuccugguacucguccuccca

SEQ ID NO: 1523281 - RNA, 15 nt, Pseudomonas aeruginosa PA01
uuuccucagcucugu

SEQ ID NO: 1523282 - RNA, 13 nt, Pseudomonas aeruginosa PA01
uuuccucaucucc

SEQ ID NO: 1523283 - RNA, 17 nt, Pseudomonas aeruginosa PA01
uuuccucgaucaggccu

SEQ ID NO: 1523284 - RNA, 22 nt, Pseudomonas aeruginosa PA01
uuucgaugguggaauccagggc

SEQ ID NO: 1523285 - RNA, 16 nt, Pseudomonas aeruginosa PA01
uuucuauuccggggac

SEQ ID NO: 1523286 - RNA, 14 nt, Pseudomonas aeruginosa PA01
uuucugcuggccac

SEQ ID NO: 1523287 - RNA, 15 nt, Pseudomonas aeruginosa PA01
uuucugcuggccacc

SEQ ID NO: 1523288 - RNA, 17 nt, Pseudomonas aeruginosa PA01
uuucugcuggccaccgc

SEQ ID NO: 1523289 - RNA, 14 nt, Pseudomonas aeruginosa PA01
uuuuccaacuccac

SEQ ID NO: 1523290 - RNA, 17 nt, Pseudomonas aeruginosa PA01
uuuucguucgcuguucu

SEQ ID NO: 1523291 - RNA, 14 nt, Pseudomonas aeruginosa PA01
uuuucguuggccag

SEQ ID NO: 1523292 - RNA, 12 nt, Pseudomonas aeruginosa PA01
uuuuccugcugg

SEQ ID NO: 1523293 - RNA, 16 nt, Pseudomonas aeruginosa PA01
uuuuccugcaucuucu

SEQ ID NO: 1523294 - RNA, 21 nt, Pseudomonas aeruginosa PA01
uuuuaucucuuuuuaagagaa

SEQ ID NO: 1523295 - RNA, 20 nt, Pseudomonas aeruginosa PA01
uuuuaauuuugcuaccagca

SEQ ID NO: 1523296 - RNA, 12 nt, Pseudomonas aeruginosa PA01
uuugcugcacgc

SEQ ID NO: 1523297 - RNA, 12 nt, Pseudomonas aeruginosa PA01
uuugggcucaga

SEQ ID NO: 1523298 - RNA, 10 nt, Pseudomonas aeruginosa PA01
uuuucuuccg

SEQ ID NO: 1523299 - RNA, 16 nt, Pseudomonas aeruginosa PA01
uuuuuccucuauggga

SEQ ID NO: 1523300 - RNA, 14 nt, Pseudomonas aeruginosa PA01
uuuuucauuuccuc

SEQ ID NO: 1523301 - RNA, 15 nt, Pseudomonas aeruginosa PA01
uuuuucaugguccgu

SEQ ID NO: 1523302 - RNA, 11 nt, Pseudomonas aeruginosa PA01
uuuuuuugccu

SEQ ID NO: 1523303 - RNA, 16 nt, Pseudomonas aeruginosa PA01
aaauucaaucagggca

SEQ ID NO: 1523304 - RNA, 14 nt, Pseudomonas aeruginosa PA01
aaauucagcgcuuc

SEQ ID NO: 1523305 - RNA, 17 nt, Pseudomonas aeruginosa PA01
uuuuuggcaaaccuccc

SEQ ID NO: 1523306 - RNA, 12 nt, Pseudomonas aeruginosa PA01
aaucaccgccac

SEQ ID NO: 1523307 - RNA, 22 nt, Pseudomonas aeruginosa PA01
aaucgaacccccgaccuucuca

SEQ ID NO: 1523308 - RNA, 13 nt, Pseudomonas aeruginosa PA01
aaucgaugcugua

SEQ ID NO: 1523309 - RNA, 14 nt, Pseudomonas aeruginosa PA01
aauguucuccuccc

SEQ ID NO: 1523310 - RNA, 18 nt, Pseudomonas aeruginosa PA01
aaugccagcgccacgccg

SEQ ID NO: 1523311 - RNA, 20 nt, Pseudomonas aeruginosa PA01
aauggcggauaaccgcaagc

SEQ ID NO: 1523312 - RNA, 18 nt, Pseudomonas aeruginosa PA01
aauggcguggcuuggccc

SEQ ID NO: 1523313 - RNA, 18 nt, Pseudomonas aeruginosa PA01
aauggguucccagcagca

SEQ ID NO: 1523314 - RNA, 15 nt, Pseudomonas aeruginosa PA01
aauguccgagcaggu

SEQ ID NO: 1523315 - RNA, 16 nt, Pseudomonas aeruginosa PA01
aagaaucgcagccaug

SEQ ID NO: 1523316 - RNA, 13 nt, Pseudomonas aeruginosa PA01
aagacaggccuuu

SEQ ID NO: 1523317 - RNA, 11 nt, Pseudomonas aeruginosa PA01
aagacccugca

SEQ ID NO: 1523318 - RNA, 20 nt, Pseudomonas aeruginosa PA01
aagaccgaacaucagcagca

SEQ ID NO: 1523319 - RNA, 23 nt, Pseudomonas aeruginosa PA01
aagaccuguugcagagcggccag

SEQ ID NO: 1523320 - RNA, 13 nt, Pseudomonas aeruginosa PA01
aagacgaaaaagc

SEQ ID NO: 1523321 - RNA, 19 nt, Pseudomonas aeruginosa PA01
aagacaaaauucucccgcu

SEQ ID NO: 1523322 - RNA, 13 nt, Pseudomonas aeruginosa PA01
aagagagcgccag

SEQ ID NO: 1523323 - RNA, 16 nt, Pseudomonas aeruginosa PA01
aagacggccaggaugu

SEQ ID NO: 1523324 - RNA, 15 nt, Pseudomonas aeruginosa PA01
aagacgcccagcagg

SEQ ID NO: 1523325 - RNA, 18 nt, Pseudomonas aeruginosa PA01
aagagcagacacaaaaaa

SEQ ID NO: 1523326 - RNA, 20 nt, Pseudomonas aeruginosa PA01
aagaguguucccucaggaua

SEQ ID NO: 1523327 - RNA, 13 nt, Pseudomonas aeruginosa PA01
aagaguaaaugcu

SEQ ID NO: 1523328 - RNA, 17 nt, Pseudomonas aeruginosa PA01
aagcacggugacacccu

SEQ ID NO: 1523329 - RNA, 20 nt, Pseudomonas aeruginosa PA01
aagcaccuugagggccuugg

SEQ ID NO: 1523330 - RNA, 23 nt, Pseudomonas aeruginosa PA01
aagcagaaagccccugccgcgga

SEQ ID NO: 1523331 - RNA, 14 nt, Pseudomonas aeruginosa PA01
aagcagccauggcu

SEQ ID NO: 1523332 - RNA, 18 nt, Pseudomonas aeruginosa PA01
aagauccgcuccaggcug

SEQ ID NO: 1523333 - RNA, 13 nt, Pseudomonas aeruginosa PA01
aagauccuguagu

SEQ ID NO: 1523334 - RNA, 17 nt, Pseudomonas aeruginosa PA01
aagaucucgccauggcg

SEQ ID NO: 1523335 - RNA, 20 nt, Pseudomonas aeruginosa PA01
aagauuccgcugaggaugua

SEQ ID NO: 1523336 - RNA, 16 nt, Pseudomonas aeruginosa PA01
aaguucgcauaggcgg

SEQ ID NO: 1523337 - RNA, 22 nt, Pseudomonas aeruginosa PA01
aaguuacugauuugauugaaaa

SEQ ID NO: 1523338 - RNA, 15 nt, Pseudomonas aeruginosa PA01
aaguucuccagcaag

SEQ ID NO: 1523339 - RNA, 17 nt, Pseudomonas aeruginosa PA01
aaguucuccagcaagcc

SEQ ID NO: 1523340 - RNA, 20 nt, Pseudomonas aeruginosa PA01
aaguguuagagguugauuca

SEQ ID NO: 1523341 - RNA, 21 nt, Pseudomonas aeruginosa PA01
aagugcagggcguccaguagc

SEQ ID NO: 1523342 - RNA, 19 nt, Pseudomonas aeruginosa PA01
aagcucucgccgcgcucgc

SEQ ID NO: 1523343 - RNA, 20 nt, Pseudomonas aeruginosa PA01
aagcucgcgcaagcgcccgg

SEQ ID NO: 1523344 - RNA, 22 nt, Pseudomonas aeruginosa PA01
aagcuccccgccgccaggcgcu

SEQ ID NO: 1523345 - RNA, 19 nt, Pseudomonas aeruginosa PA01
aagcggaagccgggaagcc

SEQ ID NO: 1523346 - RNA, 16 nt, Pseudomonas aeruginosa PA01
aagcgcucggccugcg

SEQ ID NO: 1523347 - RNA, 16 nt, Pseudomonas aeruginosa PA01
aagcguccaggguugg

SEQ ID NO: 1523348 - RNA, 22 nt, Pseudomonas aeruginosa PA01
aagcguccaggguuggaagaaa

SEQ ID NO: 1523349 - RNA, 19 nt, Pseudomonas aeruginosa PA01
aagcgucacucccaggcug

SEQ ID NO: 1523350 - RNA, 14 nt, Pseudomonas aeruginosa PA01
aaggagcgcgagcg

SEQ ID NO: 1523351 - RNA, 18 nt, Pseudomonas aeruginosa PA01
aaggagcgcgagcggcag

SEQ ID NO: 1523352 - RNA, 18 nt, Pseudomonas aeruginosa PA01
aagcugccuuccagcagg

SEQ ID NO: 1523353 - RNA, 15 nt, Pseudomonas aeruginosa PA01
aagcugccccacagg

SEQ ID NO: 1523354 - RNA, 12 nt, Pseudomonas aeruginosa PA01
aagcuguugcuc

SEQ ID NO: 1523355 - RNA, 21 nt, Pseudomonas aeruginosa PA01
aagcuguuggccaaccaggaa

SEQ ID NO: 1523356 - RNA, 18 nt, Pseudomonas aeruginosa PA01
aagcuuguugcgcaggcg

SEQ ID NO: 1523357 - RNA, 19 nt, Pseudomonas aeruginosa PA01
aaggcuucggcggucaggc

SEQ ID NO: 1523358 - RNA, 17 nt, Pseudomonas aeruginosa PA01
aaggcuccgcugcucag

SEQ ID NO: 1523359 - RNA, 15 nt, Pseudomonas aeruginosa PA01
aagguaucggccaug

SEQ ID NO: 1523360 - RNA, 19 nt, Pseudomonas aeruginosa PA01
aagguaaggauguccgggu

SEQ ID NO: 1523361 - RNA, 19 nt, Pseudomonas aeruginosa PA01
aagguuccagccccgccgg

SEQ ID NO: 1523362 - RNA, 13 nt, Pseudomonas aeruginosa PA01
aaggugugcaggu

SEQ ID NO: 1523363 - RNA, 18 nt, Pseudomonas aeruginosa PA01
aaggcauauccccucuca

SEQ ID NO: 1523364 - RNA, 11 nt, Pseudomonas aeruginosa PA01
aaggcaugccc

SEQ ID NO: 1523365 - RNA, 13 nt, Pseudomonas aeruginosa PA01
aaggcaugcccag

SEQ ID NO: 1523366 - RNA, 15 nt, Pseudomonas aeruginosa PA01
aaggcaugcccaggc

SEQ ID NO: 1523367 - RNA, 22 nt, Pseudomonas aeruginosa PA01
aaggcaacagcccgcgccgcga

SEQ ID NO: 1523368 - RNA, 21 nt, Pseudomonas aeruginosa PA01
aaggcaccaccgccgccagca

SEQ ID NO: 1523369 - RNA, 23 nt, Pseudomonas aeruginosa PA01
aaggcaccaccgccgccagcaac

SEQ ID NO: 1523370 - RNA, 20 nt, Pseudomonas aeruginosa PA01
aaggcgcggcggaagaauac

SEQ ID NO: 1523371 - RNA, 20 nt, Pseudomonas aeruginosa PA01
aaggccugacgcaagcgcuc

SEQ ID NO: 1523372 - RNA, 19 nt, Pseudomonas aeruginosa PA01
aaggccguuguagagacag

SEQ ID NO: 1523373 - RNA, 20 nt, Pseudomonas aeruginosa PA01
aaggcccggucuagccgggc

SEQ ID NO: 1523374 - RNA, 10 nt, Pseudomonas aeruginosa PA01
aaggccaggc

SEQ ID NO: 1523375 - RNA, 11 nt, Pseudomonas aeruginosa PA01
aaggccaggcc

SEQ ID NO: 1523376 - RNA, 11 nt, Pseudomonas aeruginosa PA01
aaggccaggcu

SEQ ID NO: 1523377 - RNA, 14 nt, Pseudomonas aeruginosa PA01
acaaacacugugga

SEQ ID NO: 1523378 - RNA, 18 nt, Pseudomonas aeruginosa PA01
acaagccuccagcgccgc

SEQ ID NO: 1523379 - RNA, 19 nt, Pseudomonas aeruginosa PA01
acaagcgucgccggccgcu

SEQ ID NO: 1523380 - RNA, 22 nt, Pseudomonas aeruginosa PA01
acaagccaccuucgaucaccuu

SEQ ID NO: 1523381 - RNA, 20 nt, Pseudomonas aeruginosa PA01
acaagagcagacacaaaaaa

SEQ ID NO: 1523382 - RNA, 15 nt, Pseudomonas aeruginosa PA01
acaagaauaggaaca

SEQ ID NO: 1523383 - RNA, 17 nt, Pseudomonas aeruginosa PA01
acaacggaagauggcua

SEQ ID NO: 1523384 - RNA, 16 nt, Pseudomonas aeruginosa PA01
acaacgaaaagagccg

SEQ ID NO: 1523385 - RNA, 16 nt, Pseudomonas aeruginosa PA01
acaacggcaucggcca

SEQ ID NO: 1523386 - RNA, 21 nt, Pseudomonas aeruginosa PA01
acaaccgcuugucgccuuccc

SEQ ID NO: 1523387 - RNA, 21 nt, Pseudomonas aeruginosa PA01
acaaccagccaugcaggcugc

SEQ ID NO: 1523388 - RNA, 20 nt, Pseudomonas aeruginosa PA01
aauuugaacgcuguagaaug

SEQ ID NO: 1523389 - RNA, 12 nt, Pseudomonas aeruginosa PA01
acaaaaaacccg

SEQ ID NO: 1523390 - RNA, 12 nt, Pseudomonas aeruginosa PA01
acaaaaaagccc

SEQ ID NO: 1523391 - RNA, 21 nt, Pseudomonas aeruginosa PA01
acaaaaaagcccgccaggugg

SEQ ID NO: 1523392 - RNA, 13 nt, Pseudomonas aeruginosa PA01
acacaaaaaaccc

SEQ ID NO: 1523393 - RNA, 13 nt, Pseudomonas aeruginosa PA01
acacagacgcagc

SEQ ID NO: 1523394 - RNA, 18 nt, Pseudomonas aeruginosa PA01
acaagucgaaucaagcaa

SEQ ID NO: 1523395 - RNA, 19 nt, Pseudomonas aeruginosa PA01
acaaugaaaaagggaugcc

SEQ ID NO: 1523396 - RNA, 20 nt, Pseudomonas aeruginosa PA01
acaaucuauaaugcgccccc

SEQ ID NO: 1523397 - RNA, 21 nt, Pseudomonas aeruginosa PA01
acaccugaucgaagcccaucg

SEQ ID NO: 1523398 - RNA, 23 nt, Pseudomonas aeruginosa PA01
acacgcacucauagcucagcugg

SEQ ID NO: 1523399 - RNA, 23 nt, Pseudomonas aeruginosa PA01
acacccgguccugcaacuggaag

SEQ ID NO: 1523400 - RNA, 14 nt, Pseudomonas aeruginosa PA01
acaccgacaaucgc

SEQ ID NO: 1523401 - RNA, 18 nt, Pseudomonas aeruginosa PA01
acaccaggucgccgcaca

SEQ ID NO: 1523402 - RNA, 20 nt, Pseudomonas aeruginosa PA01
acaccaggagcgccagcacc

SEQ ID NO: 1523403 - RNA, 22 nt, Pseudomonas aeruginosa PA01
acaccaggagcgccagcaccag

SEQ ID NO: 1523404 - RNA, 12 nt, Pseudomonas aeruginosa PA01
acaccagcaaac

SEQ ID NO: 1523405 - RNA, 22 nt, Pseudomonas aeruginosa PA01
acacaucgaccaggucgccaug

SEQ ID NO: 1523406 - RNA, 14 nt, Pseudomonas aeruginosa PA01
acaccaccagcauc

SEQ ID NO: 1523407 - RNA, 17 nt, Pseudomonas aeruginosa PA01
acaccaccagcaucacc

SEQ ID NO: 1523408 - RNA, 20 nt, Pseudomonas aeruginosa PA01
acacgucggcgcgcaucugg

SEQ ID NO: 1523409 - RNA, 18 nt, Pseudomonas aeruginosa PA01
acacgcuucugcuggccg

SEQ ID NO: 1523410 - RNA, 13 nt, Pseudomonas aeruginosa PA01
acagcaacaccgc

SEQ ID NO: 1523411 - RNA, 18 nt, Pseudomonas aeruginosa PA01
acagcaaagcgcagguag

SEQ ID NO: 1523412 - RNA, 23 nt, Pseudomonas aeruginosa PA01
acagcaucugcugguccuggcgc

SEQ ID NO: 1523413 - RNA, 18 nt, Pseudomonas aeruginosa PA01
acagcaggagaagcgccu

SEQ ID NO: 1523414 - RNA, 18 nt, Pseudomonas aeruginosa PA01
acagauauugaugcaagg

SEQ ID NO: 1523415 - RNA, 17 nt, Pseudomonas aeruginosa PA01
acauagcggcugcuguc

SEQ ID NO: 1523416 - RNA, 15 nt, Pseudomonas aeruginosa PA01
acaguuucauggugc

SEQ ID NO: 1523417 - RNA, 14 nt, Pseudomonas aeruginosa PA01
acaucaccacgcga

SEQ ID NO: 1523418 - RNA, 22 nt, Pseudomonas aeruginosa PA01
acaucaacccaccgaccaccau

SEQ ID NO: 1523419 - RNA, 23 nt, Pseudomonas aeruginosa PA01
acaucccgggguugcccagcagg

SEQ ID NO: 1523420 - RNA, 20 nt, Pseudomonas aeruginosa PA01
acaucguucauguagcgcuc

SEQ ID NO: 1523421 - RNA, 22 nt, Pseudomonas aeruginosa PA01
acaucggccaguccggucagca

SEQ ID NO: 1523422 - RNA, 17 nt, Pseudomonas aeruginosa PA01
acaucuuggcaaucauc

SEQ ID NO: 1523423 - RNA, 14 nt, Pseudomonas aeruginosa PA01
acaugccgagcgaa

SEQ ID NO: 1523424 - RNA, 16 nt, Pseudomonas aeruginosa PA01
acaugccgaagagcuu

SEQ ID NO: 1523425 - RNA, 12 nt, Pseudomonas aeruginosa PA01
acaugcgcucgu

SEQ ID NO: 1523426 - RNA, 21 nt, Pseudomonas aeruginosa PA01
acaugcggugcggccauugcc

SEQ ID NO: 1523427 - RNA, 15 nt, Pseudomonas aeruginosa PA01
acauugccaccacca

SEQ ID NO: 1523428 - RNA, 21 nt, Pseudomonas aeruginosa PA01
accaagcggauguucuucacc

SEQ ID NO: 1523429 - RNA, 22 nt, Pseudomonas aeruginosa PA01
accaagcggauguucuucaccu

SEQ ID NO: 1523430 - RNA, 15 nt, Pseudomonas aeruginosa PA01
accacaccugcaaca

SEQ ID NO: 1523431 - RNA, 16 nt, Pseudomonas aeruginosa PA01
accacaccaggucgcc

SEQ ID NO: 1523432 - RNA, 11 nt, Pseudomonas aeruginosa PA01
accacacaugc

SEQ ID NO: 1523433 - RNA, 22 nt, Pseudomonas aeruginosa PA01
accacaggcggcggaagaagcc

SEQ ID NO: 1523434 - RNA, 19 nt, Pseudomonas aeruginosa PA01
accagccaggcggccacca

SEQ ID NO: 1523435 - RNA, 12 nt, Pseudomonas aeruginosa PA01
accagccgcagg

SEQ ID NO: 1523436 - RNA, 12 nt, Pseudomonas aeruginosa PA01
accagcuccccg

SEQ ID NO: 1523437 - RNA, 21 nt, Pseudomonas aeruginosa PA01
accagcuccccgucccucagg

SEQ ID NO: 1523438 - RNA, 15 nt, Pseudomonas aeruginosa PA01
accagcucagcucca

SEQ ID NO: 1523439 - RNA, 21 nt, Pseudomonas aeruginosa PA01
accagcggguucuugaagaag

SEQ ID NO: 1523440 - RNA, 13 nt, Pseudomonas aeruginosa PA01
accagcaccugcg

SEQ ID NO: 1523441 - RNA, 19 nt, Pseudomonas aeruginosa PA01
accagcaccugcgggcugc

SEQ ID NO: 1523442 - RNA, 19 nt, Pseudomonas aeruginosa PA01
accagcacguagccgcccu

SEQ ID NO: 1523443 - RNA, 14 nt, Pseudomonas aeruginosa PA01
accagcaccgcaag

SEQ ID NO: 1523444 - RNA, 18 nt, Pseudomonas aeruginosa PA01
accagcagcgcaccaucc

SEQ ID NO: 1523445 - RNA, 16 nt, Pseudomonas aeruginosa PA01
accagcaggaaaacgc

SEQ ID NO: 1523446 - RNA, 12 nt, Pseudomonas aeruginosa PA01
accagcaggaag

SEQ ID NO: 1523447 - RNA, 18 nt, Pseudomonas aeruginosa PA01
accagcagcggcagccac

SEQ ID NO: 1523448 - RNA, 15 nt, Pseudomonas aeruginosa PA01
accagcaaugcccag

SEQ ID NO: 1523449 - RNA, 20 nt, Pseudomonas aeruginosa PA01
accacuucggcgguggggcc

SEQ ID NO: 1523450 - RNA, 18 nt, Pseudomonas aeruginosa PA01
accacguaguaggcgcgg

SEQ ID NO: 1523451 - RNA, 14 nt, Pseudomonas aeruginosa PA01
accacgcuggucac

SEQ ID NO: 1523452 - RNA, 15 nt, Pseudomonas aeruginosa PA01
accacgcuccuggaa

SEQ ID NO: 1523453 - RNA, 16 nt, Pseudomonas aeruginosa PA01
accacgcucuugaucg

SEQ ID NO: 1523454 - RNA, 23 nt, Pseudomonas aeruginosa PA01
accacgcccgcgguauucuccag

SEQ ID NO: 1523455 - RNA, 20 nt, Pseudomonas aeruginosa PA01
accacuuccagguagcccac

SEQ ID NO: 1523456 - RNA, 22 nt, Pseudomonas aeruginosa PA01
accacuuccagguagcccaccu

SEQ ID NO: 1523457 - RNA, 20 nt, Pseudomonas aeruginosa PA01
accacuaucuucgauugcua

SEQ ID NO: 1523458 - RNA, 17 nt, Pseudomonas aeruginosa PA01
accaccgugaccagcau

SEQ ID NO: 1523459 - RNA, 20 nt, Pseudomonas aeruginosa PA01
accaccauggucuuuccuuu

SEQ ID NO: 1523460 - RNA, 14 nt, Pseudomonas aeruginosa PA01
accacgcaggcgcg

SEQ ID NO: 1523461 - RNA, 12 nt, Pseudomonas aeruginosa PA01
accaccagcagg

SEQ ID NO: 1523462 - RNA, 13 nt, Pseudomonas aeruginosa PA01
accaccaggaagc

SEQ ID NO: 1523463 - RNA, 22 nt, Pseudomonas aeruginosa PA01
accaucgucgcuuccggcgcca

SEQ ID NO: 1523464 - RNA, 13 nt, Pseudomonas aeruginosa PA01
accaugaucaucg

SEQ ID NO: 1523465 - RNA, 19 nt, Pseudomonas aeruginosa PA01
accaugccuuccaccggcg

SEQ ID NO: 1523466 - RNA, 14 nt, Pseudomonas aeruginosa PA01
accaucuuuuccug

SEQ ID NO: 1523467 - RNA, 18 nt, Pseudomonas aeruginosa PA01
accaggagcgccagcacc

SEQ ID NO: 1523468 - RNA, 17 nt, Pseudomonas aeruginosa PA01
accaggaugcccugcuc

SEQ ID NO: 1523469 - RNA, 22 nt, Pseudomonas aeruginosa PA01
accaggaucgaccccgccgggg

SEQ ID NO: 1523470 - RNA, 17 nt, Pseudomonas aeruginosa PA01
accaggaucgccgggcu

SEQ ID NO: 1523471 - RNA, 13 nt, Pseudomonas aeruginosa PA01
accaggaccagcg

SEQ ID NO: 1523472 - RNA, 22 nt, Pseudomonas aeruginosa PA01
accaggacccagaugaucuuca

SEQ ID NO: 1523473 - RNA, 18 nt, Pseudomonas aeruginosa PA01
accagcuucaaccguggc

SEQ ID NO: 1523474 - RNA, 17 nt, Pseudomonas aeruginosa PA01
accagcuugucgccuuc

SEQ ID NO: 1523475 - RNA, 11 nt, Pseudomonas aeruginosa PA01
accaucaccag

SEQ ID NO: 1523476 - RNA, 14 nt, Pseudomonas aeruginosa PA01
accaucaccagcgc

SEQ ID NO: 1523477 - RNA, 14 nt, Pseudomonas aeruginosa PA01
accaucaccgccau

SEQ ID NO: 1523478 - RNA, 20 nt, Pseudomonas aeruginosa PA01
acccaccgaccaccaucacc

SEQ ID NO: 1523479 - RNA, 18 nt, Pseudomonas aeruginosa PA01
acccaggcuucggcgcgc

SEQ ID NO: 1523480 - RNA, 16 nt, Pseudomonas aeruginosa PA01
acccaggccugggugu

SEQ ID NO: 1523481 - RNA, 14 nt, Pseudomonas aeruginosa PA01
acccaggccacgcc

SEQ ID NO: 1523482 - RNA, 15 nt, Pseudomonas aeruginosa PA01
acccacuccggcagg

SEQ ID NO: 1523483 - RNA, 19 nt, Pseudomonas aeruginosa PA01
acccacgcauuggcuucgc

SEQ ID NO: 1523484 - RNA, 19 nt, Pseudomonas aeruginosa PA01
acccgcaccgguucgacac

SEQ ID NO: 1523485 - RNA, 13 nt, Pseudomonas aeruginosa PA01
acccgcagggcuc

SEQ ID NO: 1523486 - RNA, 14 nt, Pseudomonas aeruginosa PA01
acccgcagcggcag

SEQ ID NO: 1523487 - RNA, 22 nt, Pseudomonas aeruginosa PA01
acccgcccgccguccuccagca

SEQ ID NO: 1523488 - RNA, 22 nt, Pseudomonas aeruginosa PA01
acccgcccgccgucgcccaugu

SEQ ID NO: 1523489 - RNA, 18 nt, Pseudomonas aeruginosa PA01
acccaugccgcuagcccu

SEQ ID NO: 1523490 - RNA, 21 nt, Pseudomonas aeruginosa PA01
acccaugccgcuagcccugcu

SEQ ID NO: 1523491 - RNA, 23 nt, Pseudomonas aeruginosa PA01
acccaugccgcuagcccugcugc

SEQ ID NO: 1523492 - RNA, 20 nt, Pseudomonas aeruginosa PA01
acccaugaaaaaggccgguc

SEQ ID NO: 1523493 - RNA, 18 nt, Pseudomonas aeruginosa PA01
accccgggguucugcgag

SEQ ID NO: 1523494 - RNA, 23 nt, Pseudomonas aeruginosa PA01
accccuucggucgcgccccgcca

SEQ ID NO: 1523495 - RNA, 22 nt, Pseudomonas aeruginosa PA01
accccggcgaucuucagguagg

SEQ ID NO: 1523496 - RNA, 14 nt, Pseudomonas aeruginosa PA01
accccggccuccag

SEQ ID NO: 1523497 - RNA, 14 nt, Pseudomonas aeruginosa PA01
acccguaccccgac

SEQ ID NO: 1523498 - RNA, 23 nt, Pseudomonas aeruginosa PA01
acccgguuaccggcgaccaccgc

SEQ ID NO: 1523499 - RNA, 13 nt, Pseudomonas aeruginosa PA01
acccggguauaga

SEQ ID NO: 1523500 - RNA, 21 nt, Pseudomonas aeruginosa PA01
acccggguuuccgugugcagc

SEQ ID NO: 1523501 - RNA, 22 nt, Pseudomonas aeruginosa PA01
acccgguacagccaacccucgg

SEQ ID NO: 1523502 - RNA, 14 nt, Pseudomonas aeruginosa PA01
acccggccaggccc

SEQ ID NO: 1523503 - RNA, 19 nt, Pseudomonas aeruginosa PA01
acccggccgaccaggugcu

SEQ ID NO: 1523504 - RNA, 24 nt, Pseudomonas aeruginosa PA01
acccggccgcgcucgacggucagc

SEQ ID NO: 1523505 - RNA, 14 nt, Pseudomonas aeruginosa PA01
acccggccagcccg

SEQ ID NO: 1523506 - RNA, 21 nt, Pseudomonas aeruginosa PA01
acccggccagcccggccucgc

SEQ ID NO: 1523507 - RNA, 19 nt, Pseudomonas aeruginosa PA01
acccggcgcacgccggccu

SEQ ID NO: 1523508 - RNA, 22 nt, Pseudomonas aeruginosa PA01
acccggcgcacgccggccucgc

SEQ ID NO: 1523509 - RNA, 21 nt, Pseudomonas aeruginosa PA01
acccggcgcggcgcagccaga

SEQ ID NO: 1523510 - RNA, 17 nt, Pseudomonas aeruginosa PA01
acccgcucggccuuagc

SEQ ID NO: 1523511 - RNA, 16 nt, Pseudomonas aeruginosa PA01
acccgcugcuggaugg

SEQ ID NO: 1523512 - RNA, 13 nt, Pseudomonas aeruginosa PA01
acccgcugcacca

SEQ ID NO: 1523513 - RNA, 21 nt, Pseudomonas aeruginosa PA01
acccgcugguaauccagggag

SEQ ID NO: 1523514 - RNA, 19 nt, Pseudomonas aeruginosa PA01
acccggaucaugguaugga

SEQ ID NO: 1523515 - RNA, 18 nt, Pseudomonas aeruginosa PA01
acccgccguucgcccgcc

SEQ ID NO: 1523516 - RNA, 21 nt, Pseudomonas aeruginosa PA01
acccgccucgucgccaugcgg

SEQ ID NO: 1523517 - RNA, 10 nt, Pseudomonas aeruginosa PA01
acccgcgaag

SEQ ID NO: 1523518 - RNA, 14 nt, Pseudomonas aeruginosa PA01
acccgcgccgccgc

SEQ ID NO: 1523519 - RNA, 17 nt, Pseudomonas aeruginosa PA01
acccgcgacucgagcac

SEQ ID NO: 1523520 - RNA, 13 nt, Pseudomonas aeruginosa PA01
acccgcggcgcgc

SEQ ID NO: 1523521 - RNA, 16 nt, Pseudomonas aeruginosa PA01
acccgcggcgcgccuu

SEQ ID NO: 1523522 - RNA, 21 nt, Pseudomonas aeruginosa PA01
acccgcggcagguccugggua

SEQ ID NO: 1523523 - RNA, 23 nt, Pseudomonas aeruginosa PA01
accgccggcagugugccgcccug

SEQ ID NO: 1523524 - RNA, 14 nt, Pseudomonas aeruginosa PA01
accgcggcgcugaa

SEQ ID NO: 1523525 - RNA, 13 nt, Pseudomonas aeruginosa PA01
accgcggccucgc

SEQ ID NO: 1523526 - RNA, 14 nt, Pseudomonas aeruginosa PA01
accgcggccggcuu

SEQ ID NO: 1523527 - RNA, 22 nt, Pseudomonas aeruginosa PA01
accgcggccggcuucuacgccu

SEQ ID NO: 1523528 - RNA, 13 nt, Pseudomonas aeruginosa PA01
accgcgggcucag

SEQ ID NO: 1523529 - RNA, 14 nt, Pseudomonas aeruginosa PA01
accgcgggcucagg

SEQ ID NO: 1523530 - RNA, 16 nt, Pseudomonas aeruginosa PA01
accgcgcauggcggcg

SEQ ID NO: 1523531 - RNA, 21 nt, Pseudomonas aeruginosa PA01
accgcgcagcgucaccgcguc

SEQ ID NO: 1523532 - RNA, 19 nt, Pseudomonas aeruginosa PA01
accggaaaagaagccgcgc

SEQ ID NO: 1523533 - RNA, 21 nt, Pseudomonas aeruginosa PA01
accggaaaagaagccgcgcaa

SEQ ID NO: 1523534 - RNA, 17 nt, Pseudomonas aeruginosa PA01
accgcuugccagccgcu

SEQ ID NO: 1523535 - RNA, 17 nt, Pseudomonas aeruginosa PA01
accggaagcguccaggg

SEQ ID NO: 1523536 - RNA, 15 nt, Pseudomonas aeruginosa PA01
accggacggcugagg

SEQ ID NO: 1523537 - RNA, 22 nt, Pseudomonas aeruginosa PA01
accgcgucgggaaaggccgcca

SEQ ID NO: 1523538 - RNA, 23 nt, Pseudomonas aeruginosa PA01
accgcgucgggaaaggccgccac

SEQ ID NO: 1523539 - RNA, 15 nt, Pseudomonas aeruginosa PA01
accgcguccuugagu

SEQ ID NO: 1523540 - RNA, 20 nt, Pseudomonas aeruginosa PA01
accgcggugucggugcccuc

SEQ ID NO: 1523541 - RNA, 20 nt, Pseudomonas aeruginosa PA01
accgccaggguguuguucgc

SEQ ID NO: 1523542 - RNA, 23 nt, Pseudomonas aeruginosa PA01
accgccagcgggacgaugccgau

SEQ ID NO: 1523543 - RNA, 15 nt, Pseudomonas aeruginosa PA01
accgccagcgucgcc

SEQ ID NO: 1523544 - RNA, 18 nt, Pseudomonas aeruginosa PA01
accgccgccagcaacagu

SEQ ID NO: 1523545 - RNA, 18 nt, Pseudomonas aeruginosa PA01
accgccccggcagccacc

SEQ ID NO: 1523546 - RNA, 21 nt, Pseudomonas aeruginosa PA01
accgccagcaguugcaacagc

SEQ ID NO: 1523547 - RNA, 12 nt, Pseudomonas aeruginosa PA01
accgccagcacc

SEQ ID NO: 1523548 - RNA, 23 nt, Pseudomonas aeruginosa PA01
accgcaucgaaggcgccggcaug

SEQ ID NO: 1523549 - RNA, 23 nt, Pseudomonas aeruginosa PA01
accgcagccggcgaacagguagc

SEQ ID NO: 1523550 - RNA, 17 nt, Pseudomonas aeruginosa PA01
accgagggugcagagca

SEQ ID NO: 1523551 - RNA, 20 nt, Pseudomonas aeruginosa PA01
accgagggcauuuccugggu

SEQ ID NO: 1523552 - RNA, 13 nt, Pseudomonas aeruginosa PA01
accgagucggcaa

SEQ ID NO: 1523553 - RNA, 14 nt, Pseudomonas aeruginosa PA01
accgauccagcagu

SEQ ID NO: 1523554 - RNA, 18 nt, Pseudomonas aeruginosa PA01
accgaucagcaccgccac

SEQ ID NO: 1523555 - RNA, 13 nt, Pseudomonas aeruginosa PA01
accgacccucggc

SEQ ID NO: 1523556 - RNA, 23 nt, Pseudomonas aeruginosa PA01
accgacgcgcaggagugugggac

SEQ ID NO: 1523557 - RNA, 17 nt, Pseudomonas aeruginosa PA01
accgacacgcacucaua

SEQ ID NO: 1523558 - RNA, 13 nt, Pseudomonas aeruginosa PA01
accgacaguccca

SEQ ID NO: 1523559 - RNA, 13 nt, Pseudomonas aeruginosa PA01
accgagaaccagu

SEQ ID NO: 1523560 - RNA, 20 nt, Pseudomonas aeruginosa PA01
accgacgggucgccaugguc

SEQ ID NO: 1523561 - RNA, 21 nt, Pseudomonas aeruginosa PA01
accgacgggucgccauggucg

SEQ ID NO: 1523562 - RNA, 22 nt, Pseudomonas aeruginosa PA01
accgagccguugugcagguacg

SEQ ID NO: 1523563 - RNA, 15 nt, Pseudomonas aeruginosa PA01
accgaggaucggcac

SEQ ID NO: 1523564 - RNA, 14 nt, Pseudomonas aeruginosa PA01
accgaagucgcccg

SEQ ID NO: 1523565 - RNA, 16 nt, Pseudomonas aeruginosa PA01
accgaacaccagcaaa

SEQ ID NO: 1523566 - RNA, 20 nt, Pseudomonas aeruginosa PA01
acccucaggggugcagcccu

SEQ ID NO: 1523567 - RNA, 15 nt, Pseudomonas aeruginosa PA01
acccucauggaaacc

SEQ ID NO: 1523568 - RNA, 19 nt, Pseudomonas aeruginosa PA01
acccucauggaaaccccgg

SEQ ID NO: 1523569 - RNA, 20 nt, Pseudomonas aeruginosa PA01
acccgugguccgccagcagg

SEQ ID NO: 1523570 - RNA, 22 nt, Pseudomonas aeruginosa PA01
acccguugccgaccgagcagcg

SEQ ID NO: 1523571 - RNA, 14 nt, Pseudomonas aeruginosa PA01
acccguugcgccuc

SEQ ID NO: 1523572 - RNA, 21 nt, Pseudomonas aeruginosa PA01
acccugguaguccagcaggug

SEQ ID NO: 1523573 - RNA, 20 nt, Pseudomonas aeruginosa PA01
acccuggccacguccagcgg

SEQ ID NO: 1523574 - RNA, 17 nt, Pseudomonas aeruginosa PA01
acccuuguggccgaucu

SEQ ID NO: 1523575 - RNA, 16 nt, Pseudomonas aeruginosa PA01
acccuugcgcccggcu

SEQ ID NO: 1523576 - RNA, 13 nt, Pseudomonas aeruginosa PA01
acccuugcguccu

SEQ ID NO: 1523577 - RNA, 12 nt, Pseudomonas aeruginosa PA01
acccucucccca

SEQ ID NO: 1523578 - RNA, 13 nt, Pseudomonas aeruginosa PA01
acccucuccccaa

SEQ ID NO: 1523579 - RNA, 22 nt, Pseudomonas aeruginosa PA01
acccucggcuucguccugcugc

SEQ ID NO: 1523580 - RNA, 23 nt, Pseudomonas aeruginosa PA01
acccucggcuucguccugcugcu

SEQ ID NO: 1523581 - RNA, 13 nt, Pseudomonas aeruginosa PA01
acccucugguugg

SEQ ID NO: 1523582 - RNA, 22 nt, Pseudomonas aeruginosa PA01
acccugcugcugcucagcgcgc

SEQ ID NO: 1523583 - RNA, 15 nt, Pseudomonas aeruginosa PA01
acccugccccagcau

SEQ ID NO: 1523584 - RNA, 17 nt, Pseudomonas aeruginosa PA01
acgggaagcgaaccagg

SEQ ID NO: 1523585 - RNA, 15 nt, Pseudomonas aeruginosa PA01
acgggacgccaggcg

SEQ ID NO: 1523586 - RNA, 22 nt, Pseudomonas aeruginosa PA01
acgggagcgcgaggcgcaggca

SEQ ID NO: 1523587 - RNA, 21 nt, Pseudomonas aeruginosa PA01
acgggcauugucccugcggga

SEQ ID NO: 1523588 - RNA, 13 nt, Pseudomonas aeruginosa PA01
acguacuccagca

SEQ ID NO: 1523589 - RNA, 19 nt, Pseudomonas aeruginosa PA01
acguacucgucgcucuggg

SEQ ID NO: 1523590 - RNA, 12 nt, Pseudomonas aeruginosa PA01
acgucaggcugu

SEQ ID NO: 1523591 - RNA, 14 nt, Pseudomonas aeruginosa PA01
acgugaagccccug

SEQ ID NO: 1523592 - RNA, 22 nt, Pseudomonas aeruginosa PA01
acgucuguugcgguggugucug

SEQ ID NO: 1523593 - RNA, 21 nt, Pseudomonas aeruginosa PA01
acgucuuccgggaccggcugc

SEQ ID NO: 1523594 - RNA, 19 nt, Pseudomonas aeruginosa PA01
acgucuucgauggcggccg

SEQ ID NO: 1523595 - RNA, 15 nt, Pseudomonas aeruginosa PA01
acgugcaccaucgca

SEQ ID NO: 1523596 - RNA, 16 nt, Pseudomonas aeruginosa PA01
acgugcagcucggcac

SEQ ID NO: 1523597 - RNA, 23 nt, Pseudomonas aeruginosa PA01
acguggcgcuugagcagccaggc

SEQ ID NO: 1523598 - RNA, 13 nt, Pseudomonas aeruginosa PA01
acgugggccugcu

SEQ ID NO: 1523599 - RNA, 23 nt, Pseudomonas aeruginosa PA01
acguggugauacguccguucagg

SEQ ID NO: 1523600 - RNA, 18 nt, Pseudomonas aeruginosa PA01
acguucaggcuguugccc

SEQ ID NO: 1523601 - RNA, 14 nt, Pseudomonas aeruginosa PA01
acguucugcaggac

SEQ ID NO: 1523602 - RNA, 13 nt, Pseudomonas aeruginosa PA01
acguucuugaccu

SEQ ID NO: 1523603 - RNA, 17 nt, Pseudomonas aeruginosa PA01
acguugcaguccaggcc

SEQ ID NO: 1523604 - RNA, 18 nt, Pseudomonas aeruginosa PA01
acucaucaggcugccgag

SEQ ID NO: 1523605 - RNA, 12 nt, Pseudomonas aeruginosa PA01
acucauagcuca

SEQ ID NO: 1523606 - RNA, 15 nt, Pseudomonas aeruginosa PA01
acuccauaguagaga

SEQ ID NO: 1523607 - RNA, 13 nt, Pseudomonas aeruginosa PA01
acuccagcggggu

SEQ ID NO: 1523608 - RNA, 20 nt, Pseudomonas aeruginosa PA01
acuccagccccgcgauugca

SEQ ID NO: 1523609 - RNA, 14 nt, Pseudomonas aeruginosa PA01
acuccagcuucuuc

SEQ ID NO: 1523610 - RNA, 15 nt, Pseudomonas aeruginosa PA01
acuccagcgcgggca

SEQ ID NO: 1523611 - RNA, 14 nt, Pseudomonas aeruginosa PA01
acuccagcagcgca

SEQ ID NO: 1523612 - RNA, 19 nt, Pseudomonas aeruginosa PA01
acuccagccaggcgaugaa

SEQ ID NO: 1523613 - RNA, 18 nt, Pseudomonas aeruginosa PA01
acuccacacggaacaugg

SEQ ID NO: 1523614 - RNA, 18 nt, Pseudomonas aeruginosa PA01
acuaucuucgauugcuac

SEQ ID NO: 1523615 - RNA, 14 nt, Pseudomonas aeruginosa PA01
acucguugcacgca

SEQ ID NO: 1523616 - RNA, 17 nt, Pseudomonas aeruginosa PA01
acucguguuccggcagg

SEQ ID NO: 1523617 - RNA, 19 nt, Pseudomonas aeruginosa PA01
acucggcggggcgcagcag

SEQ ID NO: 1523618 - RNA, 13 nt, Pseudomonas aeruginosa PA01
acucgucgcccca

SEQ ID NO: 1523619 - RNA, 19 nt, Pseudomonas aeruginosa PA01
acucccggcccuugagcau

SEQ ID NO: 1523620 - RNA, 19 nt, Pseudomonas aeruginosa PA01
acucccguccagcgcuuga

SEQ ID NO: 1523621 - RNA, 14 nt, Pseudomonas aeruginosa PA01
acuccgagcaggac

SEQ ID NO: 1523622 - RNA, 17 nt, Pseudomonas aeruginosa PA01
acuccgagggccgcgcc

SEQ ID NO: 1523623 - RNA, 18 nt, Pseudomonas aeruginosa PA01
acuccgagggccgcgccg

SEQ ID NO: 1523624 - RNA, 21 nt, Pseudomonas aeruginosa PA01
acuccgagggccgcgccgacc

SEQ ID NO: 1523625 - RNA, 13 nt, Pseudomonas aeruginosa PA01
acuccgccagcac

SEQ ID NO: 1523626 - RNA, 18 nt, Pseudomonas aeruginosa PA01
acuccgccagcaccaccc

SEQ ID NO: 1523627 - RNA, 15 nt, Pseudomonas aeruginosa PA01
acuccgccagcuugu

SEQ ID NO: 1523628 - RNA, 22 nt, Pseudomonas aeruginosa PA01
acucuuccagggucggcaccga

SEQ ID NO: 1523629 - RNA, 11 nt, Pseudomonas aeruginosa PA01
acucuucaguc

SEQ ID NO: 1523630 - RNA, 14 nt, Pseudomonas aeruginosa PA01
acugaccaccagga

SEQ ID NO: 1523631 - RNA, 23 nt, Pseudomonas aeruginosa PA01
acugaacucgguguagcugaggc

SEQ ID NO: 1523632 - RNA, 23 nt, Pseudomonas aeruginosa PA01
acgccgaaguucuucagcagcau

SEQ ID NO: 1523633 - RNA, 18 nt, Pseudomonas aeruginosa PA01
acgccgagcaacggcagc

SEQ ID NO: 1523634 - RNA, 18 nt, Pseudomonas aeruginosa PA01
acgccgagccagccgcgg

SEQ ID NO: 1523635 - RNA, 18 nt, Pseudomonas aeruginosa PA01
acgccgcccccagcgcgc

SEQ ID NO: 1523636 - RNA, 22 nt, Pseudomonas aeruginosa PA01
acgccgcgccaaugccuuccga

SEQ ID NO: 1523637 - RNA, 16 nt, Pseudomonas aeruginosa PA01
acgccgccugcgccuc

SEQ ID NO: 1523638 - RNA, 19 nt, Pseudomonas aeruginosa PA01
acgccgcgcugcaagggca

SEQ ID NO: 1523639 - RNA, 22 nt, Pseudomonas aeruginosa PA01
acgcccagcagggccagccaga

SEQ ID NO: 1523640 - RNA, 16 nt, Pseudomonas aeruginosa PA01
acgcccaugccuugca

SEQ ID NO: 1523641 - RNA, 17 nt, Pseudomonas aeruginosa PA01
acgccccagaagcccca

SEQ ID NO: 1523642 - RNA, 20 nt, Pseudomonas aeruginosa PA01
acgcccgcuugcgccgccuc

SEQ ID NO: 1523643 - RNA, 16 nt, Pseudomonas aeruginosa PA01
acgcccggcacucgcc

SEQ ID NO: 1523644 - RNA, 20 nt, Pseudomonas aeruginosa PA01
acgcccggcuuuccucggcc

SEQ ID NO: 1523645 - RNA, 16 nt, Pseudomonas aeruginosa PA01
acgcccgcagccagcc

SEQ ID NO: 1523646 - RNA, 14 nt, Pseudomonas aeruginosa PA01
acgcccuccagcac

SEQ ID NO: 1523647 - RNA, 18 nt, Pseudomonas aeruginosa PA01
acgcccuccagcaccgcc

SEQ ID NO: 1523648 - RNA, 23 nt, Pseudomonas aeruginosa PA01
acgcccuguuucggguccaggcg

SEQ ID NO: 1523649 - RNA, 16 nt, Pseudomonas aeruginosa PA01
acgcccugggacaggc

SEQ ID NO: 1523650 - RNA, 17 nt, Pseudomonas aeruginosa PA01
acgcccugggacaggcg

SEQ ID NO: 1523651 - RNA, 16 nt, Pseudomonas aeruginosa PA01
acgccgguggccaggc

SEQ ID NO: 1523652 - RNA, 15 nt, Pseudomonas aeruginosa PA01
acgccguagcggccu

SEQ ID NO: 1523653 - RNA, 16 nt, Pseudomonas aeruginosa PA01
acgccguggaccagga

SEQ ID NO: 1523654 - RNA, 18 nt, Pseudomonas aeruginosa PA01
acgccggugccaggacca

SEQ ID NO: 1523655 - RNA, 19 nt, Pseudomonas aeruginosa PA01
acgccgggcaacgccaggc

SEQ ID NO: 1523656 - RNA, 14 nt, Pseudomonas aeruginosa PA01
acgccggcagguug

SEQ ID NO: 1523657 - RNA, 23 nt, Pseudomonas aeruginosa PA01
acgccgcugucguccagcgggua

SEQ ID NO: 1523658 - RNA, 20 nt, Pseudomonas aeruginosa PA01
acgccugucgcuccggcagc

SEQ ID NO: 1523659 - RNA, 14 nt, Pseudomonas aeruginosa PA01
acgccugucggcac

SEQ ID NO: 1523660 - RNA, 19 nt, Pseudomonas aeruginosa PA01
acgccugcaucucuuccuc

SEQ ID NO: 1523661 - RNA, 13 nt, Pseudomonas aeruginosa PA01
acgccucugcgcu

SEQ ID NO: 1523662 - RNA, 17 nt, Pseudomonas aeruginosa PA01
acgcgaaugcccggcag

SEQ ID NO: 1523663 - RNA, 18 nt, Pseudomonas aeruginosa PA01
acgccuugcagcaccgcc

SEQ ID NO: 1523664 - RNA, 21 nt, Pseudomonas aeruginosa PA01
acgccuugcagcaccgccugg

SEQ ID NO: 1523665 - RNA, 18 nt, Pseudomonas aeruginosa PA01
accggaucgcccuggcgc

SEQ ID NO: 1523666 - RNA, 13 nt, Pseudomonas aeruginosa PA01
acgcaccagcagg

SEQ ID NO: 1523667 - RNA, 19 nt, Pseudomonas aeruginosa PA01
acgcaccagcucccggcuc

SEQ ID NO: 1523668 - RNA, 13 nt, Pseudomonas aeruginosa PA01
acgcaccggcuuc

SEQ ID NO: 1523669 - RNA, 17 nt, Pseudomonas aeruginosa PA01
acgcacucauagcucag

SEQ ID NO: 1523670 - RNA, 21 nt, Pseudomonas aeruginosa PA01
acgcacucauagcucagcugg

SEQ ID NO: 1523671 - RNA, 22 nt, Pseudomonas aeruginosa PA01
acgcacucauagcucagcugga

SEQ ID NO: 1523672 - RNA, 19 nt, Pseudomonas aeruginosa PA01
acgcagccacccgcgggca

SEQ ID NO: 1523673 - RNA, 16 nt, Pseudomonas aeruginosa PA01
acgcaggcaggucauc

SEQ ID NO: 1523674 - RNA, 19 nt, Pseudomonas aeruginosa PA01
acgcaggcgcauggcguuc

SEQ ID NO: 1523675 - RNA, 13 nt, Pseudomonas aeruginosa PA01
acgcaggcgcugg

SEQ ID NO: 1523676 - RNA, 13 nt, Pseudomonas aeruginosa PA01
acgccaccagcca

SEQ ID NO: 1523677 - RNA, 14 nt, Pseudomonas aeruginosa PA01
acgccaccagccag

SEQ ID NO: 1523678 - RNA, 15 nt, Pseudomonas aeruginosa PA01
acgccaccagccagg

SEQ ID NO: 1523679 - RNA, 19 nt, Pseudomonas aeruginosa PA01
acgccaccagggccuugcc

SEQ ID NO: 1523680 - RNA, 11 nt, Pseudomonas aeruginosa PA01
acgccagccca

SEQ ID NO: 1523681 - RNA, 19 nt, Pseudomonas aeruginosa PA01
acgccagcccucgcccagg

SEQ ID NO: 1523682 - RNA, 14 nt, Pseudomonas aeruginosa PA01
acgccacccgcauc

SEQ ID NO: 1523683 - RNA, 18 nt, Pseudomonas aeruginosa PA01
acgccauccgccuucuuu

SEQ ID NO: 1523684 - RNA, 15 nt, Pseudomonas aeruginosa PA01
acgcgugaagcugga

SEQ ID NO: 1523685 - RNA, 13 nt, Pseudomonas aeruginosa PA01
acgcuccaggugc

SEQ ID NO: 1523686 - RNA, 14 nt, Pseudomonas aeruginosa PA01
acgcuccugcgccg

SEQ ID NO: 1523687 - RNA, 22 nt, Pseudomonas aeruginosa PA01
acgcuccuggaagaacaggcgc

SEQ ID NO: 1523688 - RNA, 15 nt, Pseudomonas aeruginosa PA01
acgcuccggugccag

SEQ ID NO: 1523689 - RNA, 16 nt, Pseudomonas aeruginosa PA01
acgcucggcuucgcgu

SEQ ID NO: 1523690 - RNA, 14 nt, Pseudomonas aeruginosa PA01
acgcucggccagcg

SEQ ID NO: 1523691 - RNA, 19 nt, Pseudomonas aeruginosa PA01
acgcucucgaacagcagca

SEQ ID NO: 1523692 - RNA, 15 nt, Pseudomonas aeruginosa PA01
acgcugacgccggca

SEQ ID NO: 1523693 - RNA, 14 nt, Pseudomonas aeruginosa PA01
acgcucuucuuaca

SEQ ID NO: 1523694 - RNA, 16 nt, Pseudomonas aeruginosa PA01
acgcggcgaagggcgc

SEQ ID NO: 1523695 - RNA, 12 nt, Pseudomonas aeruginosa PA01
acgcgggccucu

SEQ ID NO: 1523696 - RNA, 23 nt, Pseudomonas aeruginosa PA01
acgcggaccuugucgccggugag

SEQ ID NO: 1523697 - RNA, 13 nt, Pseudomonas aeruginosa PA01
acgcggcaccgcu

SEQ ID NO: 1523698 - RNA, 22 nt, Pseudomonas aeruginosa PA01
acgcgcuggaguaucgcccugg

SEQ ID NO: 1523699 - RNA, 14 nt, Pseudomonas aeruginosa PA01
acgcgccacgcagg

SEQ ID NO: 1523700 - RNA, 15 nt, Pseudomonas aeruginosa PA01
acgcgccacgcagga

SEQ ID NO: 1523701 - RNA, 17 nt, Pseudomonas aeruginosa PA01
acgcgccacgcaggaac

SEQ ID NO: 1523702 - RNA, 16 nt, Pseudomonas aeruginosa PA01
acgcgccacggaaggc

SEQ ID NO: 1523703 - RNA, 23 nt, Pseudomonas aeruginosa PA01
acgcgccacggaaggccacgccg

SEQ ID NO: 1523704 - RNA, 17 nt, Pseudomonas aeruginosa PA01
acgcgcccggccaggcc

SEQ ID NO: 1523705 - RNA, 19 nt, Pseudomonas aeruginosa PA01
acgcgaccuccggcgccag

SEQ ID NO: 1523706 - RNA, 22 nt, Pseudomonas aeruginosa PA01
acgcgaccuccggcgccaggcc

SEQ ID NO: 1523707 - RNA, 16 nt, Pseudomonas aeruginosa PA01
acgcgaccggucaggc

SEQ ID NO: 1523708 - RNA, 16 nt, Pseudomonas aeruginosa PA01
acgcgagaagccgccc

SEQ ID NO: 1523709 - RNA, 15 nt, Pseudomonas aeruginosa PA01
acgcgauauccgcca

SEQ ID NO: 1523710 - RNA, 17 nt, Pseudomonas aeruginosa PA01
acgcgcaagccagccau

SEQ ID NO: 1523711 - RNA, 20 nt, Pseudomonas aeruginosa PA01
acgcugaucaucagcagggu

SEQ ID NO: 1523712 - RNA, 17 nt, Pseudomonas aeruginosa PA01
acgcugcccagcccgcc

SEQ ID NO: 1523713 - RNA, 16 nt, Pseudomonas aeruginosa PA01
acgcugccagcaggcc

SEQ ID NO: 1523714 - RNA, 19 nt, Pseudomonas aeruginosa PA01
acgcugccgaggaacucgc

SEQ ID NO: 1523715 - RNA, 14 nt, Pseudomonas aeruginosa PA01
acgcugccagguug

SEQ ID NO: 1523716 - RNA, 18 nt, Pseudomonas aeruginosa PA01
acgcugcgaccuggcgcc

SEQ ID NO: 1523717 - RNA, 17 nt, Pseudomonas aeruginosa PA01
acgcugcggaucaacuc

SEQ ID NO: 1523718 - RNA, 14 nt, Pseudomonas aeruginosa PA01
acgcugcgccggcg

SEQ ID NO: 1523719 - RNA, 19 nt, Pseudomonas aeruginosa PA01
acgcuucugcgccuccucg

SEQ ID NO: 1523720 - RNA, 20 nt, Pseudomonas aeruginosa PA01
acgcuugagccccggcaggc

SEQ ID NO: 1523721 - RNA, 19 nt, Pseudomonas aeruginosa PA01
acgcuugcguuccuccucg

SEQ ID NO: 1523722 - RNA, 23 nt, Pseudomonas aeruginosa PA01
acggcagccgcguugucccuguc

SEQ ID NO: 1523723 - RNA, 17 nt, Pseudomonas aeruginosa PA01
acggagaagggcgcgcc

SEQ ID NO: 1523724 - RNA, 18 nt, Pseudomonas aeruginosa PA01
acggagagcagcagcucg

SEQ ID NO: 1523725 - RNA, 23 nt, Pseudomonas aeruginosa PA01
acgcuuuggauggagcacagcca

SEQ ID NO: 1523726 - RNA, 20 nt, Pseudomonas aeruginosa PA01
acggcucggcgaggaacagc

SEQ ID NO: 1523727 - RNA, 22 nt, Pseudomonas aeruginosa PA01
acggcugagaccuuccugccag

SEQ ID NO: 1523728 - RNA, 19 nt, Pseudomonas aeruginosa PA01
acggcuaucaggugagggc

SEQ ID NO: 1523729 - RNA, 19 nt, Pseudomonas aeruginosa PA01
acggcgugccgcaggccgc

SEQ ID NO: 1523730 - RNA, 15 nt, Pseudomonas aeruginosa PA01
acggcgugccgggca

SEQ ID NO: 1523731 - RNA, 13 nt, Pseudomonas aeruginosa PA01
acggcuugaggaa

SEQ ID NO: 1523732 - RNA, 15 nt, Pseudomonas aeruginosa PA01
acggcuugaggaagu

SEQ ID NO: 1523733 - RNA, 15 nt, Pseudomonas aeruginosa PA01
acggcuguugucgaa

SEQ ID NO: 1523734 - RNA, 22 nt, Pseudomonas aeruginosa PA01
acggcuguugucgaacagguag

SEQ ID NO: 1523735 - RNA, 13 nt, Pseudomonas aeruginosa PA01
acggcgcggugag

SEQ ID NO: 1523736 - RNA, 15 nt, Pseudomonas aeruginosa PA01
acggcgcagcagggc

SEQ ID NO: 1523737 - RNA, 22 nt, Pseudomonas aeruginosa PA01
acggcgcaucgucgaugcgucc

SEQ ID NO: 1523738 - RNA, 14 nt, Pseudomonas aeruginosa PA01
acggcgccgcugcc

SEQ ID NO: 1523739 - RNA, 15 nt, Pseudomonas aeruginosa PA01
acggcgccuucccag

SEQ ID NO: 1523740 - RNA, 15 nt, Pseudomonas aeruginosa PA01
acggcgcgagaaaaa

SEQ ID NO: 1523741 - RNA, 23 nt, Pseudomonas aeruginosa PA01
acggcaggggcuuucuucgccug

SEQ ID NO: 1523742 - RNA, 18 nt, Pseudomonas aeruginosa PA01
acggcaggguagccacgc

SEQ ID NO: 1523743 - RNA, 15 nt, Pseudomonas aeruginosa PA01
acggcaggcaaaaaa

SEQ ID NO: 1523744 - RNA, 22 nt, Pseudomonas aeruginosa PA01
acggcagcggcgugaagccgcc

SEQ ID NO: 1523745 - RNA, 20 nt, Pseudomonas aeruginosa PA01
acggcagcuggauccgugcc

SEQ ID NO: 1523746 - RNA, 10 nt, Pseudomonas aeruginosa PA01
acggcaggcc

SEQ ID NO: 1523747 - RNA, 16 nt, Pseudomonas aeruginosa PA01
acggcaggccagcagg

SEQ ID NO: 1523748 - RNA, 14 nt, Pseudomonas aeruginosa PA01
agaagacgcccagc

SEQ ID NO: 1523749 - RNA, 19 nt, Pseudomonas aeruginosa PA01
agaagacgcccagcagggc

SEQ ID NO: 1523750 - RNA, 21 nt, Pseudomonas aeruginosa PA01
agaagccgcacuuccaggcgc

SEQ ID NO: 1523751 - RNA, 19 nt, Pseudomonas aeruginosa PA01
agaagccgcacuuccaggu

SEQ ID NO: 1523752 - RNA, 18 nt, Pseudomonas aeruginosa PA01
agaagccgcgcaaggcag

SEQ ID NO: 1523753 - RNA, 12 nt, Pseudomonas aeruginosa PA01
agaagcgcucgu

SEQ ID NO: 1523754 - RNA, 15 nt, Pseudomonas aeruginosa PA01
agaagcgcaccaccu

SEQ ID NO: 1523755 - RNA, 23 nt, Pseudomonas aeruginosa PA01
agaagcgcaccaccugcaugcuu

SEQ ID NO: 1523756 - RNA, 13 nt, Pseudomonas aeruginosa PA01
agaaggccagggc

SEQ ID NO: 1523757 - RNA, 20 nt, Pseudomonas aeruginosa PA01
agacagcccuccaaagaaaa

SEQ ID NO: 1523758 - RNA, 17 nt, Pseudomonas aeruginosa PA01
agacaggccuccagcaa

SEQ ID NO: 1523759 - RNA, 15 nt, Pseudomonas aeruginosa PA01
agacaggccugugga

SEQ ID NO: 1523760 - RNA, 21 nt, Pseudomonas aeruginosa PA01
agacaggaaucgacccagccg

SEQ ID NO: 1523761 - RNA, 14 nt, Pseudomonas aeruginosa PA01
agaccggcagcgcc

SEQ ID NO: 1523762 - RNA, 23 nt, Pseudomonas aeruginosa PA01
agaccgcucgucaggcgcucagg

SEQ ID NO: 1523763 - RNA, 16 nt, Pseudomonas aeruginosa PA01
agacgccagccgcccu

SEQ ID NO: 1523764 - RNA, 22 nt, Pseudomonas aeruginosa PA01
agacgccaucaacggauauccc

SEQ ID NO: 1523765 - RNA, 18 nt, Pseudomonas aeruginosa PA01
agacgaaacucaucaggc

SEQ ID NO: 1523766 - RNA, 24 nt, Pseudomonas aeruginosa PA01
agaccuuccagccgcgcgcgucga

SEQ ID NO: 1523767 - RNA, 19 nt, Pseudomonas aeruginosa PA01
agaccaaggcauugcgcuu

SEQ ID NO: 1523768 - RNA, 13 nt, Pseudomonas aeruginosa PA01
agacccucucccu

SEQ ID NO: 1523769 - RNA, 12 nt, Pseudomonas aeruginosa PA01
agaccccggcga

SEQ ID NO: 1523770 - RNA, 21 nt, Pseudomonas aeruginosa PA01
agacccgcaacaccuguaccu

SEQ ID NO: 1523771 - RNA, 13 nt, Pseudomonas aeruginosa PA01
agacccugggcca

SEQ ID NO: 1523772 - RNA, 18 nt, Pseudomonas aeruginosa PA01
agacgccgccccagccuc

SEQ ID NO: 1523773 - RNA, 15 nt, Pseudomonas aeruginosa PA01
agacgcccuggauga

SEQ ID NO: 1523774 - RNA, 23 nt, Pseudomonas aeruginosa PA01
agacgcccugaggcuuuccugcg

SEQ ID NO: 1523775 - RNA, 22 nt, Pseudomonas aeruginosa PA01
agacgccguccaccagccagcu

SEQ ID NO: 1523776 - RNA, 20 nt, Pseudomonas aeruginosa PA01
agacgccgcucuaucagggu

SEQ ID NO: 1523777 - RNA, 13 nt, Pseudomonas aeruginosa PA01
agacgcugcaccg

SEQ ID NO: 1523778 - RNA, 15 nt, Pseudomonas aeruginosa PA01
agacgcucggccagc

SEQ ID NO: 1523779 - RNA, 19 nt, Pseudomonas aeruginosa PA01
agacgcggauuggccgggc

SEQ ID NO: 1523780 - RNA, 16 nt, Pseudomonas aeruginosa PA01
agacuccggcgcagcc

SEQ ID NO: 1523781 - RNA, 24 nt, Pseudomonas aeruginosa PA01
agacuccggcgcagcccagccgcu

SEQ ID NO: 1523782 - RNA, 13 nt, Pseudomonas aeruginosa PA01
agacuuccgggcu

SEQ ID NO: 1523783 - RNA, 12 nt, Pseudomonas aeruginosa PA01
agauaaaugccc

SEQ ID NO: 1523784 - RNA, 13 nt, Pseudomonas aeruginosa PA01
agaguucggcugc

SEQ ID NO: 1523785 - RNA, 18 nt, Pseudomonas aeruginosa PA01
agaggcuggcgcucugca

SEQ ID NO: 1523786 - RNA, 16 nt, Pseudomonas aeruginosa PA01
agaggcuguagcgcuc

SEQ ID NO: 1523787 - RNA, 17 nt, Pseudomonas aeruginosa PA01
agaggcgugcuggcuau

SEQ ID NO: 1523788 - RNA, 21 nt, Pseudomonas aeruginosa PA01
agagguugcgcccgucgaaga

SEQ ID NO: 1523789 - RNA, 20 nt, Pseudomonas aeruginosa PA01
agagguugcuguagaaugcg

SEQ ID NO: 1523790 - RNA, 17 nt, Pseudomonas aeruginosa PA01
agagugcccaggcgcug

SEQ ID NO: 1523791 - RNA, 22 nt, Pseudomonas aeruginosa PA01
agagugcccaggcgcuggcgcc

SEQ ID NO: 1523792 - RNA, 21 nt, Pseudomonas aeruginosa PA01
agaggcauucaucaccagcuc

SEQ ID NO: 1523793 - RNA, 19 nt, Pseudomonas aeruginosa PA01
agaggcaacaccaucggcc

SEQ ID NO: 1523794 - RNA, 15 nt, Pseudomonas aeruginosa PA01
agagcggcaggccgc

SEQ ID NO: 1523795 - RNA, 19 nt, Pseudomonas aeruginosa PA01
agagcccgccgaacagcaa

SEQ ID NO: 1523796 - RNA, 16 nt, Pseudomonas aeruginosa PA01
agagcccgcggaacgc

SEQ ID NO: 1523797 - RNA, 20 nt, Pseudomonas aeruginosa PA01
agaaaacgcccggcaucugc

SEQ ID NO: 1523798 - RNA, 14 nt, Pseudomonas aeruginosa PA01
agaaaagaaaauuu

SEQ ID NO: 1523799 - RNA, 12 nt, Pseudomonas aeruginosa PA01
agaaaaggcccg

SEQ ID NO: 1523800 - RNA, 22 nt, Pseudomonas aeruginosa PA01
agaaauccggcuggcgccggug

SEQ ID NO: 1523801 - RNA, 21 nt, Pseudomonas aeruginosa PA01
agaaauccuccggacgccgaa

SEQ ID NO: 1523802 - RNA, 12 nt, Pseudomonas aeruginosa PA01
acuugugguggg

SEQ ID NO: 1523803 - RNA, 17 nt, Pseudomonas aeruginosa PA01
acuuucccguuuugccg

SEQ ID NO: 1523804 - RNA, 16 nt, Pseudomonas aeruginosa PA01
acuguaccgcucugca

SEQ ID NO: 1523805 - RNA, 23 nt, Pseudomonas aeruginosa PA01
acugacgguggaggcgggcucac

SEQ ID NO: 1523806 - RNA, 21 nt, Pseudomonas aeruginosa PA01
acugacgcgcagcgccgccgc

SEQ ID NO: 1523807 - RNA, 14 nt, Pseudomonas aeruginosa PA01
acuuccagcugcca

SEQ ID NO: 1523808 - RNA, 16 nt, Pseudomonas aeruginosa PA01
acuuccaucagcucca

SEQ ID NO: 1523809 - RNA, 21 nt, Pseudomonas aeruginosa PA01
acuuccagguagcccaccucg

SEQ ID NO: 1523810 - RNA, 13 nt, Pseudomonas aeruginosa PA01
acuucguccgcca

SEQ ID NO: 1523811 - RNA, 14 nt, Pseudomonas aeruginosa PA01
acuucguccgccac

SEQ ID NO: 1523812 - RNA, 15 nt, Pseudomonas aeruginosa PA01
acuucuccagguaca

SEQ ID NO: 1523813 - RNA, 14 nt, Pseudomonas aeruginosa PA01
acuucuucgcugga

SEQ ID NO: 1523814 - RNA, 23 nt, Pseudomonas aeruginosa PA01
acuugccggcgccaucgaucagc

SEQ ID NO: 1523815 - RNA, 17 nt, Pseudomonas aeruginosa PA01
acuugccagggcaggga

SEQ ID NO: 1523816 - RNA, 14 nt, Pseudomonas aeruginosa PA01
acuugaaguguccg

SEQ ID NO: 1523817 - RNA, 21 nt, Pseudomonas aeruginosa PA01
acuuggcgcgcagggcaucga

SEQ ID NO: 1523818 - RNA, 14 nt, Pseudomonas aeruginosa PA01
acuugcgcaccgcg

SEQ ID NO: 1523819 - RNA, 20 nt, Pseudomonas aeruginosa PA01
acuugcgggugcgcaggcug

SEQ ID NO: 1523820 - RNA, 23 nt, Pseudomonas aeruginosa PA01
acuugcgggugcgcaggcugccu

SEQ ID NO: 1523821 - RNA, 14 nt, Pseudomonas aeruginosa PA01
acuugcuguugccg

SEQ ID NO: 1523822 - RNA, 22 nt, Pseudomonas aeruginosa PA01
acuugcuguugccgcugcaggc

SEQ ID NO: 1523823 - RNA, 21 nt, Pseudomonas aeruginosa PA01
agccaaccgucgcccuggugc

SEQ ID NO: 1523824 - RNA, 16 nt, Pseudomonas aeruginosa PA01
agccaagccaccagcg

SEQ ID NO: 1523825 - RNA, 20 nt, Pseudomonas aeruginosa PA01
agcauuaacuuacacggcgu

SEQ ID NO: 1523826 - RNA, 14 nt, Pseudomonas aeruginosa PA01
agcaugucgccggg

SEQ ID NO: 1523827 - RNA, 23 nt, Pseudomonas aeruginosa PA01
agcaugucgcuccagaccuccag

SEQ ID NO: 1523828 - RNA, 19 nt, Pseudomonas aeruginosa PA01
agcauggcgggccauugca

SEQ ID NO: 1523829 - RNA, 22 nt, Pseudomonas aeruginosa PA01
agcauggcgggccauugcaggu

SEQ ID NO: 1523830 - RNA, 19 nt, Pseudomonas aeruginosa PA01
agcaugccugcuuucccug

SEQ ID NO: 1523831 - RNA, 16 nt, Pseudomonas aeruginosa PA01
agccacucccggcccu

SEQ ID NO: 1523832 - RNA, 16 nt, Pseudomonas aeruginosa PA01
agccagccgccgaagg

SEQ ID NO: 1523833 - RNA, 13 nt, Pseudomonas aeruginosa PA01
agccagccgcagc

SEQ ID NO: 1523834 - RNA, 13 nt, Pseudomonas aeruginosa PA01
agccagcccggcg

SEQ ID NO: 1523835 - RNA, 22 nt, Pseudomonas aeruginosa PA01
agccagccggcgaagggcaggc

SEQ ID NO: 1523836 - RNA, 23 nt, Pseudomonas aeruginosa PA01
agccagccggcgaagggcaggcc

SEQ ID NO: 1523837 - RNA, 22 nt, Pseudomonas aeruginosa PA01
agccagccugcagccagcuuca

SEQ ID NO: 1523838 - RNA, 15 nt, Pseudomonas aeruginosa PA01
agccagagcuccagg

SEQ ID NO: 1523839 - RNA, 17 nt, Pseudomonas aeruginosa PA01
agccagagcuccagggc

SEQ ID NO: 1523840 - RNA, 18 nt, Pseudomonas aeruginosa PA01
agccaugcgggcgggugc

SEQ ID NO: 1523841 - RNA, 14 nt, Pseudomonas aeruginosa PA01
agccaugcccggcu

SEQ ID NO: 1523842 - RNA, 21 nt, Pseudomonas aeruginosa PA01
agccauagugcugggcgaccu

SEQ ID NO: 1523843 - RNA, 12 nt, Pseudomonas aeruginosa PA01
agccaucuuccg

SEQ ID NO: 1523844 - RNA, 16 nt, Pseudomonas aeruginosa PA01
agccaucgcuccagcg

SEQ ID NO: 1523845 - RNA, 19 nt, Pseudomonas aeruginosa PA01
agccaucgcuccagcgaau

SEQ ID NO: 1523846 - RNA, 17 nt, Pseudomonas aeruginosa PA01
agccagucggcggucuu

SEQ ID NO: 1523847 - RNA, 14 nt, Pseudomonas aeruginosa PA01
agccagggcagcag

SEQ ID NO: 1523848 - RNA, 17 nt, Pseudomonas aeruginosa PA01
agccaggggucaggccg

SEQ ID NO: 1523849 - RNA, 17 nt, Pseudomonas aeruginosa PA01
agccaggucggagugcu

SEQ ID NO: 1523850 - RNA, 14 nt, Pseudomonas aeruginosa PA01
agccaggacaaugg

SEQ ID NO: 1523851 - RNA, 14 nt, Pseudomonas aeruginosa PA01
agcaucagcaggaa

SEQ ID NO: 1523852 - RNA, 14 nt, Pseudomonas aeruginosa PA01
agcaucagcgacag

SEQ ID NO: 1523853 - RNA, 22 nt, Pseudomonas aeruginosa PA01
agcaucaugaucugguagacca

SEQ ID NO: 1523854 - RNA, 22 nt, Pseudomonas aeruginosa PA01
agcauccagguaaaggccacca

SEQ ID NO: 1523855 - RNA, 19 nt, Pseudomonas aeruginosa PA01
agcaucucggugcgcccca

SEQ ID NO: 1523856 - RNA, 17 nt, Pseudomonas aeruginosa PA01
agcaucuggcccggggu

SEQ ID NO: 1523857 - RNA, 19 nt, Pseudomonas aeruginosa PA01
agcaucugggucuucagcu

SEQ ID NO: 1523858 - RNA, 16 nt, Pseudomonas aeruginosa PA01
agcaguucgcccggcu

SEQ ID NO: 1523859 - RNA, 12 nt, Pseudomonas aeruginosa PA01
agcaguuccccc

SEQ ID NO: 1523860 - RNA, 17 nt, Pseudomonas aeruginosa PA01
agcaguucccccagcac

SEQ ID NO: 1523861 - RNA, 21 nt, Pseudomonas aeruginosa PA01
agcaguucccccagcaccugg

SEQ ID NO: 1523862 - RNA, 20 nt, Pseudomonas aeruginosa PA01
agcagucguugacggugcug

SEQ ID NO: 1523863 - RNA, 16 nt, Pseudomonas aeruginosa PA01
agcagucgcggcccug

SEQ ID NO: 1523864 - RNA, 17 nt, Pseudomonas aeruginosa PA01
agcagucgcacagccag

SEQ ID NO: 1523865 - RNA, 12 nt, Pseudomonas aeruginosa PA01
agcagcccagcg

SEQ ID NO: 1523866 - RNA, 19 nt, Pseudomonas aeruginosa PA01
agcagccccgaggccagca

SEQ ID NO: 1523867 - RNA, 21 nt, Pseudomonas aeruginosa PA01
agcagccauggcuggugcggg

SEQ ID NO: 1523868 - RNA, 19 nt, Pseudomonas aeruginosa PA01
agcagccucaguggaucgu

SEQ ID NO: 1523869 - RNA, 19 nt, Pseudomonas aeruginosa PA01
agcagcgacucgcugggcg

SEQ ID NO: 1523870 - RNA, 14 nt, Pseudomonas aeruginosa PA01
agcagcgaccugac

SEQ ID NO: 1523871 - RNA, 16 nt, Pseudomonas aeruginosa PA01
agcagcgcaccauccu

SEQ ID NO: 1523872 - RNA, 14 nt, Pseudomonas aeruginosa PA01
agcagcaugccgcu

SEQ ID NO: 1523873 - RNA, 23 nt, Pseudomonas aeruginosa PA01
agcagcaugccgcucugccagaa

SEQ ID NO: 1523874 - RNA, 16 nt, Pseudomonas aeruginosa PA01
agcagccacgggacuu

SEQ ID NO: 1523875 - RNA, 18 nt, Pseudomonas aeruginosa PA01
agcagccacgggacuuca

SEQ ID NO: 1523876 - RNA, 18 nt, Pseudomonas aeruginosa PA01
agcagccaagccaccagc

SEQ ID NO: 1523877 - RNA, 14 nt, Pseudomonas aeruginosa PA01
agcagccaggcgaa

SEQ ID NO: 1523878 - RNA, 22 nt, Pseudomonas aeruginosa PA01
agcagccaggcgaagcggcugg

SEQ ID NO: 1523879 - RNA, 20 nt, Pseudomonas aeruginosa PA01
agcagcagguugaccccgcg

SEQ ID NO: 1523880 - RNA, 12 nt, Pseudomonas aeruginosa PA01
agcagcaggccg

SEQ ID NO: 1523881 - RNA, 13 nt, Pseudomonas aeruginosa PA01
agcagcaggcgcu

SEQ ID NO: 1523882 - RNA, 22 nt, Pseudomonas aeruginosa PA01
agcagcgcggcggcggccagca

SEQ ID NO: 1523883 - RNA, 20 nt, Pseudomonas aeruginosa PA01
agcagcggcgacaccgccag

SEQ ID NO: 1523884 - RNA, 21 nt, Pseudomonas aeruginosa PA01
agcagcggcgacaccgccagc

SEQ ID NO: 1523885 - RNA, 15 nt, Pseudomonas aeruginosa PA01
agcagcgcugcguag

SEQ ID NO: 1523886 - RNA, 13 nt, Pseudomonas aeruginosa PA01
agcagcggcacca

SEQ ID NO: 1523887 - RNA, 14 nt, Pseudomonas aeruginosa PA01
agcagcgccgcccu

SEQ ID NO: 1523888 - RNA, 15 nt, Pseudomonas aeruginosa PA01
agcagcgccgcccug

SEQ ID NO: 1523889 - RNA, 15 nt, Pseudomonas aeruginosa PA01
agcagcgccgcgaac

SEQ ID NO: 1523890 - RNA, 16 nt, Pseudomonas aeruginosa PA01
agcagcgccacgcuga

SEQ ID NO: 1523891 - RNA, 14 nt, Pseudomonas aeruginosa PA01
agcagcgccagcca

SEQ ID NO: 1523892 - RNA, 21 nt, Pseudomonas aeruginosa PA01
agcagcucgccgcuacccagg

SEQ ID NO: 1523893 - RNA, 14 nt, Pseudomonas aeruginosa PA01
agcagcuccgggcu

SEQ ID NO: 1523894 - RNA, 20 nt, Pseudomonas aeruginosa PA01
agcagcgucguagagcgugc

SEQ ID NO: 1523895 - RNA, 16 nt, Pseudomonas aeruginosa PA01
agcaggaccuggccgu

SEQ ID NO: 1523896 - RNA, 18 nt, Pseudomonas aeruginosa PA01
agcaggaauucgggaagg

SEQ ID NO: 1523897 - RNA, 20 nt, Pseudomonas aeruginosa PA01
agcaggaauucgggaaggga

SEQ ID NO: 1523898 - RNA, 21 nt, Pseudomonas aeruginosa PA01
agcaggaauucgggaagggau

SEQ ID NO: 1523899 - RNA, 14 nt, Pseudomonas aeruginosa PA01
agcaggauccaggu

SEQ ID NO: 1523900 - RNA, 15 nt, Pseudomonas aeruginosa PA01
agcaggauccaggug

SEQ ID NO: 1523901 - RNA, 10 nt, Pseudomonas aeruginosa PA01
agcaggaucg

SEQ ID NO: 1523902 - RNA, 21 nt, Pseudomonas aeruginosa PA01
agcaggaugaucacguugaac

SEQ ID NO: 1523903 - RNA, 13 nt, Pseudomonas aeruginosa PA01
agcaggaugcugc

SEQ ID NO: 1523904 - RNA, 15 nt, Pseudomonas aeruginosa PA01
agcaggagcagcuug

SEQ ID NO: 1523905 - RNA, 16 nt, Pseudomonas aeruginosa PA01
agcagcuugcgcgagu

SEQ ID NO: 1523906 - RNA, 14 nt, Pseudomonas aeruginosa PA01
agcaggcaggcgcg

SEQ ID NO: 1523907 - RNA, 15 nt, Pseudomonas aeruginosa PA01
agcaggcaggcgcgg

SEQ ID NO: 1523908 - RNA, 18 nt, Pseudomonas aeruginosa PA01
agcaggccgagcccgagu

SEQ ID NO: 1523909 - RNA, 18 nt, Pseudomonas aeruginosa PA01
agcaggccuugcagggcc

SEQ ID NO: 1523910 - RNA, 13 nt, Pseudomonas aeruginosa PA01
agcaggcgcagca

SEQ ID NO: 1523911 - RNA, 16 nt, Pseudomonas aeruginosa PA01
agcaggcgcagcagcg

SEQ ID NO: 1523912 - RNA, 15 nt, Pseudomonas aeruginosa PA01
agcaggcgcgggcug

SEQ ID NO: 1523913 - RNA, 17 nt, Pseudomonas aeruginosa PA01
agcaggcgcgggcuggc

SEQ ID NO: 1523914 - RNA, 13 nt, Pseudomonas aeruginosa PA01
agcaggcguugca

SEQ ID NO: 1523915 - RNA, 21 nt, Pseudomonas aeruginosa PA01
agcaggcguugcagugcgccg

SEQ ID NO: 1523916 - RNA, 13 nt, Pseudomonas aeruginosa PA01
agcaggcgcucgg

SEQ ID NO: 1523917 - RNA, 15 nt, Pseudomonas aeruginosa PA01
agcaggcggaguagc

SEQ ID NO: 1523918 - RNA, 23 nt, Pseudomonas aeruginosa PA01
agcaggcggaucgccgccuugcg

SEQ ID NO: 1523919 - RNA, 12 nt, Pseudomonas aeruginosa PA01
agcaggcggccg

SEQ ID NO: 1523920 - RNA, 22 nt, Pseudomonas aeruginosa PA01
agcaggcgggaguccaggcggg

SEQ ID NO: 1523921 - RNA, 18 nt, Pseudomonas aeruginosa PA01
agcagggcgaugaacacc

SEQ ID NO: 1523922 - RNA, 18 nt, Pseudomonas aeruginosa PA01
agcagggcgauggccagc

SEQ ID NO: 1523923 - RNA, 19 nt, Pseudomonas aeruginosa PA01
agcagggcgcugagcgcgg

SEQ ID NO: 1523924 - RNA, 13 nt, Pseudomonas aeruginosa PA01
agcagggccaggc

SEQ ID NO: 1523925 - RNA, 20 nt, Pseudomonas aeruginosa PA01
agcagggucacgccgaucac

SEQ ID NO: 1523926 - RNA, 21 nt, Pseudomonas aeruginosa PA01
agcagggucacgccgaucacc

SEQ ID NO: 1523927 - RNA, 22 nt, Pseudomonas aeruginosa PA01
agcagggucacgccgaucaccc

SEQ ID NO: 1523928 - RNA, 16 nt, Pseudomonas aeruginosa PA01
agcagggucagcagcg

SEQ ID NO: 1523929 - RNA, 18 nt, Pseudomonas aeruginosa PA01
agcagggucgcgagcagg

SEQ ID NO: 1523930 - RNA, 16 nt, Pseudomonas aeruginosa PA01
agcagggucgcgccgu

SEQ ID NO: 1523931 - RNA, 15 nt, Pseudomonas aeruginosa PA01
agcagggucgggguc

SEQ ID NO: 1523932 - RNA, 13 nt, Pseudomonas aeruginosa PA01
agcagggccagca

SEQ ID NO: 1523933 - RNA, 16 nt, Pseudomonas aeruginosa PA01
agcagggccagcagcg

SEQ ID NO: 1523934 - RNA, 18 nt, Pseudomonas aeruginosa PA01
agcagggccagcgccugg

SEQ ID NO: 1523935 - RNA, 17 nt, Pseudomonas aeruginosa PA01
agcaggcuguacagcag

SEQ ID NO: 1523936 - RNA, 18 nt, Pseudomonas aeruginosa PA01
agcaggcuguacagcagg

SEQ ID NO: 1523937 - RNA, 14 nt, Pseudomonas aeruginosa PA01
agcaggcugcugcu

SEQ ID NO: 1523938 - RNA, 17 nt, Pseudomonas aeruginosa PA01
agcaggcugccgagaau

SEQ ID NO: 1523939 - RNA, 15 nt, Pseudomonas aeruginosa PA01
agcagguuccuccug

SEQ ID NO: 1523940 - RNA, 19 nt, Pseudomonas aeruginosa PA01
agcagguuccuccugggcc

SEQ ID NO: 1523941 - RNA, 17 nt, Pseudomonas aeruginosa PA01
agcagguggcuggucag

SEQ ID NO: 1523942 - RNA, 14 nt, Pseudomonas aeruginosa PA01
agcaggucggccug

SEQ ID NO: 1523943 - RNA, 15 nt, Pseudomonas aeruginosa PA01
agcaggugcauguag

SEQ ID NO: 1523944 - RNA, 15 nt, Pseudomonas aeruginosa PA01
agcagguucggcggu

SEQ ID NO: 1523945 - RNA, 21 nt, Pseudomonas aeruginosa PA01
agcagguugaccccgcggccg

SEQ ID NO: 1523946 - RNA, 22 nt, Pseudomonas aeruginosa PA01
agcagguugcuggcgaggaaca

SEQ ID NO: 1523947 - RNA, 16 nt, Pseudomonas aeruginosa PA01
agcagguuggucugcu

SEQ ID NO: 1523948 - RNA, 16 nt, Pseudomonas aeruginosa PA01
agcaggucgcggcccc

SEQ ID NO: 1523949 - RNA, 20 nt, Pseudomonas aeruginosa PA01
agcagguagccaggggucag

SEQ ID NO: 1523950 - RNA, 14 nt, Pseudomonas aeruginosa PA01
agcaggguguugau

SEQ ID NO: 1523951 - RNA, 15 nt, Pseudomonas aeruginosa PA01
agcaggguggccagg

SEQ ID NO: 1523952 - RNA, 16 nt, Pseudomonas aeruginosa PA01
agcaggguggccaggg

SEQ ID NO: 1523953 - RNA, 18 nt, Pseudomonas aeruginosa PA01
agcaggguggccaggguc

SEQ ID NO: 1523954 - RNA, 20 nt, Pseudomonas aeruginosa PA01
agcaggguggccaggguccg

SEQ ID NO: 1523955 - RNA, 19 nt, Pseudomonas aeruginosa PA01
agcagggugacggugaucg

SEQ ID NO: 1523956 - RNA, 13 nt, Pseudomonas aeruginosa PA01
agcagggucaggg

SEQ ID NO: 1523957 - RNA, 19 nt, Pseudomonas aeruginosa PA01
agcaauugccggcgugaac

SEQ ID NO: 1523958 - RNA, 21 nt, Pseudomonas aeruginosa PA01
agcaauucgugugggugcuug

SEQ ID NO: 1523959 - RNA, 18 nt, Pseudomonas aeruginosa PA01
agcaauuacacccaacuu

SEQ ID NO: 1523960 - RNA, 14 nt, Pseudomonas aeruginosa PA01
agcaccaccucgcc

SEQ ID NO: 1523961 - RNA, 13 nt, Pseudomonas aeruginosa PA01
agcaccacgaugc

SEQ ID NO: 1523962 - RNA, 22 nt, Pseudomonas aeruginosa PA01
agcaccacccggccgcgcucga

SEQ ID NO: 1523963 - RNA, 22 nt, Pseudomonas aeruginosa PA01
agcaccaccacucgcgagcugg

SEQ ID NO: 1523964 - RNA, 16 nt, Pseudomonas aeruginosa PA01
agcacagccccagccu

SEQ ID NO: 1523965 - RNA, 17 nt, Pseudomonas aeruginosa PA01
agcacagccccagccuc

SEQ ID NO: 1523966 - RNA, 21 nt, Pseudomonas aeruginosa PA01
agcacagccccagccucggca

SEQ ID NO: 1523967 - RNA, 17 nt, Pseudomonas aeruginosa PA01
agcaccgagacgcccug

SEQ ID NO: 1523968 - RNA, 18 nt, Pseudomonas aeruginosa PA01
agcaccgagacgcccugg

SEQ ID NO: 1523969 - RNA, 14 nt, Pseudomonas aeruginosa PA01
agcaccgagcaggc

SEQ ID NO: 1523970 - RNA, 17 nt, Pseudomonas aeruginosa PA01
agcaccgccugcaacuc

SEQ ID NO: 1523971 - RNA, 14 nt, Pseudomonas aeruginosa PA01
agcaccggcggcgc

SEQ ID NO: 1523972 - RNA, 19 nt, Pseudomonas aeruginosa PA01
agcaccggcggcgccaggc

SEQ ID NO: 1523973 - RNA, 22 nt, Pseudomonas aeruginosa PA01
agcaccggcaggacgaugauca

SEQ ID NO: 1523974 - RNA, 20 nt, Pseudomonas aeruginosa PA01
agcaccucccccagcgggcg

SEQ ID NO: 1523975 - RNA, 14 nt, Pseudomonas aeruginosa PA01
agcaccugcgccga

SEQ ID NO: 1523976 - RNA, 21 nt, Pseudomonas aeruginosa PA01
agcaccugcgccgaaggcguc

SEQ ID NO: 1523977 - RNA, 23 nt, Pseudomonas aeruginosa PA01
agcaccccgaccacccuguccug

SEQ ID NO: 1523978 - RNA, 22 nt, Pseudomonas aeruginosa PA01
agcacccggaccuuguccaggg

SEQ ID NO: 1523979 - RNA, 16 nt, Pseudomonas aeruginosa PA01
agcaccaugcgcggca

SEQ ID NO: 1523980 - RNA, 16 nt, Pseudomonas aeruginosa PA01
agcaccagucccuggc

SEQ ID NO: 1523981 - RNA, 17 nt, Pseudomonas aeruginosa PA01
agcaccagggccagggc

SEQ ID NO: 1523982 - RNA, 17 nt, Pseudomonas aeruginosa PA01
agcaccagcaauagccu

SEQ ID NO: 1523983 - RNA, 12 nt, Pseudomonas aeruginosa PA01
agcaccagcacc

SEQ ID NO: 1523984 - RNA, 16 nt, Pseudomonas aeruginosa PA01
agcaccagcaggagca

SEQ ID NO: 1523985 - RNA, 19 nt, Pseudomonas aeruginosa PA01
agcaccagcaggagcaugu

SEQ ID NO: 1523986 - RNA, 23 nt, Pseudomonas aeruginosa PA01
agcaccuugagggccuuggccuc

SEQ ID NO: 1523987 - RNA, 14 nt, Pseudomonas aeruginosa PA01
agcacgaaagccau

SEQ ID NO: 1523988 - RNA, 17 nt, Pseudomonas aeruginosa PA01
agcacgaaagcguucuu

SEQ ID NO: 1523989 - RNA, 23 nt, Pseudomonas aeruginosa PA01
agcacgaggcucaaucaaucggu

SEQ ID NO: 1523990 - RNA, 13 nt, Pseudomonas aeruginosa PA01
agcacgcccuggg

SEQ ID NO: 1523991 - RNA, 15 nt, Pseudomonas aeruginosa PA01
agcacgcccugggac

SEQ ID NO: 1523992 - RNA, 19 nt, Pseudomonas aeruginosa PA01
agcacgcccugggacaggc

SEQ ID NO: 1523993 - RNA, 20 nt, Pseudomonas aeruginosa PA01
agcacguagccgcccuuuuc

SEQ ID NO: 1523994 - RNA, 20 nt, Pseudomonas aeruginosa PA01
agcacggugaaccaggcgcc

SEQ ID NO: 1523995 - RNA, 22 nt, Pseudomonas aeruginosa PA01
agcacggugaaccaggcgccga

SEQ ID NO: 1523996 - RNA, 16 nt, Pseudomonas aeruginosa PA01
agcacgucguccagcg

SEQ ID NO: 1523997 - RNA, 16 nt, Pseudomonas aeruginosa PA01
agcacgucuugcaggc

SEQ ID NO: 1523998 - RNA, 17 nt, Pseudomonas aeruginosa PA01
agcacgucuugcaggcu

SEQ ID NO: 1523999 - RNA, 18 nt, Pseudomonas aeruginosa PA01
agcagcagcgccaugcug

SEQ ID NO: 1524000 - RNA, 22 nt, Pseudomonas aeruginosa PA01
agcagcaccaucagccagccca

SEQ ID NO: 1524001 - RNA, 17 nt, Pseudomonas aeruginosa PA01
agcagcaccaggcuggc

SEQ ID NO: 1524002 - RNA, 12 nt, Pseudomonas aeruginosa PA01
agcagcaccagg

SEQ ID NO: 1524003 - RNA, 14 nt, Pseudomonas aeruginosa PA01
agcagcaccaggcu

SEQ ID NO: 1524004 - RNA, 15 nt, Pseudomonas aeruginosa PA01
agcagcaccagcacc

SEQ ID NO: 1524005 - RNA, 23 nt, Pseudomonas aeruginosa PA01
agcagcaccacggcgauggucag

SEQ ID NO: 1524006 - RNA, 16 nt, Pseudomonas aeruginosa PA01
agcacuucccaggugc

SEQ ID NO: 1524007 - RNA, 17 nt, Pseudomonas aeruginosa PA01
agcacuucccaggugcc

SEQ ID NO: 1524008 - RNA, 21 nt, Pseudomonas aeruginosa PA01
agcacuucccaggugcccugg

SEQ ID NO: 1524009 - RNA, 14 nt, Pseudomonas aeruginosa PA01
agcagaaccgccag

SEQ ID NO: 1524010 - RNA, 20 nt, Pseudomonas aeruginosa PA01
agauugucgcgauccaccgc

SEQ ID NO: 1524011 - RNA, 23 nt, Pseudomonas aeruginosa PA01
agcaaacccgggcccaagccgag

SEQ ID NO: 1524012 - RNA, 18 nt, Pseudomonas aeruginosa PA01
agcaacaguugccgcagc

SEQ ID NO: 1524013 - RNA, 19 nt, Pseudomonas aeruginosa PA01
agcaacaguugccgcagca

SEQ ID NO: 1524014 - RNA, 22 nt, Pseudomonas aeruginosa PA01
agcaacaguugccgcagcagcg

SEQ ID NO: 1524015 - RNA, 19 nt, Pseudomonas aeruginosa PA01
agcaacccaugccgcaagc

SEQ ID NO: 1524016 - RNA, 17 nt, Pseudomonas aeruginosa PA01
agcaacacaugcaggcu

SEQ ID NO: 1524017 - RNA, 19 nt, Pseudomonas aeruginosa PA01
agcaacuguccgaccacuu

SEQ ID NO: 1524018 - RNA, 15 nt, Pseudomonas aeruginosa PA01
agcaacgccuucugc

SEQ ID NO: 1524019 - RNA, 15 nt, Pseudomonas aeruginosa PA01
agcaaugcccagcgc

SEQ ID NO: 1524020 - RNA, 18 nt, Pseudomonas aeruginosa PA01
agcaagucgaacaggccc

SEQ ID NO: 1524021 - RNA, 22 nt, Pseudomonas aeruginosa PA01
agcaaggcgucauagcagcgcc

SEQ ID NO: 1524022 - RNA, 16 nt, Pseudomonas aeruginosa PA01
agcaagccgcagcgcc

SEQ ID NO: 1524023 - RNA, 20 nt, Pseudomonas aeruginosa PA01
agcaagccguagaacgccag

SEQ ID NO: 1524024 - RNA, 20 nt, Pseudomonas aeruginosa PA01
agcaagaguguucccucagg

SEQ ID NO: 1524025 - RNA, 18 nt, Pseudomonas aeruginosa PA01
agcugcgcucggauucca

SEQ ID NO: 1524026 - RNA, 17 nt, Pseudomonas aeruginosa PA01
agcugcggcggcaccac

SEQ ID NO: 1524027 - RNA, 14 nt, Pseudomonas aeruginosa PA01
agcugaucgcgaau

SEQ ID NO: 1524028 - RNA, 18 nt, Pseudomonas aeruginosa PA01
agcucggcuugacuggca

SEQ ID NO: 1524029 - RNA, 13 nt, Pseudomonas aeruginosa PA01
agcucggcgagga

SEQ ID NO: 1524030 - RNA, 17 nt, Pseudomonas aeruginosa PA01
agcucguggcuggcgcc

SEQ ID NO: 1524031 - RNA, 23 nt, Pseudomonas aeruginosa PA01
agcucgucacccgcgccugcagg

SEQ ID NO: 1524032 - RNA, 19 nt, Pseudomonas aeruginosa PA01
agcugaccaccagggcgau

SEQ ID NO: 1524033 - RNA, 12 nt, Pseudomonas aeruginosa PA01
agcucuucgcca

SEQ ID NO: 1524034 - RNA, 19 nt, Pseudomonas aeruginosa PA01
agcucuggccguccugcuu

SEQ ID NO: 1524035 - RNA, 17 nt, Pseudomonas aeruginosa PA01
agcuccccgucccucag

SEQ ID NO: 1524036 - RNA, 13 nt, Pseudomonas aeruginosa PA01
agcuccccgcacc

SEQ ID NO: 1524037 - RNA, 15 nt, Pseudomonas aeruginosa PA01
agcuccccgccgcca

SEQ ID NO: 1524038 - RNA, 12 nt, Pseudomonas aeruginosa PA01
agcuccagcagu

SEQ ID NO: 1524039 - RNA, 10 nt, Pseudomonas aeruginosa PA01
agcuccagca

SEQ ID NO: 1524040 - RNA, 21 nt, Pseudomonas aeruginosa PA01
agcuccaccaaauugccggga

SEQ ID NO: 1524041 - RNA, 14 nt, Pseudomonas aeruginosa PA01
agcuccuccagcag

SEQ ID NO: 1524042 - RNA, 19 nt, Pseudomonas aeruginosa PA01
agcuccuggucgcggggcu

SEQ ID NO: 1524043 - RNA, 20 nt, Pseudomonas aeruginosa PA01
agcuccuugcucucgcgcac

SEQ ID NO: 1524044 - RNA, 21 nt, Pseudomonas aeruginosa PA01
agcucgaccuugcccuugaag

SEQ ID NO: 1524045 - RNA, 19 nt, Pseudomonas aeruginosa PA01
agcucgcgggacagcuuga

SEQ ID NO: 1524046 - RNA, 17 nt, Pseudomonas aeruginosa PA01
agcucgcgguaggccag

SEQ ID NO: 1524047 - RNA, 18 nt, Pseudomonas aeruginosa PA01
agcucgcgguaggccagc

SEQ ID NO: 1524048 - RNA, 22 nt, Pseudomonas aeruginosa PA01
agcucgcgguaggccagcuccu

SEQ ID NO: 1524049 - RNA, 16 nt, Pseudomonas aeruginosa PA01
agcucgccgcgcucca

SEQ ID NO: 1524050 - RNA, 21 nt, Pseudomonas aeruginosa PA01
agcucgcgcaagcgcccggcg

SEQ ID NO: 1524051 - RNA, 19 nt, Pseudomonas aeruginosa PA01
agcucgccgcuccacaccc

SEQ ID NO: 1524052 - RNA, 19 nt, Pseudomonas aeruginosa PA01
agcucgccggcguccuccu

SEQ ID NO: 1524053 - RNA, 17 nt, Pseudomonas aeruginosa PA01
agcucggccgagggcag

SEQ ID NO: 1524054 - RNA, 14 nt, Pseudomonas aeruginosa PA01
agcucggccaggca

SEQ ID NO: 1524055 - RNA, 23 nt, Pseudomonas aeruginosa PA01
agcucggccaggcacagguugau

SEQ ID NO: 1524056 - RNA, 14 nt, Pseudomonas aeruginosa PA01
agcucggcgcccug

SEQ ID NO: 1524057 - RNA, 18 nt, Pseudomonas aeruginosa PA01
agcucgcugucgccgagc

SEQ ID NO: 1524058 - RNA, 17 nt, Pseudomonas aeruginosa PA01
agcucgcuaugcagcag

SEQ ID NO: 1524059 - RNA, 21 nt, Pseudomonas aeruginosa PA01
agcucggacaagggccagagc

SEQ ID NO: 1524060 - RNA, 18 nt, Pseudomonas aeruginosa PA01
agcgucacucccaggcug

SEQ ID NO: 1524061 - RNA, 22 nt, Pseudomonas aeruginosa PA01
agcguccaggguuggaagaaag

SEQ ID NO: 1524062 - RNA, 13 nt, Pseudomonas aeruginosa PA01
agcguccaggugc

SEQ ID NO: 1524063 - RNA, 18 nt, Pseudomonas aeruginosa PA01
agcgggucgagccaggcg

SEQ ID NO: 1524064 - RNA, 16 nt, Pseudomonas aeruginosa PA01
agcgggucgagccagg

SEQ ID NO: 1524065 - RNA, 15 nt, Pseudomonas aeruginosa PA01
agcggguaacccagg

SEQ ID NO: 1524066 - RNA, 15 nt, Pseudomonas aeruginosa PA01
agcgguuagccggcg

SEQ ID NO: 1524067 - RNA, 18 nt, Pseudomonas aeruginosa PA01
agcgguuauucgccccag

SEQ ID NO: 1524068 - RNA, 17 nt, Pseudomonas aeruginosa PA01
agcgguuauucgcccua

SEQ ID NO: 1524069 - RNA, 18 nt, Pseudomonas aeruginosa PA01
agcgguuauucgcccuac

SEQ ID NO: 1524070 - RNA, 13 nt, Pseudomonas aeruginosa PA01
agcgguucagguc

SEQ ID NO: 1524071 - RNA, 21 nt, Pseudomonas aeruginosa PA01
agcgguucaggucgaggccgc

SEQ ID NO: 1524072 - RNA, 23 nt, Pseudomonas aeruginosa PA01
agcggguuggcuuccagccagcc

SEQ ID NO: 1524073 - RNA, 14 nt, Pseudomonas aeruginosa PA01
agcggcaaggccaa

SEQ ID NO: 1524074 - RNA, 13 nt, Pseudomonas aeruginosa PA01
agcggcaccucga

SEQ ID NO: 1524075 - RNA, 17 nt, Pseudomonas aeruginosa PA01
agcggcagauccgccgu

SEQ ID NO: 1524076 - RNA, 23 nt, Pseudomonas aeruginosa PA01
agcggcagaucggugcgggcaga

SEQ ID NO: 1524077 - RNA, 13 nt, Pseudomonas aeruginosa PA01
agcggcaggagca

SEQ ID NO: 1524078 - RNA, 16 nt, Pseudomonas aeruginosa PA01
agcggcaggagcauga

SEQ ID NO: 1524079 - RNA, 12 nt, Pseudomonas aeruginosa PA01
agcggcagggcg

SEQ ID NO: 1524080 - RNA, 16 nt, Pseudomonas aeruginosa PA01
agcggcagggcggcga

SEQ ID NO: 1524081 - RNA, 15 nt, Pseudomonas aeruginosa PA01
agcggcaggcacgcu

SEQ ID NO: 1524082 - RNA, 16 nt, Pseudomonas aeruginosa PA01
agcggcaggccacggc

SEQ ID NO: 1524083 - RNA, 16 nt, Pseudomonas aeruginosa PA01
agcguugcgcgagcac

SEQ ID NO: 1524084 - RNA, 22 nt, Pseudomonas aeruginosa PA01
agcguugcgccagaccagcccc

SEQ ID NO: 1524085 - RNA, 12 nt, Pseudomonas aeruginosa PA01
agcguugcaggc

SEQ ID NO: 1524086 - RNA, 15 nt, Pseudomonas aeruginosa PA01
agcguucuucagcac

SEQ ID NO: 1524087 - RNA, 17 nt, Pseudomonas aeruginosa PA01
agcguucuucagcacuu

SEQ ID NO: 1524088 - RNA, 22 nt, Pseudomonas aeruginosa PA01
agcguugggccucgcugcgcag

SEQ ID NO: 1524089 - RNA, 15 nt, Pseudomonas aeruginosa PA01
agcgugcaccagcag

SEQ ID NO: 1524090 - RNA, 23 nt, Pseudomonas aeruginosa PA01
agcgugacccgcgcuuccagggu

SEQ ID NO: 1524091 - RNA, 14 nt, Pseudomonas aeruginosa PA01
agcgucgccaggcc

SEQ ID NO: 1524092 - RNA, 23 nt, Pseudomonas aeruginosa PA01
agcguuuuuggcaaaccucccgg

SEQ ID NO: 1524093 - RNA, 15 nt, Pseudomonas aeruginosa PA01
agcuaccggcagggu

SEQ ID NO: 1524094 - RNA, 18 nt, Pseudomonas aeruginosa PA01
agcuaccgucggccugca

SEQ ID NO: 1524095 - RNA, 17 nt, Pseudomonas aeruginosa PA01
agcuaguuauugaagug

SEQ ID NO: 1524096 - RNA, 21 nt, Pseudomonas aeruginosa PA01
agcgcguacucaggccgggcg

SEQ ID NO: 1524097 - RNA, 14 nt, Pseudomonas aeruginosa PA01
agcgcgugcaggcg

SEQ ID NO: 1524098 - RNA, 16 nt, Pseudomonas aeruginosa PA01
agcgcgugcaggcgcc

SEQ ID NO: 1524099 - RNA, 19 nt, Pseudomonas aeruginosa PA01
agcgcguucaccccgcccu

SEQ ID NO: 1524100 - RNA, 16 nt, Pseudomonas aeruginosa PA01
agcgcgaaagcgcccc

SEQ ID NO: 1524101 - RNA, 14 nt, Pseudomonas aeruginosa PA01
agcgcgaaggcgcc

SEQ ID NO: 1524102 - RNA, 16 nt, Pseudomonas aeruginosa PA01
agcgcgaaggcgccuu

SEQ ID NO: 1524103 - RNA, 16 nt, Pseudomonas aeruginosa PA01
agcgccuuuucggcac

SEQ ID NO: 1524104 - RNA, 16 nt, Pseudomonas aeruginosa PA01
agcggcaacgcgccca

SEQ ID NO: 1524105 - RNA, 17 nt, Pseudomonas aeruginosa PA01
agcggcaaaggcccggc

SEQ ID NO: 1524106 - RNA, 14 nt, Pseudomonas aeruginosa PA01
agcggaucggcggu

SEQ ID NO: 1524107 - RNA, 23 nt, Pseudomonas aeruginosa PA01
agcggaucggcggugccauggau

SEQ ID NO: 1524108 - RNA, 22 nt, Pseudomonas aeruginosa PA01
agcgcuuguagcagccgcagga

SEQ ID NO: 1524109 - RNA, 15 nt, Pseudomonas aeruginosa PA01
agcgcuucauccugc

SEQ ID NO: 1524110 - RNA, 15 nt, Pseudomonas aeruginosa PA01
agcgcuuccaccgcc

SEQ ID NO: 1524111 - RNA, 21 nt, Pseudomonas aeruginosa PA01
agcgcuuccaccgccugcccc

SEQ ID NO: 1524112 - RNA, 22 nt, Pseudomonas aeruginosa PA01
agcgcuucccgcggcuccagcc

SEQ ID NO: 1524113 - RNA, 16 nt, Pseudomonas aeruginosa PA01
agcgcuuccuugcccu

SEQ ID NO: 1524114 - RNA, 15 nt, Pseudomonas aeruginosa PA01
agcgcuccagcuccu

SEQ ID NO: 1524115 - RNA, 23 nt, Pseudomonas aeruginosa PA01
agcgcuccucgcgcugcccggcg

SEQ ID NO: 1524116 - RNA, 16 nt, Pseudomonas aeruginosa PA01
agcgcuccuugcgcca

SEQ ID NO: 1524117 - RNA, 20 nt, Pseudomonas aeruginosa PA01
agcgcuccuugcgccaggcc

SEQ ID NO: 1524118 - RNA, 13 nt, Pseudomonas aeruginosa PA01
agcgccgcaggcg

SEQ ID NO: 1524119 - RNA, 23 nt, Pseudomonas aeruginosa PA01
agcgccgaggucuuggccagccg

SEQ ID NO: 1524120 - RNA, 13 nt, Pseudomonas aeruginosa PA01
agcgccgaaggcg

SEQ ID NO: 1524121 - RNA, 14 nt, Pseudomonas aeruginosa PA01
agcgccgccgggcg

SEQ ID NO: 1524122 - RNA, 14 nt, Pseudomonas aeruginosa PA01
agcgccgccaggcg

SEQ ID NO: 1524123 - RNA, 13 nt, Pseudomonas aeruginosa PA01
agcgccgcccugu

SEQ ID NO: 1524124 - RNA, 14 nt, Pseudomonas aeruginosa PA01
agcgccgccugcug

SEQ ID NO: 1524125 - RNA, 16 nt, Pseudomonas aeruginosa PA01
agcgccgccugggccg

SEQ ID NO: 1524126 - RNA, 23 nt, Pseudomonas aeruginosa PA01
agcgccgccuugagcggcgcccu

SEQ ID NO: 1524127 - RNA, 14 nt, Pseudomonas aeruginosa PA01
agcgccgccaccgc

SEQ ID NO: 1524128 - RNA, 20 nt, Pseudomonas aeruginosa PA01
agcgccgcauuggccaggcc

SEQ ID NO: 1524129 - RNA, 15 nt, Pseudomonas aeruginosa PA01
agcgccgccagcagg

SEQ ID NO: 1524130 - RNA, 16 nt, Pseudomonas aeruginosa PA01
agcgccgccagcaggu

SEQ ID NO: 1524131 - RNA, 13 nt, Pseudomonas aeruginosa PA01
agcgcccaggugc

SEQ ID NO: 1524132 - RNA, 22 nt, Pseudomonas aeruginosa PA01
agcgccccggccgcgccagcca

SEQ ID NO: 1524133 - RNA, 18 nt, Pseudomonas aeruginosa PA01
agcgccccuuggccagca

SEQ ID NO: 1524134 - RNA, 20 nt, Pseudomonas aeruginosa PA01
agcgccccuuggccagcacc

SEQ ID NO: 1524135 - RNA, 12 nt, Pseudomonas aeruginosa PA01
agcgccccacca

SEQ ID NO: 1524136 - RNA, 17 nt, Pseudomonas aeruginosa PA01
agcgccccaccaggcuc

SEQ ID NO: 1524137 - RNA, 15 nt, Pseudomonas aeruginosa PA01
agcgccccagcaccu

SEQ ID NO: 1524138 - RNA, 12 nt, Pseudomonas aeruginosa PA01
agcgcccggcga

SEQ ID NO: 1524139 - RNA, 11 nt, Pseudomonas aeruginosa PA01
agcgcccggcu

SEQ ID NO: 1524140 - RNA, 14 nt, Pseudomonas aeruginosa PA01
agcgccggccaggg

SEQ ID NO: 1524141 - RNA, 24 nt, Pseudomonas aeruginosa PA01
agcgccggccauugccgccagagu

SEQ ID NO: 1524142 - RNA, 14 nt, Pseudomonas aeruginosa PA01
agcgccggcggcgc

SEQ ID NO: 1524143 - RNA, 16 nt, Pseudomonas aeruginosa PA01
agcgccggcggcgcgu

SEQ ID NO: 1524144 - RNA, 11 nt, Pseudomonas aeruginosa PA01
agcgccgggca

SEQ ID NO: 1524145 - RNA, 19 nt, Pseudomonas aeruginosa PA01
agcgccgucaccagcagcc

SEQ ID NO: 1524146 - RNA, 16 nt, Pseudomonas aeruginosa PA01
agcgccgcggcggcgu

SEQ ID NO: 1524147 - RNA, 20 nt, Pseudomonas aeruginosa PA01
agcgccucguggaacagcgc

SEQ ID NO: 1524148 - RNA, 19 nt, Pseudomonas aeruginosa PA01
agcgccuggucggcggccu

SEQ ID NO: 1524149 - RNA, 22 nt, Pseudomonas aeruginosa PA01
agcgccucgcgggucugcgccu

SEQ ID NO: 1524150 - RNA, 13 nt, Pseudomonas aeruginosa PA01
agcgccuccagca

SEQ ID NO: 1524151 - RNA, 19 nt, Pseudomonas aeruginosa PA01
agcgcaacgaaaagccgcc

SEQ ID NO: 1524152 - RNA, 15 nt, Pseudomonas aeruginosa PA01
agcgcaagucggccu

SEQ ID NO: 1524153 - RNA, 14 nt, Pseudomonas aeruginosa PA01
agcgauugaacucg

SEQ ID NO: 1524154 - RNA, 17 nt, Pseudomonas aeruginosa PA01
agcgauuccaugggcag

SEQ ID NO: 1524155 - RNA, 20 nt, Pseudomonas aeruginosa PA01
agcgcagccgcucggccgcc

SEQ ID NO: 1524156 - RNA, 16 nt, Pseudomonas aeruginosa PA01
agcgaugccuccggcu

SEQ ID NO: 1524157 - RNA, 21 nt, Pseudomonas aeruginosa PA01
agcgaugucgaaaguguugga

SEQ ID NO: 1524158 - RNA, 15 nt, Pseudomonas aeruginosa PA01
agcgagucgacccag

SEQ ID NO: 1524159 - RNA, 16 nt, Pseudomonas aeruginosa PA01
agcgagucgacccagg

SEQ ID NO: 1524160 - RNA, 15 nt, Pseudomonas aeruginosa PA01
agcgaggcguggaag

SEQ ID NO: 1524161 - RNA, 14 nt, Pseudomonas aeruginosa PA01
agcgaguccgaccc

SEQ ID NO: 1524162 - RNA, 16 nt, Pseudomonas aeruginosa PA01
agcgagugcugaacau

SEQ ID NO: 1524163 - RNA, 23 nt, Pseudomonas aeruginosa PA01
agcgagugcugaacaucagguuc

SEQ ID NO: 1524164 - RNA, 15 nt, Pseudomonas aeruginosa PA01
agcgcauaggccugg

SEQ ID NO: 1524165 - RNA, 16 nt, Pseudomonas aeruginosa PA01
agcgcaguugccagga

SEQ ID NO: 1524166 - RNA, 17 nt, Pseudomonas aeruginosa PA01
agcgcaguugccaggag

SEQ ID NO: 1524167 - RNA, 19 nt, Pseudomonas aeruginosa PA01
agcgcaguacccggccgcc

SEQ ID NO: 1524168 - RNA, 21 nt, Pseudomonas aeruginosa PA01
agcgcaggcggacacgcaggc

SEQ ID NO: 1524169 - RNA, 22 nt, Pseudomonas aeruginosa PA01
agcgcaggcggacacgcaggcg

SEQ ID NO: 1524170 - RNA, 15 nt, Pseudomonas aeruginosa PA01
agcgcaggaagcugc

SEQ ID NO: 1524171 - RNA, 18 nt, Pseudomonas aeruginosa PA01
agcgcagccugcuggccu

SEQ ID NO: 1524172 - RNA, 17 nt, Pseudomonas aeruginosa PA01
agcgcaugaggcuggcc

SEQ ID NO: 1524173 - RNA, 15 nt, Pseudomonas aeruginosa PA01
agcgcaucggcgccu

SEQ ID NO: 1524174 - RNA, 14 nt, Pseudomonas aeruginosa PA01
agcgccaggccgcc

SEQ ID NO: 1524175 - RNA, 14 nt, Pseudomonas aeruginosa PA01
agcgccagguaguc

SEQ ID NO: 1524176 - RNA, 22 nt, Pseudomonas aeruginosa PA01
agcgccaggaagccgcgcccca

SEQ ID NO: 1524177 - RNA, 20 nt, Pseudomonas aeruginosa PA01
agcgccagggcauguuccuc

SEQ ID NO: 1524178 - RNA, 21 nt, Pseudomonas aeruginosa PA01
agcgccagguuggccuggccc

SEQ ID NO: 1524179 - RNA, 15 nt, Pseudomonas aeruginosa PA01
agcgccaucaggccc

SEQ ID NO: 1524180 - RNA, 16 nt, Pseudomonas aeruginosa PA01
agcgccaucaggcccu

SEQ ID NO: 1524181 - RNA, 13 nt, Pseudomonas aeruginosa PA01
agcgccagcaggc

SEQ ID NO: 1524182 - RNA, 16 nt, Pseudomonas aeruginosa PA01
agcgccagcagguggu

SEQ ID NO: 1524183 - RNA, 16 nt, Pseudomonas aeruginosa PA01
agcgccagcagguugg

SEQ ID NO: 1524184 - RNA, 16 nt, Pseudomonas aeruginosa PA01
agcgccagcaccagca

SEQ ID NO: 1524185 - RNA, 22 nt, Pseudomonas aeruginosa PA01
agcgccagcaccagcaggagca

SEQ ID NO: 1524186 - RNA, 17 nt, Pseudomonas aeruginosa PA01
agcgccaccagcagggc

SEQ ID NO: 1524187 - RNA, 15 nt, Pseudomonas aeruginosa PA01
agcgccaccagcaug

SEQ ID NO: 1524188 - RNA, 21 nt, Pseudomonas aeruginosa PA01
agcgccaccagcaugcccagc

SEQ ID NO: 1524189 - RNA, 19 nt, Pseudomonas aeruginosa PA01
agcgccacgcugaucauca

SEQ ID NO: 1524190 - RNA, 23 nt, Pseudomonas aeruginosa PA01
agcgccacgcugaucaucagcag

SEQ ID NO: 1524191 - RNA, 16 nt, Pseudomonas aeruginosa PA01
agcgccacuuccaggu

SEQ ID NO: 1524192 - RNA, 23 nt, Pseudomonas aeruginosa PA01
agcccgcggcgagcagcggcgcu

SEQ ID NO: 1524193 - RNA, 22 nt, Pseudomonas aeruginosa PA01
agcccgagugcgcccagcagca

SEQ ID NO: 1524194 - RNA, 20 nt, Pseudomonas aeruginosa PA01
agcccgcaauccgaccgggg

SEQ ID NO: 1524195 - RNA, 21 nt, Pseudomonas aeruginosa PA01
agcccgcaauccgaccgggga

SEQ ID NO: 1524196 - RNA, 19 nt, Pseudomonas aeruginosa PA01
agcccgccagguggcgggc

SEQ ID NO: 1524197 - RNA, 19 nt, Pseudomonas aeruginosa PA01
agcccgccaccuggcgggc

SEQ ID NO: 1524198 - RNA, 21 nt, Pseudomonas aeruginosa PA01
agccccgcuucggcggggcuu

SEQ ID NO: 1524199 - RNA, 11 nt, Pseudomonas aeruginosa PA01
agccccggcau

SEQ ID NO: 1524200 - RNA, 20 nt, Pseudomonas aeruginosa PA01
agccccgguuacucgccggc

SEQ ID NO: 1524201 - RNA, 17 nt, Pseudomonas aeruginosa PA01
agccccguuuuuccuug

SEQ ID NO: 1524202 - RNA, 19 nt, Pseudomonas aeruginosa PA01
agccccgaggccagcaggc

SEQ ID NO: 1524203 - RNA, 15 nt, Pseudomonas aeruginosa PA01
agccccugcgccuca

SEQ ID NO: 1524204 - RNA, 21 nt, Pseudomonas aeruginosa PA01
agcccucggcccggagccaac

SEQ ID NO: 1524205 - RNA, 15 nt, Pseudomonas aeruginosa PA01
agcccucgaccuggc

SEQ ID NO: 1524206 - RNA, 21 nt, Pseudomonas aeruginosa PA01
agcccugcuggcgcagccagg

SEQ ID NO: 1524207 - RNA, 22 nt, Pseudomonas aeruginosa PA01
agcccugcuggcgcagccaggc

SEQ ID NO: 1524208 - RNA, 19 nt, Pseudomonas aeruginosa PA01
agcccgucgaagccaggca

SEQ ID NO: 1524209 - RNA, 20 nt, Pseudomonas aeruginosa PA01
agcccgucgaagccaggcac

SEQ ID NO: 1524210 - RNA, 19 nt, Pseudomonas aeruginosa PA01
agcccuaggcgacccggca

SEQ ID NO: 1524211 - RNA, 22 nt, Pseudomonas aeruginosa PA01
agcccguagucguucagcgccu

SEQ ID NO: 1524212 - RNA, 23 nt, Pseudomonas aeruginosa PA01
agcccggagccguugaaacgcuc

SEQ ID NO: 1524213 - RNA, 15 nt, Pseudomonas aeruginosa PA01
agcccggcagcuccc

SEQ ID NO: 1524214 - RNA, 19 nt, Pseudomonas aeruginosa PA01
agcccggcaggucgaggac

SEQ ID NO: 1524215 - RNA, 21 nt, Pseudomonas aeruginosa PA01
agccauucggcuuccugggcg

SEQ ID NO: 1524216 - RNA, 17 nt, Pseudomonas aeruginosa PA01
agccauuuuagaaaaau

SEQ ID NO: 1524217 - RNA, 20 nt, Pseudomonas aeruginosa PA01
agcccacccccagcccggcc

SEQ ID NO: 1524218 - RNA, 22 nt, Pseudomonas aeruginosa PA01
agcccacccccagcccggccau

SEQ ID NO: 1524219 - RNA, 20 nt, Pseudomonas aeruginosa PA01
agcccacccccggcccggcc

SEQ ID NO: 1524220 - RNA, 22 nt, Pseudomonas aeruginosa PA01
agcccacccccggcccggccau

SEQ ID NO: 1524221 - RNA, 14 nt, Pseudomonas aeruginosa PA01
agcccagcgccugc

SEQ ID NO: 1524222 - RNA, 16 nt, Pseudomonas aeruginosa PA01
agcccagcgccugcaa

SEQ ID NO: 1524223 - RNA, 22 nt, Pseudomonas aeruginosa PA01
agcccagcgagccgaucaccag

SEQ ID NO: 1524224 - RNA, 13 nt, Pseudomonas aeruginosa PA01
agcccagguggca

SEQ ID NO: 1524225 - RNA, 16 nt, Pseudomonas aeruginosa PA01
agcccagguggcaggc

SEQ ID NO: 1524226 - RNA, 18 nt, Pseudomonas aeruginosa PA01
agcccaggccgaaggccu

SEQ ID NO: 1524227 - RNA, 20 nt, Pseudomonas aeruginosa PA01
agcccaggccgaaggccugg

SEQ ID NO: 1524228 - RNA, 22 nt, Pseudomonas aeruginosa PA01
agcccagcucguccaggcaagc

SEQ ID NO: 1524229 - RNA, 13 nt, Pseudomonas aeruginosa PA01
agccccagagccc

SEQ ID NO: 1524230 - RNA, 17 nt, Pseudomonas aeruginosa PA01
agccccaccgccagguu

SEQ ID NO: 1524231 - RNA, 14 nt, Pseudomonas aeruginosa PA01
agccccagcacgcc

SEQ ID NO: 1524232 - RNA, 23 nt, Pseudomonas aeruginosa PA01
agccccagccucggcagggcgcc

SEQ ID NO: 1524233 - RNA, 17 nt, Pseudomonas aeruginosa PA01
agcccccggcgcccaga

SEQ ID NO: 1524234 - RNA, 13 nt, Pseudomonas aeruginosa PA01
agcccccaggcac

SEQ ID NO: 1524235 - RNA, 21 nt, Pseudomonas aeruginosa PA01
agccgccuucgggcggcuugu

SEQ ID NO: 1524236 - RNA, 24 nt, Pseudomonas aeruginosa PA01
agccgcgcaaccguuccagcgccu

SEQ ID NO: 1524237 - RNA, 16 nt, Pseudomonas aeruginosa PA01
agccgcgccggggcag

SEQ ID NO: 1524238 - RNA, 12 nt, Pseudomonas aeruginosa PA01
agccgcgcccca

SEQ ID NO: 1524239 - RNA, 19 nt, Pseudomonas aeruginosa PA01
agccgcgccagugccugca

SEQ ID NO: 1524240 - RNA, 18 nt, Pseudomonas aeruginosa PA01
agccgcgcgccgaguugg

SEQ ID NO: 1524241 - RNA, 14 nt, Pseudomonas aeruginosa PA01
agccgcgcgccgca

SEQ ID NO: 1524242 - RNA, 12 nt, Pseudomonas aeruginosa PA01
agccgcgcucgg

SEQ ID NO: 1524243 - RNA, 16 nt, Pseudomonas aeruginosa PA01
agccgcgcugcuggua

SEQ ID NO: 1524244 - RNA, 17 nt, Pseudomonas aeruginosa PA01
agccgccgcccagcagc

SEQ ID NO: 1524245 - RNA, 21 nt, Pseudomonas aeruginosa PA01
agccgccgcccagcagcacca

SEQ ID NO: 1524246 - RNA, 16 nt, Pseudomonas aeruginosa PA01
agccgccgcugcaccg

SEQ ID NO: 1524247 - RNA, 21 nt, Pseudomonas aeruginosa PA01
agccgcccuggcucugggcca

SEQ ID NO: 1524248 - RNA, 14 nt, Pseudomonas aeruginosa PA01
agccgccccaccac

SEQ ID NO: 1524249 - RNA, 18 nt, Pseudomonas aeruginosa PA01
agccgcccacgggcggcu

SEQ ID NO: 1524250 - RNA, 12 nt, Pseudomonas aeruginosa PA01
agccgccaggac

SEQ ID NO: 1524251 - RNA, 17 nt, Pseudomonas aeruginosa PA01
agccgcucgcguccgca

SEQ ID NO: 1524252 - RNA, 21 nt, Pseudomonas aeruginosa PA01
agccgcugaccucggugagga

SEQ ID NO: 1524253 - RNA, 19 nt, Pseudomonas aeruginosa PA01
agccgcucggccgccagca

SEQ ID NO: 1524254 - RNA, 16 nt, Pseudomonas aeruginosa PA01
agccgcugcugcaacc

SEQ ID NO: 1524255 - RNA, 13 nt, Pseudomonas aeruginosa PA01
agccgcugcaggg

SEQ ID NO: 1524256 - RNA, 20 nt, Pseudomonas aeruginosa PA01
agccgcggccggggaacagg

SEQ ID NO: 1524257 - RNA, 22 nt, Pseudomonas aeruginosa PA01
agccgcggccguuguccagggu

SEQ ID NO: 1524258 - RNA, 16 nt, Pseudomonas aeruginosa PA01
agccggacggcggcgu

SEQ ID NO: 1524259 - RNA, 20 nt, Pseudomonas aeruginosa PA01
agccggccaaccaccggcgc

SEQ ID NO: 1524260 - RNA, 20 nt, Pseudomonas aeruginosa PA01
agccggauucgcgcagcagg

SEQ ID NO: 1524261 - RNA, 15 nt, Pseudomonas aeruginosa PA01
agccggcaagcgugc

SEQ ID NO: 1524262 - RNA, 13 nt, Pseudomonas aeruginosa PA01
agccggaagcgcu

SEQ ID NO: 1524263 - RNA, 15 nt, Pseudomonas aeruginosa PA01
agccgaacggguaga

SEQ ID NO: 1524264 - RNA, 16 nt, Pseudomonas aeruginosa PA01
agcccuucugucuugu

SEQ ID NO: 1524265 - RNA, 18 nt, Pseudomonas aeruginosa PA01
agcccuucugucuugucc

SEQ ID NO: 1524266 - RNA, 14 nt, Pseudomonas aeruginosa PA01
agcccuugcaaccg

SEQ ID NO: 1524267 - RNA, 19 nt, Pseudomonas aeruginosa PA01
agcccuggcguggccggcg

SEQ ID NO: 1524268 - RNA, 19 nt, Pseudomonas aeruginosa PA01
agccgaccaccuucaggcu

SEQ ID NO: 1524269 - RNA, 16 nt, Pseudomonas aeruginosa PA01
agcccuugcgcggcgc

SEQ ID NO: 1524270 - RNA, 14 nt, Pseudomonas aeruginosa PA01
agccgagcaggcca

SEQ ID NO: 1524271 - RNA, 14 nt, Pseudomonas aeruginosa PA01
agccgacgccgagc

SEQ ID NO: 1524272 - RNA, 10 nt, Pseudomonas aeruginosa PA01
agccgcaagc

SEQ ID NO: 1524273 - RNA, 22 nt, Pseudomonas aeruginosa PA01
agccgcaagcggauaucccccc

SEQ ID NO: 1524274 - RNA, 17 nt, Pseudomonas aeruginosa PA01
agccgcaauccgccgcu

SEQ ID NO: 1524275 - RNA, 13 nt, Pseudomonas aeruginosa PA01
agccgcacuucca

SEQ ID NO: 1524276 - RNA, 19 nt, Pseudomonas aeruginosa PA01
agccgcacuuccaggcgcc

SEQ ID NO: 1524277 - RNA, 15 nt, Pseudomonas aeruginosa PA01
agccgcagcgccccu

SEQ ID NO: 1524278 - RNA, 20 nt, Pseudomonas aeruginosa PA01
agccgcaggaugccgccugc

SEQ ID NO: 1524279 - RNA, 12 nt, Pseudomonas aeruginosa PA01
agccgcaggcag

SEQ ID NO: 1524280 - RNA, 11 nt, Pseudomonas aeruginosa PA01
agccgcagggu

SEQ ID NO: 1524281 - RNA, 21 nt, Pseudomonas aeruginosa PA01
agccgagguucuugcccagca

SEQ ID NO: 1524282 - RNA, 13 nt, Pseudomonas aeruginosa PA01
agccgaggcggcc

SEQ ID NO: 1524283 - RNA, 21 nt, Pseudomonas aeruginosa PA01
agccgaggcuuuccagcaggc

SEQ ID NO: 1524284 - RNA, 13 nt, Pseudomonas aeruginosa PA01
agccugggcggcu

SEQ ID NO: 1524285 - RNA, 16 nt, Pseudomonas aeruginosa PA01
agccugcgugagcugg

SEQ ID NO: 1524286 - RNA, 22 nt, Pseudomonas aeruginosa PA01
agccugcgugagcugggcaggc

SEQ ID NO: 1524287 - RNA, 14 nt, Pseudomonas aeruginosa PA01
agccugcuggccug

SEQ ID NO: 1524288 - RNA, 20 nt, Pseudomonas aeruginosa PA01
agccuggaguugugccagcg

SEQ ID NO: 1524289 - RNA, 22 nt, Pseudomonas aeruginosa PA01
agccuggauacgggcgccaggg

SEQ ID NO: 1524290 - RNA, 16 nt, Pseudomonas aeruginosa PA01
agccuggccagcgcuu

SEQ ID NO: 1524291 - RNA, 23 nt, Pseudomonas aeruginosa PA01
agccuggcuggccucagggcgcg

SEQ ID NO: 1524292 - RNA, 14 nt, Pseudomonas aeruginosa PA01
agccuucgagccac

SEQ ID NO: 1524293 - RNA, 14 nt, Pseudomonas aeruginosa PA01
agccuuggccacgg

SEQ ID NO: 1524294 - RNA, 15 nt, Pseudomonas aeruginosa PA01
agcgagccgagcaug

SEQ ID NO: 1524295 - RNA, 17 nt, Pseudomonas aeruginosa PA01
agcgagccgaucaccag

SEQ ID NO: 1524296 - RNA, 20 nt, Pseudomonas aeruginosa PA01
agcgagccgaucaccagcaa

SEQ ID NO: 1524297 - RNA, 16 nt, Pseudomonas aeruginosa PA01
agcgagccgcgcugcu

SEQ ID NO: 1524298 - RNA, 19 nt, Pseudomonas aeruginosa PA01
agcgagacccgguacuccu

SEQ ID NO: 1524299 - RNA, 23 nt, Pseudomonas aeruginosa PA01
agcgagacgccgccccagccucg

SEQ ID NO: 1524300 - RNA, 12 nt, Pseudomonas aeruginosa PA01
agcgagcuugca

SEQ ID NO: 1524301 - RNA, 13 nt, Pseudomonas aeruginosa PA01
agcgagcuugcaa

SEQ ID NO: 1524302 - RNA, 17 nt, Pseudomonas aeruginosa PA01
agcgagcggucggccau

SEQ ID NO: 1524303 - RNA, 18 nt, Pseudomonas aeruginosa PA01
agcgaccgaucaugcccu

SEQ ID NO: 1524304 - RNA, 15 nt, Pseudomonas aeruginosa PA01
agcgacggaagcccu

SEQ ID NO: 1524305 - RNA, 22 nt, Pseudomonas aeruginosa PA01
agcgacucgaugaacgcccuga

SEQ ID NO: 1524306 - RNA, 22 nt, Pseudomonas aeruginosa PA01
agcgacucgcugccggcgcgca

SEQ ID NO: 1524307 - RNA, 16 nt, Pseudomonas aeruginosa PA01
agcgacuggcccuggu

SEQ ID NO: 1524308 - RNA, 13 nt, Pseudomonas aeruginosa PA01
agcgacuguccaa

SEQ ID NO: 1524309 - RNA, 19 nt, Pseudomonas aeruginosa PA01
agcgacggugauagagcac

SEQ ID NO: 1524310 - RNA, 15 nt, Pseudomonas aeruginosa PA01
agcgaauggacaggc

SEQ ID NO: 1524311 - RNA, 20 nt, Pseudomonas aeruginosa PA01
agcgaauggacaggcgcccc

SEQ ID NO: 1524312 - RNA, 21 nt, Pseudomonas aeruginosa PA01
agcgaauggacaggcgccccu

SEQ ID NO: 1524313 - RNA, 19 nt, Pseudomonas aeruginosa PA01
agcgacaccaugcuccgcc

SEQ ID NO: 1524314 - RNA, 15 nt, Pseudomonas aeruginosa PA01
agcgacagcaucugc

SEQ ID NO: 1524315 - RNA, 14 nt, Pseudomonas aeruginosa PA01
agcgacaggcccuu

SEQ ID NO: 1524316 - RNA, 16 nt, Pseudomonas aeruginosa PA01
agcgaagugcgcugcu

SEQ ID NO: 1524317 - RNA, 15 nt, Pseudomonas aeruginosa PA01
agcgaagugggggca

SEQ ID NO: 1524318 - RNA, 18 nt, Pseudomonas aeruginosa PA01
agcgaacgacagcgaaug

SEQ ID NO: 1524319 - RNA, 15 nt, Pseudomonas aeruginosa PA01
agcgaacgccgcagc

SEQ ID NO: 1524320 - RNA, 18 nt, Pseudomonas aeruginosa PA01
agccuaccauuagaggaa

SEQ ID NO: 1524321 - RNA, 21 nt, Pseudomonas aeruginosa PA01
agccucaggcgcugcgcggcc

SEQ ID NO: 1524322 - RNA, 16 nt, Pseudomonas aeruginosa PA01
agccucacccugcugg

SEQ ID NO: 1524323 - RNA, 18 nt, Pseudomonas aeruginosa PA01
agccucacccugcugggc

SEQ ID NO: 1524324 - RNA, 19 nt, Pseudomonas aeruginosa PA01
agccucacccugcugggcg

SEQ ID NO: 1524325 - RNA, 15 nt, Pseudomonas aeruginosa PA01
agccuccagcagcuc

SEQ ID NO: 1524326 - RNA, 14 nt, Pseudomonas aeruginosa PA01
agccuccagcgccg

SEQ ID NO: 1524327 - RNA, 19 nt, Pseudomonas aeruginosa PA01
agccucgcgcucggcggcc

SEQ ID NO: 1524328 - RNA, 23 nt, Pseudomonas aeruginosa PA01
agccucgcgcucggcggccucgc

SEQ ID NO: 1524329 - RNA, 17 nt, Pseudomonas aeruginosa PA01
agccucuaaggaaaaac

SEQ ID NO: 1524330 - RNA, 19 nt, Pseudomonas aeruginosa PA01
agccguccagcuugaggua

SEQ ID NO: 1524331 - RNA, 19 nt, Pseudomonas aeruginosa PA01
agccgucguagcgcagcgg

SEQ ID NO: 1524332 - RNA, 15 nt, Pseudomonas aeruginosa PA01
agccguccugcggcc

SEQ ID NO: 1524333 - RNA, 17 nt, Pseudomonas aeruginosa PA01
agccgguggucuucagc

SEQ ID NO: 1524334 - RNA, 19 nt, Pseudomonas aeruginosa PA01
agccguuccaggcggggcg

SEQ ID NO: 1524335 - RNA, 13 nt, Pseudomonas aeruginosa PA01
agccguggcgggc

SEQ ID NO: 1524336 - RNA, 22 nt, Pseudomonas aeruginosa PA01
agccguggcaggcgcccgguca

SEQ ID NO: 1524337 - RNA, 14 nt, Pseudomonas aeruginosa PA01
agccgguaggggcc

SEQ ID NO: 1524338 - RNA, 21 nt, Pseudomonas aeruginosa PA01
agccgggaagccgcucggcgu

SEQ ID NO: 1524339 - RNA, 15 nt, Pseudomonas aeruginosa PA01
agccggcgcuucugc

SEQ ID NO: 1524340 - RNA, 12 nt, Pseudomonas aeruginosa PA01
agccggcgcugg

SEQ ID NO: 1524341 - RNA, 21 nt, Pseudomonas aeruginosa PA01
agccggcgcaucagcgccggu

SEQ ID NO: 1524342 - RNA, 17 nt, Pseudomonas aeruginosa PA01
agccggcgcaugcgccg

SEQ ID NO: 1524343 - RNA, 20 nt, Pseudomonas aeruginosa PA01
agccggcgcaugcgccggcu

SEQ ID NO: 1524344 - RNA, 21 nt, Pseudomonas aeruginosa PA01
agccggcgaucauccagcccc

SEQ ID NO: 1524345 - RNA, 23 nt, Pseudomonas aeruginosa PA01
agccggcgaugccgcccagcacc

SEQ ID NO: 1524346 - RNA, 20 nt, Pseudomonas aeruginosa PA01
agccggcgaaccaggcggcc

SEQ ID NO: 1524347 - RNA, 18 nt, Pseudomonas aeruginosa PA01
agccggcgaagggcaggc

SEQ ID NO: 1524348 - RNA, 16 nt, Pseudomonas aeruginosa PA01
agccggccgcgucgcc

SEQ ID NO: 1524349 - RNA, 21 nt, Pseudomonas aeruginosa PA01
agccggccgcgucgcccaggc

SEQ ID NO: 1524350 - RNA, 19 nt, Pseudomonas aeruginosa PA01
agccggccgaucuucagca

SEQ ID NO: 1524351 - RNA, 21 nt, Pseudomonas aeruginosa PA01
agccggccauccagccaggcg

SEQ ID NO: 1524352 - RNA, 22 nt, Pseudomonas aeruginosa PA01
agccggccauccagccaggcgc

SEQ ID NO: 1524353 - RNA, 15 nt, Pseudomonas aeruginosa PA01
agccggccccugggc

SEQ ID NO: 1524354 - RNA, 19 nt, Pseudomonas aeruginosa PA01
agccggccccugggccggc

SEQ ID NO: 1524355 - RNA, 15 nt, Pseudomonas aeruginosa PA01
aguacggcgcgguga

SEQ ID NO: 1524356 - RNA, 18 nt, Pseudomonas aeruginosa PA01
aguacggcgcggugaggg

SEQ ID NO: 1524357 - RNA, 18 nt, Pseudomonas aeruginosa PA01
aguacgaucagccagggc

SEQ ID NO: 1524358 - RNA, 18 nt, Pseudomonas aeruginosa PA01
agcuggcgaucgaccugc

SEQ ID NO: 1524359 - RNA, 19 nt, Pseudomonas aeruginosa PA01
agcuggcgaucgaccugcc

SEQ ID NO: 1524360 - RNA, 18 nt, Pseudomonas aeruginosa PA01
agcuggccaguugcaccg

SEQ ID NO: 1524361 - RNA, 21 nt, Pseudomonas aeruginosa PA01
agcuggcccaguugcccggcc

SEQ ID NO: 1524362 - RNA, 18 nt, Pseudomonas aeruginosa PA01
agcuggcgcgccuccugc

SEQ ID NO: 1524363 - RNA, 17 nt, Pseudomonas aeruginosa PA01
agcuggcgcacacgguc

SEQ ID NO: 1524364 - RNA, 23 nt, Pseudomonas aeruginosa PA01
agcuggcgcgucgcugccgccgc

SEQ ID NO: 1524365 - RNA, 16 nt, Pseudomonas aeruginosa PA01
aguaccuggcgguaca

SEQ ID NO: 1524366 - RNA, 15 nt, Pseudomonas aeruginosa PA01
aguagaugcggcugu

SEQ ID NO: 1524367 - RNA, 15 nt, Pseudomonas aeruginosa PA01
aguacucguguucgg

SEQ ID NO: 1524368 - RNA, 14 nt, Pseudomonas aeruginosa PA01
aguacuuggccagc

SEQ ID NO: 1524369 - RNA, 22 nt, Pseudomonas aeruginosa PA01
aguaguccuccgcgcccaggcg

SEQ ID NO: 1524370 - RNA, 14 nt, Pseudomonas aeruginosa PA01
aguaggggaauuuc

SEQ ID NO: 1524371 - RNA, 22 nt, Pseudomonas aeruginosa PA01
aguaggucugguaguaggcgcu

SEQ ID NO: 1524372 - RNA, 18 nt, Pseudomonas aeruginosa PA01
aguaggucuugucgaaga

SEQ ID NO: 1524373 - RNA, 16 nt, Pseudomonas aeruginosa PA01
agucaggcuccgacug

SEQ ID NO: 1524374 - RNA, 20 nt, Pseudomonas aeruginosa PA01
agucaccaggucgcggauca

SEQ ID NO: 1524375 - RNA, 23 nt, Pseudomonas aeruginosa PA01
aguauugcuccacccgcagccgc

SEQ ID NO: 1524376 - RNA, 14 nt, Pseudomonas aeruginosa PA01
agucccgccaggcg

SEQ ID NO: 1524377 - RNA, 23 nt, Pseudomonas aeruginosa PA01
agucccgcaaagcccgcuccgca

SEQ ID NO: 1524378 - RNA, 14 nt, Pseudomonas aeruginosa PA01
aguccugcaacagg

SEQ ID NO: 1524379 - RNA, 13 nt, Pseudomonas aeruginosa PA01
aguccugcaggau

SEQ ID NO: 1524380 - RNA, 14 nt, Pseudomonas aeruginosa PA01
aguccugcaggauc

SEQ ID NO: 1524381 - RNA, 21 nt, Pseudomonas aeruginosa PA01
aguccuggcgguagcccggca

SEQ ID NO: 1524382 - RNA, 18 nt, Pseudomonas aeruginosa PA01
agucggcagucgccgcac

SEQ ID NO: 1524383 - RNA, 16 nt, Pseudomonas aeruginosa PA01
agucgcugcuggcgcc

SEQ ID NO: 1524384 - RNA, 23 nt, Pseudomonas aeruginosa PA01
agucgagagcggguagcgccggu

SEQ ID NO: 1524385 - RNA, 21 nt, Pseudomonas aeruginosa PA01
aguccagcgguaccagcagcg

SEQ ID NO: 1524386 - RNA, 12 nt, Pseudomonas aeruginosa PA01
aguccagcgccg

SEQ ID NO: 1524387 - RNA, 20 nt, Pseudomonas aeruginosa PA01
aguccagcgccgcgcugcgu

SEQ ID NO: 1524388 - RNA, 16 nt, Pseudomonas aeruginosa PA01
aguccagccagugcau

SEQ ID NO: 1524389 - RNA, 23 nt, Pseudomonas aeruginosa PA01
aguccagccagugcaugcgugca

SEQ ID NO: 1524390 - RNA, 10 nt, Pseudomonas aeruginosa PA01
aguccagcac

SEQ ID NO: 1524391 - RNA, 18 nt, Pseudomonas aeruginosa PA01
agucccagaccacccggc

SEQ ID NO: 1524392 - RNA, 14 nt, Pseudomonas aeruginosa PA01
aguccaucaccgcg

SEQ ID NO: 1524393 - RNA, 23 nt, Pseudomonas aeruginosa PA01
aguccagggcgguuaccaggucu

SEQ ID NO: 1524394 - RNA, 20 nt, Pseudomonas aeruginosa PA01
aguccaggucgcggagccaa

SEQ ID NO: 1524395 - RNA, 15 nt, Pseudomonas aeruginosa PA01
agucauggccaguca

SEQ ID NO: 1524396 - RNA, 11 nt, Pseudomonas aeruginosa PA01
agugcccggca

SEQ ID NO: 1524397 - RNA, 23 nt, Pseudomonas aeruginosa PA01
agugcggggcgcucgcccuugcg

SEQ ID NO: 1524398 - RNA, 13 nt, Pseudomonas aeruginosa PA01
agugcggccaggc

SEQ ID NO: 1524399 - RNA, 14 nt, Pseudomonas aeruginosa PA01
agugcggccaggcg

SEQ ID NO: 1524400 - RNA, 16 nt, Pseudomonas aeruginosa PA01
agugcuggguggaggc

SEQ ID NO: 1524401 - RNA, 17 nt, Pseudomonas aeruginosa PA01
agugcaacaccuggcgc

SEQ ID NO: 1524402 - RNA, 22 nt, Pseudomonas aeruginosa PA01
agugccaggcucgccgccagca

SEQ ID NO: 1524403 - RNA, 20 nt, Pseudomonas aeruginosa PA01
agucggugugaccuucaacg

SEQ ID NO: 1524404 - RNA, 12 nt, Pseudomonas aeruginosa PA01
agucgugcaggu

SEQ ID NO: 1524405 - RNA, 16 nt, Pseudomonas aeruginosa PA01
aguucagcgcgcucgc

SEQ ID NO: 1524406 - RNA, 20 nt, Pseudomonas aeruginosa PA01
aguucaguagcggcagggua

SEQ ID NO: 1524407 - RNA, 20 nt, Pseudomonas aeruginosa PA01
aguucgcauaggcggccagc

SEQ ID NO: 1524408 - RNA, 21 nt, Pseudomonas aeruginosa PA01
aguucgcauaggcggccagcc

SEQ ID NO: 1524409 - RNA, 23 nt, Pseudomonas aeruginosa PA01
aguucgcauaggcggccagccuu

SEQ ID NO: 1524410 - RNA, 16 nt, Pseudomonas aeruginosa PA01
aguucgcccagcucgc

SEQ ID NO: 1524411 - RNA, 21 nt, Pseudomonas aeruginosa PA01
aguuccgcaucggccaccuuc

SEQ ID NO: 1524412 - RNA, 13 nt, Pseudomonas aeruginosa PA01
aguucgccgccga

SEQ ID NO: 1524413 - RNA, 13 nt, Pseudomonas aeruginosa PA01
aguucgccggcca

SEQ ID NO: 1524414 - RNA, 16 nt, Pseudomonas aeruginosa PA01
aguucgccggccaggu

SEQ ID NO: 1524415 - RNA, 16 nt, Pseudomonas aeruginosa PA01
aguucggccaucagca

SEQ ID NO: 1524416 - RNA, 14 nt, Pseudomonas aeruginosa PA01
aguucucgcagcag

SEQ ID NO: 1524417 - RNA, 16 nt, Pseudomonas aeruginosa PA01
aguucucgcagcaggc

SEQ ID NO: 1524418 - RNA, 18 nt, Pseudomonas aeruginosa PA01
aguucucgcagcaggcgu

SEQ ID NO: 1524419 - RNA, 16 nt, Pseudomonas aeruginosa PA01
aguucuugcgcauuuu

SEQ ID NO: 1524420 - RNA, 13 nt, Pseudomonas aeruginosa PA01
aguuaucacaacc

SEQ ID NO: 1524421 - RNA, 17 nt, Pseudomonas aeruginosa PA01
aguucaccguccacugg

SEQ ID NO: 1524422 - RNA, 21 nt, Pseudomonas aeruginosa PA01
aguucaccucggugagguagc

SEQ ID NO: 1524423 - RNA, 19 nt, Pseudomonas aeruginosa PA01
aguucacauuggcuuccga

SEQ ID NO: 1524424 - RNA, 14 nt, Pseudomonas aeruginosa PA01
aguucagccacugc

SEQ ID NO: 1524425 - RNA, 14 nt, Pseudomonas aeruginosa PA01
aguggcgcggcuga

SEQ ID NO: 1524426 - RNA, 23 nt, Pseudomonas aeruginosa PA01
aguggcgcagcgcccgauaggcg

SEQ ID NO: 1524427 - RNA, 19 nt, Pseudomonas aeruginosa PA01
aguggccgaaggcgcuccc

SEQ ID NO: 1524428 - RNA, 22 nt, Pseudomonas aeruginosa PA01
aguggccgaaggcgcuccccug

SEQ ID NO: 1524429 - RNA, 14 nt, Pseudomonas aeruginosa PA01
aguggccgaaggcg

SEQ ID NO: 1524430 - RNA, 15 nt, Pseudomonas aeruginosa PA01
aguugauggucaggc

SEQ ID NO: 1524431 - RNA, 22 nt, Pseudomonas aeruginosa PA01
aguugcggagaauugcguugga

SEQ ID NO: 1524432 - RNA, 16 nt, Pseudomonas aeruginosa PA01
aguugccgcagcagcg

SEQ ID NO: 1524433 - RNA, 20 nt, Pseudomonas aeruginosa PA01
aguugccgcagcagcggcga

SEQ ID NO: 1524434 - RNA, 13 nt, Pseudomonas aeruginosa PA01
aguugccgagcuu

SEQ ID NO: 1524435 - RNA, 19 nt, Pseudomonas aeruginosa PA01
aguugcgcgccggcgggga

SEQ ID NO: 1524436 - RNA, 20 nt, Pseudomonas aeruginosa PA01
aguugcgauagaccaggaag

SEQ ID NO: 1524437 - RNA, 15 nt, Pseudomonas aeruginosa PA01
aguugcgccgccugc

SEQ ID NO: 1524438 - RNA, 21 nt, Pseudomonas aeruginosa PA01
aguuucaucucggcgcaggca

SEQ ID NO: 1524439 - RNA, 12 nt, Pseudomonas aeruginosa PA01
auagaccagcac

SEQ ID NO: 1524440 - RNA, 13 nt, Pseudomonas aeruginosa PA01
auagaccagcacc

SEQ ID NO: 1524441 - RNA, 15 nt, Pseudomonas aeruginosa PA01
auagccgacgaaggc

SEQ ID NO: 1524442 - RNA, 15 nt, Pseudomonas aeruginosa PA01
auacccuucaucccu

SEQ ID NO: 1524443 - RNA, 12 nt, Pseudomonas aeruginosa PA01
auacccuggccg

SEQ ID NO: 1524444 - RNA, 23 nt, Pseudomonas aeruginosa PA01
auacccggcgccccggcccagcc

SEQ ID NO: 1524445 - RNA, 21 nt, Pseudomonas aeruginosa PA01
auacccgguagacgccuccca

SEQ ID NO: 1524446 - RNA, 16 nt, Pseudomonas aeruginosa PA01
auaccacguggccggc

SEQ ID NO: 1524447 - RNA, 14 nt, Pseudomonas aeruginosa PA01
auaacgcuucgcag

SEQ ID NO: 1524448 - RNA, 18 nt, Pseudomonas aeruginosa PA01
auacaaagcauuucuuca

SEQ ID NO: 1524449 - RNA, 14 nt, Pseudomonas aeruginosa PA01
auacagcagccaag

SEQ ID NO: 1524450 - RNA, 22 nt, Pseudomonas aeruginosa PA01
auauggaagaggaucuccuggc

SEQ ID NO: 1524451 - RNA, 15 nt, Pseudomonas aeruginosa PA01
auaugggugaugacc

SEQ ID NO: 1524452 - RNA, 12 nt, Pseudomonas aeruginosa PA01
auagcgcagcac

SEQ ID NO: 1524453 - RNA, 20 nt, Pseudomonas aeruginosa PA01
auagcgcaguccgguagcgc

SEQ ID NO: 1524454 - RNA, 18 nt, Pseudomonas aeruginosa PA01
auauccgggcccaggcug

SEQ ID NO: 1524455 - RNA, 14 nt, Pseudomonas aeruginosa PA01
auauccgccaggga

SEQ ID NO: 1524456 - RNA, 15 nt, Pseudomonas aeruginosa PA01
auaugccgcucagcg

SEQ ID NO: 1524457 - RNA, 18 nt, Pseudomonas aeruginosa PA01
auaugcgccgccacgugc

SEQ ID NO: 1524458 - RNA, 19 nt, Pseudomonas aeruginosa PA01
aucuguucgaccaguugcc

SEQ ID NO: 1524459 - RNA, 21 nt, Pseudomonas aeruginosa PA01
aucuguuucaacucccaggac

SEQ ID NO: 1524460 - RNA, 16 nt, Pseudomonas aeruginosa PA01
aucugcucguccaggc

SEQ ID NO: 1524461 - RNA, 20 nt, Pseudomonas aeruginosa PA01
aucuuguagccguccggguc

SEQ ID NO: 1524462 - RNA, 16 nt, Pseudomonas aeruginosa PA01
aucuuguccgggaagu

SEQ ID NO: 1524463 - RNA, 19 nt, Pseudomonas aeruginosa PA01
aucuugcaaucgaugucgu

SEQ ID NO: 1524464 - RNA, 16 nt, Pseudomonas aeruginosa PA01
aucuugcgcccggcgc

SEQ ID NO: 1524465 - RNA, 16 nt, Pseudomonas aeruginosa PA01
aucuucggcgcccacu

SEQ ID NO: 1524466 - RNA, 17 nt, Pseudomonas aeruginosa PA01
augaaaaagcccggcaa

SEQ ID NO: 1524467 - RNA, 16 nt, Pseudomonas aeruginosa PA01
augaaaaagggaugcc

SEQ ID NO: 1524468 - RNA, 21 nt, Pseudomonas aeruginosa PA01
augaaaaagggaugccgccgg

SEQ ID NO: 1524469 - RNA, 16 nt, Pseudomonas aeruginosa PA01
augacggggaucacuc

SEQ ID NO: 1524470 - RNA, 18 nt, Pseudomonas aeruginosa PA01
augaccucggccagccag

SEQ ID NO: 1524471 - RNA, 15 nt, Pseudomonas aeruginosa PA01
augaccgucagccag

SEQ ID NO: 1524472 - RNA, 18 nt, Pseudomonas aeruginosa PA01
augaccgucagccaggcu

SEQ ID NO: 1524473 - RNA, 23 nt, Pseudomonas aeruginosa PA01
augaacagcggaaugcuuccgua

SEQ ID NO: 1524474 - RNA, 19 nt, Pseudomonas aeruginosa PA01
augaacagugcgcccgugg

SEQ ID NO: 1524475 - RNA, 19 nt, Pseudomonas aeruginosa PA01
augacuccggucaaggcag

SEQ ID NO: 1524476 - RNA, 14 nt, Pseudomonas aeruginosa PA01
augagcgacccaac

SEQ ID NO: 1524477 - RNA, 14 nt, Pseudomonas aeruginosa PA01
augagccagccugc

SEQ ID NO: 1524478 - RNA, 14 nt, Pseudomonas aeruginosa PA01
augagcgaugucca

SEQ ID NO: 1524479 - RNA, 15 nt, Pseudomonas aeruginosa PA01
augagcuucgccggg

SEQ ID NO: 1524480 - RNA, 16 nt, Pseudomonas aeruginosa PA01
augaggcuggccagca

SEQ ID NO: 1524481 - RNA, 13 nt, Pseudomonas aeruginosa PA01
augaugccgccgu

SEQ ID NO: 1524482 - RNA, 22 nt, Pseudomonas aeruginosa PA01
augaucaccaggacccagauga

SEQ ID NO: 1524483 - RNA, 23 nt, Pseudomonas aeruginosa PA01
augaucuccgcgccgggcuggcc

SEQ ID NO: 1524484 - RNA, 23 nt, Pseudomonas aeruginosa PA01
augaucgacugcaugaccuccag

SEQ ID NO: 1524485 - RNA, 18 nt, Pseudomonas aeruginosa PA01
augauccggugcaggccg

SEQ ID NO: 1524486 - RNA, 13 nt, Pseudomonas aeruginosa PA01
augcaccugcgcc

SEQ ID NO: 1524487 - RNA, 24 nt, Pseudomonas aeruginosa PA01
augcacgugcagcucggcacgcag

SEQ ID NO: 1524488 - RNA, 17 nt, Pseudomonas aeruginosa PA01
augcagauccagcggca

SEQ ID NO: 1524489 - RNA, 20 nt, Pseudomonas aeruginosa PA01
auggcggucggccaggcggc

SEQ ID NO: 1524490 - RNA, 16 nt, Pseudomonas aeruginosa PA01
auggcgaucuccggga

SEQ ID NO: 1524491 - RNA, 15 nt, Pseudomonas aeruginosa PA01
auggcgcagccgcug

SEQ ID NO: 1524492 - RNA, 18 nt, Pseudomonas aeruginosa PA01
auggcggggcuucuuuua

SEQ ID NO: 1524493 - RNA, 11 nt, Pseudomonas aeruginosa PA01
auggccgccgc

SEQ ID NO: 1524494 - RNA, 16 nt, Pseudomonas aeruginosa PA01
auggccggcaccagca

SEQ ID NO: 1524495 - RNA, 16 nt, Pseudomonas aeruginosa PA01
auggccggcagcagcg

SEQ ID NO: 1524496 - RNA, 18 nt, Pseudomonas aeruginosa PA01
auggccgaccgccaggcc

SEQ ID NO: 1524497 - RNA, 14 nt, Pseudomonas aeruginosa PA01
auggcccuucgccc

SEQ ID NO: 1524498 - RNA, 22 nt, Pseudomonas aeruginosa PA01
auggcaccgucaagggccagga

SEQ ID NO: 1524499 - RNA, 17 nt, Pseudomonas aeruginosa PA01
auggcuggucaggcuga

SEQ ID NO: 1524500 - RNA, 18 nt, Pseudomonas aeruginosa PA01
auggcuguagggacaggc

SEQ ID NO: 1524501 - RNA, 12 nt, Pseudomonas aeruginosa PA01
augggggccagc

SEQ ID NO: 1524502 - RNA, 14 nt, Pseudomonas aeruginosa PA01
auggggcggccggc

SEQ ID NO: 1524503 - RNA, 13 nt, Pseudomonas aeruginosa PA01
auggucaccuuga

SEQ ID NO: 1524504 - RNA, 12 nt, Pseudomonas aeruginosa PA01
auggucaggccg

SEQ ID NO: 1524505 - RNA, 12 nt, Pseudomonas aeruginosa PA01
augguucaucuu

SEQ ID NO: 1524506 - RNA, 13 nt, Pseudomonas aeruginosa PA01
augguucaucuuc

SEQ ID NO: 1524507 - RNA, 17 nt, Pseudomonas aeruginosa PA01
augguggaucgacugca

SEQ ID NO: 1524508 - RNA, 13 nt, Pseudomonas aeruginosa PA01
auguauucgaaca

SEQ ID NO: 1524509 - RNA, 22 nt, Pseudomonas aeruginosa PA01
auguauucgaacagcuugacga

SEQ ID NO: 1524510 - RNA, 20 nt, Pseudomonas aeruginosa PA01
auguauucggcgguccaggg

SEQ ID NO: 1524511 - RNA, 23 nt, Pseudomonas aeruginosa PA01
auguagcgcuccucgcgcugccc

SEQ ID NO: 1524512 - RNA, 13 nt, Pseudomonas aeruginosa PA01
auguagacgaugc

SEQ ID NO: 1524513 - RNA, 16 nt, Pseudomonas aeruginosa PA01
auguacucgcggccga

SEQ ID NO: 1524514 - RNA, 19 nt, Pseudomonas aeruginosa PA01
augucggcgcugucgccgu

SEQ ID NO: 1524515 - RNA, 19 nt, Pseudomonas aeruginosa PA01
augucggccugcagccugg

SEQ ID NO: 1524516 - RNA, 15 nt, Pseudomonas aeruginosa PA01
augucgcuggccagc

SEQ ID NO: 1524517 - RNA, 16 nt, Pseudomonas aeruginosa PA01
augucgcuggccugca

SEQ ID NO: 1524518 - RNA, 14 nt, Pseudomonas aeruginosa PA01
augucgcggcaggc

SEQ ID NO: 1524519 - RNA, 18 nt, Pseudomonas aeruginosa PA01
augucgcgggcaugcugc

SEQ ID NO: 1524520 - RNA, 18 nt, Pseudomonas aeruginosa PA01
augucagcguagcuguuc

SEQ ID NO: 1524521 - RNA, 13 nt, Pseudomonas aeruginosa PA01
augucguggacau

SEQ ID NO: 1524522 - RNA, 16 nt, Pseudomonas aeruginosa PA01
augucguggucgccgu

SEQ ID NO: 1524523 - RNA, 13 nt, Pseudomonas aeruginosa PA01
auggagcaacagc

SEQ ID NO: 1524524 - RNA, 15 nt, Pseudomonas aeruginosa PA01
auggaccgagaccga

SEQ ID NO: 1524525 - RNA, 21 nt, Pseudomonas aeruginosa PA01
auggagggaucgcgcggcugg

SEQ ID NO: 1524526 - RNA, 23 nt, Pseudomonas aeruginosa PA01
auggaucaugggugaagaccagu

SEQ ID NO: 1524527 - RNA, 20 nt, Pseudomonas aeruginosa PA01
auggaagaggaucuccuggc

SEQ ID NO: 1524528 - RNA, 16 nt, Pseudomonas aeruginosa PA01
auggaacagcagccag

SEQ ID NO: 1524529 - RNA, 20 nt, Pseudomonas aeruginosa PA01
augcugcugaucaggaggau

SEQ ID NO: 1524530 - RNA, 22 nt, Pseudomonas aeruginosa PA01
augcuggcgcucucgaacacca

SEQ ID NO: 1524531 - RNA, 21 nt, Pseudomonas aeruginosa PA01
augcuuccguagguggauugc

SEQ ID NO: 1524532 - RNA, 17 nt, Pseudomonas aeruginosa PA01
augcuugcacaccuggu

SEQ ID NO: 1524533 - RNA, 15 nt, Pseudomonas aeruginosa PA01
augcuguuccucguc

SEQ ID NO: 1524534 - RNA, 20 nt, Pseudomonas aeruginosa PA01
augcucacugcgagcaccau

SEQ ID NO: 1524535 - RNA, 21 nt, Pseudomonas aeruginosa PA01
augcucagccgcgccggggca

SEQ ID NO: 1524536 - RNA, 20 nt, Pseudomonas aeruginosa PA01
augcucagcgccggccaggg

SEQ ID NO: 1524537 - RNA, 21 nt, Pseudomonas aeruginosa PA01
augcucgccaccuguagcagg

SEQ ID NO: 1524538 - RNA, 17 nt, Pseudomonas aeruginosa PA01
augcucggccagcucgc

SEQ ID NO: 1524539 - RNA, 17 nt, Pseudomonas aeruginosa PA01
augcucggccagguauu

SEQ ID NO: 1524540 - RNA, 14 nt, Pseudomonas aeruginosa PA01
augcucccgagcaa

SEQ ID NO: 1524541 - RNA, 21 nt, Pseudomonas aeruginosa PA01
augcucggugugaucaccagc

SEQ ID NO: 1524542 - RNA, 17 nt, Pseudomonas aeruginosa PA01
augcucgguugccaggc

SEQ ID NO: 1524543 - RNA, 17 nt, Pseudomonas aeruginosa PA01
augcguccgcgcaggcg

SEQ ID NO: 1524544 - RNA, 22 nt, Pseudomonas aeruginosa PA01
augcggcugugcucgaggaagc

SEQ ID NO: 1524545 - RNA, 17 nt, Pseudomonas aeruginosa PA01
augcggggcgaccagca

SEQ ID NO: 1524546 - RNA, 20 nt, Pseudomonas aeruginosa PA01
augcgguuccuggcuggagu

SEQ ID NO: 1524547 - RNA, 21 nt, Pseudomonas aeruginosa PA01
augcaugauuucguuggccca

SEQ ID NO: 1524548 - RNA, 23 nt, Pseudomonas aeruginosa PA01
augcaugauuucguuggcccaga

SEQ ID NO: 1524549 - RNA, 18 nt, Pseudomonas aeruginosa PA01
augcggaaggcuuccugg

SEQ ID NO: 1524550 - RNA, 21 nt, Pseudomonas aeruginosa PA01
augcgcggcagguagccgccu

SEQ ID NO: 1524551 - RNA, 18 nt, Pseudomonas aeruginosa PA01
augcgcuacggcaucacc

SEQ ID NO: 1524552 - RNA, 12 nt, Pseudomonas aeruginosa PA01
augcgccucagc

SEQ ID NO: 1524553 - RNA, 21 nt, Pseudomonas aeruginosa PA01
augcgcccccacgacgcacuc

SEQ ID NO: 1524554 - RNA, 16 nt, Pseudomonas aeruginosa PA01
aucaggaggaucgcca

SEQ ID NO: 1524555 - RNA, 16 nt, Pseudomonas aeruginosa PA01
aucaggccgagcaccg

SEQ ID NO: 1524556 - RNA, 21 nt, Pseudomonas aeruginosa PA01
aucaggccgaggaugcucgcc

SEQ ID NO: 1524557 - RNA, 17 nt, Pseudomonas aeruginosa PA01
aucaggauguggccguc

SEQ ID NO: 1524558 - RNA, 18 nt, Pseudomonas aeruginosa PA01
aucaggcucaggccgggc

SEQ ID NO: 1524559 - RNA, 23 nt, Pseudomonas aeruginosa PA01
aucaggcugaagcggccgccgaa

SEQ ID NO: 1524560 - RNA, 17 nt, Pseudomonas aeruginosa PA01
aucaggcuguccacgcc

SEQ ID NO: 1524561 - RNA, 14 nt, Pseudomonas aeruginosa PA01
aucagggcaccgcc

SEQ ID NO: 1524562 - RNA, 17 nt, Pseudomonas aeruginosa PA01
aucaggcgggcuccgcc

SEQ ID NO: 1524563 - RNA, 23 nt, Pseudomonas aeruginosa PA01
aucagggcugggcgcccuucagc

SEQ ID NO: 1524564 - RNA, 15 nt, Pseudomonas aeruginosa PA01
aucagucgcugcucg

SEQ ID NO: 1524565 - RNA, 23 nt, Pseudomonas aeruginosa PA01
aucauccagcccccaugaaaaag

SEQ ID NO: 1524566 - RNA, 18 nt, Pseudomonas aeruginosa PA01
aucaugggggccagcagg

SEQ ID NO: 1524567 - RNA, 17 nt, Pseudomonas aeruginosa PA01
aucaugggugaagacca

SEQ ID NO: 1524568 - RNA, 15 nt, Pseudomonas aeruginosa PA01
aucaucugggccauc

SEQ ID NO: 1524569 - RNA, 23 nt, Pseudomonas aeruginosa PA01
aucauguagacgaugccguucuc

SEQ ID NO: 1524570 - RNA, 13 nt, Pseudomonas aeruginosa PA01
auccacagcgugc

SEQ ID NO: 1524571 - RNA, 15 nt, Pseudomonas aeruginosa PA01
auccaccgccagggc

SEQ ID NO: 1524572 - RNA, 15 nt, Pseudomonas aeruginosa PA01
auccacgccuggccc

SEQ ID NO: 1524573 - RNA, 16 nt, Pseudomonas aeruginosa PA01
auccauaucggccacc

SEQ ID NO: 1524574 - RNA, 11 nt, Pseudomonas aeruginosa PA01
aucccagcucg

SEQ ID NO: 1524575 - RNA, 18 nt, Pseudomonas aeruginosa PA01
auccagggagaacagcag

SEQ ID NO: 1524576 - RNA, 17 nt, Pseudomonas aeruginosa PA01
auccagggccaggauga

SEQ ID NO: 1524577 - RNA, 23 nt, Pseudomonas aeruginosa PA01
auccaggugcgcggcaggaccca

SEQ ID NO: 1524578 - RNA, 20 nt, Pseudomonas aeruginosa PA01
auccagcggacgcuuguccu

SEQ ID NO: 1524579 - RNA, 17 nt, Pseudomonas aeruginosa PA01
auccagcggcagccccu

SEQ ID NO: 1524580 - RNA, 17 nt, Pseudomonas aeruginosa PA01
aucccguagaccggcuc

SEQ ID NO: 1524581 - RNA, 21 nt, Pseudomonas aeruginosa PA01
aucccggcgguuucgccgagg

SEQ ID NO: 1524582 - RNA, 16 nt, Pseudomonas aeruginosa PA01
aucccgccgccgcgcc

SEQ ID NO: 1524583 - RNA, 20 nt, Pseudomonas aeruginosa PA01
aucccgcccggucucagccg

SEQ ID NO: 1524584 - RNA, 20 nt, Pseudomonas aeruginosa PA01
aucccgacgcccuccagcac

SEQ ID NO: 1524585 - RNA, 15 nt, Pseudomonas aeruginosa PA01
auccccugcaggacc

SEQ ID NO: 1524586 - RNA, 21 nt, Pseudomonas aeruginosa PA01
auccccgccucgaccagcgcc

SEQ ID NO: 1524587 - RNA, 23 nt, Pseudomonas aeruginosa PA01
auccccggaccagggcgccgggc

SEQ ID NO: 1524588 - RNA, 14 nt, Pseudomonas aeruginosa PA01
auccccccgcgaag

SEQ ID NO: 1524589 - RNA, 20 nt, Pseudomonas aeruginosa PA01
auccggaguucgcccgcccc

SEQ ID NO: 1524590 - RNA, 16 nt, Pseudomonas aeruginosa PA01
auccgcuccagcgccu

SEQ ID NO: 1524591 - RNA, 20 nt, Pseudomonas aeruginosa PA01
auccgcuccagcgccucgac

SEQ ID NO: 1524592 - RNA, 15 nt, Pseudomonas aeruginosa PA01
auccgcuccaggcug

SEQ ID NO: 1524593 - RNA, 22 nt, Pseudomonas aeruginosa PA01
auccgcguggcgaugcccuggc

SEQ ID NO: 1524594 - RNA, 11 nt, Pseudomonas aeruginosa PA01
auccgcugcau

SEQ ID NO: 1524595 - RNA, 21 nt, Pseudomonas aeruginosa PA01
auccgccgccgggcuucggug

SEQ ID NO: 1524596 - RNA, 22 nt, Pseudomonas aeruginosa PA01
auccgcccugcgucgcagagac

SEQ ID NO: 1524597 - RNA, 13 nt, Pseudomonas aeruginosa PA01
auccgccgcagac

SEQ ID NO: 1524598 - RNA, 14 nt, Pseudomonas aeruginosa PA01
auccgccgcagacc

SEQ ID NO: 1524599 - RNA, 14 nt, Pseudomonas aeruginosa PA01
auccgccgcaggaa

SEQ ID NO: 1524600 - RNA, 17 nt, Pseudomonas aeruginosa PA01
auccgcgccgguggcca

SEQ ID NO: 1524601 - RNA, 20 nt, Pseudomonas aeruginosa PA01
auccgcgccgguggccagga

SEQ ID NO: 1524602 - RNA, 12 nt, Pseudomonas aeruginosa PA01
auccgcgccugc

SEQ ID NO: 1524603 - RNA, 15 nt, Pseudomonas aeruginosa PA01
auccgcgccugcuug

SEQ ID NO: 1524604 - RNA, 20 nt, Pseudomonas aeruginosa PA01
auccgccccaccccaggguu

SEQ ID NO: 1524605 - RNA, 20 nt, Pseudomonas aeruginosa PA01
auccgcccgaucgccucguc

SEQ ID NO: 1524606 - RNA, 19 nt, Pseudomonas aeruginosa PA01
auccgaccuggggcggccu

SEQ ID NO: 1524607 - RNA, 16 nt, Pseudomonas aeruginosa PA01
auccgaggaugggcuu

SEQ ID NO: 1524608 - RNA, 22 nt, Pseudomonas aeruginosa PA01
aucccugcuucgaccagggcau

SEQ ID NO: 1524609 - RNA, 20 nt, Pseudomonas aeruginosa PA01
auccguacuggcgccaggcc

SEQ ID NO: 1524610 - RNA, 17 nt, Pseudomonas aeruginosa PA01
auccgucauacaacugu

SEQ ID NO: 1524611 - RNA, 20 nt, Pseudomonas aeruginosa PA01
auccgggcacuugucgacgu

SEQ ID NO: 1524612 - RNA, 22 nt, Pseudomonas aeruginosa PA01
auccuccaccguuccgacccgg

SEQ ID NO: 1524613 - RNA, 13 nt, Pseudomonas aeruginosa PA01
auccuccagcacu

SEQ ID NO: 1524614 - RNA, 17 nt, Pseudomonas aeruginosa PA01
auccuccaggccgccgg

SEQ ID NO: 1524615 - RNA, 21 nt, Pseudomonas aeruginosa PA01
auccucgccucgcgccagaga

SEQ ID NO: 1524616 - RNA, 10 nt, Pseudomonas aeruginosa PA01
auccuccgcc

SEQ ID NO: 1524617 - RNA, 18 nt, Pseudomonas aeruginosa PA01
auccucccugcccgcucg

SEQ ID NO: 1524618 - RNA, 16 nt, Pseudomonas aeruginosa PA01
auccucggccauaccu

SEQ ID NO: 1524619 - RNA, 20 nt, Pseudomonas aeruginosa PA01
auccucggcauccaguucgu

SEQ ID NO: 1524620 - RNA, 16 nt, Pseudomonas aeruginosa PA01
auccugaccguccugg

SEQ ID NO: 1524621 - RNA, 18 nt, Pseudomonas aeruginosa PA01
auccugcgcgccucuucc

SEQ ID NO: 1524622 - RNA, 20 nt, Pseudomonas aeruginosa PA01
auccugcgcgccucuuccug

SEQ ID NO: 1524623 - RNA, 21 nt, Pseudomonas aeruginosa PA01
auccugcgcgccucuuccugg

SEQ ID NO: 1524624 - RNA, 23 nt, Pseudomonas aeruginosa PA01
auccugcucagcggcccagcgcc

SEQ ID NO: 1524625 - RNA, 23 nt, Pseudomonas aeruginosa PA01
auccuggguagauuuacaagccc

SEQ ID NO: 1524626 - RNA, 23 nt, Pseudomonas aeruginosa PA01
aucgguggugugauccugcuggu

SEQ ID NO: 1524627 - RNA, 22 nt, Pseudomonas aeruginosa PA01
aucggcggugccauggaucacc

SEQ ID NO: 1524628 - RNA, 13 nt, Pseudomonas aeruginosa PA01
aucggcguccugg

SEQ ID NO: 1524629 - RNA, 14 nt, Pseudomonas aeruginosa PA01
aucggcggcggccc

SEQ ID NO: 1524630 - RNA, 18 nt, Pseudomonas aeruginosa PA01
aucgucucgcgacacgug

SEQ ID NO: 1524631 - RNA, 18 nt, Pseudomonas aeruginosa PA01
aucgucucggugcucagg

SEQ ID NO: 1524632 - RNA, 14 nt, Pseudomonas aeruginosa PA01
aucgucggcccgca

SEQ ID NO: 1524633 - RNA, 23 nt, Pseudomonas aeruginosa PA01
aucguuggcgaaguucccgccgc

SEQ ID NO: 1524634 - RNA, 23 nt, Pseudomonas aeruginosa PA01
aucgcugcggguucagucggcca

SEQ ID NO: 1524635 - RNA, 17 nt, Pseudomonas aeruginosa PA01
aucgcugccggucaggc

SEQ ID NO: 1524636 - RNA, 21 nt, Pseudomonas aeruginosa PA01
aucgcugaccucgagcuggac

SEQ ID NO: 1524637 - RNA, 22 nt, Pseudomonas aeruginosa PA01
aucgcucaugugggcuaccgca

SEQ ID NO: 1524638 - RNA, 23 nt, Pseudomonas aeruginosa PA01
aucgcgaagaacacgccccagaa

SEQ ID NO: 1524639 - RNA, 13 nt, Pseudomonas aeruginosa PA01
aucgccugggccg

SEQ ID NO: 1524640 - RNA, 16 nt, Pseudomonas aeruginosa PA01
aucgccugggccggcg

SEQ ID NO: 1524641 - RNA, 19 nt, Pseudomonas aeruginosa PA01
aucgcgaaaacucccggcc

SEQ ID NO: 1524642 - RNA, 16 nt, Pseudomonas aeruginosa PA01
aucgcuuuccuggccg

SEQ ID NO: 1524643 - RNA, 23 nt, Pseudomonas aeruginosa PA01
aucggagagacccgccagcggca

SEQ ID NO: 1524644 - RNA, 17 nt, Pseudomonas aeruginosa PA01
aucggcagcaucagccg

SEQ ID NO: 1524645 - RNA, 12 nt, Pseudomonas aeruginosa PA01
aucggcagggcg

SEQ ID NO: 1524646 - RNA, 14 nt, Pseudomonas aeruginosa PA01
aucggcagggcgcc

SEQ ID NO: 1524647 - RNA, 15 nt, Pseudomonas aeruginosa PA01
aucggcgaucgggua

SEQ ID NO: 1524648 - RNA, 14 nt, Pseudomonas aeruginosa PA01
aucggcgcccagca

SEQ ID NO: 1524649 - RNA, 23 nt, Pseudomonas aeruginosa PA01
aucggcauggccgaccgccaggc

SEQ ID NO: 1524650 - RNA, 15 nt, Pseudomonas aeruginosa PA01
aucggcgauggccau

SEQ ID NO: 1524651 - RNA, 14 nt, Pseudomonas aeruginosa PA01
aucgccgccaggca

SEQ ID NO: 1524652 - RNA, 21 nt, Pseudomonas aeruginosa PA01
aucgccucggccaucgagcgc

SEQ ID NO: 1524653 - RNA, 17 nt, Pseudomonas aeruginosa PA01
aucgccucgucgagcgc

SEQ ID NO: 1524654 - RNA, 23 nt, Pseudomonas aeruginosa PA01
aucgccucguucgucgccgacug

SEQ ID NO: 1524655 - RNA, 13 nt, Pseudomonas aeruginosa PA01
aucgccagcggcg

SEQ ID NO: 1524656 - RNA, 12 nt, Pseudomonas aeruginosa PA01
aucgccagcgcc

SEQ ID NO: 1524657 - RNA, 11 nt, Pseudomonas aeruginosa PA01
aucgccaggcg

SEQ ID NO: 1524658 - RNA, 18 nt, Pseudomonas aeruginosa PA01
aucgccagggucuugccg

SEQ ID NO: 1524659 - RNA, 15 nt, Pseudomonas aeruginosa PA01
aucgacugcaacaga

SEQ ID NO: 1524660 - RNA, 14 nt, Pseudomonas aeruginosa PA01
aucgaucagcagca

SEQ ID NO: 1524661 - RNA, 18 nt, Pseudomonas aeruginosa PA01
aucgaugcucauccugcc

SEQ ID NO: 1524662 - RNA, 21 nt, Pseudomonas aeruginosa PA01
aucgauggucacuggcgaggc

SEQ ID NO: 1524663 - RNA, 18 nt, Pseudomonas aeruginosa PA01
aucgauggucaggcuggc

SEQ ID NO: 1524664 - RNA, 13 nt, Pseudomonas aeruginosa PA01
aucgacagcagcg

SEQ ID NO: 1524665 - RNA, 20 nt, Pseudomonas aeruginosa PA01
aucgacagcagcgccagggc

SEQ ID NO: 1524666 - RNA, 13 nt, Pseudomonas aeruginosa PA01
aucgacaauagcg

SEQ ID NO: 1524667 - RNA, 20 nt, Pseudomonas aeruginosa PA01
aucgaccagacgcagcagcu

SEQ ID NO: 1524668 - RNA, 14 nt, Pseudomonas aeruginosa PA01
aucgaccagcagcg

SEQ ID NO: 1524669 - RNA, 19 nt, Pseudomonas aeruginosa PA01
aucgacaggccgccguaga

SEQ ID NO: 1524670 - RNA, 17 nt, Pseudomonas aeruginosa PA01
aucgacgccagcggcga

SEQ ID NO: 1524671 - RNA, 15 nt, Pseudomonas aeruginosa PA01
aucgaacccccgacc

SEQ ID NO: 1524672 - RNA, 15 nt, Pseudomonas aeruginosa PA01
auccuuggucagggu

SEQ ID NO: 1524673 - RNA, 20 nt, Pseudomonas aeruginosa PA01
caauugccgcugcacgccuu

SEQ ID NO: 1524674 - RNA, 15 nt, Pseudomonas aeruginosa PA01
caauucuucaagguc

SEQ ID NO: 1524675 - RNA, 23 nt, Pseudomonas aeruginosa PA01
caaucagcgcgauuuugggcuca

SEQ ID NO: 1524676 - RNA, 22 nt, Pseudomonas aeruginosa PA01
caaucagcgggccuuuucuuug

SEQ ID NO: 1524677 - RNA, 13 nt, Pseudomonas aeruginosa PA01
cacaaaaaagccc

SEQ ID NO: 1524678 - RNA, 13 nt, Pseudomonas aeruginosa PA01
cacaaaaaacccg

SEQ ID NO: 1524679 - RNA, 16 nt, Pseudomonas aeruginosa PA01
cacaaacacuguggag

SEQ ID NO: 1524680 - RNA, 19 nt, Pseudomonas aeruginosa PA01
cacaacgccuuccuugucg

SEQ ID NO: 1524681 - RNA, 18 nt, Pseudomonas aeruginosa PA01
cacaccgcgcgcgccugc

SEQ ID NO: 1524682 - RNA, 13 nt, Pseudomonas aeruginosa PA01
cacaccaccagca

SEQ ID NO: 1524683 - RNA, 23 nt, Pseudomonas aeruginosa PA01
cacaccgagacgugaagccccug

SEQ ID NO: 1524684 - RNA, 19 nt, Pseudomonas aeruginosa PA01
cacacaugcaggucgugca

SEQ ID NO: 1524685 - RNA, 14 nt, Pseudomonas aeruginosa PA01
cacagggacgcggc

SEQ ID NO: 1524686 - RNA, 21 nt, Pseudomonas aeruginosa PA01
cacaggguggcgggcggcccc

SEQ ID NO: 1524687 - RNA, 13 nt, Pseudomonas aeruginosa PA01
cacagguccagca

SEQ ID NO: 1524688 - RNA, 14 nt, Pseudomonas aeruginosa PA01
cacaggcucuucuc

SEQ ID NO: 1524689 - RNA, 16 nt, Pseudomonas aeruginosa PA01
cacaggcucuucucga

SEQ ID NO: 1524690 - RNA, 17 nt, Pseudomonas aeruginosa PA01
cacaggcggcucaaaga

SEQ ID NO: 1524691 - RNA, 13 nt, Pseudomonas aeruginosa PA01
cacaggcccugga

SEQ ID NO: 1524692 - RNA, 22 nt, Pseudomonas aeruginosa PA01
cacauagagggucagccggccg

SEQ ID NO: 1524693 - RNA, 15 nt, Pseudomonas aeruginosa PA01
cacaguacgccuugc

SEQ ID NO: 1524694 - RNA, 15 nt, Pseudomonas aeruginosa PA01
cacaguugcgcgccg

SEQ ID NO: 1524695 - RNA, 18 nt, Pseudomonas aeruginosa PA01
cacagccauuucugcugu

SEQ ID NO: 1524696 - RNA, 19 nt, Pseudomonas aeruginosa PA01
cacagcguggccagcgccc

SEQ ID NO: 1524697 - RNA, 17 nt, Pseudomonas aeruginosa PA01
cacagcgugcagaccag

SEQ ID NO: 1524698 - RNA, 13 nt, Pseudomonas aeruginosa PA01
cacagcgcccaga

SEQ ID NO: 1524699 - RNA, 14 nt, Pseudomonas aeruginosa PA01
cacagcgcccagac

SEQ ID NO: 1524700 - RNA, 17 nt, Pseudomonas aeruginosa PA01
cacagaucgccagcucg

SEQ ID NO: 1524701 - RNA, 20 nt, Pseudomonas aeruginosa PA01
cacagaucgccagcucgccg

SEQ ID NO: 1524702 - RNA, 16 nt, Pseudomonas aeruginosa PA01
cacagcaccacgcucc

SEQ ID NO: 1524703 - RNA, 21 nt, Pseudomonas aeruginosa PA01
cacagcaccacgcuccuggaa

SEQ ID NO: 1524704 - RNA, 19 nt, Pseudomonas aeruginosa PA01
cacagcacgagcuuggcca

SEQ ID NO: 1524705 - RNA, 22 nt, Pseudomonas aeruginosa PA01
cacaugcaccaggcccugcucc

SEQ ID NO: 1524706 - RNA, 17 nt, Pseudomonas aeruginosa PA01
cacauggucggccaggu

SEQ ID NO: 1524707 - RNA, 18 nt, Pseudomonas aeruginosa PA01
cacauggucuucccagac

SEQ ID NO: 1524708 - RNA, 19 nt, Pseudomonas aeruginosa PA01
cacauggugggcgccgcug

SEQ ID NO: 1524709 - RNA, 14 nt, Pseudomonas aeruginosa PA01
cacauccuugccgu

SEQ ID NO: 1524710 - RNA, 15 nt, Pseudomonas aeruginosa PA01
cacauccaguugcau

SEQ ID NO: 1524711 - RNA, 21 nt, Pseudomonas aeruginosa PA01
caccaacucagucgagguaga

SEQ ID NO: 1524712 - RNA, 17 nt, Pseudomonas aeruginosa PA01
caccacguugcgccgca

SEQ ID NO: 1524713 - RNA, 18 nt, Pseudomonas aeruginosa PA01
caccacucgccagcgcgc

SEQ ID NO: 1524714 - RNA, 16 nt, Pseudomonas aeruginosa PA01
caccacucgcgagcug

SEQ ID NO: 1524715 - RNA, 17 nt, Pseudomonas aeruginosa PA01
caccacucgcgagcugg

SEQ ID NO: 1524716 - RNA, 21 nt, Pseudomonas aeruginosa PA01
caccacggcgaagccgcgccc

SEQ ID NO: 1524717 - RNA, 22 nt, Pseudomonas aeruginosa PA01
caccacggcgaagccgcgcccg

SEQ ID NO: 1524718 - RNA, 15 nt, Pseudomonas aeruginosa PA01
caccacgcuccugga

SEQ ID NO: 1524719 - RNA, 13 nt, Pseudomonas aeruginosa PA01
caccaccuggaug

SEQ ID NO: 1524720 - RNA, 14 nt, Pseudomonas aeruginosa PA01
caccaccugcaugc

SEQ ID NO: 1524721 - RNA, 23 nt, Pseudomonas aeruginosa PA01
caccagauggcuggucaggcuga

SEQ ID NO: 1524722 - RNA, 14 nt, Pseudomonas aeruginosa PA01
caccacugcaacac

SEQ ID NO: 1524723 - RNA, 17 nt, Pseudomonas aeruginosa PA01
caccaaugccagugccu

SEQ ID NO: 1524724 - RNA, 15 nt, Pseudomonas aeruginosa PA01
caccacagcaccacg

SEQ ID NO: 1524725 - RNA, 22 nt, Pseudomonas aeruginosa PA01
caccacaaggugggcagcagcg

SEQ ID NO: 1524726 - RNA, 13 nt, Pseudomonas aeruginosa PA01
caccaccaccgcg

SEQ ID NO: 1524727 - RNA, 17 nt, Pseudomonas aeruginosa PA01
caccaccaccgucuggc

SEQ ID NO: 1524728 - RNA, 15 nt, Pseudomonas aeruginosa PA01
caccaccagcgccgc

SEQ ID NO: 1524729 - RNA, 20 nt, Pseudomonas aeruginosa PA01
caccaccagcgccgccaccg

SEQ ID NO: 1524730 - RNA, 19 nt, Pseudomonas aeruginosa PA01
caccaccagcgcgcgcugg

SEQ ID NO: 1524731 - RNA, 14 nt, Pseudomonas aeruginosa PA01
caccaccagcaggc

SEQ ID NO: 1524732 - RNA, 18 nt, Pseudomonas aeruginosa PA01
caccaccagcaucagcag

SEQ ID NO: 1524733 - RNA, 16 nt, Pseudomonas aeruginosa PA01
caccaccgacgccgga

SEQ ID NO: 1524734 - RNA, 17 nt, Pseudomonas aeruginosa PA01
caccacccggccgcgcu

SEQ ID NO: 1524735 - RNA, 15 nt, Pseudomonas aeruginosa PA01
caccacccggcgcac

SEQ ID NO: 1524736 - RNA, 16 nt, Pseudomonas aeruginosa PA01
caccaccgacaggccg

SEQ ID NO: 1524737 - RNA, 16 nt, Pseudomonas aeruginosa PA01
caccacccagccgcgg

SEQ ID NO: 1524738 - RNA, 17 nt, Pseudomonas aeruginosa PA01
caccacccaucugccgg

SEQ ID NO: 1524739 - RNA, 13 nt, Pseudomonas aeruginosa PA01
caccaccagcgcc

SEQ ID NO: 1524740 - RNA, 14 nt, Pseudomonas aeruginosa PA01
caccaccagggucu

SEQ ID NO: 1524741 - RNA, 19 nt, Pseudomonas aeruginosa PA01
caccaccagggucuccagg

SEQ ID NO: 1524742 - RNA, 22 nt, Pseudomonas aeruginosa PA01
caccaccagggucuccaggacc

SEQ ID NO: 1524743 - RNA, 13 nt, Pseudomonas aeruginosa PA01
caccaccggcugg

SEQ ID NO: 1524744 - RNA, 18 nt, Pseudomonas aeruginosa PA01
caccaccgggggaagaac

SEQ ID NO: 1524745 - RNA, 17 nt, Pseudomonas aeruginosa PA01
caccaccucgccaagcu

SEQ ID NO: 1524746 - RNA, 17 nt, Pseudomonas aeruginosa PA01
caccaccgugaccagca

SEQ ID NO: 1524747 - RNA, 23 nt, Pseudomonas aeruginosa PA01
caccaccgucuggcgcauccgcc

SEQ ID NO: 1524748 - RNA, 16 nt, Pseudomonas aeruginosa PA01
caccaccgccgccagc

SEQ ID NO: 1524749 - RNA, 21 nt, Pseudomonas aeruginosa PA01
caccaugccuuccaccggcgu

SEQ ID NO: 1524750 - RNA, 20 nt, Pseudomonas aeruginosa PA01
caccaugccgaugacaugga

SEQ ID NO: 1524751 - RNA, 19 nt, Pseudomonas aeruginosa PA01
caccauggucuuuccuuuc

SEQ ID NO: 1524752 - RNA, 14 nt, Pseudomonas aeruginosa PA01
cacccagaccuucc

SEQ ID NO: 1524753 - RNA, 12 nt, Pseudomonas aeruginosa PA01
cacccccagcag

SEQ ID NO: 1524754 - RNA, 16 nt, Pseudomonas aeruginosa PA01
cacccccagcccggcc

SEQ ID NO: 1524755 - RNA, 18 nt, Pseudomonas aeruginosa PA01
cacccccagcccggccau

SEQ ID NO: 1524756 - RNA, 20 nt, Pseudomonas aeruginosa PA01
cacccccagcgagccgagca

SEQ ID NO: 1524757 - RNA, 21 nt, Pseudomonas aeruginosa PA01
caccccacaaaaaaaaucagu

SEQ ID NO: 1524758 - RNA, 21 nt, Pseudomonas aeruginosa PA01
caccccacgggcgacccaggc

SEQ ID NO: 1524759 - RNA, 15 nt, Pseudomonas aeruginosa PA01
cacccaggccugggu

SEQ ID NO: 1524760 - RNA, 14 nt, Pseudomonas aeruginosa PA01
cacccaggcgccga

SEQ ID NO: 1524761 - RNA, 17 nt, Pseudomonas aeruginosa PA01
cacccagccgcggccgu

SEQ ID NO: 1524762 - RNA, 15 nt, Pseudomonas aeruginosa PA01
cacccaucugccggc

SEQ ID NO: 1524763 - RNA, 13 nt, Pseudomonas aeruginosa PA01
cacccgcagcccc

SEQ ID NO: 1524764 - RNA, 16 nt, Pseudomonas aeruginosa PA01
cacccgcaccagccgg

SEQ ID NO: 1524765 - RNA, 18 nt, Pseudomonas aeruginosa PA01
cacccgaaagccgaagcg

SEQ ID NO: 1524766 - RNA, 23 nt, Pseudomonas aeruginosa PA01
caccccgucaacccuugcucccg

SEQ ID NO: 1524767 - RNA, 23 nt, Pseudomonas aeruginosa PA01
caccccggucauggugccgagca

SEQ ID NO: 1524768 - RNA, 18 nt, Pseudomonas aeruginosa PA01
caccccgaccagcgcgcu

SEQ ID NO: 1524769 - RNA, 23 nt, Pseudomonas aeruginosa PA01
cacccccgcaaccgcugccgccg

SEQ ID NO: 1524770 - RNA, 18 nt, Pseudomonas aeruginosa PA01
cacccccggcccggccau

SEQ ID NO: 1524771 - RNA, 14 nt, Pseudomonas aeruginosa PA01
caccccgagcccgg

SEQ ID NO: 1524772 - RNA, 15 nt, Pseudomonas aeruginosa PA01
caccccgccgcuggc

SEQ ID NO: 1524773 - RNA, 18 nt, Pseudomonas aeruginosa PA01
caccagcccgcagggucc

SEQ ID NO: 1524774 - RNA, 17 nt, Pseudomonas aeruginosa PA01
caccagccggccgcguc

SEQ ID NO: 1524775 - RNA, 17 nt, Pseudomonas aeruginosa PA01
caccagcagggccaggc

SEQ ID NO: 1524776 - RNA, 10 nt, Pseudomonas aeruginosa PA01
caccagcagg

SEQ ID NO: 1524777 - RNA, 12 nt, Pseudomonas aeruginosa PA01
caccagcagguc

SEQ ID NO: 1524778 - RNA, 13 nt, Pseudomonas aeruginosa PA01
caccagcaugccc

SEQ ID NO: 1524779 - RNA, 17 nt, Pseudomonas aeruginosa PA01
caccagccaggcggcca

SEQ ID NO: 1524780 - RNA, 12 nt, Pseudomonas aeruginosa PA01
caccagccaggu

SEQ ID NO: 1524781 - RNA, 14 nt, Pseudomonas aeruginosa PA01
caccagccaggugu

SEQ ID NO: 1524782 - RNA, 23 nt, Pseudomonas aeruginosa PA01
caccagccagguguucggccccg

SEQ ID NO: 1524783 - RNA, 20 nt, Pseudomonas aeruginosa PA01
caccagcaccagcgggaugu

SEQ ID NO: 1524784 - RNA, 21 nt, Pseudomonas aeruginosa PA01
caccagcacuuccggcgcgga

SEQ ID NO: 1524785 - RNA, 14 nt, Pseudomonas aeruginosa PA01
caccagcagcagcg

SEQ ID NO: 1524786 - RNA, 13 nt, Pseudomonas aeruginosa PA01
caccagcaggccg

SEQ ID NO: 1524787 - RNA, 23 nt, Pseudomonas aeruginosa PA01
caccagcaggccgaucaccagcg

SEQ ID NO: 1524788 - RNA, 20 nt, Pseudomonas aeruginosa PA01
caccagccgaacaguucggc

SEQ ID NO: 1524789 - RNA, 14 nt, Pseudomonas aeruginosa PA01
caccagcgccaggc

SEQ ID NO: 1524790 - RNA, 17 nt, Pseudomonas aeruginosa PA01
caccagcgccaggccgc

SEQ ID NO: 1524791 - RNA, 18 nt, Pseudomonas aeruginosa PA01
caccagcgccaggccgcc

SEQ ID NO: 1524792 - RNA, 13 nt, Pseudomonas aeruginosa PA01
caccagcgccgcc

SEQ ID NO: 1524793 - RNA, 16 nt, Pseudomonas aeruginosa PA01
caccagcgccgccagg

SEQ ID NO: 1524794 - RNA, 23 nt, Pseudomonas aeruginosa PA01
caccagcgccggcggcgcgucca

SEQ ID NO: 1524795 - RNA, 14 nt, Pseudomonas aeruginosa PA01
caccagcgccguca

SEQ ID NO: 1524796 - RNA, 18 nt, Pseudomonas aeruginosa PA01
caccagcggcgagcaggc

SEQ ID NO: 1524797 - RNA, 22 nt, Pseudomonas aeruginosa PA01
caccagcgugguaccgcugcgu

SEQ ID NO: 1524798 - RNA, 23 nt, Pseudomonas aeruginosa PA01
caccaggucgucgucacgcaggc

SEQ ID NO: 1524799 - RNA, 19 nt, Pseudomonas aeruginosa PA01
caccauagcgagccgcgcu

SEQ ID NO: 1524800 - RNA, 20 nt, Pseudomonas aeruginosa PA01
caccaucacgucgcgcaccu

SEQ ID NO: 1524801 - RNA, 23 nt, Pseudomonas aeruginosa PA01
caccaggucgcggaucaggcugg

SEQ ID NO: 1524802 - RNA, 23 nt, Pseudomonas aeruginosa PA01
caccaggguggcgcgcaccaccu

SEQ ID NO: 1524803 - RNA, 19 nt, Pseudomonas aeruginosa PA01
caccaggucgcuguccucc

SEQ ID NO: 1524804 - RNA, 17 nt, Pseudomonas aeruginosa PA01
caccaggucggcgcgcg

SEQ ID NO: 1524805 - RNA, 18 nt, Pseudomonas aeruginosa PA01
caccaggucggcgcgcga

SEQ ID NO: 1524806 - RNA, 17 nt, Pseudomonas aeruginosa PA01
caccagggucgccaggg

SEQ ID NO: 1524807 - RNA, 17 nt, Pseudomonas aeruginosa PA01
caccagggucuccagga

SEQ ID NO: 1524808 - RNA, 18 nt, Pseudomonas aeruginosa PA01
caccagggucuccaggac

SEQ ID NO: 1524809 - RNA, 21 nt, Pseudomonas aeruginosa PA01
caccagggucuccaggaccag

SEQ ID NO: 1524810 - RNA, 14 nt, Pseudomonas aeruginosa PA01
caccagggugcgcu

SEQ ID NO: 1524811 - RNA, 19 nt, Pseudomonas aeruginosa PA01
caccaggcgaugcgccgga

SEQ ID NO: 1524812 - RNA, 20 nt, Pseudomonas aeruginosa PA01
caccaggcgucgcaccuggg

SEQ ID NO: 1524813 - RNA, 18 nt, Pseudomonas aeruginosa PA01
caccaggcucgccccggc

SEQ ID NO: 1524814 - RNA, 18 nt, Pseudomonas aeruginosa PA01
caccaggcuuacccgcga

SEQ ID NO: 1524815 - RNA, 20 nt, Pseudomonas aeruginosa PA01
caccaggcuuacccgcgacc

SEQ ID NO: 1524816 - RNA, 14 nt, Pseudomonas aeruginosa PA01
caccagggccaggg

SEQ ID NO: 1524817 - RNA, 13 nt, Pseudomonas aeruginosa PA01
caccaggccgcca

SEQ ID NO: 1524818 - RNA, 14 nt, Pseudomonas aeruginosa PA01
caccaggccaggcu

SEQ ID NO: 1524819 - RNA, 19 nt, Pseudomonas aeruginosa PA01
caccaggccaggcugcgcu

SEQ ID NO: 1524820 - RNA, 13 nt, Pseudomonas aeruginosa PA01
caccaggccaggu

SEQ ID NO: 1524821 - RNA, 20 nt, Pseudomonas aeruginosa PA01
caccaggccauagcgcgccg

SEQ ID NO: 1524822 - RNA, 18 nt, Pseudomonas aeruginosa PA01
caccaggcgccagggacg

SEQ ID NO: 1524823 - RNA, 21 nt, Pseudomonas aeruginosa PA01
caccaggcgguacaccgccag

SEQ ID NO: 1524824 - RNA, 14 nt, Pseudomonas aeruginosa PA01
caccaggccuccca

SEQ ID NO: 1524825 - RNA, 15 nt, Pseudomonas aeruginosa PA01
caccaggccucccag

SEQ ID NO: 1524826 - RNA, 17 nt, Pseudomonas aeruginosa PA01
caccaggccucccagcc

SEQ ID NO: 1524827 - RNA, 15 nt, Pseudomonas aeruginosa PA01
caccaggaaggcguc

SEQ ID NO: 1524828 - RNA, 12 nt, Pseudomonas aeruginosa PA01
caccaggagcgc

SEQ ID NO: 1524829 - RNA, 14 nt, Pseudomonas aeruginosa PA01
caccaggagcgcca

SEQ ID NO: 1524830 - RNA, 17 nt, Pseudomonas aeruginosa PA01
caccaggagcgccagca

SEQ ID NO: 1524831 - RNA, 20 nt, Pseudomonas aeruginosa PA01
caccaggagcgccagcacca

SEQ ID NO: 1524832 - RNA, 21 nt, Pseudomonas aeruginosa PA01
caccaggagcgccagcaccag

SEQ ID NO: 1524833 - RNA, 18 nt, Pseudomonas aeruginosa PA01
caccggggugauccagcu

SEQ ID NO: 1524834 - RNA, 16 nt, Pseudomonas aeruginosa PA01
caccgguacgcucacc

SEQ ID NO: 1524835 - RNA, 16 nt, Pseudomonas aeruginosa PA01
caccgguaccacgggc

SEQ ID NO: 1524836 - RNA, 21 nt, Pseudomonas aeruginosa PA01
caccguaggccaggcagacca

SEQ ID NO: 1524837 - RNA, 20 nt, Pseudomonas aeruginosa PA01
caccguccuucggccgcacc

SEQ ID NO: 1524838 - RNA, 21 nt, Pseudomonas aeruginosa PA01
caccguucuugaucaccgcgg

SEQ ID NO: 1524839 - RNA, 22 nt, Pseudomonas aeruginosa PA01
caccgugcccgccggcgcgccc

SEQ ID NO: 1524840 - RNA, 18 nt, Pseudomonas aeruginosa PA01
caccguggucagcaccag

SEQ ID NO: 1524841 - RNA, 20 nt, Pseudomonas aeruginosa PA01
caccguggucagcaccaggg

SEQ ID NO: 1524842 - RNA, 23 nt, Pseudomonas aeruginosa PA01
caccguggucagcaccagggcca

SEQ ID NO: 1524843 - RNA, 19 nt, Pseudomonas aeruginosa PA01
caccguggucauggcgcag

SEQ ID NO: 1524844 - RNA, 22 nt, Pseudomonas aeruginosa PA01
caccugcagacgguucagcagc

SEQ ID NO: 1524845 - RNA, 19 nt, Pseudomonas aeruginosa PA01
caccugcaucacguacggc

SEQ ID NO: 1524846 - RNA, 16 nt, Pseudomonas aeruginosa PA01
caccugcaacgcccgc

SEQ ID NO: 1524847 - RNA, 15 nt, Pseudomonas aeruginosa PA01
caccugaacgcgccc

SEQ ID NO: 1524848 - RNA, 18 nt, Pseudomonas aeruginosa PA01
caccugaacgcgcccggc

SEQ ID NO: 1524849 - RNA, 19 nt, Pseudomonas aeruginosa PA01
caccugaacgcgcccggcc

SEQ ID NO: 1524850 - RNA, 23 nt, Pseudomonas aeruginosa PA01
caccugaacgcgcccggccaggc

SEQ ID NO: 1524851 - RNA, 15 nt, Pseudomonas aeruginosa PA01
caccucgaucagcgg

SEQ ID NO: 1524852 - RNA, 23 nt, Pseudomonas aeruginosa PA01
caccucgaaggugugcagguugc

SEQ ID NO: 1524853 - RNA, 22 nt, Pseudomonas aeruginosa PA01
caccucgacccuggcgccgacc

SEQ ID NO: 1524854 - RNA, 16 nt, Pseudomonas aeruginosa PA01
caccucgaccgcgccg

SEQ ID NO: 1524855 - RNA, 18 nt, Pseudomonas aeruginosa PA01
caccucgaccgcgccggc

SEQ ID NO: 1524856 - RNA, 13 nt, Pseudomonas aeruginosa PA01
caccucgacgccc

SEQ ID NO: 1524857 - RNA, 20 nt, Pseudomonas aeruginosa PA01
caccucgacggcgaucucag

SEQ ID NO: 1524858 - RNA, 16 nt, Pseudomonas aeruginosa PA01
caccucgaaccccugg

SEQ ID NO: 1524859 - RNA, 23 nt, Pseudomonas aeruginosa PA01
caccuccuguucgcgcgccucgc

SEQ ID NO: 1524860 - RNA, 13 nt, Pseudomonas aeruginosa PA01
caccucggccagg

SEQ ID NO: 1524861 - RNA, 12 nt, Pseudomonas aeruginosa PA01
caccucggcgcc

SEQ ID NO: 1524862 - RNA, 13 nt, Pseudomonas aeruginosa PA01
caccucggcgcca

SEQ ID NO: 1524863 - RNA, 22 nt, Pseudomonas aeruginosa PA01
caccucggcgccauaggccagc

SEQ ID NO: 1524864 - RNA, 16 nt, Pseudomonas aeruginosa PA01
caccucauacuugggu

SEQ ID NO: 1524865 - RNA, 23 nt, Pseudomonas aeruginosa PA01
caccuccggaugcagauccagcg

SEQ ID NO: 1524866 - RNA, 15 nt, Pseudomonas aeruginosa PA01
cacgacgcacucaua

SEQ ID NO: 1524867 - RNA, 16 nt, Pseudomonas aeruginosa PA01
cacgacccugcuggcc

SEQ ID NO: 1524868 - RNA, 16 nt, Pseudomonas aeruginosa PA01
cacgaacugcauggcc

SEQ ID NO: 1524869 - RNA, 22 nt, Pseudomonas aeruginosa PA01
cacgaacugcauggccuuguga

SEQ ID NO: 1524870 - RNA, 16 nt, Pseudomonas aeruginosa PA01
cacgaaagccaugccc

SEQ ID NO: 1524871 - RNA, 20 nt, Pseudomonas aeruginosa PA01
cacgaacaggcugugcgcca

SEQ ID NO: 1524872 - RNA, 19 nt, Pseudomonas aeruginosa PA01
cacgaagaacgccagccca

SEQ ID NO: 1524873 - RNA, 17 nt, Pseudomonas aeruginosa PA01
cacgaagagcaccuugu

SEQ ID NO: 1524874 - RNA, 23 nt, Pseudomonas aeruginosa PA01
cacgaagcggucgccggcgcgca

SEQ ID NO: 1524875 - RNA, 22 nt, Pseudomonas aeruginosa PA01
cacgaaccauugcggcccgcca

SEQ ID NO: 1524876 - RNA, 17 nt, Pseudomonas aeruginosa PA01
cacgaccacaucggcca

SEQ ID NO: 1524877 - RNA, 17 nt, Pseudomonas aeruginosa PA01
caccuucaggcugcuca

SEQ ID NO: 1524878 - RNA, 11 nt, Pseudomonas aeruginosa PA01
caccuuccucg

SEQ ID NO: 1524879 - RNA, 15 nt, Pseudomonas aeruginosa PA01
caccuugcgcaccgc

SEQ ID NO: 1524880 - RNA, 17 nt, Pseudomonas aeruginosa PA01
caccuugcgcaccgccu

SEQ ID NO: 1524881 - RNA, 20 nt, Pseudomonas aeruginosa PA01
caccuugcgcaccgccugca

SEQ ID NO: 1524882 - RNA, 16 nt, Pseudomonas aeruginosa PA01
caccuuggccaugggc

SEQ ID NO: 1524883 - RNA, 21 nt, Pseudomonas aeruginosa PA01
caccugcuugggcgccucgcc

SEQ ID NO: 1524884 - RNA, 12 nt, Pseudomonas aeruginosa PA01
caccuggcaggu

SEQ ID NO: 1524885 - RNA, 17 nt, Pseudomonas aeruginosa PA01
caccuggccgugcucga

SEQ ID NO: 1524886 - RNA, 19 nt, Pseudomonas aeruginosa PA01
caccuggcgaugcccuggc

SEQ ID NO: 1524887 - RNA, 13 nt, Pseudomonas aeruginosa PA01
caccuggcgcagg

SEQ ID NO: 1524888 - RNA, 18 nt, Pseudomonas aeruginosa PA01
caccuggcggcugagcug

SEQ ID NO: 1524889 - RNA, 22 nt, Pseudomonas aeruginosa PA01
caccuggcggucgccgccggcg

SEQ ID NO: 1524890 - RNA, 23 nt, Pseudomonas aeruginosa PA01
caccugcguggcgaacgcccggc

SEQ ID NO: 1524891 - RNA, 14 nt, Pseudomonas aeruginosa PA01
caccuguuccagca

SEQ ID NO: 1524892 - RNA, 23 nt, Pseudomonas aeruginosa PA01
caccugggcguuggccagcgcca

SEQ ID NO: 1524893 - RNA, 22 nt, Pseudomonas aeruginosa PA01
caccugguucaucgagcggcgg

SEQ ID NO: 1524894 - RNA, 19 nt, Pseudomonas aeruginosa PA01
caccugguggacacccugc

SEQ ID NO: 1524895 - RNA, 21 nt, Pseudomonas aeruginosa PA01
caccugguggacacccugcug

SEQ ID NO: 1524896 - RNA, 24 nt, Pseudomonas aeruginosa PA01
caccugguggacacccugcugcug

SEQ ID NO: 1524897 - RNA, 14 nt, Pseudomonas aeruginosa PA01
caccgcggccuugg

SEQ ID NO: 1524898 - RNA, 21 nt, Pseudomonas aeruginosa PA01
caccgcggauccacgccuggc

SEQ ID NO: 1524899 - RNA, 14 nt, Pseudomonas aeruginosa PA01
caccgcggcgcuga

SEQ ID NO: 1524900 - RNA, 15 nt, Pseudomonas aeruginosa PA01
caccgcgguggaggc

SEQ ID NO: 1524901 - RNA, 20 nt, Pseudomonas aeruginosa PA01
caccgcgacgcgcuggacca

SEQ ID NO: 1524902 - RNA, 14 nt, Pseudomonas aeruginosa PA01
caccgccuggacca

SEQ ID NO: 1524903 - RNA, 14 nt, Pseudomonas aeruginosa PA01
caccgcgccgcgcu

SEQ ID NO: 1524904 - RNA, 15 nt, Pseudomonas aeruginosa PA01
caccgcgccuuccag

SEQ ID NO: 1524905 - RNA, 14 nt, Pseudomonas aeruginosa PA01
caccgcgcgcgccu

SEQ ID NO: 1524906 - RNA, 16 nt, Pseudomonas aeruginosa PA01
caccgcgcgcgccugc

SEQ ID NO: 1524907 - RNA, 13 nt, Pseudomonas aeruginosa PA01
caccgccucgacc

SEQ ID NO: 1524908 - RNA, 23 nt, Pseudomonas aeruginosa PA01
caccgccucggagaacagcagcg

SEQ ID NO: 1524909 - RNA, 16 nt, Pseudomonas aeruginosa PA01
caccgccucgugcagc

SEQ ID NO: 1524910 - RNA, 16 nt, Pseudomonas aeruginosa PA01
caccgcgaauccgcgg

SEQ ID NO: 1524911 - RNA, 20 nt, Pseudomonas aeruginosa PA01
caccgccggguacagcgcca

SEQ ID NO: 1524912 - RNA, 13 nt, Pseudomonas aeruginosa PA01
caccgccgggacc

SEQ ID NO: 1524913 - RNA, 12 nt, Pseudomonas aeruginosa PA01
caccgcccagcc

SEQ ID NO: 1524914 - RNA, 17 nt, Pseudomonas aeruginosa PA01
caccgcccccggcgcca

SEQ ID NO: 1524915 - RNA, 14 nt, Pseudomonas aeruginosa PA01
caccgccgccagca

SEQ ID NO: 1524916 - RNA, 16 nt, Pseudomonas aeruginosa PA01
caccgccgccagcaac

SEQ ID NO: 1524917 - RNA, 24 nt, Pseudomonas aeruginosa PA01
caccgccgacaucggagugcaugc

SEQ ID NO: 1524918 - RNA, 15 nt, Pseudomonas aeruginosa PA01
caccgcuuucaccag

SEQ ID NO: 1524919 - RNA, 19 nt, Pseudomonas aeruginosa PA01
caccgcuuucagcgccgcu

SEQ ID NO: 1524920 - RNA, 15 nt, Pseudomonas aeruginosa PA01
caccgcugcgccgcc

SEQ ID NO: 1524921 - RNA, 18 nt, Pseudomonas aeruginosa PA01
caccgcugcgccgccguc

SEQ ID NO: 1524922 - RNA, 19 nt, Pseudomonas aeruginosa PA01
caccgcguuguaggaaaaa

SEQ ID NO: 1524923 - RNA, 21 nt, Pseudomonas aeruginosa PA01
caccgcgucgggaaaggccgc

SEQ ID NO: 1524924 - RNA, 14 nt, Pseudomonas aeruginosa PA01
caccggacccggcu

SEQ ID NO: 1524925 - RNA, 16 nt, Pseudomonas aeruginosa PA01
caccggaucgcccugg

SEQ ID NO: 1524926 - RNA, 16 nt, Pseudomonas aeruginosa PA01
caccggccacucgcag

SEQ ID NO: 1524927 - RNA, 19 nt, Pseudomonas aeruginosa PA01
caccggcacgcccuguuuc

SEQ ID NO: 1524928 - RNA, 20 nt, Pseudomonas aeruginosa PA01
caccggcauguagcgcgccg

SEQ ID NO: 1524929 - RNA, 22 nt, Pseudomonas aeruginosa PA01
caccggcagggcgauccgcccg

SEQ ID NO: 1524930 - RNA, 22 nt, Pseudomonas aeruginosa PA01
caccggcgccacccucggcuuc

SEQ ID NO: 1524931 - RNA, 21 nt, Pseudomonas aeruginosa PA01
caccggcgauggccggcacca

SEQ ID NO: 1524932 - RNA, 15 nt, Pseudomonas aeruginosa PA01
caccggcagcagcgg

SEQ ID NO: 1524933 - RNA, 14 nt, Pseudomonas aeruginosa PA01
caccggcggcgcca

SEQ ID NO: 1524934 - RNA, 16 nt, Pseudomonas aeruginosa PA01
caccgggaagcagguc

SEQ ID NO: 1524935 - RNA, 15 nt, Pseudomonas aeruginosa PA01
caccgggaucugccg

SEQ ID NO: 1524936 - RNA, 20 nt, Pseudomonas aeruginosa PA01
caccgggaugaacugcagcu

SEQ ID NO: 1524937 - RNA, 17 nt, Pseudomonas aeruginosa PA01
caccgggaggcgccgcg

SEQ ID NO: 1524938 - RNA, 19 nt, Pseudomonas aeruginosa PA01
caccgggaggcgccgcgcc

SEQ ID NO: 1524939 - RNA, 21 nt, Pseudomonas aeruginosa PA01
caccgggaggcgccgcgccag

SEQ ID NO: 1524940 - RNA, 13 nt, Pseudomonas aeruginosa PA01
caccgggccgacc

SEQ ID NO: 1524941 - RNA, 12 nt, Pseudomonas aeruginosa PA01
caccgggccgcc

SEQ ID NO: 1524942 - RNA, 15 nt, Pseudomonas aeruginosa PA01
caccgggccgucggg

SEQ ID NO: 1524943 - RNA, 16 nt, Pseudomonas aeruginosa PA01
caccggcucgcucucg

SEQ ID NO: 1524944 - RNA, 20 nt, Pseudomonas aeruginosa PA01
caccgacgggucgccauggu

SEQ ID NO: 1524945 - RNA, 16 nt, Pseudomonas aeruginosa PA01
caccgagagcggcgcc

SEQ ID NO: 1524946 - RNA, 14 nt, Pseudomonas aeruginosa PA01
caccgaccaccauc

SEQ ID NO: 1524947 - RNA, 15 nt, Pseudomonas aeruginosa PA01
caccgaccaccauca

SEQ ID NO: 1524948 - RNA, 20 nt, Pseudomonas aeruginosa PA01
caccgacaggccgaccagca

SEQ ID NO: 1524949 - RNA, 13 nt, Pseudomonas aeruginosa PA01
caccgaguugacc

SEQ ID NO: 1524950 - RNA, 17 nt, Pseudomonas aeruginosa PA01
caccgaguugaccagca

SEQ ID NO: 1524951 - RNA, 20 nt, Pseudomonas aeruginosa PA01
caccgagguagucccagacc

SEQ ID NO: 1524952 - RNA, 15 nt, Pseudomonas aeruginosa PA01
caccgaggcgcgccg

SEQ ID NO: 1524953 - RNA, 20 nt, Pseudomonas aeruginosa PA01
caccgagacgcccuggauga

SEQ ID NO: 1524954 - RNA, 15 nt, Pseudomonas aeruginosa PA01
caccgauggcgcgcu

SEQ ID NO: 1524955 - RNA, 20 nt, Pseudomonas aeruginosa PA01
caccgccaccagcgagucga

SEQ ID NO: 1524956 - RNA, 15 nt, Pseudomonas aeruginosa PA01
caccgccaccccgcc

SEQ ID NO: 1524957 - RNA, 20 nt, Pseudomonas aeruginosa PA01
caccgcaucgaagcgcacca

SEQ ID NO: 1524958 - RNA, 23 nt, Pseudomonas aeruginosa PA01
caccgccagcgucgccgccgcgg

SEQ ID NO: 1524959 - RNA, 22 nt, Pseudomonas aeruginosa PA01
caccgccagcaguugcaacagc

SEQ ID NO: 1524960 - RNA, 23 nt, Pseudomonas aeruginosa PA01
cacccugucccaucacggccccg

SEQ ID NO: 1524961 - RNA, 18 nt, Pseudomonas aeruginosa PA01
cacccuugcguccugccu

SEQ ID NO: 1524962 - RNA, 18 nt, Pseudomonas aeruginosa PA01
cacccuuggagccgcccu

SEQ ID NO: 1524963 - RNA, 17 nt, Pseudomonas aeruginosa PA01
caccgacacgcacucau

SEQ ID NO: 1524964 - RNA, 17 nt, Pseudomonas aeruginosa PA01
caccgaaucgaugcugu

SEQ ID NO: 1524965 - RNA, 17 nt, Pseudomonas aeruginosa PA01
caccgaauaccagggcu

SEQ ID NO: 1524966 - RNA, 16 nt, Pseudomonas aeruginosa PA01
caccgaacggugcagc

SEQ ID NO: 1524967 - RNA, 18 nt, Pseudomonas aeruginosa PA01
cacccucuuccgcgcuga

SEQ ID NO: 1524968 - RNA, 22 nt, Pseudomonas aeruginosa PA01
cacccuggccacguccagcggc

SEQ ID NO: 1524969 - RNA, 11 nt, Pseudomonas aeruginosa PA01
cacccugcugc

SEQ ID NO: 1524970 - RNA, 14 nt, Pseudomonas aeruginosa PA01
cacccugccgcgcc

SEQ ID NO: 1524971 - RNA, 15 nt, Pseudomonas aeruginosa PA01
cacccugccgcgccg

SEQ ID NO: 1524972 - RNA, 16 nt, Pseudomonas aeruginosa PA01
cacccguucgccggcc

SEQ ID NO: 1524973 - RNA, 15 nt, Pseudomonas aeruginosa PA01
cacccgcaucgaggc

SEQ ID NO: 1524974 - RNA, 17 nt, Pseudomonas aeruginosa PA01
cacccgcgccgccgcgg

SEQ ID NO: 1524975 - RNA, 18 nt, Pseudomonas aeruginosa PA01
cacccgcgccgccgcggc

SEQ ID NO: 1524976 - RNA, 13 nt, Pseudomonas aeruginosa PA01
cacccgccucguc

SEQ ID NO: 1524977 - RNA, 17 nt, Pseudomonas aeruginosa PA01
cacccgcgacucgagca

SEQ ID NO: 1524978 - RNA, 13 nt, Pseudomonas aeruginosa PA01
cacccgcuccgcg

SEQ ID NO: 1524979 - RNA, 15 nt, Pseudomonas aeruginosa PA01
cacccgcuccgcggc

SEQ ID NO: 1524980 - RNA, 18 nt, Pseudomonas aeruginosa PA01
cacccgcucgaccuugcc

SEQ ID NO: 1524981 - RNA, 18 nt, Pseudomonas aeruginosa PA01
cacccgggcgaccugcuc

SEQ ID NO: 1524982 - RNA, 20 nt, Pseudomonas aeruginosa PA01
cacccggugcaggaacaggu

SEQ ID NO: 1524983 - RNA, 16 nt, Pseudomonas aeruginosa PA01
cacccggucgcgcugg

SEQ ID NO: 1524984 - RNA, 15 nt, Pseudomonas aeruginosa PA01
cacccggccauggcg

SEQ ID NO: 1524985 - RNA, 18 nt, Pseudomonas aeruginosa PA01
cacccggcgguccgccgc

SEQ ID NO: 1524986 - RNA, 20 nt, Pseudomonas aeruginosa PA01
cacccggcgguccgccgcgg

SEQ ID NO: 1524987 - RNA, 20 nt, Pseudomonas aeruginosa PA01
cacccggcgaagcuccucga

SEQ ID NO: 1524988 - RNA, 18 nt, Pseudomonas aeruginosa PA01
cacccggcgcacgccggc

SEQ ID NO: 1524989 - RNA, 19 nt, Pseudomonas aeruginosa PA01
cacggcgauggucaggacg

SEQ ID NO: 1524990 - RNA, 13 nt, Pseudomonas aeruginosa PA01
cacggcgcagccg

SEQ ID NO: 1524991 - RNA, 14 nt, Pseudomonas aeruginosa PA01
cacggcgccccggg

SEQ ID NO: 1524992 - RNA, 16 nt, Pseudomonas aeruginosa PA01
cacggcgccuucccag

SEQ ID NO: 1524993 - RNA, 16 nt, Pseudomonas aeruginosa PA01
cacggcgcgagaaaaa

SEQ ID NO: 1524994 - RNA, 16 nt, Pseudomonas aeruginosa PA01
cacggcgagagcgccg

SEQ ID NO: 1524995 - RNA, 19 nt, Pseudomonas aeruginosa PA01
cacggcgacgaaggccugg

SEQ ID NO: 1524996 - RNA, 17 nt, Pseudomonas aeruginosa PA01
cacggcgaagaacagcg

SEQ ID NO: 1524997 - RNA, 17 nt, Pseudomonas aeruginosa PA01
cacggcgaagccgcgcc

SEQ ID NO: 1524998 - RNA, 16 nt, Pseudomonas aeruginosa PA01
cacggccccgagaaaa

SEQ ID NO: 1524999 - RNA, 18 nt, Pseudomonas aeruginosa PA01
cacggccaggcccacgcc

SEQ ID NO: 1525000 - RNA, 22 nt, Pseudomonas aeruginosa PA01
cacggcgcgcuccggcgcgcca

SEQ ID NO: 1525001 - RNA, 14 nt, Pseudomonas aeruginosa PA01
cacggcgggacagg

SEQ ID NO: 1525002 - RNA, 21 nt, Pseudomonas aeruginosa PA01
cacggauaccacccgcagccc

SEQ ID NO: 1525003 - RNA, 20 nt, Pseudomonas aeruginosa PA01
cacggaugcagucccgccag

SEQ ID NO: 1525004 - RNA, 18 nt, Pseudomonas aeruginosa PA01
cacggauaugcgccgcca

SEQ ID NO: 1525005 - RNA, 19 nt, Pseudomonas aeruginosa PA01
cacggauaugcgccgccac

SEQ ID NO: 1525006 - RNA, 15 nt, Pseudomonas aeruginosa PA01
cacgcugugcggcag

SEQ ID NO: 1525007 - RNA, 17 nt, Pseudomonas aeruginosa PA01
cacgcugugcggcagca

SEQ ID NO: 1525008 - RNA, 14 nt, Pseudomonas aeruginosa PA01
cacgcuucugcugg

SEQ ID NO: 1525009 - RNA, 15 nt, Pseudomonas aeruginosa PA01
cacgcuucugcuggc

SEQ ID NO: 1525010 - RNA, 21 nt, Pseudomonas aeruginosa PA01
cacggagaagcguccgaggug

SEQ ID NO: 1525011 - RNA, 16 nt, Pseudomonas aeruginosa PA01
cacggaacggguccuu

SEQ ID NO: 1525012 - RNA, 19 nt, Pseudomonas aeruginosa PA01
cacggaagcgcugcucgac

SEQ ID NO: 1525013 - RNA, 16 nt, Pseudomonas aeruginosa PA01
cacggaaggccacgcc

SEQ ID NO: 1525014 - RNA, 18 nt, Pseudomonas aeruginosa PA01
cacggaaggccacgccgc

SEQ ID NO: 1525015 - RNA, 20 nt, Pseudomonas aeruginosa PA01
cacggaaggccacgccgccg

SEQ ID NO: 1525016 - RNA, 23 nt, Pseudomonas aeruginosa PA01
cacgccuugcagcaccgccuggu

SEQ ID NO: 1525017 - RNA, 15 nt, Pseudomonas aeruginosa PA01
cacgccuggcggcug

SEQ ID NO: 1525018 - RNA, 13 nt, Pseudomonas aeruginosa PA01
cacgccuugcugc

SEQ ID NO: 1525019 - RNA, 18 nt, Pseudomonas aeruginosa PA01
cacgccuuccagaucguc

SEQ ID NO: 1525020 - RNA, 23 nt, Pseudomonas aeruginosa PA01
cacgccguucagggucagguugc

SEQ ID NO: 1525021 - RNA, 14 nt, Pseudomonas aeruginosa PA01
cacgcucucgaaca

SEQ ID NO: 1525022 - RNA, 17 nt, Pseudomonas aeruginosa PA01
cacgcucucgaacagca

SEQ ID NO: 1525023 - RNA, 12 nt, Pseudomonas aeruginosa PA01
cacgcucccaac

SEQ ID NO: 1525024 - RNA, 17 nt, Pseudomonas aeruginosa PA01
cacgcucagccguggca

SEQ ID NO: 1525025 - RNA, 13 nt, Pseudomonas aeruginosa PA01
cacgcucaggcag

SEQ ID NO: 1525026 - RNA, 15 nt, Pseudomonas aeruginosa PA01
cacgcucaggcagcg

SEQ ID NO: 1525027 - RNA, 17 nt, Pseudomonas aeruginosa PA01
cacgcugcgccggcgcu

SEQ ID NO: 1525028 - RNA, 20 nt, Pseudomonas aeruginosa PA01
cacgcuggugaugucgcggc

SEQ ID NO: 1525029 - RNA, 22 nt, Pseudomonas aeruginosa PA01
cacgcuggugaugucgcggcag

SEQ ID NO: 1525030 - RNA, 14 nt, Pseudomonas aeruginosa PA01
cacgcucuucuuac

SEQ ID NO: 1525031 - RNA, 22 nt, Pseudomonas aeruginosa PA01
cacgcugaucaucagcaggguc

SEQ ID NO: 1525032 - RNA, 16 nt, Pseudomonas aeruginosa PA01
cacgccgauaccggcc

SEQ ID NO: 1525033 - RNA, 21 nt, Pseudomonas aeruginosa PA01
cacgccgagggcgcggcgcca

SEQ ID NO: 1525034 - RNA, 24 nt, Pseudomonas aeruginosa PA01
cacgccgaaguccugcaacagggc

SEQ ID NO: 1525035 - RNA, 23 nt, Pseudomonas aeruginosa PA01
cacgccgcgaccgaagccgcgca

SEQ ID NO: 1525036 - RNA, 17 nt, Pseudomonas aeruginosa PA01
cacgccgcgcaccagca

SEQ ID NO: 1525037 - RNA, 19 nt, Pseudomonas aeruginosa PA01
cacgccgcggaaggcccgc

SEQ ID NO: 1525038 - RNA, 22 nt, Pseudomonas aeruginosa PA01
cacgccgcggcugaugccgcgg

SEQ ID NO: 1525039 - RNA, 19 nt, Pseudomonas aeruginosa PA01
cacgccgucgcgcucuucc

SEQ ID NO: 1525040 - RNA, 22 nt, Pseudomonas aeruginosa PA01
cacgccgugcaucaccggcagc

SEQ ID NO: 1525041 - RNA, 17 nt, Pseudomonas aeruginosa PA01
cacgccgggcacaaaaa

SEQ ID NO: 1525042 - RNA, 22 nt, Pseudomonas aeruginosa PA01
cacgccggugauguaggacgcc

SEQ ID NO: 1525043 - RNA, 15 nt, Pseudomonas aeruginosa PA01
cacgccauccuccga

SEQ ID NO: 1525044 - RNA, 11 nt, Pseudomonas aeruginosa PA01
cacgcccaggc

SEQ ID NO: 1525045 - RNA, 20 nt, Pseudomonas aeruginosa PA01
cacgcccaguugcgccgccu

SEQ ID NO: 1525046 - RNA, 22 nt, Pseudomonas aeruginosa PA01
cacgcccaguugcgccgccugc

SEQ ID NO: 1525047 - RNA, 17 nt, Pseudomonas aeruginosa PA01
cacgcccaugccuugca

SEQ ID NO: 1525048 - RNA, 17 nt, Pseudomonas aeruginosa PA01
cacgaucggcaccauca

SEQ ID NO: 1525049 - RNA, 19 nt, Pseudomonas aeruginosa PA01
cacgauggccggcagcagc

SEQ ID NO: 1525050 - RNA, 23 nt, Pseudomonas aeruginosa PA01
cacgauggccggcagcagcgcca

SEQ ID NO: 1525051 - RNA, 23 nt, Pseudomonas aeruginosa PA01
cacgaucugcuugcgcgccgccg

SEQ ID NO: 1525052 - RNA, 14 nt, Pseudomonas aeruginosa PA01
cacgcaggaacagc

SEQ ID NO: 1525053 - RNA, 11 nt, Pseudomonas aeruginosa PA01
cacgcaggcgc

SEQ ID NO: 1525054 - RNA, 19 nt, Pseudomonas aeruginosa PA01
cacgcaggcgccgauggcu

SEQ ID NO: 1525055 - RNA, 14 nt, Pseudomonas aeruginosa PA01
cacgcagccacccg

SEQ ID NO: 1525056 - RNA, 12 nt, Pseudomonas aeruginosa PA01
cacgcacucaua

SEQ ID NO: 1525057 - RNA, 19 nt, Pseudomonas aeruginosa PA01
cacgcaaccccgaaggauc

SEQ ID NO: 1525058 - RNA, 18 nt, Pseudomonas aeruginosa PA01
cacgcaaacccauuuccc

SEQ ID NO: 1525059 - RNA, 19 nt, Pseudomonas aeruginosa PA01
cacgcaagugcccugggcg

SEQ ID NO: 1525060 - RNA, 23 nt, Pseudomonas aeruginosa PA01
cacgcaauagugcagcuccaccg

SEQ ID NO: 1525061 - RNA, 19 nt, Pseudomonas aeruginosa PA01
cacgggcuuccagaggcau

SEQ ID NO: 1525062 - RNA, 15 nt, Pseudomonas aeruginosa PA01
cacgggucgcagccg

SEQ ID NO: 1525063 - RNA, 22 nt, Pseudomonas aeruginosa PA01
cacggucauggccagcucgacc

SEQ ID NO: 1525064 - RNA, 22 nt, Pseudomonas aeruginosa PA01
cacguccagaugaaacugcccg

SEQ ID NO: 1525065 - RNA, 14 nt, Pseudomonas aeruginosa PA01
cacgucgccccagg

SEQ ID NO: 1525066 - RNA, 22 nt, Pseudomonas aeruginosa PA01
cacgucgauauccagcggcagc

SEQ ID NO: 1525067 - RNA, 24 nt, Pseudomonas aeruginosa PA01
cacgucgauauccagcggcagccc

SEQ ID NO: 1525068 - RNA, 14 nt, Pseudomonas aeruginosa PA01
cacgucggcgcgca

SEQ ID NO: 1525069 - RNA, 22 nt, Pseudomonas aeruginosa PA01
cacguccggcgagaaaggcugc

SEQ ID NO: 1525070 - RNA, 20 nt, Pseudomonas aeruginosa PA01
cacguccuccaggcucaggg

SEQ ID NO: 1525071 - RNA, 15 nt, Pseudomonas aeruginosa PA01
cacguagcccccgcc

SEQ ID NO: 1525072 - RNA, 19 nt, Pseudomonas aeruginosa PA01
cacguagggcgugguguag

SEQ ID NO: 1525073 - RNA, 20 nt, Pseudomonas aeruginosa PA01
cacguaguugacccgccccu

SEQ ID NO: 1525074 - RNA, 15 nt, Pseudomonas aeruginosa PA01
cacguacguccaggg

SEQ ID NO: 1525075 - RNA, 23 nt, Pseudomonas aeruginosa PA01
cacguucuugaccuucugcaccg

SEQ ID NO: 1525076 - RNA, 17 nt, Pseudomonas aeruginosa PA01
cacguugccauccagcg

SEQ ID NO: 1525077 - RNA, 19 nt, Pseudomonas aeruginosa PA01
cacguugccauccagcgcc

SEQ ID NO: 1525078 - RNA, 21 nt, Pseudomonas aeruginosa PA01
cacguugggauagcuuuccag

SEQ ID NO: 1525079 - RNA, 13 nt, Pseudomonas aeruginosa PA01
cacguugggaucg

SEQ ID NO: 1525080 - RNA, 17 nt, Pseudomonas aeruginosa PA01
cacguugcgccgcagca

SEQ ID NO: 1525081 - RNA, 17 nt, Pseudomonas aeruginosa PA01
cacgucguccggcgcca

SEQ ID NO: 1525082 - RNA, 17 nt, Pseudomonas aeruginosa PA01
cacgucggcguccaugg

SEQ ID NO: 1525083 - RNA, 18 nt, Pseudomonas aeruginosa PA01
cacgucgguucagcgcgg

SEQ ID NO: 1525084 - RNA, 14 nt, Pseudomonas aeruginosa PA01
cacgugccccaggc

SEQ ID NO: 1525085 - RNA, 20 nt, Pseudomonas aeruginosa PA01
cacgugcagcucggcacgca

SEQ ID NO: 1525086 - RNA, 18 nt, Pseudomonas aeruginosa PA01
cacuacaggaccuucaga

SEQ ID NO: 1525087 - RNA, 20 nt, Pseudomonas aeruginosa PA01
cacuaucuucgauugcuaca

SEQ ID NO: 1525088 - RNA, 13 nt, Pseudomonas aeruginosa PA01
cacucauagcuca

SEQ ID NO: 1525089 - RNA, 16 nt, Pseudomonas aeruginosa PA01
cacucauagcucagcu

SEQ ID NO: 1525090 - RNA, 13 nt, Pseudomonas aeruginosa PA01
cacuccagcgcgg

SEQ ID NO: 1525091 - RNA, 21 nt, Pseudomonas aeruginosa PA01
cacucauccucgccgcuggcg

SEQ ID NO: 1525092 - RNA, 17 nt, Pseudomonas aeruginosa PA01
cacucugguagcugcgg

SEQ ID NO: 1525093 - RNA, 18 nt, Pseudomonas aeruginosa PA01
cacucugguagcugcggc

SEQ ID NO: 1525094 - RNA, 14 nt, Pseudomonas aeruginosa PA01
cacucuucaguccc

SEQ ID NO: 1525095 - RNA, 17 nt, Pseudomonas aeruginosa PA01
cacugacgcgcagcgcc

SEQ ID NO: 1525096 - RNA, 19 nt, Pseudomonas aeruginosa PA01
cacuccgccacccgcuccg

SEQ ID NO: 1525097 - RNA, 18 nt, Pseudomonas aeruginosa PA01
cacuccguccagugcggc

SEQ ID NO: 1525098 - RNA, 13 nt, Pseudomonas aeruginosa PA01
cacuccgucucca

SEQ ID NO: 1525099 - RNA, 15 nt, Pseudomonas aeruginosa PA01
cacuccgucuccagc

SEQ ID NO: 1525100 - RNA, 15 nt, Pseudomonas aeruginosa PA01
cacucccugcucgcg

SEQ ID NO: 1525101 - RNA, 21 nt, Pseudomonas aeruginosa PA01
cacucgcagccgcgcucggcc

SEQ ID NO: 1525102 - RNA, 15 nt, Pseudomonas aeruginosa PA01
cacuccuccgccugc

SEQ ID NO: 1525103 - RNA, 20 nt, Pseudomonas aeruginosa PA01
cacucggcgaccacccggcg

SEQ ID NO: 1525104 - RNA, 15 nt, Pseudomonas aeruginosa PA01
cacucggccaggcgc

SEQ ID NO: 1525105 - RNA, 17 nt, Pseudomonas aeruginosa PA01
cacucggccaggcgcca

SEQ ID NO: 1525106 - RNA, 12 nt, Pseudomonas aeruginosa PA01
cacucgccgccg

SEQ ID NO: 1525107 - RNA, 18 nt, Pseudomonas aeruginosa PA01
cacucgcgagauggcguc

SEQ ID NO: 1525108 - RNA, 20 nt, Pseudomonas aeruginosa PA01
cacucgcgagcuggcgccgu

SEQ ID NO: 1525109 - RNA, 18 nt, Pseudomonas aeruginosa PA01
auucuugauccaguagcc

SEQ ID NO: 1525110 - RNA, 23 nt, Pseudomonas aeruginosa PA01
auucuucuccagaaucucccgca

SEQ ID NO: 1525111 - RNA, 15 nt, Pseudomonas aeruginosa PA01
auucucucuucagca

SEQ ID NO: 1525112 - RNA, 22 nt, Pseudomonas aeruginosa PA01
auucggugcgccguauucuuca

SEQ ID NO: 1525113 - RNA, 14 nt, Pseudomonas aeruginosa PA01
auugcaggcccggc

SEQ ID NO: 1525114 - RNA, 15 nt, Pseudomonas aeruginosa PA01
auuggaauugcugac

SEQ ID NO: 1525115 - RNA, 20 nt, Pseudomonas aeruginosa PA01
auuggcgaaguugccgccgc

SEQ ID NO: 1525116 - RNA, 20 nt, Pseudomonas aeruginosa PA01
auuggccaucagcgccgccu

SEQ ID NO: 1525117 - RNA, 12 nt, Pseudomonas aeruginosa PA01
auugcugagggg

SEQ ID NO: 1525118 - RNA, 22 nt, Pseudomonas aeruginosa PA01
auugacacggauauccgggccc

SEQ ID NO: 1525119 - RNA, 19 nt, Pseudomonas aeruginosa PA01
auugcagguaguccagcca

SEQ ID NO: 1525120 - RNA, 20 nt, Pseudomonas aeruginosa PA01
auugcagguaguccagccag

SEQ ID NO: 1525121 - RNA, 24 nt, Pseudomonas aeruginosa PA01
auugcagguaguccagccagugca

SEQ ID NO: 1525122 - RNA, 15 nt, Pseudomonas aeruginosa PA01
auuccaccggcuggc

SEQ ID NO: 1525123 - RNA, 20 nt, Pseudomonas aeruginosa PA01
auucagugggucgaugcccu

SEQ ID NO: 1525124 - RNA, 21 nt, Pseudomonas aeruginosa PA01
auucagugggucgaugcccuc

SEQ ID NO: 1525125 - RNA, 22 nt, Pseudomonas aeruginosa PA01
auuccuggccggugacgaaacc

SEQ ID NO: 1525126 - RNA, 14 nt, Pseudomonas aeruginosa PA01
auuccuuccagggu

SEQ ID NO: 1525127 - RNA, 17 nt, Pseudomonas aeruginosa PA01
auuccuugcgccaugcg

SEQ ID NO: 1525128 - RNA, 15 nt, Pseudomonas aeruginosa PA01
auuccuuuaauuuca

SEQ ID NO: 1525129 - RNA, 17 nt, Pseudomonas aeruginosa PA01
auucgacccgccgacca

SEQ ID NO: 1525130 - RNA, 14 nt, Pseudomonas aeruginosa PA01
auucggccagcgcg

SEQ ID NO: 1525131 - RNA, 13 nt, Pseudomonas aeruginosa PA01
auucggcccaugc

SEQ ID NO: 1525132 - RNA, 17 nt, Pseudomonas aeruginosa PA01
auucgcugucagggcuu

SEQ ID NO: 1525133 - RNA, 16 nt, Pseudomonas aeruginosa PA01
auucgcugucgagcag

SEQ ID NO: 1525134 - RNA, 18 nt, Pseudomonas aeruginosa PA01
auucgcuucggccaccag

SEQ ID NO: 1525135 - RNA, 19 nt, Pseudomonas aeruginosa PA01
auucgcuucggccaccagc

SEQ ID NO: 1525136 - RNA, 13 nt, Pseudomonas aeruginosa PA01
auucgcccuaccc

SEQ ID NO: 1525137 - RNA, 22 nt, Pseudomonas aeruginosa PA01
auucgcccuaccccccaauugc

SEQ ID NO: 1525138 - RNA, 21 nt, Pseudomonas aeruginosa PA01
auucgcccuacccgacaggca

SEQ ID NO: 1525139 - RNA, 19 nt, Pseudomonas aeruginosa PA01
auucgcccuaccgcccacc

SEQ ID NO: 1525140 - RNA, 23 nt, Pseudomonas aeruginosa PA01
auucgcccuaccgcccacccugc

SEQ ID NO: 1525141 - RNA, 15 nt, Pseudomonas aeruginosa PA01
auucgccggccaggu

SEQ ID NO: 1525142 - RNA, 23 nt, Pseudomonas aeruginosa PA01
auuccggggacgcugucccggcc

SEQ ID NO: 1525143 - RNA, 18 nt, Pseudomonas aeruginosa PA01
auuccucagugcgggcag

SEQ ID NO: 1525144 - RNA, 20 nt, Pseudomonas aeruginosa PA01
auuccucggcgucgggcagg

SEQ ID NO: 1525145 - RNA, 17 nt, Pseudomonas aeruginosa PA01
auuuccgcgcccggcug

SEQ ID NO: 1525146 - RNA, 22 nt, Pseudomonas aeruginosa PA01
auuuccagcaacgugaagcccu

SEQ ID NO: 1525147 - RNA, 14 nt, Pseudomonas aeruginosa PA01
auuuccugcggcac

SEQ ID NO: 1525148 - RNA, 22 nt, Pseudomonas aeruginosa PA01
auuuccugggugccgcgaaugu

SEQ ID NO: 1525149 - RNA, 23 nt, Pseudomonas aeruginosa PA01
auuuccuugaccaucuuuuccug

SEQ ID NO: 1525150 - RNA, 21 nt, Pseudomonas aeruginosa PA01
auugguggucaccagcguggg

SEQ ID NO: 1525151 - RNA, 20 nt, Pseudomonas aeruginosa PA01
auuggugcugccgaugcuga

SEQ ID NO: 1525152 - RNA, 14 nt, Pseudomonas aeruginosa PA01
auugguauccaggu

SEQ ID NO: 1525153 - RNA, 16 nt, Pseudomonas aeruginosa PA01
auuuugccggagaugu

SEQ ID NO: 1525154 - RNA, 13 nt, Pseudomonas aeruginosa PA01
auuuuccagcagg

SEQ ID NO: 1525155 - RNA, 17 nt, Pseudomonas aeruginosa PA01
caacgcggccagcagca

SEQ ID NO: 1525156 - RNA, 20 nt, Pseudomonas aeruginosa PA01
caacgcgcgcaggaccagac

SEQ ID NO: 1525157 - RNA, 13 nt, Pseudomonas aeruginosa PA01
caacuccugcaaa

SEQ ID NO: 1525158 - RNA, 19 nt, Pseudomonas aeruginosa PA01
caaccuugcacauccagcc

SEQ ID NO: 1525159 - RNA, 18 nt, Pseudomonas aeruginosa PA01
caaccuuucggagugaac

SEQ ID NO: 1525160 - RNA, 19 nt, Pseudomonas aeruginosa PA01
caacgaaaaagggcggcca

SEQ ID NO: 1525161 - RNA, 23 nt, Pseudomonas aeruginosa PA01
caacgaaaaagggcggccacccg

SEQ ID NO: 1525162 - RNA, 18 nt, Pseudomonas aeruginosa PA01
caacgaaaagagccgcgc

SEQ ID NO: 1525163 - RNA, 15 nt, Pseudomonas aeruginosa PA01
caacuuucccucucu

SEQ ID NO: 1525164 - RNA, 22 nt, Pseudomonas aeruginosa PA01
caacucggcggcgagcgccgcg

SEQ ID NO: 1525165 - RNA, 15 nt, Pseudomonas aeruginosa PA01
caagaagccccgcua

SEQ ID NO: 1525166 - RNA, 15 nt, Pseudomonas aeruginosa PA01
caauacccgccgcug

SEQ ID NO: 1525167 - RNA, 15 nt, Pseudomonas aeruginosa PA01
caauacccacagggu

SEQ ID NO: 1525168 - RNA, 16 nt, Pseudomonas aeruginosa PA01
caaguugccuggcagg

SEQ ID NO: 1525169 - RNA, 16 nt, Pseudomonas aeruginosa PA01
caaggccagggcggcg

SEQ ID NO: 1525170 - RNA, 17 nt, Pseudomonas aeruginosa PA01
caagguuugcgccgccg

SEQ ID NO: 1525171 - RNA, 13 nt, Pseudomonas aeruginosa PA01
caagugcccuggg

SEQ ID NO: 1525172 - RNA, 20 nt, Pseudomonas aeruginosa PA01
caagugcucgauggcgaagc

SEQ ID NO: 1525173 - RNA, 22 nt, Pseudomonas aeruginosa PA01
caagugcucgauggcgaagcgc

SEQ ID NO: 1525174 - RNA, 23 nt, Pseudomonas aeruginosa PA01
caagcgcggaaaaucaaaaccag

SEQ ID NO: 1525175 - RNA, 13 nt, Pseudomonas aeruginosa PA01
caaggcacacgcc

SEQ ID NO: 1525176 - RNA, 22 nt, Pseudomonas aeruginosa PA01
caaggcacacgcccggcacucg

SEQ ID NO: 1525177 - RNA, 14 nt, Pseudomonas aeruginosa PA01
caacagcgaagcug

SEQ ID NO: 1525178 - RNA, 19 nt, Pseudomonas aeruginosa PA01
caacagcagguagaccacg

SEQ ID NO: 1525179 - RNA, 14 nt, Pseudomonas aeruginosa PA01
caacaguucugccg

SEQ ID NO: 1525180 - RNA, 18 nt, Pseudomonas aeruginosa PA01
caacagcgcggcggugca

SEQ ID NO: 1525181 - RNA, 14 nt, Pseudomonas aeruginosa PA01
caacacccaggccu

SEQ ID NO: 1525182 - RNA, 14 nt, Pseudomonas aeruginosa PA01
caacaaaccucgag

SEQ ID NO: 1525183 - RNA, 14 nt, Pseudomonas aeruginosa PA01
caaagcgcgggcug

SEQ ID NO: 1525184 - RNA, 16 nt, Pseudomonas aeruginosa PA01
caaagcggcgacgcca

SEQ ID NO: 1525185 - RNA, 19 nt, Pseudomonas aeruginosa PA01
caaacgccgccaccaacca

SEQ ID NO: 1525186 - RNA, 21 nt, Pseudomonas aeruginosa PA01
caaacgggcaucgucgaaggg

SEQ ID NO: 1525187 - RNA, 20 nt, Pseudomonas aeruginosa PA01
caaaauguauaggagccugc

SEQ ID NO: 1525188 - RNA, 20 nt, Pseudomonas aeruginosa PA01
cauccagucuucgccggccu

SEQ ID NO: 1525189 - RNA, 15 nt, Pseudomonas aeruginosa PA01
cauccagcgccugga

SEQ ID NO: 1525190 - RNA, 17 nt, Pseudomonas aeruginosa PA01
cauccagcauccgugcg

SEQ ID NO: 1525191 - RNA, 16 nt, Pseudomonas aeruginosa PA01
cauccacagcgugcag

SEQ ID NO: 1525192 - RNA, 18 nt, Pseudomonas aeruginosa PA01
cauccacagcgugcagac

SEQ ID NO: 1525193 - RNA, 20 nt, Pseudomonas aeruginosa PA01
cauccacagggucggcagga

SEQ ID NO: 1525194 - RNA, 19 nt, Pseudomonas aeruginosa PA01
caucagcgucugcagcuug

SEQ ID NO: 1525195 - RNA, 20 nt, Pseudomonas aeruginosa PA01
caucagcuggaucuggugga

SEQ ID NO: 1525196 - RNA, 21 nt, Pseudomonas aeruginosa PA01
cauccgcaccauccgccgcag

SEQ ID NO: 1525197 - RNA, 14 nt, Pseudomonas aeruginosa PA01
caucccuucuuuua

SEQ ID NO: 1525198 - RNA, 22 nt, Pseudomonas aeruginosa PA01
caucccguuggggaugcgccgu

SEQ ID NO: 1525199 - RNA, 13 nt, Pseudomonas aeruginosa PA01
cauccccgaggcg

SEQ ID NO: 1525200 - RNA, 22 nt, Pseudomonas aeruginosa PA01
cauccccuuuuuuugcgcgcca

SEQ ID NO: 1525201 - RNA, 19 nt, Pseudomonas aeruginosa PA01
caucccgggguugcccagc

SEQ ID NO: 1525202 - RNA, 14 nt, Pseudomonas aeruginosa PA01
caucgcucugcuga

SEQ ID NO: 1525203 - RNA, 13 nt, Pseudomonas aeruginosa PA01
caucgcugaccug

SEQ ID NO: 1525204 - RNA, 14 nt, Pseudomonas aeruginosa PA01
caucgcugaccugg

SEQ ID NO: 1525205 - RNA, 17 nt, Pseudomonas aeruginosa PA01
caucgccggcagcgccg

SEQ ID NO: 1525206 - RNA, 15 nt, Pseudomonas aeruginosa PA01
caucgccucgccggc

SEQ ID NO: 1525207 - RNA, 21 nt, Pseudomonas aeruginosa PA01
caucgccucgcggaccucggg

SEQ ID NO: 1525208 - RNA, 20 nt, Pseudomonas aeruginosa PA01
caucgccgaagacgccuguc

SEQ ID NO: 1525209 - RNA, 14 nt, Pseudomonas aeruginosa PA01
caucgaugccuugc

SEQ ID NO: 1525210 - RNA, 20 nt, Pseudomonas aeruginosa PA01
caucgaugccuugcggcccc

SEQ ID NO: 1525211 - RNA, 18 nt, Pseudomonas aeruginosa PA01
cauccuggcccuggauau

SEQ ID NO: 1525212 - RNA, 18 nt, Pseudomonas aeruginosa PA01
cauccugcgcgccucuuc

SEQ ID NO: 1525213 - RNA, 21 nt, Pseudomonas aeruginosa PA01
cauccugcgcgccucuuccug

SEQ ID NO: 1525214 - RNA, 16 nt, Pseudomonas aeruginosa PA01
caucgaugugagcccc

SEQ ID NO: 1525215 - RNA, 14 nt, Pseudomonas aeruginosa PA01
caucgauggucagg

SEQ ID NO: 1525216 - RNA, 22 nt, Pseudomonas aeruginosa PA01
caucgauggucaggcuggcccc

SEQ ID NO: 1525217 - RNA, 14 nt, Pseudomonas aeruginosa PA01
caucgaucagcagc

SEQ ID NO: 1525218 - RNA, 15 nt, Pseudomonas aeruginosa PA01
caucgaucagcagcg

SEQ ID NO: 1525219 - RNA, 18 nt, Pseudomonas aeruginosa PA01
caucgaucagcagcgcca

SEQ ID NO: 1525220 - RNA, 22 nt, Pseudomonas aeruginosa PA01
caucggccgggauacagcagcc

SEQ ID NO: 1525221 - RNA, 20 nt, Pseudomonas aeruginosa PA01
caucggcccgacgccgcccg

SEQ ID NO: 1525222 - RNA, 22 nt, Pseudomonas aeruginosa PA01
caucggccuggggcucggcuuc

SEQ ID NO: 1525223 - RNA, 20 nt, Pseudomonas aeruginosa PA01
caucgucucgcgacacgugc

SEQ ID NO: 1525224 - RNA, 16 nt, Pseudomonas aeruginosa PA01
caucguggggcggcgc

SEQ ID NO: 1525225 - RNA, 15 nt, Pseudomonas aeruginosa PA01
caucguucaguugcc

SEQ ID NO: 1525226 - RNA, 16 nt, Pseudomonas aeruginosa PA01
caucucggugcgcccc

SEQ ID NO: 1525227 - RNA, 18 nt, Pseudomonas aeruginosa PA01
caucucggugcgccccag

SEQ ID NO: 1525228 - RNA, 22 nt, Pseudomonas aeruginosa PA01
caucucguccucggggaagcgc

SEQ ID NO: 1525229 - RNA, 17 nt, Pseudomonas aeruginosa PA01
caucucguugaggguca

SEQ ID NO: 1525230 - RNA, 15 nt, Pseudomonas aeruginosa PA01
caucuccaggccgcu

SEQ ID NO: 1525231 - RNA, 23 nt, Pseudomonas aeruginosa PA01
caucagcaauuccgcagccuugg

SEQ ID NO: 1525232 - RNA, 15 nt, Pseudomonas aeruginosa PA01
caucagaucgcguuu

SEQ ID NO: 1525233 - RNA, 14 nt, Pseudomonas aeruginosa PA01
caucagcaccagga

SEQ ID NO: 1525234 - RNA, 18 nt, Pseudomonas aeruginosa PA01
caucagcaccaggaagcc

SEQ ID NO: 1525235 - RNA, 13 nt, Pseudomonas aeruginosa PA01
caucagcaggaag

SEQ ID NO: 1525236 - RNA, 15 nt, Pseudomonas aeruginosa PA01
caucagcagcgccag

SEQ ID NO: 1525237 - RNA, 13 nt, Pseudomonas aeruginosa PA01
caucagcgccgcc

SEQ ID NO: 1525238 - RNA, 17 nt, Pseudomonas aeruginosa PA01
caucagcgccgccucgc

SEQ ID NO: 1525239 - RNA, 14 nt, Pseudomonas aeruginosa PA01
caucaccagcgccg

SEQ ID NO: 1525240 - RNA, 20 nt, Pseudomonas aeruginosa PA01
caucaccagcggcgagcagg

SEQ ID NO: 1525241 - RNA, 12 nt, Pseudomonas aeruginosa PA01
caucaccaggcu

SEQ ID NO: 1525242 - RNA, 14 nt, Pseudomonas aeruginosa PA01
cauauccccucuca

SEQ ID NO: 1525243 - RNA, 21 nt, Pseudomonas aeruginosa PA01
cauaguggaugugcugguugg

SEQ ID NO: 1525244 - RNA, 13 nt, Pseudomonas aeruginosa PA01
cauauagcgcugu

SEQ ID NO: 1525245 - RNA, 15 nt, Pseudomonas aeruginosa PA01
cauaggucagguaca

SEQ ID NO: 1525246 - RNA, 16 nt, Pseudomonas aeruginosa PA01
cauaggucaugcccag

SEQ ID NO: 1525247 - RNA, 18 nt, Pseudomonas aeruginosa PA01
cauaggucaugcccaggc

SEQ ID NO: 1525248 - RNA, 23 nt, Pseudomonas aeruginosa PA01
cauaggccugggcguacaggccc

SEQ ID NO: 1525249 - RNA, 14 nt, Pseudomonas aeruginosa PA01
cauaggccagcacc

SEQ ID NO: 1525250 - RNA, 15 nt, Pseudomonas aeruginosa PA01
cauaguagagaugca

SEQ ID NO: 1525251 - RNA, 13 nt, Pseudomonas aeruginosa PA01
cauagcggcugcu

SEQ ID NO: 1525252 - RNA, 14 nt, Pseudomonas aeruginosa PA01
cauagcucagcugg

SEQ ID NO: 1525253 - RNA, 17 nt, Pseudomonas aeruginosa PA01
cauagcucagcuggaua

SEQ ID NO: 1525254 - RNA, 14 nt, Pseudomonas aeruginosa PA01
cauagaccagcagc

SEQ ID NO: 1525255 - RNA, 17 nt, Pseudomonas aeruginosa PA01
cauacacaugcaggcuc

SEQ ID NO: 1525256 - RNA, 21 nt, Pseudomonas aeruginosa PA01
cauacacaugcaggcucgaca

SEQ ID NO: 1525257 - RNA, 14 nt, Pseudomonas aeruginosa PA01
cauacaccaggccg

SEQ ID NO: 1525258 - RNA, 14 nt, Pseudomonas aeruginosa PA01
cauagcgcagcacc

SEQ ID NO: 1525259 - RNA, 15 nt, Pseudomonas aeruginosa PA01
cauagccggcgcgcc

SEQ ID NO: 1525260 - RNA, 16 nt, Pseudomonas aeruginosa PA01
cauagccggcgcgccc

SEQ ID NO: 1525261 - RNA, 12 nt, Pseudomonas aeruginosa PA01
cauagcagcgcc

SEQ ID NO: 1525262 - RNA, 15 nt, Pseudomonas aeruginosa PA01
cauagaugaaggcuu

SEQ ID NO: 1525263 - RNA, 13 nt, Pseudomonas aeruginosa PA01
cauuccucagcgc

SEQ ID NO: 1525264 - RNA, 15 nt, Pseudomonas aeruginosa PA01
cauuccucagcgccg

SEQ ID NO: 1525265 - RNA, 15 nt, Pseudomonas aeruginosa PA01
cauuccuuccagggu

SEQ ID NO: 1525266 - RNA, 20 nt, Pseudomonas aeruginosa PA01
cauuccuugauuugcccggc

SEQ ID NO: 1525267 - RNA, 21 nt, Pseudomonas aeruginosa PA01
cauuccugggccccggccagg

SEQ ID NO: 1525268 - RNA, 20 nt, Pseudomonas aeruginosa PA01
cauuccgacaaggagcgcga

SEQ ID NO: 1525269 - RNA, 16 nt, Pseudomonas aeruginosa PA01
cauuacuauuuaccug

SEQ ID NO: 1525270 - RNA, 15 nt, Pseudomonas aeruginosa PA01
cauucuucuccagaa

SEQ ID NO: 1525271 - RNA, 21 nt, Pseudomonas aeruginosa PA01
cauucuugggacuagagguac

SEQ ID NO: 1525272 - RNA, 22 nt, Pseudomonas aeruginosa PA01
cauucggugcgcuccuguugcu

SEQ ID NO: 1525273 - RNA, 13 nt, Pseudomonas aeruginosa PA01
cauucggccuggc

SEQ ID NO: 1525274 - RNA, 14 nt, Pseudomonas aeruginosa PA01
cauugccaccacca

SEQ ID NO: 1525275 - RNA, 17 nt, Pseudomonas aeruginosa PA01
cauugaaaaacccaugc

SEQ ID NO: 1525276 - RNA, 17 nt, Pseudomonas aeruginosa PA01
cauuggccaucagcgcc

SEQ ID NO: 1525277 - RNA, 16 nt, Pseudomonas aeruginosa PA01
cauuggccgacgccgc

SEQ ID NO: 1525278 - RNA, 12 nt, Pseudomonas aeruginosa PA01
cauuucaaggcg

SEQ ID NO: 1525279 - RNA, 13 nt, Pseudomonas aeruginosa PA01
cauuuccuccgag

SEQ ID NO: 1525280 - RNA, 22 nt, Pseudomonas aeruginosa PA01
caugaacacauagaccagcagc

SEQ ID NO: 1525281 - RNA, 14 nt, Pseudomonas aeruginosa PA01
caugaacaccgugu

SEQ ID NO: 1525282 - RNA, 16 nt, Pseudomonas aeruginosa PA01
caugaaugccuugagg

SEQ ID NO: 1525283 - RNA, 20 nt, Pseudomonas aeruginosa PA01
caugaaugccuugaggccuu

SEQ ID NO: 1525284 - RNA, 20 nt, Pseudomonas aeruginosa PA01
caugaccagagccgccgaac

SEQ ID NO: 1525285 - RNA, 21 nt, Pseudomonas aeruginosa PA01
caugaccgauggcgccgcgau

SEQ ID NO: 1525286 - RNA, 20 nt, Pseudomonas aeruginosa PA01
caugaccgccgcucaucugc

SEQ ID NO: 1525287 - RNA, 18 nt, Pseudomonas aeruginosa PA01
caugaccgucagccaggc

SEQ ID NO: 1525288 - RNA, 21 nt, Pseudomonas aeruginosa PA01
caugacgauaucggcgccggc

SEQ ID NO: 1525289 - RNA, 14 nt, Pseudomonas aeruginosa PA01
caugaucuggcugu

SEQ ID NO: 1525290 - RNA, 19 nt, Pseudomonas aeruginosa PA01
caugauuucguuggcccag

SEQ ID NO: 1525291 - RNA, 23 nt, Pseudomonas aeruginosa PA01
caugauuucguuggcccagaccu

SEQ ID NO: 1525292 - RNA, 15 nt, Pseudomonas aeruginosa PA01
caugcagguggcgcu

SEQ ID NO: 1525293 - RNA, 17 nt, Pseudomonas aeruginosa PA01
caugcagguggcgcuca

SEQ ID NO: 1525294 - RNA, 17 nt, Pseudomonas aeruginosa PA01
caugagcgaucccaggu

SEQ ID NO: 1525295 - RNA, 13 nt, Pseudomonas aeruginosa PA01
caugauccggugc

SEQ ID NO: 1525296 - RNA, 20 nt, Pseudomonas aeruginosa PA01
caugauccggugcaggccga

SEQ ID NO: 1525297 - RNA, 14 nt, Pseudomonas aeruginosa PA01
caugaucgccaccg

SEQ ID NO: 1525298 - RNA, 19 nt, Pseudomonas aeruginosa PA01
caugaucccuagggguucu

SEQ ID NO: 1525299 - RNA, 15 nt, Pseudomonas aeruginosa PA01
caugauaaggcaaag

SEQ ID NO: 1525300 - RNA, 24 nt, Pseudomonas aeruginosa PA01
caugccgacgagcagcucgccggc

SEQ ID NO: 1525301 - RNA, 17 nt, Pseudomonas aeruginosa PA01
caugccacgcaccacca

SEQ ID NO: 1525302 - RNA, 23 nt, Pseudomonas aeruginosa PA01
caugccagggccuugcugaaguu

SEQ ID NO: 1525303 - RNA, 22 nt, Pseudomonas aeruginosa PA01
caugcucaggucgaacugcacc

SEQ ID NO: 1525304 - RNA, 17 nt, Pseudomonas aeruginosa PA01
caugccgcccggccgcu

SEQ ID NO: 1525305 - RNA, 20 nt, Pseudomonas aeruginosa PA01
caugccgcaagcuccccgcc

SEQ ID NO: 1525306 - RNA, 21 nt, Pseudomonas aeruginosa PA01
caugccgcaagcuccccgccg

SEQ ID NO: 1525307 - RNA, 20 nt, Pseudomonas aeruginosa PA01
caugccgcuagcccugcugc

SEQ ID NO: 1525308 - RNA, 22 nt, Pseudomonas aeruginosa PA01
caugccggccaggaaggccgcu

SEQ ID NO: 1525309 - RNA, 15 nt, Pseudomonas aeruginosa PA01
caugcucgccaccug

SEQ ID NO: 1525310 - RNA, 15 nt, Pseudomonas aeruginosa PA01
caugcucagccgcgc

SEQ ID NO: 1525311 - RNA, 15 nt, Pseudomonas aeruginosa PA01
caugcuccgccuggc

SEQ ID NO: 1525312 - RNA, 20 nt, Pseudomonas aeruginosa PA01
caugcuccgccuggcggaua

SEQ ID NO: 1525313 - RNA, 21 nt, Pseudomonas aeruginosa PA01
caugcugcucaguugcaccug

SEQ ID NO: 1525314 - RNA, 19 nt, Pseudomonas aeruginosa PA01
caugcucgggguuuccucg

SEQ ID NO: 1525315 - RNA, 12 nt, Pseudomonas aeruginosa PA01
caugcuggcgcu

SEQ ID NO: 1525316 - RNA, 17 nt, Pseudomonas aeruginosa PA01
caugcuggcgcucucga

SEQ ID NO: 1525317 - RNA, 12 nt, Pseudomonas aeruginosa PA01
cauggcaucccc

SEQ ID NO: 1525318 - RNA, 18 nt, Pseudomonas aeruginosa PA01
cauggccgaccgccaggc

SEQ ID NO: 1525319 - RNA, 16 nt, Pseudomonas aeruginosa PA01
cauggccgcagcggcu

SEQ ID NO: 1525320 - RNA, 20 nt, Pseudomonas aeruginosa PA01
cauggccuggcgcucagcgc

SEQ ID NO: 1525321 - RNA, 22 nt, Pseudomonas aeruginosa PA01
cauggccuggcgcucagcgccg

SEQ ID NO: 1525322 - RNA, 23 nt, Pseudomonas aeruginosa PA01
cauggccuggcgcucagcgccgc

SEQ ID NO: 1525323 - RNA, 19 nt, Pseudomonas aeruginosa PA01
cauggcgcgaaucuucggc

SEQ ID NO: 1525324 - RNA, 22 nt, Pseudomonas aeruginosa PA01
cauggcgcacgccgcggaaggc

SEQ ID NO: 1525325 - RNA, 21 nt, Pseudomonas aeruginosa PA01
cauggcgccacgcaaacccau

SEQ ID NO: 1525326 - RNA, 22 nt, Pseudomonas aeruginosa PA01
caugucgguauccaccggaccc

SEQ ID NO: 1525327 - RNA, 13 nt, Pseudomonas aeruginosa PA01
caugucgcuggcc

SEQ ID NO: 1525328 - RNA, 15 nt, Pseudomonas aeruginosa PA01
cauguccucggcgcc

SEQ ID NO: 1525329 - RNA, 17 nt, Pseudomonas aeruginosa PA01
cauguccgccaguuccg

SEQ ID NO: 1525330 - RNA, 15 nt, Pseudomonas aeruginosa PA01
cauguaggcgcacca

SEQ ID NO: 1525331 - RNA, 17 nt, Pseudomonas aeruginosa PA01
cauguccaccgccgcca

SEQ ID NO: 1525332 - RNA, 14 nt, Pseudomonas aeruginosa PA01
cauguccagccagu

SEQ ID NO: 1525333 - RNA, 18 nt, Pseudomonas aeruginosa PA01
cauguccagccaguggcu

SEQ ID NO: 1525334 - RNA, 23 nt, Pseudomonas aeruginosa PA01
cauggcgcugaggaagagcagcg

SEQ ID NO: 1525335 - RNA, 19 nt, Pseudomonas aeruginosa PA01
cauggcgcgaugcucccga

SEQ ID NO: 1525336 - RNA, 21 nt, Pseudomonas aeruginosa PA01
cauggcgcgaugcucccgagc

SEQ ID NO: 1525337 - RNA, 13 nt, Pseudomonas aeruginosa PA01
cauggcguccggu

SEQ ID NO: 1525338 - RNA, 23 nt, Pseudomonas aeruginosa PA01
cauguagaacggguugaucaggu

SEQ ID NO: 1525339 - RNA, 16 nt, Pseudomonas aeruginosa PA01
cagcgucugccgcugg

SEQ ID NO: 1525340 - RNA, 14 nt, Pseudomonas aeruginosa PA01
cagcguggccagcg

SEQ ID NO: 1525341 - RNA, 18 nt, Pseudomonas aeruginosa PA01
cagcguggccagcgccca

SEQ ID NO: 1525342 - RNA, 23 nt, Pseudomonas aeruginosa PA01
cagcgugguaccgcugcgugcca

SEQ ID NO: 1525343 - RNA, 17 nt, Pseudomonas aeruginosa PA01
cagcgucucggcugccg

SEQ ID NO: 1525344 - RNA, 20 nt, Pseudomonas aeruginosa PA01
cagcgucucggcugccgcca

SEQ ID NO: 1525345 - RNA, 21 nt, Pseudomonas aeruginosa PA01
cagcgucgcgucggccuggcg

SEQ ID NO: 1525346 - RNA, 15 nt, Pseudomonas aeruginosa PA01
cagcgucgccaacgc

SEQ ID NO: 1525347 - RNA, 18 nt, Pseudomonas aeruginosa PA01
cagcgucgccugccaggc

SEQ ID NO: 1525348 - RNA, 14 nt, Pseudomonas aeruginosa PA01
cagcgucgccgggc

SEQ ID NO: 1525349 - RNA, 23 nt, Pseudomonas aeruginosa PA01
cagcguguggcgaaacuccagca

SEQ ID NO: 1525350 - RNA, 20 nt, Pseudomonas aeruginosa PA01
cagcguuguccucggcggcu

SEQ ID NO: 1525351 - RNA, 14 nt, Pseudomonas aeruginosa PA01
cagcggugggaaga

SEQ ID NO: 1525352 - RNA, 20 nt, Pseudomonas aeruginosa PA01
cagcgguucgcccgcgggca

SEQ ID NO: 1525353 - RNA, 14 nt, Pseudomonas aeruginosa PA01
cagcguccugcccu

SEQ ID NO: 1525354 - RNA, 13 nt, Pseudomonas aeruginosa PA01
cagcgggccaggc

SEQ ID NO: 1525355 - RNA, 20 nt, Pseudomonas aeruginosa PA01
cagcgggaugugcaccagca

SEQ ID NO: 1525356 - RNA, 23 nt, Pseudomonas aeruginosa PA01
cagcgggaaggucggcagcagcu

SEQ ID NO: 1525357 - RNA, 18 nt, Pseudomonas aeruginosa PA01
cagcggcuuguccuggcg

SEQ ID NO: 1525358 - RNA, 13 nt, Pseudomonas aeruginosa PA01
cagcggucgccgg

SEQ ID NO: 1525359 - RNA, 14 nt, Pseudomonas aeruginosa PA01
cagcggucgccggu

SEQ ID NO: 1525360 - RNA, 20 nt, Pseudomonas aeruginosa PA01
cagcgguaugccgcaggcag

SEQ ID NO: 1525361 - RNA, 15 nt, Pseudomonas aeruginosa PA01
cagcgguaguucagu

SEQ ID NO: 1525362 - RNA, 18 nt, Pseudomonas aeruginosa PA01
cagcgguaguucagucgg

SEQ ID NO: 1525363 - RNA, 16 nt, Pseudomonas aeruginosa PA01
cagcgggugccgaaga

SEQ ID NO: 1525364 - RNA, 19 nt, Pseudomonas aeruginosa PA01
cagcgguacguagcgcggu

SEQ ID NO: 1525365 - RNA, 23 nt, Pseudomonas aeruginosa PA01
cagcggguaguagaucagcuucu

SEQ ID NO: 1525366 - RNA, 15 nt, Pseudomonas aeruginosa PA01
cagcgggucgcggcu

SEQ ID NO: 1525367 - RNA, 14 nt, Pseudomonas aeruginosa PA01
cagcgggucggcga

SEQ ID NO: 1525368 - RNA, 19 nt, Pseudomonas aeruginosa PA01
cagcgggucgucgaagcgc

SEQ ID NO: 1525369 - RNA, 20 nt, Pseudomonas aeruginosa PA01
cagcgggucgucgaagcgca

SEQ ID NO: 1525370 - RNA, 17 nt, Pseudomonas aeruginosa PA01
cagcgggguggcgcgga

SEQ ID NO: 1525371 - RNA, 14 nt, Pseudomonas aeruginosa PA01
cagcgggcgccgcc

SEQ ID NO: 1525372 - RNA, 15 nt, Pseudomonas aeruginosa PA01
cagcgggcugaagug

SEQ ID NO: 1525373 - RNA, 23 nt, Pseudomonas aeruginosa PA01
cagcucuggggucaguucguuga

SEQ ID NO: 1525374 - RNA, 17 nt, Pseudomonas aeruginosa PA01
cagcugcggcggcacca

SEQ ID NO: 1525375 - RNA, 14 nt, Pseudomonas aeruginosa PA01
cagcugccagcccc

SEQ ID NO: 1525376 - RNA, 17 nt, Pseudomonas aeruginosa PA01
cagcugccagccccgcu

SEQ ID NO: 1525377 - RNA, 14 nt, Pseudomonas aeruginosa PA01
cagcugcaccgcgc

SEQ ID NO: 1525378 - RNA, 15 nt, Pseudomonas aeruginosa PA01
cagcucucccgaggc

SEQ ID NO: 1525379 - RNA, 16 nt, Pseudomonas aeruginosa PA01
cagcucucccgaggcg

SEQ ID NO: 1525380 - RNA, 15 nt, Pseudomonas aeruginosa PA01
cagcucguugcacag

SEQ ID NO: 1525381 - RNA, 16 nt, Pseudomonas aeruginosa PA01
cagcucguugcccggc

SEQ ID NO: 1525382 - RNA, 15 nt, Pseudomonas aeruginosa PA01
cagcucgaucagccc

SEQ ID NO: 1525383 - RNA, 17 nt, Pseudomonas aeruginosa PA01
cagcucgaucagcccgc

SEQ ID NO: 1525384 - RNA, 18 nt, Pseudomonas aeruginosa PA01
cagcucgaucagcccgcc

SEQ ID NO: 1525385 - RNA, 19 nt, Pseudomonas aeruginosa PA01
cagcucgaucagcccgcca

SEQ ID NO: 1525386 - RNA, 21 nt, Pseudomonas aeruginosa PA01
cagcucgaucagcccgccaac

SEQ ID NO: 1525387 - RNA, 16 nt, Pseudomonas aeruginosa PA01
cagcucgaggccagga

SEQ ID NO: 1525388 - RNA, 18 nt, Pseudomonas aeruginosa PA01
cagcucgacccgcccgcc

SEQ ID NO: 1525389 - RNA, 16 nt, Pseudomonas aeruginosa PA01
cagcucgaccuugccc

SEQ ID NO: 1525390 - RNA, 15 nt, Pseudomonas aeruginosa PA01
cagcuccuugcgcuc

SEQ ID NO: 1525391 - RNA, 20 nt, Pseudomonas aeruginosa PA01
cagcucauaggucagguaca

SEQ ID NO: 1525392 - RNA, 15 nt, Pseudomonas aeruginosa PA01
cagcucagcuccagg

SEQ ID NO: 1525393 - RNA, 13 nt, Pseudomonas aeruginosa PA01
cagcucagcaggu

SEQ ID NO: 1525394 - RNA, 15 nt, Pseudomonas aeruginosa PA01
cagcuugccuuccag

SEQ ID NO: 1525395 - RNA, 18 nt, Pseudomonas aeruginosa PA01
cagcuugccuuccaggcu

SEQ ID NO: 1525396 - RNA, 20 nt, Pseudomonas aeruginosa PA01
cagcuugccuuccaggcugu

SEQ ID NO: 1525397 - RNA, 21 nt, Pseudomonas aeruginosa PA01
cagcuugccuuccaggcugua

SEQ ID NO: 1525398 - RNA, 22 nt, Pseudomonas aeruginosa PA01
cagcuugcgcucagggacaccc

SEQ ID NO: 1525399 - RNA, 16 nt, Pseudomonas aeruginosa PA01
cagcuugcgcgccagg

SEQ ID NO: 1525400 - RNA, 13 nt, Pseudomonas aeruginosa PA01
cagcuucgccgcc

SEQ ID NO: 1525401 - RNA, 17 nt, Pseudomonas aeruginosa PA01
cagcuucgccgcccugg

SEQ ID NO: 1525402 - RNA, 18 nt, Pseudomonas aeruginosa PA01
cagcuucggcgcgacgcu

SEQ ID NO: 1525403 - RNA, 14 nt, Pseudomonas aeruginosa PA01
cagcuggcgcgccu

SEQ ID NO: 1525404 - RNA, 16 nt, Pseudomonas aeruginosa PA01
cagcuggcgcgucgcu

SEQ ID NO: 1525405 - RNA, 13 nt, Pseudomonas aeruginosa PA01
cagcugguuccag

SEQ ID NO: 1525406 - RNA, 19 nt, Pseudomonas aeruginosa PA01
cagcuugggauggccagcc

SEQ ID NO: 1525407 - RNA, 18 nt, Pseudomonas aeruginosa PA01
cagcuugguauccaccuc

SEQ ID NO: 1525408 - RNA, 21 nt, Pseudomonas aeruginosa PA01
cagcuugcuggcguucucggc

SEQ ID NO: 1525409 - RNA, 17 nt, Pseudomonas aeruginosa PA01
cagcuugguggugaucc

SEQ ID NO: 1525410 - RNA, 13 nt, Pseudomonas aeruginosa PA01
cagcuugucgccu

SEQ ID NO: 1525411 - RNA, 15 nt, Pseudomonas aeruginosa PA01
caggaaaaagcccgc

SEQ ID NO: 1525412 - RNA, 16 nt, Pseudomonas aeruginosa PA01
caggccaaccaccccg

SEQ ID NO: 1525413 - RNA, 21 nt, Pseudomonas aeruginosa PA01
caggccaagcaugaagugcca

SEQ ID NO: 1525414 - RNA, 24 nt, Pseudomonas aeruginosa PA01
caggccaagcuguugcuccaacca

SEQ ID NO: 1525415 - RNA, 15 nt, Pseudomonas aeruginosa PA01
caggccaagcuuguu

SEQ ID NO: 1525416 - RNA, 18 nt, Pseudomonas aeruginosa PA01
caggccacgcccaugccu

SEQ ID NO: 1525417 - RNA, 22 nt, Pseudomonas aeruginosa PA01
caggccacgcccaugccuugca

SEQ ID NO: 1525418 - RNA, 19 nt, Pseudomonas aeruginosa PA01
caggccaccgcgcagcugg

SEQ ID NO: 1525419 - RNA, 14 nt, Pseudomonas aeruginosa PA01
caggccacccgccu

SEQ ID NO: 1525420 - RNA, 23 nt, Pseudomonas aeruginosa PA01
caggccagggcggugagguugcc

SEQ ID NO: 1525421 - RNA, 16 nt, Pseudomonas aeruginosa PA01
caggcauccagcaccg

SEQ ID NO: 1525422 - RNA, 19 nt, Pseudomonas aeruginosa PA01
caggcauccccggaccagg

SEQ ID NO: 1525423 - RNA, 21 nt, Pseudomonas aeruginosa PA01
caggcauccccggaccagggc

SEQ ID NO: 1525424 - RNA, 19 nt, Pseudomonas aeruginosa PA01
caggcaccguaggccaggc

SEQ ID NO: 1525425 - RNA, 20 nt, Pseudomonas aeruginosa PA01
caggcauuccuccagggucg

SEQ ID NO: 1525426 - RNA, 18 nt, Pseudomonas aeruginosa PA01
caggcaugcggccccggc

SEQ ID NO: 1525427 - RNA, 20 nt, Pseudomonas aeruginosa PA01
caggccaugggugucggcga

SEQ ID NO: 1525428 - RNA, 13 nt, Pseudomonas aeruginosa PA01
caggcccacgccc

SEQ ID NO: 1525429 - RNA, 19 nt, Pseudomonas aeruginosa PA01
caggccauagcgcgccggg

SEQ ID NO: 1525430 - RNA, 19 nt, Pseudomonas aeruginosa PA01
caggccagcucgcccgccu

SEQ ID NO: 1525431 - RNA, 23 nt, Pseudomonas aeruginosa PA01
caggcccagcuucuuggcccggu

SEQ ID NO: 1525432 - RNA, 12 nt, Pseudomonas aeruginosa PA01
caggccccaggc

SEQ ID NO: 1525433 - RNA, 17 nt, Pseudomonas aeruginosa PA01
caggccccaggcgaucc

SEQ ID NO: 1525434 - RNA, 13 nt, Pseudomonas aeruginosa PA01
caggccccagggc

SEQ ID NO: 1525435 - RNA, 21 nt, Pseudomonas aeruginosa PA01
caggccccagggccggcgccc

SEQ ID NO: 1525436 - RNA, 14 nt, Pseudomonas aeruginosa PA01
caggcccgagccgg

SEQ ID NO: 1525437 - RNA, 20 nt, Pseudomonas aeruginosa PA01
caggcaaagaccgaccagua

SEQ ID NO: 1525438 - RNA, 17 nt, Pseudomonas aeruginosa PA01
caggaugcugcacagcc

SEQ ID NO: 1525439 - RNA, 17 nt, Pseudomonas aeruginosa PA01
caggcaauggccggcgg

SEQ ID NO: 1525440 - RNA, 15 nt, Pseudomonas aeruginosa PA01
caggcaagcgcauga

SEQ ID NO: 1525441 - RNA, 19 nt, Pseudomonas aeruginosa PA01
caggcaaucucccccucuu

SEQ ID NO: 1525442 - RNA, 19 nt, Pseudomonas aeruginosa PA01
caggcaccgaagcugaggc

SEQ ID NO: 1525443 - RNA, 17 nt, Pseudomonas aeruginosa PA01
caggcacgcugccagca

SEQ ID NO: 1525444 - RNA, 19 nt, Pseudomonas aeruginosa PA01
caggcacgcugccagcagg

SEQ ID NO: 1525445 - RNA, 19 nt, Pseudomonas aeruginosa PA01
caggcacggaagcgcugcu

SEQ ID NO: 1525446 - RNA, 23 nt, Pseudomonas aeruginosa PA01
caggcacggcuucagcgccaggc

SEQ ID NO: 1525447 - RNA, 20 nt, Pseudomonas aeruginosa PA01
caggcacgaauuuccuggcg

SEQ ID NO: 1525448 - RNA, 14 nt, Pseudomonas aeruginosa PA01
caggaacacccggu

SEQ ID NO: 1525449 - RNA, 16 nt, Pseudomonas aeruginosa PA01
caggaaccgacgcgca

SEQ ID NO: 1525450 - RNA, 20 nt, Pseudomonas aeruginosa PA01
caggaacagcuccuccagcg

SEQ ID NO: 1525451 - RNA, 22 nt, Pseudomonas aeruginosa PA01
caggaaccaggggucgacgcag

SEQ ID NO: 1525452 - RNA, 14 nt, Pseudomonas aeruginosa PA01
caggaugcccugcu

SEQ ID NO: 1525453 - RNA, 22 nt, Pseudomonas aeruginosa PA01
caggaugcgcuuuuccucgacc

SEQ ID NO: 1525454 - RNA, 20 nt, Pseudomonas aeruginosa PA01
caggaucagguugaagagca

SEQ ID NO: 1525455 - RNA, 14 nt, Pseudomonas aeruginosa PA01
caggauaucgccca

SEQ ID NO: 1525456 - RNA, 19 nt, Pseudomonas aeruginosa PA01
caggauaucgcccagggcc

SEQ ID NO: 1525457 - RNA, 15 nt, Pseudomonas aeruginosa PA01
cagggaaaccaccug

SEQ ID NO: 1525458 - RNA, 20 nt, Pseudomonas aeruginosa PA01
caggcuuuccaccgccagca

SEQ ID NO: 1525459 - RNA, 23 nt, Pseudomonas aeruginosa PA01
caggcuuuccaccgccagcaccc

SEQ ID NO: 1525460 - RNA, 14 nt, Pseudomonas aeruginosa PA01
caggcuuggucagg

SEQ ID NO: 1525461 - RNA, 15 nt, Pseudomonas aeruginosa PA01
caggcuuggucaggg

SEQ ID NO: 1525462 - RNA, 19 nt, Pseudomonas aeruginosa PA01
caggcuuucguaggcaggc

SEQ ID NO: 1525463 - RNA, 12 nt, Pseudomonas aeruginosa PA01
caggcugugcag

SEQ ID NO: 1525464 - RNA, 17 nt, Pseudomonas aeruginosa PA01
caggcugugcgccaggc

SEQ ID NO: 1525465 - RNA, 20 nt, Pseudomonas aeruginosa PA01
caggcugucggccagccccu

SEQ ID NO: 1525466 - RNA, 16 nt, Pseudomonas aeruginosa PA01
caggcugucggccauc

SEQ ID NO: 1525467 - RNA, 16 nt, Pseudomonas aeruginosa PA01
caggcuguaguggcuu

SEQ ID NO: 1525468 - RNA, 19 nt, Pseudomonas aeruginosa PA01
caggcugguaugcagcaac

SEQ ID NO: 1525469 - RNA, 16 nt, Pseudomonas aeruginosa PA01
caggcuucggcgcgcu

SEQ ID NO: 1525470 - RNA, 17 nt, Pseudomonas aeruginosa PA01
caggcuguugcccuggg

SEQ ID NO: 1525471 - RNA, 18 nt, Pseudomonas aeruginosa PA01
caggcuguugcccugggc

SEQ ID NO: 1525472 - RNA, 19 nt, Pseudomonas aeruginosa PA01
caggcuguugcccugggcc

SEQ ID NO: 1525473 - RNA, 23 nt, Pseudomonas aeruginosa PA01
caggcugccgccuucgcgggcca

SEQ ID NO: 1525474 - RNA, 13 nt, Pseudomonas aeruginosa PA01
caggcugaucagc

SEQ ID NO: 1525475 - RNA, 18 nt, Pseudomonas aeruginosa PA01
caggcugaucagcccgcu

SEQ ID NO: 1525476 - RNA, 22 nt, Pseudomonas aeruginosa PA01
caggcugauccgcgacaguucg

SEQ ID NO: 1525477 - RNA, 12 nt, Pseudomonas aeruginosa PA01
caggcugacccg

SEQ ID NO: 1525478 - RNA, 17 nt, Pseudomonas aeruginosa PA01
caggcugacgucgacgc

SEQ ID NO: 1525479 - RNA, 21 nt, Pseudomonas aeruginosa PA01
caggcugcggcggaaggcggc

SEQ ID NO: 1525480 - RNA, 17 nt, Pseudomonas aeruginosa PA01
caggcugcgcuugcugc

SEQ ID NO: 1525481 - RNA, 15 nt, Pseudomonas aeruginosa PA01
caggcugccuucgac

SEQ ID NO: 1525482 - RNA, 19 nt, Pseudomonas aeruginosa PA01
caggcugccgagcaggguc

SEQ ID NO: 1525483 - RNA, 22 nt, Pseudomonas aeruginosa PA01
caggcugcgcaccucggccagg

SEQ ID NO: 1525484 - RNA, 12 nt, Pseudomonas aeruginosa PA01
caggcuggcucc

SEQ ID NO: 1525485 - RNA, 22 nt, Pseudomonas aeruginosa PA01
caggcuggcggcaucggcgccg

SEQ ID NO: 1525486 - RNA, 18 nt, Pseudomonas aeruginosa PA01
caggcuggccgagcgccg

SEQ ID NO: 1525487 - RNA, 14 nt, Pseudomonas aeruginosa PA01
caggcuggccagaa

SEQ ID NO: 1525488 - RNA, 21 nt, Pseudomonas aeruginosa PA01
caggcuggccagaauuccagc

SEQ ID NO: 1525489 - RNA, 19 nt, Pseudomonas aeruginosa PA01
caggcgucccauggcgcca

SEQ ID NO: 1525490 - RNA, 16 nt, Pseudomonas aeruginosa PA01
caggcgucgccgacuu

SEQ ID NO: 1525491 - RNA, 17 nt, Pseudomonas aeruginosa PA01
caggcgucggcgccuuc

SEQ ID NO: 1525492 - RNA, 23 nt, Pseudomonas aeruginosa PA01
caggcguccgcuggccugcagca

SEQ ID NO: 1525493 - RNA, 17 nt, Pseudomonas aeruginosa PA01
caggcgucccuggagca

SEQ ID NO: 1525494 - RNA, 20 nt, Pseudomonas aeruginosa PA01
caggcgucccuggagcaggg

SEQ ID NO: 1525495 - RNA, 16 nt, Pseudomonas aeruginosa PA01
caggcucgguucugcg

SEQ ID NO: 1525496 - RNA, 19 nt, Pseudomonas aeruginosa PA01
caggcucgccgccagcagg

SEQ ID NO: 1525497 - RNA, 15 nt, Pseudomonas aeruginosa PA01
caggcucgccccggc

SEQ ID NO: 1525498 - RNA, 15 nt, Pseudomonas aeruginosa PA01
caggcgucgguccag

SEQ ID NO: 1525499 - RNA, 23 nt, Pseudomonas aeruginosa PA01
caggcgucguuguugcgggcgag

SEQ ID NO: 1525500 - RNA, 15 nt, Pseudomonas aeruginosa PA01
caggcucuucagcac

SEQ ID NO: 1525501 - RNA, 17 nt, Pseudomonas aeruginosa PA01
caggcucuucagcacgc

SEQ ID NO: 1525502 - RNA, 23 nt, Pseudomonas aeruginosa PA01
caggcggaucgcccggcgcucca

SEQ ID NO: 1525503 - RNA, 18 nt, Pseudomonas aeruginosa PA01
caggcgcuguccuguggc

SEQ ID NO: 1525504 - RNA, 23 nt, Pseudomonas aeruginosa PA01
caggcgcuguccuguggcgcuuc

SEQ ID NO: 1525505 - RNA, 21 nt, Pseudomonas aeruginosa PA01
caggcggccgaauccuccagc

SEQ ID NO: 1525506 - RNA, 22 nt, Pseudomonas aeruginosa PA01
caggcggccgaauccuccagcc

SEQ ID NO: 1525507 - RNA, 24 nt, Pseudomonas aeruginosa PA01
caggcggucggccaucuggcugcc

SEQ ID NO: 1525508 - RNA, 17 nt, Pseudomonas aeruginosa PA01
caggcgguuguucagcg

SEQ ID NO: 1525509 - RNA, 22 nt, Pseudomonas aeruginosa PA01
caggcgcagcguccugcccucc

SEQ ID NO: 1525510 - RNA, 21 nt, Pseudomonas aeruginosa PA01
caggcgcuccuugagcagcuc

SEQ ID NO: 1525511 - RNA, 13 nt, Pseudomonas aeruginosa PA01
caggcgcagcagc

SEQ ID NO: 1525512 - RNA, 21 nt, Pseudomonas aeruginosa PA01
caggcgcucgcgggccgccug

SEQ ID NO: 1525513 - RNA, 18 nt, Pseudomonas aeruginosa PA01
caggcgcugcguuccugu

SEQ ID NO: 1525514 - RNA, 14 nt, Pseudomonas aeruginosa PA01
caggcgcugcagcc

SEQ ID NO: 1525515 - RNA, 17 nt, Pseudomonas aeruginosa PA01
caggcgcugguccagca

SEQ ID NO: 1525516 - RNA, 21 nt, Pseudomonas aeruginosa PA01
caggcgcugguccagcacgcu

SEQ ID NO: 1525517 - RNA, 22 nt, Pseudomonas aeruginosa PA01
caggcgcugguccagcacgcug

SEQ ID NO: 1525518 - RNA, 11 nt, Pseudomonas aeruginosa PA01
caggcgcaccu

SEQ ID NO: 1525519 - RNA, 15 nt, Pseudomonas aeruginosa PA01
caggcgcaccuccuc

SEQ ID NO: 1525520 - RNA, 15 nt, Pseudomonas aeruginosa PA01
caggcgcaccuggcg

SEQ ID NO: 1525521 - RNA, 16 nt, Pseudomonas aeruginosa PA01
caggcgacgccgcgcu

SEQ ID NO: 1525522 - RNA, 15 nt, Pseudomonas aeruginosa PA01
caggcgaggaacagc

SEQ ID NO: 1525523 - RNA, 20 nt, Pseudomonas aeruginosa PA01
caggcgaggaacagcgagag

SEQ ID NO: 1525524 - RNA, 23 nt, Pseudomonas aeruginosa PA01
caggcgaggaacagcgagagggg

SEQ ID NO: 1525525 - RNA, 16 nt, Pseudomonas aeruginosa PA01
caggcgaugaccgccc

SEQ ID NO: 1525526 - RNA, 17 nt, Pseudomonas aeruginosa PA01
caggcgaugaccgcccc

SEQ ID NO: 1525527 - RNA, 20 nt, Pseudomonas aeruginosa PA01
caggcgaugaucagcccuuc

SEQ ID NO: 1525528 - RNA, 21 nt, Pseudomonas aeruginosa PA01
caggcgauaucccgccgccgc

SEQ ID NO: 1525529 - RNA, 14 nt, Pseudomonas aeruginosa PA01
caggcccucagcgg

SEQ ID NO: 1525530 - RNA, 16 nt, Pseudomonas aeruginosa PA01
caggcccuggaucacc

SEQ ID NO: 1525531 - RNA, 15 nt, Pseudomonas aeruginosa PA01
caggcccugcuccuc

SEQ ID NO: 1525532 - RNA, 14 nt, Pseudomonas aeruginosa PA01
caggccucccagcc

SEQ ID NO: 1525533 - RNA, 16 nt, Pseudomonas aeruginosa PA01
caggccucccagccgu

SEQ ID NO: 1525534 - RNA, 18 nt, Pseudomonas aeruginosa PA01
caggccucccagccgugg

SEQ ID NO: 1525535 - RNA, 21 nt, Pseudomonas aeruginosa PA01
caggccucccagccgugggcg

SEQ ID NO: 1525536 - RNA, 17 nt, Pseudomonas aeruginosa PA01
caggcccuuggucaggc

SEQ ID NO: 1525537 - RNA, 19 nt, Pseudomonas aeruginosa PA01
caggcccuugaacaggcug

SEQ ID NO: 1525538 - RNA, 17 nt, Pseudomonas aeruginosa PA01
caggcccuugagggccu

SEQ ID NO: 1525539 - RNA, 22 nt, Pseudomonas aeruginosa PA01
caggcccuugagggccucggcg

SEQ ID NO: 1525540 - RNA, 17 nt, Pseudomonas aeruginosa PA01
caggcgaaaaaaagccc

SEQ ID NO: 1525541 - RNA, 20 nt, Pseudomonas aeruginosa PA01
caggcgaaaaaaagccccgc

SEQ ID NO: 1525542 - RNA, 16 nt, Pseudomonas aeruginosa PA01
caggccuugcagggcc

SEQ ID NO: 1525543 - RNA, 17 nt, Pseudomonas aeruginosa PA01
caggccuugcagggccg

SEQ ID NO: 1525544 - RNA, 13 nt, Pseudomonas aeruginosa PA01
caggcgacgccgc

SEQ ID NO: 1525545 - RNA, 18 nt, Pseudomonas aeruginosa PA01
caggcgaagaaagccccu

SEQ ID NO: 1525546 - RNA, 20 nt, Pseudomonas aeruginosa PA01
caggcgaagaaagccccugc

SEQ ID NO: 1525547 - RNA, 13 nt, Pseudomonas aeruginosa PA01
caggccuguggau

SEQ ID NO: 1525548 - RNA, 14 nt, Pseudomonas aeruginosa PA01
caggccuuccggga

SEQ ID NO: 1525549 - RNA, 23 nt, Pseudomonas aeruginosa PA01
caggccuucgacuucgacgaacu

SEQ ID NO: 1525550 - RNA, 17 nt, Pseudomonas aeruginosa PA01
caggccuggagcgccuc

SEQ ID NO: 1525551 - RNA, 18 nt, Pseudomonas aeruginosa PA01
caguuccaggcguccgcu

SEQ ID NO: 1525552 - RNA, 22 nt, Pseudomonas aeruginosa PA01
caguuccaggcgugcugcacgg

SEQ ID NO: 1525553 - RNA, 15 nt, Pseudomonas aeruginosa PA01
caguuccagggucag

SEQ ID NO: 1525554 - RNA, 21 nt, Pseudomonas aeruginosa PA01
caguuccagggucagcuggcg

SEQ ID NO: 1525555 - RNA, 19 nt, Pseudomonas aeruginosa PA01
caguuccggggucagcgcc

SEQ ID NO: 1525556 - RNA, 15 nt, Pseudomonas aeruginosa PA01
caguuccucgccgcu

SEQ ID NO: 1525557 - RNA, 20 nt, Pseudomonas aeruginosa PA01
caguuccgacugcgagccga

SEQ ID NO: 1525558 - RNA, 16 nt, Pseudomonas aeruginosa PA01
caguuccgccagaugc

SEQ ID NO: 1525559 - RNA, 17 nt, Pseudomonas aeruginosa PA01
caguuccgccagaugcg

SEQ ID NO: 1525560 - RNA, 19 nt, Pseudomonas aeruginosa PA01
caguucggcgaugaccagc

SEQ ID NO: 1525561 - RNA, 17 nt, Pseudomonas aeruginosa PA01
caguucggccagcggca

SEQ ID NO: 1525562 - RNA, 20 nt, Pseudomonas aeruginosa PA01
caguucggccaucagcacgu

SEQ ID NO: 1525563 - RNA, 17 nt, Pseudomonas aeruginosa PA01
caguucggcccagcagc

SEQ ID NO: 1525564 - RNA, 20 nt, Pseudomonas aeruginosa PA01
caguucggcccagcagcgcu

SEQ ID NO: 1525565 - RNA, 20 nt, Pseudomonas aeruginosa PA01
caguucggccgcggcuggca

SEQ ID NO: 1525566 - RNA, 16 nt, Pseudomonas aeruginosa PA01
caguucggccagcggc

SEQ ID NO: 1525567 - RNA, 15 nt, Pseudomonas aeruginosa PA01
caguucgccccgccg

SEQ ID NO: 1525568 - RNA, 18 nt, Pseudomonas aeruginosa PA01
caguucgccgcccgaggc

SEQ ID NO: 1525569 - RNA, 23 nt, Pseudomonas aeruginosa PA01
caguucgccgccgagcgccuggc

SEQ ID NO: 1525570 - RNA, 15 nt, Pseudomonas aeruginosa PA01
caguucgcgcggagu

SEQ ID NO: 1525571 - RNA, 15 nt, Pseudomonas aeruginosa PA01
caguucgcgggccgc

SEQ ID NO: 1525572 - RNA, 20 nt, Pseudomonas aeruginosa PA01
caguucgcgggccgcggcga

SEQ ID NO: 1525573 - RNA, 23 nt, Pseudomonas aeruginosa PA01
caguucgcugccgccgcgcugca

SEQ ID NO: 1525574 - RNA, 17 nt, Pseudomonas aeruginosa PA01
caguuccugcuccuccg

SEQ ID NO: 1525575 - RNA, 17 nt, Pseudomonas aeruginosa PA01
caguuccuugggcaucg

SEQ ID NO: 1525576 - RNA, 16 nt, Pseudomonas aeruginosa PA01
cagugguuccaggagg

SEQ ID NO: 1525577 - RNA, 19 nt, Pseudomonas aeruginosa PA01
caguucaggcugggccgaa

SEQ ID NO: 1525578 - RNA, 17 nt, Pseudomonas aeruginosa PA01
cagugccugcaccacgc

SEQ ID NO: 1525579 - RNA, 19 nt, Pseudomonas aeruginosa PA01
cagugccugcaccacgcag

SEQ ID NO: 1525580 - RNA, 23 nt, Pseudomonas aeruginosa PA01
caguggcuccgcgcguucagcca

SEQ ID NO: 1525581 - RNA, 15 nt, Pseudomonas aeruginosa PA01
caguggcgccagcca

SEQ ID NO: 1525582 - RNA, 17 nt, Pseudomonas aeruginosa PA01
caguggcgccagccagc

SEQ ID NO: 1525583 - RNA, 17 nt, Pseudomonas aeruginosa PA01
caguggcgccgccaugg

SEQ ID NO: 1525584 - RNA, 21 nt, Pseudomonas aeruginosa PA01
caguccgguagcgcgccugcu

SEQ ID NO: 1525585 - RNA, 23 nt, Pseudomonas aeruginosa PA01
caguccgguagcgcgccugcuuu

SEQ ID NO: 1525586 - RNA, 19 nt, Pseudomonas aeruginosa PA01
cagucccgcaaagcccgcu

SEQ ID NO: 1525587 - RNA, 22 nt, Pseudomonas aeruginosa PA01
cagucccuggccggcgauggcc

SEQ ID NO: 1525588 - RNA, 19 nt, Pseudomonas aeruginosa PA01
caguucgucuuccagcggc

SEQ ID NO: 1525589 - RNA, 14 nt, Pseudomonas aeruginosa PA01
caguucgugccagg

SEQ ID NO: 1525590 - RNA, 20 nt, Pseudomonas aeruginosa PA01
caguucguccaucgccaggc

SEQ ID NO: 1525591 - RNA, 20 nt, Pseudomonas aeruginosa PA01
caguucgucgagggucugcu

SEQ ID NO: 1525592 - RNA, 20 nt, Pseudomonas aeruginosa PA01
caguucguugagggccuuga

SEQ ID NO: 1525593 - RNA, 12 nt, Pseudomonas aeruginosa PA01
caguauuucucg

SEQ ID NO: 1525594 - RNA, 14 nt, Pseudomonas aeruginosa PA01
cagucccgccaggc

SEQ ID NO: 1525595 - RNA, 20 nt, Pseudomonas aeruginosa PA01
cagucccgcgcggcccuucg

SEQ ID NO: 1525596 - RNA, 22 nt, Pseudomonas aeruginosa PA01
caguaccuggcgguacagcccc

SEQ ID NO: 1525597 - RNA, 23 nt, Pseudomonas aeruginosa PA01
caguaccuggcgguacagccccc

SEQ ID NO: 1525598 - RNA, 14 nt, Pseudomonas aeruginosa PA01
caguacgcucuggg

SEQ ID NO: 1525599 - RNA, 13 nt, Pseudomonas aeruginosa PA01
caguagcgccugg

SEQ ID NO: 1525600 - RNA, 20 nt, Pseudomonas aeruginosa PA01
caguagcgcuucgcgcagcu

SEQ ID NO: 1525601 - RNA, 14 nt, Pseudomonas aeruginosa PA01
caguagcggcaggg

SEQ ID NO: 1525602 - RNA, 21 nt, Pseudomonas aeruginosa PA01
caguagguagagaugcagcag

SEQ ID NO: 1525603 - RNA, 21 nt, Pseudomonas aeruginosa PA01
cagguucgaaugcugcccgga

SEQ ID NO: 1525604 - RNA, 19 nt, Pseudomonas aeruginosa PA01
cagguucgcguggcccggc

SEQ ID NO: 1525605 - RNA, 16 nt, Pseudomonas aeruginosa PA01
cagguucggcagcgcc

SEQ ID NO: 1525606 - RNA, 17 nt, Pseudomonas aeruginosa PA01
cagguucggcagcgccu

SEQ ID NO: 1525607 - RNA, 17 nt, Pseudomonas aeruginosa PA01
cagguucggcgccagcu

SEQ ID NO: 1525608 - RNA, 20 nt, Pseudomonas aeruginosa PA01
cagguucagcaggucgcggc

SEQ ID NO: 1525609 - RNA, 18 nt, Pseudomonas aeruginosa PA01
cagguugaagagcagcac

SEQ ID NO: 1525610 - RNA, 12 nt, Pseudomonas aeruginosa PA01
cagguugaccuu

SEQ ID NO: 1525611 - RNA, 18 nt, Pseudomonas aeruginosa PA01
cagguugaccuucugucc

SEQ ID NO: 1525612 - RNA, 20 nt, Pseudomonas aeruginosa PA01
cagguucaucgccgccaggc

SEQ ID NO: 1525613 - RNA, 22 nt, Pseudomonas aeruginosa PA01
cagguucacccaguuguaacga

SEQ ID NO: 1525614 - RNA, 23 nt, Pseudomonas aeruginosa PA01
caggugcccuggcagacgcugcu

SEQ ID NO: 1525615 - RNA, 19 nt, Pseudomonas aeruginosa PA01
caggugccgcucguccagu

SEQ ID NO: 1525616 - RNA, 22 nt, Pseudomonas aeruginosa PA01
caggugccgcucguccaguucc

SEQ ID NO: 1525617 - RNA, 17 nt, Pseudomonas aeruginosa PA01
caggugcauguagcgcu

SEQ ID NO: 1525618 - RNA, 23 nt, Pseudomonas aeruginosa PA01
caggugcauguagcgcuccucgc

SEQ ID NO: 1525619 - RNA, 12 nt, Pseudomonas aeruginosa PA01
caggugcaggaa

SEQ ID NO: 1525620 - RNA, 16 nt, Pseudomonas aeruginosa PA01
caggugcaggaacagc

SEQ ID NO: 1525621 - RNA, 21 nt, Pseudomonas aeruginosa PA01
cagguuguucgccgcagcggu

SEQ ID NO: 1525622 - RNA, 15 nt, Pseudomonas aeruginosa PA01
caggucgcgcggcgc

SEQ ID NO: 1525623 - RNA, 18 nt, Pseudomonas aeruginosa PA01
caggucgcgcggcgccug

SEQ ID NO: 1525624 - RNA, 23 nt, Pseudomonas aeruginosa PA01
caggucgcgcggcgccugcugcg

SEQ ID NO: 1525625 - RNA, 20 nt, Pseudomonas aeruginosa PA01
caggucgcugcccucgacca

SEQ ID NO: 1525626 - RNA, 23 nt, Pseudomonas aeruginosa PA01
caggucgcugcccucgaccaggu

SEQ ID NO: 1525627 - RNA, 16 nt, Pseudomonas aeruginosa PA01
caggucgcuggcaccg

SEQ ID NO: 1525628 - RNA, 22 nt, Pseudomonas aeruginosa PA01
caggucgcuguccuccagcggc

SEQ ID NO: 1525629 - RNA, 20 nt, Pseudomonas aeruginosa PA01
caggucgcugucgcguuccc

SEQ ID NO: 1525630 - RNA, 17 nt, Pseudomonas aeruginosa PA01
caggucgcgcagggcca

SEQ ID NO: 1525631 - RNA, 14 nt, Pseudomonas aeruginosa PA01
caggucggcagcgu

SEQ ID NO: 1525632 - RNA, 22 nt, Pseudomonas aeruginosa PA01
caggucggcagcgucgagcugg

SEQ ID NO: 1525633 - RNA, 19 nt, Pseudomonas aeruginosa PA01
caggucgcuuucgcgcaga

SEQ ID NO: 1525634 - RNA, 17 nt, Pseudomonas aeruginosa PA01
caggucggacaggcauu

SEQ ID NO: 1525635 - RNA, 16 nt, Pseudomonas aeruginosa PA01
caggucgaugcccagc

SEQ ID NO: 1525636 - RNA, 21 nt, Pseudomonas aeruginosa PA01
caggucgaugcccagccaggg

SEQ ID NO: 1525637 - RNA, 21 nt, Pseudomonas aeruginosa PA01
caggucgagguuguagcccug

SEQ ID NO: 1525638 - RNA, 23 nt, Pseudomonas aeruginosa PA01
caggucgagguuguagcccuggg

SEQ ID NO: 1525639 - RNA, 16 nt, Pseudomonas aeruginosa PA01
caggucgccgcugaau

SEQ ID NO: 1525640 - RNA, 23 nt, Pseudomonas aeruginosa PA01
caggucgccguagaacagcacgu

SEQ ID NO: 1525641 - RNA, 14 nt, Pseudomonas aeruginosa PA01
caggucgcccaccu

SEQ ID NO: 1525642 - RNA, 11 nt, Pseudomonas aeruginosa PA01
cagguccaggc

SEQ ID NO: 1525643 - RNA, 20 nt, Pseudomonas aeruginosa PA01
cagguccgaacagaggaagg

SEQ ID NO: 1525644 - RNA, 14 nt, Pseudomonas aeruginosa PA01
cagguccgccuggu

SEQ ID NO: 1525645 - RNA, 14 nt, Pseudomonas aeruginosa PA01
cagguccgcgccuc

SEQ ID NO: 1525646 - RNA, 16 nt, Pseudomonas aeruginosa PA01
cagguccgcgccucgc

SEQ ID NO: 1525647 - RNA, 19 nt, Pseudomonas aeruginosa PA01
cagguccguuccguucaaa

SEQ ID NO: 1525648 - RNA, 16 nt, Pseudomonas aeruginosa PA01
cagguccggcagcgcc

SEQ ID NO: 1525649 - RNA, 17 nt, Pseudomonas aeruginosa PA01
cagguccggcagcgccu

SEQ ID NO: 1525650 - RNA, 23 nt, Pseudomonas aeruginosa PA01
cagguccuggguauagaccagca

SEQ ID NO: 1525651 - RNA, 14 nt, Pseudomonas aeruginosa PA01
cagguccuggaaca

SEQ ID NO: 1525652 - RNA, 16 nt, Pseudomonas aeruginosa PA01
cagguccuggaacagg

SEQ ID NO: 1525653 - RNA, 16 nt, Pseudomonas aeruginosa PA01
caggucgaucagcagc

SEQ ID NO: 1525654 - RNA, 17 nt, Pseudomonas aeruginosa PA01
caggucgauccccaacc

SEQ ID NO: 1525655 - RNA, 23 nt, Pseudomonas aeruginosa PA01
caggucgagacgcgggcccagcg

SEQ ID NO: 1525656 - RNA, 15 nt, Pseudomonas aeruginosa PA01
caggucgaggccgcg

SEQ ID NO: 1525657 - RNA, 21 nt, Pseudomonas aeruginosa PA01
caggucgacgaccuugcccac

SEQ ID NO: 1525658 - RNA, 23 nt, Pseudomonas aeruginosa PA01
caggucguugacgaucugcgagc

SEQ ID NO: 1525659 - RNA, 16 nt, Pseudomonas aeruginosa PA01
caggucgucgggcaga

SEQ ID NO: 1525660 - RNA, 22 nt, Pseudomonas aeruginosa PA01
caggucguugcgccggcccagc

SEQ ID NO: 1525661 - RNA, 16 nt, Pseudomonas aeruginosa PA01
caggucggcggcacgc

SEQ ID NO: 1525662 - RNA, 13 nt, Pseudomonas aeruginosa PA01
caggucggcgccg

SEQ ID NO: 1525663 - RNA, 15 nt, Pseudomonas aeruginosa PA01
caggucggcgccggu

SEQ ID NO: 1525664 - RNA, 16 nt, Pseudomonas aeruginosa PA01
caggucggcgccggug

SEQ ID NO: 1525665 - RNA, 18 nt, Pseudomonas aeruginosa PA01
caggucggcgcgacggcc

SEQ ID NO: 1525666 - RNA, 17 nt, Pseudomonas aeruginosa PA01
caggucggcgcgcaccu

SEQ ID NO: 1525667 - RNA, 15 nt, Pseudomonas aeruginosa PA01
caggucggccgccuc

SEQ ID NO: 1525668 - RNA, 15 nt, Pseudomonas aeruginosa PA01
caggucggccugcug

SEQ ID NO: 1525669 - RNA, 14 nt, Pseudomonas aeruginosa PA01
caggucggccgccu

SEQ ID NO: 1525670 - RNA, 15 nt, Pseudomonas aeruginosa PA01
caggucgguccgccg

SEQ ID NO: 1525671 - RNA, 18 nt, Pseudomonas aeruginosa PA01
caggugcaccgcgcugga

SEQ ID NO: 1525672 - RNA, 16 nt, Pseudomonas aeruginosa PA01
caggugcacggccagg

SEQ ID NO: 1525673 - RNA, 14 nt, Pseudomonas aeruginosa PA01
caggugaaaagcgc

SEQ ID NO: 1525674 - RNA, 18 nt, Pseudomonas aeruginosa PA01
caggucaugaaggaaacc

SEQ ID NO: 1525675 - RNA, 23 nt, Pseudomonas aeruginosa PA01
caggucaugaaggaaaccggcca

SEQ ID NO: 1525676 - RNA, 15 nt, Pseudomonas aeruginosa PA01
cagguccaccagcca

SEQ ID NO: 1525677 - RNA, 13 nt, Pseudomonas aeruginosa PA01
cagguagagcagc

SEQ ID NO: 1525678 - RNA, 20 nt, Pseudomonas aeruginosa PA01
cagguagcgcugcgccaggc

SEQ ID NO: 1525679 - RNA, 15 nt, Pseudomonas aeruginosa PA01
cagguagcugagcag

SEQ ID NO: 1525680 - RNA, 17 nt, Pseudomonas aeruginosa PA01
cagguagcuggaaagcu

SEQ ID NO: 1525681 - RNA, 13 nt, Pseudomonas aeruginosa PA01
cagguaggagagg

SEQ ID NO: 1525682 - RNA, 21 nt, Pseudomonas aeruginosa PA01
cagguaggagagggucagcag

SEQ ID NO: 1525683 - RNA, 19 nt, Pseudomonas aeruginosa PA01
cagguaggagaugcagcgu

SEQ ID NO: 1525684 - RNA, 14 nt, Pseudomonas aeruginosa PA01
cagguagugcaaca

SEQ ID NO: 1525685 - RNA, 17 nt, Pseudomonas aeruginosa PA01
cagguagugcucggcca

SEQ ID NO: 1525686 - RNA, 14 nt, Pseudomonas aeruginosa PA01
cagguaggcgcccu

SEQ ID NO: 1525687 - RNA, 21 nt, Pseudomonas aeruginosa PA01
cagguaguccagccagugcau

SEQ ID NO: 1525688 - RNA, 19 nt, Pseudomonas aeruginosa PA01
cagguaguucuccaggccc

SEQ ID NO: 1525689 - RNA, 15 nt, Pseudomonas aeruginosa PA01
cagguacucgccggc

SEQ ID NO: 1525690 - RNA, 18 nt, Pseudomonas aeruginosa PA01
cagguacucgccggcgau

SEQ ID NO: 1525691 - RNA, 21 nt, Pseudomonas aeruginosa PA01
cagguagaagaacaucggcgc

SEQ ID NO: 1525692 - RNA, 14 nt, Pseudomonas aeruginosa PA01
cagguacugggcga

SEQ ID NO: 1525693 - RNA, 13 nt, Pseudomonas aeruginosa PA01
cagguagccaggg

SEQ ID NO: 1525694 - RNA, 15 nt, Pseudomonas aeruginosa PA01
cagguagcccaccuc

SEQ ID NO: 1525695 - RNA, 12 nt, Pseudomonas aeruginosa PA01
cagguagccccg

SEQ ID NO: 1525696 - RNA, 16 nt, Pseudomonas aeruginosa PA01
cagguagccccggccc

SEQ ID NO: 1525697 - RNA, 21 nt, Pseudomonas aeruginosa PA01
cagguagccccggcccggcgu

SEQ ID NO: 1525698 - RNA, 15 nt, Pseudomonas aeruginosa PA01
cagguagccgcgccg

SEQ ID NO: 1525699 - RNA, 19 nt, Pseudomonas aeruginosa PA01
cagguagccugcggccagc

SEQ ID NO: 1525700 - RNA, 22 nt, Pseudomonas aeruginosa PA01
cagguagaccacgcaggccagc

SEQ ID NO: 1525701 - RNA, 23 nt, Pseudomonas aeruginosa PA01
cagguagaccacgcaggccagcg

SEQ ID NO: 1525702 - RNA, 21 nt, Pseudomonas aeruginosa PA01
cagguagaccuugccguugcu

SEQ ID NO: 1525703 - RNA, 16 nt, Pseudomonas aeruginosa PA01
cagguagauguucagu

SEQ ID NO: 1525704 - RNA, 20 nt, Pseudomonas aeruginosa PA01
cagguacagccgcagaugcu

SEQ ID NO: 1525705 - RNA, 22 nt, Pseudomonas aeruginosa PA01
cagguacagcgacucgcugccg

SEQ ID NO: 1525706 - RNA, 16 nt, Pseudomonas aeruginosa PA01
cagguaccggccaggc

SEQ ID NO: 1525707 - RNA, 14 nt, Pseudomonas aeruginosa PA01
cagggcaacgccag

SEQ ID NO: 1525708 - RNA, 14 nt, Pseudomonas aeruginosa PA01
cagguaagcggcgu

SEQ ID NO: 1525709 - RNA, 19 nt, Pseudomonas aeruginosa PA01
cagggauacucaugcaggc

SEQ ID NO: 1525710 - RNA, 20 nt, Pseudomonas aeruginosa PA01
cagggauuccuuggucaggu

SEQ ID NO: 1525711 - RNA, 14 nt, Pseudomonas aeruginosa PA01
ccaaaugauuccug

SEQ ID NO: 1525712 - RNA, 14 nt, Pseudomonas aeruginosa PA01
ccaacgcccgggcc

SEQ ID NO: 1525713 - RNA, 13 nt, Pseudomonas aeruginosa PA01
ccaacgcaggcgc

SEQ ID NO: 1525714 - RNA, 14 nt, Pseudomonas aeruginosa PA01
ccaaccucucccca

SEQ ID NO: 1525715 - RNA, 18 nt, Pseudomonas aeruginosa PA01
ccaacggaaaaaggcgcc

SEQ ID NO: 1525716 - RNA, 21 nt, Pseudomonas aeruginosa PA01
ccaacgucuucaggcgcuccu

SEQ ID NO: 1525717 - RNA, 18 nt, Pseudomonas aeruginosa PA01
ccaacucggccuggaacc

SEQ ID NO: 1525718 - RNA, 19 nt, Pseudomonas aeruginosa PA01
ccaacccgcuucgucccau

SEQ ID NO: 1525719 - RNA, 16 nt, Pseudomonas aeruginosa PA01
ccaacccggccagccc

SEQ ID NO: 1525720 - RNA, 20 nt, Pseudomonas aeruginosa PA01
ccaacagucgucgcgcagcu

SEQ ID NO: 1525721 - RNA, 24 nt, Pseudomonas aeruginosa PA01
ccaacagcagguagaccacgcagg

SEQ ID NO: 1525722 - RNA, 22 nt, Pseudomonas aeruginosa PA01
ccaaccaggaaggcguagaccu

SEQ ID NO: 1525723 - RNA, 14 nt, Pseudomonas aeruginosa PA01
ccaaggcacgcccc

SEQ ID NO: 1525724 - RNA, 16 nt, Pseudomonas aeruginosa PA01
ccaagcuguugcucca

SEQ ID NO: 1525725 - RNA, 17 nt, Pseudomonas aeruginosa PA01
ccaagguuccagccccg

SEQ ID NO: 1525726 - RNA, 22 nt, Pseudomonas aeruginosa PA01
ccaagggccugggcgccgccag

SEQ ID NO: 1525727 - RNA, 20 nt, Pseudomonas aeruginosa PA01
ccaagggcguaaagcaagcc

SEQ ID NO: 1525728 - RNA, 15 nt, Pseudomonas aeruginosa PA01
ccaagucggccgccc

SEQ ID NO: 1525729 - RNA, 20 nt, Pseudomonas aeruginosa PA01
ccaagucggccgcccagcgg

SEQ ID NO: 1525730 - RNA, 18 nt, Pseudomonas aeruginosa PA01
ccaaguugccuggcaggu

SEQ ID NO: 1525731 - RNA, 18 nt, Pseudomonas aeruginosa PA01
ccaagcccggcgagagcg

SEQ ID NO: 1525732 - RNA, 22 nt, Pseudomonas aeruginosa PA01
ccaagcgagacgccgccccagc

SEQ ID NO: 1525733 - RNA, 20 nt, Pseudomonas aeruginosa PA01
ccaagcggauguucuucacc

SEQ ID NO: 1525734 - RNA, 14 nt, Pseudomonas aeruginosa PA01
ccaauacccacagg

SEQ ID NO: 1525735 - RNA, 16 nt, Pseudomonas aeruginosa PA01
ccacacauccagugug

SEQ ID NO: 1525736 - RNA, 11 nt, Pseudomonas aeruginosa PA01
ccacaccaggu

SEQ ID NO: 1525737 - RNA, 20 nt, Pseudomonas aeruginosa PA01
ccacaggguggcgggcggcc

SEQ ID NO: 1525738 - RNA, 22 nt, Pseudomonas aeruginosa PA01
ccacaggcggcggaagaagccc

SEQ ID NO: 1525739 - RNA, 22 nt, Pseudomonas aeruginosa PA01
ccacaggcguuauccgccgccg

SEQ ID NO: 1525740 - RNA, 14 nt, Pseudomonas aeruginosa PA01
ccacaggcccugca

SEQ ID NO: 1525741 - RNA, 17 nt, Pseudomonas aeruginosa PA01
ccacaaacacuguggag

SEQ ID NO: 1525742 - RNA, 22 nt, Pseudomonas aeruginosa PA01
ccaccccaggguuggcggcauc

SEQ ID NO: 1525743 - RNA, 14 nt, Pseudomonas aeruginosa PA01
ccacccccagcccg

SEQ ID NO: 1525744 - RNA, 18 nt, Pseudomonas aeruginosa PA01
ccacccccagcccggcca

SEQ ID NO: 1525745 - RNA, 14 nt, Pseudomonas aeruginosa PA01
ccaccagggccucg

SEQ ID NO: 1525746 - RNA, 23 nt, Pseudomonas aeruginosa PA01
ccaccagggccucggggccgucc

SEQ ID NO: 1525747 - RNA, 15 nt, Pseudomonas aeruginosa PA01
ccaccaggucggcgc

SEQ ID NO: 1525748 - RNA, 11 nt, Pseudomonas aeruginosa PA01
ccaccaggcgc

SEQ ID NO: 1525749 - RNA, 24 nt, Pseudomonas aeruginosa PA01
ccaccaggcgucgcaccugggacu

SEQ ID NO: 1525750 - RNA, 19 nt, Pseudomonas aeruginosa PA01
ccaccagcgcccguagcac

SEQ ID NO: 1525751 - RNA, 15 nt, Pseudomonas aeruginosa PA01
ccaccagcgccgcca

SEQ ID NO: 1525752 - RNA, 19 nt, Pseudomonas aeruginosa PA01
ccaccagcgccgccaccgc

SEQ ID NO: 1525753 - RNA, 20 nt, Pseudomonas aeruginosa PA01
ccaccagcgucgccaggccg

SEQ ID NO: 1525754 - RNA, 13 nt, Pseudomonas aeruginosa PA01
ccaccagcccgca

SEQ ID NO: 1525755 - RNA, 12 nt, Pseudomonas aeruginosa PA01
ccaccagcgccc

SEQ ID NO: 1525756 - RNA, 17 nt, Pseudomonas aeruginosa PA01
ccaccagcagggccagg

SEQ ID NO: 1525757 - RNA, 16 nt, Pseudomonas aeruginosa PA01
ccaccagccagucgag

SEQ ID NO: 1525758 - RNA, 20 nt, Pseudomonas aeruginosa PA01
ccaccagagccagccgcgag

SEQ ID NO: 1525759 - RNA, 16 nt, Pseudomonas aeruginosa PA01
ccacauuuaaaguuuc

SEQ ID NO: 1525760 - RNA, 22 nt, Pseudomonas aeruginosa PA01
ccaccaccaugccuuccaccgg

SEQ ID NO: 1525761 - RNA, 19 nt, Pseudomonas aeruginosa PA01
ccaccaccaucgccgcgga

SEQ ID NO: 1525762 - RNA, 14 nt, Pseudomonas aeruginosa PA01
ccaccaccgacagg

SEQ ID NO: 1525763 - RNA, 14 nt, Pseudomonas aeruginosa PA01
ccaccucgcccucg

SEQ ID NO: 1525764 - RNA, 19 nt, Pseudomonas aeruginosa PA01
ccaccucgcccucgcucca

SEQ ID NO: 1525765 - RNA, 18 nt, Pseudomonas aeruginosa PA01
ccaccuugcgucccuggg

SEQ ID NO: 1525766 - RNA, 20 nt, Pseudomonas aeruginosa PA01
ccaccuugcgucccugggcc

SEQ ID NO: 1525767 - RNA, 22 nt, Pseudomonas aeruginosa PA01
ccaccuucaggcugcucaugcc

SEQ ID NO: 1525768 - RNA, 14 nt, Pseudomonas aeruginosa PA01
ccaccucgccaagc

SEQ ID NO: 1525769 - RNA, 16 nt, Pseudomonas aeruginosa PA01
ccaccucgacccuggc

SEQ ID NO: 1525770 - RNA, 23 nt, Pseudomonas aeruginosa PA01
ccaccgagagcggcgccaggcgu

SEQ ID NO: 1525771 - RNA, 18 nt, Pseudomonas aeruginosa PA01
ccaccguggcgccggcgc

SEQ ID NO: 1525772 - RNA, 14 nt, Pseudomonas aeruginosa PA01
ccacccccggcccg

SEQ ID NO: 1525773 - RNA, 21 nt, Pseudomonas aeruginosa PA01
ccacccuugcguccugccucg

SEQ ID NO: 1525774 - RNA, 22 nt, Pseudomonas aeruginosa PA01
ccaccgaauccuugaucaccuu

SEQ ID NO: 1525775 - RNA, 24 nt, Pseudomonas aeruginosa PA01
ccaccgacaggccgaccagcaggg

SEQ ID NO: 1525776 - RNA, 17 nt, Pseudomonas aeruginosa PA01
ccacggacgcgcagggu

SEQ ID NO: 1525777 - RNA, 21 nt, Pseudomonas aeruginosa PA01
ccacggacgcgcagggucagg

SEQ ID NO: 1525778 - RNA, 21 nt, Pseudomonas aeruginosa PA01
ccacggcacacgucggcaucg

SEQ ID NO: 1525779 - RNA, 17 nt, Pseudomonas aeruginosa PA01
ccacgcugugcggcagc

SEQ ID NO: 1525780 - RNA, 16 nt, Pseudomonas aeruginosa PA01
ccacgcugcugccggc

SEQ ID NO: 1525781 - RNA, 15 nt, Pseudomonas aeruginosa PA01
ccacgcugaucauca

SEQ ID NO: 1525782 - RNA, 15 nt, Pseudomonas aeruginosa PA01
ccacgcugaggcuca

SEQ ID NO: 1525783 - RNA, 17 nt, Pseudomonas aeruginosa PA01
ccacgcccugcgccagc

SEQ ID NO: 1525784 - RNA, 20 nt, Pseudomonas aeruginosa PA01
ccacgcucucgaacagcagc

SEQ ID NO: 1525785 - RNA, 13 nt, Pseudomonas aeruginosa PA01
ccacgcccgcggu

SEQ ID NO: 1525786 - RNA, 17 nt, Pseudomonas aeruginosa PA01
ccacggguaacgguagc

SEQ ID NO: 1525787 - RNA, 14 nt, Pseudomonas aeruginosa PA01
ccacggccagcagg

SEQ ID NO: 1525788 - RNA, 19 nt, Pseudomonas aeruginosa PA01
ccacggccgcugcgcaggc

SEQ ID NO: 1525789 - RNA, 21 nt, Pseudomonas aeruginosa PA01
ccacggcgagagcgccgacca

SEQ ID NO: 1525790 - RNA, 22 nt, Pseudomonas aeruginosa PA01
ccacggcgagagcgccgaccag

SEQ ID NO: 1525791 - RNA, 21 nt, Pseudomonas aeruginosa PA01
ccacggcgccuucccagauac

SEQ ID NO: 1525792 - RNA, 15 nt, Pseudomonas aeruginosa PA01
ccagcagcgagcagg

SEQ ID NO: 1525793 - RNA, 17 nt, Pseudomonas aeruginosa PA01
ccagcagcgagcaggcg

SEQ ID NO: 1525794 - RNA, 17 nt, Pseudomonas aeruginosa PA01
ccagcagcgcaccaucc

SEQ ID NO: 1525795 - RNA, 23 nt, Pseudomonas aeruginosa PA01
ccagcagccccgaggccagcagg

SEQ ID NO: 1525796 - RNA, 14 nt, Pseudomonas aeruginosa PA01
ccagcagcccggcc

SEQ ID NO: 1525797 - RNA, 15 nt, Pseudomonas aeruginosa PA01
ccagcagcccggccu

SEQ ID NO: 1525798 - RNA, 14 nt, Pseudomonas aeruginosa PA01
ccagcagccaggcc

SEQ ID NO: 1525799 - RNA, 15 nt, Pseudomonas aeruginosa PA01
ccagcaucagcagga

SEQ ID NO: 1525800 - RNA, 20 nt, Pseudomonas aeruginosa PA01
ccagcagcgcacgcuucucc

SEQ ID NO: 1525801 - RNA, 12 nt, Pseudomonas aeruginosa PA01
ccagcagcgccu

SEQ ID NO: 1525802 - RNA, 14 nt, Pseudomonas aeruginosa PA01
ccagcagcgccucg

SEQ ID NO: 1525803 - RNA, 18 nt, Pseudomonas aeruginosa PA01
ccagcaugcccagcgugg

SEQ ID NO: 1525804 - RNA, 22 nt, Pseudomonas aeruginosa PA01
ccagcaugcccagcguggccag

SEQ ID NO: 1525805 - RNA, 15 nt, Pseudomonas aeruginosa PA01
ccagcaucguaggga

SEQ ID NO: 1525806 - RNA, 17 nt, Pseudomonas aeruginosa PA01
ccagcaucgccggcagc

SEQ ID NO: 1525807 - RNA, 21 nt, Pseudomonas aeruginosa PA01
ccagccagguguucggccccg

SEQ ID NO: 1525808 - RNA, 14 nt, Pseudomonas aeruginosa PA01
ccagccagggcagc

SEQ ID NO: 1525809 - RNA, 18 nt, Pseudomonas aeruginosa PA01
ccagccagggcagcaggu

SEQ ID NO: 1525810 - RNA, 17 nt, Pseudomonas aeruginosa PA01
ccagccaguccggcagc

SEQ ID NO: 1525811 - RNA, 14 nt, Pseudomonas aeruginosa PA01
ccagccagccgccu

SEQ ID NO: 1525812 - RNA, 11 nt, Pseudomonas aeruginosa PA01
ccagccagccg

SEQ ID NO: 1525813 - RNA, 12 nt, Pseudomonas aeruginosa PA01
ccagccagcucg

SEQ ID NO: 1525814 - RNA, 20 nt, Pseudomonas aeruginosa PA01
ccagccaggaagagcccgcc

SEQ ID NO: 1525815 - RNA, 23 nt, Pseudomonas aeruginosa PA01
ccagccaggaagagcccgccacg

SEQ ID NO: 1525816 - RNA, 14 nt, Pseudomonas aeruginosa PA01
ccagccaggcccgg

SEQ ID NO: 1525817 - RNA, 13 nt, Pseudomonas aeruginosa PA01
ccagccagcagcc

SEQ ID NO: 1525818 - RNA, 20 nt, Pseudomonas aeruginosa PA01
ccagccagcagcccggccug

SEQ ID NO: 1525819 - RNA, 15 nt, Pseudomonas aeruginosa PA01
ccagccagagcagcg

SEQ ID NO: 1525820 - RNA, 16 nt, Pseudomonas aeruginosa PA01
ccagccagagcagcgu

SEQ ID NO: 1525821 - RNA, 15 nt, Pseudomonas aeruginosa PA01
ccagcaaugcccagc

SEQ ID NO: 1525822 - RNA, 17 nt, Pseudomonas aeruginosa PA01
ccagcaaugcccgcgcc

SEQ ID NO: 1525823 - RNA, 23 nt, Pseudomonas aeruginosa PA01
ccagcaaugcccgcgccugggcc

SEQ ID NO: 1525824 - RNA, 15 nt, Pseudomonas aeruginosa PA01
ccagcacccagguag

SEQ ID NO: 1525825 - RNA, 17 nt, Pseudomonas aeruginosa PA01
ccagcagacgcuccuug

SEQ ID NO: 1525826 - RNA, 22 nt, Pseudomonas aeruginosa PA01
ccagcacucgcuccuccgggcg

SEQ ID NO: 1525827 - RNA, 19 nt, Pseudomonas aeruginosa PA01
ccagcacggugaaccaggc

SEQ ID NO: 1525828 - RNA, 20 nt, Pseudomonas aeruginosa PA01
ccagcacggugaaccaggcg

SEQ ID NO: 1525829 - RNA, 17 nt, Pseudomonas aeruginosa PA01
ccagcacguagccgccc

SEQ ID NO: 1525830 - RNA, 21 nt, Pseudomonas aeruginosa PA01
ccagcacuacgcccauggcgg

SEQ ID NO: 1525831 - RNA, 17 nt, Pseudomonas aeruginosa PA01
ccagcaauacccgccgc

SEQ ID NO: 1525832 - RNA, 16 nt, Pseudomonas aeruginosa PA01
ccagcaauagccucag

SEQ ID NO: 1525833 - RNA, 18 nt, Pseudomonas aeruginosa PA01
ccagcaauagccucagua

SEQ ID NO: 1525834 - RNA, 18 nt, Pseudomonas aeruginosa PA01
ccagcaacugaccuggcc

SEQ ID NO: 1525835 - RNA, 19 nt, Pseudomonas aeruginosa PA01
ccagcaagacgguccccag

SEQ ID NO: 1525836 - RNA, 20 nt, Pseudomonas aeruginosa PA01
ccagcaacgugaagcccuuc

SEQ ID NO: 1525837 - RNA, 13 nt, Pseudomonas aeruginosa PA01
ccagcaacgccgc

SEQ ID NO: 1525838 - RNA, 23 nt, Pseudomonas aeruginosa PA01
ccagaugaucaggccgagcaccg

SEQ ID NO: 1525839 - RNA, 17 nt, Pseudomonas aeruginosa PA01
ccagaugaucuucaucc

SEQ ID NO: 1525840 - RNA, 19 nt, Pseudomonas aeruginosa PA01
ccagaugacgauggccgcc

SEQ ID NO: 1525841 - RNA, 21 nt, Pseudomonas aeruginosa PA01
ccagaugacgauggccgccgc

SEQ ID NO: 1525842 - RNA, 23 nt, Pseudomonas aeruginosa PA01
ccagaugacgauggccgccgccg

SEQ ID NO: 1525843 - RNA, 16 nt, Pseudomonas aeruginosa PA01
ccagcaacccaugccg

SEQ ID NO: 1525844 - RNA, 22 nt, Pseudomonas aeruginosa PA01
ccagaucggcgcgcagggccag

SEQ ID NO: 1525845 - RNA, 19 nt, Pseudomonas aeruginosa PA01
ccagaugaaacugcccggc

SEQ ID NO: 1525846 - RNA, 21 nt, Pseudomonas aeruginosa PA01
ccagacauccggguccagcgg

SEQ ID NO: 1525847 - RNA, 14 nt, Pseudomonas aeruginosa PA01
ccagaccagcagcg

SEQ ID NO: 1525848 - RNA, 12 nt, Pseudomonas aeruginosa PA01
ccagaccccggc

SEQ ID NO: 1525849 - RNA, 20 nt, Pseudomonas aeruginosa PA01
ccagaccgagauuggccgcc

SEQ ID NO: 1525850 - RNA, 13 nt, Pseudomonas aeruginosa PA01
ccagaccggcagc

SEQ ID NO: 1525851 - RNA, 19 nt, Pseudomonas aeruginosa PA01
ccagaccggcagcgccgcc

SEQ ID NO: 1525852 - RNA, 16 nt, Pseudomonas aeruginosa PA01
ccagaccucgagcagg

SEQ ID NO: 1525853 - RNA, 20 nt, Pseudomonas aeruginosa PA01
ccagaccugccgcccggcca

SEQ ID NO: 1525854 - RNA, 23 nt, Pseudomonas aeruginosa PA01
ccagaccugccgcccggccaggc

SEQ ID NO: 1525855 - RNA, 14 nt, Pseudomonas aeruginosa PA01
ccagacgaucagcg

SEQ ID NO: 1525856 - RNA, 15 nt, Pseudomonas aeruginosa PA01
ccagacgcucggcca

SEQ ID NO: 1525857 - RNA, 12 nt, Pseudomonas aeruginosa PA01
ccagacgcagca

SEQ ID NO: 1525858 - RNA, 17 nt, Pseudomonas aeruginosa PA01
ccagaggucgagcuggg

SEQ ID NO: 1525859 - RNA, 14 nt, Pseudomonas aeruginosa PA01
ccagaucgccaccc

SEQ ID NO: 1525860 - RNA, 17 nt, Pseudomonas aeruginosa PA01
ccagagcuccagggcug

SEQ ID NO: 1525861 - RNA, 14 nt, Pseudomonas aeruginosa PA01
ccagagcccgccga

SEQ ID NO: 1525862 - RNA, 22 nt, Pseudomonas aeruginosa PA01
ccagagcgcgcccugcaggccg

SEQ ID NO: 1525863 - RNA, 18 nt, Pseudomonas aeruginosa PA01
ccagagaucgcccagcgg

SEQ ID NO: 1525864 - RNA, 18 nt, Pseudomonas aeruginosa PA01
ccagagccaugggccggc

SEQ ID NO: 1525865 - RNA, 16 nt, Pseudomonas aeruginosa PA01
ccagacucuccagguc

SEQ ID NO: 1525866 - RNA, 17 nt, Pseudomonas aeruginosa PA01
ccagacucuccaggucg

SEQ ID NO: 1525867 - RNA, 18 nt, Pseudomonas aeruginosa PA01
ccagacuuccgggcugcg

SEQ ID NO: 1525868 - RNA, 22 nt, Pseudomonas aeruginosa PA01
ccacgucugugccgaggccgcc

SEQ ID NO: 1525869 - RNA, 22 nt, Pseudomonas aeruginosa PA01
ccacgucgagcgggcggucguc

SEQ ID NO: 1525870 - RNA, 13 nt, Pseudomonas aeruginosa PA01
ccagaaaaaagcc

SEQ ID NO: 1525871 - RNA, 16 nt, Pseudomonas aeruginosa PA01
ccagaaacggcugccg

SEQ ID NO: 1525872 - RNA, 18 nt, Pseudomonas aeruginosa PA01
ccagaaucucccgcaggc

SEQ ID NO: 1525873 - RNA, 22 nt, Pseudomonas aeruginosa PA01
ccagaagcggccgaccaggccg

SEQ ID NO: 1525874 - RNA, 18 nt, Pseudomonas aeruginosa PA01
ccagaagcgacuguccaa

SEQ ID NO: 1525875 - RNA, 18 nt, Pseudomonas aeruginosa PA01
ccagguucugccagagcg

SEQ ID NO: 1525876 - RNA, 16 nt, Pseudomonas aeruginosa PA01
ccagguugcccggcuu

SEQ ID NO: 1525877 - RNA, 13 nt, Pseudomonas aeruginosa PA01
ccagguuggccag

SEQ ID NO: 1525878 - RNA, 19 nt, Pseudomonas aeruginosa PA01
ccagguuggccuggcccgg

SEQ ID NO: 1525879 - RNA, 21 nt, Pseudomonas aeruginosa PA01
ccagguuggccuggcccggcg

SEQ ID NO: 1525880 - RNA, 17 nt, Pseudomonas aeruginosa PA01
ccagguguucggccccg

SEQ ID NO: 1525881 - RNA, 20 nt, Pseudomonas aeruginosa PA01
ccagguguucggccccggcc

SEQ ID NO: 1525882 - RNA, 21 nt, Pseudomonas aeruginosa PA01
ccagguguucggccccggcca

SEQ ID NO: 1525883 - RNA, 17 nt, Pseudomonas aeruginosa PA01
ccaggguuuccagcagc

SEQ ID NO: 1525884 - RNA, 19 nt, Pseudomonas aeruginosa PA01
ccaggguuuccagcagcac

SEQ ID NO: 1525885 - RNA, 14 nt, Pseudomonas aeruginosa PA01
ccagguacagccgc

SEQ ID NO: 1525886 - RNA, 16 nt, Pseudomonas aeruginosa PA01
ccagguaaaggccacc

SEQ ID NO: 1525887 - RNA, 19 nt, Pseudomonas aeruginosa PA01
ccagguaaaggccaccaga

SEQ ID NO: 1525888 - RNA, 18 nt, Pseudomonas aeruginosa PA01
ccagggcuucccaggcca

SEQ ID NO: 1525889 - RNA, 20 nt, Pseudomonas aeruginosa PA01
ccagggcgaacagcgccgcg

SEQ ID NO: 1525890 - RNA, 15 nt, Pseudomonas aeruginosa PA01
ccagggcgggccgcu

SEQ ID NO: 1525891 - RNA, 15 nt, Pseudomonas aeruginosa PA01
ccagggcguggucgg

SEQ ID NO: 1525892 - RNA, 23 nt, Pseudomonas aeruginosa PA01
ccagggcguggucggcggccucg

SEQ ID NO: 1525893 - RNA, 18 nt, Pseudomonas aeruginosa PA01
ccaggugcacggccaggc

SEQ ID NO: 1525894 - RNA, 17 nt, Pseudomonas aeruginosa PA01
ccaggucuucuggaaau

SEQ ID NO: 1525895 - RNA, 20 nt, Pseudomonas aeruginosa PA01
ccagguagagcagcccgggc

SEQ ID NO: 1525896 - RNA, 19 nt, Pseudomonas aeruginosa PA01
ccagguacuuggccacgcc

SEQ ID NO: 1525897 - RNA, 20 nt, Pseudomonas aeruginosa PA01
ccagguacuuggccacgccu

SEQ ID NO: 1525898 - RNA, 21 nt, Pseudomonas aeruginosa PA01
ccagguagcggaccccggccu

SEQ ID NO: 1525899 - RNA, 20 nt, Pseudomonas aeruginosa PA01
ccagguacggaucggucccc

SEQ ID NO: 1525900 - RNA, 18 nt, Pseudomonas aeruginosa PA01
ccagguacggcccgcgga

SEQ ID NO: 1525901 - RNA, 19 nt, Pseudomonas aeruginosa PA01
ccagguaccggccaggcgg

SEQ ID NO: 1525902 - RNA, 19 nt, Pseudomonas aeruginosa PA01
ccaggugcaggaagcgccg

SEQ ID NO: 1525903 - RNA, 23 nt, Pseudomonas aeruginosa PA01
ccaggugcaggaagcgccgggcc

SEQ ID NO: 1525904 - RNA, 17 nt, Pseudomonas aeruginosa PA01
ccaggugcgcaggcgcu

SEQ ID NO: 1525905 - RNA, 19 nt, Pseudomonas aeruginosa PA01
ccaggugccaauccgggcg

SEQ ID NO: 1525906 - RNA, 17 nt, Pseudomonas aeruginosa PA01
ccagguggaagcgcgcg

SEQ ID NO: 1525907 - RNA, 16 nt, Pseudomonas aeruginosa PA01
ccagguggcaggccug

SEQ ID NO: 1525908 - RNA, 22 nt, Pseudomonas aeruginosa PA01
ccaggccucggcgcgggccuuc

SEQ ID NO: 1525909 - RNA, 16 nt, Pseudomonas aeruginosa PA01
ccaggccucagaacug

SEQ ID NO: 1525910 - RNA, 14 nt, Pseudomonas aeruginosa PA01
ccaggccucccagc

SEQ ID NO: 1525911 - RNA, 16 nt, Pseudomonas aeruginosa PA01
ccaggccucccagccg

SEQ ID NO: 1525912 - RNA, 20 nt, Pseudomonas aeruginosa PA01
ccaggcaggcgaugaccgcc

SEQ ID NO: 1525913 - RNA, 12 nt, Pseudomonas aeruginosa PA01
ccaggcaggcgg

SEQ ID NO: 1525914 - RNA, 16 nt, Pseudomonas aeruginosa PA01
ccaggcacggcuucag

SEQ ID NO: 1525915 - RNA, 19 nt, Pseudomonas aeruginosa PA01
ccaggcaauggccggcggg

SEQ ID NO: 1525916 - RNA, 15 nt, Pseudomonas aeruginosa PA01
ccaggcagaccagcg

SEQ ID NO: 1525917 - RNA, 17 nt, Pseudomonas aeruginosa PA01
ccaggcagaccaggccg

SEQ ID NO: 1525918 - RNA, 23 nt, Pseudomonas aeruginosa PA01
ccaggcagaucgcgccgagcugg

SEQ ID NO: 1525919 - RNA, 17 nt, Pseudomonas aeruginosa PA01
ccaggcgaggaacagcg

SEQ ID NO: 1525920 - RNA, 18 nt, Pseudomonas aeruginosa PA01
ccaggcgauaucccgccg

SEQ ID NO: 1525921 - RNA, 17 nt, Pseudomonas aeruginosa PA01
ccaggcgauccacagca

SEQ ID NO: 1525922 - RNA, 17 nt, Pseudomonas aeruginosa PA01
ccaggcgcaccagcagg

SEQ ID NO: 1525923 - RNA, 22 nt, Pseudomonas aeruginosa PA01
ccaggcgcaccagcaggcgcaa

SEQ ID NO: 1525924 - RNA, 14 nt, Pseudomonas aeruginosa PA01
ccaggcgaugcgcc

SEQ ID NO: 1525925 - RNA, 21 nt, Pseudomonas aeruginosa PA01
ccaggccuuccagaacgccgc

SEQ ID NO: 1525926 - RNA, 24 nt, Pseudomonas aeruginosa PA01
ccaggccuugcagcaacucgccgc

SEQ ID NO: 1525927 - RNA, 19 nt, Pseudomonas aeruginosa PA01
ccaggcgacgaaacggcuc

SEQ ID NO: 1525928 - RNA, 17 nt, Pseudomonas aeruginosa PA01
ccaggcgcaggcgagga

SEQ ID NO: 1525929 - RNA, 17 nt, Pseudomonas aeruginosa PA01
ccaggcgccagagcgcg

SEQ ID NO: 1525930 - RNA, 16 nt, Pseudomonas aeruginosa PA01
ccaggcgccagggccg

SEQ ID NO: 1525931 - RNA, 14 nt, Pseudomonas aeruginosa PA01
ccaggcgcaccucc

SEQ ID NO: 1525932 - RNA, 14 nt, Pseudomonas aeruginosa PA01
ccaggcgcccaggc

SEQ ID NO: 1525933 - RNA, 15 nt, Pseudomonas aeruginosa PA01
ccaggcgcccaggca

SEQ ID NO: 1525934 - RNA, 20 nt, Pseudomonas aeruginosa PA01
ccaggcgccgaugcccaggc

SEQ ID NO: 1525935 - RNA, 12 nt, Pseudomonas aeruginosa PA01
ccaggcgcgccu

SEQ ID NO: 1525936 - RNA, 21 nt, Pseudomonas aeruginosa PA01
ccaggcgcgaacgcucccagc

SEQ ID NO: 1525937 - RNA, 12 nt, Pseudomonas aeruginosa PA01
ccaggcgcgccg

SEQ ID NO: 1525938 - RNA, 19 nt, Pseudomonas aeruginosa PA01
ccagggccgcgagagguuc

SEQ ID NO: 1525939 - RNA, 18 nt, Pseudomonas aeruginosa PA01
ccagggccugcuccagcg

SEQ ID NO: 1525940 - RNA, 22 nt, Pseudomonas aeruginosa PA01
ccagggcaugggucagcgccag

SEQ ID NO: 1525941 - RNA, 21 nt, Pseudomonas aeruginosa PA01
ccagggcagggaguccgccag

SEQ ID NO: 1525942 - RNA, 24 nt, Pseudomonas aeruginosa PA01
ccagggcagggaguccgccagccg

SEQ ID NO: 1525943 - RNA, 20 nt, Pseudomonas aeruginosa PA01
ccagggccgagcacagggug

SEQ ID NO: 1525944 - RNA, 15 nt, Pseudomonas aeruginosa PA01
ccagggcccagagca

SEQ ID NO: 1525945 - RNA, 18 nt, Pseudomonas aeruginosa PA01
ccagggcccagagcagca

SEQ ID NO: 1525946 - RNA, 19 nt, Pseudomonas aeruginosa PA01
ccagggcccagagcagcac

SEQ ID NO: 1525947 - RNA, 14 nt, Pseudomonas aeruginosa PA01
ccagggccagcagc

SEQ ID NO: 1525948 - RNA, 19 nt, Pseudomonas aeruginosa PA01
ccagggccagcuuggucgg

SEQ ID NO: 1525949 - RNA, 20 nt, Pseudomonas aeruginosa PA01
ccaggcuguggcgcggcugg

SEQ ID NO: 1525950 - RNA, 17 nt, Pseudomonas aeruginosa PA01
ccaggcuuuccaccgcc

SEQ ID NO: 1525951 - RNA, 13 nt, Pseudomonas aeruginosa PA01
ccagggaaaucag

SEQ ID NO: 1525952 - RNA, 18 nt, Pseudomonas aeruginosa PA01
ccaggcgcuccagggcau

SEQ ID NO: 1525953 - RNA, 15 nt, Pseudomonas aeruginosa PA01
ccaggcuuacccgcg

SEQ ID NO: 1525954 - RNA, 23 nt, Pseudomonas aeruginosa PA01
ccaggcgcgcuggaugcccuccu

SEQ ID NO: 1525955 - RNA, 21 nt, Pseudomonas aeruginosa PA01
ccaggcgcgccuggaucagcg

SEQ ID NO: 1525956 - RNA, 17 nt, Pseudomonas aeruginosa PA01
ccagggagcgcucgcgc

SEQ ID NO: 1525957 - RNA, 18 nt, Pseudomonas aeruginosa PA01
ccagggagcgcucgcgca

SEQ ID NO: 1525958 - RNA, 16 nt, Pseudomonas aeruginosa PA01
ccagggacgcgcagcg

SEQ ID NO: 1525959 - RNA, 19 nt, Pseudomonas aeruginosa PA01
ccagggagaacagcagggu

SEQ ID NO: 1525960 - RNA, 21 nt, Pseudomonas aeruginosa PA01
ccagggagaacagcaggguca

SEQ ID NO: 1525961 - RNA, 19 nt, Pseudomonas aeruginosa PA01
ccagggaggcgcuggccag

SEQ ID NO: 1525962 - RNA, 23 nt, Pseudomonas aeruginosa PA01
ccagggaggcgcuggccagcgcu

SEQ ID NO: 1525963 - RNA, 21 nt, Pseudomonas aeruginosa PA01
ccagggagucgcuggccaucu

SEQ ID NO: 1525964 - RNA, 22 nt, Pseudomonas aeruginosa PA01
ccagcucccccacguacuccag

SEQ ID NO: 1525965 - RNA, 17 nt, Pseudomonas aeruginosa PA01
ccagcuccccgucccuc

SEQ ID NO: 1525966 - RNA, 23 nt, Pseudomonas aeruginosa PA01
ccagcucggucagcggcgcagcc

SEQ ID NO: 1525967 - RNA, 18 nt, Pseudomonas aeruginosa PA01
ccagcucauggagcaaca

SEQ ID NO: 1525968 - RNA, 14 nt, Pseudomonas aeruginosa PA01
ccagcucagcucca

SEQ ID NO: 1525969 - RNA, 17 nt, Pseudomonas aeruginosa PA01
ccagcucagcuccaggc

SEQ ID NO: 1525970 - RNA, 18 nt, Pseudomonas aeruginosa PA01
ccagcgugguaccgcugc

SEQ ID NO: 1525971 - RNA, 14 nt, Pseudomonas aeruginosa PA01
ccagcgugcccgcu

SEQ ID NO: 1525972 - RNA, 17 nt, Pseudomonas aeruginosa PA01
ccagcgugcccgcugca

SEQ ID NO: 1525973 - RNA, 22 nt, Pseudomonas aeruginosa PA01
ccagcggcgguagcuccaggcc

SEQ ID NO: 1525974 - RNA, 16 nt, Pseudomonas aeruginosa PA01
ccagcgguugagcagg

SEQ ID NO: 1525975 - RNA, 13 nt, Pseudomonas aeruginosa PA01
ccagcggcgagca

SEQ ID NO: 1525976 - RNA, 12 nt, Pseudomonas aeruginosa PA01
ccagcggccgcg

SEQ ID NO: 1525977 - RNA, 14 nt, Pseudomonas aeruginosa PA01
ccagcggccgcgag

SEQ ID NO: 1525978 - RNA, 18 nt, Pseudomonas aeruginosa PA01
ccagcggccgcgagcgcg

SEQ ID NO: 1525979 - RNA, 12 nt, Pseudomonas aeruginosa PA01
ccagcggcagcg

SEQ ID NO: 1525980 - RNA, 14 nt, Pseudomonas aeruginosa PA01
ccagcggcccggcg

SEQ ID NO: 1525981 - RNA, 13 nt, Pseudomonas aeruginosa PA01
ccagcggcaggca

SEQ ID NO: 1525982 - RNA, 14 nt, Pseudomonas aeruginosa PA01
ccagcggcaggcac

SEQ ID NO: 1525983 - RNA, 19 nt, Pseudomonas aeruginosa PA01
ccagcggcaggugguaagc

SEQ ID NO: 1525984 - RNA, 21 nt, Pseudomonas aeruginosa PA01
ccagcggcauccgccgcuggg

SEQ ID NO: 1525985 - RNA, 18 nt, Pseudomonas aeruginosa PA01
ccagccccaggccgcccu

SEQ ID NO: 1525986 - RNA, 14 nt, Pseudomonas aeruginosa PA01
ccagccccaggcgc

SEQ ID NO: 1525987 - RNA, 14 nt, Pseudomonas aeruginosa PA01
ccagccccaguccc

SEQ ID NO: 1525988 - RNA, 18 nt, Pseudomonas aeruginosa PA01
ccagcccccucgcccucg

SEQ ID NO: 1525989 - RNA, 12 nt, Pseudomonas aeruginosa PA01
ccagccccugcg

SEQ ID NO: 1525990 - RNA, 18 nt, Pseudomonas aeruginosa PA01
ccagcuuccaggcgcgcu

SEQ ID NO: 1525991 - RNA, 13 nt, Pseudomonas aeruginosa PA01
ccagcuugcgcuc

SEQ ID NO: 1525992 - RNA, 21 nt, Pseudomonas aeruginosa PA01
ccagcuugagguaggccagcc

SEQ ID NO: 1525993 - RNA, 15 nt, Pseudomonas aeruginosa PA01
ccagcuucuugccuu

SEQ ID NO: 1525994 - RNA, 21 nt, Pseudomonas aeruginosa PA01
ccagcuggcgacggcucugga

SEQ ID NO: 1525995 - RNA, 15 nt, Pseudomonas aeruginosa PA01
ccagcuggcgcagcc

SEQ ID NO: 1525996 - RNA, 18 nt, Pseudomonas aeruginosa PA01
ccagcucuugcccugcca

SEQ ID NO: 1525997 - RNA, 15 nt, Pseudomonas aeruginosa PA01
ccaggaucgccgggc

SEQ ID NO: 1525998 - RNA, 15 nt, Pseudomonas aeruginosa PA01
ccaggcaagcgcaug

SEQ ID NO: 1525999 - RNA, 21 nt, Pseudomonas aeruginosa PA01
ccaggcaagcgcaugaggcug

SEQ ID NO: 1526000 - RNA, 17 nt, Pseudomonas aeruginosa PA01
ccaggaucggcauggcc

SEQ ID NO: 1526001 - RNA, 17 nt, Pseudomonas aeruginosa PA01
ccaggaucgucggcccg

SEQ ID NO: 1526002 - RNA, 14 nt, Pseudomonas aeruginosa PA01
ccaggagggcugcu

SEQ ID NO: 1526003 - RNA, 23 nt, Pseudomonas aeruginosa PA01
ccaggagggcugcuguccagcgc

SEQ ID NO: 1526004 - RNA, 18 nt, Pseudomonas aeruginosa PA01
ccaggagcgccagcacca

SEQ ID NO: 1526005 - RNA, 21 nt, Pseudomonas aeruginosa PA01
ccaggagcgccagcaccagca

SEQ ID NO: 1526006 - RNA, 23 nt, Pseudomonas aeruginosa PA01
ccaggacucgccaucggccuggg

SEQ ID NO: 1526007 - RNA, 13 nt, Pseudomonas aeruginosa PA01
ccaggaagagccc

SEQ ID NO: 1526008 - RNA, 19 nt, Pseudomonas aeruginosa PA01
ccaggaacgccucugcgcu

SEQ ID NO: 1526009 - RNA, 18 nt, Pseudomonas aeruginosa PA01
ccagcuugucgccuuccu

SEQ ID NO: 1526010 - RNA, 17 nt, Pseudomonas aeruginosa PA01
ccagcuugucggccuug

SEQ ID NO: 1526011 - RNA, 12 nt, Pseudomonas aeruginosa PA01
ccagcuugcgcc

SEQ ID NO: 1526012 - RNA, 17 nt, Pseudomonas aeruginosa PA01
ccagcuuguccacgcca

SEQ ID NO: 1526013 - RNA, 19 nt, Pseudomonas aeruginosa PA01
ccagcuuguaguagcgccc

SEQ ID NO: 1526014 - RNA, 12 nt, Pseudomonas aeruginosa PA01
ccagcuugggca

SEQ ID NO: 1526015 - RNA, 18 nt, Pseudomonas aeruginosa PA01
ccaguuccugcuccuccg

SEQ ID NO: 1526016 - RNA, 15 nt, Pseudomonas aeruginosa PA01
ccaguuccuucuuga

SEQ ID NO: 1526017 - RNA, 23 nt, Pseudomonas aeruginosa PA01
ccaguuccuucuugacccgcugc

SEQ ID NO: 1526018 - RNA, 17 nt, Pseudomonas aeruginosa PA01
ccaguuccuugaggucg

SEQ ID NO: 1526019 - RNA, 15 nt, Pseudomonas aeruginosa PA01
ccaguucaucgagca

SEQ ID NO: 1526020 - RNA, 15 nt, Pseudomonas aeruginosa PA01
ccaguggcgccgcca

SEQ ID NO: 1526021 - RNA, 23 nt, Pseudomonas aeruginosa PA01
ccagugguuccaggagggcugcu

SEQ ID NO: 1526022 - RNA, 18 nt, Pseudomonas aeruginosa PA01
ccaguaccagcaaugccc

SEQ ID NO: 1526023 - RNA, 24 nt, Pseudomonas aeruginosa PA01
ccaguaccagcaaugcccagcgca

SEQ ID NO: 1526024 - RNA, 16 nt, Pseudomonas aeruginosa PA01
ccaguaccacgcagcc

SEQ ID NO: 1526025 - RNA, 15 nt, Pseudomonas aeruginosa PA01
ccaguacacccaggg

SEQ ID NO: 1526026 - RNA, 20 nt, Pseudomonas aeruginosa PA01
ccauaggcuggaucgaucuc

SEQ ID NO: 1526027 - RNA, 19 nt, Pseudomonas aeruginosa PA01
ccauaggccagcaccucga

SEQ ID NO: 1526028 - RNA, 22 nt, Pseudomonas aeruginosa PA01
ccauagaguugcuuggcgcgcu

SEQ ID NO: 1526029 - RNA, 23 nt, Pseudomonas aeruginosa PA01
ccauagcgcgccggguugcgccg

SEQ ID NO: 1526030 - RNA, 19 nt, Pseudomonas aeruginosa PA01
ccauccagucuucgccggc

SEQ ID NO: 1526031 - RNA, 23 nt, Pseudomonas aeruginosa PA01
ccauccagucuucgccggccugc

SEQ ID NO: 1526032 - RNA, 20 nt, Pseudomonas aeruginosa PA01
ccauccaggcuuuccaccgc

SEQ ID NO: 1526033 - RNA, 23 nt, Pseudomonas aeruginosa PA01
ccauccaggcuuuccaccgccag

SEQ ID NO: 1526034 - RNA, 15 nt, Pseudomonas aeruginosa PA01
ccaucaccagcgccg

SEQ ID NO: 1526035 - RNA, 15 nt, Pseudomonas aeruginosa PA01
ccauccagccaggcg

SEQ ID NO: 1526036 - RNA, 15 nt, Pseudomonas aeruginosa PA01
ccaucaccgacaguc

SEQ ID NO: 1526037 - RNA, 17 nt, Pseudomonas aeruginosa PA01
ccaucaccgacaguccc

SEQ ID NO: 1526038 - RNA, 21 nt, Pseudomonas aeruginosa PA01
ccaucaccgacagucccaggc

SEQ ID NO: 1526039 - RNA, 20 nt, Pseudomonas aeruginosa PA01
ccauccuggucgcguuccag

SEQ ID NO: 1526040 - RNA, 11 nt, Pseudomonas aeruginosa PA01
ccauccuccag

SEQ ID NO: 1526041 - RNA, 14 nt, Pseudomonas aeruginosa PA01
ccauccuccagcac

SEQ ID NO: 1526042 - RNA, 21 nt, Pseudomonas aeruginosa PA01
ccauccuccgaggccaccacu

SEQ ID NO: 1526043 - RNA, 19 nt, Pseudomonas aeruginosa PA01
ccaucguucaguugccucu

SEQ ID NO: 1526044 - RNA, 12 nt, Pseudomonas aeruginosa PA01
ccaucgccgcgg

SEQ ID NO: 1526045 - RNA, 19 nt, Pseudomonas aeruginosa PA01
ccaucgccggcgagccgcu

SEQ ID NO: 1526046 - RNA, 21 nt, Pseudomonas aeruginosa PA01
ccaugcaagaacgccgacccu

SEQ ID NO: 1526047 - RNA, 12 nt, Pseudomonas aeruginosa PA01
ccaugaucaucg

SEQ ID NO: 1526048 - RNA, 15 nt, Pseudomonas aeruginosa PA01
ccaugcaggccaggg

SEQ ID NO: 1526049 - RNA, 18 nt, Pseudomonas aeruginosa PA01
ccaugcaggccagggcgg

SEQ ID NO: 1526050 - RNA, 21 nt, Pseudomonas aeruginosa PA01
ccaugcaugauuucguuggcc

SEQ ID NO: 1526051 - RNA, 21 nt, Pseudomonas aeruginosa PA01
ccaugcccuuguccggcccgg

SEQ ID NO: 1526052 - RNA, 18 nt, Pseudomonas aeruginosa PA01
ccaugcccauuacguugu

SEQ ID NO: 1526053 - RNA, 13 nt, Pseudomonas aeruginosa PA01
ccaugcccgcugg

SEQ ID NO: 1526054 - RNA, 21 nt, Pseudomonas aeruginosa PA01
ccaugcccgcugggcaggugg

SEQ ID NO: 1526055 - RNA, 17 nt, Pseudomonas aeruginosa PA01
ccaugcccagacgccgc

SEQ ID NO: 1526056 - RNA, 21 nt, Pseudomonas aeruginosa PA01
ccaugccguagaucaggacga

SEQ ID NO: 1526057 - RNA, 17 nt, Pseudomonas aeruginosa PA01
ccaugccuugcagcgcc

SEQ ID NO: 1526058 - RNA, 17 nt, Pseudomonas aeruginosa PA01
ccaugccguucaggccg

SEQ ID NO: 1526059 - RNA, 20 nt, Pseudomonas aeruginosa PA01
ccaugcccgucgaccaucac

SEQ ID NO: 1526060 - RNA, 19 nt, Pseudomonas aeruginosa PA01
ccaugccgcuagcccugcu

SEQ ID NO: 1526061 - RNA, 16 nt, Pseudomonas aeruginosa PA01
ccaugaacucuucccc

SEQ ID NO: 1526062 - RNA, 19 nt, Pseudomonas aeruginosa PA01
ccaugaaaaaggcgcccgc

SEQ ID NO: 1526063 - RNA, 15 nt, Pseudomonas aeruginosa PA01
ccaucuggaucagga

SEQ ID NO: 1526064 - RNA, 13 nt, Pseudomonas aeruginosa PA01
ccaugagccgggg

SEQ ID NO: 1526065 - RNA, 13 nt, Pseudomonas aeruginosa PA01
cccccugccgccc

SEQ ID NO: 1526066 - RNA, 23 nt, Pseudomonas aeruginosa PA01
cccccuuuuucggcgcggaccgc

SEQ ID NO: 1526067 - RNA, 16 nt, Pseudomonas aeruginosa PA01
ccccggcaagggccug

SEQ ID NO: 1526068 - RNA, 21 nt, Pseudomonas aeruginosa PA01
ccccggcaagggccugcucag

SEQ ID NO: 1526069 - RNA, 15 nt, Pseudomonas aeruginosa PA01
ccccgaccacccugu

SEQ ID NO: 1526070 - RNA, 16 nt, Pseudomonas aeruginosa PA01
ccccgggucgcgcagc

SEQ ID NO: 1526071 - RNA, 19 nt, Pseudomonas aeruginosa PA01
ccccggcgcccagaaaaaa

SEQ ID NO: 1526072 - RNA, 16 nt, Pseudomonas aeruginosa PA01
ccccggccuggcuggc

SEQ ID NO: 1526073 - RNA, 13 nt, Pseudomonas aeruginosa PA01
ccccggccgcgcc

SEQ ID NO: 1526074 - RNA, 15 nt, Pseudomonas aeruginosa PA01
ccccggccgcgccag

SEQ ID NO: 1526075 - RNA, 15 nt, Pseudomonas aeruginosa PA01
ccccggccuccaggc

SEQ ID NO: 1526076 - RNA, 12 nt, Pseudomonas aeruginosa PA01
ccccggccagca

SEQ ID NO: 1526077 - RNA, 13 nt, Pseudomonas aeruginosa PA01
ccccggcccagcc

SEQ ID NO: 1526078 - RNA, 11 nt, Pseudomonas aeruginosa PA01
ccccggcccgg

SEQ ID NO: 1526079 - RNA, 19 nt, Pseudomonas aeruginosa PA01
ccccguuguacccggcgga

SEQ ID NO: 1526080 - RNA, 14 nt, Pseudomonas aeruginosa PA01
ccccguguugcgga

SEQ ID NO: 1526081 - RNA, 19 nt, Pseudomonas aeruginosa PA01
ccccuagaccaacugcgcc

SEQ ID NO: 1526082 - RNA, 19 nt, Pseudomonas aeruginosa PA01
ccccuccaguuccugcucc

SEQ ID NO: 1526083 - RNA, 12 nt, Pseudomonas aeruginosa PA01
ccccucacacca

SEQ ID NO: 1526084 - RNA, 22 nt, Pseudomonas aeruginosa PA01
ccccucagaaguaguaggggaa

SEQ ID NO: 1526085 - RNA, 14 nt, Pseudomonas aeruginosa PA01
ccccguggcgccgc

SEQ ID NO: 1526086 - RNA, 13 nt, Pseudomonas aeruginosa PA01
ccccguggcgggc

SEQ ID NO: 1526087 - RNA, 15 nt, Pseudomonas aeruginosa PA01
ccccggucaggccga

SEQ ID NO: 1526088 - RNA, 20 nt, Pseudomonas aeruginosa PA01
ccccagcccggccauccugg

SEQ ID NO: 1526089 - RNA, 18 nt, Pseudomonas aeruginosa PA01
ccccaggcgauccacagc

SEQ ID NO: 1526090 - RNA, 18 nt, Pseudomonas aeruginosa PA01
ccccaggccgcccuugac

SEQ ID NO: 1526091 - RNA, 23 nt, Pseudomonas aeruginosa PA01
ccccaggccgcccuugaccccac

SEQ ID NO: 1526092 - RNA, 16 nt, Pseudomonas aeruginosa PA01
ccccagcucagcaggu

SEQ ID NO: 1526093 - RNA, 16 nt, Pseudomonas aeruginosa PA01
ccccagcgccugggcc

SEQ ID NO: 1526094 - RNA, 15 nt, Pseudomonas aeruginosa PA01
ccccagggccggcgc

SEQ ID NO: 1526095 - RNA, 17 nt, Pseudomonas aeruginosa PA01
ccccagggccggcgccc

SEQ ID NO: 1526096 - RNA, 22 nt, Pseudomonas aeruginosa PA01
ccccaguagcgcuucgcgcagc

SEQ ID NO: 1526097 - RNA, 16 nt, Pseudomonas aeruginosa PA01
ccccauguaccucugg

SEQ ID NO: 1526098 - RNA, 21 nt, Pseudomonas aeruginosa PA01
cccccggcccggccauccugg

SEQ ID NO: 1526099 - RNA, 12 nt, Pseudomonas aeruginosa PA01
cccccggcgccc

SEQ ID NO: 1526100 - RNA, 14 nt, Pseudomonas aeruginosa PA01
cccauccgccgcag

SEQ ID NO: 1526101 - RNA, 13 nt, Pseudomonas aeruginosa PA01
cccaucaggaugc

SEQ ID NO: 1526102 - RNA, 17 nt, Pseudomonas aeruginosa PA01
cccaucaacgagccgag

SEQ ID NO: 1526103 - RNA, 20 nt, Pseudomonas aeruginosa PA01
cccaucucgguguccaccac

SEQ ID NO: 1526104 - RNA, 20 nt, Pseudomonas aeruginosa PA01
cccaucugccggccaccauc

SEQ ID NO: 1526105 - RNA, 20 nt, Pseudomonas aeruginosa PA01
cccaugaaaaagccccgccg

SEQ ID NO: 1526106 - RNA, 24 nt, Pseudomonas aeruginosa PA01
cccaucgccgaagacgccugucgg

SEQ ID NO: 1526107 - RNA, 18 nt, Pseudomonas aeruginosa PA01
cccaucgccaccagcagg

SEQ ID NO: 1526108 - RNA, 14 nt, Pseudomonas aeruginosa PA01
cccaucgccuccac

SEQ ID NO: 1526109 - RNA, 15 nt, Pseudomonas aeruginosa PA01
cccaguucgcugccg

SEQ ID NO: 1526110 - RNA, 21 nt, Pseudomonas aeruginosa PA01
cccaguucgcugccgccgcgc

SEQ ID NO: 1526111 - RNA, 15 nt, Pseudomonas aeruginosa PA01
cccagugguuccagg

SEQ ID NO: 1526112 - RNA, 19 nt, Pseudomonas aeruginosa PA01
cccagugguuccaggaggg

SEQ ID NO: 1526113 - RNA, 18 nt, Pseudomonas aeruginosa PA01
cccaguucuucgccgccc

SEQ ID NO: 1526114 - RNA, 19 nt, Pseudomonas aeruginosa PA01
cccaguucuucgccgcccg

SEQ ID NO: 1526115 - RNA, 13 nt, Pseudomonas aeruginosa PA01
cccaguugggcca

SEQ ID NO: 1526116 - RNA, 16 nt, Pseudomonas aeruginosa PA01
cccaguugggccagga

SEQ ID NO: 1526117 - RNA, 15 nt, Pseudomonas aeruginosa PA01
cccaguugcgccgcc

SEQ ID NO: 1526118 - RNA, 15 nt, Pseudomonas aeruginosa PA01
cccauaccgccucgg

SEQ ID NO: 1526119 - RNA, 16 nt, Pseudomonas aeruginosa PA01
cccagccacagagguc

SEQ ID NO: 1526120 - RNA, 14 nt, Pseudomonas aeruginosa PA01
cccagcaucgccgg

SEQ ID NO: 1526121 - RNA, 19 nt, Pseudomonas aeruginosa PA01
cccagcaucgccggcagcg

SEQ ID NO: 1526122 - RNA, 15 nt, Pseudomonas aeruginosa PA01
cccagccagggccgc

SEQ ID NO: 1526123 - RNA, 18 nt, Pseudomonas aeruginosa PA01
cccagcucguccaggcaa

SEQ ID NO: 1526124 - RNA, 12 nt, Pseudomonas aeruginosa PA01
cccagcccaggg

SEQ ID NO: 1526125 - RNA, 20 nt, Pseudomonas aeruginosa PA01
cccagccauugagcgcgccc

SEQ ID NO: 1526126 - RNA, 12 nt, Pseudomonas aeruginosa PA01
cccaggccgccg

SEQ ID NO: 1526127 - RNA, 23 nt, Pseudomonas aeruginosa PA01
cccaggacaacgacagccccggc

SEQ ID NO: 1526128 - RNA, 16 nt, Pseudomonas aeruginosa PA01
cccagcuugcuggcgu

SEQ ID NO: 1526129 - RNA, 12 nt, Pseudomonas aeruginosa PA01
cccagcuuggcc

SEQ ID NO: 1526130 - RNA, 20 nt, Pseudomonas aeruginosa PA01
cccaggccgggucgcagccg

SEQ ID NO: 1526131 - RNA, 18 nt, Pseudomonas aeruginosa PA01
cccaggccgucgagggca

SEQ ID NO: 1526132 - RNA, 19 nt, Pseudomonas aeruginosa PA01
cccaggccgcgcagcaacg

SEQ ID NO: 1526133 - RNA, 14 nt, Pseudomonas aeruginosa PA01
cccaggccugggug

SEQ ID NO: 1526134 - RNA, 22 nt, Pseudomonas aeruginosa PA01
cccaggcgauccacagcagguu

SEQ ID NO: 1526135 - RNA, 17 nt, Pseudomonas aeruginosa PA01
cccaggcgcccaggcag

SEQ ID NO: 1526136 - RNA, 18 nt, Pseudomonas aeruginosa PA01
cccagugcgagucggcga

SEQ ID NO: 1526137 - RNA, 21 nt, Pseudomonas aeruginosa PA01
cccagucccuucagcgcaccg

SEQ ID NO: 1526138 - RNA, 18 nt, Pseudomonas aeruginosa PA01
cccaguacccgcugguaa

SEQ ID NO: 1526139 - RNA, 22 nt, Pseudomonas aeruginosa PA01
cccaggcgcucggcggcgcgca

SEQ ID NO: 1526140 - RNA, 16 nt, Pseudomonas aeruginosa PA01
cccaggcgucgcgcca

SEQ ID NO: 1526141 - RNA, 17 nt, Pseudomonas aeruginosa PA01
cccaggcgucgcgccag

SEQ ID NO: 1526142 - RNA, 15 nt, Pseudomonas aeruginosa PA01
cccaggcugacccgg

SEQ ID NO: 1526143 - RNA, 15 nt, Pseudomonas aeruginosa PA01
cccaggcugccgccg

SEQ ID NO: 1526144 - RNA, 16 nt, Pseudomonas aeruginosa PA01
cccaggugcgcaggcg

SEQ ID NO: 1526145 - RNA, 24 nt, Pseudomonas aeruginosa PA01
cccaggugcgccgagcgcucgccg

SEQ ID NO: 1526146 - RNA, 16 nt, Pseudomonas aeruginosa PA01
cccagguggcaggccu

SEQ ID NO: 1526147 - RNA, 18 nt, Pseudomonas aeruginosa PA01
cccagguggcaggccugg

SEQ ID NO: 1526148 - RNA, 16 nt, Pseudomonas aeruginosa PA01
cccagguuggcgaaca

SEQ ID NO: 1526149 - RNA, 20 nt, Pseudomonas aeruginosa PA01
cccagguucuggucgccgac

SEQ ID NO: 1526150 - RNA, 21 nt, Pseudomonas aeruginosa PA01
cccagguggucgaccaggcgu

SEQ ID NO: 1526151 - RNA, 12 nt, Pseudomonas aeruginosa PA01
ccauggcauccc

SEQ ID NO: 1526152 - RNA, 13 nt, Pseudomonas aeruginosa PA01
ccaugcucgccac

SEQ ID NO: 1526153 - RNA, 15 nt, Pseudomonas aeruginosa PA01
ccaugcucggccagc

SEQ ID NO: 1526154 - RNA, 14 nt, Pseudomonas aeruginosa PA01
ccaugcucuucagg

SEQ ID NO: 1526155 - RNA, 18 nt, Pseudomonas aeruginosa PA01
ccaugcuccgccuggcgg

SEQ ID NO: 1526156 - RNA, 18 nt, Pseudomonas aeruginosa PA01
ccaugcggaucgccuccg

SEQ ID NO: 1526157 - RNA, 16 nt, Pseudomonas aeruginosa PA01
ccauggucuuuccuuu

SEQ ID NO: 1526158 - RNA, 19 nt, Pseudomonas aeruginosa PA01
ccaugggcgcguucucccu

SEQ ID NO: 1526159 - RNA, 17 nt, Pseudomonas aeruginosa PA01
ccauguaccucuggcug

SEQ ID NO: 1526160 - RNA, 22 nt, Pseudomonas aeruginosa PA01
ccauggcgcuucaucuccugcu

SEQ ID NO: 1526161 - RNA, 13 nt, Pseudomonas aeruginosa PA01
ccauggcggacau

SEQ ID NO: 1526162 - RNA, 18 nt, Pseudomonas aeruginosa PA01
ccauggcgacgcauggau

SEQ ID NO: 1526163 - RNA, 18 nt, Pseudomonas aeruginosa PA01
ccaugugcuugaccgccg

SEQ ID NO: 1526164 - RNA, 18 nt, Pseudomonas aeruginosa PA01
ccauugcgccaggaccau

SEQ ID NO: 1526165 - RNA, 14 nt, Pseudomonas aeruginosa PA01
ccauuccuuccagg

SEQ ID NO: 1526166 - RNA, 15 nt, Pseudomonas aeruginosa PA01
ccauuccuuccaggg

SEQ ID NO: 1526167 - RNA, 20 nt, Pseudomonas aeruginosa PA01
ccauucaugggcgcacuccg

SEQ ID NO: 1526168 - RNA, 23 nt, Pseudomonas aeruginosa PA01
cccaauugcccguagggcgaaca

SEQ ID NO: 1526169 - RNA, 14 nt, Pseudomonas aeruginosa PA01
cccacaaagucacu

SEQ ID NO: 1526170 - RNA, 17 nt, Pseudomonas aeruginosa PA01
cccacaggcccugcagc

SEQ ID NO: 1526171 - RNA, 21 nt, Pseudomonas aeruginosa PA01
cccacaggcccugcagcgcca

SEQ ID NO: 1526172 - RNA, 18 nt, Pseudomonas aeruginosa PA01
cccacaggccggcuaacc

SEQ ID NO: 1526173 - RNA, 19 nt, Pseudomonas aeruginosa PA01
cccaccgaauaccagggcu

SEQ ID NO: 1526174 - RNA, 14 nt, Pseudomonas aeruginosa PA01
cccacccgucccgc

SEQ ID NO: 1526175 - RNA, 23 nt, Pseudomonas aeruginosa PA01
cccaaggccaggcgauacgcggc

SEQ ID NO: 1526176 - RNA, 13 nt, Pseudomonas aeruginosa PA01
cccaaggccaggu

SEQ ID NO: 1526177 - RNA, 22 nt, Pseudomonas aeruginosa PA01
cccaagggccugggcgccgcca

SEQ ID NO: 1526178 - RNA, 16 nt, Pseudomonas aeruginosa PA01
cccaaccuucucccuu

SEQ ID NO: 1526179 - RNA, 16 nt, Pseudomonas aeruginosa PA01
cccacgacgcacucau

SEQ ID NO: 1526180 - RNA, 16 nt, Pseudomonas aeruginosa PA01
cccacgcauuggcuuc

SEQ ID NO: 1526181 - RNA, 21 nt, Pseudomonas aeruginosa PA01
cccacuccccagcaggcaggc

SEQ ID NO: 1526182 - RNA, 12 nt, Pseudomonas aeruginosa PA01
cccacuuccucg

SEQ ID NO: 1526183 - RNA, 15 nt, Pseudomonas aeruginosa PA01
cccacuuccggcccg

SEQ ID NO: 1526184 - RNA, 17 nt, Pseudomonas aeruginosa PA01
cccacuuccggcccggc

SEQ ID NO: 1526185 - RNA, 22 nt, Pseudomonas aeruginosa PA01
cccagaaaccgaucagcaccgc

SEQ ID NO: 1526186 - RNA, 13 nt, Pseudomonas aeruginosa PA01
cccagaccccauc

SEQ ID NO: 1526187 - RNA, 14 nt, Pseudomonas aeruginosa PA01
cccagacccucucc

SEQ ID NO: 1526188 - RNA, 15 nt, Pseudomonas aeruginosa PA01
cccagacccucuccc

SEQ ID NO: 1526189 - RNA, 18 nt, Pseudomonas aeruginosa PA01
cccagacaggccugugga

SEQ ID NO: 1526190 - RNA, 16 nt, Pseudomonas aeruginosa PA01
cccagacacgccucaa

SEQ ID NO: 1526191 - RNA, 15 nt, Pseudomonas aeruginosa PA01
cccagaagccccaga

SEQ ID NO: 1526192 - RNA, 15 nt, Pseudomonas aeruginosa PA01
cccagaaggccaggg

SEQ ID NO: 1526193 - RNA, 15 nt, Pseudomonas aeruginosa PA01
cccagacguccagcg

SEQ ID NO: 1526194 - RNA, 16 nt, Pseudomonas aeruginosa PA01
cccagacguccagcgc

SEQ ID NO: 1526195 - RNA, 13 nt, Pseudomonas aeruginosa PA01
cccagagcccgcc

SEQ ID NO: 1526196 - RNA, 14 nt, Pseudomonas aeruginosa PA01
cccagagcgcgccc

SEQ ID NO: 1526197 - RNA, 17 nt, Pseudomonas aeruginosa PA01
cccagaccacccggcug

SEQ ID NO: 1526198 - RNA, 19 nt, Pseudomonas aeruginosa PA01
cccagaccuggccgcugug

SEQ ID NO: 1526199 - RNA, 18 nt, Pseudomonas aeruginosa PA01
cccagaccuuccagccgc

SEQ ID NO: 1526200 - RNA, 19 nt, Pseudomonas aeruginosa PA01
cccagaguucgcccagcuc

SEQ ID NO: 1526201 - RNA, 18 nt, Pseudomonas aeruginosa PA01
cccagaucgccagcgcca

SEQ ID NO: 1526202 - RNA, 17 nt, Pseudomonas aeruginosa PA01
cccagauccccugcagg

SEQ ID NO: 1526203 - RNA, 15 nt, Pseudomonas aeruginosa PA01
cgaccgccaggccga

SEQ ID NO: 1526204 - RNA, 17 nt, Pseudomonas aeruginosa PA01
cgaccgccugcucgcgg

SEQ ID NO: 1526205 - RNA, 20 nt, Pseudomonas aeruginosa PA01
cgaccgcgaguucgccggcc

SEQ ID NO: 1526206 - RNA, 17 nt, Pseudomonas aeruginosa PA01
cgaccgcgcgccugcaa

SEQ ID NO: 1526207 - RNA, 13 nt, Pseudomonas aeruginosa PA01
cgaccgcggcgcu

SEQ ID NO: 1526208 - RNA, 13 nt, Pseudomonas aeruginosa PA01
cgaccgcuggacc

SEQ ID NO: 1526209 - RNA, 14 nt, Pseudomonas aeruginosa PA01
cgacccgcuccgga

SEQ ID NO: 1526210 - RNA, 13 nt, Pseudomonas aeruginosa PA01
cgacccgcugaag

SEQ ID NO: 1526211 - RNA, 18 nt, Pseudomonas aeruginosa PA01
cgacccuggccgcgcggc

SEQ ID NO: 1526212 - RNA, 14 nt, Pseudomonas aeruginosa PA01
cgaccggcgccggg

SEQ ID NO: 1526213 - RNA, 18 nt, Pseudomonas aeruginosa PA01
cgaccgguuccagcggcc

SEQ ID NO: 1526214 - RNA, 21 nt, Pseudomonas aeruginosa PA01
cgaccgguuccagcggccgcg

SEQ ID NO: 1526215 - RNA, 16 nt, Pseudomonas aeruginosa PA01
cgaccgucgccacgcu

SEQ ID NO: 1526216 - RNA, 18 nt, Pseudomonas aeruginosa PA01
cgaccuggggcggccuca

SEQ ID NO: 1526217 - RNA, 15 nt, Pseudomonas aeruginosa PA01
cgaccuggccacgcc

SEQ ID NO: 1526218 - RNA, 18 nt, Pseudomonas aeruginosa PA01
cgaccugcucgcgcaccg

SEQ ID NO: 1526219 - RNA, 19 nt, Pseudomonas aeruginosa PA01
cgaccugcucgcgcaccgc

SEQ ID NO: 1526220 - RNA, 19 nt, Pseudomonas aeruginosa PA01
cgaccugcggugucccuuc

SEQ ID NO: 1526221 - RNA, 21 nt, Pseudomonas aeruginosa PA01
cgaccugcucgaaccggaaaa

SEQ ID NO: 1526222 - RNA, 14 nt, Pseudomonas aeruginosa PA01
cgaccucggccgcc

SEQ ID NO: 1526223 - RNA, 21 nt, Pseudomonas aeruginosa PA01
cgaccucagaccacgcccugc

SEQ ID NO: 1526224 - RNA, 14 nt, Pseudomonas aeruginosa PA01
cgaccuccaggccg

SEQ ID NO: 1526225 - RNA, 13 nt, Pseudomonas aeruginosa PA01
cgaccucgcgggc

SEQ ID NO: 1526226 - RNA, 14 nt, Pseudomonas aeruginosa PA01
cgaccucgcgggcg

SEQ ID NO: 1526227 - RNA, 16 nt, Pseudomonas aeruginosa PA01
cgaccucgcgggcgac

SEQ ID NO: 1526228 - RNA, 17 nt, Pseudomonas aeruginosa PA01
cgaccuccgccgcuucc

SEQ ID NO: 1526229 - RNA, 22 nt, Pseudomonas aeruginosa PA01
cgacgccccccacucgcguagc

SEQ ID NO: 1526230 - RNA, 15 nt, Pseudomonas aeruginosa PA01
cgacgcccuccagca

SEQ ID NO: 1526231 - RNA, 19 nt, Pseudomonas aeruginosa PA01
cgacgcccucggcgacgag

SEQ ID NO: 1526232 - RNA, 19 nt, Pseudomonas aeruginosa PA01
cgacgccauggguggaacc

SEQ ID NO: 1526233 - RNA, 13 nt, Pseudomonas aeruginosa PA01
cgacgccacccgc

SEQ ID NO: 1526234 - RNA, 12 nt, Pseudomonas aeruginosa PA01
cgacgccgcgau

SEQ ID NO: 1526235 - RNA, 12 nt, Pseudomonas aeruginosa PA01
cgacgccgagcc

SEQ ID NO: 1526236 - RNA, 15 nt, Pseudomonas aeruginosa PA01
cgacgccgcgcugca

SEQ ID NO: 1526237 - RNA, 18 nt, Pseudomonas aeruginosa PA01
cgacgccgcuggcggcgc

SEQ ID NO: 1526238 - RNA, 18 nt, Pseudomonas aeruginosa PA01
cgacgccggacgcaccag

SEQ ID NO: 1526239 - RNA, 16 nt, Pseudomonas aeruginosa PA01
cgacgcagcgcgcgcc

SEQ ID NO: 1526240 - RNA, 23 nt, Pseudomonas aeruginosa PA01
cgacgauguuguugcccaccagc

SEQ ID NO: 1526241 - RNA, 19 nt, Pseudomonas aeruginosa PA01
cgacgcacucauagcucag

SEQ ID NO: 1526242 - RNA, 21 nt, Pseudomonas aeruginosa PA01
cgacgaguaaaacggcaggca

SEQ ID NO: 1526243 - RNA, 14 nt, Pseudomonas aeruginosa PA01
cgacgaaggcgcgc

SEQ ID NO: 1526244 - RNA, 20 nt, Pseudomonas aeruginosa PA01
cgacgaaggucggcggcagc

SEQ ID NO: 1526245 - RNA, 15 nt, Pseudomonas aeruginosa PA01
cgacgaagcgccggc

SEQ ID NO: 1526246 - RNA, 22 nt, Pseudomonas aeruginosa PA01
cgacgaagcgccggcggccugc

SEQ ID NO: 1526247 - RNA, 16 nt, Pseudomonas aeruginosa PA01
cgacgacugcggcagc

SEQ ID NO: 1526248 - RNA, 17 nt, Pseudomonas aeruginosa PA01
cgacgaggcgcggcgga

SEQ ID NO: 1526249 - RNA, 22 nt, Pseudomonas aeruginosa PA01
cgacgaggaacgccucgcagag

SEQ ID NO: 1526250 - RNA, 20 nt, Pseudomonas aeruginosa PA01
cgacgagccggacggcggcg

SEQ ID NO: 1526251 - RNA, 21 nt, Pseudomonas aeruginosa PA01
cgacgagccggacggcggcgu

SEQ ID NO: 1526252 - RNA, 18 nt, Pseudomonas aeruginosa PA01
cgaccuucaccaccagcg

SEQ ID NO: 1526253 - RNA, 15 nt, Pseudomonas aeruginosa PA01
cgaccuugccgagcg

SEQ ID NO: 1526254 - RNA, 21 nt, Pseudomonas aeruginosa PA01
cgaccuugcgcaccagggcca

SEQ ID NO: 1526255 - RNA, 23 nt, Pseudomonas aeruginosa PA01
cgaccuugcuggugcccugggcg

SEQ ID NO: 1526256 - RNA, 20 nt, Pseudomonas aeruginosa PA01
cgaccuugcccucggcgccc

SEQ ID NO: 1526257 - RNA, 17 nt, Pseudomonas aeruginosa PA01
cgacgaagcccaggcug

SEQ ID NO: 1526258 - RNA, 14 nt, Pseudomonas aeruginosa PA01
cgacgaacggcgcu

SEQ ID NO: 1526259 - RNA, 16 nt, Pseudomonas aeruginosa PA01
cgacgaaagaagccgc

SEQ ID NO: 1526260 - RNA, 21 nt, Pseudomonas aeruginosa PA01
cgacgaaauagucgcgggccu

SEQ ID NO: 1526261 - RNA, 14 nt, Pseudomonas aeruginosa PA01
cgaccuuggccagc

SEQ ID NO: 1526262 - RNA, 14 nt, Pseudomonas aeruginosa PA01
cgaccagcggcggu

SEQ ID NO: 1526263 - RNA, 20 nt, Pseudomonas aeruginosa PA01
cgaccagcgucgcgcgugcc

SEQ ID NO: 1526264 - RNA, 21 nt, Pseudomonas aeruginosa PA01
cgaccagcgucgcgcgugccc

SEQ ID NO: 1526265 - RNA, 19 nt, Pseudomonas aeruginosa PA01
cgaccagccgcaggcugcc

SEQ ID NO: 1526266 - RNA, 16 nt, Pseudomonas aeruginosa PA01
cgaccagcgccgcggc

SEQ ID NO: 1526267 - RNA, 17 nt, Pseudomonas aeruginosa PA01
cgaccacgcucuugauc

SEQ ID NO: 1526268 - RNA, 15 nt, Pseudomonas aeruginosa PA01
cgaccacgacccggg

SEQ ID NO: 1526269 - RNA, 18 nt, Pseudomonas aeruginosa PA01
cgaccacgacccgggucu

SEQ ID NO: 1526270 - RNA, 19 nt, Pseudomonas aeruginosa PA01
cgaccaccucggcgucggc

SEQ ID NO: 1526271 - RNA, 19 nt, Pseudomonas aeruginosa PA01
cgaccaccgcguggugcug

SEQ ID NO: 1526272 - RNA, 18 nt, Pseudomonas aeruginosa PA01
cgaccaguaccagcaaug

SEQ ID NO: 1526273 - RNA, 15 nt, Pseudomonas aeruginosa PA01
cgaccaguaccaggc

SEQ ID NO: 1526274 - RNA, 14 nt, Pseudomonas aeruginosa PA01
cgaccagggccggg

SEQ ID NO: 1526275 - RNA, 22 nt, Pseudomonas aeruginosa PA01
cgaccagguagagcagcccggg

SEQ ID NO: 1526276 - RNA, 13 nt, Pseudomonas aeruginosa PA01
cgaccaggacagc

SEQ ID NO: 1526277 - RNA, 13 nt, Pseudomonas aeruginosa PA01
cgaccaucaccag

SEQ ID NO: 1526278 - RNA, 20 nt, Pseudomonas aeruginosa PA01
cgaccaucggcggcggcccg

SEQ ID NO: 1526279 - RNA, 21 nt, Pseudomonas aeruginosa PA01
cgaccccacgccggccggcuc

SEQ ID NO: 1526280 - RNA, 20 nt, Pseudomonas aeruginosa PA01
cgaccauguucaccagcgcu

SEQ ID NO: 1526281 - RNA, 14 nt, Pseudomonas aeruginosa PA01
cgacccagaccugc

SEQ ID NO: 1526282 - RNA, 19 nt, Pseudomonas aeruginosa PA01
cgacccagaccugccgccc

SEQ ID NO: 1526283 - RNA, 17 nt, Pseudomonas aeruginosa PA01
cgacccagagcgcgccc

SEQ ID NO: 1526284 - RNA, 18 nt, Pseudomonas aeruginosa PA01
cgacaucgacgcccucgg

SEQ ID NO: 1526285 - RNA, 13 nt, Pseudomonas aeruginosa PA01
cgacaugccccgc

SEQ ID NO: 1526286 - RNA, 18 nt, Pseudomonas aeruginosa PA01
cgacaugcaggccggccu

SEQ ID NO: 1526287 - RNA, 15 nt, Pseudomonas aeruginosa PA01
cgacaugcucaucuu

SEQ ID NO: 1526288 - RNA, 18 nt, Pseudomonas aeruginosa PA01
cgacagccccggcccggu

SEQ ID NO: 1526289 - RNA, 20 nt, Pseudomonas aeruginosa PA01
cgacagcaggucgugcugga

SEQ ID NO: 1526290 - RNA, 15 nt, Pseudomonas aeruginosa PA01
cgacaggcagcgccg

SEQ ID NO: 1526291 - RNA, 22 nt, Pseudomonas aeruginosa PA01
cgacaggccauucuucuccaga

SEQ ID NO: 1526292 - RNA, 13 nt, Pseudomonas aeruginosa PA01
cgacaggccgacc

SEQ ID NO: 1526293 - RNA, 18 nt, Pseudomonas aeruginosa PA01
cgacaggccgaccagcag

SEQ ID NO: 1526294 - RNA, 20 nt, Pseudomonas aeruginosa PA01
cgacaggccgaccagcaggg

SEQ ID NO: 1526295 - RNA, 21 nt, Pseudomonas aeruginosa PA01
cgacagcggcuggcgcuugcc

SEQ ID NO: 1526296 - RNA, 20 nt, Pseudomonas aeruginosa PA01
cgacagcgucguaguggcgc

SEQ ID NO: 1526297 - RNA, 14 nt, Pseudomonas aeruginosa PA01
cgacagcgaaugcu

SEQ ID NO: 1526298 - RNA, 21 nt, Pseudomonas aeruginosa PA01
cgacaggcggcgggccggcgu

SEQ ID NO: 1526299 - RNA, 15 nt, Pseudomonas aeruginosa PA01
cgacaggcuggugcc

SEQ ID NO: 1526300 - RNA, 14 nt, Pseudomonas aeruginosa PA01
cgacaggucggcga

SEQ ID NO: 1526301 - RNA, 16 nt, Pseudomonas aeruginosa PA01
cgacagucagaacaca

SEQ ID NO: 1526302 - RNA, 16 nt, Pseudomonas aeruginosa PA01
cgacagucccaggcca

SEQ ID NO: 1526303 - RNA, 13 nt, Pseudomonas aeruginosa PA01
cgacagguucagg

SEQ ID NO: 1526304 - RNA, 16 nt, Pseudomonas aeruginosa PA01
cgacagguucaggacg

SEQ ID NO: 1526305 - RNA, 22 nt, Pseudomonas aeruginosa PA01
cgacagguucaggacgcuccug

SEQ ID NO: 1526306 - RNA, 21 nt, Pseudomonas aeruginosa PA01
cgaauuggacagcaggcugcc

SEQ ID NO: 1526307 - RNA, 19 nt, Pseudomonas aeruginosa PA01
cgaaugugaauaacguguu

SEQ ID NO: 1526308 - RNA, 18 nt, Pseudomonas aeruginosa PA01
cgaaugagcugcucuacc

SEQ ID NO: 1526309 - RNA, 13 nt, Pseudomonas aeruginosa PA01
cgaaugcccggca

SEQ ID NO: 1526310 - RNA, 19 nt, Pseudomonas aeruginosa PA01
cgaaugcccgugcgcugcg

SEQ ID NO: 1526311 - RNA, 23 nt, Pseudomonas aeruginosa PA01
cgaauggcagcaggcacagggcg

SEQ ID NO: 1526312 - RNA, 20 nt, Pseudomonas aeruginosa PA01
cgaauggcauucagcucgau

SEQ ID NO: 1526313 - RNA, 15 nt, Pseudomonas aeruginosa PA01
cgaauacaccgagcg

SEQ ID NO: 1526314 - RNA, 18 nt, Pseudomonas aeruginosa PA01
cgaauaacgccacaggcg

SEQ ID NO: 1526315 - RNA, 20 nt, Pseudomonas aeruginosa PA01
cgaauacugcacgcccaggc

SEQ ID NO: 1526316 - RNA, 21 nt, Pseudomonas aeruginosa PA01
cgaauagggcggcgccaccgc

SEQ ID NO: 1526317 - RNA, 18 nt, Pseudomonas aeruginosa PA01
cgaaucccuuggcugcuc

SEQ ID NO: 1526318 - RNA, 13 nt, Pseudomonas aeruginosa PA01
cgaauccuccagc

SEQ ID NO: 1526319 - RNA, 15 nt, Pseudomonas aeruginosa PA01
cgaauccuugaucac

SEQ ID NO: 1526320 - RNA, 16 nt, Pseudomonas aeruginosa PA01
cgacagcacgauggcg

SEQ ID NO: 1526321 - RNA, 22 nt, Pseudomonas aeruginosa PA01
cgacagauagcaggucacgccc

SEQ ID NO: 1526322 - RNA, 16 nt, Pseudomonas aeruginosa PA01
cgacacguucaggcgu

SEQ ID NO: 1526323 - RNA, 22 nt, Pseudomonas aeruginosa PA01
cgacacucugguagcugcggcc

SEQ ID NO: 1526324 - RNA, 15 nt, Pseudomonas aeruginosa PA01
cgacacgcacucaua

SEQ ID NO: 1526325 - RNA, 20 nt, Pseudomonas aeruginosa PA01
cgacacgcacucauagcuca

SEQ ID NO: 1526326 - RNA, 22 nt, Pseudomonas aeruginosa PA01
cgacaccaugcuccgccuggcg

SEQ ID NO: 1526327 - RNA, 14 nt, Pseudomonas aeruginosa PA01
cgacacagacgcag

SEQ ID NO: 1526328 - RNA, 19 nt, Pseudomonas aeruginosa PA01
cgacacauggucggccagg

SEQ ID NO: 1526329 - RNA, 20 nt, Pseudomonas aeruginosa PA01
cgacaacgaaaagagccgcg

SEQ ID NO: 1526330 - RNA, 15 nt, Pseudomonas aeruginosa PA01
cgaagcccagcgagc

SEQ ID NO: 1526331 - RNA, 19 nt, Pseudomonas aeruginosa PA01
cgaagcagccguauggccc

SEQ ID NO: 1526332 - RNA, 14 nt, Pseudomonas aeruginosa PA01
cgaagaacgccagc

SEQ ID NO: 1526333 - RNA, 15 nt, Pseudomonas aeruginosa PA01
cgaagaaggcucacc

SEQ ID NO: 1526334 - RNA, 17 nt, Pseudomonas aeruginosa PA01
cgaagaaccacuggaug

SEQ ID NO: 1526335 - RNA, 16 nt, Pseudomonas aeruginosa PA01
cgaagacccccugccg

SEQ ID NO: 1526336 - RNA, 19 nt, Pseudomonas aeruginosa PA01
cgaacggugcagcuugacc

SEQ ID NO: 1526337 - RNA, 23 nt, Pseudomonas aeruginosa PA01
cgaacgguggccccucagaagua

SEQ ID NO: 1526338 - RNA, 17 nt, Pseudomonas aeruginosa PA01
cgaacgcucccagccga

SEQ ID NO: 1526339 - RNA, 16 nt, Pseudomonas aeruginosa PA01
cgaacucaugcccagc

SEQ ID NO: 1526340 - RNA, 19 nt, Pseudomonas aeruginosa PA01
cgaacugcacccgccgacc

SEQ ID NO: 1526341 - RNA, 14 nt, Pseudomonas aeruginosa PA01
cgaacuccgccagc

SEQ ID NO: 1526342 - RNA, 18 nt, Pseudomonas aeruginosa PA01
cgaacucgaaggccagcu

SEQ ID NO: 1526343 - RNA, 13 nt, Pseudomonas aeruginosa PA01
cgaacugcuccug

SEQ ID NO: 1526344 - RNA, 14 nt, Pseudomonas aeruginosa PA01
cgaacuucagggcu

SEQ ID NO: 1526345 - RNA, 17 nt, Pseudomonas aeruginosa PA01
cgaagcucucgccgcgc

SEQ ID NO: 1526346 - RNA, 12 nt, Pseudomonas aeruginosa PA01
cgaagcuggggc

SEQ ID NO: 1526347 - RNA, 14 nt, Pseudomonas aeruginosa PA01
cgaagcuggggcug

SEQ ID NO: 1526348 - RNA, 21 nt, Pseudomonas aeruginosa PA01
cgaagcugucguaguccuggg

SEQ ID NO: 1526349 - RNA, 19 nt, Pseudomonas aeruginosa PA01
cgaagcuucaucgaggugc

SEQ ID NO: 1526350 - RNA, 21 nt, Pseudomonas aeruginosa PA01
cgaagcgugggcggccggcca

SEQ ID NO: 1526351 - RNA, 17 nt, Pseudomonas aeruginosa PA01
cgaaggcauauccccuc

SEQ ID NO: 1526352 - RNA, 23 nt, Pseudomonas aeruginosa PA01
cgaaggcgccuuccaggcgugcc

SEQ ID NO: 1526353 - RNA, 23 nt, Pseudomonas aeruginosa PA01
cgaaggcgauguaggucaccgcg

SEQ ID NO: 1526354 - RNA, 12 nt, Pseudomonas aeruginosa PA01
cgaaggccagga

SEQ ID NO: 1526355 - RNA, 12 nt, Pseudomonas aeruginosa PA01
cgaaggccaggc

SEQ ID NO: 1526356 - RNA, 14 nt, Pseudomonas aeruginosa PA01
cgaagcgcagcacg

SEQ ID NO: 1526357 - RNA, 16 nt, Pseudomonas aeruginosa PA01
cgaagccggcggcgcg

SEQ ID NO: 1526358 - RNA, 11 nt, Pseudomonas aeruginosa PA01
cgaagcccugc

SEQ ID NO: 1526359 - RNA, 17 nt, Pseudomonas aeruginosa PA01
cgaagcccugcaaagcg

SEQ ID NO: 1526360 - RNA, 20 nt, Pseudomonas aeruginosa PA01
cgaagcccugcaaagcggcg

SEQ ID NO: 1526361 - RNA, 18 nt, Pseudomonas aeruginosa PA01
cgaagcggggcuuuuucc

SEQ ID NO: 1526362 - RNA, 21 nt, Pseudomonas aeruginosa PA01
cgaagcggcucggccagggcc

SEQ ID NO: 1526363 - RNA, 14 nt, Pseudomonas aeruginosa PA01
cgaagcgcagcagg

SEQ ID NO: 1526364 - RNA, 15 nt, Pseudomonas aeruginosa PA01
cgaagcgcagcaggu

SEQ ID NO: 1526365 - RNA, 16 nt, Pseudomonas aeruginosa PA01
cgaagcgccggcggcc

SEQ ID NO: 1526366 - RNA, 22 nt, Pseudomonas aeruginosa PA01
cgaagcgcaggugcaccgcgcu

SEQ ID NO: 1526367 - RNA, 16 nt, Pseudomonas aeruginosa PA01
cgaagcgcucccagac

SEQ ID NO: 1526368 - RNA, 22 nt, Pseudomonas aeruginosa PA01
cgaagcgcucggucagcucccu

SEQ ID NO: 1526369 - RNA, 13 nt, Pseudomonas aeruginosa PA01
cgaaguagaagcg

SEQ ID NO: 1526370 - RNA, 23 nt, Pseudomonas aeruginosa PA01
cgaaguagcgacggaagcccucg

SEQ ID NO: 1526371 - RNA, 15 nt, Pseudomonas aeruginosa PA01
cgaaguaucuggguc

SEQ ID NO: 1526372 - RNA, 18 nt, Pseudomonas aeruginosa PA01
cgaagugcgcugcuugaa

SEQ ID NO: 1526373 - RNA, 15 nt, Pseudomonas aeruginosa PA01
cgaaguugccgccgc

SEQ ID NO: 1526374 - RNA, 18 nt, Pseudomonas aeruginosa PA01
cgaaguguuacagcagga

SEQ ID NO: 1526375 - RNA, 15 nt, Pseudomonas aeruginosa PA01
cgaaggugcaggccg

SEQ ID NO: 1526376 - RNA, 19 nt, Pseudomonas aeruginosa PA01
cgaaggugcaggccgcgcg

SEQ ID NO: 1526377 - RNA, 18 nt, Pseudomonas aeruginosa PA01
cgaaggucggcggcagcu

SEQ ID NO: 1526378 - RNA, 20 nt, Pseudomonas aeruginosa PA01
cgaaggguuggccgcagcag

SEQ ID NO: 1526379 - RNA, 23 nt, Pseudomonas aeruginosa PA01
cgaagggaaucuuuccuccagag

SEQ ID NO: 1526380 - RNA, 17 nt, Pseudomonas aeruginosa PA01
cgaagggcucagcccag

SEQ ID NO: 1526381 - RNA, 22 nt, Pseudomonas aeruginosa PA01
cgaagggcucagcccaggcgcc

SEQ ID NO: 1526382 - RNA, 20 nt, Pseudomonas aeruginosa PA01
cgaagggaaacaccaggccg

SEQ ID NO: 1526383 - RNA, 21 nt, Pseudomonas aeruginosa PA01
ccuucggucgcgccccgccag

SEQ ID NO: 1526384 - RNA, 17 nt, Pseudomonas aeruginosa PA01
ccuucgguggcgaccag

SEQ ID NO: 1526385 - RNA, 16 nt, Pseudomonas aeruginosa PA01
ccuucgguaccugguc

SEQ ID NO: 1526386 - RNA, 13 nt, Pseudomonas aeruginosa PA01
ccuucuccgccag

SEQ ID NO: 1526387 - RNA, 23 nt, Pseudomonas aeruginosa PA01
ccuucuccggggcccggcaggca

SEQ ID NO: 1526388 - RNA, 17 nt, Pseudomonas aeruginosa PA01
ccuucgugggccugcuc

SEQ ID NO: 1526389 - RNA, 19 nt, Pseudomonas aeruginosa PA01
ccuucucgucgccgcccgg

SEQ ID NO: 1526390 - RNA, 21 nt, Pseudomonas aeruginosa PA01
ccuucugcaauugcuugcgcu

SEQ ID NO: 1526391 - RNA, 18 nt, Pseudomonas aeruginosa PA01
ccuucugcaccuuggcca

SEQ ID NO: 1526392 - RNA, 14 nt, Pseudomonas aeruginosa PA01
ccuugaccaccgcc

SEQ ID NO: 1526393 - RNA, 20 nt, Pseudomonas aeruginosa PA01
ccuugaccaccgccaggcug

SEQ ID NO: 1526394 - RNA, 19 nt, Pseudomonas aeruginosa PA01
ccuugaagccuucgcccag

SEQ ID NO: 1526395 - RNA, 17 nt, Pseudomonas aeruginosa PA01
ccuugacgaagccggcg

SEQ ID NO: 1526396 - RNA, 18 nt, Pseudomonas aeruginosa PA01
ccuugacccucugguugg

SEQ ID NO: 1526397 - RNA, 14 nt, Pseudomonas aeruginosa PA01
ccuugaccaucuuu

SEQ ID NO: 1526398 - RNA, 19 nt, Pseudomonas aeruginosa PA01
ccuugaccaucuuuuccug

SEQ ID NO: 1526399 - RNA, 22 nt, Pseudomonas aeruginosa PA01
ccuucuuuuauacccggcgccc

SEQ ID NO: 1526400 - RNA, 12 nt, Pseudomonas aeruginosa PA01
ccuucuugcugc

SEQ ID NO: 1526401 - RNA, 20 nt, Pseudomonas aeruginosa PA01
ccuucuugcugccggcgucc

SEQ ID NO: 1526402 - RNA, 15 nt, Pseudomonas aeruginosa PA01
ccuuccgcgcccagg

SEQ ID NO: 1526403 - RNA, 21 nt, Pseudomonas aeruginosa PA01
ccuuccgcgcccaggcugccg

SEQ ID NO: 1526404 - RNA, 21 nt, Pseudomonas aeruginosa PA01
ccuuccggguugaaggcgcgg

SEQ ID NO: 1526405 - RNA, 17 nt, Pseudomonas aeruginosa PA01
ccuuccucgcgccuuuu

SEQ ID NO: 1526406 - RNA, 22 nt, Pseudomonas aeruginosa PA01
ccuucccacuccguccagugcg

SEQ ID NO: 1526407 - RNA, 15 nt, Pseudomonas aeruginosa PA01
ccuuccagcccuucg

SEQ ID NO: 1526408 - RNA, 18 nt, Pseudomonas aeruginosa PA01
ccuuccagcuugcgccag

SEQ ID NO: 1526409 - RNA, 17 nt, Pseudomonas aeruginosa PA01
ccuuccaggcuguagcc

SEQ ID NO: 1526410 - RNA, 17 nt, Pseudomonas aeruginosa PA01
ccuuccaccaccagggu

SEQ ID NO: 1526411 - RNA, 16 nt, Pseudomonas aeruginosa PA01
ccuuccaccggcgucc

SEQ ID NO: 1526412 - RNA, 18 nt, Pseudomonas aeruginosa PA01
ccuguggucaggcgccag

SEQ ID NO: 1526413 - RNA, 19 nt, Pseudomonas aeruginosa PA01
ccuguggucaggcgccagg

SEQ ID NO: 1526414 - RNA, 21 nt, Pseudomonas aeruginosa PA01
ccugugguuggaaaagccccg

SEQ ID NO: 1526415 - RNA, 13 nt, Pseudomonas aeruginosa PA01
ccuucggcgcucu

SEQ ID NO: 1526416 - RNA, 20 nt, Pseudomonas aeruginosa PA01
ccuucggcgcucuucagcac

SEQ ID NO: 1526417 - RNA, 12 nt, Pseudomonas aeruginosa PA01
ccuucggcgaca

SEQ ID NO: 1526418 - RNA, 19 nt, Pseudomonas aeruginosa PA01
ccuucggcgacacagacgc

SEQ ID NO: 1526419 - RNA, 22 nt, Pseudomonas aeruginosa PA01
ccuucggcgcauagccaccgcc

SEQ ID NO: 1526420 - RNA, 16 nt, Pseudomonas aeruginosa PA01
ccuucggcaccccuuc

SEQ ID NO: 1526421 - RNA, 16 nt, Pseudomonas aeruginosa PA01
ccuucgcgggccaggc

SEQ ID NO: 1526422 - RNA, 17 nt, Pseudomonas aeruginosa PA01
ccuucgccggaagcuuc

SEQ ID NO: 1526423 - RNA, 15 nt, Pseudomonas aeruginosa PA01
ccuucgcguucgcuc

SEQ ID NO: 1526424 - RNA, 20 nt, Pseudomonas aeruginosa PA01
ccuucgcguucgcuccgggc

SEQ ID NO: 1526425 - RNA, 12 nt, Pseudomonas aeruginosa PA01
ccuucgcugaaa

SEQ ID NO: 1526426 - RNA, 24 nt, Pseudomonas aeruginosa PA01
ccuucgccagcaggcucaugccca

SEQ ID NO: 1526427 - RNA, 18 nt, Pseudomonas aeruginosa PA01
ccuucgccagcggccagg

SEQ ID NO: 1526428 - RNA, 22 nt, Pseudomonas aeruginosa PA01
ccuucgcccgcugcgcugccag

SEQ ID NO: 1526429 - RNA, 13 nt, Pseudomonas aeruginosa PA01
ccuucgcccucag

SEQ ID NO: 1526430 - RNA, 14 nt, Pseudomonas aeruginosa PA01
ccuucgcccucagc

SEQ ID NO: 1526431 - RNA, 15 nt, Pseudomonas aeruginosa PA01
ccuucgcccucagca

SEQ ID NO: 1526432 - RNA, 15 nt, Pseudomonas aeruginosa PA01
ccuucgaugcuccuu

SEQ ID NO: 1526433 - RNA, 15 nt, Pseudomonas aeruginosa PA01
ccuucgagccuggcc

SEQ ID NO: 1526434 - RNA, 21 nt, Pseudomonas aeruginosa PA01
ccuucgagcaacacaugcagg

SEQ ID NO: 1526435 - RNA, 13 nt, Pseudomonas aeruginosa PA01
ccuuccugcuuca

SEQ ID NO: 1526436 - RNA, 18 nt, Pseudomonas aeruginosa PA01
ccuuguacagcuucaggc

SEQ ID NO: 1526437 - RNA, 21 nt, Pseudomonas aeruginosa PA01
ccuuguagaucgacagccacu

SEQ ID NO: 1526438 - RNA, 20 nt, Pseudomonas aeruginosa PA01
ccuugucguaugccugugca

SEQ ID NO: 1526439 - RNA, 16 nt, Pseudomonas aeruginosa PA01
ccuugucgccgcuggg

SEQ ID NO: 1526440 - RNA, 18 nt, Pseudomonas aeruginosa PA01
ccuugucgccgcugggca

SEQ ID NO: 1526441 - RNA, 19 nt, Pseudomonas aeruginosa PA01
ccuuguccugcggccgggu

SEQ ID NO: 1526442 - RNA, 21 nt, Pseudomonas aeruginosa PA01
ccuugucgaugagccagccug

SEQ ID NO: 1526443 - RNA, 16 nt, Pseudomonas aeruginosa PA01
ccuugucgcaccagcc

SEQ ID NO: 1526444 - RNA, 21 nt, Pseudomonas aeruginosa PA01
ccuuggugucgaugccgcccg

SEQ ID NO: 1526445 - RNA, 17 nt, Pseudomonas aeruginosa PA01
ccuugguguuggucagg

SEQ ID NO: 1526446 - RNA, 18 nt, Pseudomonas aeruginosa PA01
ccuuggcuuccuggcgcc

SEQ ID NO: 1526447 - RNA, 13 nt, Pseudomonas aeruginosa PA01
ccuugggccaggc

SEQ ID NO: 1526448 - RNA, 12 nt, Pseudomonas aeruginosa PA01
ccuuggccagca

SEQ ID NO: 1526449 - RNA, 20 nt, Pseudomonas aeruginosa PA01
ccuuggccacgacccugcug

SEQ ID NO: 1526450 - RNA, 24 nt, Pseudomonas aeruginosa PA01
ccuuggcccgguuggccaggacca

SEQ ID NO: 1526451 - RNA, 14 nt, Pseudomonas aeruginosa PA01
ccuuggccaugccc

SEQ ID NO: 1526452 - RNA, 19 nt, Pseudomonas aeruginosa PA01
ccuuggccaugggcacgcc

SEQ ID NO: 1526453 - RNA, 10 nt, Pseudomonas aeruginosa PA01
ccuuggccac

SEQ ID NO: 1526454 - RNA, 12 nt, Pseudomonas aeruginosa PA01
ccuuguuuuccu

SEQ ID NO: 1526455 - RNA, 18 nt, Pseudomonas aeruginosa PA01
ccuuguuuuccuggcccu

SEQ ID NO: 1526456 - RNA, 21 nt, Pseudomonas aeruginosa PA01
ccuuguucaggguggcgaccg

SEQ ID NO: 1526457 - RNA, 13 nt, Pseudomonas aeruginosa PA01
ccuuguuccaggc

SEQ ID NO: 1526458 - RNA, 15 nt, Pseudomonas aeruginosa PA01
ccuuguucggcugga

SEQ ID NO: 1526459 - RNA, 19 nt, Pseudomonas aeruginosa PA01
ccuuguugacguucugccc

SEQ ID NO: 1526460 - RNA, 15 nt, Pseudomonas aeruginosa PA01
ccuugugcugccugc

SEQ ID NO: 1526461 - RNA, 17 nt, Pseudomonas aeruginosa PA01
ccuugcagggccgccag

SEQ ID NO: 1526462 - RNA, 14 nt, Pseudomonas aeruginosa PA01
ccuugccauccucc

SEQ ID NO: 1526463 - RNA, 17 nt, Pseudomonas aeruginosa PA01
ccuugccauccuccagc

SEQ ID NO: 1526464 - RNA, 20 nt, Pseudomonas aeruginosa PA01
ccuugccauccuccagcacu

SEQ ID NO: 1526465 - RNA, 14 nt, Pseudomonas aeruginosa PA01
ccuugccccaggug

SEQ ID NO: 1526466 - RNA, 14 nt, Pseudomonas aeruginosa PA01
ccuugcagccagcc

SEQ ID NO: 1526467 - RNA, 18 nt, Pseudomonas aeruginosa PA01
ccuugcacuugcggcagu

SEQ ID NO: 1526468 - RNA, 21 nt, Pseudomonas aeruginosa PA01
ccuugcagcaacucgccgccg

SEQ ID NO: 1526469 - RNA, 19 nt, Pseudomonas aeruginosa PA01
ccuugagcacccgggcgac

SEQ ID NO: 1526470 - RNA, 23 nt, Pseudomonas aeruginosa PA01
ccuugaguucccagaccuggccg

SEQ ID NO: 1526471 - RNA, 17 nt, Pseudomonas aeruginosa PA01
ccuugagcggcgcccug

SEQ ID NO: 1526472 - RNA, 22 nt, Pseudomonas aeruginosa PA01
ccuugaggcgggccagcagggu

SEQ ID NO: 1526473 - RNA, 21 nt, Pseudomonas aeruginosa PA01
ccuugauggugugcagcagca

SEQ ID NO: 1526474 - RNA, 21 nt, Pseudomonas aeruginosa PA01
ccuugaucggauaccagauca

SEQ ID NO: 1526475 - RNA, 23 nt, Pseudomonas aeruginosa PA01
ccuugaugaucaggucggccgcc

SEQ ID NO: 1526476 - RNA, 14 nt, Pseudomonas aeruginosa PA01
ccuugcuggacuuc

SEQ ID NO: 1526477 - RNA, 18 nt, Pseudomonas aeruginosa PA01
ccuugcucccgccgcucc

SEQ ID NO: 1526478 - RNA, 19 nt, Pseudomonas aeruginosa PA01
ccuugcucucgcgcacgcu

SEQ ID NO: 1526479 - RNA, 20 nt, Pseudomonas aeruginosa PA01
ccuugcugaagcccaggcgu

SEQ ID NO: 1526480 - RNA, 17 nt, Pseudomonas aeruginosa PA01
ccuugcgucccugggcc

SEQ ID NO: 1526481 - RNA, 13 nt, Pseudomonas aeruginosa PA01
ccuugcgguccag

SEQ ID NO: 1526482 - RNA, 20 nt, Pseudomonas aeruginosa PA01
ccuugcgcaccagggccagg

SEQ ID NO: 1526483 - RNA, 15 nt, Pseudomonas aeruginosa PA01
ccuugcgaaaagccc

SEQ ID NO: 1526484 - RNA, 16 nt, Pseudomonas aeruginosa PA01
ccuugcgaaaagcccg

SEQ ID NO: 1526485 - RNA, 23 nt, Pseudomonas aeruginosa PA01
ccuugcccucggcgcccgccugc

SEQ ID NO: 1526486 - RNA, 23 nt, Pseudomonas aeruginosa PA01
ccuugccgacgccgcggccggcg

SEQ ID NO: 1526487 - RNA, 16 nt, Pseudomonas aeruginosa PA01
ccuugcccggcgccag

SEQ ID NO: 1526488 - RNA, 23 nt, Pseudomonas aeruginosa PA01
ccuugccguaguggcguuccagg

SEQ ID NO: 1526489 - RNA, 13 nt, Pseudomonas aeruginosa PA01
ccuugccguggcu

SEQ ID NO: 1526490 - RNA, 19 nt, Pseudomonas aeruginosa PA01
ccuugccguggcuccugga

SEQ ID NO: 1526491 - RNA, 23 nt, Pseudomonas aeruginosa PA01
ccuugccguccagccggcgcuuc

SEQ ID NO: 1526492 - RNA, 19 nt, Pseudomonas aeruginosa PA01
ccuuucggaacagcgccuu

SEQ ID NO: 1526493 - RNA, 20 nt, Pseudomonas aeruginosa PA01
ccuuucuuuucugccacccg

SEQ ID NO: 1526494 - RNA, 10 nt, Pseudomonas aeruginosa PA01
ccuuuuucau

SEQ ID NO: 1526495 - RNA, 20 nt, Pseudomonas aeruginosa PA01
ccuuuuuugugcccgccccu

SEQ ID NO: 1526496 - RNA, 23 nt, Pseudomonas aeruginosa PA01
ccuuuuuugugcccgccccuuuc

SEQ ID NO: 1526497 - RNA, 16 nt, Pseudomonas aeruginosa PA01
ccuuuucggcacucag

SEQ ID NO: 1526498 - RNA, 20 nt, Pseudomonas aeruginosa PA01
ccuuuucgaacaaucccagc

SEQ ID NO: 1526499 - RNA, 20 nt, Pseudomonas aeruginosa PA01
cgaacagguggcuuuccagc

SEQ ID NO: 1526500 - RNA, 21 nt, Pseudomonas aeruginosa PA01
cgaacagcuccuccagccgcg

SEQ ID NO: 1526501 - RNA, 15 nt, Pseudomonas aeruginosa PA01
cgaacagcgagaccc

SEQ ID NO: 1526502 - RNA, 18 nt, Pseudomonas aeruginosa PA01
cgaacagccgccccacca

SEQ ID NO: 1526503 - RNA, 12 nt, Pseudomonas aeruginosa PA01
cgaacagccagc

SEQ ID NO: 1526504 - RNA, 15 nt, Pseudomonas aeruginosa PA01
cgaacaucagcagca

SEQ ID NO: 1526505 - RNA, 19 nt, Pseudomonas aeruginosa PA01
cgaacaguuguuccggguu

SEQ ID NO: 1526506 - RNA, 11 nt, Pseudomonas aeruginosa PA01
cgaacauggcc

SEQ ID NO: 1526507 - RNA, 17 nt, Pseudomonas aeruginosa PA01
cgaaccacaccaggucg

SEQ ID NO: 1526508 - RNA, 20 nt, Pseudomonas aeruginosa PA01
cgaaccacugcgccaugccg

SEQ ID NO: 1526509 - RNA, 13 nt, Pseudomonas aeruginosa PA01
cgaaccaguccag

SEQ ID NO: 1526510 - RNA, 19 nt, Pseudomonas aeruginosa PA01
cgaaccagcucagcuccag

SEQ ID NO: 1526511 - RNA, 12 nt, Pseudomonas aeruginosa PA01
cgaaccagcagc

SEQ ID NO: 1526512 - RNA, 20 nt, Pseudomonas aeruginosa PA01
cgaaccgaagguacugccgc

SEQ ID NO: 1526513 - RNA, 22 nt, Pseudomonas aeruginosa PA01
cgaacccaggccgcgcagcaac

SEQ ID NO: 1526514 - RNA, 23 nt, Pseudomonas aeruginosa PA01
cgaacccaggccgcgcagcaacg

SEQ ID NO: 1526515 - RNA, 18 nt, Pseudomonas aeruginosa PA01
cgaaccguggcggccgcc

SEQ ID NO: 1526516 - RNA, 19 nt, Pseudomonas aeruginosa PA01
cgaaccguggcggccgccg

SEQ ID NO: 1526517 - RNA, 19 nt, Pseudomonas aeruginosa PA01
cgaacgccgcagcucggcc

SEQ ID NO: 1526518 - RNA, 13 nt, Pseudomonas aeruginosa PA01
cgaaccuggagaa

SEQ ID NO: 1526519 - RNA, 21 nt, Pseudomonas aeruginosa PA01
cgaacgagaagccgaucaggu

SEQ ID NO: 1526520 - RNA, 14 nt, Pseudomonas aeruginosa PA01
cgaacgaagcgccc

SEQ ID NO: 1526521 - RNA, 16 nt, Pseudomonas aeruginosa PA01
cgaaacggcaggccag

SEQ ID NO: 1526522 - RNA, 20 nt, Pseudomonas aeruginosa PA01
cgaaacggcaggccagcagg

SEQ ID NO: 1526523 - RNA, 21 nt, Pseudomonas aeruginosa PA01
cgaaacgguccaccaggguac

SEQ ID NO: 1526524 - RNA, 14 nt, Pseudomonas aeruginosa PA01
cgaaacggaacagg

SEQ ID NO: 1526525 - RNA, 21 nt, Pseudomonas aeruginosa PA01
cgaaacucaucaggcugccga

SEQ ID NO: 1526526 - RNA, 15 nt, Pseudomonas aeruginosa PA01
cgaaacuccagcagg

SEQ ID NO: 1526527 - RNA, 17 nt, Pseudomonas aeruginosa PA01
cgaaaccggccagcgcg

SEQ ID NO: 1526528 - RNA, 18 nt, Pseudomonas aeruginosa PA01
cgaaagccuccagcagcu

SEQ ID NO: 1526529 - RNA, 17 nt, Pseudomonas aeruginosa PA01
cgaaagccaugcccaga

SEQ ID NO: 1526530 - RNA, 15 nt, Pseudomonas aeruginosa PA01
cgaaagaaacaacga

SEQ ID NO: 1526531 - RNA, 15 nt, Pseudomonas aeruginosa PA01
cgaaagaagccgcac

SEQ ID NO: 1526532 - RNA, 20 nt, Pseudomonas aeruginosa PA01
cgaaagaagccgcacuucca

SEQ ID NO: 1526533 - RNA, 17 nt, Pseudomonas aeruginosa PA01
cgaacaccgggccgccg

SEQ ID NO: 1526534 - RNA, 15 nt, Pseudomonas aeruginosa PA01
cgaacaaucccagcu

SEQ ID NO: 1526535 - RNA, 17 nt, Pseudomonas aeruginosa PA01
cgaaauggguucccagc

SEQ ID NO: 1526536 - RNA, 16 nt, Pseudomonas aeruginosa PA01
cgaugcuuagcccggg

SEQ ID NO: 1526537 - RNA, 20 nt, Pseudomonas aeruginosa PA01
cgaugcuggcaacggcgggc

SEQ ID NO: 1526538 - RNA, 15 nt, Pseudomonas aeruginosa PA01
cgaugcuguucagca

SEQ ID NO: 1526539 - RNA, 19 nt, Pseudomonas aeruginosa PA01
cgauggcguuguuggucag

SEQ ID NO: 1526540 - RNA, 18 nt, Pseudomonas aeruginosa PA01
cgaugucgcggcugaagg

SEQ ID NO: 1526541 - RNA, 18 nt, Pseudomonas aeruginosa PA01
cgaugucggccugcagcc

SEQ ID NO: 1526542 - RNA, 15 nt, Pseudomonas aeruginosa PA01
cgauggugaucacgu

SEQ ID NO: 1526543 - RNA, 14 nt, Pseudomonas aeruginosa PA01
cgaugccgcgccgg

SEQ ID NO: 1526544 - RNA, 12 nt, Pseudomonas aeruginosa PA01
cgaugccgcgcg

SEQ ID NO: 1526545 - RNA, 14 nt, Pseudomonas aeruginosa PA01
cgaugccgcgcgcc

SEQ ID NO: 1526546 - RNA, 15 nt, Pseudomonas aeruginosa PA01
cgaugccgcgcgccu

SEQ ID NO: 1526547 - RNA, 14 nt, Pseudomonas aeruginosa PA01
cgaugccgccgccg

SEQ ID NO: 1526548 - RNA, 22 nt, Pseudomonas aeruginosa PA01
cgaugccgccgccgccccagca

SEQ ID NO: 1526549 - RNA, 22 nt, Pseudomonas aeruginosa PA01
cgaugccgccgggcaucaugcc

SEQ ID NO: 1526550 - RNA, 15 nt, Pseudomonas aeruginosa PA01
cgaucacguccuuga

SEQ ID NO: 1526551 - RNA, 11 nt, Pseudomonas aeruginosa PA01
cgaugcccucg

SEQ ID NO: 1526552 - RNA, 22 nt, Pseudomonas aeruginosa PA01
cgaugcgccccagcgccugggc

SEQ ID NO: 1526553 - RNA, 13 nt, Pseudomonas aeruginosa PA01
cgaugcucagcgc

SEQ ID NO: 1526554 - RNA, 18 nt, Pseudomonas aeruginosa PA01
cgaugcugccguagcgcu

SEQ ID NO: 1526555 - RNA, 17 nt, Pseudomonas aeruginosa PA01
cgaugcucauccugccc

SEQ ID NO: 1526556 - RNA, 21 nt, Pseudomonas aeruginosa PA01
cgaugccguuaccuuggccac

SEQ ID NO: 1526557 - RNA, 16 nt, Pseudomonas aeruginosa PA01
cgaugccguucaggcg

SEQ ID NO: 1526558 - RNA, 22 nt, Pseudomonas aeruginosa PA01
cgaugccguucucggugaccac

SEQ ID NO: 1526559 - RNA, 12 nt, Pseudomonas aeruginosa PA01
cgaucaccuuca

SEQ ID NO: 1526560 - RNA, 15 nt, Pseudomonas aeruginosa PA01
cgaucaccccgccca

SEQ ID NO: 1526561 - RNA, 14 nt, Pseudomonas aeruginosa PA01
cgaucacccccagc

SEQ ID NO: 1526562 - RNA, 18 nt, Pseudomonas aeruginosa PA01
cgaucacccccagcgagc

SEQ ID NO: 1526563 - RNA, 15 nt, Pseudomonas aeruginosa PA01
cgaucaacgcggcca

SEQ ID NO: 1526564 - RNA, 18 nt, Pseudomonas aeruginosa PA01
cgaucaccaggaucgccg

SEQ ID NO: 1526565 - RNA, 15 nt, Pseudomonas aeruginosa PA01
cgaucaccaccagca

SEQ ID NO: 1526566 - RNA, 18 nt, Pseudomonas aeruginosa PA01
cgauucguucgagcagcu

SEQ ID NO: 1526567 - RNA, 15 nt, Pseudomonas aeruginosa PA01
cgauucccagugcuc

SEQ ID NO: 1526568 - RNA, 13 nt, Pseudomonas aeruginosa PA01
cgauguucuccac

SEQ ID NO: 1526569 - RNA, 19 nt, Pseudomonas aeruginosa PA01
cgauguugacgauggcgcc

SEQ ID NO: 1526570 - RNA, 14 nt, Pseudomonas aeruginosa PA01
cgauugcuacagca

SEQ ID NO: 1526571 - RNA, 17 nt, Pseudomonas aeruginosa PA01
cgauugcuacagcaauu

SEQ ID NO: 1526572 - RNA, 20 nt, Pseudomonas aeruginosa PA01
cgauuuccaccggcacgcca

SEQ ID NO: 1526573 - RNA, 20 nt, Pseudomonas aeruginosa PA01
cgcacgcaauggcgcagccg

SEQ ID NO: 1526574 - RNA, 21 nt, Pseudomonas aeruginosa PA01
cgcacgaggauuuccgcgccc

SEQ ID NO: 1526575 - RNA, 18 nt, Pseudomonas aeruginosa PA01
cgcaccgacgccgccugc

SEQ ID NO: 1526576 - RNA, 14 nt, Pseudomonas aeruginosa PA01
cgcaccaccuggca

SEQ ID NO: 1526577 - RNA, 14 nt, Pseudomonas aeruginosa PA01
cgcaccgcgccggg

SEQ ID NO: 1526578 - RNA, 22 nt, Pseudomonas aeruginosa PA01
cgcaccgccugcagcaccaccu

SEQ ID NO: 1526579 - RNA, 18 nt, Pseudomonas aeruginosa PA01
cgcagacgauugaccucc

SEQ ID NO: 1526580 - RNA, 20 nt, Pseudomonas aeruginosa PA01
cgcagacgauugaccucccg

SEQ ID NO: 1526581 - RNA, 20 nt, Pseudomonas aeruginosa PA01
cgcagacuccggcgcagccc

SEQ ID NO: 1526582 - RNA, 14 nt, Pseudomonas aeruginosa PA01
cgcagacggggccu

SEQ ID NO: 1526583 - RNA, 13 nt, Pseudomonas aeruginosa PA01
cgcagagccagcc

SEQ ID NO: 1526584 - RNA, 22 nt, Pseudomonas aeruginosa PA01
cgcagagccagccgcagcccgg

SEQ ID NO: 1526585 - RNA, 18 nt, Pseudomonas aeruginosa PA01
cgcagagaucggcggcgc

SEQ ID NO: 1526586 - RNA, 18 nt, Pseudomonas aeruginosa PA01
cgcagagcaucacccgcg

SEQ ID NO: 1526587 - RNA, 19 nt, Pseudomonas aeruginosa PA01
cgcagagcgccagccagcg

SEQ ID NO: 1526588 - RNA, 17 nt, Pseudomonas aeruginosa PA01
cgcagacaggccuccag

SEQ ID NO: 1526589 - RNA, 18 nt, Pseudomonas aeruginosa PA01
cgcagacaggccuccagc

SEQ ID NO: 1526590 - RNA, 21 nt, Pseudomonas aeruginosa PA01
cgcacguugaggucgaagacc

SEQ ID NO: 1526591 - RNA, 14 nt, Pseudomonas aeruginosa PA01
cgcacggucuccgg

SEQ ID NO: 1526592 - RNA, 23 nt, Pseudomonas aeruginosa PA01
cgcaaugccgcgucgaagucgau

SEQ ID NO: 1526593 - RNA, 14 nt, Pseudomonas aeruginosa PA01
cgcaaucagggcug

SEQ ID NO: 1526594 - RNA, 15 nt, Pseudomonas aeruginosa PA01
cgcacaucacccggu

SEQ ID NO: 1526595 - RNA, 16 nt, Pseudomonas aeruginosa PA01
cgcaacaggcgcaugc

SEQ ID NO: 1526596 - RNA, 17 nt, Pseudomonas aeruginosa PA01
cgcaaccagcccuggcg

SEQ ID NO: 1526597 - RNA, 14 nt, Pseudomonas aeruginosa PA01
cgcaaccagcgcuc

SEQ ID NO: 1526598 - RNA, 15 nt, Pseudomonas aeruginosa PA01
cgcaaccguuccagc

SEQ ID NO: 1526599 - RNA, 16 nt, Pseudomonas aeruginosa PA01
cgcaacccgcccggcu

SEQ ID NO: 1526600 - RNA, 17 nt, Pseudomonas aeruginosa PA01
cgcaagcuccccgccgc

SEQ ID NO: 1526601 - RNA, 19 nt, Pseudomonas aeruginosa PA01
cgcaagcucgucacccgcg

SEQ ID NO: 1526602 - RNA, 16 nt, Pseudomonas aeruginosa PA01
cgcaagcuuuuccgaa

SEQ ID NO: 1526603 - RNA, 20 nt, Pseudomonas aeruginosa PA01
cgcaaggccagggcggcgcc

SEQ ID NO: 1526604 - RNA, 13 nt, Pseudomonas aeruginosa PA01
cgcaagccagcca

SEQ ID NO: 1526605 - RNA, 20 nt, Pseudomonas aeruginosa PA01
cgcaagccagccaugugcuc

SEQ ID NO: 1526606 - RNA, 15 nt, Pseudomonas aeruginosa PA01
cgcaagcccaagggc

SEQ ID NO: 1526607 - RNA, 23 nt, Pseudomonas aeruginosa PA01
cgcaagcggcggcuucagccaga

SEQ ID NO: 1526608 - RNA, 22 nt, Pseudomonas aeruginosa PA01
cgccagacaggccagcucgccc

SEQ ID NO: 1526609 - RNA, 16 nt, Pseudomonas aeruginosa PA01
cgccagagaucgccca

SEQ ID NO: 1526610 - RNA, 13 nt, Pseudomonas aeruginosa PA01
cgccagagcaggc

SEQ ID NO: 1526611 - RNA, 16 nt, Pseudomonas aeruginosa PA01
cgccagaagcggccga

SEQ ID NO: 1526612 - RNA, 18 nt, Pseudomonas aeruginosa PA01
cgccagaagcggccgacc

SEQ ID NO: 1526613 - RNA, 22 nt, Pseudomonas aeruginosa PA01
cgccacgcuucugcgccuccuc

SEQ ID NO: 1526614 - RNA, 15 nt, Pseudomonas aeruginosa PA01
cgccacggccagcag

SEQ ID NO: 1526615 - RNA, 15 nt, Pseudomonas aeruginosa PA01
cgccacuuccagcac

SEQ ID NO: 1526616 - RNA, 14 nt, Pseudomonas aeruginosa PA01
cgccacgcucuccg

SEQ ID NO: 1526617 - RNA, 19 nt, Pseudomonas aeruginosa PA01
cgccacgcugcugccggcc

SEQ ID NO: 1526618 - RNA, 19 nt, Pseudomonas aeruginosa PA01
cgccacggaugcagucccg

SEQ ID NO: 1526619 - RNA, 19 nt, Pseudomonas aeruginosa PA01
cgccacgcucaccggucga

SEQ ID NO: 1526620 - RNA, 14 nt, Pseudomonas aeruginosa PA01
cgccacgccggcgc

SEQ ID NO: 1526621 - RNA, 19 nt, Pseudomonas aeruginosa PA01
cgccacgccggcgcuccuc

SEQ ID NO: 1526622 - RNA, 21 nt, Pseudomonas aeruginosa PA01
cgccacgcaggaacagcuccu

SEQ ID NO: 1526623 - RNA, 17 nt, Pseudomonas aeruginosa PA01
cgccaccgauucgccgg

SEQ ID NO: 1526624 - RNA, 13 nt, Pseudomonas aeruginosa PA01
cgccaccgccgga

SEQ ID NO: 1526625 - RNA, 16 nt, Pseudomonas aeruginosa PA01
cgccacccgcuccggc

SEQ ID NO: 1526626 - RNA, 15 nt, Pseudomonas aeruginosa PA01
cgccaccccgccgcu

SEQ ID NO: 1526627 - RNA, 12 nt, Pseudomonas aeruginosa PA01
cgccacccgcau

SEQ ID NO: 1526628 - RNA, 14 nt, Pseudomonas aeruginosa PA01
cgccaccccgccgc

SEQ ID NO: 1526629 - RNA, 18 nt, Pseudomonas aeruginosa PA01
cgccaccccgccgcgcau

SEQ ID NO: 1526630 - RNA, 17 nt, Pseudomonas aeruginosa PA01
cgccaagguacggggcu

SEQ ID NO: 1526631 - RNA, 11 nt, Pseudomonas aeruginosa PA01
cgccaaggcgg

SEQ ID NO: 1526632 - RNA, 14 nt, Pseudomonas aeruginosa PA01
cgccaaggcggggc

SEQ ID NO: 1526633 - RNA, 15 nt, Pseudomonas aeruginosa PA01
cgccaaggcggggcu

SEQ ID NO: 1526634 - RNA, 13 nt, Pseudomonas aeruginosa PA01
cgccaagcccggc

SEQ ID NO: 1526635 - RNA, 21 nt, Pseudomonas aeruginosa PA01
cgccaauaaauccgucauaca

SEQ ID NO: 1526636 - RNA, 22 nt, Pseudomonas aeruginosa PA01
cgccaaaguucaguagcggcag

SEQ ID NO: 1526637 - RNA, 14 nt, Pseudomonas aeruginosa PA01
cgccaacgcgccgu

SEQ ID NO: 1526638 - RNA, 13 nt, Pseudomonas aeruginosa PA01
cgccaacguccuc

SEQ ID NO: 1526639 - RNA, 15 nt, Pseudomonas aeruginosa PA01
cgccaacucggccug

SEQ ID NO: 1526640 - RNA, 15 nt, Pseudomonas aeruginosa PA01
cgcauuccaccuugg

SEQ ID NO: 1526641 - RNA, 20 nt, Pseudomonas aeruginosa PA01
cgcaugccguuggccgagcg

SEQ ID NO: 1526642 - RNA, 13 nt, Pseudomonas aeruginosa PA01
cgcaugcgcggcg

SEQ ID NO: 1526643 - RNA, 17 nt, Pseudomonas aeruginosa PA01
cgcaugcggaaggcuuc

SEQ ID NO: 1526644 - RNA, 20 nt, Pseudomonas aeruginosa PA01
cgcauugaaaaacccaugcg

SEQ ID NO: 1526645 - RNA, 20 nt, Pseudomonas aeruginosa PA01
cgccaaaaagcaggacggcg

SEQ ID NO: 1526646 - RNA, 21 nt, Pseudomonas aeruginosa PA01
cgccaaaaaaagccccggcau

SEQ ID NO: 1526647 - RNA, 18 nt, Pseudomonas aeruginosa PA01
cgcagaugaucgccaccg

SEQ ID NO: 1526648 - RNA, 19 nt, Pseudomonas aeruginosa PA01
cgcagaugaucgccaccgg

SEQ ID NO: 1526649 - RNA, 22 nt, Pseudomonas aeruginosa PA01
cgcagaucgcguccagggugcu

SEQ ID NO: 1526650 - RNA, 21 nt, Pseudomonas aeruginosa PA01
cgcagcaacuggucgccgcag

SEQ ID NO: 1526651 - RNA, 15 nt, Pseudomonas aeruginosa PA01
cgcagcacggcggcu

SEQ ID NO: 1526652 - RNA, 23 nt, Pseudomonas aeruginosa PA01
cgcaggcaguggcgccagccagc

SEQ ID NO: 1526653 - RNA, 20 nt, Pseudomonas aeruginosa PA01
cgcagcuccucggcguggcu

SEQ ID NO: 1526654 - RNA, 15 nt, Pseudomonas aeruginosa PA01
cgcagcucggccucg

SEQ ID NO: 1526655 - RNA, 13 nt, Pseudomonas aeruginosa PA01
cgcaggcgaggau

SEQ ID NO: 1526656 - RNA, 16 nt, Pseudomonas aeruginosa PA01
cgcagggccagcaaca

SEQ ID NO: 1526657 - RNA, 13 nt, Pseudomonas aeruginosa PA01
cgcagggccaggg

SEQ ID NO: 1526658 - RNA, 15 nt, Pseudomonas aeruginosa PA01
cgcagggcgccgucg

SEQ ID NO: 1526659 - RNA, 16 nt, Pseudomonas aeruginosa PA01
cgcagggcgccgucgg

SEQ ID NO: 1526660 - RNA, 17 nt, Pseudomonas aeruginosa PA01
cgcagggcgccgucggg

SEQ ID NO: 1526661 - RNA, 16 nt, Pseudomonas aeruginosa PA01
cgcagggcggcgagcu

SEQ ID NO: 1526662 - RNA, 19 nt, Pseudomonas aeruginosa PA01
cgcagggcggcgccuggag

SEQ ID NO: 1526663 - RNA, 19 nt, Pseudomonas aeruginosa PA01
cgcagggcgguacgccgcg

SEQ ID NO: 1526664 - RNA, 17 nt, Pseudomonas aeruginosa PA01
cgcaggccgggaaugga

SEQ ID NO: 1526665 - RNA, 16 nt, Pseudomonas aeruginosa PA01
cgcaggccgaccucgg

SEQ ID NO: 1526666 - RNA, 19 nt, Pseudomonas aeruginosa PA01
cgcaggcgaaaaaaagccc

SEQ ID NO: 1526667 - RNA, 15 nt, Pseudomonas aeruginosa PA01
cgcaggcgaacugcc

SEQ ID NO: 1526668 - RNA, 16 nt, Pseudomonas aeruginosa PA01
cgcaggccgcggccga

SEQ ID NO: 1526669 - RNA, 15 nt, Pseudomonas aeruginosa PA01
cgcaggccgccggcg

SEQ ID NO: 1526670 - RNA, 11 nt, Pseudomonas aeruginosa PA01
cgcaggccagc

SEQ ID NO: 1526671 - RNA, 13 nt, Pseudomonas aeruginosa PA01
cgcaggccagcgc

SEQ ID NO: 1526672 - RNA, 13 nt, Pseudomonas aeruginosa PA01
cgcaggccaggcg

SEQ ID NO: 1526673 - RNA, 14 nt, Pseudomonas aeruginosa PA01
cgcaggccaggcgc

SEQ ID NO: 1526674 - RNA, 19 nt, Pseudomonas aeruginosa PA01
cgcagucgcuuccgcgcgg

SEQ ID NO: 1526675 - RNA, 16 nt, Pseudomonas aeruginosa PA01
cgcagucguagcgcag

SEQ ID NO: 1526676 - RNA, 18 nt, Pseudomonas aeruginosa PA01
cgcagguacucgccggcg

SEQ ID NO: 1526677 - RNA, 20 nt, Pseudomonas aeruginosa PA01
cgcaggucgcuggcgucgac

SEQ ID NO: 1526678 - RNA, 15 nt, Pseudomonas aeruginosa PA01
cgcaggucggccucg

SEQ ID NO: 1526679 - RNA, 15 nt, Pseudomonas aeruginosa PA01
cgcagguaacccgcg

SEQ ID NO: 1526680 - RNA, 16 nt, Pseudomonas aeruginosa PA01
cgcagguaacccgcgg

SEQ ID NO: 1526681 - RNA, 21 nt, Pseudomonas aeruginosa PA01
cgcagggucgcguuggcgugc

SEQ ID NO: 1526682 - RNA, 22 nt, Pseudomonas aeruginosa PA01
cgcagggucgcguuggcgugcu

SEQ ID NO: 1526683 - RNA, 15 nt, Pseudomonas aeruginosa PA01
cgcaggggcgcgccg

SEQ ID NO: 1526684 - RNA, 16 nt, Pseudomonas aeruginosa PA01
cgcaggggcgcggcgc

SEQ ID NO: 1526685 - RNA, 16 nt, Pseudomonas aeruginosa PA01
cgcaucggcgccuccc

SEQ ID NO: 1526686 - RNA, 18 nt, Pseudomonas aeruginosa PA01
cgcaucggcgccucccag

SEQ ID NO: 1526687 - RNA, 23 nt, Pseudomonas aeruginosa PA01
cgcaucguuggcgccguccugca

SEQ ID NO: 1526688 - RNA, 13 nt, Pseudomonas aeruginosa PA01
cgcaugcccaggg

SEQ ID NO: 1526689 - RNA, 14 nt, Pseudomonas aeruginosa PA01
cgcaugcccagggc

SEQ ID NO: 1526690 - RNA, 21 nt, Pseudomonas aeruginosa PA01
cgcaugcccagggccagcagc

SEQ ID NO: 1526691 - RNA, 19 nt, Pseudomonas aeruginosa PA01
cgcaugaaaaagccgccca

SEQ ID NO: 1526692 - RNA, 16 nt, Pseudomonas aeruginosa PA01
cgcaugcaguggaagg

SEQ ID NO: 1526693 - RNA, 23 nt, Pseudomonas aeruginosa PA01
cgcaucugcgcguagcgguccuc

SEQ ID NO: 1526694 - RNA, 18 nt, Pseudomonas aeruginosa PA01
cgcaucuggugcgcgucc

SEQ ID NO: 1526695 - RNA, 17 nt, Pseudomonas aeruginosa PA01
cgcaucgccugggccgg

SEQ ID NO: 1526696 - RNA, 21 nt, Pseudomonas aeruginosa PA01
cgcaucgcgguuauccgccgg

SEQ ID NO: 1526697 - RNA, 20 nt, Pseudomonas aeruginosa PA01
cgcaucgaggccgcccagcg

SEQ ID NO: 1526698 - RNA, 16 nt, Pseudomonas aeruginosa PA01
cgcaucaggccaaagc

SEQ ID NO: 1526699 - RNA, 22 nt, Pseudomonas aeruginosa PA01
cgcaucagcgccgguucguuga

SEQ ID NO: 1526700 - RNA, 17 nt, Pseudomonas aeruginosa PA01
cgcauagugaccccaau

SEQ ID NO: 1526701 - RNA, 14 nt, Pseudomonas aeruginosa PA01
cgcauagccaccgc

SEQ ID NO: 1526702 - RNA, 18 nt, Pseudomonas aeruginosa PA01
cgcauagccggcgcgccc

SEQ ID NO: 1526703 - RNA, 18 nt, Pseudomonas aeruginosa PA01
cgcaguucgcgggccgcg

SEQ ID NO: 1526704 - RNA, 14 nt, Pseudomonas aeruginosa PA01
cgcaguucgccccg

SEQ ID NO: 1526705 - RNA, 17 nt, Pseudomonas aeruginosa PA01
cgcaguucgccccgccg

SEQ ID NO: 1526706 - RNA, 14 nt, Pseudomonas aeruginosa PA01
cgcaguucgccgcc

SEQ ID NO: 1526707 - RNA, 16 nt, Pseudomonas aeruginosa PA01
cgcaguuccgcggcgu

SEQ ID NO: 1526708 - RNA, 16 nt, Pseudomonas aeruginosa PA01
cgcaguuccucgccgc

SEQ ID NO: 1526709 - RNA, 18 nt, Pseudomonas aeruginosa PA01
cgcaguuccucgccgcug

SEQ ID NO: 1526710 - RNA, 21 nt, Pseudomonas aeruginosa PA01
cgagcagaguuuagccgccag

SEQ ID NO: 1526711 - RNA, 20 nt, Pseudomonas aeruginosa PA01
cgagcagcaccaggcuggcc

SEQ ID NO: 1526712 - RNA, 14 nt, Pseudomonas aeruginosa PA01
cgagcaggcgcgcc

SEQ ID NO: 1526713 - RNA, 13 nt, Pseudomonas aeruginosa PA01
cgagcagcgccag

SEQ ID NO: 1526714 - RNA, 18 nt, Pseudomonas aeruginosa PA01
cgagcagcgcgcggcucg

SEQ ID NO: 1526715 - RNA, 15 nt, Pseudomonas aeruginosa PA01
cgagcagcggcgcuu

SEQ ID NO: 1526716 - RNA, 18 nt, Pseudomonas aeruginosa PA01
cgagcaccacgcgcaagc

SEQ ID NO: 1526717 - RNA, 15 nt, Pseudomonas aeruginosa PA01
cgagcaccggccuca

SEQ ID NO: 1526718 - RNA, 18 nt, Pseudomonas aeruginosa PA01
cgagcaccccgaccaccc

SEQ ID NO: 1526719 - RNA, 19 nt, Pseudomonas aeruginosa PA01
cgagcaccccgaccacccu

SEQ ID NO: 1526720 - RNA, 16 nt, Pseudomonas aeruginosa PA01
cgagcaccgcgcagac

SEQ ID NO: 1526721 - RNA, 18 nt, Pseudomonas aeruginosa PA01
cgagcaauccggcgcugc

SEQ ID NO: 1526722 - RNA, 21 nt, Pseudomonas aeruginosa PA01
cgagcaauccggcgcugccga

SEQ ID NO: 1526723 - RNA, 19 nt, Pseudomonas aeruginosa PA01
cgagcaacugcucgggcgu

SEQ ID NO: 1526724 - RNA, 20 nt, Pseudomonas aeruginosa PA01
cgagcaacacaugcaggcuc

SEQ ID NO: 1526725 - RNA, 14 nt, Pseudomonas aeruginosa PA01
cgagcaacagcagg

SEQ ID NO: 1526726 - RNA, 16 nt, Pseudomonas aeruginosa PA01
cgagcaacagcaggag

SEQ ID NO: 1526727 - RNA, 13 nt, Pseudomonas aeruginosa PA01
cgagcccaggcag

SEQ ID NO: 1526728 - RNA, 20 nt, Pseudomonas aeruginosa PA01
cgagccagguuuccggcagc

SEQ ID NO: 1526729 - RNA, 21 nt, Pseudomonas aeruginosa PA01
cgagccagccguggcaggcgc

SEQ ID NO: 1526730 - RNA, 11 nt, Pseudomonas aeruginosa PA01
cgagccgagca

SEQ ID NO: 1526731 - RNA, 17 nt, Pseudomonas aeruginosa PA01
cgagcccgagugcgccc

SEQ ID NO: 1526732 - RNA, 12 nt, Pseudomonas aeruginosa PA01
cgagcaggguca

SEQ ID NO: 1526733 - RNA, 13 nt, Pseudomonas aeruginosa PA01
cgagcaggcugcc

SEQ ID NO: 1526734 - RNA, 15 nt, Pseudomonas aeruginosa PA01
cgagcagguccuguc

SEQ ID NO: 1526735 - RNA, 17 nt, Pseudomonas aeruginosa PA01
cgagcagggcacagcca

SEQ ID NO: 1526736 - RNA, 19 nt, Pseudomonas aeruginosa PA01
cgagcagguagaccgccuc

SEQ ID NO: 1526737 - RNA, 22 nt, Pseudomonas aeruginosa PA01
cgagcauuccgacaaggagcgc

SEQ ID NO: 1526738 - RNA, 21 nt, Pseudomonas aeruginosa PA01
cgagcauuccucagcgccggu

SEQ ID NO: 1526739 - RNA, 20 nt, Pseudomonas aeruginosa PA01
cgagcaugccgaggaacgcc

SEQ ID NO: 1526740 - RNA, 18 nt, Pseudomonas aeruginosa PA01
cgagcaguugcuggaugu

SEQ ID NO: 1526741 - RNA, 23 nt, Pseudomonas aeruginosa PA01
cgagaggggcgcucguugcgccg

SEQ ID NO: 1526742 - RNA, 15 nt, Pseudomonas aeruginosa PA01
cgagagcagggccug

SEQ ID NO: 1526743 - RNA, 12 nt, Pseudomonas aeruginosa PA01
cgagagcgcugc

SEQ ID NO: 1526744 - RNA, 18 nt, Pseudomonas aeruginosa PA01
cgagacgugaagccccug

SEQ ID NO: 1526745 - RNA, 17 nt, Pseudomonas aeruginosa PA01
cgagagcggguagcgcc

SEQ ID NO: 1526746 - RNA, 21 nt, Pseudomonas aeruginosa PA01
cgagacuccggagaaccggcg

SEQ ID NO: 1526747 - RNA, 14 nt, Pseudomonas aeruginosa PA01
cgagaugaagcgcc

SEQ ID NO: 1526748 - RNA, 22 nt, Pseudomonas aeruginosa PA01
cgagaugcugcgggcgccgccg

SEQ ID NO: 1526749 - RNA, 22 nt, Pseudomonas aeruginosa PA01
cgagaccaccgacggcuccgga

SEQ ID NO: 1526750 - RNA, 13 nt, Pseudomonas aeruginosa PA01
cgagacgggcgag

SEQ ID NO: 1526751 - RNA, 17 nt, Pseudomonas aeruginosa PA01
cgagacgcccuggauga

SEQ ID NO: 1526752 - RNA, 19 nt, Pseudomonas aeruginosa PA01
cgagacgccgccccagccu

SEQ ID NO: 1526753 - RNA, 22 nt, Pseudomonas aeruginosa PA01
cgagaccaucuggaucaggaag

SEQ ID NO: 1526754 - RNA, 22 nt, Pseudomonas aeruginosa PA01
cgagacccccgggaugcccggc

SEQ ID NO: 1526755 - RNA, 17 nt, Pseudomonas aeruginosa PA01
cgagaccgcagcccagu

SEQ ID NO: 1526756 - RNA, 21 nt, Pseudomonas aeruginosa PA01
cgagaaaguucccgcauggcu

SEQ ID NO: 1526757 - RNA, 16 nt, Pseudomonas aeruginosa PA01
cgagaaauaggcgcug

SEQ ID NO: 1526758 - RNA, 20 nt, Pseudomonas aeruginosa PA01
cgagaaagucgaucagcgcg

SEQ ID NO: 1526759 - RNA, 17 nt, Pseudomonas aeruginosa PA01
cgagaaaaagcccggca

SEQ ID NO: 1526760 - RNA, 21 nt, Pseudomonas aeruginosa PA01
cgagaaaacccugggaauggc

SEQ ID NO: 1526761 - RNA, 14 nt, Pseudomonas aeruginosa PA01
cgagaaacugcagg

SEQ ID NO: 1526762 - RNA, 23 nt, Pseudomonas aeruginosa PA01
cgagaagccgcccacgggcggcu

SEQ ID NO: 1526763 - RNA, 16 nt, Pseudomonas aeruginosa PA01
cgagaagccagccagg

SEQ ID NO: 1526764 - RNA, 24 nt, Pseudomonas aeruginosa PA01
cgagaaggaagucgagcuggugga

SEQ ID NO: 1526765 - RNA, 22 nt, Pseudomonas aeruginosa PA01
cgagaagguucucggccaccac

SEQ ID NO: 1526766 - RNA, 20 nt, Pseudomonas aeruginosa PA01
cgacgguaccagggaagcgc

SEQ ID NO: 1526767 - RNA, 23 nt, Pseudomonas aeruginosa PA01
cgacggucaggccgagcagcgcc

SEQ ID NO: 1526768 - RNA, 22 nt, Pseudomonas aeruginosa PA01
cgacgguuucaggccuugcuga

SEQ ID NO: 1526769 - RNA, 18 nt, Pseudomonas aeruginosa PA01
cgacguaccgccugccau

SEQ ID NO: 1526770 - RNA, 21 nt, Pseudomonas aeruginosa PA01
cgacguccacugcguccuggu

SEQ ID NO: 1526771 - RNA, 17 nt, Pseudomonas aeruginosa PA01
cgacgucccuuccccga

SEQ ID NO: 1526772 - RNA, 14 nt, Pseudomonas aeruginosa PA01
cgacgucgaucuug

SEQ ID NO: 1526773 - RNA, 16 nt, Pseudomonas aeruginosa PA01
cgacggcggccgccau

SEQ ID NO: 1526774 - RNA, 15 nt, Pseudomonas aeruginosa PA01
cgacggcggugcgca

SEQ ID NO: 1526775 - RNA, 15 nt, Pseudomonas aeruginosa PA01
cgacggcuugaucac

SEQ ID NO: 1526776 - RNA, 13 nt, Pseudomonas aeruginosa PA01
cgacggcuuccag

SEQ ID NO: 1526777 - RNA, 15 nt, Pseudomonas aeruginosa PA01
cgacggcuuccaggg

SEQ ID NO: 1526778 - RNA, 14 nt, Pseudomonas aeruginosa PA01
cgacggcuucgacc

SEQ ID NO: 1526779 - RNA, 15 nt, Pseudomonas aeruginosa PA01
cgacgcucagcaccc

SEQ ID NO: 1526780 - RNA, 12 nt, Pseudomonas aeruginosa PA01
cgacgcgcagcg

SEQ ID NO: 1526781 - RNA, 20 nt, Pseudomonas aeruginosa PA01
cgacgcgaccuccggcgcca

SEQ ID NO: 1526782 - RNA, 15 nt, Pseudomonas aeruginosa PA01
cgacgccuucagcau

SEQ ID NO: 1526783 - RNA, 12 nt, Pseudomonas aeruginosa PA01
cgacgcgcugcc

SEQ ID NO: 1526784 - RNA, 15 nt, Pseudomonas aeruginosa PA01
cgacgcugucgugga

SEQ ID NO: 1526785 - RNA, 13 nt, Pseudomonas aeruginosa PA01
cgacggaagcccu

SEQ ID NO: 1526786 - RNA, 13 nt, Pseudomonas aeruginosa PA01
cgacggaacagga

SEQ ID NO: 1526787 - RNA, 16 nt, Pseudomonas aeruginosa PA01
cgacgcuuccucgcuc

SEQ ID NO: 1526788 - RNA, 13 nt, Pseudomonas aeruginosa PA01
cgacuggcccugg

SEQ ID NO: 1526789 - RNA, 16 nt, Pseudomonas aeruginosa PA01
cgacugccgucggcgc

SEQ ID NO: 1526790 - RNA, 12 nt, Pseudomonas aeruginosa PA01
cgacugcugcug

SEQ ID NO: 1526791 - RNA, 18 nt, Pseudomonas aeruginosa PA01
cgacugcugcugcggggc

SEQ ID NO: 1526792 - RNA, 18 nt, Pseudomonas aeruginosa PA01
cgacugguccugcggcgg

SEQ ID NO: 1526793 - RNA, 20 nt, Pseudomonas aeruginosa PA01
cgacugguccugcggcggca

SEQ ID NO: 1526794 - RNA, 18 nt, Pseudomonas aeruginosa PA01
cgacugucgagcaggguc

SEQ ID NO: 1526795 - RNA, 16 nt, Pseudomonas aeruginosa PA01
cgacugcaugaccucc

SEQ ID NO: 1526796 - RNA, 12 nt, Pseudomonas aeruginosa PA01
cgacugcagcgg

SEQ ID NO: 1526797 - RNA, 20 nt, Pseudomonas aeruginosa PA01
cgacugcgagccgacuucca

SEQ ID NO: 1526798 - RNA, 14 nt, Pseudomonas aeruginosa PA01
cgacuuccaggcgc

SEQ ID NO: 1526799 - RNA, 23 nt, Pseudomonas aeruginosa PA01
cgacuuccgccuuguccugcaac

SEQ ID NO: 1526800 - RNA, 13 nt, Pseudomonas aeruginosa PA01
cgacuccugcaac

SEQ ID NO: 1526801 - RNA, 22 nt, Pseudomonas aeruginosa PA01
cgacucgauggcgcggugggcc

SEQ ID NO: 1526802 - RNA, 13 nt, Pseudomonas aeruginosa PA01
cgacuccagcuuc

SEQ ID NO: 1526803 - RNA, 17 nt, Pseudomonas aeruginosa PA01
cgacucgcugccggcgc

SEQ ID NO: 1526804 - RNA, 16 nt, Pseudomonas aeruginosa PA01
cgacucgcugggcgcc

SEQ ID NO: 1526805 - RNA, 12 nt, Pseudomonas aeruginosa PA01
cgacucggcugc

SEQ ID NO: 1526806 - RNA, 21 nt, Pseudomonas aeruginosa PA01
cgacucgguaaagcccaggua

SEQ ID NO: 1526807 - RNA, 17 nt, Pseudomonas aeruginosa PA01
cgacguugcgcaggggc

SEQ ID NO: 1526808 - RNA, 18 nt, Pseudomonas aeruginosa PA01
cgaggucggccuggcugc

SEQ ID NO: 1526809 - RNA, 14 nt, Pseudomonas aeruginosa PA01
cgaggucggcggcg

SEQ ID NO: 1526810 - RNA, 15 nt, Pseudomonas aeruginosa PA01
cgaggucuuggccag

SEQ ID NO: 1526811 - RNA, 17 nt, Pseudomonas aeruginosa PA01
cgaggucuuggccagcc

SEQ ID NO: 1526812 - RNA, 21 nt, Pseudomonas aeruginosa PA01
cgaggucuuggccagccgcgc

SEQ ID NO: 1526813 - RNA, 22 nt, Pseudomonas aeruginosa PA01
cgaggucuuggccagccgcgcg

SEQ ID NO: 1526814 - RNA, 21 nt, Pseudomonas aeruginosa PA01
cgaggucugugccgugaucac

SEQ ID NO: 1526815 - RNA, 15 nt, Pseudomonas aeruginosa PA01
cgaggugcugcaccg

SEQ ID NO: 1526816 - RNA, 19 nt, Pseudomonas aeruginosa PA01
cgagguggcugaagcccca

SEQ ID NO: 1526817 - RNA, 17 nt, Pseudomonas aeruginosa PA01
cgagguggaugaacagc

SEQ ID NO: 1526818 - RNA, 17 nt, Pseudomonas aeruginosa PA01
cgagguucuugcccagc

SEQ ID NO: 1526819 - RNA, 18 nt, Pseudomonas aeruginosa PA01
cgagguucuugcccagca

SEQ ID NO: 1526820 - RNA, 23 nt, Pseudomonas aeruginosa PA01
cgagguuuccaguugcagggugc

SEQ ID NO: 1526821 - RNA, 15 nt, Pseudomonas aeruginosa PA01
cgagguugcgcggca

SEQ ID NO: 1526822 - RNA, 16 nt, Pseudomonas aeruginosa PA01
cgagguugcgcuccau

SEQ ID NO: 1526823 - RNA, 20 nt, Pseudomonas aeruginosa PA01
cgagguagaacaggcugccg

SEQ ID NO: 1526824 - RNA, 17 nt, Pseudomonas aeruginosa PA01
cgaggggcggagcagcc

SEQ ID NO: 1526825 - RNA, 17 nt, Pseudomonas aeruginosa PA01
cgagggucugcucgacg

SEQ ID NO: 1526826 - RNA, 19 nt, Pseudomonas aeruginosa PA01
cgagggugaacuggccguc

SEQ ID NO: 1526827 - RNA, 12 nt, Pseudomonas aeruginosa PA01
cgagggugcaga

SEQ ID NO: 1526828 - RNA, 16 nt, Pseudomonas aeruginosa PA01
cgagggugcagagcag

SEQ ID NO: 1526829 - RNA, 22 nt, Pseudomonas aeruginosa PA01
cgaggggaacauugccaccacc

SEQ ID NO: 1526830 - RNA, 18 nt, Pseudomonas aeruginosa PA01
cgagggaggaggcgccgg

SEQ ID NO: 1526831 - RNA, 18 nt, Pseudomonas aeruginosa PA01
cgagggcgaacagcagcg

SEQ ID NO: 1526832 - RNA, 20 nt, Pseudomonas aeruginosa PA01
cgagggcgccaggugcagga

SEQ ID NO: 1526833 - RNA, 18 nt, Pseudomonas aeruginosa PA01
cgagggcaaaggcgcgca

SEQ ID NO: 1526834 - RNA, 12 nt, Pseudomonas aeruginosa PA01
cgagggcaccac

SEQ ID NO: 1526835 - RNA, 14 nt, Pseudomonas aeruginosa PA01
cgagggcaugaccg

SEQ ID NO: 1526836 - RNA, 18 nt, Pseudomonas aeruginosa PA01
cgagggcauguuggcgcc

SEQ ID NO: 1526837 - RNA, 19 nt, Pseudomonas aeruginosa PA01
cgaguggcgaagccagcac

SEQ ID NO: 1526838 - RNA, 17 nt, Pseudomonas aeruginosa PA01
cgaguggcgcagcgccc

SEQ ID NO: 1526839 - RNA, 14 nt, Pseudomonas aeruginosa PA01
cgagugcgcccagc

SEQ ID NO: 1526840 - RNA, 15 nt, Pseudomonas aeruginosa PA01
cgagugcgcccagca

SEQ ID NO: 1526841 - RNA, 17 nt, Pseudomonas aeruginosa PA01
cgagugcgcccagcagc

SEQ ID NO: 1526842 - RNA, 15 nt, Pseudomonas aeruginosa PA01
cgagucgacccaggc

SEQ ID NO: 1526843 - RNA, 22 nt, Pseudomonas aeruginosa PA01
cgagucgacccaggcccagccg

SEQ ID NO: 1526844 - RNA, 14 nt, Pseudomonas aeruginosa PA01
cgagucgggucuuc

SEQ ID NO: 1526845 - RNA, 22 nt, Pseudomonas aeruginosa PA01
cgaguccgcgcgcgcgcuccuc

SEQ ID NO: 1526846 - RNA, 11 nt, Pseudomonas aeruginosa PA01
cgaguaggucc

SEQ ID NO: 1526847 - RNA, 21 nt, Pseudomonas aeruginosa PA01
cgaguaguagcguuccuggcg

SEQ ID NO: 1526848 - RNA, 21 nt, Pseudomonas aeruginosa PA01
cgagucaccccgaccagcgcg

SEQ ID NO: 1526849 - RNA, 17 nt, Pseudomonas aeruginosa PA01
cgaguaggcgaagccca

SEQ ID NO: 1526850 - RNA, 18 nt, Pseudomonas aeruginosa PA01
cgaguaggcgaagcccag

SEQ ID NO: 1526851 - RNA, 19 nt, Pseudomonas aeruginosa PA01
cgaguaaccaccgcucucg

SEQ ID NO: 1526852 - RNA, 14 nt, Pseudomonas aeruginosa PA01
cgauaccgccgccg

SEQ ID NO: 1526853 - RNA, 14 nt, Pseudomonas aeruginosa PA01
cgauaugcaggucg

SEQ ID NO: 1526854 - RNA, 16 nt, Pseudomonas aeruginosa PA01
cgauagccuggcuggc

SEQ ID NO: 1526855 - RNA, 21 nt, Pseudomonas aeruginosa PA01
cgaguucggcguuguccaggc

SEQ ID NO: 1526856 - RNA, 19 nt, Pseudomonas aeruginosa PA01
cgaguugggcgaccugcuc

SEQ ID NO: 1526857 - RNA, 19 nt, Pseudomonas aeruginosa PA01
cgaguucgccgcgagcacc

SEQ ID NO: 1526858 - RNA, 13 nt, Pseudomonas aeruginosa PA01
cgagccgcgcagc

SEQ ID NO: 1526859 - RNA, 13 nt, Pseudomonas aeruginosa PA01
cgagccgccgggg

SEQ ID NO: 1526860 - RNA, 18 nt, Pseudomonas aeruginosa PA01
cgagccgccggggaagcu

SEQ ID NO: 1526861 - RNA, 21 nt, Pseudomonas aeruginosa PA01
cgagccgcgacgcgaccuccg

SEQ ID NO: 1526862 - RNA, 20 nt, Pseudomonas aeruginosa PA01
cgagccgcuuggagcgggcg

SEQ ID NO: 1526863 - RNA, 14 nt, Pseudomonas aeruginosa PA01
cgagccggacggcg

SEQ ID NO: 1526864 - RNA, 21 nt, Pseudomonas aeruginosa PA01
cgagccguuccaggcggggcg

SEQ ID NO: 1526865 - RNA, 15 nt, Pseudomonas aeruginosa PA01
cgagccuggccaggc

SEQ ID NO: 1526866 - RNA, 18 nt, Pseudomonas aeruginosa PA01
cgagccuucagcacggcg

SEQ ID NO: 1526867 - RNA, 22 nt, Pseudomonas aeruginosa PA01
cgagcgacuccgggaacagccc

SEQ ID NO: 1526868 - RNA, 13 nt, Pseudomonas aeruginosa PA01
cgagcgcgccgcc

SEQ ID NO: 1526869 - RNA, 15 nt, Pseudomonas aeruginosa PA01
cgagcgcgcccaggu

SEQ ID NO: 1526870 - RNA, 13 nt, Pseudomonas aeruginosa PA01
cgagcgccgccuu

SEQ ID NO: 1526871 - RNA, 15 nt, Pseudomonas aeruginosa PA01
cgagcgccuggcaac

SEQ ID NO: 1526872 - RNA, 16 nt, Pseudomonas aeruginosa PA01
cgagcgccuggcaacc

SEQ ID NO: 1526873 - RNA, 14 nt, Pseudomonas aeruginosa PA01
cgagcgccagggcc

SEQ ID NO: 1526874 - RNA, 19 nt, Pseudomonas aeruginosa PA01
cgagcgcagcgacacaacg

SEQ ID NO: 1526875 - RNA, 16 nt, Pseudomonas aeruginosa PA01
cgagccgcgcugcugg

SEQ ID NO: 1526876 - RNA, 15 nt, Pseudomonas aeruginosa PA01
cgagcucggccaggc

SEQ ID NO: 1526877 - RNA, 16 nt, Pseudomonas aeruginosa PA01
cgagcgugcgcaugcc

SEQ ID NO: 1526878 - RNA, 20 nt, Pseudomonas aeruginosa PA01
cgagcgugcgcaugcccgcg

SEQ ID NO: 1526879 - RNA, 14 nt, Pseudomonas aeruginosa PA01
cgagcgggaagcgu

SEQ ID NO: 1526880 - RNA, 21 nt, Pseudomonas aeruginosa PA01
cgagcgggaagcguuccugga

SEQ ID NO: 1526881 - RNA, 14 nt, Pseudomonas aeruginosa PA01
cgagcgcuccaccg

SEQ ID NO: 1526882 - RNA, 20 nt, Pseudomonas aeruginosa PA01
cgagcggcggccgucgcugg

SEQ ID NO: 1526883 - RNA, 17 nt, Pseudomonas aeruginosa PA01
cgaggaacagcaccagc

SEQ ID NO: 1526884 - RNA, 23 nt, Pseudomonas aeruginosa PA01
cgaggaacagcgagaggggcgcu

SEQ ID NO: 1526885 - RNA, 17 nt, Pseudomonas aeruginosa PA01
cgaggaaaaggaucgcc

SEQ ID NO: 1526886 - RNA, 21 nt, Pseudomonas aeruginosa PA01
cgagcuggaucggcaggcugg

SEQ ID NO: 1526887 - RNA, 15 nt, Pseudomonas aeruginosa PA01
cgagcuuggcccugg

SEQ ID NO: 1526888 - RNA, 22 nt, Pseudomonas aeruginosa PA01
cgagcuuugcgcagccacccgc

SEQ ID NO: 1526889 - RNA, 20 nt, Pseudomonas aeruginosa PA01
cgaggaggacgauggaacgc

SEQ ID NO: 1526890 - RNA, 23 nt, Pseudomonas aeruginosa PA01
cgaggaggaucucgcgccccggg

SEQ ID NO: 1526891 - RNA, 14 nt, Pseudomonas aeruginosa PA01
cgaggaggccagca

SEQ ID NO: 1526892 - RNA, 20 nt, Pseudomonas aeruginosa PA01
cgaggaucuugcgcccggcg

SEQ ID NO: 1526893 - RNA, 17 nt, Pseudomonas aeruginosa PA01
cgaggaucgcgcuggcc

SEQ ID NO: 1526894 - RNA, 17 nt, Pseudomonas aeruginosa PA01
cgaggaucgcucccagg

SEQ ID NO: 1526895 - RNA, 19 nt, Pseudomonas aeruginosa PA01
cgaggauacgcucaggaag

SEQ ID NO: 1526896 - RNA, 17 nt, Pseudomonas aeruginosa PA01
cgaggaucacgcagcag

SEQ ID NO: 1526897 - RNA, 18 nt, Pseudomonas aeruginosa PA01
cgaggaucacgcagcagg

SEQ ID NO: 1526898 - RNA, 15 nt, Pseudomonas aeruginosa PA01
cgaggaaggccagca

SEQ ID NO: 1526899 - RNA, 22 nt, Pseudomonas aeruginosa PA01
cgaggaagaaaaagcccgcuuc

SEQ ID NO: 1526900 - RNA, 17 nt, Pseudomonas aeruginosa PA01
cgaggaagucggcggcc

SEQ ID NO: 1526901 - RNA, 20 nt, Pseudomonas aeruginosa PA01
cgaggaaggcgcgcaccagc

SEQ ID NO: 1526902 - RNA, 23 nt, Pseudomonas aeruginosa PA01
cgaggaauuccggcagcgacugg

SEQ ID NO: 1526903 - RNA, 22 nt, Pseudomonas aeruginosa PA01
cgaggacuucauggaggaagcu

SEQ ID NO: 1526904 - RNA, 15 nt, Pseudomonas aeruginosa PA01
cgaggagacgcggca

SEQ ID NO: 1526905 - RNA, 14 nt, Pseudomonas aeruginosa PA01
cgaggacgccgccg

SEQ ID NO: 1526906 - RNA, 12 nt, Pseudomonas aeruginosa PA01
cgaggcgcggcg

SEQ ID NO: 1526907 - RNA, 22 nt, Pseudomonas aeruginosa PA01
cgaggcgaguaccaccgugccc

SEQ ID NO: 1526908 - RNA, 14 nt, Pseudomonas aeruginosa PA01
cgaggcggcgcagc

SEQ ID NO: 1526909 - RNA, 20 nt, Pseudomonas aeruginosa PA01
cgaggcgcuucugcucggcc

SEQ ID NO: 1526910 - RNA, 22 nt, Pseudomonas aeruginosa PA01
cgaggcggagaagccgcugacc

SEQ ID NO: 1526911 - RNA, 22 nt, Pseudomonas aeruginosa PA01
cgaggcgcucgacgaucaggug

SEQ ID NO: 1526912 - RNA, 22 nt, Pseudomonas aeruginosa PA01
cgaggcgcucuucacuuccagc

SEQ ID NO: 1526913 - RNA, 14 nt, Pseudomonas aeruginosa PA01
cgaggcgucggcgg

SEQ ID NO: 1526914 - RNA, 15 nt, Pseudomonas aeruginosa PA01
cgaggcguggaaggg

SEQ ID NO: 1526915 - RNA, 17 nt, Pseudomonas aeruginosa PA01
cgaggcguuccaggugg

SEQ ID NO: 1526916 - RNA, 22 nt, Pseudomonas aeruginosa PA01
cgaggcucggucgcgcgggugc

SEQ ID NO: 1526917 - RNA, 15 nt, Pseudomonas aeruginosa PA01
cgaggaugucggcga

SEQ ID NO: 1526918 - RNA, 14 nt, Pseudomonas aeruginosa PA01
cgaggauggucagg

SEQ ID NO: 1526919 - RNA, 14 nt, Pseudomonas aeruginosa PA01
cgaggauggccguc

SEQ ID NO: 1526920 - RNA, 17 nt, Pseudomonas aeruginosa PA01
cgaggccgcggagcacc

SEQ ID NO: 1526921 - RNA, 22 nt, Pseudomonas aeruginosa PA01
cgaggcccagcgacuccgccag

SEQ ID NO: 1526922 - RNA, 17 nt, Pseudomonas aeruginosa PA01
cgaggccgccgcgggca

SEQ ID NO: 1526923 - RNA, 16 nt, Pseudomonas aeruginosa PA01
cgaggccgaaauggcg

SEQ ID NO: 1526924 - RNA, 15 nt, Pseudomonas aeruginosa PA01
ccggcucgccgccgg

SEQ ID NO: 1526925 - RNA, 14 nt, Pseudomonas aeruginosa PA01
ccggcucgccgcgc

SEQ ID NO: 1526926 - RNA, 11 nt, Pseudomonas aeruginosa PA01
ccggcucgccc

SEQ ID NO: 1526927 - RNA, 16 nt, Pseudomonas aeruginosa PA01
ccggcuccuugcgccg

SEQ ID NO: 1526928 - RNA, 16 nt, Pseudomonas aeruginosa PA01
ccggcuccagccgggc

SEQ ID NO: 1526929 - RNA, 17 nt, Pseudomonas aeruginosa PA01
ccggcuccagccgggcu

SEQ ID NO: 1526930 - RNA, 17 nt, Pseudomonas aeruginosa PA01
ccggcguugaacugccc

SEQ ID NO: 1526931 - RNA, 20 nt, Pseudomonas aeruginosa PA01
ccggcgugggcggucggcga

SEQ ID NO: 1526932 - RNA, 20 nt, Pseudomonas aeruginosa PA01
ccggcgugagcagggccgag

SEQ ID NO: 1526933 - RNA, 20 nt, Pseudomonas aeruginosa PA01
ccggcgucggcgcgggcgcc

SEQ ID NO: 1526934 - RNA, 13 nt, Pseudomonas aeruginosa PA01
ccggcgucggcgc

SEQ ID NO: 1526935 - RNA, 18 nt, Pseudomonas aeruginosa PA01
ccggcugugcagggcagc

SEQ ID NO: 1526936 - RNA, 17 nt, Pseudomonas aeruginosa PA01
ccggcuggucagaacca

SEQ ID NO: 1526937 - RNA, 19 nt, Pseudomonas aeruginosa PA01
ccggcugguugccagcagc

SEQ ID NO: 1526938 - RNA, 20 nt, Pseudomonas aeruginosa PA01
ccggcugguugccagcagcg

SEQ ID NO: 1526939 - RNA, 14 nt, Pseudomonas aeruginosa PA01
ccggcugucgacgc

SEQ ID NO: 1526940 - RNA, 19 nt, Pseudomonas aeruginosa PA01
ccggcugucgacgcagccg

SEQ ID NO: 1526941 - RNA, 21 nt, Pseudomonas aeruginosa PA01
ccggcuugccgaugucgccgg

SEQ ID NO: 1526942 - RNA, 18 nt, Pseudomonas aeruginosa PA01
ccggcuugaccgccgccg

SEQ ID NO: 1526943 - RNA, 19 nt, Pseudomonas aeruginosa PA01
ccggcuucggcggcgcgcu

SEQ ID NO: 1526944 - RNA, 23 nt, Pseudomonas aeruginosa PA01
ccggcugaugcccgggucgucgg

SEQ ID NO: 1526945 - RNA, 23 nt, Pseudomonas aeruginosa PA01
ccggcucguucaugucggcuccu

SEQ ID NO: 1526946 - RNA, 15 nt, Pseudomonas aeruginosa PA01
ccggcucgucggcgu

SEQ ID NO: 1526947 - RNA, 17 nt, Pseudomonas aeruginosa PA01
ccggcuggcccuccauc

SEQ ID NO: 1526948 - RNA, 12 nt, Pseudomonas aeruginosa PA01
ccggcuggcgcc

SEQ ID NO: 1526949 - RNA, 20 nt, Pseudomonas aeruginosa PA01
ccggcuggcgccggugcaug

SEQ ID NO: 1526950 - RNA, 18 nt, Pseudomonas aeruginosa PA01
ccggcuggcggcucggcu

SEQ ID NO: 1526951 - RNA, 17 nt, Pseudomonas aeruginosa PA01
ccggccagguaccggcc

SEQ ID NO: 1526952 - RNA, 20 nt, Pseudomonas aeruginosa PA01
ccggccagguaccggccagg

SEQ ID NO: 1526953 - RNA, 23 nt, Pseudomonas aeruginosa PA01
ccggccagguaccggccaggcgg

SEQ ID NO: 1526954 - RNA, 21 nt, Pseudomonas aeruginosa PA01
ccggccagguaggcgacgaag

SEQ ID NO: 1526955 - RNA, 17 nt, Pseudomonas aeruginosa PA01
ccggccaggcgcggcgc

SEQ ID NO: 1526956 - RNA, 21 nt, Pseudomonas aeruginosa PA01
ccggccaccaucacgucgcgc

SEQ ID NO: 1526957 - RNA, 13 nt, Pseudomonas aeruginosa PA01
ccggcggccaggg

SEQ ID NO: 1526958 - RNA, 23 nt, Pseudomonas aeruginosa PA01
ccggcggcgaucuucuccgccgc

SEQ ID NO: 1526959 - RNA, 18 nt, Pseudomonas aeruginosa PA01
ccggcggcgacccagacc

SEQ ID NO: 1526960 - RNA, 16 nt, Pseudomonas aeruginosa PA01
ccggcggccugccccg

SEQ ID NO: 1526961 - RNA, 18 nt, Pseudomonas aeruginosa PA01
ccggcggccugccccgcc

SEQ ID NO: 1526962 - RNA, 16 nt, Pseudomonas aeruginosa PA01
ccggccauccuggccg

SEQ ID NO: 1526963 - RNA, 22 nt, Pseudomonas aeruginosa PA01
ccggcggaugacguucccgucc

SEQ ID NO: 1526964 - RNA, 19 nt, Pseudomonas aeruginosa PA01
ccggcggcgcguccaccug

SEQ ID NO: 1526965 - RNA, 19 nt, Pseudomonas aeruginosa PA01
ccggcggcugcugcgccug

SEQ ID NO: 1526966 - RNA, 15 nt, Pseudomonas aeruginosa PA01
ccggcgggacgcgca

SEQ ID NO: 1526967 - RNA, 16 nt, Pseudomonas aeruginosa PA01
ccggcgguccgccgcg

SEQ ID NO: 1526968 - RNA, 17 nt, Pseudomonas aeruginosa PA01
ccggcgguccgccgcgg

SEQ ID NO: 1526969 - RNA, 23 nt, Pseudomonas aeruginosa PA01
ccggcgguccgccgcgggacgcc

SEQ ID NO: 1526970 - RNA, 20 nt, Pseudomonas aeruginosa PA01
ccggcgguggacgucggcgu

SEQ ID NO: 1526971 - RNA, 13 nt, Pseudomonas aeruginosa PA01
ccggcguccagga

SEQ ID NO: 1526972 - RNA, 14 nt, Pseudomonas aeruginosa PA01
ccggcguccuugcc

SEQ ID NO: 1526973 - RNA, 14 nt, Pseudomonas aeruginosa PA01
ccggcguccgggug

SEQ ID NO: 1526974 - RNA, 15 nt, Pseudomonas aeruginosa PA01
ccggcguccuccucc

SEQ ID NO: 1526975 - RNA, 22 nt, Pseudomonas aeruginosa PA01
ccggcguaccuugagcagggcg

SEQ ID NO: 1526976 - RNA, 16 nt, Pseudomonas aeruginosa PA01
ccgggcuggccaccgc

SEQ ID NO: 1526977 - RNA, 21 nt, Pseudomonas aeruginosa PA01
ccgggcuggccaccgccagga

SEQ ID NO: 1526978 - RNA, 17 nt, Pseudomonas aeruginosa PA01
ccgggcugccgaacagg

SEQ ID NO: 1526979 - RNA, 17 nt, Pseudomonas aeruginosa PA01
ccgggcuguagugcucc

SEQ ID NO: 1526980 - RNA, 15 nt, Pseudomonas aeruginosa PA01
ccgggcuccgccgcg

SEQ ID NO: 1526981 - RNA, 17 nt, Pseudomonas aeruginosa PA01
ccgggcuugcaauccgu

SEQ ID NO: 1526982 - RNA, 21 nt, Pseudomonas aeruginosa PA01
ccgggcuuuuucucgucgcgc

SEQ ID NO: 1526983 - RNA, 16 nt, Pseudomonas aeruginosa PA01
ccggggcagcagggcg

SEQ ID NO: 1526984 - RNA, 16 nt, Pseudomonas aeruginosa PA01
ccgggcggcgcggcgc

SEQ ID NO: 1526985 - RNA, 17 nt, Pseudomonas aeruginosa PA01
ccgggcggcgcggcgca

SEQ ID NO: 1526986 - RNA, 13 nt, Pseudomonas aeruginosa PA01
ccgggcggcggcg

SEQ ID NO: 1526987 - RNA, 16 nt, Pseudomonas aeruginosa PA01
ccgggcggcgggcgca

SEQ ID NO: 1526988 - RNA, 19 nt, Pseudomonas aeruginosa PA01
ccgggcggcgucgcggaga

SEQ ID NO: 1526989 - RNA, 23 nt, Pseudomonas aeruginosa PA01
ccgggcgugucgaggaaggccag

SEQ ID NO: 1526990 - RNA, 17 nt, Pseudomonas aeruginosa PA01
ccgggcucacucccguc

SEQ ID NO: 1526991 - RNA, 18 nt, Pseudomonas aeruginosa PA01
ccgggccgaucaccaccu

SEQ ID NO: 1526992 - RNA, 15 nt, Pseudomonas aeruginosa PA01
ccgggcccaggcugg

SEQ ID NO: 1526993 - RNA, 19 nt, Pseudomonas aeruginosa PA01
ccgggccgagggcugagac

SEQ ID NO: 1526994 - RNA, 15 nt, Pseudomonas aeruginosa PA01
ccgggaaacagggcg

SEQ ID NO: 1526995 - RNA, 20 nt, Pseudomonas aeruginosa PA01
ccgggaaacagggcgacgcc

SEQ ID NO: 1526996 - RNA, 21 nt, Pseudomonas aeruginosa PA01
ccggcuuuccucggccaugcc

SEQ ID NO: 1526997 - RNA, 16 nt, Pseudomonas aeruginosa PA01
ccgggaagcaggucuc

SEQ ID NO: 1526998 - RNA, 18 nt, Pseudomonas aeruginosa PA01
ccgggaaagucugugauc

SEQ ID NO: 1526999 - RNA, 22 nt, Pseudomonas aeruginosa PA01
ccgggaccggcugcuuggccag

SEQ ID NO: 1527000 - RNA, 16 nt, Pseudomonas aeruginosa PA01
ccgggaagucguuccc

SEQ ID NO: 1527001 - RNA, 20 nt, Pseudomonas aeruginosa PA01
ccgggaaucgccagcaggcu

SEQ ID NO: 1527002 - RNA, 16 nt, Pseudomonas aeruginosa PA01
ccgggaagccgcucgg

SEQ ID NO: 1527003 - RNA, 17 nt, Pseudomonas aeruginosa PA01
ccgggccagcuccgccu

SEQ ID NO: 1527004 - RNA, 16 nt, Pseudomonas aeruginosa PA01
ccgggacgaagcggaa

SEQ ID NO: 1527005 - RNA, 17 nt, Pseudomonas aeruginosa PA01
ccggguugaaggcgcgg

SEQ ID NO: 1527006 - RNA, 18 nt, Pseudomonas aeruginosa PA01
ccggguugguggccgcgc

SEQ ID NO: 1527007 - RNA, 23 nt, Pseudomonas aeruginosa PA01
ccggguguuguucuucauccagu

SEQ ID NO: 1527008 - RNA, 15 nt, Pseudomonas aeruginosa PA01
ccggguguuuuuccu

SEQ ID NO: 1527009 - RNA, 13 nt, Pseudomonas aeruginosa PA01
ccgggucaggccg

SEQ ID NO: 1527010 - RNA, 15 nt, Pseudomonas aeruginosa PA01
ccggggccggcaccc

SEQ ID NO: 1527011 - RNA, 12 nt, Pseudomonas aeruginosa PA01
ccggggccguuc

SEQ ID NO: 1527012 - RNA, 21 nt, Pseudomonas aeruginosa PA01
ccggggcggauucaggcgcgc

SEQ ID NO: 1527013 - RNA, 22 nt, Pseudomonas aeruginosa PA01
ccggggcggccaaccucucccc

SEQ ID NO: 1527014 - RNA, 12 nt, Pseudomonas aeruginosa PA01
ccggggcgcgcc

SEQ ID NO: 1527015 - RNA, 19 nt, Pseudomonas aeruginosa PA01
ccggguacuggcgcugcgc

SEQ ID NO: 1527016 - RNA, 22 nt, Pseudomonas aeruginosa PA01
ccggguaugcaggaucaguucg

SEQ ID NO: 1527017 - RNA, 17 nt, Pseudomonas aeruginosa PA01
ccggucgcaccgccagc

SEQ ID NO: 1527018 - RNA, 18 nt, Pseudomonas aeruginosa PA01
ccggucgcaccgccagca

SEQ ID NO: 1527019 - RNA, 15 nt, Pseudomonas aeruginosa PA01
ccggucuugccggcu

SEQ ID NO: 1527020 - RNA, 22 nt, Pseudomonas aeruginosa PA01
ccggucgcuuuuuccgcugccg

SEQ ID NO: 1527021 - RNA, 22 nt, Pseudomonas aeruginosa PA01
ccggucuucacgccuugcugcg

SEQ ID NO: 1527022 - RNA, 13 nt, Pseudomonas aeruginosa PA01
ccggugaacaggu

SEQ ID NO: 1527023 - RNA, 17 nt, Pseudomonas aeruginosa PA01
ccgguaucgcgcuugga

SEQ ID NO: 1527024 - RNA, 17 nt, Pseudomonas aeruginosa PA01
ccgguccguccagcgcg

SEQ ID NO: 1527025 - RNA, 13 nt, Pseudomonas aeruginosa PA01
ccggucaccgugg

SEQ ID NO: 1527026 - RNA, 14 nt, Pseudomonas aeruginosa PA01
ccgucagccaggcu

SEQ ID NO: 1527027 - RNA, 14 nt, Pseudomonas aeruginosa PA01
ccgucgaagaucac

SEQ ID NO: 1527028 - RNA, 15 nt, Pseudomonas aeruginosa PA01
ccgucgaagaucacc

SEQ ID NO: 1527029 - RNA, 16 nt, Pseudomonas aeruginosa PA01
ccgucgaacagcagcu

SEQ ID NO: 1527030 - RNA, 16 nt, Pseudomonas aeruginosa PA01
ccgucgaaccagccgc

SEQ ID NO: 1527031 - RNA, 17 nt, Pseudomonas aeruginosa PA01
ccgucgaaccagggacg

SEQ ID NO: 1527032 - RNA, 21 nt, Pseudomonas aeruginosa PA01
ccgucgaccaucaccagcgcc

SEQ ID NO: 1527033 - RNA, 13 nt, Pseudomonas aeruginosa PA01
ccgucgacccgcc

SEQ ID NO: 1527034 - RNA, 21 nt, Pseudomonas aeruginosa PA01
ccgucgagccagcccagcggc

SEQ ID NO: 1527035 - RNA, 17 nt, Pseudomonas aeruginosa PA01
ccgucgagcaccaggcg

SEQ ID NO: 1527036 - RNA, 18 nt, Pseudomonas aeruginosa PA01
ccgucggcaagcaggccg

SEQ ID NO: 1527037 - RNA, 22 nt, Pseudomonas aeruginosa PA01
ccgucggcaagcaggccgcggu

SEQ ID NO: 1527038 - RNA, 14 nt, Pseudomonas aeruginosa PA01
ccgucgcuucgccc

SEQ ID NO: 1527039 - RNA, 19 nt, Pseudomonas aeruginosa PA01
ccgucgcuucgcccgccgc

SEQ ID NO: 1527040 - RNA, 16 nt, Pseudomonas aeruginosa PA01
ccgucggcccuccccu

SEQ ID NO: 1527041 - RNA, 16 nt, Pseudomonas aeruginosa PA01
ccgucgaggucggcga

SEQ ID NO: 1527042 - RNA, 15 nt, Pseudomonas aeruginosa PA01
ccgucgcgcgcccgu

SEQ ID NO: 1527043 - RNA, 22 nt, Pseudomonas aeruginosa PA01
ccgucgcggucaucgccggcgc

SEQ ID NO: 1527044 - RNA, 22 nt, Pseudomonas aeruginosa PA01
ccgucuucaguaggccagcggc

SEQ ID NO: 1527045 - RNA, 17 nt, Pseudomonas aeruginosa PA01
ccgucuccagcaaccca

SEQ ID NO: 1527046 - RNA, 22 nt, Pseudomonas aeruginosa PA01
ccgucguagcgcagcggcaggc

SEQ ID NO: 1527047 - RNA, 13 nt, Pseudomonas aeruginosa PA01
ccgucggugaucg

SEQ ID NO: 1527048 - RNA, 14 nt, Pseudomonas aeruginosa PA01
ccgucggcuccgcu

SEQ ID NO: 1527049 - RNA, 13 nt, Pseudomonas aeruginosa PA01
ccggugccgccgg

SEQ ID NO: 1527050 - RNA, 20 nt, Pseudomonas aeruginosa PA01
ccguaaaauggcgcgccucu

SEQ ID NO: 1527051 - RNA, 18 nt, Pseudomonas aeruginosa PA01
ccggugaucucgcggcgc

SEQ ID NO: 1527052 - RNA, 23 nt, Pseudomonas aeruginosa PA01
ccggugaggcgcagcagcgccag

SEQ ID NO: 1527053 - RNA, 18 nt, Pseudomonas aeruginosa PA01
ccggugccccgcuggccc

SEQ ID NO: 1527054 - RNA, 15 nt, Pseudomonas aeruginosa PA01
ccggugccaggacca

SEQ ID NO: 1527055 - RNA, 14 nt, Pseudomonas aeruginosa PA01
ccggugccagggcg

SEQ ID NO: 1527056 - RNA, 19 nt, Pseudomonas aeruginosa PA01
ccggugccagggcggucgg

SEQ ID NO: 1527057 - RNA, 17 nt, Pseudomonas aeruginosa PA01
ccggugcaccaggcgau

SEQ ID NO: 1527058 - RNA, 14 nt, Pseudomonas aeruginosa PA01
ccguagaugugcug

SEQ ID NO: 1527059 - RNA, 18 nt, Pseudomonas aeruginosa PA01
ccguagccgucgaacagc

SEQ ID NO: 1527060 - RNA, 19 nt, Pseudomonas aeruginosa PA01
ccguagaggucgccguccu

SEQ ID NO: 1527061 - RNA, 19 nt, Pseudomonas aeruginosa PA01
ccguacucauggccgcagc

SEQ ID NO: 1527062 - RNA, 16 nt, Pseudomonas aeruginosa PA01
ccguagaccaccagca

SEQ ID NO: 1527063 - RNA, 19 nt, Pseudomonas aeruginosa PA01
ccguaggugaccgcccagg

SEQ ID NO: 1527064 - RNA, 18 nt, Pseudomonas aeruginosa PA01
ccguagcugcgcgccucu

SEQ ID NO: 1527065 - RNA, 23 nt, Pseudomonas aeruginosa PA01
ccguagggcgaacaacgccgccg

SEQ ID NO: 1527066 - RNA, 18 nt, Pseudomonas aeruginosa PA01
ccgucacuucacgacagg

SEQ ID NO: 1527067 - RNA, 21 nt, Pseudomonas aeruginosa PA01
ccguaguggcguuccaggcgg

SEQ ID NO: 1527068 - RNA, 16 nt, Pseudomonas aeruginosa PA01
ccguuucgccgccggc

SEQ ID NO: 1527069 - RNA, 19 nt, Pseudomonas aeruginosa PA01
ccguugccuucgccgucga

SEQ ID NO: 1527070 - RNA, 22 nt, Pseudomonas aeruginosa PA01
ccguuccguucaaagcccgccu

SEQ ID NO: 1527071 - RNA, 19 nt, Pseudomonas aeruginosa PA01
ccguuccuccucgccgccg

SEQ ID NO: 1527072 - RNA, 12 nt, Pseudomonas aeruginosa PA01
ccguuccuugcg

SEQ ID NO: 1527073 - RNA, 14 nt, Pseudomonas aeruginosa PA01
ccguuccgacccgg

SEQ ID NO: 1527074 - RNA, 15 nt, Pseudomonas aeruginosa PA01
ccguuccgacccggc

SEQ ID NO: 1527075 - RNA, 13 nt, Pseudomonas aeruginosa PA01
ccgugcgccccag

SEQ ID NO: 1527076 - RNA, 20 nt, Pseudomonas aeruginosa PA01
ccgugcgccccagcucagca

SEQ ID NO: 1527077 - RNA, 17 nt, Pseudomonas aeruginosa PA01
ccgugcgcuccgccagg

SEQ ID NO: 1527078 - RNA, 19 nt, Pseudomonas aeruginosa PA01
ccgugcgcuccgccaggcc

SEQ ID NO: 1527079 - RNA, 12 nt, Pseudomonas aeruginosa PA01
ccgugccgggcc

SEQ ID NO: 1527080 - RNA, 16 nt, Pseudomonas aeruginosa PA01
ccgugaggcgcagggg

SEQ ID NO: 1527081 - RNA, 18 nt, Pseudomonas aeruginosa PA01
ccgugaggcgcaggggcu

SEQ ID NO: 1527082 - RNA, 22 nt, Pseudomonas aeruginosa PA01
ccgugaagcacggugacacccu

SEQ ID NO: 1527083 - RNA, 20 nt, Pseudomonas aeruginosa PA01
ccgugaccagcauggcgggc

SEQ ID NO: 1527084 - RNA, 22 nt, Pseudomonas aeruginosa PA01
ccgugacgaggggcugcggagc

SEQ ID NO: 1527085 - RNA, 20 nt, Pseudomonas aeruginosa PA01
ccgugcggagggucaggccg

SEQ ID NO: 1527086 - RNA, 22 nt, Pseudomonas aeruginosa PA01
ccgugcuucaucggcccggcuu

SEQ ID NO: 1527087 - RNA, 14 nt, Pseudomonas aeruginosa PA01
ccgugcuggccggc

SEQ ID NO: 1527088 - RNA, 17 nt, Pseudomonas aeruginosa PA01
ccgugguagucgagccg

SEQ ID NO: 1527089 - RNA, 18 nt, Pseudomonas aeruginosa PA01
ccgugguagucgagccgg

SEQ ID NO: 1527090 - RNA, 12 nt, Pseudomonas aeruginosa PA01
ccgugguacacc

SEQ ID NO: 1527091 - RNA, 22 nt, Pseudomonas aeruginosa PA01
ccguggcaggcgcccggucagg

SEQ ID NO: 1527092 - RNA, 16 nt, Pseudomonas aeruginosa PA01
ccguggcaccaggucg

SEQ ID NO: 1527093 - RNA, 16 nt, Pseudomonas aeruginosa PA01
ccguggcacccaggcc

SEQ ID NO: 1527094 - RNA, 17 nt, Pseudomonas aeruginosa PA01
ccguggaucgcccggcu

SEQ ID NO: 1527095 - RNA, 15 nt, Pseudomonas aeruginosa PA01
ccguggauuucagca

SEQ ID NO: 1527096 - RNA, 16 nt, Pseudomonas aeruginosa PA01
ccgugugcagcagggu

SEQ ID NO: 1527097 - RNA, 15 nt, Pseudomonas aeruginosa PA01
ccgugucggcggcgc

SEQ ID NO: 1527098 - RNA, 23 nt, Pseudomonas aeruginosa PA01
ccgugucggcggcgccuucgccg

SEQ ID NO: 1527099 - RNA, 18 nt, Pseudomonas aeruginosa PA01
ccguguaaugacuccggu

SEQ ID NO: 1527100 - RNA, 15 nt, Pseudomonas aeruginosa PA01
ccguucaggccggcg

SEQ ID NO: 1527101 - RNA, 13 nt, Pseudomonas aeruginosa PA01
ccguucacgccug

SEQ ID NO: 1527102 - RNA, 17 nt, Pseudomonas aeruginosa PA01
ccguucacgccuggcgg

SEQ ID NO: 1527103 - RNA, 15 nt, Pseudomonas aeruginosa PA01
ccguuccagcggcac

SEQ ID NO: 1527104 - RNA, 19 nt, Pseudomonas aeruginosa PA01
ccuccaucagcgccuccau

SEQ ID NO: 1527105 - RNA, 18 nt, Pseudomonas aeruginosa PA01
ccucccagggucgccucg

SEQ ID NO: 1527106 - RNA, 21 nt, Pseudomonas aeruginosa PA01
ccucccgggccagcuccgccu

SEQ ID NO: 1527107 - RNA, 13 nt, Pseudomonas aeruginosa PA01
ccuccccggcccg

SEQ ID NO: 1527108 - RNA, 17 nt, Pseudomonas aeruginosa PA01
ccuccccguccuggcgg

SEQ ID NO: 1527109 - RNA, 16 nt, Pseudomonas aeruginosa PA01
ccucccgccgcggcgu

SEQ ID NO: 1527110 - RNA, 14 nt, Pseudomonas aeruginosa PA01
ccucccgcgccagc

SEQ ID NO: 1527111 - RNA, 14 nt, Pseudomonas aeruginosa PA01
ccuccgccugcacg

SEQ ID NO: 1527112 - RNA, 15 nt, Pseudomonas aeruginosa PA01
ccuccgccagcccca

SEQ ID NO: 1527113 - RNA, 13 nt, Pseudomonas aeruginosa PA01
ccuccgccagcgu

SEQ ID NO: 1527114 - RNA, 14 nt, Pseudomonas aeruginosa PA01
ccuccgcgcccagg

SEQ ID NO: 1527115 - RNA, 15 nt, Pseudomonas aeruginosa PA01
ccucccugcccgcuc

SEQ ID NO: 1527116 - RNA, 20 nt, Pseudomonas aeruginosa PA01
ccuccuggaggacgcgggcu

SEQ ID NO: 1527117 - RNA, 15 nt, Pseudomonas aeruginosa PA01
ccuccuggcgcgucg

SEQ ID NO: 1527118 - RNA, 19 nt, Pseudomonas aeruginosa PA01
ccuccugggccgacgcuuc

SEQ ID NO: 1527119 - RNA, 21 nt, Pseudomonas aeruginosa PA01
ccuccugggccgacgcuuccu

SEQ ID NO: 1527120 - RNA, 18 nt, Pseudomonas aeruginosa PA01
ccuccugcaacgccuggu

SEQ ID NO: 1527121 - RNA, 18 nt, Pseudomonas aeruginosa PA01
ccuccucggcggccuuuu

SEQ ID NO: 1527122 - RNA, 16 nt, Pseudomonas aeruginosa PA01
ccuccucggcggcuuc

SEQ ID NO: 1527123 - RNA, 23 nt, Pseudomonas aeruginosa PA01
ccuccucggcggcuuccuccauc

SEQ ID NO: 1527124 - RNA, 17 nt, Pseudomonas aeruginosa PA01
ccuccucgccgcuccgc

SEQ ID NO: 1527125 - RNA, 14 nt, Pseudomonas aeruginosa PA01
ccuccucgcuccag

SEQ ID NO: 1527126 - RNA, 17 nt, Pseudomonas aeruginosa PA01
ccuccucgcuccagagg

SEQ ID NO: 1527127 - RNA, 23 nt, Pseudomonas aeruginosa PA01
ccuccggaugcagauccagcggc

SEQ ID NO: 1527128 - RNA, 13 nt, Pseudomonas aeruginosa PA01
ccuccggcagcgu

SEQ ID NO: 1527129 - RNA, 13 nt, Pseudomonas aeruginosa PA01
ccuccggcgccag

SEQ ID NO: 1527130 - RNA, 14 nt, Pseudomonas aeruginosa PA01
ccuccggcgccagg

SEQ ID NO: 1527131 - RNA, 13 nt, Pseudomonas aeruginosa PA01
ccuccuccagcag

SEQ ID NO: 1527132 - RNA, 21 nt, Pseudomonas aeruginosa PA01
ccucauucgcucugcgccagg

SEQ ID NO: 1527133 - RNA, 14 nt, Pseudomonas aeruginosa PA01
ccuccagcgccgca

SEQ ID NO: 1527134 - RNA, 14 nt, Pseudomonas aeruginosa PA01
ccuccagcgccgcc

SEQ ID NO: 1527135 - RNA, 16 nt, Pseudomonas aeruginosa PA01
ccuccagcgccgccag

SEQ ID NO: 1527136 - RNA, 17 nt, Pseudomonas aeruginosa PA01
ccuccagcgccgccagg

SEQ ID NO: 1527137 - RNA, 18 nt, Pseudomonas aeruginosa PA01
ccuccagcgccgccaggc

SEQ ID NO: 1527138 - RNA, 16 nt, Pseudomonas aeruginosa PA01
ccuccagcgccgccuc

SEQ ID NO: 1527139 - RNA, 17 nt, Pseudomonas aeruginosa PA01
ccuccagcgccgccucg

SEQ ID NO: 1527140 - RNA, 24 nt, Pseudomonas aeruginosa PA01
ccuccagccggcgacgcaggacgu

SEQ ID NO: 1527141 - RNA, 18 nt, Pseudomonas aeruginosa PA01
ccuccagcauccagcgau

SEQ ID NO: 1527142 - RNA, 20 nt, Pseudomonas aeruginosa PA01
ccuccagccagcagcccggc

SEQ ID NO: 1527143 - RNA, 12 nt, Pseudomonas aeruginosa PA01
ccuccagccggc

SEQ ID NO: 1527144 - RNA, 20 nt, Pseudomonas aeruginosa PA01
ccuccagagugcgcagcagc

SEQ ID NO: 1527145 - RNA, 14 nt, Pseudomonas aeruginosa PA01
ccuccagcaacgcc

SEQ ID NO: 1527146 - RNA, 15 nt, Pseudomonas aeruginosa PA01
ccuccagggucgccc

SEQ ID NO: 1527147 - RNA, 21 nt, Pseudomonas aeruginosa PA01
ccuccagggucgcccgugccu

SEQ ID NO: 1527148 - RNA, 16 nt, Pseudomonas aeruginosa PA01
ccuccaggcucuucag

SEQ ID NO: 1527149 - RNA, 23 nt, Pseudomonas aeruginosa PA01
ccuccaggcucuucagcacgcgu

SEQ ID NO: 1527150 - RNA, 13 nt, Pseudomonas aeruginosa PA01
ccuccagcugcgc

SEQ ID NO: 1527151 - RNA, 19 nt, Pseudomonas aeruginosa PA01
ccuccaggaauccuccgcc

SEQ ID NO: 1527152 - RNA, 21 nt, Pseudomonas aeruginosa PA01
ccuccaggaauccuccgccag

SEQ ID NO: 1527153 - RNA, 14 nt, Pseudomonas aeruginosa PA01
ccuccaggaccagg

SEQ ID NO: 1527154 - RNA, 20 nt, Pseudomonas aeruginosa PA01
ccuccaggccgaagccgccg

SEQ ID NO: 1527155 - RNA, 13 nt, Pseudomonas aeruginosa PA01
ccuccaggccgcc

SEQ ID NO: 1527156 - RNA, 14 nt, Pseudomonas aeruginosa PA01
ccuccaggccgccg

SEQ ID NO: 1527157 - RNA, 16 nt, Pseudomonas aeruginosa PA01
ccuccaggccgccggc

SEQ ID NO: 1527158 - RNA, 14 nt, Pseudomonas aeruginosa PA01
ccuacgaaagcgcc

SEQ ID NO: 1527159 - RNA, 16 nt, Pseudomonas aeruginosa PA01
ccuaccagaccgcagc

SEQ ID NO: 1527160 - RNA, 16 nt, Pseudomonas aeruginosa PA01
ccuacccgacaggcag

SEQ ID NO: 1527161 - RNA, 17 nt, Pseudomonas aeruginosa PA01
ccuacccgacaggcagc

SEQ ID NO: 1527162 - RNA, 21 nt, Pseudomonas aeruginosa PA01
ccuacccgacaggcagcgccg

SEQ ID NO: 1527163 - RNA, 20 nt, Pseudomonas aeruginosa PA01
ccuacccgagcaacugcucg

SEQ ID NO: 1527164 - RNA, 11 nt, Pseudomonas aeruginosa PA01
ccuaccccagg

SEQ ID NO: 1527165 - RNA, 12 nt, Pseudomonas aeruginosa PA01
ccuacccgcgcu

SEQ ID NO: 1527166 - RNA, 17 nt, Pseudomonas aeruginosa PA01
ccucauggcuguagcuc

SEQ ID NO: 1527167 - RNA, 15 nt, Pseudomonas aeruginosa PA01
ccuacggccccaggc

SEQ ID NO: 1527168 - RNA, 22 nt, Pseudomonas aeruginosa PA01
ccuacgguacaguucaggcugg

SEQ ID NO: 1527169 - RNA, 23 nt, Pseudomonas aeruginosa PA01
ccucgcgggaacggcguaccagg

SEQ ID NO: 1527170 - RNA, 16 nt, Pseudomonas aeruginosa PA01
ccucgcgcugcccggc

SEQ ID NO: 1527171 - RNA, 18 nt, Pseudomonas aeruginosa PA01
ccucgcgcugcccggcgc

SEQ ID NO: 1527172 - RNA, 14 nt, Pseudomonas aeruginosa PA01
ccucgcggaccucg

SEQ ID NO: 1527173 - RNA, 14 nt, Pseudomonas aeruginosa PA01
ccucgcggagcugg

SEQ ID NO: 1527174 - RNA, 15 nt, Pseudomonas aeruginosa PA01
ccucgcggagcugga

SEQ ID NO: 1527175 - RNA, 19 nt, Pseudomonas aeruginosa PA01
ccucgcgcguggccgccag

SEQ ID NO: 1527176 - RNA, 22 nt, Pseudomonas aeruginosa PA01
ccucgacgagguugcucugggc

SEQ ID NO: 1527177 - RNA, 21 nt, Pseudomonas aeruginosa PA01
ccucgaccuggccacgcccgg

SEQ ID NO: 1527178 - RNA, 14 nt, Pseudomonas aeruginosa PA01
ccucgaccuggcuc

SEQ ID NO: 1527179 - RNA, 12 nt, Pseudomonas aeruginosa PA01
ccucgaccuggu

SEQ ID NO: 1527180 - RNA, 13 nt, Pseudomonas aeruginosa PA01
ccucgacggcggg

SEQ ID NO: 1527181 - RNA, 16 nt, Pseudomonas aeruginosa PA01
ccucgacggcgggagc

SEQ ID NO: 1527182 - RNA, 20 nt, Pseudomonas aeruginosa PA01
ccucgaaggucagcccgugu

SEQ ID NO: 1527183 - RNA, 19 nt, Pseudomonas aeruginosa PA01
ccucgaagcccagcgccug

SEQ ID NO: 1527184 - RNA, 14 nt, Pseudomonas aeruginosa PA01
ccucgaagcccugc

SEQ ID NO: 1527185 - RNA, 13 nt, Pseudomonas aeruginosa PA01
ccucgaagcuggc

SEQ ID NO: 1527186 - RNA, 16 nt, Pseudomonas aeruginosa PA01
ccucgaaggccggcaa

SEQ ID NO: 1527187 - RNA, 23 nt, Pseudomonas aeruginosa PA01
ccucgaagaaaaggcccggcguc

SEQ ID NO: 1527188 - RNA, 18 nt, Pseudomonas aeruginosa PA01
ccucgaaccccuggcgcu

SEQ ID NO: 1527189 - RNA, 17 nt, Pseudomonas aeruginosa PA01
ccucgaacgcuucuugu

SEQ ID NO: 1527190 - RNA, 16 nt, Pseudomonas aeruginosa PA01
ccucgacccuggcgcc

SEQ ID NO: 1527191 - RNA, 17 nt, Pseudomonas aeruginosa PA01
ccucgaccagcgccgcg

SEQ ID NO: 1527192 - RNA, 19 nt, Pseudomonas aeruginosa PA01
ccucgaccagguccggcag

SEQ ID NO: 1527193 - RNA, 23 nt, Pseudomonas aeruginosa PA01
ccucgaccagguccggcagcgcc

SEQ ID NO: 1527194 - RNA, 13 nt, Pseudomonas aeruginosa PA01
ccucgguagccgg

SEQ ID NO: 1527195 - RNA, 13 nt, Pseudomonas aeruginosa PA01
ccucgggcgccgu

SEQ ID NO: 1527196 - RNA, 18 nt, Pseudomonas aeruginosa PA01
ccucggggaaacccucag

SEQ ID NO: 1527197 - RNA, 19 nt, Pseudomonas aeruginosa PA01
ccucggggccguccgccag

SEQ ID NO: 1527198 - RNA, 13 nt, Pseudomonas aeruginosa PA01
ccucggucaggua

SEQ ID NO: 1527199 - RNA, 21 nt, Pseudomonas aeruginosa PA01
ccucgucguucagcccacccc

SEQ ID NO: 1527200 - RNA, 21 nt, Pseudomonas aeruginosa PA01
ccucgguuuccggccaggcgc

SEQ ID NO: 1527201 - RNA, 23 nt, Pseudomonas aeruginosa PA01
ccucgguuuccggccaggcgcgg

SEQ ID NO: 1527202 - RNA, 13 nt, Pseudomonas aeruginosa PA01
ccucggugaggua

SEQ ID NO: 1527203 - RNA, 18 nt, Pseudomonas aeruginosa PA01
ccucggugauaccgccgg

SEQ ID NO: 1527204 - RNA, 21 nt, Pseudomonas aeruginosa PA01
ccucggcggacagcccgcgcu

SEQ ID NO: 1527205 - RNA, 20 nt, Pseudomonas aeruginosa PA01
ccucggcgcgauccuccgcc

SEQ ID NO: 1527206 - RNA, 20 nt, Pseudomonas aeruginosa PA01
ccucggcggccuuuucggcg

SEQ ID NO: 1527207 - RNA, 18 nt, Pseudomonas aeruginosa PA01
ccucggcggcggccugcu

SEQ ID NO: 1527208 - RNA, 19 nt, Pseudomonas aeruginosa PA01
ccucggcggcggccugcuc

SEQ ID NO: 1527209 - RNA, 17 nt, Pseudomonas aeruginosa PA01
ccucgcuagucuuccug

SEQ ID NO: 1527210 - RNA, 19 nt, Pseudomonas aeruginosa PA01
ccucgggaugcaguucguu

SEQ ID NO: 1527211 - RNA, 15 nt, Pseudomonas aeruginosa PA01
ccucgggcaccagca

SEQ ID NO: 1527212 - RNA, 12 nt, Pseudomonas aeruginosa PA01
ccucgggcagcc

SEQ ID NO: 1527213 - RNA, 13 nt, Pseudomonas aeruginosa PA01
ccucgggcagcuu

SEQ ID NO: 1527214 - RNA, 13 nt, Pseudomonas aeruginosa PA01
ccucgggccggag

SEQ ID NO: 1527215 - RNA, 21 nt, Pseudomonas aeruginosa PA01
ccucgggccggagcaggccau

SEQ ID NO: 1527216 - RNA, 15 nt, Pseudomonas aeruginosa PA01
ccucggcguagccgg

SEQ ID NO: 1527217 - RNA, 17 nt, Pseudomonas aeruginosa PA01
ccucggcguagccggcc

SEQ ID NO: 1527218 - RNA, 19 nt, Pseudomonas aeruginosa PA01
ccucggcguagccggccag

SEQ ID NO: 1527219 - RNA, 20 nt, Pseudomonas aeruginosa PA01
ccucgugcagcaagccgcag

SEQ ID NO: 1527220 - RNA, 20 nt, Pseudomonas aeruginosa PA01
ccucguucggcgaccauuca

SEQ ID NO: 1527221 - RNA, 20 nt, Pseudomonas aeruginosa PA01
ccucucaggagcgccgcgca

SEQ ID NO: 1527222 - RNA, 12 nt, Pseudomonas aeruginosa PA01
ccucuccccaga

SEQ ID NO: 1527223 - RNA, 20 nt, Pseudomonas aeruginosa PA01
ccucuccccagacccucucc

SEQ ID NO: 1527224 - RNA, 22 nt, Pseudomonas aeruginosa PA01
ccucuccccagacccucucccu

SEQ ID NO: 1527225 - RNA, 20 nt, Pseudomonas aeruginosa PA01
ccucuucguggacggacagg

SEQ ID NO: 1527226 - RNA, 23 nt, Pseudomonas aeruginosa PA01
ccucugaccgcgcccggaaaaaa

SEQ ID NO: 1527227 - RNA, 15 nt, Pseudomonas aeruginosa PA01
ccugaacgcgcccgg

SEQ ID NO: 1527228 - RNA, 22 nt, Pseudomonas aeruginosa PA01
ccugccgucacuugaaguccca

SEQ ID NO: 1527229 - RNA, 17 nt, Pseudomonas aeruginosa PA01
ccugccggugcucggcc

SEQ ID NO: 1527230 - RNA, 19 nt, Pseudomonas aeruginosa PA01
ccugcgccucgaccuggcc

SEQ ID NO: 1527231 - RNA, 12 nt, Pseudomonas aeruginosa PA01
ccugcgccucgg

SEQ ID NO: 1527232 - RNA, 17 nt, Pseudomonas aeruginosa PA01
ccugcgcgccucuuccu

SEQ ID NO: 1527233 - RNA, 17 nt, Pseudomonas aeruginosa PA01
ccugcgcgaucccccgc

SEQ ID NO: 1527234 - RNA, 16 nt, Pseudomonas aeruginosa PA01
ccugcgcgcaccaggc

SEQ ID NO: 1527235 - RNA, 14 nt, Pseudomonas aeruginosa PA01
ccugcgcuuccggc

SEQ ID NO: 1527236 - RNA, 18 nt, Pseudomonas aeruginosa PA01
ccugcggauagccaacca

SEQ ID NO: 1527237 - RNA, 22 nt, Pseudomonas aeruginosa PA01
ccugcggauggcgcggggcccc

SEQ ID NO: 1527238 - RNA, 19 nt, Pseudomonas aeruginosa PA01
ccugcggaaacggacccca

SEQ ID NO: 1527239 - RNA, 18 nt, Pseudomonas aeruginosa PA01
ccugcgucgcauccacca

SEQ ID NO: 1527240 - RNA, 22 nt, Pseudomonas aeruginosa PA01
ccugcggguuggucggcaccag

SEQ ID NO: 1527241 - RNA, 15 nt, Pseudomonas aeruginosa PA01
ccugcggcuugcccu

SEQ ID NO: 1527242 - RNA, 23 nt, Pseudomonas aeruginosa PA01
ccugcggcuggcgaaccagucca

SEQ ID NO: 1527243 - RNA, 22 nt, Pseudomonas aeruginosa PA01
ccugcagcaccaccucgccaag

SEQ ID NO: 1527244 - RNA, 17 nt, Pseudomonas aeruginosa PA01
ccugcaggucgaggcgc

SEQ ID NO: 1527245 - RNA, 22 nt, Pseudomonas aeruginosa PA01
ccugcaggucgaggcgcuccac

SEQ ID NO: 1527246 - RNA, 15 nt, Pseudomonas aeruginosa PA01
ccugcaucaccaggc

SEQ ID NO: 1527247 - RNA, 17 nt, Pseudomonas aeruginosa PA01
ccugcaucaccaggcug

SEQ ID NO: 1527248 - RNA, 11 nt, Pseudomonas aeruginosa PA01
ccugcaugccg

SEQ ID NO: 1527249 - RNA, 17 nt, Pseudomonas aeruginosa PA01
ccugcccgcgccucgcu

SEQ ID NO: 1527250 - RNA, 16 nt, Pseudomonas aeruginosa PA01
ccugcaucucuuccuc

SEQ ID NO: 1527251 - RNA, 17 nt, Pseudomonas aeruginosa PA01
ccugcaucuucucccag

SEQ ID NO: 1527252 - RNA, 14 nt, Pseudomonas aeruginosa PA01
ccugccccgugcac

SEQ ID NO: 1527253 - RNA, 16 nt, Pseudomonas aeruginosa PA01
ccugccccgugcaccg

SEQ ID NO: 1527254 - RNA, 13 nt, Pseudomonas aeruginosa PA01
ccugcccuccugc

SEQ ID NO: 1527255 - RNA, 14 nt, Pseudomonas aeruginosa PA01
ccugcccuccugcu

SEQ ID NO: 1527256 - RNA, 15 nt, Pseudomonas aeruginosa PA01
ccugaagggagaggg

SEQ ID NO: 1527257 - RNA, 15 nt, Pseudomonas aeruginosa PA01
ccugcaacucggcgc

SEQ ID NO: 1527258 - RNA, 22 nt, Pseudomonas aeruginosa PA01
ccugcaacucggcgucgcgcuu

SEQ ID NO: 1527259 - RNA, 17 nt, Pseudomonas aeruginosa PA01
ccugcaauggggcggcc

SEQ ID NO: 1527260 - RNA, 22 nt, Pseudomonas aeruginosa PA01
ccugcaaggcggugaccagcgg

SEQ ID NO: 1527261 - RNA, 20 nt, Pseudomonas aeruginosa PA01
ccugcacaucaccuucgccc

SEQ ID NO: 1527262 - RNA, 22 nt, Pseudomonas aeruginosa PA01
ccugcaccagccaguccggcag

SEQ ID NO: 1527263 - RNA, 20 nt, Pseudomonas aeruginosa PA01
ccugcacgcugcgccggcgc

SEQ ID NO: 1527264 - RNA, 20 nt, Pseudomonas aeruginosa PA01
ccuguccauuuccacgcucc

SEQ ID NO: 1527265 - RNA, 16 nt, Pseudomonas aeruginosa PA01
ccuguccccucacggc

SEQ ID NO: 1527266 - RNA, 16 nt, Pseudomonas aeruginosa PA01
ccuguagcguuccggg

SEQ ID NO: 1527267 - RNA, 22 nt, Pseudomonas aeruginosa PA01
ccuguccgggaaugcucagcac

SEQ ID NO: 1527268 - RNA, 17 nt, Pseudomonas aeruginosa PA01
ccugucgaggccucguc

SEQ ID NO: 1527269 - RNA, 20 nt, Pseudomonas aeruginosa PA01
ccugucggcacgacaccaaa

SEQ ID NO: 1527270 - RNA, 20 nt, Pseudomonas aeruginosa PA01
ccuguccgcugcgcgaagcc

SEQ ID NO: 1527271 - RNA, 22 nt, Pseudomonas aeruginosa PA01
ccugguaggugcgcuggcgcca

SEQ ID NO: 1527272 - RNA, 16 nt, Pseudomonas aeruginosa PA01
ccugguagucgccggu

SEQ ID NO: 1527273 - RNA, 12 nt, Pseudomonas aeruginosa PA01
ccuguacagaaa

SEQ ID NO: 1527274 - RNA, 17 nt, Pseudomonas aeruginosa PA01
ccuguacauagcggguc

SEQ ID NO: 1527275 - RNA, 13 nt, Pseudomonas aeruginosa PA01
ccuguaccagggg

SEQ ID NO: 1527276 - RNA, 23 nt, Pseudomonas aeruginosa PA01
ccugguacucguccucccagugc

SEQ ID NO: 1527277 - RNA, 17 nt, Pseudomonas aeruginosa PA01
ccugguagcagaggguc

SEQ ID NO: 1527278 - RNA, 17 nt, Pseudomonas aeruginosa PA01
ccuggguugccgcgccg

SEQ ID NO: 1527279 - RNA, 21 nt, Pseudomonas aeruginosa PA01
ccugggcuucguccgccuggg

SEQ ID NO: 1527280 - RNA, 18 nt, Pseudomonas aeruginosa PA01
ccugggugaacagcggcc

SEQ ID NO: 1527281 - RNA, 21 nt, Pseudomonas aeruginosa PA01
ccugggugaacagcggcccga

SEQ ID NO: 1527282 - RNA, 17 nt, Pseudomonas aeruginosa PA01
ccugggucgacugcugg

SEQ ID NO: 1527283 - RNA, 23 nt, Pseudomonas aeruginosa PA01
ccuggggcucggcuuccaucacc

SEQ ID NO: 1527284 - RNA, 16 nt, Pseudomonas aeruginosa PA01
ccugggguuucugcug

SEQ ID NO: 1527285 - RNA, 19 nt, Pseudomonas aeruginosa PA01
ccugggguuucugcuggcc

SEQ ID NO: 1527286 - RNA, 21 nt, Pseudomonas aeruginosa PA01
ccugggguuucugcuggccac

SEQ ID NO: 1527287 - RNA, 21 nt, Pseudomonas aeruginosa PA01
ccuggguagauuuacaagccc

SEQ ID NO: 1527288 - RNA, 21 nt, Pseudomonas aeruginosa PA01
ccugggcgugcuuggcgaggc

SEQ ID NO: 1527289 - RNA, 19 nt, Pseudomonas aeruginosa PA01
ccugggcggucucggcggg

SEQ ID NO: 1527290 - RNA, 20 nt, Pseudomonas aeruginosa PA01
ccugggcguacaggccccag

SEQ ID NO: 1527291 - RNA, 17 nt, Pseudomonas aeruginosa PA01
ccuggccaauccacaaa

SEQ ID NO: 1527292 - RNA, 23 nt, Pseudomonas aeruginosa PA01
ccuggcagugcgccggcaucgcc

SEQ ID NO: 1527293 - RNA, 17 nt, Pseudomonas aeruginosa PA01
ccuggaugaucucgcag

SEQ ID NO: 1527294 - RNA, 23 nt, Pseudomonas aeruginosa PA01
ccuggcaacaaggcauucaccag

SEQ ID NO: 1527295 - RNA, 17 nt, Pseudomonas aeruginosa PA01
ccuggcggucgccgccg

SEQ ID NO: 1527296 - RNA, 20 nt, Pseudomonas aeruginosa PA01
ccuggcgguacagcccccag

SEQ ID NO: 1527297 - RNA, 19 nt, Pseudomonas aeruginosa PA01
ccuggcgguagcccggcag

SEQ ID NO: 1527298 - RNA, 20 nt, Pseudomonas aeruginosa PA01
ccuggcggcguggcaccgcu

SEQ ID NO: 1527299 - RNA, 13 nt, Pseudomonas aeruginosa PA01
ccuggcggcuggc

SEQ ID NO: 1527300 - RNA, 19 nt, Pseudomonas aeruginosa PA01
ccugggccauguccaccac

SEQ ID NO: 1527301 - RNA, 13 nt, Pseudomonas aeruginosa PA01
ccugggccccggc

SEQ ID NO: 1527302 - RNA, 12 nt, Pseudomonas aeruginosa PA01
ccugggccggcu

SEQ ID NO: 1527303 - RNA, 15 nt, Pseudomonas aeruginosa PA01
ccugggcgccgccag

SEQ ID NO: 1527304 - RNA, 15 nt, Pseudomonas aeruginosa PA01
ccugggcgaacagca

SEQ ID NO: 1527305 - RNA, 15 nt, Pseudomonas aeruginosa PA01
ccugggcgcaggccg

SEQ ID NO: 1527306 - RNA, 15 nt, Pseudomonas aeruginosa PA01
ccuggaucuccuggg

SEQ ID NO: 1527307 - RNA, 15 nt, Pseudomonas aeruginosa PA01
ccuggauaucugggc

SEQ ID NO: 1527308 - RNA, 19 nt, Pseudomonas aeruginosa PA01
ccuggaucaccgcggcgcu

SEQ ID NO: 1527309 - RNA, 16 nt, Pseudomonas aeruginosa PA01
ccuggauacgggcgcc

SEQ ID NO: 1527310 - RNA, 13 nt, Pseudomonas aeruginosa PA01
ccuggagcagggc

SEQ ID NO: 1527311 - RNA, 16 nt, Pseudomonas aeruginosa PA01
ccuggagcagggcgau

SEQ ID NO: 1527312 - RNA, 18 nt, Pseudomonas aeruginosa PA01
ccuggagcaguuucggau

SEQ ID NO: 1527313 - RNA, 21 nt, Pseudomonas aeruginosa PA01
ccugcugagcagucgccuggc

SEQ ID NO: 1527314 - RNA, 22 nt, Pseudomonas aeruginosa PA01
ccugcugagcagucgccuggcc

SEQ ID NO: 1527315 - RNA, 19 nt, Pseudomonas aeruginosa PA01
ccuggagaaacucgcgggc

SEQ ID NO: 1527316 - RNA, 21 nt, Pseudomonas aeruginosa PA01
ccuggagaaacucgcgggcgc

SEQ ID NO: 1527317 - RNA, 20 nt, Pseudomonas aeruginosa PA01
ccugcucggccugcugcgcc

SEQ ID NO: 1527318 - RNA, 16 nt, Pseudomonas aeruginosa PA01
ccugcucgcgcagcca

SEQ ID NO: 1527319 - RNA, 16 nt, Pseudomonas aeruginosa PA01
ccugcucgcggcuggc

SEQ ID NO: 1527320 - RNA, 18 nt, Pseudomonas aeruginosa PA01
ccugcucuuccagcgggc

SEQ ID NO: 1527321 - RNA, 20 nt, Pseudomonas aeruginosa PA01
ccugcucuucggcggccagc

SEQ ID NO: 1527322 - RNA, 18 nt, Pseudomonas aeruginosa PA01
ccugcguggaaccgcggc

SEQ ID NO: 1527323 - RNA, 22 nt, Pseudomonas aeruginosa PA01
ccugcguggaaccgcggcgccc

SEQ ID NO: 1527324 - RNA, 14 nt, Pseudomonas aeruginosa PA01
ccgccggacccugc

SEQ ID NO: 1527325 - RNA, 16 nt, Pseudomonas aeruginosa PA01
ccgccggacccugccg

SEQ ID NO: 1527326 - RNA, 20 nt, Pseudomonas aeruginosa PA01
ccgccgcugaggcucgccgg

SEQ ID NO: 1527327 - RNA, 19 nt, Pseudomonas aeruginosa PA01
ccgccgcugaucaguaccg

SEQ ID NO: 1527328 - RNA, 14 nt, Pseudomonas aeruginosa PA01
ccgccgcucugcug

SEQ ID NO: 1527329 - RNA, 17 nt, Pseudomonas aeruginosa PA01
ccgccgcucugcuggcc

SEQ ID NO: 1527330 - RNA, 16 nt, Pseudomonas aeruginosa PA01
ccgccgcuuccgccgg

SEQ ID NO: 1527331 - RNA, 17 nt, Pseudomonas aeruginosa PA01
ccgccgcuuccgccggc

SEQ ID NO: 1527332 - RNA, 14 nt, Pseudomonas aeruginosa PA01
ccgccggccaugcc

SEQ ID NO: 1527333 - RNA, 12 nt, Pseudomonas aeruginosa PA01
ccgccggccagc

SEQ ID NO: 1527334 - RNA, 20 nt, Pseudomonas aeruginosa PA01
ccgccggcagugugccgccc

SEQ ID NO: 1527335 - RNA, 10 nt, Pseudomonas aeruginosa PA01
ccgccggcau

SEQ ID NO: 1527336 - RNA, 14 nt, Pseudomonas aeruginosa PA01
ccgccggcgugccg

SEQ ID NO: 1527337 - RNA, 11 nt, Pseudomonas aeruginosa PA01
ccgccggcguu

SEQ ID NO: 1527338 - RNA, 13 nt, Pseudomonas aeruginosa PA01
ccgccgggccgcc

SEQ ID NO: 1527339 - RNA, 22 nt, Pseudomonas aeruginosa PA01
ccgccgggaccacgcucagguc

SEQ ID NO: 1527340 - RNA, 16 nt, Pseudomonas aeruginosa PA01
ccgccgggacccuggu

SEQ ID NO: 1527341 - RNA, 12 nt, Pseudomonas aeruginosa PA01
ccgccggcgccc

SEQ ID NO: 1527342 - RNA, 15 nt, Pseudomonas aeruginosa PA01
ccgccggcgccgccg

SEQ ID NO: 1527343 - RNA, 11 nt, Pseudomonas aeruginosa PA01
ccgccggccgg

SEQ ID NO: 1527344 - RNA, 17 nt, Pseudomonas aeruginosa PA01
ccgccggccggggcgcg

SEQ ID NO: 1527345 - RNA, 12 nt, Pseudomonas aeruginosa PA01
ccgccggccucg

SEQ ID NO: 1527346 - RNA, 19 nt, Pseudomonas aeruginosa PA01
ccgccggccucgcugccgc

SEQ ID NO: 1527347 - RNA, 22 nt, Pseudomonas aeruginosa PA01
ccgccggcgaacagccagcggu

SEQ ID NO: 1527348 - RNA, 16 nt, Pseudomonas aeruginosa PA01
ccgccggcgaccgcgc

SEQ ID NO: 1527349 - RNA, 15 nt, Pseudomonas aeruginosa PA01
ccgccgccaggcggc

SEQ ID NO: 1527350 - RNA, 16 nt, Pseudomonas aeruginosa PA01
ccgccgcgagcgccgc

SEQ ID NO: 1527351 - RNA, 14 nt, Pseudomonas aeruginosa PA01
ccgccgcagagcca

SEQ ID NO: 1527352 - RNA, 17 nt, Pseudomonas aeruginosa PA01
ccgccgcagagccagcc

SEQ ID NO: 1527353 - RNA, 19 nt, Pseudomonas aeruginosa PA01
ccgccgcgcaucaccccgc

SEQ ID NO: 1527354 - RNA, 20 nt, Pseudomonas aeruginosa PA01
ccgccgcgugcgcgcccucg

SEQ ID NO: 1527355 - RNA, 15 nt, Pseudomonas aeruginosa PA01
ccgccgcuacugcgc

SEQ ID NO: 1527356 - RNA, 18 nt, Pseudomonas aeruginosa PA01
ccgccgcuaucgccgccg

SEQ ID NO: 1527357 - RNA, 19 nt, Pseudomonas aeruginosa PA01
ccgccgcuaucgccgccgc

SEQ ID NO: 1527358 - RNA, 22 nt, Pseudomonas aeruginosa PA01
ccgccgcuaucgccgccgcagc

SEQ ID NO: 1527359 - RNA, 19 nt, Pseudomonas aeruginosa PA01
ccgccgcgggacgccgcag

SEQ ID NO: 1527360 - RNA, 20 nt, Pseudomonas aeruginosa PA01
ccgccgcgggcaaccgcggc

SEQ ID NO: 1527361 - RNA, 14 nt, Pseudomonas aeruginosa PA01
ccgccgcgggcgaa

SEQ ID NO: 1527362 - RNA, 14 nt, Pseudomonas aeruginosa PA01
ccgccgacacccgc

SEQ ID NO: 1527363 - RNA, 17 nt, Pseudomonas aeruginosa PA01
ccgccgacacccgcgcc

SEQ ID NO: 1527364 - RNA, 22 nt, Pseudomonas aeruginosa PA01
ccgccgacacccgcgccgccgc

SEQ ID NO: 1527365 - RNA, 20 nt, Pseudomonas aeruginosa PA01
ccgccgaccgugagcuuguc

SEQ ID NO: 1527366 - RNA, 15 nt, Pseudomonas aeruginosa PA01
ccgccgaccagcacg

SEQ ID NO: 1527367 - RNA, 20 nt, Pseudomonas aeruginosa PA01
ccgccgagaacccggccagg

SEQ ID NO: 1527368 - RNA, 21 nt, Pseudomonas aeruginosa PA01
ccgcccugcgcgaucccccgc

SEQ ID NO: 1527369 - RNA, 21 nt, Pseudomonas aeruginosa PA01
ccgcccuacgcaacccgcccg

SEQ ID NO: 1527370 - RNA, 15 nt, Pseudomonas aeruginosa PA01
ccgcccucgggccgc

SEQ ID NO: 1527371 - RNA, 15 nt, Pseudomonas aeruginosa PA01
ccgccgaagggccgc

SEQ ID NO: 1527372 - RNA, 22 nt, Pseudomonas aeruginosa PA01
ccgcccggucuagcgccccggc

SEQ ID NO: 1527373 - RNA, 23 nt, Pseudomonas aeruginosa PA01
ccgcccggucuagcgccccggcc

SEQ ID NO: 1527374 - RNA, 16 nt, Pseudomonas aeruginosa PA01
ccgcccggucucagcc

SEQ ID NO: 1527375 - RNA, 14 nt, Pseudomonas aeruginosa PA01
ccgcccgcaugcca

SEQ ID NO: 1527376 - RNA, 24 nt, Pseudomonas aeruginosa PA01
ccgcccgaucgccucgucgagcgc

SEQ ID NO: 1527377 - RNA, 20 nt, Pseudomonas aeruginosa PA01
ccgcccgagcuuugcgcagc

SEQ ID NO: 1527378 - RNA, 23 nt, Pseudomonas aeruginosa PA01
ccgccccgaaaaaaaaggccgca

SEQ ID NO: 1527379 - RNA, 17 nt, Pseudomonas aeruginosa PA01
ccgccccgaggggcggc

SEQ ID NO: 1527380 - RNA, 21 nt, Pseudomonas aeruginosa PA01
ccgcccaguucgccggccagc

SEQ ID NO: 1527381 - RNA, 13 nt, Pseudomonas aeruginosa PA01
ccgcccccggccc

SEQ ID NO: 1527382 - RNA, 14 nt, Pseudomonas aeruginosa PA01
ccgccccggcagcc

SEQ ID NO: 1527383 - RNA, 17 nt, Pseudomonas aeruginosa PA01
ccgccccggcagccacc

SEQ ID NO: 1527384 - RNA, 17 nt, Pseudomonas aeruginosa PA01
ccgccccaccccagggu

SEQ ID NO: 1527385 - RNA, 14 nt, Pseudomonas aeruginosa PA01
ccgccccagccucg

SEQ ID NO: 1527386 - RNA, 20 nt, Pseudomonas aeruginosa PA01
ccgcccauugcccggccagg

SEQ ID NO: 1527387 - RNA, 21 nt, Pseudomonas aeruginosa PA01
ccgcccauugcccggccaggc

SEQ ID NO: 1527388 - RNA, 12 nt, Pseudomonas aeruginosa PA01
ccgcccagcgga

SEQ ID NO: 1527389 - RNA, 20 nt, Pseudomonas aeruginosa PA01
ccgcccagcggaugcgcgaa

SEQ ID NO: 1527390 - RNA, 17 nt, Pseudomonas aeruginosa PA01
ccgcccagggggccggg

SEQ ID NO: 1527391 - RNA, 12 nt, Pseudomonas aeruginosa PA01
ccgcaguuccuu

SEQ ID NO: 1527392 - RNA, 17 nt, Pseudomonas aeruginosa PA01
ccgcaguucgccccgcc

SEQ ID NO: 1527393 - RNA, 18 nt, Pseudomonas aeruginosa PA01
ccgcgcacaaaaaagccc

SEQ ID NO: 1527394 - RNA, 21 nt, Pseudomonas aeruginosa PA01
ccgcgcacaaaaaagcccgcc

SEQ ID NO: 1527395 - RNA, 23 nt, Pseudomonas aeruginosa PA01
ccgcgcacaaaaaagcccgccag

SEQ ID NO: 1527396 - RNA, 23 nt, Pseudomonas aeruginosa PA01
ccgcgcagcgcggcgcuggguca

SEQ ID NO: 1527397 - RNA, 22 nt, Pseudomonas aeruginosa PA01
ccgcgcagaucgcguccagggu

SEQ ID NO: 1527398 - RNA, 16 nt, Pseudomonas aeruginosa PA01
ccgcgcagcacuuccu

SEQ ID NO: 1527399 - RNA, 15 nt, Pseudomonas aeruginosa PA01
ccgcgcccaggcugc

SEQ ID NO: 1527400 - RNA, 19 nt, Pseudomonas aeruginosa PA01
ccgcgcccaggcugccggc

SEQ ID NO: 1527401 - RNA, 22 nt, Pseudomonas aeruginosa PA01
ccgcgcccaggcugccggccag

SEQ ID NO: 1527402 - RNA, 17 nt, Pseudomonas aeruginosa PA01
ccgcgccccagcggcag

SEQ ID NO: 1527403 - RNA, 18 nt, Pseudomonas aeruginosa PA01
ccgcgccccagcggcagg

SEQ ID NO: 1527404 - RNA, 15 nt, Pseudomonas aeruginosa PA01
ccgcgcagcgucacc

SEQ ID NO: 1527405 - RNA, 12 nt, Pseudomonas aeruginosa PA01
ccgcgcccggcc

SEQ ID NO: 1527406 - RNA, 15 nt, Pseudomonas aeruginosa PA01
ccgcgcccggccagg

SEQ ID NO: 1527407 - RNA, 12 nt, Pseudomonas aeruginosa PA01
ccgcgcccggcu

SEQ ID NO: 1527408 - RNA, 16 nt, Pseudomonas aeruginosa PA01
ccgcgcccggcuggcc

SEQ ID NO: 1527409 - RNA, 16 nt, Pseudomonas aeruginosa PA01
ccgcgccgaccagccg

SEQ ID NO: 1527410 - RNA, 17 nt, Pseudomonas aeruginosa PA01
ccgcgccgaccagccgc

SEQ ID NO: 1527411 - RNA, 15 nt, Pseudomonas aeruginosa PA01
ccgcgccgagccggc

SEQ ID NO: 1527412 - RNA, 22 nt, Pseudomonas aeruginosa PA01
ccgcgccaucggucgcgccccc

SEQ ID NO: 1527413 - RNA, 13 nt, Pseudomonas aeruginosa PA01
ccgcgccggcagc

SEQ ID NO: 1527414 - RNA, 19 nt, Pseudomonas aeruginosa PA01
ccgcgccggcagcucggcc

SEQ ID NO: 1527415 - RNA, 20 nt, Pseudomonas aeruginosa PA01
ccgccuuggcaucgccgccc

SEQ ID NO: 1527416 - RNA, 18 nt, Pseudomonas aeruginosa PA01
ccgccuuguccugcaacu

SEQ ID NO: 1527417 - RNA, 21 nt, Pseudomonas aeruginosa PA01
ccgccuuguucgccagcaccu

SEQ ID NO: 1527418 - RNA, 23 nt, Pseudomonas aeruginosa PA01
ccgccuugaccugcugggccagc

SEQ ID NO: 1527419 - RNA, 18 nt, Pseudomonas aeruginosa PA01
ccgccuugcucgacccgg

SEQ ID NO: 1527420 - RNA, 20 nt, Pseudomonas aeruginosa PA01
ccgccuucgcgggccaggcc

SEQ ID NO: 1527421 - RNA, 16 nt, Pseudomonas aeruginosa PA01
ccgcgcaaccguucca

SEQ ID NO: 1527422 - RNA, 14 nt, Pseudomonas aeruginosa PA01
ccgcgagcuuggcc

SEQ ID NO: 1527423 - RNA, 18 nt, Pseudomonas aeruginosa PA01
ccgcgagcuuggcccugg

SEQ ID NO: 1527424 - RNA, 20 nt, Pseudomonas aeruginosa PA01
ccgcgagagguucaccgacc

SEQ ID NO: 1527425 - RNA, 22 nt, Pseudomonas aeruginosa PA01
ccgcgagccuucagcacggcgc

SEQ ID NO: 1527426 - RNA, 21 nt, Pseudomonas aeruginosa PA01
ccgcgagcgcggccggccacg

SEQ ID NO: 1527427 - RNA, 18 nt, Pseudomonas aeruginosa PA01
ccgcgaggaucagccacg

SEQ ID NO: 1527428 - RNA, 12 nt, Pseudomonas aeruginosa PA01
ccgcgagccagc

SEQ ID NO: 1527429 - RNA, 22 nt, Pseudomonas aeruginosa PA01
ccgcgagccagccguggcaggc

SEQ ID NO: 1527430 - RNA, 17 nt, Pseudomonas aeruginosa PA01
ccgcgacguugcaauug

SEQ ID NO: 1527431 - RNA, 21 nt, Pseudomonas aeruginosa PA01
ccgcgacgcuccagcggcagc

SEQ ID NO: 1527432 - RNA, 14 nt, Pseudomonas aeruginosa PA01
ccgccucgcgccgc

SEQ ID NO: 1527433 - RNA, 16 nt, Pseudomonas aeruginosa PA01
ccgccucgcgccgcgc

SEQ ID NO: 1527434 - RNA, 15 nt, Pseudomonas aeruginosa PA01
ccgccucgggcagcc

SEQ ID NO: 1527435 - RNA, 21 nt, Pseudomonas aeruginosa PA01
ccgccucggagaacagcagcg

SEQ ID NO: 1527436 - RNA, 17 nt, Pseudomonas aeruginosa PA01
ccgccugaaggcgggcu

SEQ ID NO: 1527437 - RNA, 18 nt, Pseudomonas aeruginosa PA01
ccgccucgaccagcgccg

SEQ ID NO: 1527438 - RNA, 20 nt, Pseudomonas aeruginosa PA01
ccgccuauccacgacgucgg

SEQ ID NO: 1527439 - RNA, 20 nt, Pseudomonas aeruginosa PA01
ccgccuauccgugacgucgg

SEQ ID NO: 1527440 - RNA, 19 nt, Pseudomonas aeruginosa PA01
ccgccguugaugacgaacu

SEQ ID NO: 1527441 - RNA, 20 nt, Pseudomonas aeruginosa PA01
ccgccguucucauugcgccg

SEQ ID NO: 1527442 - RNA, 16 nt, Pseudomonas aeruginosa PA01
ccgccguccuccagca

SEQ ID NO: 1527443 - RNA, 21 nt, Pseudomonas aeruginosa PA01
ccgccguccuguuucugcugu

SEQ ID NO: 1527444 - RNA, 15 nt, Pseudomonas aeruginosa PA01
ccgccgugcgcuccg

SEQ ID NO: 1527445 - RNA, 22 nt, Pseudomonas aeruginosa PA01
ccgccgugcgcuccgccaggcc

SEQ ID NO: 1527446 - RNA, 20 nt, Pseudomonas aeruginosa PA01
ccgccgugaggcgcgcgccg

SEQ ID NO: 1527447 - RNA, 17 nt, Pseudomonas aeruginosa PA01
ccgccgggcgcccggcc

SEQ ID NO: 1527448 - RNA, 19 nt, Pseudomonas aeruginosa PA01
ccgccgggcgcgcgccuca

SEQ ID NO: 1527449 - RNA, 14 nt, Pseudomonas aeruginosa PA01
ccgccggggcgggc

SEQ ID NO: 1527450 - RNA, 23 nt, Pseudomonas aeruginosa PA01
ccgccggugaacagguagcugga

SEQ ID NO: 1527451 - RNA, 23 nt, Pseudomonas aeruginosa PA01
ccgcugcaugaaaaagcccggcc

SEQ ID NO: 1527452 - RNA, 15 nt, Pseudomonas aeruginosa PA01
ccgcugcaggccacc

SEQ ID NO: 1527453 - RNA, 15 nt, Pseudomonas aeruginosa PA01
ccgcugcagggcggc

SEQ ID NO: 1527454 - RNA, 17 nt, Pseudomonas aeruginosa PA01
ccgcugcagggcggcgc

SEQ ID NO: 1527455 - RNA, 17 nt, Pseudomonas aeruginosa PA01
ccgcucugcuggccacc

SEQ ID NO: 1527456 - RNA, 19 nt, Pseudomonas aeruginosa PA01
ccgcucugcuggccacccu

SEQ ID NO: 1527457 - RNA, 18 nt, Pseudomonas aeruginosa PA01
ccgcucugcuggccgccc

SEQ ID NO: 1527458 - RNA, 19 nt, Pseudomonas aeruginosa PA01
ccgcucugcuggccgcccu

SEQ ID NO: 1527459 - RNA, 15 nt, Pseudomonas aeruginosa PA01
ccgcucuuuccucau

SEQ ID NO: 1527460 - RNA, 14 nt, Pseudomonas aeruginosa PA01
ccgcucuugauacc

SEQ ID NO: 1527461 - RNA, 22 nt, Pseudomonas aeruginosa PA01
ccgcugaaguccuggccgagca

SEQ ID NO: 1527462 - RNA, 20 nt, Pseudomonas aeruginosa PA01
ccgcugaauaccaccgggcc

SEQ ID NO: 1527463 - RNA, 20 nt, Pseudomonas aeruginosa PA01
ccgcucggugccuucccagc

SEQ ID NO: 1527464 - RNA, 16 nt, Pseudomonas aeruginosa PA01
ccgcucaggcgucccg

SEQ ID NO: 1527465 - RNA, 21 nt, Pseudomonas aeruginosa PA01
ccgcucaggcgucccgcucca

SEQ ID NO: 1527466 - RNA, 17 nt, Pseudomonas aeruginosa PA01
ccgcucgucauggcgca

SEQ ID NO: 1527467 - RNA, 13 nt, Pseudomonas aeruginosa PA01
ccgcucguccagu

SEQ ID NO: 1527468 - RNA, 19 nt, Pseudomonas aeruginosa PA01
ccgcucguccaguuccagg

SEQ ID NO: 1527469 - RNA, 15 nt, Pseudomonas aeruginosa PA01
ccgcucguggaaaaa

SEQ ID NO: 1527470 - RNA, 18 nt, Pseudomonas aeruginosa PA01
ccgcucguuggcggccag

SEQ ID NO: 1527471 - RNA, 20 nt, Pseudomonas aeruginosa PA01
ccgcucguuggcggccagca

SEQ ID NO: 1527472 - RNA, 15 nt, Pseudomonas aeruginosa PA01
ccgcucugcagugcg

SEQ ID NO: 1527473 - RNA, 22 nt, Pseudomonas aeruginosa PA01
ccgcucucgaggacgugcacca

SEQ ID NO: 1527474 - RNA, 18 nt, Pseudomonas aeruginosa PA01
ccgcucaccgccaccccg

SEQ ID NO: 1527475 - RNA, 18 nt, Pseudomonas aeruginosa PA01
ccgcucaccaggcccgcc

SEQ ID NO: 1527476 - RNA, 17 nt, Pseudomonas aeruginosa PA01
ccgcucaaccgaacagg

SEQ ID NO: 1527477 - RNA, 22 nt, Pseudomonas aeruginosa PA01
ccgcuuccgccaggcgcagcca

SEQ ID NO: 1527478 - RNA, 17 nt, Pseudomonas aeruginosa PA01
ccgcuuccggcccggcc

SEQ ID NO: 1527479 - RNA, 20 nt, Pseudomonas aeruginosa PA01
ccgcuuccggcccggccagg

SEQ ID NO: 1527480 - RNA, 20 nt, Pseudomonas aeruginosa PA01
ccgcuguggaaguacggcgc

SEQ ID NO: 1527481 - RNA, 23 nt, Pseudomonas aeruginosa PA01
ccgcuucagcgcgccgagccagg

SEQ ID NO: 1527482 - RNA, 19 nt, Pseudomonas aeruginosa PA01
ccgcuggccuggccacccu

SEQ ID NO: 1527483 - RNA, 14 nt, Pseudomonas aeruginosa PA01
ccgcuggcguuauu

SEQ ID NO: 1527484 - RNA, 21 nt, Pseudomonas aeruginosa PA01
ccgcuggcggcgcucacccac

SEQ ID NO: 1527485 - RNA, 16 nt, Pseudomonas aeruginosa PA01
ccgcuggcgacgcuuu

SEQ ID NO: 1527486 - RNA, 21 nt, Pseudomonas aeruginosa PA01
ccgcuggcgaggauuuccucg

SEQ ID NO: 1527487 - RNA, 13 nt, Pseudomonas aeruginosa PA01
ccgcugccgccgc

SEQ ID NO: 1527488 - RNA, 18 nt, Pseudomonas aeruginosa PA01
ccgcugccgcucuggcug

SEQ ID NO: 1527489 - RNA, 20 nt, Pseudomonas aeruginosa PA01
ccgcuggaaccggccggcag

SEQ ID NO: 1527490 - RNA, 21 nt, Pseudomonas aeruginosa PA01
ccgcguucagucccgcggcgc

SEQ ID NO: 1527491 - RNA, 19 nt, Pseudomonas aeruginosa PA01
ccgcguucaccguggcgcu

SEQ ID NO: 1527492 - RNA, 21 nt, Pseudomonas aeruginosa PA01
ccgcguucgccgaggcggcgc

SEQ ID NO: 1527493 - RNA, 15 nt, Pseudomonas aeruginosa PA01
ccgcuaucgccgccg

SEQ ID NO: 1527494 - RNA, 20 nt, Pseudomonas aeruginosa PA01
ccgcuaucgcuggcgcagcc

SEQ ID NO: 1527495 - RNA, 19 nt, Pseudomonas aeruginosa PA01
ccgcuaagcgucacuccca

SEQ ID NO: 1527496 - RNA, 19 nt, Pseudomonas aeruginosa PA01
ccgcgggucugcucggcgc

SEQ ID NO: 1527497 - RNA, 23 nt, Pseudomonas aeruginosa PA01
ccgcggguuccucacggcgcagc

SEQ ID NO: 1527498 - RNA, 22 nt, Pseudomonas aeruginosa PA01
ccgcgguagcugcgcagggcgc

SEQ ID NO: 1527499 - RNA, 15 nt, Pseudomonas aeruginosa PA01
ccgcgguauucucca

SEQ ID NO: 1527500 - RNA, 18 nt, Pseudomonas aeruginosa PA01
ccgcgguauucuccagca

SEQ ID NO: 1527501 - RNA, 14 nt, Pseudomonas aeruginosa PA01
ccgcguaagcggcc

SEQ ID NO: 1527502 - RNA, 16 nt, Pseudomonas aeruginosa PA01
ccgcguaauaggcgaa

SEQ ID NO: 1527503 - RNA, 15 nt, Pseudomonas aeruginosa PA01
ccgcguagcgccagg

SEQ ID NO: 1527504 - RNA, 11 nt, Pseudomonas aeruginosa PA01
ccgcguagggc

SEQ ID NO: 1527505 - RNA, 19 nt, Pseudomonas aeruginosa PA01
ccgcguccgagagcagggc

SEQ ID NO: 1527506 - RNA, 18 nt, Pseudomonas aeruginosa PA01
ccgcgggcgaacggcagc

SEQ ID NO: 1527507 - RNA, 22 nt, Pseudomonas aeruginosa PA01
ccgcggggaggaagcuccccgc

SEQ ID NO: 1527508 - RNA, 19 nt, Pseudomonas aeruginosa PA01
ccgcggcguuagccgccug

SEQ ID NO: 1527509 - RNA, 23 nt, Pseudomonas aeruginosa PA01
ccgcggcguugucggccagcagc

SEQ ID NO: 1527510 - RNA, 24 nt, Pseudomonas aeruginosa PA01
ccgcggcguugucggccagcagca

SEQ ID NO: 1527511 - RNA, 14 nt, Pseudomonas aeruginosa PA01
ccgcggcuccagcc

SEQ ID NO: 1527512 - RNA, 14 nt, Pseudomonas aeruginosa PA01
ccgcgggaggccgc

SEQ ID NO: 1527513 - RNA, 15 nt, Pseudomonas aeruginosa PA01
ccgcggcggcgugca

SEQ ID NO: 1527514 - RNA, 20 nt, Pseudomonas aeruginosa PA01
ccgcggcguaaucgcgccag

SEQ ID NO: 1527515 - RNA, 14 nt, Pseudomonas aeruginosa PA01
ccgcgccuucaguu

SEQ ID NO: 1527516 - RNA, 13 nt, Pseudomonas aeruginosa PA01
ccgcgccuuccag

SEQ ID NO: 1527517 - RNA, 14 nt, Pseudomonas aeruginosa PA01
ccgcgccuccaggc

SEQ ID NO: 1527518 - RNA, 19 nt, Pseudomonas aeruginosa PA01
ccgcgccuccaggcgcgcc

SEQ ID NO: 1527519 - RNA, 16 nt, Pseudomonas aeruginosa PA01
ccgcgccucgucgcgc

SEQ ID NO: 1527520 - RNA, 20 nt, Pseudomonas aeruginosa PA01
ccgcgccucgucgcgccagg

SEQ ID NO: 1527521 - RNA, 20 nt, Pseudomonas aeruginosa PA01
ccgcgccggcgaucgccagg

SEQ ID NO: 1527522 - RNA, 16 nt, Pseudomonas aeruginosa PA01
ccgcgccgggcuggcc

SEQ ID NO: 1527523 - RNA, 18 nt, Pseudomonas aeruginosa PA01
ccggcaugcagguggcgc

SEQ ID NO: 1527524 - RNA, 19 nt, Pseudomonas aeruginosa PA01
ccggcagggccagcggaac

SEQ ID NO: 1527525 - RNA, 20 nt, Pseudomonas aeruginosa PA01
ccggcagcggcuggccgucg

SEQ ID NO: 1527526 - RNA, 22 nt, Pseudomonas aeruginosa PA01
ccggcaggccgauggccccggc

SEQ ID NO: 1527527 - RNA, 16 nt, Pseudomonas aeruginosa PA01
ccggcaggcagugccg

SEQ ID NO: 1527528 - RNA, 14 nt, Pseudomonas aeruginosa PA01
ccggcagcucggcc

SEQ ID NO: 1527529 - RNA, 18 nt, Pseudomonas aeruginosa PA01
ccggcacucgccgggcgu

SEQ ID NO: 1527530 - RNA, 14 nt, Pseudomonas aeruginosa PA01
ccggcacgcuccag

SEQ ID NO: 1527531 - RNA, 14 nt, Pseudomonas aeruginosa PA01
ccggcacggcaucg

SEQ ID NO: 1527532 - RNA, 15 nt, Pseudomonas aeruginosa PA01
ccggcagccaccagg

SEQ ID NO: 1527533 - RNA, 14 nt, Pseudomonas aeruginosa PA01
ccggcagccagccg

SEQ ID NO: 1527534 - RNA, 14 nt, Pseudomonas aeruginosa PA01
ccggcagcgccgcc

SEQ ID NO: 1527535 - RNA, 21 nt, Pseudomonas aeruginosa PA01
ccggcagcgaccaccaccagg

SEQ ID NO: 1527536 - RNA, 15 nt, Pseudomonas aeruginosa PA01
ccggcagcagcgcca

SEQ ID NO: 1527537 - RNA, 16 nt, Pseudomonas aeruginosa PA01
ccggcagcagcgccag

SEQ ID NO: 1527538 - RNA, 14 nt, Pseudomonas aeruginosa PA01
ccggcagcaggccg

SEQ ID NO: 1527539 - RNA, 16 nt, Pseudomonas aeruginosa PA01
ccggcagcaggccgcc

SEQ ID NO: 1527540 - RNA, 13 nt, Pseudomonas aeruginosa PA01
ccggcagcagggu

SEQ ID NO: 1527541 - RNA, 23 nt, Pseudomonas aeruginosa PA01
ccggcagcagggucagcagcgcc

SEQ ID NO: 1527542 - RNA, 16 nt, Pseudomonas aeruginosa PA01
ccggcaagcgugcccc

SEQ ID NO: 1527543 - RNA, 15 nt, Pseudomonas aeruginosa PA01
ccggauacaccaggu

SEQ ID NO: 1527544 - RNA, 19 nt, Pseudomonas aeruginosa PA01
ccggauacaccagguuggc

SEQ ID NO: 1527545 - RNA, 23 nt, Pseudomonas aeruginosa PA01
ccggauagacgccguccaccagc

SEQ ID NO: 1527546 - RNA, 22 nt, Pseudomonas aeruginosa PA01
ccggcaccgucgagcaccaggc

SEQ ID NO: 1527547 - RNA, 21 nt, Pseudomonas aeruginosa PA01
ccggcaccgcucugcagugcg

SEQ ID NO: 1527548 - RNA, 13 nt, Pseudomonas aeruginosa PA01
ccggaaaaagcac

SEQ ID NO: 1527549 - RNA, 19 nt, Pseudomonas aeruginosa PA01
ccggaaaagaagccgcgca

SEQ ID NO: 1527550 - RNA, 15 nt, Pseudomonas aeruginosa PA01
ccgcuuucguagggc

SEQ ID NO: 1527551 - RNA, 18 nt, Pseudomonas aeruginosa PA01
ccgcuuucagcgccgcuc

SEQ ID NO: 1527552 - RNA, 20 nt, Pseudomonas aeruginosa PA01
ccgcuuucagcgccgcucgg

SEQ ID NO: 1527553 - RNA, 19 nt, Pseudomonas aeruginosa PA01
ccggaagcguccaggguug

SEQ ID NO: 1527554 - RNA, 22 nt, Pseudomonas aeruginosa PA01
ccggaagacggaaacgcgcgcu

SEQ ID NO: 1527555 - RNA, 17 nt, Pseudomonas aeruginosa PA01
ccggaaguggcagcgcc

SEQ ID NO: 1527556 - RNA, 20 nt, Pseudomonas aeruginosa PA01
ccggaagguugucgaagcga

SEQ ID NO: 1527557 - RNA, 17 nt, Pseudomonas aeruginosa PA01
ccggagaucgccgcgcc

SEQ ID NO: 1527558 - RNA, 16 nt, Pseudomonas aeruginosa PA01
ccggagaucggcugca

SEQ ID NO: 1527559 - RNA, 19 nt, Pseudomonas aeruginosa PA01
ccggacugcccagcgccgc

SEQ ID NO: 1527560 - RNA, 20 nt, Pseudomonas aeruginosa PA01
ccggacugcccagcgccgcc

SEQ ID NO: 1527561 - RNA, 15 nt, Pseudomonas aeruginosa PA01
ccggacuuccuugca

SEQ ID NO: 1527562 - RNA, 14 nt, Pseudomonas aeruginosa PA01
ccggagaccgugcc

SEQ ID NO: 1527563 - RNA, 19 nt, Pseudomonas aeruginosa PA01
ccggagaccgugccgccgg

SEQ ID NO: 1527564 - RNA, 11 nt, Pseudomonas aeruginosa PA01
ccggacagccu

SEQ ID NO: 1527565 - RNA, 17 nt, Pseudomonas aeruginosa PA01
ccggacguuuccagcgg

SEQ ID NO: 1527566 - RNA, 15 nt, Pseudomonas aeruginosa PA01
ccgaggcgcuucugc

SEQ ID NO: 1527567 - RNA, 18 nt, Pseudomonas aeruginosa PA01
ccgaggcggccguagccg

SEQ ID NO: 1527568 - RNA, 12 nt, Pseudomonas aeruginosa PA01
ccgaggcgcgcc

SEQ ID NO: 1527569 - RNA, 22 nt, Pseudomonas aeruginosa PA01
ccgaggcgucgaaacgggcgcu

SEQ ID NO: 1527570 - RNA, 14 nt, Pseudomonas aeruginosa PA01
ccgaggcugcgggc

SEQ ID NO: 1527571 - RNA, 19 nt, Pseudomonas aeruginosa PA01
ccgaggaacuccuccucgc

SEQ ID NO: 1527572 - RNA, 13 nt, Pseudomonas aeruginosa PA01
ccgagggccgcgc

SEQ ID NO: 1527573 - RNA, 13 nt, Pseudomonas aeruginosa PA01
ccgaggcuuucca

SEQ ID NO: 1527574 - RNA, 21 nt, Pseudomonas aeruginosa PA01
ccgaggcuuuccagcaggcgc

SEQ ID NO: 1527575 - RNA, 19 nt, Pseudomonas aeruginosa PA01
ccgagggcaggaaccagac

SEQ ID NO: 1527576 - RNA, 14 nt, Pseudomonas aeruginosa PA01
ccgagggcgaagau

SEQ ID NO: 1527577 - RNA, 22 nt, Pseudomonas aeruginosa PA01
ccgagggcgaguucggcgagca

SEQ ID NO: 1527578 - RNA, 19 nt, Pseudomonas aeruginosa PA01
ccgaggguacguuccauga

SEQ ID NO: 1527579 - RNA, 16 nt, Pseudomonas aeruginosa PA01
ccgagggugcagagca

SEQ ID NO: 1527580 - RNA, 21 nt, Pseudomonas aeruginosa PA01
ccgagggcugagacgcugccg

SEQ ID NO: 1527581 - RNA, 16 nt, Pseudomonas aeruginosa PA01
ccgagggcugccgccc

SEQ ID NO: 1527582 - RNA, 15 nt, Pseudomonas aeruginosa PA01
ccgagcuggcgcgcg

SEQ ID NO: 1527583 - RNA, 18 nt, Pseudomonas aeruginosa PA01
ccgagcuggcgcgcgucg

SEQ ID NO: 1527584 - RNA, 17 nt, Pseudomonas aeruginosa PA01
ccgagcugccgggcgag

SEQ ID NO: 1527585 - RNA, 15 nt, Pseudomonas aeruginosa PA01
ccgagcugaccacca

SEQ ID NO: 1527586 - RNA, 20 nt, Pseudomonas aeruginosa PA01
ccgagcugaccaccagggcg

SEQ ID NO: 1527587 - RNA, 22 nt, Pseudomonas aeruginosa PA01
ccgagcugaccaccagggcgau

SEQ ID NO: 1527588 - RNA, 14 nt, Pseudomonas aeruginosa PA01
ccgagcgccgccag

SEQ ID NO: 1527589 - RNA, 16 nt, Pseudomonas aeruginosa PA01
ccgagcgccgccuggg

SEQ ID NO: 1527590 - RNA, 18 nt, Pseudomonas aeruginosa PA01
ccgagcgcgagugcagcg

SEQ ID NO: 1527591 - RNA, 14 nt, Pseudomonas aeruginosa PA01
ccgaucaccaccag

SEQ ID NO: 1527592 - RNA, 16 nt, Pseudomonas aeruginosa PA01
ccgaucaccaccagca

SEQ ID NO: 1527593 - RNA, 18 nt, Pseudomonas aeruginosa PA01
ccgauaucucccaacugg

SEQ ID NO: 1527594 - RNA, 19 nt, Pseudomonas aeruginosa PA01
ccgaguucgccgcgagcac

SEQ ID NO: 1527595 - RNA, 18 nt, Pseudomonas aeruginosa PA01
ccgaguucgcgcaggcgc

SEQ ID NO: 1527596 - RNA, 16 nt, Pseudomonas aeruginosa PA01
ccgaguggcgcagcgc

SEQ ID NO: 1527597 - RNA, 14 nt, Pseudomonas aeruginosa PA01
ccgagugccggcgc

SEQ ID NO: 1527598 - RNA, 19 nt, Pseudomonas aeruginosa PA01
ccgagugcgcccagcagca

SEQ ID NO: 1527599 - RNA, 15 nt, Pseudomonas aeruginosa PA01
ccgaucaccccgccc

SEQ ID NO: 1527600 - RNA, 16 nt, Pseudomonas aeruginosa PA01
ccgaucagcccgucgg

SEQ ID NO: 1527601 - RNA, 18 nt, Pseudomonas aeruginosa PA01
ccgaucagcccgucggcc

SEQ ID NO: 1527602 - RNA, 19 nt, Pseudomonas aeruginosa PA01
ccgaucaggucgcgcgccu

SEQ ID NO: 1527603 - RNA, 22 nt, Pseudomonas aeruginosa PA01
ccgaucaguggucgcagcucca

SEQ ID NO: 1527604 - RNA, 16 nt, Pseudomonas aeruginosa PA01
ccgaucagcgccucgg

SEQ ID NO: 1527605 - RNA, 15 nt, Pseudomonas aeruginosa PA01
ccgaucagcgcgccu

SEQ ID NO: 1527606 - RNA, 14 nt, Pseudomonas aeruginosa PA01
ccgaucuccuccgc

SEQ ID NO: 1527607 - RNA, 16 nt, Pseudomonas aeruginosa PA01
ccgaucuccuccgccc

SEQ ID NO: 1527608 - RNA, 20 nt, Pseudomonas aeruginosa PA01
ccgagaugcagagaaaaggc

SEQ ID NO: 1527609 - RNA, 13 nt, Pseudomonas aeruginosa PA01
ccgagagcggcgc

SEQ ID NO: 1527610 - RNA, 22 nt, Pseudomonas aeruginosa PA01
ccgagagcggcgccaggcguuc

SEQ ID NO: 1527611 - RNA, 15 nt, Pseudomonas aeruginosa PA01
ccgagacgcccugga

SEQ ID NO: 1527612 - RNA, 17 nt, Pseudomonas aeruginosa PA01
ccgagacgcccuggaug

SEQ ID NO: 1527613 - RNA, 22 nt, Pseudomonas aeruginosa PA01
ccgagacgcugcaccgcggcgc

SEQ ID NO: 1527614 - RNA, 16 nt, Pseudomonas aeruginosa PA01
ccgagcaccggcagga

SEQ ID NO: 1527615 - RNA, 16 nt, Pseudomonas aeruginosa PA01
ccgagcaacugcaugu

SEQ ID NO: 1527616 - RNA, 14 nt, Pseudomonas aeruginosa PA01
ccgagcaacugcuc

SEQ ID NO: 1527617 - RNA, 20 nt, Pseudomonas aeruginosa PA01
ccgagcaacugcucgggcgu

SEQ ID NO: 1527618 - RNA, 14 nt, Pseudomonas aeruginosa PA01
ccgagcacagggug

SEQ ID NO: 1527619 - RNA, 12 nt, Pseudomonas aeruginosa PA01
ccgagaaaaccc

SEQ ID NO: 1527620 - RNA, 14 nt, Pseudomonas aeruginosa PA01
ccgagaaccaguac

SEQ ID NO: 1527621 - RNA, 16 nt, Pseudomonas aeruginosa PA01
ccgagaaucugcccgg

SEQ ID NO: 1527622 - RNA, 18 nt, Pseudomonas aeruginosa PA01
ccgacgagcagcucgccg

SEQ ID NO: 1527623 - RNA, 17 nt, Pseudomonas aeruginosa PA01
ccgacgauccggccgau

SEQ ID NO: 1527624 - RNA, 20 nt, Pseudomonas aeruginosa PA01
ccgacgauguucgaggcgcc

SEQ ID NO: 1527625 - RNA, 23 nt, Pseudomonas aeruginosa PA01
ccgacgaaggcgagggugaacug

SEQ ID NO: 1527626 - RNA, 15 nt, Pseudomonas aeruginosa PA01
ccgacgaacagccag

SEQ ID NO: 1527627 - RNA, 15 nt, Pseudomonas aeruginosa PA01
ccgaauccuccagcc

SEQ ID NO: 1527628 - RNA, 22 nt, Pseudomonas aeruginosa PA01
ccgaccuggggcggccucaggc

SEQ ID NO: 1527629 - RNA, 15 nt, Pseudomonas aeruginosa PA01
ccgacgccgcccggc

SEQ ID NO: 1527630 - RNA, 12 nt, Pseudomonas aeruginosa PA01
ccgacgccgccu

SEQ ID NO: 1527631 - RNA, 16 nt, Pseudomonas aeruginosa PA01
ccgacgccgccugcgc

SEQ ID NO: 1527632 - RNA, 19 nt, Pseudomonas aeruginosa PA01
ccgacgccgccugcgccuc

SEQ ID NO: 1527633 - RNA, 19 nt, Pseudomonas aeruginosa PA01
ccgacgccaccagccaggc

SEQ ID NO: 1527634 - RNA, 15 nt, Pseudomonas aeruginosa PA01
ccgacguccuccagg

SEQ ID NO: 1527635 - RNA, 21 nt, Pseudomonas aeruginosa PA01
ccgacguccuccaggaccagg

SEQ ID NO: 1527636 - RNA, 13 nt, Pseudomonas aeruginosa PA01
ccgcagcccgguc

SEQ ID NO: 1527637 - RNA, 21 nt, Pseudomonas aeruginosa PA01
ccgcagcccuaggcgacccgg

SEQ ID NO: 1527638 - RNA, 12 nt, Pseudomonas aeruginosa PA01
ccgcagcccagu

SEQ ID NO: 1527639 - RNA, 13 nt, Pseudomonas aeruginosa PA01
ccgcaggccgcgg

SEQ ID NO: 1527640 - RNA, 14 nt, Pseudomonas aeruginosa PA01
ccgcaggggcugcc

SEQ ID NO: 1527641 - RNA, 15 nt, Pseudomonas aeruginosa PA01
ccgcaggcgggcgcc

SEQ ID NO: 1527642 - RNA, 14 nt, Pseudomonas aeruginosa PA01
ccgcaggucggcgu

SEQ ID NO: 1527643 - RNA, 16 nt, Pseudomonas aeruginosa PA01
ccgcaggucggcgucu

SEQ ID NO: 1527644 - RNA, 20 nt, Pseudomonas aeruginosa PA01
ccgcagguagcugagcaggc

SEQ ID NO: 1527645 - RNA, 18 nt, Pseudomonas aeruginosa PA01
ccgcagguuggccccgcc

SEQ ID NO: 1527646 - RNA, 12 nt, Pseudomonas aeruginosa PA01
ccgcaccagcca

SEQ ID NO: 1527647 - RNA, 20 nt, Pseudomonas aeruginosa PA01
ccgcaagcgguuauucgccc

SEQ ID NO: 1527648 - RNA, 13 nt, Pseudomonas aeruginosa PA01
ccgcaaggagccc

SEQ ID NO: 1527649 - RNA, 14 nt, Pseudomonas aeruginosa PA01
ccgcaaggccaggg

SEQ ID NO: 1527650 - RNA, 20 nt, Pseudomonas aeruginosa PA01
ccgcaaggugcgggccgucg

SEQ ID NO: 1527651 - RNA, 14 nt, Pseudomonas aeruginosa PA01
ccgcaaguaccgcc

SEQ ID NO: 1527652 - RNA, 21 nt, Pseudomonas aeruginosa PA01
ccgcaccacguagccggcguc

SEQ ID NO: 1527653 - RNA, 16 nt, Pseudomonas aeruginosa PA01
ccgcaagggcgucgcu

SEQ ID NO: 1527654 - RNA, 13 nt, Pseudomonas aeruginosa PA01
ccgcagcacagcc

SEQ ID NO: 1527655 - RNA, 16 nt, Pseudomonas aeruginosa PA01
ccgcacuuccaggcgc

SEQ ID NO: 1527656 - RNA, 22 nt, Pseudomonas aeruginosa PA01
ccgauuucgaugacgccauccu

SEQ ID NO: 1527657 - RNA, 21 nt, Pseudomonas aeruginosa PA01
ccgcaaccagcccuggcgcag

SEQ ID NO: 1527658 - RNA, 20 nt, Pseudomonas aeruginosa PA01
ccgcaacgaaaaagggcggc

SEQ ID NO: 1527659 - RNA, 18 nt, Pseudomonas aeruginosa PA01
ccgauucgccggccacca

SEQ ID NO: 1527660 - RNA, 18 nt, Pseudomonas aeruginosa PA01
ccgauguacggcaccacc

SEQ ID NO: 1527661 - RNA, 21 nt, Pseudomonas aeruginosa PA01
ccgaugcgccgacgccaccag

SEQ ID NO: 1527662 - RNA, 16 nt, Pseudomonas aeruginosa PA01
ccgaucuucagcagca

SEQ ID NO: 1527663 - RNA, 22 nt, Pseudomonas aeruginosa PA01
ccgaucucgguuuccaggaugc

SEQ ID NO: 1527664 - RNA, 16 nt, Pseudomonas aeruginosa PA01
ccgaugaaagagcccg

SEQ ID NO: 1527665 - RNA, 14 nt, Pseudomonas aeruginosa PA01
ccgaugcccaggcc

SEQ ID NO: 1527666 - RNA, 20 nt, Pseudomonas aeruginosa PA01
ccgaugcccgggcguuggua

SEQ ID NO: 1527667 - RNA, 21 nt, Pseudomonas aeruginosa PA01
cccugugguuggaaaagcccc

SEQ ID NO: 1527668 - RNA, 15 nt, Pseudomonas aeruginosa PA01
cccugggagccgccg

SEQ ID NO: 1527669 - RNA, 17 nt, Pseudomonas aeruginosa PA01
cccugggccccggccgg

SEQ ID NO: 1527670 - RNA, 19 nt, Pseudomonas aeruginosa PA01
cccugggccccggccggca

SEQ ID NO: 1527671 - RNA, 14 nt, Pseudomonas aeruginosa PA01
cccugggccugcag

SEQ ID NO: 1527672 - RNA, 21 nt, Pseudomonas aeruginosa PA01
cccugggcgaacagcacccag

SEQ ID NO: 1527673 - RNA, 19 nt, Pseudomonas aeruginosa PA01
cccuggcgcagacaggccu

SEQ ID NO: 1527674 - RNA, 14 nt, Pseudomonas aeruginosa PA01
cccuggcuuuccag

SEQ ID NO: 1527675 - RNA, 22 nt, Pseudomonas aeruginosa PA01
cccugguacagcacccaggcga

SEQ ID NO: 1527676 - RNA, 17 nt, Pseudomonas aeruginosa PA01
cccuucagcgcaccgcc

SEQ ID NO: 1527677 - RNA, 14 nt, Pseudomonas aeruginosa PA01
cccuucagcgccuc

SEQ ID NO: 1527678 - RNA, 18 nt, Pseudomonas aeruginosa PA01
cccuucacgagaccaccg

SEQ ID NO: 1527679 - RNA, 22 nt, Pseudomonas aeruginosa PA01
cccuucacguaguugacccgcc

SEQ ID NO: 1527680 - RNA, 18 nt, Pseudomonas aeruginosa PA01
cccuucgaacccgcccuc

SEQ ID NO: 1527681 - RNA, 15 nt, Pseudomonas aeruginosa PA01
cccuucaucccuucu

SEQ ID NO: 1527682 - RNA, 13 nt, Pseudomonas aeruginosa PA01
cccuuccagccgc

SEQ ID NO: 1527683 - RNA, 15 nt, Pseudomonas aeruginosa PA01
cccuuccagcgugug

SEQ ID NO: 1527684 - RNA, 17 nt, Pseudomonas aeruginosa PA01
ccgaaguagucgccccg

SEQ ID NO: 1527685 - RNA, 14 nt, Pseudomonas aeruginosa PA01
ccgaagucgcccgc

SEQ ID NO: 1527686 - RNA, 16 nt, Pseudomonas aeruginosa PA01
ccgaagauccgcucca

SEQ ID NO: 1527687 - RNA, 19 nt, Pseudomonas aeruginosa PA01
ccgaagaggcccucggcgc

SEQ ID NO: 1527688 - RNA, 19 nt, Pseudomonas aeruginosa PA01
ccgaacaucagcagcagga

SEQ ID NO: 1527689 - RNA, 18 nt, Pseudomonas aeruginosa PA01
ccgaacaugccgaagagc

SEQ ID NO: 1527690 - RNA, 14 nt, Pseudomonas aeruginosa PA01
ccgaacuucccccu

SEQ ID NO: 1527691 - RNA, 17 nt, Pseudomonas aeruginosa PA01
ccgaacuucccccuccc

SEQ ID NO: 1527692 - RNA, 22 nt, Pseudomonas aeruginosa PA01
ccgaacuuccgccgaauauuuc

SEQ ID NO: 1527693 - RNA, 19 nt, Pseudomonas aeruginosa PA01
ccgaacuucuccgccaccc

SEQ ID NO: 1527694 - RNA, 16 nt, Pseudomonas aeruginosa PA01
ccgaagacaggccuuu

SEQ ID NO: 1527695 - RNA, 20 nt, Pseudomonas aeruginosa PA01
ccgaagacgccugucggcac

SEQ ID NO: 1527696 - RNA, 13 nt, Pseudomonas aeruginosa PA01
ccgaaaccaggau

SEQ ID NO: 1527697 - RNA, 14 nt, Pseudomonas aeruginosa PA01
ccgaacagcaggga

SEQ ID NO: 1527698 - RNA, 16 nt, Pseudomonas aeruginosa PA01
ccgaacagccgcccca

SEQ ID NO: 1527699 - RNA, 21 nt, Pseudomonas aeruginosa PA01
ccgaacagccgccccaccacc

SEQ ID NO: 1527700 - RNA, 14 nt, Pseudomonas aeruginosa PA01
ccgaacagaggaag

SEQ ID NO: 1527701 - RNA, 16 nt, Pseudomonas aeruginosa PA01
ccgaacagaggaaggc

SEQ ID NO: 1527702 - RNA, 15 nt, Pseudomonas aeruginosa PA01
ccgaaaagaaaaggc

SEQ ID NO: 1527703 - RNA, 19 nt, Pseudomonas aeruginosa PA01
cccuuuuucggcgcggacc

SEQ ID NO: 1527704 - RNA, 19 nt, Pseudomonas aeruginosa PA01
cccuugcguccugccucgg

SEQ ID NO: 1527705 - RNA, 23 nt, Pseudomonas aeruginosa PA01
cccuucguccucguggcgcgccg

SEQ ID NO: 1527706 - RNA, 18 nt, Pseudomonas aeruginosa PA01
cccuucggucgcgccccg

SEQ ID NO: 1527707 - RNA, 20 nt, Pseudomonas aeruginosa PA01
cccuucggucgcgccccgcc

SEQ ID NO: 1527708 - RNA, 22 nt, Pseudomonas aeruginosa PA01
cccuucggucgcgccccgccag

SEQ ID NO: 1527709 - RNA, 15 nt, Pseudomonas aeruginosa PA01
cccuucuccgccagc

SEQ ID NO: 1527710 - RNA, 22 nt, Pseudomonas aeruginosa PA01
cccuugaagcgcuucugcaggc

SEQ ID NO: 1527711 - RNA, 21 nt, Pseudomonas aeruginosa PA01
cccuucuuuuuuucaccgcuc

SEQ ID NO: 1527712 - RNA, 14 nt, Pseudomonas aeruginosa PA01
cccuucugucuugu

SEQ ID NO: 1527713 - RNA, 16 nt, Pseudomonas aeruginosa PA01
cccuugcggcccgccu

SEQ ID NO: 1527714 - RNA, 19 nt, Pseudomonas aeruginosa PA01
cccuugcggcccgccucgg

SEQ ID NO: 1527715 - RNA, 16 nt, Pseudomonas aeruginosa PA01
cccuugcagccagccg

SEQ ID NO: 1527716 - RNA, 17 nt, Pseudomonas aeruginosa PA01
cccuugaggguguucag

SEQ ID NO: 1527717 - RNA, 22 nt, Pseudomonas aeruginosa PA01
cccuugaggucguuggccaggc

SEQ ID NO: 1527718 - RNA, 21 nt, Pseudomonas aeruginosa PA01
cccuugacguucaggcuguug

SEQ ID NO: 1527719 - RNA, 14 nt, Pseudomonas aeruginosa PA01
cccugcaggacccg

SEQ ID NO: 1527720 - RNA, 15 nt, Pseudomonas aeruginosa PA01
cccugcaacaggacc

SEQ ID NO: 1527721 - RNA, 22 nt, Pseudomonas aeruginosa PA01
cccugcaauggggcggccggcg

SEQ ID NO: 1527722 - RNA, 14 nt, Pseudomonas aeruginosa PA01
cccucguggcgggu

SEQ ID NO: 1527723 - RNA, 19 nt, Pseudomonas aeruginosa PA01
cccucguugauuccgccgg

SEQ ID NO: 1527724 - RNA, 20 nt, Pseudomonas aeruginosa PA01
cccucucaggagcgccgcgc

SEQ ID NO: 1527725 - RNA, 20 nt, Pseudomonas aeruginosa PA01
cccucggugauaccgccggc

SEQ ID NO: 1527726 - RNA, 15 nt, Pseudomonas aeruginosa PA01
cccucggggccgagg

SEQ ID NO: 1527727 - RNA, 19 nt, Pseudomonas aeruginosa PA01
cccucggggccgaggucga

SEQ ID NO: 1527728 - RNA, 20 nt, Pseudomonas aeruginosa PA01
ccccuuccuccucgccgcuc

SEQ ID NO: 1527729 - RNA, 12 nt, Pseudomonas aeruginosa PA01
cccucggcgccc

SEQ ID NO: 1527730 - RNA, 18 nt, Pseudomonas aeruginosa PA01
cccucggcgcuggccagg

SEQ ID NO: 1527731 - RNA, 14 nt, Pseudomonas aeruginosa PA01
ccccugguccucaa

SEQ ID NO: 1527732 - RNA, 11 nt, Pseudomonas aeruginosa PA01
ccccugcuccu

SEQ ID NO: 1527733 - RNA, 16 nt, Pseudomonas aeruginosa PA01
ccccugcuccucgccg

SEQ ID NO: 1527734 - RNA, 17 nt, Pseudomonas aeruginosa PA01
ccccugcuccucgccgu

SEQ ID NO: 1527735 - RNA, 21 nt, Pseudomonas aeruginosa PA01
ccccugcuccucgccguacag

SEQ ID NO: 1527736 - RNA, 20 nt, Pseudomonas aeruginosa PA01
ccccuggccguugaccagcg

SEQ ID NO: 1527737 - RNA, 13 nt, Pseudomonas aeruginosa PA01
ccccugggccggc

SEQ ID NO: 1527738 - RNA, 15 nt, Pseudomonas aeruginosa PA01
cccugcccgcgccuc

SEQ ID NO: 1527739 - RNA, 12 nt, Pseudomonas aeruginosa PA01
cccugccggcgg

SEQ ID NO: 1527740 - RNA, 13 nt, Pseudomonas aeruginosa PA01
cccugccggcggu

SEQ ID NO: 1527741 - RNA, 13 nt, Pseudomonas aeruginosa PA01
cccugcgccagca

SEQ ID NO: 1527742 - RNA, 13 nt, Pseudomonas aeruginosa PA01
cccugcgccgcag

SEQ ID NO: 1527743 - RNA, 15 nt, Pseudomonas aeruginosa PA01
cccugcgccgcagcg

SEQ ID NO: 1527744 - RNA, 19 nt, Pseudomonas aeruginosa PA01
cccugcgcgaucccccgcc

SEQ ID NO: 1527745 - RNA, 14 nt, Pseudomonas aeruginosa PA01
cccugcgccucgac

SEQ ID NO: 1527746 - RNA, 17 nt, Pseudomonas aeruginosa PA01
cccugcgccucgaccug

SEQ ID NO: 1527747 - RNA, 18 nt, Pseudomonas aeruginosa PA01
cccugcgccucgaccugg

SEQ ID NO: 1527748 - RNA, 19 nt, Pseudomonas aeruginosa PA01
cccugcgccucgaccuggc

SEQ ID NO: 1527749 - RNA, 17 nt, Pseudomonas aeruginosa PA01
cccugcggcaggcgcca

SEQ ID NO: 1527750 - RNA, 16 nt, Pseudomonas aeruginosa PA01
cccugcaugccggccg

SEQ ID NO: 1527751 - RNA, 17 nt, Pseudomonas aeruginosa PA01
cccugcaugccggccgu

SEQ ID NO: 1527752 - RNA, 12 nt, Pseudomonas aeruginosa PA01
cccugccagcgg

SEQ ID NO: 1527753 - RNA, 13 nt, Pseudomonas aeruginosa PA01
cccugccccuucg

SEQ ID NO: 1527754 - RNA, 22 nt, Pseudomonas aeruginosa PA01
cccugcccagugggccaccggc

SEQ ID NO: 1527755 - RNA, 23 nt, Pseudomonas aeruginosa PA01
cccugccccagcaucgccggcag

SEQ ID NO: 1527756 - RNA, 14 nt, Pseudomonas aeruginosa PA01
cccugcuggccggu

SEQ ID NO: 1527757 - RNA, 19 nt, Pseudomonas aeruginosa PA01
cccugcuggcgcagccagg

SEQ ID NO: 1527758 - RNA, 21 nt, Pseudomonas aeruginosa PA01
cccugcuggcgcagccaggcg

SEQ ID NO: 1527759 - RNA, 22 nt, Pseudomonas aeruginosa PA01
cccugcuggcgcagccaggcga

SEQ ID NO: 1527760 - RNA, 16 nt, Pseudomonas aeruginosa PA01
cccugcugcagggccu

SEQ ID NO: 1527761 - RNA, 14 nt, Pseudomonas aeruginosa PA01
cccugcugcucgcc

SEQ ID NO: 1527762 - RNA, 19 nt, Pseudomonas aeruginosa PA01
cccuggccgacgcugagga

SEQ ID NO: 1527763 - RNA, 19 nt, Pseudomonas aeruginosa PA01
cccuggccgaucagcuugg

SEQ ID NO: 1527764 - RNA, 13 nt, Pseudomonas aeruginosa PA01
cccuggccgccaa

SEQ ID NO: 1527765 - RNA, 14 nt, Pseudomonas aeruginosa PA01
cccuggccgcccag

SEQ ID NO: 1527766 - RNA, 14 nt, Pseudomonas aeruginosa PA01
cccuggcgcaggcg

SEQ ID NO: 1527767 - RNA, 15 nt, Pseudomonas aeruginosa PA01
cccuggccgcugccg

SEQ ID NO: 1527768 - RNA, 16 nt, Pseudomonas aeruginosa PA01
cccuggccggcacccu

SEQ ID NO: 1527769 - RNA, 12 nt, Pseudomonas aeruginosa PA01
cccuggccggcg

SEQ ID NO: 1527770 - RNA, 18 nt, Pseudomonas aeruginosa PA01
cccuggccucggcguccu

SEQ ID NO: 1527771 - RNA, 16 nt, Pseudomonas aeruginosa PA01
cccuggaagccggcag

SEQ ID NO: 1527772 - RNA, 19 nt, Pseudomonas aeruginosa PA01
cccugcuuggccagcgcgg

SEQ ID NO: 1527773 - RNA, 15 nt, Pseudomonas aeruginosa PA01
cccuggaucuccugg

SEQ ID NO: 1527774 - RNA, 16 nt, Pseudomonas aeruginosa PA01
cccuggaucuccuggg

SEQ ID NO: 1527775 - RNA, 22 nt, Pseudomonas aeruginosa PA01
cggcgcaggcggaucgcccggc

SEQ ID NO: 1527776 - RNA, 13 nt, Pseudomonas aeruginosa PA01
cggcgcaggcaug

SEQ ID NO: 1527777 - RNA, 13 nt, Pseudomonas aeruginosa PA01
cggcgcaggcuug

SEQ ID NO: 1527778 - RNA, 14 nt, Pseudomonas aeruginosa PA01
cggcgcaggcuugg

SEQ ID NO: 1527779 - RNA, 16 nt, Pseudomonas aeruginosa PA01
cggcgcauagccaccg

SEQ ID NO: 1527780 - RNA, 13 nt, Pseudomonas aeruginosa PA01
cggcgccaccccg

SEQ ID NO: 1527781 - RNA, 22 nt, Pseudomonas aeruginosa PA01
cggcgccaccccgccgcgcauc

SEQ ID NO: 1527782 - RNA, 12 nt, Pseudomonas aeruginosa PA01
cggcgccaccgc

SEQ ID NO: 1527783 - RNA, 13 nt, Pseudomonas aeruginosa PA01
cggcgccagcagg

SEQ ID NO: 1527784 - RNA, 18 nt, Pseudomonas aeruginosa PA01
cggcgccagcgccccacc

SEQ ID NO: 1527785 - RNA, 16 nt, Pseudomonas aeruginosa PA01
cggcgcacgccggccu

SEQ ID NO: 1527786 - RNA, 18 nt, Pseudomonas aeruginosa PA01
cggcgcagaucgcggcgc

SEQ ID NO: 1527787 - RNA, 18 nt, Pseudomonas aeruginosa PA01
cggcgcagcccagccgcu

SEQ ID NO: 1527788 - RNA, 14 nt, Pseudomonas aeruginosa PA01
cggcgcaggcgaug

SEQ ID NO: 1527789 - RNA, 20 nt, Pseudomonas aeruginosa PA01
cggcgcaagggcgccgccga

SEQ ID NO: 1527790 - RNA, 21 nt, Pseudomonas aeruginosa PA01
cggcgcaaucagggcugggcg

SEQ ID NO: 1527791 - RNA, 17 nt, Pseudomonas aeruginosa PA01
cggcgcaccgacgccgc

SEQ ID NO: 1527792 - RNA, 23 nt, Pseudomonas aeruginosa PA01
cggcgcaccgacgccgccugcgc

SEQ ID NO: 1527793 - RNA, 22 nt, Pseudomonas aeruginosa PA01
cggcgccgaacagggcgagcag

SEQ ID NO: 1527794 - RNA, 14 nt, Pseudomonas aeruginosa PA01
cggcgcccugggug

SEQ ID NO: 1527795 - RNA, 16 nt, Pseudomonas aeruginosa PA01
cggcgccgaucuccgc

SEQ ID NO: 1527796 - RNA, 12 nt, Pseudomonas aeruginosa PA01
cggcgccgccuc

SEQ ID NO: 1527797 - RNA, 14 nt, Pseudomonas aeruginosa PA01
cggcgccgccgggg

SEQ ID NO: 1527798 - RNA, 17 nt, Pseudomonas aeruginosa PA01
cggcgccgcccuugccu

SEQ ID NO: 1527799 - RNA, 13 nt, Pseudomonas aeruginosa PA01
cggcgccgcgcac

SEQ ID NO: 1527800 - RNA, 20 nt, Pseudomonas aeruginosa PA01
cggcgccgcgcaccugggcg

SEQ ID NO: 1527801 - RNA, 20 nt, Pseudomonas aeruginosa PA01
cggcgcccgccugcaggaag

SEQ ID NO: 1527802 - RNA, 15 nt, Pseudomonas aeruginosa PA01
cggcgccccggccca

SEQ ID NO: 1527803 - RNA, 13 nt, Pseudomonas aeruginosa PA01
cggcgccccaggc

SEQ ID NO: 1527804 - RNA, 15 nt, Pseudomonas aeruginosa PA01
cggcgccccaggcgc

SEQ ID NO: 1527805 - RNA, 15 nt, Pseudomonas aeruginosa PA01
cggcgccagcuccag

SEQ ID NO: 1527806 - RNA, 17 nt, Pseudomonas aeruginosa PA01
cggcgccaguucgccgg

SEQ ID NO: 1527807 - RNA, 16 nt, Pseudomonas aeruginosa PA01
cggcgcgggcgccgau

SEQ ID NO: 1527808 - RNA, 15 nt, Pseudomonas aeruginosa PA01
cggcgcgggcgcgcg

SEQ ID NO: 1527809 - RNA, 21 nt, Pseudomonas aeruginosa PA01
cggcgcgggucugcucgcgcu

SEQ ID NO: 1527810 - RNA, 22 nt, Pseudomonas aeruginosa PA01
cggcgcggggcccggcuccagc

SEQ ID NO: 1527811 - RNA, 22 nt, Pseudomonas aeruginosa PA01
cggcgcggucggguccgggccc

SEQ ID NO: 1527812 - RNA, 22 nt, Pseudomonas aeruginosa PA01
cggcgcguagaggaugccggcc

SEQ ID NO: 1527813 - RNA, 18 nt, Pseudomonas aeruginosa PA01
cggcgcguccaccuggcg

SEQ ID NO: 1527814 - RNA, 17 nt, Pseudomonas aeruginosa PA01
cggcgcgucccugggcg

SEQ ID NO: 1527815 - RNA, 14 nt, Pseudomonas aeruginosa PA01
cggcgcgucggugc

SEQ ID NO: 1527816 - RNA, 22 nt, Pseudomonas aeruginosa PA01
cggcgcgucggugccgcccggc

SEQ ID NO: 1527817 - RNA, 14 nt, Pseudomonas aeruginosa PA01
cggcgcgucggcgg

SEQ ID NO: 1527818 - RNA, 14 nt, Pseudomonas aeruginosa PA01
cggcgcugcuucuu

SEQ ID NO: 1527819 - RNA, 15 nt, Pseudomonas aeruginosa PA01
cggcgcugccggcca

SEQ ID NO: 1527820 - RNA, 19 nt, Pseudomonas aeruginosa PA01
cggcgcgccagaagcggcc

SEQ ID NO: 1527821 - RNA, 14 nt, Pseudomonas aeruginosa PA01
cggcgcgcuccggc

SEQ ID NO: 1527822 - RNA, 18 nt, Pseudomonas aeruginosa PA01
cggcgcggcggccgccuc

SEQ ID NO: 1527823 - RNA, 14 nt, Pseudomonas aeruginosa PA01
cggcgcgcggcagc

SEQ ID NO: 1527824 - RNA, 15 nt, Pseudomonas aeruginosa PA01
cggcgcgcggcagca

SEQ ID NO: 1527825 - RNA, 15 nt, Pseudomonas aeruginosa PA01
cggcgccggagcugg

SEQ ID NO: 1527826 - RNA, 21 nt, Pseudomonas aeruginosa PA01
cggcgccggcagguagaccuc

SEQ ID NO: 1527827 - RNA, 19 nt, Pseudomonas aeruginosa PA01
cggcgccgcuagggcgccc

SEQ ID NO: 1527828 - RNA, 23 nt, Pseudomonas aeruginosa PA01
cggcgccgguugcgucucagcgg

SEQ ID NO: 1527829 - RNA, 20 nt, Pseudomonas aeruginosa PA01
cggcgccggugaggcgcagc

SEQ ID NO: 1527830 - RNA, 21 nt, Pseudomonas aeruginosa PA01
cggcgccggugaggcgcagca

SEQ ID NO: 1527831 - RNA, 22 nt, Pseudomonas aeruginosa PA01
cggcgccggugcuggcgagcag

SEQ ID NO: 1527832 - RNA, 14 nt, Pseudomonas aeruginosa PA01
cggcgccucccagg

SEQ ID NO: 1527833 - RNA, 17 nt, Pseudomonas aeruginosa PA01
cggcgccugguucccuc

SEQ ID NO: 1527834 - RNA, 17 nt, Pseudomonas aeruginosa PA01
cggcgcgauccuccgcc

SEQ ID NO: 1527835 - RNA, 23 nt, Pseudomonas aeruginosa PA01
cggcgcgauccuccgccagcccc

SEQ ID NO: 1527836 - RNA, 19 nt, Pseudomonas aeruginosa PA01
cggcgcgauauccgccagg

SEQ ID NO: 1527837 - RNA, 17 nt, Pseudomonas aeruginosa PA01
cggcgcgacgcuccagg

SEQ ID NO: 1527838 - RNA, 13 nt, Pseudomonas aeruginosa PA01
cggcgagccggcg

SEQ ID NO: 1527839 - RNA, 17 nt, Pseudomonas aeruginosa PA01
cggcgagggcaccacgu

SEQ ID NO: 1527840 - RNA, 13 nt, Pseudomonas aeruginosa PA01
cggcgagggcgcc

SEQ ID NO: 1527841 - RNA, 14 nt, Pseudomonas aeruginosa PA01
cggcgaggaucgcc

SEQ ID NO: 1527842 - RNA, 12 nt, Pseudomonas aeruginosa PA01
cggcgaggaaca

SEQ ID NO: 1527843 - RNA, 15 nt, Pseudomonas aeruginosa PA01
cggcgaggaacagca

SEQ ID NO: 1527844 - RNA, 13 nt, Pseudomonas aeruginosa PA01
cggcgagcaggua

SEQ ID NO: 1527845 - RNA, 14 nt, Pseudomonas aeruginosa PA01
cggcgagcagguag

SEQ ID NO: 1527846 - RNA, 21 nt, Pseudomonas aeruginosa PA01
cggcgagcagguagaccgccu

SEQ ID NO: 1527847 - RNA, 17 nt, Pseudomonas aeruginosa PA01
cggcgagcagcggcgcu

SEQ ID NO: 1527848 - RNA, 19 nt, Pseudomonas aeruginosa PA01
cggcgagaucuucaggccg

SEQ ID NO: 1527849 - RNA, 16 nt, Pseudomonas aeruginosa PA01
cggcgagauugcgcug

SEQ ID NO: 1527850 - RNA, 17 nt, Pseudomonas aeruginosa PA01
cggcgagaggucggcgc

SEQ ID NO: 1527851 - RNA, 20 nt, Pseudomonas aeruginosa PA01
cggcgagaggucggcgcgcc

SEQ ID NO: 1527852 - RNA, 21 nt, Pseudomonas aeruginosa PA01
cggcgagaggucggcgcgccc

SEQ ID NO: 1527853 - RNA, 13 nt, Pseudomonas aeruginosa PA01
cggcgacgaucac

SEQ ID NO: 1527854 - RNA, 19 nt, Pseudomonas aeruginosa PA01
cggcgacgaaggucggcgg

SEQ ID NO: 1527855 - RNA, 23 nt, Pseudomonas aeruginosa PA01
cggcgacgaaggucggcggcagc

SEQ ID NO: 1527856 - RNA, 18 nt, Pseudomonas aeruginosa PA01
cggcgaccuugcgcacca

SEQ ID NO: 1527857 - RNA, 18 nt, Pseudomonas aeruginosa PA01
cggcgaccuuguccaggc

SEQ ID NO: 1527858 - RNA, 21 nt, Pseudomonas aeruginosa PA01
cggcgaccuuguccugcggcc

SEQ ID NO: 1527859 - RNA, 15 nt, Pseudomonas aeruginosa PA01
cggcgauggcccaga

SEQ ID NO: 1527860 - RNA, 15 nt, Pseudomonas aeruginosa PA01
cggcgauggccgcca

SEQ ID NO: 1527861 - RNA, 18 nt, Pseudomonas aeruginosa PA01
cggcgauggccgccagca

SEQ ID NO: 1527862 - RNA, 19 nt, Pseudomonas aeruginosa PA01
cggcgauggccgccagcag

SEQ ID NO: 1527863 - RNA, 22 nt, Pseudomonas aeruginosa PA01
cggcgauggccgccagcaggcc

SEQ ID NO: 1527864 - RNA, 14 nt, Pseudomonas aeruginosa PA01
cggcgaugcucagc

SEQ ID NO: 1527865 - RNA, 19 nt, Pseudomonas aeruginosa PA01
cggcgauucguucgagcag

SEQ ID NO: 1527866 - RNA, 20 nt, Pseudomonas aeruginosa PA01
cggcgauucguucgagcagc

SEQ ID NO: 1527867 - RNA, 17 nt, Pseudomonas aeruginosa PA01
cggcgauggucaggacg

SEQ ID NO: 1527868 - RNA, 16 nt, Pseudomonas aeruginosa PA01
cggcgaugucgcgggc

SEQ ID NO: 1527869 - RNA, 14 nt, Pseudomonas aeruginosa PA01
cggcgaugucggcc

SEQ ID NO: 1527870 - RNA, 18 nt, Pseudomonas aeruginosa PA01
cggcgauggcguccaccg

SEQ ID NO: 1527871 - RNA, 17 nt, Pseudomonas aeruginosa PA01
cggcgaugggucgcgug

SEQ ID NO: 1527872 - RNA, 18 nt, Pseudomonas aeruginosa PA01
cggcgaugauggucaaca

SEQ ID NO: 1527873 - RNA, 23 nt, Pseudomonas aeruginosa PA01
cggcgaucuucagguaggcgcgg

SEQ ID NO: 1527874 - RNA, 14 nt, Pseudomonas aeruginosa PA01
cggcgaucuucucc

SEQ ID NO: 1527875 - RNA, 21 nt, Pseudomonas aeruginosa PA01
cggcgaugccgcccagcaccg

SEQ ID NO: 1527876 - RNA, 16 nt, Pseudomonas aeruginosa PA01
cggcgaugccgccggg

SEQ ID NO: 1527877 - RNA, 16 nt, Pseudomonas aeruginosa PA01
cggcgaugccgcgcca

SEQ ID NO: 1527878 - RNA, 15 nt, Pseudomonas aeruginosa PA01
cggcgaugcccaggc

SEQ ID NO: 1527879 - RNA, 18 nt, Pseudomonas aeruginosa PA01
cggcgaguugcgcgaggc

SEQ ID NO: 1527880 - RNA, 21 nt, Pseudomonas aeruginosa PA01
cggcgauacccaggccgucga

SEQ ID NO: 1527881 - RNA, 23 nt, Pseudomonas aeruginosa PA01
cggcgaucacccggcgaagcucc

SEQ ID NO: 1527882 - RNA, 17 nt, Pseudomonas aeruginosa PA01
cggcgaucauccagccc

SEQ ID NO: 1527883 - RNA, 19 nt, Pseudomonas aeruginosa PA01
cggcgaucauccagccccc

SEQ ID NO: 1527884 - RNA, 19 nt, Pseudomonas aeruginosa PA01
cggcgaccauccagccugc

SEQ ID NO: 1527885 - RNA, 21 nt, Pseudomonas aeruginosa PA01
cggcgaccauguucaccagcg

SEQ ID NO: 1527886 - RNA, 15 nt, Pseudomonas aeruginosa PA01
cggcgacccagaccu

SEQ ID NO: 1527887 - RNA, 21 nt, Pseudomonas aeruginosa PA01
cggcgacccagaccugccgcc

SEQ ID NO: 1527888 - RNA, 22 nt, Pseudomonas aeruginosa PA01
cggcgacccagaccugccgccc

SEQ ID NO: 1527889 - RNA, 15 nt, Pseudomonas aeruginosa PA01
cggcgaccgcgcgca

SEQ ID NO: 1527890 - RNA, 15 nt, Pseudomonas aeruginosa PA01
cggcgaccccgauca

SEQ ID NO: 1527891 - RNA, 12 nt, Pseudomonas aeruginosa PA01
cggcgacccgca

SEQ ID NO: 1527892 - RNA, 15 nt, Pseudomonas aeruginosa PA01
cggcgacccuggggu

SEQ ID NO: 1527893 - RNA, 21 nt, Pseudomonas aeruginosa PA01
cggcgaccgaacagcgcgcca

SEQ ID NO: 1527894 - RNA, 17 nt, Pseudomonas aeruginosa PA01
cggcgaccacccggcgg

SEQ ID NO: 1527895 - RNA, 12 nt, Pseudomonas aeruginosa PA01
cggcgaccaccg

SEQ ID NO: 1527896 - RNA, 16 nt, Pseudomonas aeruginosa PA01
cggcgaccaccgccgg

SEQ ID NO: 1527897 - RNA, 17 nt, Pseudomonas aeruginosa PA01
cggcgaccaacagggcg

SEQ ID NO: 1527898 - RNA, 15 nt, Pseudomonas aeruginosa PA01
cggcgacauagccgg

SEQ ID NO: 1527899 - RNA, 16 nt, Pseudomonas aeruginosa PA01
cggcgaaugccgggcu

SEQ ID NO: 1527900 - RNA, 14 nt, Pseudomonas aeruginosa PA01
cggcgacaccgcca

SEQ ID NO: 1527901 - RNA, 16 nt, Pseudomonas aeruginosa PA01
cggcgacaccgccagc

SEQ ID NO: 1527902 - RNA, 17 nt, Pseudomonas aeruginosa PA01
cggcgacaccgccagca

SEQ ID NO: 1527903 - RNA, 16 nt, Pseudomonas aeruginosa PA01
cggcgaaguccaccag

SEQ ID NO: 1527904 - RNA, 18 nt, Pseudomonas aeruginosa PA01
cggcgaagucgccgucgu

SEQ ID NO: 1527905 - RNA, 14 nt, Pseudomonas aeruginosa PA01
cggcgaagcggccc

SEQ ID NO: 1527906 - RNA, 16 nt, Pseudomonas aeruginosa PA01
cggcgaagccgcgccc

SEQ ID NO: 1527907 - RNA, 19 nt, Pseudomonas aeruginosa PA01
cggcgaacgcuugagcccc

SEQ ID NO: 1527908 - RNA, 18 nt, Pseudomonas aeruginosa PA01
cggcgaacgacagcacca

SEQ ID NO: 1527909 - RNA, 18 nt, Pseudomonas aeruginosa PA01
cggcgaacagguagcccc

SEQ ID NO: 1527910 - RNA, 19 nt, Pseudomonas aeruginosa PA01
cggcgaacaccgggccgcc

SEQ ID NO: 1527911 - RNA, 14 nt, Pseudomonas aeruginosa PA01
cggcgaaauccucg

SEQ ID NO: 1527912 - RNA, 21 nt, Pseudomonas aeruginosa PA01
cggcgaaauggguucccagca

SEQ ID NO: 1527913 - RNA, 22 nt, Pseudomonas aeruginosa PA01
cggcgaaauggguucccagcag

SEQ ID NO: 1527914 - RNA, 15 nt, Pseudomonas aeruginosa PA01
cggcccagcgccccg

SEQ ID NO: 1527915 - RNA, 14 nt, Pseudomonas aeruginosa PA01
cggcccagcgcccc

SEQ ID NO: 1527916 - RNA, 18 nt, Pseudomonas aeruginosa PA01
cggcccagcggcaggucg

SEQ ID NO: 1527917 - RNA, 19 nt, Pseudomonas aeruginosa PA01
cggcccagcguucggcgcu

SEQ ID NO: 1527918 - RNA, 15 nt, Pseudomonas aeruginosa PA01
cggcccauccgccgc

SEQ ID NO: 1527919 - RNA, 18 nt, Pseudomonas aeruginosa PA01
cggccaucagcaccagga

SEQ ID NO: 1527920 - RNA, 15 nt, Pseudomonas aeruginosa PA01
cggccaucaggcgcu

SEQ ID NO: 1527921 - RNA, 15 nt, Pseudomonas aeruginosa PA01
cggccauccuggccg

SEQ ID NO: 1527922 - RNA, 15 nt, Pseudomonas aeruginosa PA01
cggccaugccggcca

SEQ ID NO: 1527923 - RNA, 16 nt, Pseudomonas aeruginosa PA01
cggccaugcuggcgcu

SEQ ID NO: 1527924 - RNA, 19 nt, Pseudomonas aeruginosa PA01
cggccaucgagcgcuccac

SEQ ID NO: 1527925 - RNA, 20 nt, Pseudomonas aeruginosa PA01
cggccaugcaggccagggcg

SEQ ID NO: 1527926 - RNA, 22 nt, Pseudomonas aeruginosa PA01
cggccuugcucuugaggucggc

SEQ ID NO: 1527927 - RNA, 20 nt, Pseudomonas aeruginosa PA01
cggcgaaagccggaccucuc

SEQ ID NO: 1527928 - RNA, 19 nt, Pseudomonas aeruginosa PA01
cggccuuuucucugcaucu

SEQ ID NO: 1527929 - RNA, 21 nt, Pseudomonas aeruginosa PA01
cggccuuuuucaugggugcug

SEQ ID NO: 1527930 - RNA, 18 nt, Pseudomonas aeruginosa PA01
cggccuuguccggcacca

SEQ ID NO: 1527931 - RNA, 20 nt, Pseudomonas aeruginosa PA01
cggcugacgaagugauggaa

SEQ ID NO: 1527932 - RNA, 18 nt, Pseudomonas aeruginosa PA01
cggcugaucggccgccag

SEQ ID NO: 1527933 - RNA, 20 nt, Pseudomonas aeruginosa PA01
cggcugaagaagcugcccca

SEQ ID NO: 1527934 - RNA, 21 nt, Pseudomonas aeruginosa PA01
cggcucugcuucugucccugg

SEQ ID NO: 1527935 - RNA, 15 nt, Pseudomonas aeruginosa PA01
cggcucgugcgacuc

SEQ ID NO: 1527936 - RNA, 16 nt, Pseudomonas aeruginosa PA01
cggcucgcugacgcca

SEQ ID NO: 1527937 - RNA, 20 nt, Pseudomonas aeruginosa PA01
cggcucggccagggccgcuc

SEQ ID NO: 1527938 - RNA, 21 nt, Pseudomonas aeruginosa PA01
cggcucggcgggcugccgcgg

SEQ ID NO: 1527939 - RNA, 18 nt, Pseudomonas aeruginosa PA01
cggcucggccgugugccu

SEQ ID NO: 1527940 - RNA, 22 nt, Pseudomonas aeruginosa PA01
cggcuccaguugcagcaccccc

SEQ ID NO: 1527941 - RNA, 13 nt, Pseudomonas aeruginosa PA01
cggcuccagggcg

SEQ ID NO: 1527942 - RNA, 14 nt, Pseudomonas aeruginosa PA01
cggcuccagggcga

SEQ ID NO: 1527943 - RNA, 16 nt, Pseudomonas aeruginosa PA01
cggcuccagccaggcc

SEQ ID NO: 1527944 - RNA, 17 nt, Pseudomonas aeruginosa PA01
cggcuccagccaggccc

SEQ ID NO: 1527945 - RNA, 16 nt, Pseudomonas aeruginosa PA01
cggcuccagccgggcu

SEQ ID NO: 1527946 - RNA, 19 nt, Pseudomonas aeruginosa PA01
cggcgucuggggugaggcc

SEQ ID NO: 1527947 - RNA, 19 nt, Pseudomonas aeruginosa PA01
cggcgugauccgcagguag

SEQ ID NO: 1527948 - RNA, 14 nt, Pseudomonas aeruginosa PA01
cggcgugagcaggg

SEQ ID NO: 1527949 - RNA, 22 nt, Pseudomonas aeruginosa PA01
cggcgugaagccgccgcccagc

SEQ ID NO: 1527950 - RNA, 20 nt, Pseudomonas aeruginosa PA01
cggcgucucggagugaggcc

SEQ ID NO: 1527951 - RNA, 17 nt, Pseudomonas aeruginosa PA01
cggcgucucauggaaca

SEQ ID NO: 1527952 - RNA, 19 nt, Pseudomonas aeruginosa PA01
cggcgucucauggaacagc

SEQ ID NO: 1527953 - RNA, 17 nt, Pseudomonas aeruginosa PA01
cggcgucggcugcgcug

SEQ ID NO: 1527954 - RNA, 16 nt, Pseudomonas aeruginosa PA01
cggcgucggcgcgggc

SEQ ID NO: 1527955 - RNA, 16 nt, Pseudomonas aeruginosa PA01
cggcgucggcauggcu

SEQ ID NO: 1527956 - RNA, 16 nt, Pseudomonas aeruginosa PA01
cggcguuuacgcgcca

SEQ ID NO: 1527957 - RNA, 17 nt, Pseudomonas aeruginosa PA01
cggcguuuagcgcccga

SEQ ID NO: 1527958 - RNA, 16 nt, Pseudomonas aeruginosa PA01
cggcuccaacggcccu

SEQ ID NO: 1527959 - RNA, 20 nt, Pseudomonas aeruginosa PA01
cggcguuggccgaggaggcc

SEQ ID NO: 1527960 - RNA, 17 nt, Pseudomonas aeruginosa PA01
cggcguuguccaggcug

SEQ ID NO: 1527961 - RNA, 18 nt, Pseudomonas aeruginosa PA01
cggcguugucggccagca

SEQ ID NO: 1527962 - RNA, 16 nt, Pseudomonas aeruginosa PA01
cggcguucgccgcggg

SEQ ID NO: 1527963 - RNA, 17 nt, Pseudomonas aeruginosa PA01
cggcguucgccgcgggc

SEQ ID NO: 1527964 - RNA, 14 nt, Pseudomonas aeruginosa PA01
cggcggcagcugcg

SEQ ID NO: 1527965 - RNA, 20 nt, Pseudomonas aeruginosa PA01
cggcggcagcugcggcggca

SEQ ID NO: 1527966 - RNA, 14 nt, Pseudomonas aeruginosa PA01
cggcggcaggcugc

SEQ ID NO: 1527967 - RNA, 16 nt, Pseudomonas aeruginosa PA01
cggcggcaggcugcgc

SEQ ID NO: 1527968 - RNA, 20 nt, Pseudomonas aeruginosa PA01
cggcggcaggucggacaggc

SEQ ID NO: 1527969 - RNA, 13 nt, Pseudomonas aeruginosa PA01
cggcggggccauc

SEQ ID NO: 1527970 - RNA, 20 nt, Pseudomonas aeruginosa PA01
cggcggggcgcaccgccucg

SEQ ID NO: 1527971 - RNA, 21 nt, Pseudomonas aeruginosa PA01
cggcggggcgcaccgccucga

SEQ ID NO: 1527972 - RNA, 14 nt, Pseudomonas aeruginosa PA01
cggcggggcgcagc

SEQ ID NO: 1527973 - RNA, 16 nt, Pseudomonas aeruginosa PA01
cggcggggcgcagcag

SEQ ID NO: 1527974 - RNA, 18 nt, Pseudomonas aeruginosa PA01
cggcggguauccgccggg

SEQ ID NO: 1527975 - RNA, 13 nt, Pseudomonas aeruginosa PA01
cggcggguggcgc

SEQ ID NO: 1527976 - RNA, 21 nt, Pseudomonas aeruginosa PA01
cggcggcaccacgugcagcag

SEQ ID NO: 1527977 - RNA, 22 nt, Pseudomonas aeruginosa PA01
cggcggcacccucuuccgcgcu

SEQ ID NO: 1527978 - RNA, 13 nt, Pseudomonas aeruginosa PA01
cggcgcuuuccac

SEQ ID NO: 1527979 - RNA, 19 nt, Pseudomonas aeruginosa PA01
cggcgcuuugcugcacgcu

SEQ ID NO: 1527980 - RNA, 16 nt, Pseudomonas aeruginosa PA01
cggcgcuggccgcgcg

SEQ ID NO: 1527981 - RNA, 19 nt, Pseudomonas aeruginosa PA01
cggcgcuggccgcgcgacc

SEQ ID NO: 1527982 - RNA, 17 nt, Pseudomonas aeruginosa PA01
cggcggugcgccggcgg

SEQ ID NO: 1527983 - RNA, 22 nt, Pseudomonas aeruginosa PA01
cggcggguggcgcugucgccgg

SEQ ID NO: 1527984 - RNA, 15 nt, Pseudomonas aeruginosa PA01
cggcgguucgauccc

SEQ ID NO: 1527985 - RNA, 21 nt, Pseudomonas aeruginosa PA01
cggcgguucgccgagcgccgc

SEQ ID NO: 1527986 - RNA, 23 nt, Pseudomonas aeruginosa PA01
cggcgguucgccgagcgccgcca

SEQ ID NO: 1527987 - RNA, 19 nt, Pseudomonas aeruginosa PA01
cggcguaugcgccuccagg

SEQ ID NO: 1527988 - RNA, 19 nt, Pseudomonas aeruginosa PA01
cggcgucccggcgccgccc

SEQ ID NO: 1527989 - RNA, 19 nt, Pseudomonas aeruginosa PA01
cggcguccacuccggcagc

SEQ ID NO: 1527990 - RNA, 21 nt, Pseudomonas aeruginosa PA01
cggcguccacuccggcagcac

SEQ ID NO: 1527991 - RNA, 22 nt, Pseudomonas aeruginosa PA01
cggcguccacuccggcagcacc

SEQ ID NO: 1527992 - RNA, 13 nt, Pseudomonas aeruginosa PA01
cggcgucgcgcag

SEQ ID NO: 1527993 - RNA, 20 nt, Pseudomonas aeruginosa PA01
cggcgucgaggugcggcugc

SEQ ID NO: 1527994 - RNA, 22 nt, Pseudomonas aeruginosa PA01
cggcgucgaccacggccuucgg

SEQ ID NO: 1527995 - RNA, 14 nt, Pseudomonas aeruginosa PA01
cggcguccgccggg

SEQ ID NO: 1527996 - RNA, 14 nt, Pseudomonas aeruginosa PA01
cggcguccgccucg

SEQ ID NO: 1527997 - RNA, 18 nt, Pseudomonas aeruginosa PA01
cggcguccgggugcccca

SEQ ID NO: 1527998 - RNA, 20 nt, Pseudomonas aeruginosa PA01
cggcguccuccuccaguucc

SEQ ID NO: 1527999 - RNA, 14 nt, Pseudomonas aeruginosa PA01
cggcguccucggag

SEQ ID NO: 1528000 - RNA, 16 nt, Pseudomonas aeruginosa PA01
cggcuugccggcagcg

SEQ ID NO: 1528001 - RNA, 15 nt, Pseudomonas aeruginosa PA01
cggcuugccggcgcg

SEQ ID NO: 1528002 - RNA, 16 nt, Pseudomonas aeruginosa PA01
cggcuugccggcggcg

SEQ ID NO: 1528003 - RNA, 13 nt, Pseudomonas aeruginosa PA01
cggcuugaggaaa

SEQ ID NO: 1528004 - RNA, 16 nt, Pseudomonas aeruginosa PA01
cggcuugaggaaguag

SEQ ID NO: 1528005 - RNA, 14 nt, Pseudomonas aeruginosa PA01
cgggaaacgcgagu

SEQ ID NO: 1528006 - RNA, 15 nt, Pseudomonas aeruginosa PA01
cgggaaaccaccagg

SEQ ID NO: 1528007 - RNA, 20 nt, Pseudomonas aeruginosa PA01
cggcuugaccgccgccgccu

SEQ ID NO: 1528008 - RNA, 18 nt, Pseudomonas aeruginosa PA01
cggcuucguccugcugcu

SEQ ID NO: 1528009 - RNA, 24 nt, Pseudomonas aeruginosa PA01
cggcuggaccuccuggcgcgucgg

SEQ ID NO: 1528010 - RNA, 14 nt, Pseudomonas aeruginosa PA01
cggcuggcagggcg

SEQ ID NO: 1528011 - RNA, 19 nt, Pseudomonas aeruginosa PA01
cggcuggcagggcgcgucc

SEQ ID NO: 1528012 - RNA, 18 nt, Pseudomonas aeruginosa PA01
cggcugcuugccgcucag

SEQ ID NO: 1528013 - RNA, 23 nt, Pseudomonas aeruginosa PA01
cggcugaugccgcgguaggucag

SEQ ID NO: 1528014 - RNA, 17 nt, Pseudomonas aeruginosa PA01
cggcugcugcgccuggc

SEQ ID NO: 1528015 - RNA, 13 nt, Pseudomonas aeruginosa PA01
cggcugcuccggg

SEQ ID NO: 1528016 - RNA, 15 nt, Pseudomonas aeruginosa PA01
cgggagagggcggcg

SEQ ID NO: 1528017 - RNA, 20 nt, Pseudomonas aeruginosa PA01
cgggagcuaugcaaaagugc

SEQ ID NO: 1528018 - RNA, 13 nt, Pseudomonas aeruginosa PA01
cgggacgcggcgu

SEQ ID NO: 1528019 - RNA, 22 nt, Pseudomonas aeruginosa PA01
cgggacccugguaguccagcag

SEQ ID NO: 1528020 - RNA, 19 nt, Pseudomonas aeruginosa PA01
cgggaacuuggcgcgcagg

SEQ ID NO: 1528021 - RNA, 21 nt, Pseudomonas aeruginosa PA01
cgggaagaaauagggccucaa

SEQ ID NO: 1528022 - RNA, 15 nt, Pseudomonas aeruginosa PA01
cgggaacgaugccgc

SEQ ID NO: 1528023 - RNA, 17 nt, Pseudomonas aeruginosa PA01
cgggaaauuucgcgcac

SEQ ID NO: 1528024 - RNA, 23 nt, Pseudomonas aeruginosa PA01
cgggaucgaguaagugccgacca

SEQ ID NO: 1528025 - RNA, 18 nt, Pseudomonas aeruginosa PA01
cgggaucagcggcggggc

SEQ ID NO: 1528026 - RNA, 13 nt, Pseudomonas aeruginosa PA01
cgggaucaggucg

SEQ ID NO: 1528027 - RNA, 13 nt, Pseudomonas aeruginosa PA01
cgggaggcgccgc

SEQ ID NO: 1528028 - RNA, 19 nt, Pseudomonas aeruginosa PA01
cgggauaccggccaucagc

SEQ ID NO: 1528029 - RNA, 23 nt, Pseudomonas aeruginosa PA01
cgggauaccggccaucagcacca

SEQ ID NO: 1528030 - RNA, 22 nt, Pseudomonas aeruginosa PA01
cgggauagucguucuuccugag

SEQ ID NO: 1528031 - RNA, 14 nt, Pseudomonas aeruginosa PA01
cgggaugcccggcc

SEQ ID NO: 1528032 - RNA, 20 nt, Pseudomonas aeruginosa PA01
cgggaugaagaucaucuggg

SEQ ID NO: 1528033 - RNA, 23 nt, Pseudomonas aeruginosa PA01
cgggaucgcuaccgacaggacca

SEQ ID NO: 1528034 - RNA, 17 nt, Pseudomonas aeruginosa PA01
cgggaucguaggcgcgc

SEQ ID NO: 1528035 - RNA, 16 nt, Pseudomonas aeruginosa PA01
cgggcagauguccagg

SEQ ID NO: 1528036 - RNA, 17 nt, Pseudomonas aeruginosa PA01
cgggcagauguccaggc

SEQ ID NO: 1528037 - RNA, 18 nt, Pseudomonas aeruginosa PA01
cgggcagacaccaccagg

SEQ ID NO: 1528038 - RNA, 17 nt, Pseudomonas aeruginosa PA01
cgggauugucgccgccg

SEQ ID NO: 1528039 - RNA, 20 nt, Pseudomonas aeruginosa PA01
cgggauuuccgauccuccug

SEQ ID NO: 1528040 - RNA, 14 nt, Pseudomonas aeruginosa PA01
cgggaugugcacca

SEQ ID NO: 1528041 - RNA, 16 nt, Pseudomonas aeruginosa PA01
cgggaugugcaccagc

SEQ ID NO: 1528042 - RNA, 17 nt, Pseudomonas aeruginosa PA01
cgggaugugcaccagca

SEQ ID NO: 1528043 - RNA, 20 nt, Pseudomonas aeruginosa PA01
cgggcaacgauucgacgcag

SEQ ID NO: 1528044 - RNA, 16 nt, Pseudomonas aeruginosa PA01
cgggcaacggcugggu

SEQ ID NO: 1528045 - RNA, 15 nt, Pseudomonas aeruginosa PA01
cgggcaagcucgacg

SEQ ID NO: 1528046 - RNA, 15 nt, Pseudomonas aeruginosa PA01
cggguucccugcgcc

SEQ ID NO: 1528047 - RNA, 23 nt, Pseudomonas aeruginosa PA01
cggguucagcccgccgugcgcuc

SEQ ID NO: 1528048 - RNA, 19 nt, Pseudomonas aeruginosa PA01
cggguuuccgugugcagca

SEQ ID NO: 1528049 - RNA, 21 nt, Pseudomonas aeruginosa PA01
cggguuuccgugugcagcagg

SEQ ID NO: 1528050 - RNA, 22 nt, Pseudomonas aeruginosa PA01
cggguuuccgugugcagcaggg

SEQ ID NO: 1528051 - RNA, 14 nt, Pseudomonas aeruginosa PA01
cggguuguccaggc

SEQ ID NO: 1528052 - RNA, 23 nt, Pseudomonas aeruginosa PA01
cggguugucguugcgcagcuucu

SEQ ID NO: 1528053 - RNA, 19 nt, Pseudomonas aeruginosa PA01
cggguuggcuuccagccag

SEQ ID NO: 1528054 - RNA, 17 nt, Pseudomonas aeruginosa PA01
cggguuggucggcacca

SEQ ID NO: 1528055 - RNA, 14 nt, Pseudomonas aeruginosa PA01
cggguugagcaccc

SEQ ID NO: 1528056 - RNA, 15 nt, Pseudomonas aeruginosa PA01
cggguucgagucccg

SEQ ID NO: 1528057 - RNA, 21 nt, Pseudomonas aeruginosa PA01
cggguugagguagagcacgcc

SEQ ID NO: 1528058 - RNA, 17 nt, Pseudomonas aeruginosa PA01
cggguugaugccgaggc

SEQ ID NO: 1528059 - RNA, 13 nt, Pseudomonas aeruginosa PA01
cggguugcccggc

SEQ ID NO: 1528060 - RNA, 16 nt, Pseudomonas aeruginosa PA01
cggguugcccggcucc

SEQ ID NO: 1528061 - RNA, 20 nt, Pseudomonas aeruginosa PA01
cggguugcccucgcagccgg

SEQ ID NO: 1528062 - RNA, 15 nt, Pseudomonas aeruginosa PA01
cgguaaagcccaggu

SEQ ID NO: 1528063 - RNA, 17 nt, Pseudomonas aeruginosa PA01
cgguaugccgcaggcag

SEQ ID NO: 1528064 - RNA, 18 nt, Pseudomonas aeruginosa PA01
cgguagugcuucagguag

SEQ ID NO: 1528065 - RNA, 15 nt, Pseudomonas aeruginosa PA01
cgguagcgccgcgcc

SEQ ID NO: 1528066 - RNA, 17 nt, Pseudomonas aeruginosa PA01
cgguagcgggccagcag

SEQ ID NO: 1528067 - RNA, 19 nt, Pseudomonas aeruginosa PA01
cgguagcgggccagcagcu

SEQ ID NO: 1528068 - RNA, 15 nt, Pseudomonas aeruginosa PA01
cgguagccggcgauc

SEQ ID NO: 1528069 - RNA, 20 nt, Pseudomonas aeruginosa PA01
cgguagcccggcagcucccu

SEQ ID NO: 1528070 - RNA, 17 nt, Pseudomonas aeruginosa PA01
cgguacgcucaccacca

SEQ ID NO: 1528071 - RNA, 18 nt, Pseudomonas aeruginosa PA01
cgguacgcucaccaccac

SEQ ID NO: 1528072 - RNA, 16 nt, Pseudomonas aeruginosa PA01
cgguacugggucuugu

SEQ ID NO: 1528073 - RNA, 24 nt, Pseudomonas aeruginosa PA01
cgguagaccccggugugcgcugca

SEQ ID NO: 1528074 - RNA, 19 nt, Pseudomonas aeruginosa PA01
cgguagacgccucccaccg

SEQ ID NO: 1528075 - RNA, 15 nt, Pseudomonas aeruginosa PA01
cgguacaccgccagg

SEQ ID NO: 1528076 - RNA, 22 nt, Pseudomonas aeruginosa PA01
cgguacaggcggauuuccugcg

SEQ ID NO: 1528077 - RNA, 20 nt, Pseudomonas aeruginosa PA01
cgguaccagcgcaccagggu

SEQ ID NO: 1528078 - RNA, 21 nt, Pseudomonas aeruginosa PA01
cgguaccagggaagcgcgcgc

SEQ ID NO: 1528079 - RNA, 20 nt, Pseudomonas aeruginosa PA01
cgguaccacgggcaguucca

SEQ ID NO: 1528080 - RNA, 17 nt, Pseudomonas aeruginosa PA01
cgguacauggccuucuc

SEQ ID NO: 1528081 - RNA, 18 nt, Pseudomonas aeruginosa PA01
cgguacccggcagggcca

SEQ ID NO: 1528082 - RNA, 18 nt, Pseudomonas aeruginosa PA01
cgggugccggugcgggug

SEQ ID NO: 1528083 - RNA, 16 nt, Pseudomonas aeruginosa PA01
cgggugcgcaggcugc

SEQ ID NO: 1528084 - RNA, 21 nt, Pseudomonas aeruginosa PA01
cgggugcguggugcauccgcc

SEQ ID NO: 1528085 - RNA, 23 nt, Pseudomonas aeruginosa PA01
cgggugcggcuggcgcgcgcgcu

SEQ ID NO: 1528086 - RNA, 22 nt, Pseudomonas aeruginosa PA01
cgggugcugcggaugggcgacg

SEQ ID NO: 1528087 - RNA, 22 nt, Pseudomonas aeruginosa PA01
cggguggagaggcgugcuggcu

SEQ ID NO: 1528088 - RNA, 16 nt, Pseudomonas aeruginosa PA01
cgggucgucgaagcgc

SEQ ID NO: 1528089 - RNA, 22 nt, Pseudomonas aeruginosa PA01
cgggucgucgaagcgcagcagg

SEQ ID NO: 1528090 - RNA, 21 nt, Pseudomonas aeruginosa PA01
cgggucgucggucggccagga

SEQ ID NO: 1528091 - RNA, 18 nt, Pseudomonas aeruginosa PA01
cgggucguacaccagaug

SEQ ID NO: 1528092 - RNA, 20 nt, Pseudomonas aeruginosa PA01
cgggucguacaccgcgcggc

SEQ ID NO: 1528093 - RNA, 20 nt, Pseudomonas aeruginosa PA01
cgggucggcgaaguccacca

SEQ ID NO: 1528094 - RNA, 22 nt, Pseudomonas aeruginosa PA01
cgggucauagucggugaccucc

SEQ ID NO: 1528095 - RNA, 21 nt, Pseudomonas aeruginosa PA01
cgggucuugccggucugcugc

SEQ ID NO: 1528096 - RNA, 17 nt, Pseudomonas aeruginosa PA01
cgggucuugcgcagggc

SEQ ID NO: 1528097 - RNA, 20 nt, Pseudomonas aeruginosa PA01
cgggguugaguugcaggccg

SEQ ID NO: 1528098 - RNA, 21 nt, Pseudomonas aeruginosa PA01
cgggguuucuuuuuauccggc

SEQ ID NO: 1528099 - RNA, 22 nt, Pseudomonas aeruginosa PA01
cggggcguuuuucauggcggca

SEQ ID NO: 1528100 - RNA, 16 nt, Pseudomonas aeruginosa PA01
cggggcugcuccuccc

SEQ ID NO: 1528101 - RNA, 15 nt, Pseudomonas aeruginosa PA01
cggggcuugcgcccc

SEQ ID NO: 1528102 - RNA, 16 nt, Pseudomonas aeruginosa PA01
cggggcuugcgccccc

SEQ ID NO: 1528103 - RNA, 21 nt, Pseudomonas aeruginosa PA01
cggggcuuuuucguuuccggc

SEQ ID NO: 1528104 - RNA, 21 nt, Pseudomonas aeruginosa PA01
cggggcuuuuuuaugcgcagc

SEQ ID NO: 1528105 - RNA, 19 nt, Pseudomonas aeruginosa PA01
cgggucagcagugcggggc

SEQ ID NO: 1528106 - RNA, 17 nt, Pseudomonas aeruginosa PA01
cgggucaugccgccauc

SEQ ID NO: 1528107 - RNA, 13 nt, Pseudomonas aeruginosa PA01
cgggucauuggcg

SEQ ID NO: 1528108 - RNA, 23 nt, Pseudomonas aeruginosa PA01
cggguccaggcgccagagcgcgc

SEQ ID NO: 1528109 - RNA, 14 nt, Pseudomonas aeruginosa PA01
cgggucaugagguu

SEQ ID NO: 1528110 - RNA, 17 nt, Pseudomonas aeruginosa PA01
cggguaaagcgcccgcg

SEQ ID NO: 1528111 - RNA, 13 nt, Pseudomonas aeruginosa PA01
cggguacgcgggc

SEQ ID NO: 1528112 - RNA, 23 nt, Pseudomonas aeruginosa PA01
cggguacagcgccacggccagca

SEQ ID NO: 1528113 - RNA, 13 nt, Pseudomonas aeruginosa PA01
cgggucagcagca

SEQ ID NO: 1528114 - RNA, 21 nt, Pseudomonas aeruginosa PA01
cgggucagcagcaccgcgagc

SEQ ID NO: 1528115 - RNA, 16 nt, Pseudomonas aeruginosa PA01
cgggcauggaucuccc

SEQ ID NO: 1528116 - RNA, 19 nt, Pseudomonas aeruginosa PA01
cgggcaugccgugggcgcc

SEQ ID NO: 1528117 - RNA, 22 nt, Pseudomonas aeruginosa PA01
cgggcaugccgugggcgccgcc

SEQ ID NO: 1528118 - RNA, 21 nt, Pseudomonas aeruginosa PA01
cgggcucugugcuuugcccgu

SEQ ID NO: 1528119 - RNA, 17 nt, Pseudomonas aeruginosa PA01
cgggccagcagcuccgg

SEQ ID NO: 1528120 - RNA, 12 nt, Pseudomonas aeruginosa PA01
cgggccagcagg

SEQ ID NO: 1528121 - RNA, 23 nt, Pseudomonas aeruginosa PA01
cggggaagauguucgccgccgcc

SEQ ID NO: 1528122 - RNA, 22 nt, Pseudomonas aeruginosa PA01
cggggaagcgcggcucggggau

SEQ ID NO: 1528123 - RNA, 19 nt, Pseudomonas aeruginosa PA01
cggggaagcugccuuccag

SEQ ID NO: 1528124 - RNA, 22 nt, Pseudomonas aeruginosa PA01
cggggaagcugccuuccagcag

SEQ ID NO: 1528125 - RNA, 16 nt, Pseudomonas aeruginosa PA01
cggggaauuuccggca

SEQ ID NO: 1528126 - RNA, 21 nt, Pseudomonas aeruginosa PA01
cggggaauuuccggcaacagg

SEQ ID NO: 1528127 - RNA, 19 nt, Pseudomonas aeruginosa PA01
cggggaaagcuccucggcc

SEQ ID NO: 1528128 - RNA, 21 nt, Pseudomonas aeruginosa PA01
cggggaaccacaccugcaaca

SEQ ID NO: 1528129 - RNA, 12 nt, Pseudomonas aeruginosa PA01
cgggcugccccu

SEQ ID NO: 1528130 - RNA, 13 nt, Pseudomonas aeruginosa PA01
cgggcugccccuc

SEQ ID NO: 1528131 - RNA, 21 nt, Pseudomonas aeruginosa PA01
cgggcugccccucacaccacc

SEQ ID NO: 1528132 - RNA, 22 nt, Pseudomonas aeruginosa PA01
cgggcugccccucacaccacca

SEQ ID NO: 1528133 - RNA, 19 nt, Pseudomonas aeruginosa PA01
cgggcugcgugccagcacc

SEQ ID NO: 1528134 - RNA, 20 nt, Pseudomonas aeruginosa PA01
cgggcugcgugccagcaccu

SEQ ID NO: 1528135 - RNA, 19 nt, Pseudomonas aeruginosa PA01
cgggcuggaaaacgccaca

SEQ ID NO: 1528136 - RNA, 13 nt, Pseudomonas aeruginosa PA01
cgggcuggccacc

SEQ ID NO: 1528137 - RNA, 19 nt, Pseudomonas aeruginosa PA01
cgggcuggccaccagcacc

SEQ ID NO: 1528138 - RNA, 20 nt, Pseudomonas aeruginosa PA01
cgggcuggccaccagcaccu

SEQ ID NO: 1528139 - RNA, 15 nt, Pseudomonas aeruginosa PA01
cgggcuggccaccgc

SEQ ID NO: 1528140 - RNA, 22 nt, Pseudomonas aeruginosa PA01
cggggaugaccguccggucgcu

SEQ ID NO: 1528141 - RNA, 15 nt, Pseudomonas aeruginosa PA01
cggggcagcagggcg

SEQ ID NO: 1528142 - RNA, 18 nt, Pseudomonas aeruginosa PA01
cggggaucaggucgccgc

SEQ ID NO: 1528143 - RNA, 18 nt, Pseudomonas aeruginosa PA01
cggggacgcugucccggc

SEQ ID NO: 1528144 - RNA, 23 nt, Pseudomonas aeruginosa PA01
cggggcaggcaugcggccccggc

SEQ ID NO: 1528145 - RNA, 18 nt, Pseudomonas aeruginosa PA01
cggggcauucguccagcc

SEQ ID NO: 1528146 - RNA, 20 nt, Pseudomonas aeruginosa PA01
cggggcauucguccagccgc

SEQ ID NO: 1528147 - RNA, 23 nt, Pseudomonas aeruginosa PA01
cggggcauucguccagccgccgc

SEQ ID NO: 1528148 - RNA, 16 nt, Pseudomonas aeruginosa PA01
cggggcccuccaggcg

SEQ ID NO: 1528149 - RNA, 14 nt, Pseudomonas aeruginosa PA01
cggggcccggcagg

SEQ ID NO: 1528150 - RNA, 17 nt, Pseudomonas aeruginosa PA01
cggggcccggcaggcag

SEQ ID NO: 1528151 - RNA, 22 nt, Pseudomonas aeruginosa PA01
cggggccaggucgguccgccga

SEQ ID NO: 1528152 - RNA, 16 nt, Pseudomonas aeruginosa PA01
cggggccugcugcggg

SEQ ID NO: 1528153 - RNA, 13 nt, Pseudomonas aeruginosa PA01
cggggcuccccug

SEQ ID NO: 1528154 - RNA, 15 nt, Pseudomonas aeruginosa PA01
cggggcuccccugga

SEQ ID NO: 1528155 - RNA, 22 nt, Pseudomonas aeruginosa PA01
cggucuucccguaaggccaggc

SEQ ID NO: 1528156 - RNA, 11 nt, Pseudomonas aeruginosa PA01
cggugaacagg

SEQ ID NO: 1528157 - RNA, 18 nt, Pseudomonas aeruginosa PA01
cggugaacgagcccaggc

SEQ ID NO: 1528158 - RNA, 21 nt, Pseudomonas aeruginosa PA01
cggucagcgcguucaccccgc

SEQ ID NO: 1528159 - RNA, 18 nt, Pseudomonas aeruginosa PA01
cggucagcggcgcagccu

SEQ ID NO: 1528160 - RNA, 19 nt, Pseudomonas aeruginosa PA01
cggucagcggcgcagccuc

SEQ ID NO: 1528161 - RNA, 23 nt, Pseudomonas aeruginosa PA01
cggucucuucgucggucaugucc

SEQ ID NO: 1528162 - RNA, 20 nt, Pseudomonas aeruginosa PA01
cggucucgccgccgagcagg

SEQ ID NO: 1528163 - RNA, 18 nt, Pseudomonas aeruginosa PA01
cggugauagagcacgccc

SEQ ID NO: 1528164 - RNA, 21 nt, Pseudomonas aeruginosa PA01
cggugaucgaaaaaaggcgcc

SEQ ID NO: 1528165 - RNA, 16 nt, Pseudomonas aeruginosa PA01
cggugaucgagccgcc

SEQ ID NO: 1528166 - RNA, 11 nt, Pseudomonas aeruginosa PA01
cggugaccacc

SEQ ID NO: 1528167 - RNA, 14 nt, Pseudomonas aeruginosa PA01
cggugagggcgacg

SEQ ID NO: 1528168 - RNA, 16 nt, Pseudomonas aeruginosa PA01
cggugacacccugccg

SEQ ID NO: 1528169 - RNA, 20 nt, Pseudomonas aeruginosa PA01
cggugacacccugccgcgcc

SEQ ID NO: 1528170 - RNA, 19 nt, Pseudomonas aeruginosa PA01
cggugagcacgccgcgacc

SEQ ID NO: 1528171 - RNA, 14 nt, Pseudomonas aeruginosa PA01
cggugccggcggcg

SEQ ID NO: 1528172 - RNA, 22 nt, Pseudomonas aeruginosa PA01
cggugccggcggcggacgcagg

SEQ ID NO: 1528173 - RNA, 20 nt, Pseudomonas aeruginosa PA01
cggugccgggaagcgcaggc

SEQ ID NO: 1528174 - RNA, 21 nt, Pseudomonas aeruginosa PA01
cggugccggcaggccuucgac

SEQ ID NO: 1528175 - RNA, 12 nt, Pseudomonas aeruginosa PA01
cggugccgaucu

SEQ ID NO: 1528176 - RNA, 17 nt, Pseudomonas aeruginosa PA01
cggugccgccggccacc

SEQ ID NO: 1528177 - RNA, 11 nt, Pseudomonas aeruginosa PA01
cggugccgcgc

SEQ ID NO: 1528178 - RNA, 12 nt, Pseudomonas aeruginosa PA01
cggugccgcgca

SEQ ID NO: 1528179 - RNA, 14 nt, Pseudomonas aeruginosa PA01
cggugccgcgcagc

SEQ ID NO: 1528180 - RNA, 20 nt, Pseudomonas aeruginosa PA01
cgguguuuccucagcucugu

SEQ ID NO: 1528181 - RNA, 12 nt, Pseudomonas aeruginosa PA01
cgguucagcagc

SEQ ID NO: 1528182 - RNA, 17 nt, Pseudomonas aeruginosa PA01
cgguggugucugguucc

SEQ ID NO: 1528183 - RNA, 16 nt, Pseudomonas aeruginosa PA01
cgguguagaccaccag

SEQ ID NO: 1528184 - RNA, 16 nt, Pseudomonas aeruginosa PA01
cgguguagcugaggcc

SEQ ID NO: 1528185 - RNA, 21 nt, Pseudomonas aeruginosa PA01
cggugcgccccaggugcagcg

SEQ ID NO: 1528186 - RNA, 17 nt, Pseudomonas aeruginosa PA01
cggugcggauggcaaug

SEQ ID NO: 1528187 - RNA, 22 nt, Pseudomonas aeruginosa PA01
cggugcggguggucgccgccca

SEQ ID NO: 1528188 - RNA, 17 nt, Pseudomonas aeruginosa PA01
cgguggccgugggccgc

SEQ ID NO: 1528189 - RNA, 15 nt, Pseudomonas aeruginosa PA01
cgguggccuccugca

SEQ ID NO: 1528190 - RNA, 21 nt, Pseudomonas aeruginosa PA01
cgguggcgaccaggacagcac

SEQ ID NO: 1528191 - RNA, 16 nt, Pseudomonas aeruginosa PA01
cgguggcgacgcgcag

SEQ ID NO: 1528192 - RNA, 17 nt, Pseudomonas aeruginosa PA01
cgguggcgacgcgcagg

SEQ ID NO: 1528193 - RNA, 13 nt, Pseudomonas aeruginosa PA01
cgguggcggacug

SEQ ID NO: 1528194 - RNA, 17 nt, Pseudomonas aeruginosa PA01
cgguggcgcccagccag

SEQ ID NO: 1528195 - RNA, 13 nt, Pseudomonas aeruginosa PA01
cguaaggccaggc

SEQ ID NO: 1528196 - RNA, 18 nt, Pseudomonas aeruginosa PA01
cguaagucagguccuugu

SEQ ID NO: 1528197 - RNA, 14 nt, Pseudomonas aeruginosa PA01
cgguucugcuccug

SEQ ID NO: 1528198 - RNA, 20 nt, Pseudomonas aeruginosa PA01
cgguucggcaaggcgcagcu

SEQ ID NO: 1528199 - RNA, 20 nt, Pseudomonas aeruginosa PA01
cgguuccagcggccgcgagc

SEQ ID NO: 1528200 - RNA, 17 nt, Pseudomonas aeruginosa PA01
cgguucaggucgaggcc

SEQ ID NO: 1528201 - RNA, 14 nt, Pseudomonas aeruginosa PA01
cgguugcagccacc

SEQ ID NO: 1528202 - RNA, 17 nt, Pseudomonas aeruginosa PA01
cgguugagauccuggcc

SEQ ID NO: 1528203 - RNA, 18 nt, Pseudomonas aeruginosa PA01
cgguuuuuuuaugccugc

SEQ ID NO: 1528204 - RNA, 21 nt, Pseudomonas aeruginosa PA01
cguacaccgcgcggcacagcg

SEQ ID NO: 1528205 - RNA, 20 nt, Pseudomonas aeruginosa PA01
cguacagcgcgacaucggcg

SEQ ID NO: 1528206 - RNA, 19 nt, Pseudomonas aeruginosa PA01
cguacaggccaccgcgcag

SEQ ID NO: 1528207 - RNA, 18 nt, Pseudomonas aeruginosa PA01
cguacaggccccaggcga

SEQ ID NO: 1528208 - RNA, 16 nt, Pseudomonas aeruginosa PA01
cguaccuucgagcagg

SEQ ID NO: 1528209 - RNA, 13 nt, Pseudomonas aeruginosa PA01
cguaccagccgcg

SEQ ID NO: 1528210 - RNA, 19 nt, Pseudomonas aeruginosa PA01
cguacucauggccgcagcg

SEQ ID NO: 1528211 - RNA, 12 nt, Pseudomonas aeruginosa PA01
cguacuccagca

SEQ ID NO: 1528212 - RNA, 15 nt, Pseudomonas aeruginosa PA01
cguaccagcgcgcag

SEQ ID NO: 1528213 - RNA, 16 nt, Pseudomonas aeruginosa PA01
cguaccagcgcgcagc

SEQ ID NO: 1528214 - RNA, 13 nt, Pseudomonas aeruginosa PA01
cggacgcuggcga

SEQ ID NO: 1528215 - RNA, 14 nt, Pseudomonas aeruginosa PA01
cggacgcuggcgau

SEQ ID NO: 1528216 - RNA, 13 nt, Pseudomonas aeruginosa PA01
cggacgcaggccg

SEQ ID NO: 1528217 - RNA, 18 nt, Pseudomonas aeruginosa PA01
cggacgcaggccgaccuc

SEQ ID NO: 1528218 - RNA, 16 nt, Pseudomonas aeruginosa PA01
cggaccucgggcagcu

SEQ ID NO: 1528219 - RNA, 23 nt, Pseudomonas aeruginosa PA01
cggaccugagaucagcgcccggc

SEQ ID NO: 1528220 - RNA, 13 nt, Pseudomonas aeruginosa PA01
cggaccuccagcc

SEQ ID NO: 1528221 - RNA, 18 nt, Pseudomonas aeruginosa PA01
cggaccuccgccaggucg

SEQ ID NO: 1528222 - RNA, 14 nt, Pseudomonas aeruginosa PA01
cggacgcaccagca

SEQ ID NO: 1528223 - RNA, 16 nt, Pseudomonas aeruginosa PA01
cggacgcaccagcagg

SEQ ID NO: 1528224 - RNA, 16 nt, Pseudomonas aeruginosa PA01
cggaccuuguccaggg

SEQ ID NO: 1528225 - RNA, 13 nt, Pseudomonas aeruginosa PA01
cggaccgcagaac

SEQ ID NO: 1528226 - RNA, 15 nt, Pseudomonas aeruginosa PA01
cggaccgggcgccuc

SEQ ID NO: 1528227 - RNA, 21 nt, Pseudomonas aeruginosa PA01
cggaccgaucucguucgggua

SEQ ID NO: 1528228 - RNA, 16 nt, Pseudomonas aeruginosa PA01
cggaccggugccccgc

SEQ ID NO: 1528229 - RNA, 22 nt, Pseudomonas aeruginosa PA01
cggacccaguugggccaggagg

SEQ ID NO: 1528230 - RNA, 23 nt, Pseudomonas aeruginosa PA01
cggaccccauguaccucuggcug

SEQ ID NO: 1528231 - RNA, 20 nt, Pseudomonas aeruginosa PA01
cggacagcccgcgcucggcc

SEQ ID NO: 1528232 - RNA, 18 nt, Pseudomonas aeruginosa PA01
cggacaggcauuccgggc

SEQ ID NO: 1528233 - RNA, 14 nt, Pseudomonas aeruginosa PA01
cggacaggccaccc

SEQ ID NO: 1528234 - RNA, 16 nt, Pseudomonas aeruginosa PA01
cggaaugacgagccgc

SEQ ID NO: 1528235 - RNA, 17 nt, Pseudomonas aeruginosa PA01
cggacggcucgcgcagc

SEQ ID NO: 1528236 - RNA, 15 nt, Pseudomonas aeruginosa PA01
cggacggcugaggcu

SEQ ID NO: 1528237 - RNA, 22 nt, Pseudomonas aeruginosa PA01
cggacuccggaggcgcacaggc

SEQ ID NO: 1528238 - RNA, 17 nt, Pseudomonas aeruginosa PA01
cggacugguaggacagg

SEQ ID NO: 1528239 - RNA, 20 nt, Pseudomonas aeruginosa PA01
cggacugguaggacagggcc

SEQ ID NO: 1528240 - RNA, 24 nt, Pseudomonas aeruginosa PA01
cggacugcccagcgccgccagcag

SEQ ID NO: 1528241 - RNA, 15 nt, Pseudomonas aeruginosa PA01
cggagaacagcagcg

SEQ ID NO: 1528242 - RNA, 22 nt, Pseudomonas aeruginosa PA01
cggagaacagcgagaccucgcc

SEQ ID NO: 1528243 - RNA, 23 nt, Pseudomonas aeruginosa PA01
cggagagcagccaagccaccagc

SEQ ID NO: 1528244 - RNA, 17 nt, Pseudomonas aeruginosa PA01
cggagagacccgccagc

SEQ ID NO: 1528245 - RNA, 13 nt, Pseudomonas aeruginosa PA01
cggagaccacggu

SEQ ID NO: 1528246 - RNA, 16 nt, Pseudomonas aeruginosa PA01
cggagaagggcgcgcc

SEQ ID NO: 1528247 - RNA, 14 nt, Pseudomonas aeruginosa PA01
cggaggucgagcag

SEQ ID NO: 1528248 - RNA, 22 nt, Pseudomonas aeruginosa PA01
cggaggggcggccgccgagcaa

SEQ ID NO: 1528249 - RNA, 18 nt, Pseudomonas aeruginosa PA01
cggagguucgaauccucc

SEQ ID NO: 1528250 - RNA, 13 nt, Pseudomonas aeruginosa PA01
cggaggcgcacag

SEQ ID NO: 1528251 - RNA, 21 nt, Pseudomonas aeruginosa PA01
cggagagcgaauacaccgagc

SEQ ID NO: 1528252 - RNA, 16 nt, Pseudomonas aeruginosa PA01
cggagauagccuccuc

SEQ ID NO: 1528253 - RNA, 18 nt, Pseudomonas aeruginosa PA01
cggagugugucggggccg

SEQ ID NO: 1528254 - RNA, 19 nt, Pseudomonas aeruginosa PA01
cggauacaugcugcucagu

SEQ ID NO: 1528255 - RNA, 17 nt, Pseudomonas aeruginosa PA01
cggagucguagcgcgcg

SEQ ID NO: 1528256 - RNA, 19 nt, Pseudomonas aeruginosa PA01
cggagucguagcgcgcggc

SEQ ID NO: 1528257 - RNA, 15 nt, Pseudomonas aeruginosa PA01
cggaaggccucggug

SEQ ID NO: 1528258 - RNA, 13 nt, Pseudomonas aeruginosa PA01
cggaagggccgag

SEQ ID NO: 1528259 - RNA, 16 nt, Pseudomonas aeruginosa PA01
cggaagcgucagccgc

SEQ ID NO: 1528260 - RNA, 15 nt, Pseudomonas aeruginosa PA01
cggaagcguccaggg

SEQ ID NO: 1528261 - RNA, 13 nt, Pseudomonas aeruginosa PA01
cggaagccgucgg

SEQ ID NO: 1528262 - RNA, 24 nt, Pseudomonas aeruginosa PA01
cggaagcccugcuggcgcagccag

SEQ ID NO: 1528263 - RNA, 16 nt, Pseudomonas aeruginosa PA01
cggaagcacggcucgg

SEQ ID NO: 1528264 - RNA, 17 nt, Pseudomonas aeruginosa PA01
cggaagcacggcucggc

SEQ ID NO: 1528265 - RNA, 14 nt, Pseudomonas aeruginosa PA01
cggaagcccagcag

SEQ ID NO: 1528266 - RNA, 18 nt, Pseudomonas aeruginosa PA01
cggaagaauaccgccagc

SEQ ID NO: 1528267 - RNA, 20 nt, Pseudomonas aeruginosa PA01
cggaagacgaucucccgcga

SEQ ID NO: 1528268 - RNA, 13 nt, Pseudomonas aeruginosa PA01
cggaacauggugu

SEQ ID NO: 1528269 - RNA, 20 nt, Pseudomonas aeruginosa PA01
cggaacaggagccaucgcuc

SEQ ID NO: 1528270 - RNA, 16 nt, Pseudomonas aeruginosa PA01
cggaacaagccgccuu

SEQ ID NO: 1528271 - RNA, 14 nt, Pseudomonas aeruginosa PA01
cgcuuuccuggccg

SEQ ID NO: 1528272 - RNA, 18 nt, Pseudomonas aeruginosa PA01
cgcuuguccuccagcugc

SEQ ID NO: 1528273 - RNA, 15 nt, Pseudomonas aeruginosa PA01
cgcuuugcgcgcagu

SEQ ID NO: 1528274 - RNA, 16 nt, Pseudomonas aeruginosa PA01
cgcugccugcaccggg

SEQ ID NO: 1528275 - RNA, 16 nt, Pseudomonas aeruginosa PA01
cgcugccggcgcgcac

SEQ ID NO: 1528276 - RNA, 20 nt, Pseudomonas aeruginosa PA01
cgcugccgccgcgcaggcgg

SEQ ID NO: 1528277 - RNA, 15 nt, Pseudomonas aeruginosa PA01
cgcugccgccgcgcu

SEQ ID NO: 1528278 - RNA, 17 nt, Pseudomonas aeruginosa PA01
cgcugccgccgcgcugc

SEQ ID NO: 1528279 - RNA, 14 nt, Pseudomonas aeruginosa PA01
cgcugccggccagg

SEQ ID NO: 1528280 - RNA, 17 nt, Pseudomonas aeruginosa PA01
cgcuucaggcaguccuu

SEQ ID NO: 1528281 - RNA, 16 nt, Pseudomonas aeruginosa PA01
cgcugccuggggacgg

SEQ ID NO: 1528282 - RNA, 15 nt, Pseudomonas aeruginosa PA01
cgcuucagcgcgccg

SEQ ID NO: 1528283 - RNA, 19 nt, Pseudomonas aeruginosa PA01
cgcuucauccugcgcgccu

SEQ ID NO: 1528284 - RNA, 22 nt, Pseudomonas aeruginosa PA01
cgcuuccaggguagcgccgcgg

SEQ ID NO: 1528285 - RNA, 14 nt, Pseudomonas aeruginosa PA01
cgcuuccgcccagu

SEQ ID NO: 1528286 - RNA, 17 nt, Pseudomonas aeruginosa PA01
cgcuuccgccggcgccg

SEQ ID NO: 1528287 - RNA, 21 nt, Pseudomonas aeruginosa PA01
cgcuuccgcgcggcgcccugc

SEQ ID NO: 1528288 - RNA, 23 nt, Pseudomonas aeruginosa PA01
cgcuuccgcgcggcgcccugccg

SEQ ID NO: 1528289 - RNA, 17 nt, Pseudomonas aeruginosa PA01
cgcuuccggcagccagc

SEQ ID NO: 1528290 - RNA, 20 nt, Pseudomonas aeruginosa PA01
cgcuuccggcagccagccgc

SEQ ID NO: 1528291 - RNA, 16 nt, Pseudomonas aeruginosa PA01
cgcuuccggcccggcc

SEQ ID NO: 1528292 - RNA, 13 nt, Pseudomonas aeruginosa PA01
cgcuuccggcgcc

SEQ ID NO: 1528293 - RNA, 17 nt, Pseudomonas aeruginosa PA01
cgcuuccggcuugguuc

SEQ ID NO: 1528294 - RNA, 16 nt, Pseudomonas aeruginosa PA01
cgcuucggccaccagc

SEQ ID NO: 1528295 - RNA, 15 nt, Pseudomonas aeruginosa PA01
cgcuucgcccgccgc

SEQ ID NO: 1528296 - RNA, 17 nt, Pseudomonas aeruginosa PA01
cgcuucgcccgccgccu

SEQ ID NO: 1528297 - RNA, 14 nt, Pseudomonas aeruginosa PA01
cgcuucggcccgcu

SEQ ID NO: 1528298 - RNA, 16 nt, Pseudomonas aeruginosa PA01
cgcuucuucccgccca

SEQ ID NO: 1528299 - RNA, 15 nt, Pseudomonas aeruginosa PA01
cgcuucugcgccucc

SEQ ID NO: 1528300 - RNA, 16 nt, Pseudomonas aeruginosa PA01
cgcuucugcucggccu

SEQ ID NO: 1528301 - RNA, 12 nt, Pseudomonas aeruginosa PA01
cgcuucugcugg

SEQ ID NO: 1528302 - RNA, 13 nt, Pseudomonas aeruginosa PA01
cgcuugagcagcc

SEQ ID NO: 1528303 - RNA, 17 nt, Pseudomonas aeruginosa PA01
cgcuugcgggcgcgccu

SEQ ID NO: 1528304 - RNA, 20 nt, Pseudomonas aeruginosa PA01
cgcuugcgguuauccgccgu

SEQ ID NO: 1528305 - RNA, 16 nt, Pseudomonas aeruginosa PA01
cgcuuguagcagccgc

SEQ ID NO: 1528306 - RNA, 16 nt, Pseudomonas aeruginosa PA01
cgcuuguagcccaggg

SEQ ID NO: 1528307 - RNA, 23 nt, Pseudomonas aeruginosa PA01
cggcagaguuucucggucgccgc

SEQ ID NO: 1528308 - RNA, 23 nt, Pseudomonas aeruginosa PA01
cggcagauccgccgugaggcgcg

SEQ ID NO: 1528309 - RNA, 18 nt, Pseudomonas aeruginosa PA01
cggcacucagccagcggc

SEQ ID NO: 1528310 - RNA, 23 nt, Pseudomonas aeruginosa PA01
cggcagcacgucuugcaggcuca

SEQ ID NO: 1528311 - RNA, 20 nt, Pseudomonas aeruginosa PA01
cggcagcacccgcaccagcc

SEQ ID NO: 1528312 - RNA, 22 nt, Pseudomonas aeruginosa PA01
cggcagcacgaugaggcguggg

SEQ ID NO: 1528313 - RNA, 20 nt, Pseudomonas aeruginosa PA01
cggcagaucucccuguccua

SEQ ID NO: 1528314 - RNA, 17 nt, Pseudomonas aeruginosa PA01
cggcagaugccgggcgu

SEQ ID NO: 1528315 - RNA, 14 nt, Pseudomonas aeruginosa PA01
cggcagccagccgc

SEQ ID NO: 1528316 - RNA, 17 nt, Pseudomonas aeruginosa PA01
cggcagccagccgccga

SEQ ID NO: 1528317 - RNA, 14 nt, Pseudomonas aeruginosa PA01
cggcagccaccagg

SEQ ID NO: 1528318 - RNA, 12 nt, Pseudomonas aeruginosa PA01
cggcagcggcuc

SEQ ID NO: 1528319 - RNA, 14 nt, Pseudomonas aeruginosa PA01
cggcagcagcgcca

SEQ ID NO: 1528320 - RNA, 11 nt, Pseudomonas aeruginosa PA01
cggcagcaggc

SEQ ID NO: 1528321 - RNA, 13 nt, Pseudomonas aeruginosa PA01
cggcagcaggccg

SEQ ID NO: 1528322 - RNA, 13 nt, Pseudomonas aeruginosa PA01
cggcagcaggcgg

SEQ ID NO: 1528323 - RNA, 13 nt, Pseudomonas aeruginosa PA01
cggcagcaggcug

SEQ ID NO: 1528324 - RNA, 23 nt, Pseudomonas aeruginosa PA01
cggcagcaucucggugcgcccca

SEQ ID NO: 1528325 - RNA, 15 nt, Pseudomonas aeruginosa PA01
cggcagcagggucag

SEQ ID NO: 1528326 - RNA, 20 nt, Pseudomonas aeruginosa PA01
cggcagcagggucagcagcg

SEQ ID NO: 1528327 - RNA, 19 nt, Pseudomonas aeruginosa PA01
cggcaauucuucaaggucu

SEQ ID NO: 1528328 - RNA, 22 nt, Pseudomonas aeruginosa PA01
cggcacagcguggccagcgccc

SEQ ID NO: 1528329 - RNA, 21 nt, Pseudomonas aeruginosa PA01
cggcacgcugcuugcgcaccu

SEQ ID NO: 1528330 - RNA, 18 nt, Pseudomonas aeruginosa PA01
cggcacgguggaccaacg

SEQ ID NO: 1528331 - RNA, 15 nt, Pseudomonas aeruginosa PA01
cggcacgcuccagau

SEQ ID NO: 1528332 - RNA, 13 nt, Pseudomonas aeruginosa PA01
cggcaccgcucug

SEQ ID NO: 1528333 - RNA, 21 nt, Pseudomonas aeruginosa PA01
cggcaagcugaagcgccgcgg

SEQ ID NO: 1528334 - RNA, 11 nt, Pseudomonas aeruginosa PA01
cggcaaggcgc

SEQ ID NO: 1528335 - RNA, 22 nt, Pseudomonas aeruginosa PA01
cggcaagggcacgugcagcggc

SEQ ID NO: 1528336 - RNA, 17 nt, Pseudomonas aeruginosa PA01
cggcaagggcgucuggg

SEQ ID NO: 1528337 - RNA, 19 nt, Pseudomonas aeruginosa PA01
cggcaaggccaagucggcc

SEQ ID NO: 1528338 - RNA, 22 nt, Pseudomonas aeruginosa PA01
cggcaaggccaagucggccgcc

SEQ ID NO: 1528339 - RNA, 19 nt, Pseudomonas aeruginosa PA01
cggcaauguccgagcaggu

SEQ ID NO: 1528340 - RNA, 20 nt, Pseudomonas aeruginosa PA01
cggcaacgaacuucagggcu

SEQ ID NO: 1528341 - RNA, 15 nt, Pseudomonas aeruginosa PA01
cggcaacgagcagga

SEQ ID NO: 1528342 - RNA, 22 nt, Pseudomonas aeruginosa PA01
cggcaacgauaccgccgccggc

SEQ ID NO: 1528343 - RNA, 17 nt, Pseudomonas aeruginosa PA01
cggcaacgucaggcugu

SEQ ID NO: 1528344 - RNA, 13 nt, Pseudomonas aeruginosa PA01
cggcaaccgggcg

SEQ ID NO: 1528345 - RNA, 12 nt, Pseudomonas aeruginosa PA01
cggaucagucag

SEQ ID NO: 1528346 - RNA, 13 nt, Pseudomonas aeruginosa PA01
cggauacuccuuc

SEQ ID NO: 1528347 - RNA, 21 nt, Pseudomonas aeruginosa PA01
cggauacaccagguuggccag

SEQ ID NO: 1528348 - RNA, 22 nt, Pseudomonas aeruginosa PA01
cggauacaccagguuggccagu

SEQ ID NO: 1528349 - RNA, 18 nt, Pseudomonas aeruginosa PA01
cggauaccacccgcagcc

SEQ ID NO: 1528350 - RNA, 17 nt, Pseudomonas aeruginosa PA01
cggauagccgugcagca

SEQ ID NO: 1528351 - RNA, 13 nt, Pseudomonas aeruginosa PA01
cggauacgccagg

SEQ ID NO: 1528352 - RNA, 15 nt, Pseudomonas aeruginosa PA01
cggaucagccggccc

SEQ ID NO: 1528353 - RNA, 17 nt, Pseudomonas aeruginosa PA01
cggaucaccggcuggcc

SEQ ID NO: 1528354 - RNA, 21 nt, Pseudomonas aeruginosa PA01
cggaucaccggcuggcccucc

SEQ ID NO: 1528355 - RNA, 11 nt, Pseudomonas aeruginosa PA01
cggaucaccug

SEQ ID NO: 1528356 - RNA, 23 nt, Pseudomonas aeruginosa PA01
cggauauccccguauccuccgcg

SEQ ID NO: 1528357 - RNA, 15 nt, Pseudomonas aeruginosa PA01
cggcauggccgaccg

SEQ ID NO: 1528358 - RNA, 22 nt, Pseudomonas aeruginosa PA01
cggcaugguccguucggcgccc

SEQ ID NO: 1528359 - RNA, 14 nt, Pseudomonas aeruginosa PA01
cggcaugcucagcc

SEQ ID NO: 1528360 - RNA, 14 nt, Pseudomonas aeruginosa PA01
cggcaugcccugcc

SEQ ID NO: 1528361 - RNA, 19 nt, Pseudomonas aeruginosa PA01
cggcaugcccugccggcgc

SEQ ID NO: 1528362 - RNA, 18 nt, Pseudomonas aeruginosa PA01
cggcaugcacgcccugga

SEQ ID NO: 1528363 - RNA, 19 nt, Pseudomonas aeruginosa PA01
cggcaucuuguguaccacc

SEQ ID NO: 1528364 - RNA, 18 nt, Pseudomonas aeruginosa PA01
cggcagcuuggcgacguc

SEQ ID NO: 1528365 - RNA, 22 nt, Pseudomonas aeruginosa PA01
cggcagcggugaagguccgcgc

SEQ ID NO: 1528366 - RNA, 18 nt, Pseudomonas aeruginosa PA01
cggcagcgucgagcuggc

SEQ ID NO: 1528367 - RNA, 18 nt, Pseudomonas aeruginosa PA01
cggcagcgucggaaaacc

SEQ ID NO: 1528368 - RNA, 18 nt, Pseudomonas aeruginosa PA01
cggcagcgucucagcccu

SEQ ID NO: 1528369 - RNA, 21 nt, Pseudomonas aeruginosa PA01
cggcagcgucucagcccucgg

SEQ ID NO: 1528370 - RNA, 20 nt, Pseudomonas aeruginosa PA01
cggcagcgucucggcugccg

SEQ ID NO: 1528371 - RNA, 20 nt, Pseudomonas aeruginosa PA01
cggcagcuccggcgggcggu

SEQ ID NO: 1528372 - RNA, 18 nt, Pseudomonas aeruginosa PA01
cggcagcucauaggucag

SEQ ID NO: 1528373 - RNA, 17 nt, Pseudomonas aeruginosa PA01
cggcaucugccgggcgu

SEQ ID NO: 1528374 - RNA, 23 nt, Pseudomonas aeruginosa PA01
cggcagcugcggcggcaccacgu

SEQ ID NO: 1528375 - RNA, 22 nt, Pseudomonas aeruginosa PA01
cggccaaccucuccccagaccc

SEQ ID NO: 1528376 - RNA, 20 nt, Pseudomonas aeruginosa PA01
cggcauuggagaugaucagc

SEQ ID NO: 1528377 - RNA, 17 nt, Pseudomonas aeruginosa PA01
cggcauuggcacccugg

SEQ ID NO: 1528378 - RNA, 15 nt, Pseudomonas aeruginosa PA01
cggcauucgccgggc

SEQ ID NO: 1528379 - RNA, 14 nt, Pseudomonas aeruginosa PA01
cggcauuagucuuu

SEQ ID NO: 1528380 - RNA, 14 nt, Pseudomonas aeruginosa PA01
cggcauuccgggcg

SEQ ID NO: 1528381 - RNA, 16 nt, Pseudomonas aeruginosa PA01
cggcauuccgggcgaa

SEQ ID NO: 1528382 - RNA, 20 nt, Pseudomonas aeruginosa PA01
cggcauucgacccgccgacc

SEQ ID NO: 1528383 - RNA, 18 nt, Pseudomonas aeruginosa PA01
cggccaacugggccuuga

SEQ ID NO: 1528384 - RNA, 17 nt, Pseudomonas aeruginosa PA01
cggccaggaccagggcg

SEQ ID NO: 1528385 - RNA, 22 nt, Pseudomonas aeruginosa PA01
cggccaggacgccaccaggccg

SEQ ID NO: 1528386 - RNA, 15 nt, Pseudomonas aeruginosa PA01
cggccagcgcggcgg

SEQ ID NO: 1528387 - RNA, 16 nt, Pseudomonas aeruginosa PA01
cggccagcggaugcug

SEQ ID NO: 1528388 - RNA, 14 nt, Pseudomonas aeruginosa PA01
cggccagcggcaga

SEQ ID NO: 1528389 - RNA, 19 nt, Pseudomonas aeruginosa PA01
cggccagcgcggccgccgc

SEQ ID NO: 1528390 - RNA, 18 nt, Pseudomonas aeruginosa PA01
cggccagcgcggcgcgcu

SEQ ID NO: 1528391 - RNA, 18 nt, Pseudomonas aeruginosa PA01
cggccaggcgccagggcc

SEQ ID NO: 1528392 - RNA, 19 nt, Pseudomonas aeruginosa PA01
cggccaggcgccagggccg

SEQ ID NO: 1528393 - RNA, 15 nt, Pseudomonas aeruginosa PA01
cggccaggcgcgggu

SEQ ID NO: 1528394 - RNA, 16 nt, Pseudomonas aeruginosa PA01
cggccaggcgcggguc

SEQ ID NO: 1528395 - RNA, 15 nt, Pseudomonas aeruginosa PA01
cggccaggccacggc

SEQ ID NO: 1528396 - RNA, 18 nt, Pseudomonas aeruginosa PA01
cggccaggcccacgccga

SEQ ID NO: 1528397 - RNA, 17 nt, Pseudomonas aeruginosa PA01
cggccauaccuccagcc

SEQ ID NO: 1528398 - RNA, 14 nt, Pseudomonas aeruginosa PA01
cggccagggagcgc

SEQ ID NO: 1528399 - RNA, 16 nt, Pseudomonas aeruginosa PA01
cggccagggagcgcga

SEQ ID NO: 1528400 - RNA, 17 nt, Pseudomonas aeruginosa PA01
cggccagggagcgcgac

SEQ ID NO: 1528401 - RNA, 15 nt, Pseudomonas aeruginosa PA01
cggccagggccgcuc

SEQ ID NO: 1528402 - RNA, 22 nt, Pseudomonas aeruginosa PA01
cggccagggcgaacagcgccgc

SEQ ID NO: 1528403 - RNA, 15 nt, Pseudomonas aeruginosa PA01
cggccaccagcagca

SEQ ID NO: 1528404 - RNA, 19 nt, Pseudomonas aeruginosa PA01
cggccaccgacgcgcgcgc

SEQ ID NO: 1528405 - RNA, 19 nt, Pseudomonas aeruginosa PA01
cggccaccuucgcccgcug

SEQ ID NO: 1528406 - RNA, 15 nt, Pseudomonas aeruginosa PA01
cggccacgcgaccag

SEQ ID NO: 1528407 - RNA, 20 nt, Pseudomonas aeruginosa PA01
cggccacgcgaccagcgcca

SEQ ID NO: 1528408 - RNA, 20 nt, Pseudomonas aeruginosa PA01
cggccacuucguccggccgc

SEQ ID NO: 1528409 - RNA, 22 nt, Pseudomonas aeruginosa PA01
cggccacuucguccggccgccc

SEQ ID NO: 1528410 - RNA, 14 nt, Pseudomonas aeruginosa PA01
cggccacuccagcc

SEQ ID NO: 1528411 - RNA, 15 nt, Pseudomonas aeruginosa PA01
cggccacucgcagcc

SEQ ID NO: 1528412 - RNA, 21 nt, Pseudomonas aeruginosa PA01
cggccacucgcagccgcgcuc

SEQ ID NO: 1528413 - RNA, 19 nt, Pseudomonas aeruginosa PA01
cggccacuaucgccaacgc

SEQ ID NO: 1528414 - RNA, 13 nt, Pseudomonas aeruginosa PA01
cggccagagcuuc

SEQ ID NO: 1528415 - RNA, 19 nt, Pseudomonas aeruginosa PA01
cgcguagguggcgccgccg

SEQ ID NO: 1528416 - RNA, 18 nt, Pseudomonas aeruginosa PA01
cgcguaggggaccacccc

SEQ ID NO: 1528417 - RNA, 22 nt, Pseudomonas aeruginosa PA01
cgcgucggcggcacccucuucc

SEQ ID NO: 1528418 - RNA, 21 nt, Pseudomonas aeruginosa PA01
cgcgucgggaaaggccgccac

SEQ ID NO: 1528419 - RNA, 22 nt, Pseudomonas aeruginosa PA01
cgcgugaaaacaagaagccccg

SEQ ID NO: 1528420 - RNA, 14 nt, Pseudomonas aeruginosa PA01
cgcgugggccacca

SEQ ID NO: 1528421 - RNA, 19 nt, Pseudomonas aeruginosa PA01
cgcgugggcuucgccgccg

SEQ ID NO: 1528422 - RNA, 17 nt, Pseudomonas aeruginosa PA01
cgcgugguaucggcgcu

SEQ ID NO: 1528423 - RNA, 19 nt, Pseudomonas aeruginosa PA01
cgcgucugaacgaagaagc

SEQ ID NO: 1528424 - RNA, 19 nt, Pseudomonas aeruginosa PA01
cgcguacgcccgcagccac

SEQ ID NO: 1528425 - RNA, 12 nt, Pseudomonas aeruginosa PA01
cgcgggcugccc

SEQ ID NO: 1528426 - RNA, 18 nt, Pseudomonas aeruginosa PA01
cgcgggcguugcgcgccu

SEQ ID NO: 1528427 - RNA, 18 nt, Pseudomonas aeruginosa PA01
cgcgggcguuggccugga

SEQ ID NO: 1528428 - RNA, 20 nt, Pseudomonas aeruginosa PA01
cgcgggcuauucccgccgcu

SEQ ID NO: 1528429 - RNA, 21 nt, Pseudomonas aeruginosa PA01
cgcggugccauucggugcgcu

SEQ ID NO: 1528430 - RNA, 14 nt, Pseudomonas aeruginosa PA01
cgcggugcgcgcca

SEQ ID NO: 1528431 - RNA, 14 nt, Pseudomonas aeruginosa PA01
cgcggugcgggccu

SEQ ID NO: 1528432 - RNA, 16 nt, Pseudomonas aeruginosa PA01
cgcgguggaggcggcg

SEQ ID NO: 1528433 - RNA, 14 nt, Pseudomonas aeruginosa PA01
cgcuagggcgcccu

SEQ ID NO: 1528434 - RNA, 15 nt, Pseudomonas aeruginosa PA01
cgcucaagggcuggc

SEQ ID NO: 1528435 - RNA, 16 nt, Pseudomonas aeruginosa PA01
cgcucaggguggcguu

SEQ ID NO: 1528436 - RNA, 23 nt, Pseudomonas aeruginosa PA01
cgcucauccgcugguagcccagg

SEQ ID NO: 1528437 - RNA, 13 nt, Pseudomonas aeruginosa PA01
cgcucaccgccac

SEQ ID NO: 1528438 - RNA, 19 nt, Pseudomonas aeruginosa PA01
cgcucaccaggcccgccgg

SEQ ID NO: 1528439 - RNA, 17 nt, Pseudomonas aeruginosa PA01
cgcucacccacauggcg

SEQ ID NO: 1528440 - RNA, 15 nt, Pseudomonas aeruginosa PA01
cgcucaccaccaccg

SEQ ID NO: 1528441 - RNA, 20 nt, Pseudomonas aeruginosa PA01
cgcguucaucgucggcagcc

SEQ ID NO: 1528442 - RNA, 14 nt, Pseudomonas aeruginosa PA01
cgcguucaccccgc

SEQ ID NO: 1528443 - RNA, 13 nt, Pseudomonas aeruginosa PA01
cgcguucacucca

SEQ ID NO: 1528444 - RNA, 21 nt, Pseudomonas aeruginosa PA01
cgcguucggcgaugccgcgcc

SEQ ID NO: 1528445 - RNA, 14 nt, Pseudomonas aeruginosa PA01
cgcguucucccuga

SEQ ID NO: 1528446 - RNA, 15 nt, Pseudomonas aeruginosa PA01
cgcguugcccagccc

SEQ ID NO: 1528447 - RNA, 23 nt, Pseudomonas aeruginosa PA01
cgcguugacgcggaugcccuggu

SEQ ID NO: 1528448 - RNA, 23 nt, Pseudomonas aeruginosa PA01
cgcguuguagaaacgguccaggg

SEQ ID NO: 1528449 - RNA, 18 nt, Pseudomonas aeruginosa PA01
cgcugccaaacgccgucu

SEQ ID NO: 1528450 - RNA, 16 nt, Pseudomonas aeruginosa PA01
cgcugcauguccgcag

SEQ ID NO: 1528451 - RNA, 18 nt, Pseudomonas aeruginosa PA01
cgcugcaugugccaggcc

SEQ ID NO: 1528452 - RNA, 22 nt, Pseudomonas aeruginosa PA01
cgcugcaugugccaggccuggg

SEQ ID NO: 1528453 - RNA, 15 nt, Pseudomonas aeruginosa PA01
cgcugcacgccuucc

SEQ ID NO: 1528454 - RNA, 16 nt, Pseudomonas aeruginosa PA01
cgcugcaccagcuucu

SEQ ID NO: 1528455 - RNA, 16 nt, Pseudomonas aeruginosa PA01
cgcugcaacuccgccu

SEQ ID NO: 1528456 - RNA, 13 nt, Pseudomonas aeruginosa PA01
cgcugagcgccuc

SEQ ID NO: 1528457 - RNA, 16 nt, Pseudomonas aeruginosa PA01
cgcugagcgccucgau

SEQ ID NO: 1528458 - RNA, 23 nt, Pseudomonas aeruginosa PA01
cgcugagcaucugggucuucagc

SEQ ID NO: 1528459 - RNA, 19 nt, Pseudomonas aeruginosa PA01
cgcugacggcaaggaccug

SEQ ID NO: 1528460 - RNA, 16 nt, Pseudomonas aeruginosa PA01
cgcucugcuggccacc

SEQ ID NO: 1528461 - RNA, 17 nt, Pseudomonas aeruginosa PA01
cgcucugcuggccaccc

SEQ ID NO: 1528462 - RNA, 19 nt, Pseudomonas aeruginosa PA01
cgcucugcuggccgcccuu

SEQ ID NO: 1528463 - RNA, 18 nt, Pseudomonas aeruginosa PA01
cgcucggcgaggccggcg

SEQ ID NO: 1528464 - RNA, 14 nt, Pseudomonas aeruginosa PA01
cgcucggcgagccg

SEQ ID NO: 1528465 - RNA, 14 nt, Pseudomonas aeruginosa PA01
cgcucggccgccag

SEQ ID NO: 1528466 - RNA, 15 nt, Pseudomonas aeruginosa PA01
cgcucggccgccagc

SEQ ID NO: 1528467 - RNA, 18 nt, Pseudomonas aeruginosa PA01
cgcucggaucaggcgggc

SEQ ID NO: 1528468 - RNA, 16 nt, Pseudomonas aeruginosa PA01
cgcucggacagcuucu

SEQ ID NO: 1528469 - RNA, 17 nt, Pseudomonas aeruginosa PA01
cgcucgcugucgcucag

SEQ ID NO: 1528470 - RNA, 16 nt, Pseudomonas aeruginosa PA01
cgcucgcuacagccgg

SEQ ID NO: 1528471 - RNA, 19 nt, Pseudomonas aeruginosa PA01
cgcucgcgguuauccgccg

SEQ ID NO: 1528472 - RNA, 17 nt, Pseudomonas aeruginosa PA01
cgcucgcggaccucugc

SEQ ID NO: 1528473 - RNA, 19 nt, Pseudomonas aeruginosa PA01
cgcucgcggcaucccgccc

SEQ ID NO: 1528474 - RNA, 16 nt, Pseudomonas aeruginosa PA01
cgcucgcgcaugaccu

SEQ ID NO: 1528475 - RNA, 16 nt, Pseudomonas aeruginosa PA01
cgcucgcgcggcaccc

SEQ ID NO: 1528476 - RNA, 20 nt, Pseudomonas aeruginosa PA01
cgcugacgccauucaggcgg

SEQ ID NO: 1528477 - RNA, 19 nt, Pseudomonas aeruginosa PA01
cgcugaaauccaccagcac

SEQ ID NO: 1528478 - RNA, 13 nt, Pseudomonas aeruginosa PA01
cgcucuggccgcg

SEQ ID NO: 1528479 - RNA, 13 nt, Pseudomonas aeruginosa PA01
cgcucuggcugcu

SEQ ID NO: 1528480 - RNA, 14 nt, Pseudomonas aeruginosa PA01
cgcucuucacuucc

SEQ ID NO: 1528481 - RNA, 18 nt, Pseudomonas aeruginosa PA01
cgcucuucgccgcggcgu

SEQ ID NO: 1528482 - RNA, 14 nt, Pseudomonas aeruginosa PA01
cgcucuuccuuguc

SEQ ID NO: 1528483 - RNA, 20 nt, Pseudomonas aeruginosa PA01
cgcucgccuaccggcgccgc

SEQ ID NO: 1528484 - RNA, 19 nt, Pseudomonas aeruginosa PA01
cgcucgccagaugacgaug

SEQ ID NO: 1528485 - RNA, 21 nt, Pseudomonas aeruginosa PA01
cgcucgacauacuccgccgcu

SEQ ID NO: 1528486 - RNA, 19 nt, Pseudomonas aeruginosa PA01
cgcucgaguucgcgcgggu

SEQ ID NO: 1528487 - RNA, 22 nt, Pseudomonas aeruginosa PA01
cgcucgagcuugaggucggccu

SEQ ID NO: 1528488 - RNA, 21 nt, Pseudomonas aeruginosa PA01
cgcucgagggcgaccgccagg

SEQ ID NO: 1528489 - RNA, 14 nt, Pseudomonas aeruginosa PA01
cgcucgagccggcu

SEQ ID NO: 1528490 - RNA, 15 nt, Pseudomonas aeruginosa PA01
cgcucgagccggcug

SEQ ID NO: 1528491 - RNA, 13 nt, Pseudomonas aeruginosa PA01
cgcuccgcggccg

SEQ ID NO: 1528492 - RNA, 13 nt, Pseudomonas aeruginosa PA01
cgcuccgccaggc

SEQ ID NO: 1528493 - RNA, 20 nt, Pseudomonas aeruginosa PA01
cgcuccgccaggccgcgcag

SEQ ID NO: 1528494 - RNA, 15 nt, Pseudomonas aeruginosa PA01
cgcuccgagcaggcc

SEQ ID NO: 1528495 - RNA, 20 nt, Pseudomonas aeruginosa PA01
cgcuccggcgcgccauggcg

SEQ ID NO: 1528496 - RNA, 23 nt, Pseudomonas aeruginosa PA01
cgcuccgggcccgugcggcacgc

SEQ ID NO: 1528497 - RNA, 16 nt, Pseudomonas aeruginosa PA01
cgcuccggcucucccc

SEQ ID NO: 1528498 - RNA, 18 nt, Pseudomonas aeruginosa PA01
cgcuccggugccagggcg

SEQ ID NO: 1528499 - RNA, 13 nt, Pseudomonas aeruginosa PA01
cgcuccguagggc

SEQ ID NO: 1528500 - RNA, 22 nt, Pseudomonas aeruginosa PA01
cgcuccguagggcgacgcccga

SEQ ID NO: 1528501 - RNA, 18 nt, Pseudomonas aeruginosa PA01
cgcuccuugcgccaggcc

SEQ ID NO: 1528502 - RNA, 19 nt, Pseudomonas aeruginosa PA01
cgcuccuugcgccaggccc

SEQ ID NO: 1528503 - RNA, 17 nt, Pseudomonas aeruginosa PA01
cgcuccuuucccagcgu

SEQ ID NO: 1528504 - RNA, 15 nt, Pseudomonas aeruginosa PA01
cgcuccugcgccggc

SEQ ID NO: 1528505 - RNA, 20 nt, Pseudomonas aeruginosa PA01
cgcuccucgcgcugcccggc

SEQ ID NO: 1528506 - RNA, 16 nt, Pseudomonas aeruginosa PA01
cgcuccuccagcgccg

SEQ ID NO: 1528507 - RNA, 18 nt, Pseudomonas aeruginosa PA01
cgcuccuccagcgccgcc

SEQ ID NO: 1528508 - RNA, 18 nt, Pseudomonas aeruginosa PA01
cgcuccaacagcagguag

SEQ ID NO: 1528509 - RNA, 22 nt, Pseudomonas aeruginosa PA01
cgcuccaacgcaggcgcauggc

SEQ ID NO: 1528510 - RNA, 14 nt, Pseudomonas aeruginosa PA01
cgcuccacccaggc

SEQ ID NO: 1528511 - RNA, 18 nt, Pseudomonas aeruginosa PA01
cgcuccaccgcccccggc

SEQ ID NO: 1528512 - RNA, 15 nt, Pseudomonas aeruginosa PA01
cgcuccacagcugcc

SEQ ID NO: 1528513 - RNA, 20 nt, Pseudomonas aeruginosa PA01
cgcuccacagcugccagccc

SEQ ID NO: 1528514 - RNA, 13 nt, Pseudomonas aeruginosa PA01
cgcuccaggcugu

SEQ ID NO: 1528515 - RNA, 12 nt, Pseudomonas aeruginosa PA01
cgcuccagggcg

SEQ ID NO: 1528516 - RNA, 18 nt, Pseudomonas aeruginosa PA01
cgcuccaggugcacggcc

SEQ ID NO: 1528517 - RNA, 21 nt, Pseudomonas aeruginosa PA01
cgcuccaggugcacggccagg

SEQ ID NO: 1528518 - RNA, 13 nt, Pseudomonas aeruginosa PA01
cgcuccagcgccu

SEQ ID NO: 1528519 - RNA, 16 nt, Pseudomonas aeruginosa PA01
cgcuccagcggcagcu

SEQ ID NO: 1528520 - RNA, 22 nt, Pseudomonas aeruginosa PA01
cgcuccagacucuccaggucgg

SEQ ID NO: 1528521 - RNA, 14 nt, Pseudomonas aeruginosa PA01
cgcuccaggcccgg

SEQ ID NO: 1528522 - RNA, 15 nt, Pseudomonas aeruginosa PA01
cgcuccaggcccggc

SEQ ID NO: 1528523 - RNA, 19 nt, Pseudomonas aeruginosa PA01
cgcuccccacucggccagc

SEQ ID NO: 1528524 - RNA, 23 nt, Pseudomonas aeruginosa PA01
cgcuccccacucggccagcaaug

SEQ ID NO: 1528525 - RNA, 18 nt, Pseudomonas aeruginosa PA01
cgcucccaggcucacgca

SEQ ID NO: 1528526 - RNA, 13 nt, Pseudomonas aeruginosa PA01
cgcucccgcggcc

SEQ ID NO: 1528527 - RNA, 13 nt, Pseudomonas aeruginosa PA01
cgcuccccugccg

SEQ ID NO: 1528528 - RNA, 15 nt, Pseudomonas aeruginosa PA01
cgccagcaacccgcc

SEQ ID NO: 1528529 - RNA, 20 nt, Pseudomonas aeruginosa PA01
cgccagcaccacccggccgc

SEQ ID NO: 1528530 - RNA, 21 nt, Pseudomonas aeruginosa PA01
cgccagcaccacccggccgcg

SEQ ID NO: 1528531 - RNA, 18 nt, Pseudomonas aeruginosa PA01
cgccagcaauugccgcug

SEQ ID NO: 1528532 - RNA, 13 nt, Pseudomonas aeruginosa PA01
cgccagcaacagu

SEQ ID NO: 1528533 - RNA, 19 nt, Pseudomonas aeruginosa PA01
cgccagcaacaguugccgc

SEQ ID NO: 1528534 - RNA, 14 nt, Pseudomonas aeruginosa PA01
cgccagaugacgau

SEQ ID NO: 1528535 - RNA, 17 nt, Pseudomonas aeruginosa PA01
cgcgccugagcuggccc

SEQ ID NO: 1528536 - RNA, 15 nt, Pseudomonas aeruginosa PA01
cgcgccuccggcagc

SEQ ID NO: 1528537 - RNA, 13 nt, Pseudomonas aeruginosa PA01
cgcgccucgcccc

SEQ ID NO: 1528538 - RNA, 14 nt, Pseudomonas aeruginosa PA01
cgcgccucgcgcaa

SEQ ID NO: 1528539 - RNA, 15 nt, Pseudomonas aeruginosa PA01
cgcgccucgcgcaac

SEQ ID NO: 1528540 - RNA, 16 nt, Pseudomonas aeruginosa PA01
cgcgccgggcucagcg

SEQ ID NO: 1528541 - RNA, 14 nt, Pseudomonas aeruginosa PA01
cgcgcgccaguccc

SEQ ID NO: 1528542 - RNA, 18 nt, Pseudomonas aeruginosa PA01
cgcgcgauggccggcgga

SEQ ID NO: 1528543 - RNA, 22 nt, Pseudomonas aeruginosa PA01
cgcgcgauaaaaagccccgcuu

SEQ ID NO: 1528544 - RNA, 19 nt, Pseudomonas aeruginosa PA01
cgcgcgcccuugagcacgu

SEQ ID NO: 1528545 - RNA, 12 nt, Pseudomonas aeruginosa PA01
cgcgcgcggcca

SEQ ID NO: 1528546 - RNA, 13 nt, Pseudomonas aeruginosa PA01
cgcgcgcgcugcc

SEQ ID NO: 1528547 - RNA, 22 nt, Pseudomonas aeruginosa PA01
cgcgccuuuuucauuucgcgcg

SEQ ID NO: 1528548 - RNA, 17 nt, Pseudomonas aeruginosa PA01
cgcgcgaccgcggcgcu

SEQ ID NO: 1528549 - RNA, 22 nt, Pseudomonas aeruginosa PA01
cgcgcgacgagaaaaagcccgg

SEQ ID NO: 1528550 - RNA, 14 nt, Pseudomonas aeruginosa PA01
cgcgccuucugcac

SEQ ID NO: 1528551 - RNA, 14 nt, Pseudomonas aeruginosa PA01
cgcgccuucagccc

SEQ ID NO: 1528552 - RNA, 15 nt, Pseudomonas aeruginosa PA01
cgcgccuuccagccc

SEQ ID NO: 1528553 - RNA, 17 nt, Pseudomonas aeruginosa PA01
cgcgccugcucuucggc

SEQ ID NO: 1528554 - RNA, 18 nt, Pseudomonas aeruginosa PA01
cgcgccuggaucagcgcc

SEQ ID NO: 1528555 - RNA, 12 nt, Pseudomonas aeruginosa PA01
cgcgcggcuggc

SEQ ID NO: 1528556 - RNA, 20 nt, Pseudomonas aeruginosa PA01
cgcgcggggucuggccggcg

SEQ ID NO: 1528557 - RNA, 20 nt, Pseudomonas aeruginosa PA01
cgcgcggguuuccgugcgcu

SEQ ID NO: 1528558 - RNA, 23 nt, Pseudomonas aeruginosa PA01
cgcgcggguuuccgugcgcugcg

SEQ ID NO: 1528559 - RNA, 15 nt, Pseudomonas aeruginosa PA01
cgcgcguccagccgg

SEQ ID NO: 1528560 - RNA, 15 nt, Pseudomonas aeruginosa PA01
cgcgcguaggcuugg

SEQ ID NO: 1528561 - RNA, 15 nt, Pseudomonas aeruginosa PA01
cgcgcggucgagcag

SEQ ID NO: 1528562 - RNA, 18 nt, Pseudomonas aeruginosa PA01
cgcgcggucgagcagcgc

SEQ ID NO: 1528563 - RNA, 19 nt, Pseudomonas aeruginosa PA01
cgcgcggucgagcagcgcc

SEQ ID NO: 1528564 - RNA, 21 nt, Pseudomonas aeruginosa PA01
cgcgcggcggguagagucgcu

SEQ ID NO: 1528565 - RNA, 18 nt, Pseudomonas aeruginosa PA01
cgcgcggcuugccggcgc

SEQ ID NO: 1528566 - RNA, 15 nt, Pseudomonas aeruginosa PA01
cgcgcggggcgcgcu

SEQ ID NO: 1528567 - RNA, 14 nt, Pseudomonas aeruginosa PA01
cgcgcgggccggcg

SEQ ID NO: 1528568 - RNA, 15 nt, Pseudomonas aeruginosa PA01
cgcgcgggccggcga

SEQ ID NO: 1528569 - RNA, 22 nt, Pseudomonas aeruginosa PA01
cgcgcggcauagcgcagccgcu

SEQ ID NO: 1528570 - RNA, 13 nt, Pseudomonas aeruginosa PA01
cgcgcggcacagg

SEQ ID NO: 1528571 - RNA, 15 nt, Pseudomonas aeruginosa PA01
cgcgcggauccccuc

SEQ ID NO: 1528572 - RNA, 15 nt, Pseudomonas aeruginosa PA01
cgcgcggcccuucga

SEQ ID NO: 1528573 - RNA, 17 nt, Pseudomonas aeruginosa PA01
cgcgcgcuggcgcagcg

SEQ ID NO: 1528574 - RNA, 18 nt, Pseudomonas aeruginosa PA01
cgcgcgcucucgccggcc

SEQ ID NO: 1528575 - RNA, 17 nt, Pseudomonas aeruginosa PA01
cgcgcucuucgccgcgg

SEQ ID NO: 1528576 - RNA, 13 nt, Pseudomonas aeruginosa PA01
cgcgcugcccggc

SEQ ID NO: 1528577 - RNA, 16 nt, Pseudomonas aeruginosa PA01
cgcgcucgcugucgcu

SEQ ID NO: 1528578 - RNA, 20 nt, Pseudomonas aeruginosa PA01
cgcgcucgcugucgcucagc

SEQ ID NO: 1528579 - RNA, 22 nt, Pseudomonas aeruginosa PA01
cgcgcucgcugucgcucagcgg

SEQ ID NO: 1528580 - RNA, 14 nt, Pseudomonas aeruginosa PA01
cgcgcucgcggaac

SEQ ID NO: 1528581 - RNA, 16 nt, Pseudomonas aeruginosa PA01
cgcgcucggcggccuc

SEQ ID NO: 1528582 - RNA, 16 nt, Pseudomonas aeruginosa PA01
cgcgcucgggaucgcc

SEQ ID NO: 1528583 - RNA, 17 nt, Pseudomonas aeruginosa PA01
cgcgcucggccaguucg

SEQ ID NO: 1528584 - RNA, 14 nt, Pseudomonas aeruginosa PA01
cgcgcucucgccgg

SEQ ID NO: 1528585 - RNA, 21 nt, Pseudomonas aeruginosa PA01
cgcgcucgguccagaucgcca

SEQ ID NO: 1528586 - RNA, 12 nt, Pseudomonas aeruginosa PA01
cgcgcucuggcc

SEQ ID NO: 1528587 - RNA, 12 nt, Pseudomonas aeruginosa PA01
cgcgcuccucga

SEQ ID NO: 1528588 - RNA, 13 nt, Pseudomonas aeruginosa PA01
cgcgcuccaggcc

SEQ ID NO: 1528589 - RNA, 18 nt, Pseudomonas aeruginosa PA01
cgcgcuccaggcccggca

SEQ ID NO: 1528590 - RNA, 13 nt, Pseudomonas aeruginosa PA01
cgcgcucaggcgc

SEQ ID NO: 1528591 - RNA, 16 nt, Pseudomonas aeruginosa PA01
cgcgcucaggcgcagc

SEQ ID NO: 1528592 - RNA, 20 nt, Pseudomonas aeruginosa PA01
cgcgcucaggcgcagcgucc

SEQ ID NO: 1528593 - RNA, 20 nt, Pseudomonas aeruginosa PA01
cgcggaaucgcguagcgccc

SEQ ID NO: 1528594 - RNA, 16 nt, Pseudomonas aeruginosa PA01
cgcggaauggcgcgca

SEQ ID NO: 1528595 - RNA, 15 nt, Pseudomonas aeruginosa PA01
cgcggaacuucgcau

SEQ ID NO: 1528596 - RNA, 16 nt, Pseudomonas aeruginosa PA01
cgcggaagucggcggg

SEQ ID NO: 1528597 - RNA, 19 nt, Pseudomonas aeruginosa PA01
cgcgcuuguccuccagcug

SEQ ID NO: 1528598 - RNA, 20 nt, Pseudomonas aeruginosa PA01
cgcgcuuguccuccagcugc

SEQ ID NO: 1528599 - RNA, 16 nt, Pseudomonas aeruginosa PA01
cgcgcuuccaggcacg

SEQ ID NO: 1528600 - RNA, 14 nt, Pseudomonas aeruginosa PA01
cgcgcugcggcagg

SEQ ID NO: 1528601 - RNA, 15 nt, Pseudomonas aeruginosa PA01
cgcgcuggaccuggc

SEQ ID NO: 1528602 - RNA, 23 nt, Pseudomonas aeruginosa PA01
cgcgcuggaguaucgcccuggcc

SEQ ID NO: 1528603 - RNA, 17 nt, Pseudomonas aeruginosa PA01
cgcgcuggaugcccucc

SEQ ID NO: 1528604 - RNA, 14 nt, Pseudomonas aeruginosa PA01
cgcgcuggcgcagc

SEQ ID NO: 1528605 - RNA, 21 nt, Pseudomonas aeruginosa PA01
cgcgcuggaccauggccggcg

SEQ ID NO: 1528606 - RNA, 23 nt, Pseudomonas aeruginosa PA01
cgcgcugcgugcgccgcucgcgc

SEQ ID NO: 1528607 - RNA, 17 nt, Pseudomonas aeruginosa PA01
cgcgcuguugccgcgcu

SEQ ID NO: 1528608 - RNA, 23 nt, Pseudomonas aeruginosa PA01
cgcgcuggucguucucgcgcauc

SEQ ID NO: 1528609 - RNA, 14 nt, Pseudomonas aeruginosa PA01
cgcgcuguagccgg

SEQ ID NO: 1528610 - RNA, 17 nt, Pseudomonas aeruginosa PA01
cgcgcuguagccggcgc

SEQ ID NO: 1528611 - RNA, 16 nt, Pseudomonas aeruginosa PA01
cgcggaccgggcggcg

SEQ ID NO: 1528612 - RNA, 13 nt, Pseudomonas aeruginosa PA01
cgcggacccgcgc

SEQ ID NO: 1528613 - RNA, 21 nt, Pseudomonas aeruginosa PA01
cgcggacccgcgccggcagcu

SEQ ID NO: 1528614 - RNA, 17 nt, Pseudomonas aeruginosa PA01
cgcggaccucgggcagc

SEQ ID NO: 1528615 - RNA, 23 nt, Pseudomonas aeruginosa PA01
cgcggaccucugcguucugcugc

SEQ ID NO: 1528616 - RNA, 18 nt, Pseudomonas aeruginosa PA01
cgcggaccuugucgccgg

SEQ ID NO: 1528617 - RNA, 19 nt, Pseudomonas aeruginosa PA01
cgcggacgauggucgccgc

SEQ ID NO: 1528618 - RNA, 18 nt, Pseudomonas aeruginosa PA01
cgcggaccuucgacggca

SEQ ID NO: 1528619 - RNA, 12 nt, Pseudomonas aeruginosa PA01
cgcggacgccga

SEQ ID NO: 1528620 - RNA, 14 nt, Pseudomonas aeruginosa PA01
cgcggacggccugc

SEQ ID NO: 1528621 - RNA, 15 nt, Pseudomonas aeruginosa PA01
cgcggacggccugcg

SEQ ID NO: 1528622 - RNA, 13 nt, Pseudomonas aeruginosa PA01
cgcggagaacagu

SEQ ID NO: 1528623 - RNA, 16 nt, Pseudomonas aeruginosa PA01
cgcggagauccccucc

SEQ ID NO: 1528624 - RNA, 20 nt, Pseudomonas aeruginosa PA01
cgcggagauccccuccucca

SEQ ID NO: 1528625 - RNA, 22 nt, Pseudomonas aeruginosa PA01
cgcggagauccccuccuccagc

SEQ ID NO: 1528626 - RNA, 20 nt, Pseudomonas aeruginosa PA01
cgcggauaucgcuggcgccc

SEQ ID NO: 1528627 - RNA, 18 nt, Pseudomonas aeruginosa PA01
cgcggaucaacgggcccu

SEQ ID NO: 1528628 - RNA, 18 nt, Pseudomonas aeruginosa PA01
cgcggcaacgucaggcug

SEQ ID NO: 1528629 - RNA, 21 nt, Pseudomonas aeruginosa PA01
cgcggauccccucccgcgcca

SEQ ID NO: 1528630 - RNA, 22 nt, Pseudomonas aeruginosa PA01
cgcggcacagcguggccagcgc

SEQ ID NO: 1528631 - RNA, 13 nt, Pseudomonas aeruginosa PA01
cgcggcagcagcc

SEQ ID NO: 1528632 - RNA, 19 nt, Pseudomonas aeruginosa PA01
cgcggcagcagccaaccgu

SEQ ID NO: 1528633 - RNA, 15 nt, Pseudomonas aeruginosa PA01
cgcggcagcaggcgg

SEQ ID NO: 1528634 - RNA, 17 nt, Pseudomonas aeruginosa PA01
cgcggcagcaggcgggc

SEQ ID NO: 1528635 - RNA, 13 nt, Pseudomonas aeruginosa PA01
cgcgggacgcggc

SEQ ID NO: 1528636 - RNA, 18 nt, Pseudomonas aeruginosa PA01
cgcgggaggccgccucga

SEQ ID NO: 1528637 - RNA, 22 nt, Pseudomonas aeruginosa PA01
cgcggcuuucuuccagcacgcg

SEQ ID NO: 1528638 - RNA, 23 nt, Pseudomonas aeruginosa PA01
cgcgggcggccucgauggcggca

SEQ ID NO: 1528639 - RNA, 15 nt, Pseudomonas aeruginosa PA01
cgcgggcgcgcgcca

SEQ ID NO: 1528640 - RNA, 19 nt, Pseudomonas aeruginosa PA01
cgcgggcgcgcgccaccgc

SEQ ID NO: 1528641 - RNA, 12 nt, Pseudomonas aeruginosa PA01
cgcgggcgcgca

SEQ ID NO: 1528642 - RNA, 13 nt, Pseudomonas aeruginosa PA01
cgcgggcgcgcag

SEQ ID NO: 1528643 - RNA, 18 nt, Pseudomonas aeruginosa PA01
cgcgggauaaacggcgga

SEQ ID NO: 1528644 - RNA, 19 nt, Pseudomonas aeruginosa PA01
cgcggcguaaucgcgccag

SEQ ID NO: 1528645 - RNA, 17 nt, Pseudomonas aeruginosa PA01
cgcggcguaccagccgc

SEQ ID NO: 1528646 - RNA, 18 nt, Pseudomonas aeruginosa PA01
cgcggcguaccagccgcg

SEQ ID NO: 1528647 - RNA, 14 nt, Pseudomonas aeruginosa PA01
cgcggcguggcgga

SEQ ID NO: 1528648 - RNA, 22 nt, Pseudomonas aeruginosa PA01
cgcggcgucggcgaagccugcg

SEQ ID NO: 1528649 - RNA, 17 nt, Pseudomonas aeruginosa PA01
cgcggcguaggcgcgcc

SEQ ID NO: 1528650 - RNA, 18 nt, Pseudomonas aeruginosa PA01
cgcggcguaggcgcgcca

SEQ ID NO: 1528651 - RNA, 17 nt, Pseudomonas aeruginosa PA01
cgcggcuacccucuccc

SEQ ID NO: 1528652 - RNA, 18 nt, Pseudomonas aeruginosa PA01
cgcggcuacccucucccc

SEQ ID NO: 1528653 - RNA, 20 nt, Pseudomonas aeruginosa PA01
cgcggcguugucggccagca

SEQ ID NO: 1528654 - RNA, 15 nt, Pseudomonas aeruginosa PA01
cgcggcggccgccuc

SEQ ID NO: 1528655 - RNA, 18 nt, Pseudomonas aeruginosa PA01
cgcggcggaugccggcgc

SEQ ID NO: 1528656 - RNA, 12 nt, Pseudomonas aeruginosa PA01
cgcggcggccuc

SEQ ID NO: 1528657 - RNA, 17 nt, Pseudomonas aeruginosa PA01
cgcggcggcggccagca

SEQ ID NO: 1528658 - RNA, 16 nt, Pseudomonas aeruginosa PA01
cgcggcggcggccgca

SEQ ID NO: 1528659 - RNA, 22 nt, Pseudomonas aeruginosa PA01
cgcggcgaacaucauccacagc

SEQ ID NO: 1528660 - RNA, 22 nt, Pseudomonas aeruginosa PA01
cgcggcgacgaucacccccagc

SEQ ID NO: 1528661 - RNA, 13 nt, Pseudomonas aeruginosa PA01
cgcggcgaccagc

SEQ ID NO: 1528662 - RNA, 19 nt, Pseudomonas aeruginosa PA01
cgcggcgagcagcggcgcu

SEQ ID NO: 1528663 - RNA, 23 nt, Pseudomonas aeruginosa PA01
cgcggcgagcaucucggccaggc

SEQ ID NO: 1528664 - RNA, 15 nt, Pseudomonas aeruginosa PA01
cgcggcgacggcucu

SEQ ID NO: 1528665 - RNA, 14 nt, Pseudomonas aeruginosa PA01
cgcggccagcagca

SEQ ID NO: 1528666 - RNA, 20 nt, Pseudomonas aeruginosa PA01
cgcggccagcccccucgccc

SEQ ID NO: 1528667 - RNA, 14 nt, Pseudomonas aeruginosa PA01
cgcggccagccgcu

SEQ ID NO: 1528668 - RNA, 19 nt, Pseudomonas aeruginosa PA01
cgcggcaggaaauccgccg

SEQ ID NO: 1528669 - RNA, 15 nt, Pseudomonas aeruginosa PA01
cgcggccuucagcgg

SEQ ID NO: 1528670 - RNA, 22 nt, Pseudomonas aeruginosa PA01
cgcggccuucucgucgccgccc

SEQ ID NO: 1528671 - RNA, 21 nt, Pseudomonas aeruginosa PA01
cgcggccagcgcggccgccgc

SEQ ID NO: 1528672 - RNA, 16 nt, Pseudomonas aeruginosa PA01
cguccacuccggcagc

SEQ ID NO: 1528673 - RNA, 22 nt, Pseudomonas aeruginosa PA01
cguccacuccggcagcacccgc

SEQ ID NO: 1528674 - RNA, 14 nt, Pseudomonas aeruginosa PA01
cguccaccuccacc

SEQ ID NO: 1528675 - RNA, 14 nt, Pseudomonas aeruginosa PA01
cguccaccuggcgg

SEQ ID NO: 1528676 - RNA, 18 nt, Pseudomonas aeruginosa PA01
cguccaccuggcggcuga

SEQ ID NO: 1528677 - RNA, 21 nt, Pseudomonas aeruginosa PA01
cguccagcgccacuuccaggu

SEQ ID NO: 1528678 - RNA, 19 nt, Pseudomonas aeruginosa PA01
cguccagcgggcccauggc

SEQ ID NO: 1528679 - RNA, 20 nt, Pseudomonas aeruginosa PA01
cguccagcgcuugaacgcgc

SEQ ID NO: 1528680 - RNA, 14 nt, Pseudomonas aeruginosa PA01
cguccagccgccgc

SEQ ID NO: 1528681 - RNA, 16 nt, Pseudomonas aeruginosa PA01
cguccagccggcgcuu

SEQ ID NO: 1528682 - RNA, 19 nt, Pseudomonas aeruginosa PA01
cguccaggguuggaagaaa

SEQ ID NO: 1528683 - RNA, 16 nt, Pseudomonas aeruginosa PA01
cguccagguagaaaug

SEQ ID NO: 1528684 - RNA, 12 nt, Pseudomonas aeruginosa PA01
cguccagcucca

SEQ ID NO: 1528685 - RNA, 14 nt, Pseudomonas aeruginosa PA01
cgucccacaggccg

SEQ ID NO: 1528686 - RNA, 22 nt, Pseudomonas aeruginosa PA01
cgucccaugaccgucagccagg

SEQ ID NO: 1528687 - RNA, 22 nt, Pseudomonas aeruginosa PA01
cgucccagucggcguccgccuc

SEQ ID NO: 1528688 - RNA, 14 nt, Pseudomonas aeruginosa PA01
cgucccguuccggc

SEQ ID NO: 1528689 - RNA, 16 nt, Pseudomonas aeruginosa PA01
cgucccggcgccgccc

SEQ ID NO: 1528690 - RNA, 18 nt, Pseudomonas aeruginosa PA01
cgucccggcgccgcccuu

SEQ ID NO: 1528691 - RNA, 17 nt, Pseudomonas aeruginosa PA01
cgucccggaguuccagc

SEQ ID NO: 1528692 - RNA, 16 nt, Pseudomonas aeruginosa PA01
cgucccgcaguagcuc

SEQ ID NO: 1528693 - RNA, 15 nt, Pseudomonas aeruginosa PA01
cgucccgcuccagcc

SEQ ID NO: 1528694 - RNA, 23 nt, Pseudomonas aeruginosa PA01
cgucccugggcgcaggggcgcgc

SEQ ID NO: 1528695 - RNA, 20 nt, Pseudomonas aeruginosa PA01
cgucccugcccgcgccucgc

SEQ ID NO: 1528696 - RNA, 21 nt, Pseudomonas aeruginosa PA01
cguccgcagcacagccccagc

SEQ ID NO: 1528697 - RNA, 19 nt, Pseudomonas aeruginosa PA01
cguccgcaguucgccccgc

SEQ ID NO: 1528698 - RNA, 22 nt, Pseudomonas aeruginosa PA01
cguccgcaguucgccccgccgc

SEQ ID NO: 1528699 - RNA, 22 nt, Pseudomonas aeruginosa PA01
cguccgcccaguucgccggcca

SEQ ID NO: 1528700 - RNA, 18 nt, Pseudomonas aeruginosa PA01
cguccgcggccugcucgg

SEQ ID NO: 1528701 - RNA, 14 nt, Pseudomonas aeruginosa PA01
cguccgggcacgca

SEQ ID NO: 1528702 - RNA, 17 nt, Pseudomonas aeruginosa PA01
cguccggcgucccgcag

SEQ ID NO: 1528703 - RNA, 22 nt, Pseudomonas aeruginosa PA01
cguccgguaggagcgagagcgc

SEQ ID NO: 1528704 - RNA, 20 nt, Pseudomonas aeruginosa PA01
cguccggucgcaccgccagc

SEQ ID NO: 1528705 - RNA, 19 nt, Pseudomonas aeruginosa PA01
cguccguaaugcaacccgc

SEQ ID NO: 1528706 - RNA, 22 nt, Pseudomonas aeruginosa PA01
cguccguaaugcaacccgccgc

SEQ ID NO: 1528707 - RNA, 23 nt, Pseudomonas aeruginosa PA01
cguccguaaugcaacccgccgcu

SEQ ID NO: 1528708 - RNA, 15 nt, Pseudomonas aeruginosa PA01
cguccggccagccug

SEQ ID NO: 1528709 - RNA, 15 nt, Pseudomonas aeruginosa PA01
cguccggccgcccga

SEQ ID NO: 1528710 - RNA, 15 nt, Pseudomonas aeruginosa PA01
cguccggcagggccu

SEQ ID NO: 1528711 - RNA, 23 nt, Pseudomonas aeruginosa PA01
cguccuucuuguauaccagcggc

SEQ ID NO: 1528712 - RNA, 16 nt, Pseudomonas aeruginosa PA01
cguccugcucccuggc

SEQ ID NO: 1528713 - RNA, 14 nt, Pseudomonas aeruginosa PA01
cguccugcgcggcg

SEQ ID NO: 1528714 - RNA, 13 nt, Pseudomonas aeruginosa PA01
cguccguucaggc

SEQ ID NO: 1528715 - RNA, 23 nt, Pseudomonas aeruginosa PA01
cguccuccuggaggacgcgggcu

SEQ ID NO: 1528716 - RNA, 12 nt, Pseudomonas aeruginosa PA01
cguccuccaccg

SEQ ID NO: 1528717 - RNA, 19 nt, Pseudomonas aeruginosa PA01
cguccuccaccgcuccggc

SEQ ID NO: 1528718 - RNA, 12 nt, Pseudomonas aeruginosa PA01
cguccuccagca

SEQ ID NO: 1528719 - RNA, 12 nt, Pseudomonas aeruginosa PA01
cguccucccagu

SEQ ID NO: 1528720 - RNA, 16 nt, Pseudomonas aeruginosa PA01
cguccucguggcgcgc

SEQ ID NO: 1528721 - RNA, 19 nt, Pseudomonas aeruginosa PA01
cguccucgaugcccgccuc

SEQ ID NO: 1528722 - RNA, 21 nt, Pseudomonas aeruginosa PA01
cguccucgcgacaccgggccu

SEQ ID NO: 1528723 - RNA, 14 nt, Pseudomonas aeruginosa PA01
cguccucgcgccgc

SEQ ID NO: 1528724 - RNA, 14 nt, Pseudomonas aeruginosa PA01
cgucgaccaccgcg

SEQ ID NO: 1528725 - RNA, 16 nt, Pseudomonas aeruginosa PA01
cgucgaccaucaccag

SEQ ID NO: 1528726 - RNA, 19 nt, Pseudomonas aeruginosa PA01
cgucgaauuggacagcagg

SEQ ID NO: 1528727 - RNA, 16 nt, Pseudomonas aeruginosa PA01
cgucgaagcgcagcag

SEQ ID NO: 1528728 - RNA, 20 nt, Pseudomonas aeruginosa PA01
cgucgaaggcggcgcggcgg

SEQ ID NO: 1528729 - RNA, 18 nt, Pseudomonas aeruginosa PA01
cgucgaagggcacgccgc

SEQ ID NO: 1528730 - RNA, 21 nt, Pseudomonas aeruginosa PA01
cgucgaacagguggcuuucca

SEQ ID NO: 1528731 - RNA, 19 nt, Pseudomonas aeruginosa PA01
cgucgaaccagggacgccc

SEQ ID NO: 1528732 - RNA, 22 nt, Pseudomonas aeruginosa PA01
cgucgaacgacucuucgaaguu

SEQ ID NO: 1528733 - RNA, 14 nt, Pseudomonas aeruginosa PA01
cguccugcccuccu

SEQ ID NO: 1528734 - RNA, 14 nt, Pseudomonas aeruginosa PA01
cgucggccaccagg

SEQ ID NO: 1528735 - RNA, 17 nt, Pseudomonas aeruginosa PA01
cgucggacuugcggccc

SEQ ID NO: 1528736 - RNA, 22 nt, Pseudomonas aeruginosa PA01
cgucggacuugcggcccaccac

SEQ ID NO: 1528737 - RNA, 20 nt, Pseudomonas aeruginosa PA01
cgucggagauagccuccucc

SEQ ID NO: 1528738 - RNA, 16 nt, Pseudomonas aeruginosa PA01
cgucggccgcucggcc

SEQ ID NO: 1528739 - RNA, 18 nt, Pseudomonas aeruginosa PA01
cgucggccuggcgcagcg

SEQ ID NO: 1528740 - RNA, 21 nt, Pseudomonas aeruginosa PA01
cgucggccugcucgaacggcg

SEQ ID NO: 1528741 - RNA, 15 nt, Pseudomonas aeruginosa PA01
cgucggcgccuuccu

SEQ ID NO: 1528742 - RNA, 19 nt, Pseudomonas aeruginosa PA01
cgucggcgcggccggcgcc

SEQ ID NO: 1528743 - RNA, 21 nt, Pseudomonas aeruginosa PA01
cgucggcgcggccggcgccgc

SEQ ID NO: 1528744 - RNA, 16 nt, Pseudomonas aeruginosa PA01
cgucggcgaucgccag

SEQ ID NO: 1528745 - RNA, 21 nt, Pseudomonas aeruginosa PA01
cgucgcgaagaccggccggcu

SEQ ID NO: 1528746 - RNA, 12 nt, Pseudomonas aeruginosa PA01
cgucgcgcgccc

SEQ ID NO: 1528747 - RNA, 21 nt, Pseudomonas aeruginosa PA01
cgucgcgccgcccggcucgcc

SEQ ID NO: 1528748 - RNA, 15 nt, Pseudomonas aeruginosa PA01
cgucgcgcaccaccc

SEQ ID NO: 1528749 - RNA, 16 nt, Pseudomonas aeruginosa PA01
cgucgcgccagcaccg

SEQ ID NO: 1528750 - RNA, 18 nt, Pseudomonas aeruginosa PA01
cgucgcgccagcaccgug

SEQ ID NO: 1528751 - RNA, 14 nt, Pseudomonas aeruginosa PA01
cgucgcgcagcucc

SEQ ID NO: 1528752 - RNA, 19 nt, Pseudomonas aeruginosa PA01
cgucgcgcagcuccucggc

SEQ ID NO: 1528753 - RNA, 21 nt, Pseudomonas aeruginosa PA01
cgucgcgauagacgccggcga

SEQ ID NO: 1528754 - RNA, 19 nt, Pseudomonas aeruginosa PA01
cgucgcgcguccagccggu

SEQ ID NO: 1528755 - RNA, 21 nt, Pseudomonas aeruginosa PA01
cgucgcgcuugagcagggugu

SEQ ID NO: 1528756 - RNA, 22 nt, Pseudomonas aeruginosa PA01
cgucgcgguacagcucguccuu

SEQ ID NO: 1528757 - RNA, 19 nt, Pseudomonas aeruginosa PA01
cgucgcucauccgcgaggc

SEQ ID NO: 1528758 - RNA, 16 nt, Pseudomonas aeruginosa PA01
cgucgcugcgcggguc

SEQ ID NO: 1528759 - RNA, 12 nt, Pseudomonas aeruginosa PA01
cgucgaccucga

SEQ ID NO: 1528760 - RNA, 23 nt, Pseudomonas aeruginosa PA01
cgucgagcaucugccgggcgcgc

SEQ ID NO: 1528761 - RNA, 21 nt, Pseudomonas aeruginosa PA01
cgucgagaugcugcgggcgcc

SEQ ID NO: 1528762 - RNA, 12 nt, Pseudomonas aeruginosa PA01
cgucgagcacca

SEQ ID NO: 1528763 - RNA, 14 nt, Pseudomonas aeruginosa PA01
cgucgagcagcgcg

SEQ ID NO: 1528764 - RNA, 19 nt, Pseudomonas aeruginosa PA01
cgucgagcagcgcgcggcu

SEQ ID NO: 1528765 - RNA, 22 nt, Pseudomonas aeruginosa PA01
cgucgaggauguacagggucuu

SEQ ID NO: 1528766 - RNA, 18 nt, Pseudomonas aeruginosa PA01
cgucgaucaggcgggcgu

SEQ ID NO: 1528767 - RNA, 17 nt, Pseudomonas aeruginosa PA01
cgucgauauccagcggc

SEQ ID NO: 1528768 - RNA, 18 nt, Pseudomonas aeruginosa PA01
cgucgauauccagcggca

SEQ ID NO: 1528769 - RNA, 21 nt, Pseudomonas aeruginosa PA01
cgucgauauccagcggcagcc

SEQ ID NO: 1528770 - RNA, 18 nt, Pseudomonas aeruginosa PA01
cgucgagucgcgcagcca

SEQ ID NO: 1528771 - RNA, 23 nt, Pseudomonas aeruginosa PA01
cgucgagguagaacaggcugccg

SEQ ID NO: 1528772 - RNA, 22 nt, Pseudomonas aeruginosa PA01
cgucgagguagucggugaagcg

SEQ ID NO: 1528773 - RNA, 20 nt, Pseudomonas aeruginosa PA01
cgucgagggcaaaggcgcgc

SEQ ID NO: 1528774 - RNA, 21 nt, Pseudomonas aeruginosa PA01
cgucgagggcaaaggcgcgca

SEQ ID NO: 1528775 - RNA, 17 nt, Pseudomonas aeruginosa PA01
cgucgagggccuugucg

SEQ ID NO: 1528776 - RNA, 16 nt, Pseudomonas aeruginosa PA01
cgucgagccagcccag

SEQ ID NO: 1528777 - RNA, 16 nt, Pseudomonas aeruginosa PA01
cgucgagcuggcgcag

SEQ ID NO: 1528778 - RNA, 14 nt, Pseudomonas aeruginosa PA01
cgucgccaagcccg

SEQ ID NO: 1528779 - RNA, 19 nt, Pseudomonas aeruginosa PA01
cgucgcaccugggacuccc

SEQ ID NO: 1528780 - RNA, 13 nt, Pseudomonas aeruginosa PA01
cgucgcaggccug

SEQ ID NO: 1528781 - RNA, 15 nt, Pseudomonas aeruginosa PA01
cgucgcaggccuggu

SEQ ID NO: 1528782 - RNA, 20 nt, Pseudomonas aeruginosa PA01
cgucgaugccuucggcggcc

SEQ ID NO: 1528783 - RNA, 18 nt, Pseudomonas aeruginosa PA01
cgucgaugcgccucagcg

SEQ ID NO: 1528784 - RNA, 21 nt, Pseudomonas aeruginosa PA01
cgucgccgacuucggcaagca

SEQ ID NO: 1528785 - RNA, 14 nt, Pseudomonas aeruginosa PA01
cgucgccgcccggc

SEQ ID NO: 1528786 - RNA, 18 nt, Pseudomonas aeruginosa PA01
cgucgccgcccggcagcg

SEQ ID NO: 1528787 - RNA, 14 nt, Pseudomonas aeruginosa PA01
cgucgccggagggg

SEQ ID NO: 1528788 - RNA, 14 nt, Pseudomonas aeruginosa PA01
cgucgccccagccu

SEQ ID NO: 1528789 - RNA, 15 nt, Pseudomonas aeruginosa PA01
cgucgccccacagcg

SEQ ID NO: 1528790 - RNA, 20 nt, Pseudomonas aeruginosa PA01
cgucgcccuggugcacggcg

SEQ ID NO: 1528791 - RNA, 20 nt, Pseudomonas aeruginosa PA01
cgucgccgaacuccgagcag

SEQ ID NO: 1528792 - RNA, 16 nt, Pseudomonas aeruginosa PA01
cgugccgggccggcca

SEQ ID NO: 1528793 - RNA, 17 nt, Pseudomonas aeruginosa PA01
cgugccggucgcgcagc

SEQ ID NO: 1528794 - RNA, 14 nt, Pseudomonas aeruginosa PA01
cgugccuccagccu

SEQ ID NO: 1528795 - RNA, 15 nt, Pseudomonas aeruginosa PA01
cgugccuccagccuc

SEQ ID NO: 1528796 - RNA, 13 nt, Pseudomonas aeruginosa PA01
cgugccgccaggc

SEQ ID NO: 1528797 - RNA, 16 nt, Pseudomonas aeruginosa PA01
cgugccaggcggcagc

SEQ ID NO: 1528798 - RNA, 20 nt, Pseudomonas aeruginosa PA01
cgugccaggcggcagccgcg

SEQ ID NO: 1528799 - RNA, 20 nt, Pseudomonas aeruginosa PA01
cgugccagggcuucccaggc

SEQ ID NO: 1528800 - RNA, 24 nt, Pseudomonas aeruginosa PA01
cgugccagggcuucccaggccagc

SEQ ID NO: 1528801 - RNA, 20 nt, Pseudomonas aeruginosa PA01
cgugccaucaggccgcggcc

SEQ ID NO: 1528802 - RNA, 17 nt, Pseudomonas aeruginosa PA01
cgugcccgccggcgcgc

SEQ ID NO: 1528803 - RNA, 20 nt, Pseudomonas aeruginosa PA01
cgugcaucaccggcagcagc

SEQ ID NO: 1528804 - RNA, 21 nt, Pseudomonas aeruginosa PA01
cgugcaucaccggcagcagcg

SEQ ID NO: 1528805 - RNA, 22 nt, Pseudomonas aeruginosa PA01
cgugcaggguauuuuccagcag

SEQ ID NO: 1528806 - RNA, 20 nt, Pseudomonas aeruginosa PA01
cgugcaggaucaccugcuuc

SEQ ID NO: 1528807 - RNA, 23 nt, Pseudomonas aeruginosa PA01
cgugcaguacuuggccagcagca

SEQ ID NO: 1528808 - RNA, 15 nt, Pseudomonas aeruginosa PA01
cgugcagcagcgccu

SEQ ID NO: 1528809 - RNA, 15 nt, Pseudomonas aeruginosa PA01
cgugcagcggcagcg

SEQ ID NO: 1528810 - RNA, 13 nt, Pseudomonas aeruginosa PA01
cgugcaccagcag

SEQ ID NO: 1528811 - RNA, 15 nt, Pseudomonas aeruginosa PA01
cgugcaccgaggcgc

SEQ ID NO: 1528812 - RNA, 18 nt, Pseudomonas aeruginosa PA01
cgugcaccgaggcgcgcc

SEQ ID NO: 1528813 - RNA, 19 nt, Pseudomonas aeruginosa PA01
cgugcagcaagccgcagcg

SEQ ID NO: 1528814 - RNA, 20 nt, Pseudomonas aeruginosa PA01
cgugcagcacauagaggguc

SEQ ID NO: 1528815 - RNA, 16 nt, Pseudomonas aeruginosa PA01
cgugaccagcauggcg

SEQ ID NO: 1528816 - RNA, 14 nt, Pseudomonas aeruginosa PA01
cgugaacgcggcga

SEQ ID NO: 1528817 - RNA, 21 nt, Pseudomonas aeruginosa PA01
cgugaagccgccgcccagcag

SEQ ID NO: 1528818 - RNA, 19 nt, Pseudomonas aeruginosa PA01
cgugaagcuggagcagcag

SEQ ID NO: 1528819 - RNA, 20 nt, Pseudomonas aeruginosa PA01
cgugaagcuggagcagcagc

SEQ ID NO: 1528820 - RNA, 12 nt, Pseudomonas aeruginosa PA01
cgugaugcccag

SEQ ID NO: 1528821 - RNA, 17 nt, Pseudomonas aeruginosa PA01
cgugaugcccagcggcg

SEQ ID NO: 1528822 - RNA, 21 nt, Pseudomonas aeruginosa PA01
cgugagcuuguccagggcgcc

SEQ ID NO: 1528823 - RNA, 16 nt, Pseudomonas aeruginosa PA01
cgugaggcgcgcgccg

SEQ ID NO: 1528824 - RNA, 17 nt, Pseudomonas aeruginosa PA01
cgugauacagcucgcug

SEQ ID NO: 1528825 - RNA, 15 nt, Pseudomonas aeruginosa PA01
cgucuccugccgccg

SEQ ID NO: 1528826 - RNA, 16 nt, Pseudomonas aeruginosa PA01
cgucgugcgccggccu

SEQ ID NO: 1528827 - RNA, 21 nt, Pseudomonas aeruginosa PA01
cgucguggaaguauugcucca

SEQ ID NO: 1528828 - RNA, 20 nt, Pseudomonas aeruginosa PA01
cgucguggauaggcggcgga

SEQ ID NO: 1528829 - RNA, 20 nt, Pseudomonas aeruginosa PA01
cgucguggccauagagccgc

SEQ ID NO: 1528830 - RNA, 14 nt, Pseudomonas aeruginosa PA01
cgucgucgcggcgc

SEQ ID NO: 1528831 - RNA, 22 nt, Pseudomonas aeruginosa PA01
cgucguccaccgaguggcgcag

SEQ ID NO: 1528832 - RNA, 22 nt, Pseudomonas aeruginosa PA01
cgucggcggggcgcaccgccuc

SEQ ID NO: 1528833 - RNA, 13 nt, Pseudomonas aeruginosa PA01
cgucggcugcgcu

SEQ ID NO: 1528834 - RNA, 16 nt, Pseudomonas aeruginosa PA01
cgucggcguugcugau

SEQ ID NO: 1528835 - RNA, 13 nt, Pseudomonas aeruginosa PA01
cgucggcuccgcu

SEQ ID NO: 1528836 - RNA, 17 nt, Pseudomonas aeruginosa PA01
cgucggggugccgccag

SEQ ID NO: 1528837 - RNA, 20 nt, Pseudomonas aeruginosa PA01
cgucgggcaguuccgccaga

SEQ ID NO: 1528838 - RNA, 22 nt, Pseudomonas aeruginosa PA01
cgucgggcagaguggcgcggcu

SEQ ID NO: 1528839 - RNA, 22 nt, Pseudomonas aeruginosa PA01
cgucggucggccaggacgccac

SEQ ID NO: 1528840 - RNA, 21 nt, Pseudomonas aeruginosa PA01
cgucggugaucgagacgccgu

SEQ ID NO: 1528841 - RNA, 21 nt, Pseudomonas aeruginosa PA01
cgucggugccgcccggcgcca

SEQ ID NO: 1528842 - RNA, 16 nt, Pseudomonas aeruginosa PA01
cgucuucgccgaugcg

SEQ ID NO: 1528843 - RNA, 18 nt, Pseudomonas aeruginosa PA01
cgucuuccuugcugaagc

SEQ ID NO: 1528844 - RNA, 22 nt, Pseudomonas aeruginosa PA01
cgucuucgauggcggccgccau

SEQ ID NO: 1528845 - RNA, 14 nt, Pseudomonas aeruginosa PA01
cgucuucggcggcg

SEQ ID NO: 1528846 - RNA, 14 nt, Pseudomonas aeruginosa PA01
cgucugccgcuggc

SEQ ID NO: 1528847 - RNA, 20 nt, Pseudomonas aeruginosa PA01
cgucugcucauucggccagc

SEQ ID NO: 1528848 - RNA, 18 nt, Pseudomonas aeruginosa PA01
cgucugugccgaggccgc

SEQ ID NO: 1528849 - RNA, 18 nt, Pseudomonas aeruginosa PA01
cgucugggugaccagcag

SEQ ID NO: 1528850 - RNA, 16 nt, Pseudomonas aeruginosa PA01
cgucucgcgacacgug

SEQ ID NO: 1528851 - RNA, 21 nt, Pseudomonas aeruginosa PA01
cgucugcagcuugcgcgccag

SEQ ID NO: 1528852 - RNA, 18 nt, Pseudomonas aeruginosa PA01
cuaaguagauaaaugccc

SEQ ID NO: 1528853 - RNA, 21 nt, Pseudomonas aeruginosa PA01
cuaaguagauaaaugcccggg

SEQ ID NO: 1528854 - RNA, 20 nt, Pseudomonas aeruginosa PA01
cuaaggaaaaacccggccca

SEQ ID NO: 1528855 - RNA, 18 nt, Pseudomonas aeruginosa PA01
cuaacaggucaacaagaa

SEQ ID NO: 1528856 - RNA, 19 nt, Pseudomonas aeruginosa PA01
cuaacaggucaacaagaau

SEQ ID NO: 1528857 - RNA, 12 nt, Pseudomonas aeruginosa PA01
cguuucgccggg

SEQ ID NO: 1528858 - RNA, 15 nt, Pseudomonas aeruginosa PA01
cguuucgccgggccu

SEQ ID NO: 1528859 - RNA, 18 nt, Pseudomonas aeruginosa PA01
cguugcugugcugcacca

SEQ ID NO: 1528860 - RNA, 17 nt, Pseudomonas aeruginosa PA01
cguuggaguaggggcag

SEQ ID NO: 1528861 - RNA, 16 nt, Pseudomonas aeruginosa PA01
cguuggccggcugcuc

SEQ ID NO: 1528862 - RNA, 15 nt, Pseudomonas aeruginosa PA01
cguuggcccagaccu

SEQ ID NO: 1528863 - RNA, 21 nt, Pseudomonas aeruginosa PA01
cguuggcccagaccuuggagc

SEQ ID NO: 1528864 - RNA, 23 nt, Pseudomonas aeruginosa PA01
cguuggcgcgaccgcccgccuca

SEQ ID NO: 1528865 - RNA, 21 nt, Pseudomonas aeruginosa PA01
cguucuugaccuucugcaccg

SEQ ID NO: 1528866 - RNA, 15 nt, Pseudomonas aeruginosa PA01
cguucgcuccagucg

SEQ ID NO: 1528867 - RNA, 13 nt, Pseudomonas aeruginosa PA01
cguuuccagcggc

SEQ ID NO: 1528868 - RNA, 15 nt, Pseudomonas aeruginosa PA01
cguuggcggugccgc

SEQ ID NO: 1528869 - RNA, 21 nt, Pseudomonas aeruginosa PA01
cguuggcggugccgcagacau

SEQ ID NO: 1528870 - RNA, 16 nt, Pseudomonas aeruginosa PA01
cguuggcgucgcgcac

SEQ ID NO: 1528871 - RNA, 14 nt, Pseudomonas aeruginosa PA01
cguuggucaacggc

SEQ ID NO: 1528872 - RNA, 14 nt, Pseudomonas aeruginosa PA01
cguuguugccgcgc

SEQ ID NO: 1528873 - RNA, 20 nt, Pseudomonas aeruginosa PA01
cguuguaggccaugaucauc

SEQ ID NO: 1528874 - RNA, 20 nt, Pseudomonas aeruginosa PA01
cguuguagaucugcaccgcc

SEQ ID NO: 1528875 - RNA, 15 nt, Pseudomonas aeruginosa PA01
cguuacgaaacggcg

SEQ ID NO: 1528876 - RNA, 19 nt, Pseudomonas aeruginosa PA01
cguucaccccgcccuuggc

SEQ ID NO: 1528877 - RNA, 14 nt, Pseudomonas aeruginosa PA01
cguucaccgcgcaa

SEQ ID NO: 1528878 - RNA, 20 nt, Pseudomonas aeruginosa PA01
cguucacgcgaccaccuucu

SEQ ID NO: 1528879 - RNA, 15 nt, Pseudomonas aeruginosa PA01
cguucagcgccucgc

SEQ ID NO: 1528880 - RNA, 21 nt, Pseudomonas aeruginosa PA01
cguuccacguccuccaggcuc

SEQ ID NO: 1528881 - RNA, 13 nt, Pseudomonas aeruginosa PA01
cguuccagcaccu

SEQ ID NO: 1528882 - RNA, 16 nt, Pseudomonas aeruginosa PA01
cguucgccgaaauagc

SEQ ID NO: 1528883 - RNA, 18 nt, Pseudomonas aeruginosa PA01
cguuccaugaacucuucc

SEQ ID NO: 1528884 - RNA, 16 nt, Pseudomonas aeruginosa PA01
cguuccaugauguguc

SEQ ID NO: 1528885 - RNA, 15 nt, Pseudomonas aeruginosa PA01
cguuccagggccugg

SEQ ID NO: 1528886 - RNA, 15 nt, Pseudomonas aeruginosa PA01
cguuccagcgcuggc

SEQ ID NO: 1528887 - RNA, 18 nt, Pseudomonas aeruginosa PA01
cguuccaguucggccgcg

SEQ ID NO: 1528888 - RNA, 21 nt, Pseudomonas aeruginosa PA01
cgugucgaggaaggccagcag

SEQ ID NO: 1528889 - RNA, 19 nt, Pseudomonas aeruginosa PA01
cgugucgagggcgaacagc

SEQ ID NO: 1528890 - RNA, 17 nt, Pseudomonas aeruginosa PA01
cgugugucgacaccugg

SEQ ID NO: 1528891 - RNA, 21 nt, Pseudomonas aeruginosa PA01
cguguggcgaaacuccagcag

SEQ ID NO: 1528892 - RNA, 19 nt, Pseudomonas aeruginosa PA01
cguggucuccgugcuggcc

SEQ ID NO: 1528893 - RNA, 15 nt, Pseudomonas aeruginosa PA01
cgugguugaggcgcu

SEQ ID NO: 1528894 - RNA, 17 nt, Pseudomonas aeruginosa PA01
cgugguugaggcgcucg

SEQ ID NO: 1528895 - RNA, 15 nt, Pseudomonas aeruginosa PA01
cgugcggccugcaac

SEQ ID NO: 1528896 - RNA, 22 nt, Pseudomonas aeruginosa PA01
cgugcgccgcgggucaccagcg

SEQ ID NO: 1528897 - RNA, 18 nt, Pseudomonas aeruginosa PA01
cgugcgccggccucuccg

SEQ ID NO: 1528898 - RNA, 13 nt, Pseudomonas aeruginosa PA01
cgugcgccgggcu

SEQ ID NO: 1528899 - RNA, 14 nt, Pseudomonas aeruginosa PA01
cgugcgcgcggccu

SEQ ID NO: 1528900 - RNA, 19 nt, Pseudomonas aeruginosa PA01
cgugcggaaaccgcggccg

SEQ ID NO: 1528901 - RNA, 20 nt, Pseudomonas aeruginosa PA01
cgugcgaacacaccgaccgc

SEQ ID NO: 1528902 - RNA, 20 nt, Pseudomonas aeruginosa PA01
cgugcgccccagcucagcag

SEQ ID NO: 1528903 - RNA, 19 nt, Pseudomonas aeruginosa PA01
cguggacauacaggcgcgc

SEQ ID NO: 1528904 - RNA, 20 nt, Pseudomonas aeruginosa PA01
cguggacauacaggcgcgcc

SEQ ID NO: 1528905 - RNA, 12 nt, Pseudomonas aeruginosa PA01
cguggacgccgg

SEQ ID NO: 1528906 - RNA, 20 nt, Pseudomonas aeruginosa PA01
cguggaaguauugcuccacc

SEQ ID NO: 1528907 - RNA, 21 nt, Pseudomonas aeruginosa PA01
cguggaaguauugcuccaccc

SEQ ID NO: 1528908 - RNA, 13 nt, Pseudomonas aeruginosa PA01
cguggaccaacag

SEQ ID NO: 1528909 - RNA, 18 nt, Pseudomonas aeruginosa PA01
cguggaccaacagccggc

SEQ ID NO: 1528910 - RNA, 21 nt, Pseudomonas aeruginosa PA01
cguggaccaacagccggcggg

SEQ ID NO: 1528911 - RNA, 21 nt, Pseudomonas aeruginosa PA01
cguggacccgugcgccccagc

SEQ ID NO: 1528912 - RNA, 17 nt, Pseudomonas aeruginosa PA01
cgugcuggccggcagca

SEQ ID NO: 1528913 - RNA, 21 nt, Pseudomonas aeruginosa PA01
cgugcugggucuccuccucca

SEQ ID NO: 1528914 - RNA, 14 nt, Pseudomonas aeruginosa PA01
cgugggccagccca

SEQ ID NO: 1528915 - RNA, 23 nt, Pseudomonas aeruginosa PA01
cgugggaucgccacgccggcgcu

SEQ ID NO: 1528916 - RNA, 15 nt, Pseudomonas aeruginosa PA01
cgugggcggccggcc

SEQ ID NO: 1528917 - RNA, 15 nt, Pseudomonas aeruginosa PA01
cgugggccggcgcgc

SEQ ID NO: 1528918 - RNA, 12 nt, Pseudomonas aeruginosa PA01
cgugggccugcu

SEQ ID NO: 1528919 - RNA, 13 nt, Pseudomonas aeruginosa PA01
cgugggccugcuc

SEQ ID NO: 1528920 - RNA, 18 nt, Pseudomonas aeruginosa PA01
cgugggccugcuccucgg

SEQ ID NO: 1528921 - RNA, 19 nt, Pseudomonas aeruginosa PA01
cgugggccugcuccucggc

SEQ ID NO: 1528922 - RNA, 15 nt, Pseudomonas aeruginosa PA01
cgugggggggaaggg

SEQ ID NO: 1528923 - RNA, 20 nt, Pseudomonas aeruginosa PA01
cgugggggggaagggccgga

SEQ ID NO: 1528924 - RNA, 21 nt, Pseudomonas aeruginosa PA01
cgugggcuucgccgccgcgcg

SEQ ID NO: 1528925 - RNA, 19 nt, Pseudomonas aeruginosa PA01
cguggugcauccgccgcag

SEQ ID NO: 1528926 - RNA, 19 nt, Pseudomonas aeruginosa PA01
cgugguggcggggaacagc

SEQ ID NO: 1528927 - RNA, 16 nt, Pseudomonas aeruginosa PA01
cgugguccgccagcag

SEQ ID NO: 1528928 - RNA, 18 nt, Pseudomonas aeruginosa PA01
cguggcgcuugagcagcc

SEQ ID NO: 1528929 - RNA, 15 nt, Pseudomonas aeruginosa PA01
cguggcggccgccgc

SEQ ID NO: 1528930 - RNA, 14 nt, Pseudomonas aeruginosa PA01
cguggcgggccagc

SEQ ID NO: 1528931 - RNA, 16 nt, Pseudomonas aeruginosa PA01
cguggcgggccagcag

SEQ ID NO: 1528932 - RNA, 17 nt, Pseudomonas aeruginosa PA01
cguggcucgaucagccg

SEQ ID NO: 1528933 - RNA, 15 nt, Pseudomonas aeruginosa PA01
cguggcucggcggca

SEQ ID NO: 1528934 - RNA, 15 nt, Pseudomonas aeruginosa PA01
cguggcuggcgccgc

SEQ ID NO: 1528935 - RNA, 13 nt, Pseudomonas aeruginosa PA01
cguggcuuggccc

SEQ ID NO: 1528936 - RNA, 19 nt, Pseudomonas aeruginosa PA01
cguggccauagagccgcug

SEQ ID NO: 1528937 - RNA, 22 nt, Pseudomonas aeruginosa PA01
cguggccgcgggaggccgccuc

SEQ ID NO: 1528938 - RNA, 17 nt, Pseudomonas aeruginosa PA01
cguggccggcgaccagc

SEQ ID NO: 1528939 - RNA, 19 nt, Pseudomonas aeruginosa PA01
cguggcgccauccuccagc

SEQ ID NO: 1528940 - RNA, 21 nt, Pseudomonas aeruginosa PA01
cguggcgccccaggcgggcac

SEQ ID NO: 1528941 - RNA, 19 nt, Pseudomonas aeruginosa PA01
cguggcgaugcccuggcuu

SEQ ID NO: 1528942 - RNA, 18 nt, Pseudomonas aeruginosa PA01
cguggcgaucaggcagcg

SEQ ID NO: 1528943 - RNA, 21 nt, Pseudomonas aeruginosa PA01
cguggcgaucaggcagcgcgc

SEQ ID NO: 1528944 - RNA, 21 nt, Pseudomonas aeruginosa PA01
cuccauaguagagaugcaccg

SEQ ID NO: 1528945 - RNA, 18 nt, Pseudomonas aeruginosa PA01
cuccaugaaacgguuggc

SEQ ID NO: 1528946 - RNA, 17 nt, Pseudomonas aeruginosa PA01
cuccaguuccucgcgag

SEQ ID NO: 1528947 - RNA, 12 nt, Pseudomonas aeruginosa PA01
cuccaguuccug

SEQ ID NO: 1528948 - RNA, 17 nt, Pseudomonas aeruginosa PA01
cuccaguugcagcaccc

SEQ ID NO: 1528949 - RNA, 23 nt, Pseudomonas aeruginosa PA01
cuccaguugcagcacccccagca

SEQ ID NO: 1528950 - RNA, 17 nt, Pseudomonas aeruginosa PA01
cuccaguagcggaagca

SEQ ID NO: 1528951 - RNA, 20 nt, Pseudomonas aeruginosa PA01
cuccagucggggcaggcgca

SEQ ID NO: 1528952 - RNA, 22 nt, Pseudomonas aeruginosa PA01
cuccagggcgaauaccagugcc

SEQ ID NO: 1528953 - RNA, 20 nt, Pseudomonas aeruginosa PA01
cuccagggcgcugaccaggu

SEQ ID NO: 1528954 - RNA, 17 nt, Pseudomonas aeruginosa PA01
cuccaggcuggccuugg

SEQ ID NO: 1528955 - RNA, 20 nt, Pseudomonas aeruginosa PA01
cuccagggaaaccaccugga

SEQ ID NO: 1528956 - RNA, 12 nt, Pseudomonas aeruginosa PA01
cuccaggggucg

SEQ ID NO: 1528957 - RNA, 18 nt, Pseudomonas aeruginosa PA01
cuccagguacagccgcag

SEQ ID NO: 1528958 - RNA, 19 nt, Pseudomonas aeruginosa PA01
cuccaggucggucggcggc

SEQ ID NO: 1528959 - RNA, 17 nt, Pseudomonas aeruginosa PA01
cuccagguucggcgcca

SEQ ID NO: 1528960 - RNA, 23 nt, Pseudomonas aeruginosa PA01
cuccagccggcaagcgugccccg

SEQ ID NO: 1528961 - RNA, 15 nt, Pseudomonas aeruginosa PA01
cuccagccgcacccu

SEQ ID NO: 1528962 - RNA, 12 nt, Pseudomonas aeruginosa PA01
cuccagccagca

SEQ ID NO: 1528963 - RNA, 18 nt, Pseudomonas aeruginosa PA01
cuccagcgccuggcgcag

SEQ ID NO: 1528964 - RNA, 18 nt, Pseudomonas aeruginosa PA01
cuccagcgccucgaccag

SEQ ID NO: 1528965 - RNA, 14 nt, Pseudomonas aeruginosa PA01
cuccagcgccucgc

SEQ ID NO: 1528966 - RNA, 15 nt, Pseudomonas aeruginosa PA01
cuccagcgccgccag

SEQ ID NO: 1528967 - RNA, 21 nt, Pseudomonas aeruginosa PA01
cuccagcgggaaggucggcag

SEQ ID NO: 1528968 - RNA, 19 nt, Pseudomonas aeruginosa PA01
cuccagcgggccuucgcca

SEQ ID NO: 1528969 - RNA, 14 nt, Pseudomonas aeruginosa PA01
cuccaggcgcgccg

SEQ ID NO: 1528970 - RNA, 14 nt, Pseudomonas aeruginosa PA01
cuccaggcggcggu

SEQ ID NO: 1528971 - RNA, 15 nt, Pseudomonas aeruginosa PA01
cuccaggcccggcag

SEQ ID NO: 1528972 - RNA, 20 nt, Pseudomonas aeruginosa PA01
cuccagcgccgccucgaagg

SEQ ID NO: 1528973 - RNA, 15 nt, Pseudomonas aeruginosa PA01
cuccagcuccuccag

SEQ ID NO: 1528974 - RNA, 16 nt, Pseudomonas aeruginosa PA01
cuccagcuucuucugc

SEQ ID NO: 1528975 - RNA, 17 nt, Pseudomonas aeruginosa PA01
cuccagcuucuucugca

SEQ ID NO: 1528976 - RNA, 16 nt, Pseudomonas aeruginosa PA01
cuccagcucgacccgc

SEQ ID NO: 1528977 - RNA, 14 nt, Pseudomonas aeruginosa PA01
cuccacgaggaugu

SEQ ID NO: 1528978 - RNA, 16 nt, Pseudomonas aeruginosa PA01
cuccacgucggcccgg

SEQ ID NO: 1528979 - RNA, 15 nt, Pseudomonas aeruginosa PA01
cuccacugcuuggcc

SEQ ID NO: 1528980 - RNA, 20 nt, Pseudomonas aeruginosa PA01
cuccagcaccagcacgcccu

SEQ ID NO: 1528981 - RNA, 15 nt, Pseudomonas aeruginosa PA01
cuccagcacccaggu

SEQ ID NO: 1528982 - RNA, 18 nt, Pseudomonas aeruginosa PA01
cuccagcacccagguaga

SEQ ID NO: 1528983 - RNA, 19 nt, Pseudomonas aeruginosa PA01
cuccagcaccguggcgcca

SEQ ID NO: 1528984 - RNA, 18 nt, Pseudomonas aeruginosa PA01
cuccagcauccagcgaua

SEQ ID NO: 1528985 - RNA, 10 nt, Pseudomonas aeruginosa PA01
cuccagcagg

SEQ ID NO: 1528986 - RNA, 15 nt, Pseudomonas aeruginosa PA01
cuccagcaggaccug

SEQ ID NO: 1528987 - RNA, 19 nt, Pseudomonas aeruginosa PA01
cuccagcaggaccuggccg

SEQ ID NO: 1528988 - RNA, 20 nt, Pseudomonas aeruginosa PA01
cuccagcagucgcacagcca

SEQ ID NO: 1528989 - RNA, 21 nt, Pseudomonas aeruginosa PA01
cuccagcagucgcacagccag

SEQ ID NO: 1528990 - RNA, 23 nt, Pseudomonas aeruginosa PA01
cuccagcagggccagcgccuggc

SEQ ID NO: 1528991 - RNA, 16 nt, Pseudomonas aeruginosa PA01
cuccagcagggucgcc

SEQ ID NO: 1528992 - RNA, 17 nt, Pseudomonas aeruginosa PA01
cuccagaucgccguucu

SEQ ID NO: 1528993 - RNA, 21 nt, Pseudomonas aeruginosa PA01
cuccagauagugcggccaggc

SEQ ID NO: 1528994 - RNA, 20 nt, Pseudomonas aeruginosa PA01
cuccagcaaugccagcgcca

SEQ ID NO: 1528995 - RNA, 15 nt, Pseudomonas aeruginosa PA01
cuccagacucuccag

SEQ ID NO: 1528996 - RNA, 14 nt, Pseudomonas aeruginosa PA01
cuccagcaacgccg

SEQ ID NO: 1528997 - RNA, 19 nt, Pseudomonas aeruginosa PA01
cuccagcaacgccgccccc

SEQ ID NO: 1528998 - RNA, 20 nt, Pseudomonas aeruginosa PA01
cuccagaggaacaguucggc

SEQ ID NO: 1528999 - RNA, 17 nt, Pseudomonas aeruginosa PA01
cuccagaguccaugcuc

SEQ ID NO: 1529000 - RNA, 13 nt, Pseudomonas aeruginosa PA01
cuccagagugcgc

SEQ ID NO: 1529001 - RNA, 19 nt, Pseudomonas aeruginosa PA01
cuccagagugcgcagcagc

SEQ ID NO: 1529002 - RNA, 23 nt, Pseudomonas aeruginosa PA01
cuccagagugcgcagcagcgucg

SEQ ID NO: 1529003 - RNA, 22 nt, Pseudomonas aeruginosa PA01
cuccagaaucucccgcaggcgc

SEQ ID NO: 1529004 - RNA, 20 nt, Pseudomonas aeruginosa PA01
cuccucggccgacaggcugg

SEQ ID NO: 1529005 - RNA, 16 nt, Pseudomonas aeruginosa PA01
cuccucgauccgcucc

SEQ ID NO: 1529006 - RNA, 14 nt, Pseudomonas aeruginosa PA01
cuccucgcuccaga

SEQ ID NO: 1529007 - RNA, 15 nt, Pseudomonas aeruginosa PA01
cuccucggcagcgcu

SEQ ID NO: 1529008 - RNA, 20 nt, Pseudomonas aeruginosa PA01
cuccucggcagcgcuggcga

SEQ ID NO: 1529009 - RNA, 22 nt, Pseudomonas aeruginosa PA01
cuccucgaugaaacgcagggcc

SEQ ID NO: 1529010 - RNA, 23 nt, Pseudomonas aeruginosa PA01
cuccucgaugaaacgcagggccg

SEQ ID NO: 1529011 - RNA, 13 nt, Pseudomonas aeruginosa PA01
cuccucgccgccg

SEQ ID NO: 1529012 - RNA, 14 nt, Pseudomonas aeruginosa PA01
cuccucgccgcucc

SEQ ID NO: 1529013 - RNA, 15 nt, Pseudomonas aeruginosa PA01
cuccucgccgcuccg

SEQ ID NO: 1529014 - RNA, 23 nt, Pseudomonas aeruginosa PA01
cuccucgccguacagcaggcagg

SEQ ID NO: 1529015 - RNA, 23 nt, Pseudomonas aeruginosa PA01
cuccucgacggcgggagcggccu

SEQ ID NO: 1529016 - RNA, 20 nt, Pseudomonas aeruginosa PA01
cuccucgaacaacuggacga

SEQ ID NO: 1529017 - RNA, 16 nt, Pseudomonas aeruginosa PA01
cuccggucaaggcaga

SEQ ID NO: 1529018 - RNA, 19 nt, Pseudomonas aeruginosa PA01
cuccggggugaagcucuuc

SEQ ID NO: 1529019 - RNA, 20 nt, Pseudomonas aeruginosa PA01
cuccggggugaagcucuucu

SEQ ID NO: 1529020 - RNA, 16 nt, Pseudomonas aeruginosa PA01
cuccggggcccggcag

SEQ ID NO: 1529021 - RNA, 20 nt, Pseudomonas aeruginosa PA01
cuccggggcccggcaggcag

SEQ ID NO: 1529022 - RNA, 23 nt, Pseudomonas aeruginosa PA01
cuccggcgccaggccggagccgc

SEQ ID NO: 1529023 - RNA, 21 nt, Pseudomonas aeruginosa PA01
cuccggcgccgggcuguagug

SEQ ID NO: 1529024 - RNA, 18 nt, Pseudomonas aeruginosa PA01
cuccggcgcagcccagcc

SEQ ID NO: 1529025 - RNA, 16 nt, Pseudomonas aeruginosa PA01
cuccgggagcaucugg

SEQ ID NO: 1529026 - RNA, 20 nt, Pseudomonas aeruginosa PA01
cuccgggccgagggcugaga

SEQ ID NO: 1529027 - RNA, 18 nt, Pseudomonas aeruginosa PA01
cuccggcacgcugccgcc

SEQ ID NO: 1529028 - RNA, 20 nt, Pseudomonas aeruginosa PA01
cuccgccgcgugcgcgcccu

SEQ ID NO: 1529029 - RNA, 13 nt, Pseudomonas aeruginosa PA01
cuccgccgcuucc

SEQ ID NO: 1529030 - RNA, 20 nt, Pseudomonas aeruginosa PA01
cuccgccgcuuccgccggcg

SEQ ID NO: 1529031 - RNA, 19 nt, Pseudomonas aeruginosa PA01
cuccgccaggaccuccugc

SEQ ID NO: 1529032 - RNA, 13 nt, Pseudomonas aeruginosa PA01
cuccgccaggccg

SEQ ID NO: 1529033 - RNA, 15 nt, Pseudomonas aeruginosa PA01
cuccgccccggcaag

SEQ ID NO: 1529034 - RNA, 23 nt, Pseudomonas aeruginosa PA01
cuccgccgaacgccaccagggcc

SEQ ID NO: 1529035 - RNA, 19 nt, Pseudomonas aeruginosa PA01
cuccgccacccgcuccggc

SEQ ID NO: 1529036 - RNA, 16 nt, Pseudomonas aeruginosa PA01
cuccgccagcaccacc

SEQ ID NO: 1529037 - RNA, 12 nt, Pseudomonas aeruginosa PA01
cuccgccagcca

SEQ ID NO: 1529038 - RNA, 19 nt, Pseudomonas aeruginosa PA01
cuccgccagccagccgcgc

SEQ ID NO: 1529039 - RNA, 12 nt, Pseudomonas aeruginosa PA01
cucccaccgcuu

SEQ ID NO: 1529040 - RNA, 17 nt, Pseudomonas aeruginosa PA01
cucccaccgcuuucagc

SEQ ID NO: 1529041 - RNA, 14 nt, Pseudomonas aeruginosa PA01
cuccgauuccugcg

SEQ ID NO: 1529042 - RNA, 15 nt, Pseudomonas aeruginosa PA01
cucccuucagggaga

SEQ ID NO: 1529043 - RNA, 17 nt, Pseudomonas aeruginosa PA01
cucccuucagggagagg

SEQ ID NO: 1529044 - RNA, 14 nt, Pseudomonas aeruginosa PA01
cucccugcccgcuc

SEQ ID NO: 1529045 - RNA, 15 nt, Pseudomonas aeruginosa PA01
cucccugagccuguc

SEQ ID NO: 1529046 - RNA, 20 nt, Pseudomonas aeruginosa PA01
cucccgcaaccugccagaaa

SEQ ID NO: 1529047 - RNA, 18 nt, Pseudomonas aeruginosa PA01
cucccccacguacuccag

SEQ ID NO: 1529048 - RNA, 12 nt, Pseudomonas aeruginosa PA01
cucccccucuuc

SEQ ID NO: 1529049 - RNA, 21 nt, Pseudomonas aeruginosa PA01
cucccgcgauucgccgggcuc

SEQ ID NO: 1529050 - RNA, 17 nt, Pseudomonas aeruginosa PA01
cucccgaggcgaucgcc

SEQ ID NO: 1529051 - RNA, 23 nt, Pseudomonas aeruginosa PA01
cucccgcaggcgcuucagcgccu

SEQ ID NO: 1529052 - RNA, 17 nt, Pseudomonas aeruginosa PA01
cucccgcgccagcgccg

SEQ ID NO: 1529053 - RNA, 19 nt, Pseudomonas aeruginosa PA01
cucccgcgccagcgccgcc

SEQ ID NO: 1529054 - RNA, 11 nt, Pseudomonas aeruginosa PA01
cucggccaggc

SEQ ID NO: 1529055 - RNA, 13 nt, Pseudomonas aeruginosa PA01
cucggccaggcac

SEQ ID NO: 1529056 - RNA, 14 nt, Pseudomonas aeruginosa PA01
cucggccaggcaca

SEQ ID NO: 1529057 - RNA, 15 nt, Pseudomonas aeruginosa PA01
cucggccagcucgcc

SEQ ID NO: 1529058 - RNA, 19 nt, Pseudomonas aeruginosa PA01
cucggccaggaccagggcg

SEQ ID NO: 1529059 - RNA, 16 nt, Pseudomonas aeruginosa PA01
cucggccaugccggcc

SEQ ID NO: 1529060 - RNA, 18 nt, Pseudomonas aeruginosa PA01
cucggccaucagcgccag

SEQ ID NO: 1529061 - RNA, 20 nt, Pseudomonas aeruginosa PA01
cucggccaguucgcggcgca

SEQ ID NO: 1529062 - RNA, 16 nt, Pseudomonas aeruginosa PA01
cucggccaguucgucg

SEQ ID NO: 1529063 - RNA, 21 nt, Pseudomonas aeruginosa PA01
cucggccauaccuccagccag

SEQ ID NO: 1529064 - RNA, 16 nt, Pseudomonas aeruginosa PA01
cucggccgccaggcgc

SEQ ID NO: 1529065 - RNA, 16 nt, Pseudomonas aeruginosa PA01
cucggccgccuggcgu

SEQ ID NO: 1529066 - RNA, 12 nt, Pseudomonas aeruginosa PA01
cucggccggcag

SEQ ID NO: 1529067 - RNA, 21 nt, Pseudomonas aeruginosa PA01
cucggccgcaucgaccuugcc

SEQ ID NO: 1529068 - RNA, 17 nt, Pseudomonas aeruginosa PA01
cucggcgauggcgcgcg

SEQ ID NO: 1529069 - RNA, 18 nt, Pseudomonas aeruginosa PA01
cucggcgauguugcgcag

SEQ ID NO: 1529070 - RNA, 22 nt, Pseudomonas aeruginosa PA01
cucggcgauguugcgcagggug

SEQ ID NO: 1529071 - RNA, 20 nt, Pseudomonas aeruginosa PA01
cucggcgauucgcggcgaca

SEQ ID NO: 1529072 - RNA, 16 nt, Pseudomonas aeruginosa PA01
cucggcgcccagggcu

SEQ ID NO: 1529073 - RNA, 18 nt, Pseudomonas aeruginosa PA01
cucggacaagggccagag

SEQ ID NO: 1529074 - RNA, 22 nt, Pseudomonas aeruginosa PA01
cucggacaagggccagagcacg

SEQ ID NO: 1529075 - RNA, 21 nt, Pseudomonas aeruginosa PA01
cucggauaugccgcucagcgg

SEQ ID NO: 1529076 - RNA, 16 nt, Pseudomonas aeruginosa PA01
cucggagaacagcagc

SEQ ID NO: 1529077 - RNA, 18 nt, Pseudomonas aeruginosa PA01
cucgcugggcgccggcag

SEQ ID NO: 1529078 - RNA, 15 nt, Pseudomonas aeruginosa PA01
cucgcuucagcgagc

SEQ ID NO: 1529079 - RNA, 19 nt, Pseudomonas aeruginosa PA01
cucgcuguaguuguucggc

SEQ ID NO: 1529080 - RNA, 24 nt, Pseudomonas aeruginosa PA01
cucgcugcgugcguugcgcggcag

SEQ ID NO: 1529081 - RNA, 12 nt, Pseudomonas aeruginosa PA01
cucgcugccgcc

SEQ ID NO: 1529082 - RNA, 16 nt, Pseudomonas aeruginosa PA01
cucggcguagccggcc

SEQ ID NO: 1529083 - RNA, 22 nt, Pseudomonas aeruginosa PA01
cucggcguagccggccagggcg

SEQ ID NO: 1529084 - RNA, 24 nt, Pseudomonas aeruginosa PA01
cucggcuucgcguugcaggcgacg

SEQ ID NO: 1529085 - RNA, 18 nt, Pseudomonas aeruginosa PA01
cucggcuugacuggcagu

SEQ ID NO: 1529086 - RNA, 19 nt, Pseudomonas aeruginosa PA01
cucggcuugacuggcaguc

SEQ ID NO: 1529087 - RNA, 20 nt, Pseudomonas aeruginosa PA01
cucggcuccagccaggcccg

SEQ ID NO: 1529088 - RNA, 17 nt, Pseudomonas aeruginosa PA01
cucggcugcaacgccgc

SEQ ID NO: 1529089 - RNA, 19 nt, Pseudomonas aeruginosa PA01
cucggcugcaacgccgcgg

SEQ ID NO: 1529090 - RNA, 22 nt, Pseudomonas aeruginosa PA01
cucggcgugccgggccggccag

SEQ ID NO: 1529091 - RNA, 21 nt, Pseudomonas aeruginosa PA01
cucggcgcgaugaugccgccg

SEQ ID NO: 1529092 - RNA, 14 nt, Pseudomonas aeruginosa PA01
cucggcgcgcgccc

SEQ ID NO: 1529093 - RNA, 16 nt, Pseudomonas aeruginosa PA01
cucggcgcgcgccccc

SEQ ID NO: 1529094 - RNA, 22 nt, Pseudomonas aeruginosa PA01
cucggcgcgcgcccccuggccg

SEQ ID NO: 1529095 - RNA, 15 nt, Pseudomonas aeruginosa PA01
cucggcgcccuggcc

SEQ ID NO: 1529096 - RNA, 16 nt, Pseudomonas aeruginosa PA01
cucggcgcccuggccg

SEQ ID NO: 1529097 - RNA, 22 nt, Pseudomonas aeruginosa PA01
cucggcgccgagcauuccgaca

SEQ ID NO: 1529098 - RNA, 18 nt, Pseudomonas aeruginosa PA01
cucggcgcuuucgcucug

SEQ ID NO: 1529099 - RNA, 20 nt, Pseudomonas aeruginosa PA01
cucggcggacagcccgcgcu

SEQ ID NO: 1529100 - RNA, 16 nt, Pseudomonas aeruginosa PA01
cucggcgcugccggcc

SEQ ID NO: 1529101 - RNA, 14 nt, Pseudomonas aeruginosa PA01
cucggucgccgcca

SEQ ID NO: 1529102 - RNA, 15 nt, Pseudomonas aeruginosa PA01
cucggucgccgccag

SEQ ID NO: 1529103 - RNA, 17 nt, Pseudomonas aeruginosa PA01
cucggucgccgccagca

SEQ ID NO: 1529104 - RNA, 16 nt, Pseudomonas aeruginosa PA01
cucggugaccaccagg

SEQ ID NO: 1529105 - RNA, 18 nt, Pseudomonas aeruginosa PA01
cucggugaccaccaggcg

SEQ ID NO: 1529106 - RNA, 18 nt, Pseudomonas aeruginosa PA01
cucggucgagccccacgu

SEQ ID NO: 1529107 - RNA, 13 nt, Pseudomonas aeruginosa PA01
cucuaccaggcgg

SEQ ID NO: 1529108 - RNA, 19 nt, Pseudomonas aeruginosa PA01
cucgugcagguagccgcgc

SEQ ID NO: 1529109 - RNA, 16 nt, Pseudomonas aeruginosa PA01
cucgugcuccaccucg

SEQ ID NO: 1529110 - RNA, 23 nt, Pseudomonas aeruginosa PA01
cucgugcucggggaacacgcgcu

SEQ ID NO: 1529111 - RNA, 21 nt, Pseudomonas aeruginosa PA01
cucgugcuuggugucggccgc

SEQ ID NO: 1529112 - RNA, 13 nt, Pseudomonas aeruginosa PA01
cucguggcgcgcc

SEQ ID NO: 1529113 - RNA, 14 nt, Pseudomonas aeruginosa PA01
cucguuggcggcca

SEQ ID NO: 1529114 - RNA, 18 nt, Pseudomonas aeruginosa PA01
cucguuggcggccagcau

SEQ ID NO: 1529115 - RNA, 13 nt, Pseudomonas aeruginosa PA01
cucguccaggccg

SEQ ID NO: 1529116 - RNA, 21 nt, Pseudomonas aeruginosa PA01
cucgguugccaggccggcgca

SEQ ID NO: 1529117 - RNA, 21 nt, Pseudomonas aeruginosa PA01
cucgguuuccggccaggcgcg

SEQ ID NO: 1529118 - RNA, 16 nt, Pseudomonas aeruginosa PA01
cucgguucugcgcacc

SEQ ID NO: 1529119 - RNA, 13 nt, Pseudomonas aeruginosa PA01
cucgguuccagcu

SEQ ID NO: 1529120 - RNA, 22 nt, Pseudomonas aeruginosa PA01
cucggugugaucaccagccacu

SEQ ID NO: 1529121 - RNA, 14 nt, Pseudomonas aeruginosa PA01
cucggugagcaggc

SEQ ID NO: 1529122 - RNA, 13 nt, Pseudomonas aeruginosa PA01
cucggugagguag

SEQ ID NO: 1529123 - RNA, 20 nt, Pseudomonas aeruginosa PA01
cucggugauaccgccggcgg

SEQ ID NO: 1529124 - RNA, 22 nt, Pseudomonas aeruginosa PA01
cucggugauaccgccggcggcg

SEQ ID NO: 1529125 - RNA, 13 nt, Pseudomonas aeruginosa PA01
cucgucgccgccc

SEQ ID NO: 1529126 - RNA, 18 nt, Pseudomonas aeruginosa PA01
cucgucgccgcccggcag

SEQ ID NO: 1529127 - RNA, 20 nt, Pseudomonas aeruginosa PA01
cucgucguucagcccacccc

SEQ ID NO: 1529128 - RNA, 13 nt, Pseudomonas aeruginosa PA01
cucgucuuccuug

SEQ ID NO: 1529129 - RNA, 18 nt, Pseudomonas aeruginosa PA01
cucgucuuccuugcugaa

SEQ ID NO: 1529130 - RNA, 23 nt, Pseudomonas aeruginosa PA01
cucgugcagcaagccgcagcgcc

SEQ ID NO: 1529131 - RNA, 17 nt, Pseudomonas aeruginosa PA01
cucguccauguugcggc

SEQ ID NO: 1529132 - RNA, 22 nt, Pseudomonas aeruginosa PA01
cucguccauguugcggcccagc

SEQ ID NO: 1529133 - RNA, 14 nt, Pseudomonas aeruginosa PA01
cucgucgacgcuca

SEQ ID NO: 1529134 - RNA, 21 nt, Pseudomonas aeruginosa PA01
cucgucgagcaucugccgggc

SEQ ID NO: 1529135 - RNA, 17 nt, Pseudomonas aeruginosa PA01
cucguccucccagugcg

SEQ ID NO: 1529136 - RNA, 20 nt, Pseudomonas aeruginosa PA01
cucgaccagguccggcagcg

SEQ ID NO: 1529137 - RNA, 23 nt, Pseudomonas aeruginosa PA01
cucgaccagguccggcagcgccu

SEQ ID NO: 1529138 - RNA, 19 nt, Pseudomonas aeruginosa PA01
cucgacggcgaucucagcc

SEQ ID NO: 1529139 - RNA, 15 nt, Pseudomonas aeruginosa PA01
cucgacggcgggagc

SEQ ID NO: 1529140 - RNA, 22 nt, Pseudomonas aeruginosa PA01
cucgacggcgggagcggccuga

SEQ ID NO: 1529141 - RNA, 22 nt, Pseudomonas aeruginosa PA01
cucgccacugauaccgcuggcc

SEQ ID NO: 1529142 - RNA, 18 nt, Pseudomonas aeruginosa PA01
cucgccaccuguagcagg

SEQ ID NO: 1529143 - RNA, 22 nt, Pseudomonas aeruginosa PA01
cucgccacgcuucugcgccucc

SEQ ID NO: 1529144 - RNA, 19 nt, Pseudomonas aeruginosa PA01
cucgauguaggccucggcc

SEQ ID NO: 1529145 - RNA, 23 nt, Pseudomonas aeruginosa PA01
cucgauggugacguugcgccgca

SEQ ID NO: 1529146 - RNA, 18 nt, Pseudomonas aeruginosa PA01
cucgaggucggccuggcu

SEQ ID NO: 1529147 - RNA, 14 nt, Pseudomonas aeruginosa PA01
cucgagcaccacca

SEQ ID NO: 1529148 - RNA, 13 nt, Pseudomonas aeruginosa PA01
cucgaucaggccu

SEQ ID NO: 1529149 - RNA, 15 nt, Pseudomonas aeruginosa PA01
cucgaucaggccuuc

SEQ ID NO: 1529150 - RNA, 16 nt, Pseudomonas aeruginosa PA01
cucgaucaggccuucc

SEQ ID NO: 1529151 - RNA, 20 nt, Pseudomonas aeruginosa PA01
cucgauagcguccaggugcg

SEQ ID NO: 1529152 - RNA, 19 nt, Pseudomonas aeruginosa PA01
cucgcguucaucgucggca

SEQ ID NO: 1529153 - RNA, 22 nt, Pseudomonas aeruginosa PA01
cucgcguucaucgucggcagcc

SEQ ID NO: 1529154 - RNA, 16 nt, Pseudomonas aeruginosa PA01
cucgcgggacagcuug

SEQ ID NO: 1529155 - RNA, 16 nt, Pseudomonas aeruginosa PA01
cucgcgguaggccagc

SEQ ID NO: 1529156 - RNA, 18 nt, Pseudomonas aeruginosa PA01
cucgcgggcuaccaggaa

SEQ ID NO: 1529157 - RNA, 19 nt, Pseudomonas aeruginosa PA01
cucgcggcggaugccggcg

SEQ ID NO: 1529158 - RNA, 18 nt, Pseudomonas aeruginosa PA01
cucgcggccgaauuccag

SEQ ID NO: 1529159 - RNA, 14 nt, Pseudomonas aeruginosa PA01
cucgcggcgcggcg

SEQ ID NO: 1529160 - RNA, 21 nt, Pseudomonas aeruginosa PA01
cucgcggcaucccgcccgguc

SEQ ID NO: 1529161 - RNA, 20 nt, Pseudomonas aeruginosa PA01
cucgcggaucugcuccugca

SEQ ID NO: 1529162 - RNA, 21 nt, Pseudomonas aeruginosa PA01
cucgcggaagcguugcucgag

SEQ ID NO: 1529163 - RNA, 17 nt, Pseudomonas aeruginosa PA01
cucgcggaccagcuccg

SEQ ID NO: 1529164 - RNA, 23 nt, Pseudomonas aeruginosa PA01
cucgcggaccagcuccgaaggga

SEQ ID NO: 1529165 - RNA, 15 nt, Pseudomonas aeruginosa PA01
cucgcugccgccgca

SEQ ID NO: 1529166 - RNA, 16 nt, Pseudomonas aeruginosa PA01
cucgcugccgccgcag

SEQ ID NO: 1529167 - RNA, 16 nt, Pseudomonas aeruginosa PA01
cucgcugccggcgcgc

SEQ ID NO: 1529168 - RNA, 17 nt, Pseudomonas aeruginosa PA01
cucgcugccggcgcgca

SEQ ID NO: 1529169 - RNA, 21 nt, Pseudomonas aeruginosa PA01
cucgcugacuuccaucagcuc

SEQ ID NO: 1529170 - RNA, 14 nt, Pseudomonas aeruginosa PA01
cucgcugacccagg

SEQ ID NO: 1529171 - RNA, 21 nt, Pseudomonas aeruginosa PA01
cucgcugaaauccaccagcac

SEQ ID NO: 1529172 - RNA, 22 nt, Pseudomonas aeruginosa PA01
cucgcugaaauccaccagcacg

SEQ ID NO: 1529173 - RNA, 20 nt, Pseudomonas aeruginosa PA01
cucgcuaucaggcauccccg

SEQ ID NO: 1529174 - RNA, 15 nt, Pseudomonas aeruginosa PA01
cucgcuccuccgggc

SEQ ID NO: 1529175 - RNA, 15 nt, Pseudomonas aeruginosa PA01
cucgcuacggaaggu

SEQ ID NO: 1529176 - RNA, 22 nt, Pseudomonas aeruginosa PA01
cucgcuagucuuccugcacgcu

SEQ ID NO: 1529177 - RNA, 15 nt, Pseudomonas aeruginosa PA01
cucgcuccaacgcag

SEQ ID NO: 1529178 - RNA, 12 nt, Pseudomonas aeruginosa PA01
cucgcuccagag

SEQ ID NO: 1529179 - RNA, 16 nt, Pseudomonas aeruginosa PA01
cucgcuccagaggaac

SEQ ID NO: 1529180 - RNA, 22 nt, Pseudomonas aeruginosa PA01
cucgccgggcgucugcccgguc

SEQ ID NO: 1529181 - RNA, 18 nt, Pseudomonas aeruginosa PA01
cucgccgggucgccgcag

SEQ ID NO: 1529182 - RNA, 21 nt, Pseudomonas aeruginosa PA01
cucgccggguuguccaggcga

SEQ ID NO: 1529183 - RNA, 23 nt, Pseudomonas aeruginosa PA01
cucgccggguuguccaggcgaug

SEQ ID NO: 1529184 - RNA, 15 nt, Pseudomonas aeruginosa PA01
cucgccggcguccuc

SEQ ID NO: 1529185 - RNA, 18 nt, Pseudomonas aeruginosa PA01
cucgccggcguccuccuc

SEQ ID NO: 1529186 - RNA, 21 nt, Pseudomonas aeruginosa PA01
cucgccggcguccuccuccag

SEQ ID NO: 1529187 - RNA, 19 nt, Pseudomonas aeruginosa PA01
cucgccgggaaucgccagc

SEQ ID NO: 1529188 - RNA, 15 nt, Pseudomonas aeruginosa PA01
cucgccgcugcuggc

SEQ ID NO: 1529189 - RNA, 16 nt, Pseudomonas aeruginosa PA01
cucgccgcuggcgcug

SEQ ID NO: 1529190 - RNA, 17 nt, Pseudomonas aeruginosa PA01
cucgccgcuccacaccc

SEQ ID NO: 1529191 - RNA, 14 nt, Pseudomonas aeruginosa PA01
cucgccgcuccgcg

SEQ ID NO: 1529192 - RNA, 20 nt, Pseudomonas aeruginosa PA01
cucgccgcuccgcgccacgc

SEQ ID NO: 1529193 - RNA, 14 nt, Pseudomonas aeruginosa PA01
cucgccagcccggc

SEQ ID NO: 1529194 - RNA, 14 nt, Pseudomonas aeruginosa PA01
cucgcgcagccacu

SEQ ID NO: 1529195 - RNA, 12 nt, Pseudomonas aeruginosa PA01
cucgcgcagcag

SEQ ID NO: 1529196 - RNA, 12 nt, Pseudomonas aeruginosa PA01
cucgccguaacc

SEQ ID NO: 1529197 - RNA, 14 nt, Pseudomonas aeruginosa PA01
cucgccguacagca

SEQ ID NO: 1529198 - RNA, 19 nt, Pseudomonas aeruginosa PA01
cucgccguacagcaggcag

SEQ ID NO: 1529199 - RNA, 18 nt, Pseudomonas aeruginosa PA01
cucgcgcaccgcggccag

SEQ ID NO: 1529200 - RNA, 13 nt, Pseudomonas aeruginosa PA01
cucgcgccagccc

SEQ ID NO: 1529201 - RNA, 21 nt, Pseudomonas aeruginosa PA01
cucgcgccagccccaggcgcg

SEQ ID NO: 1529202 - RNA, 17 nt, Pseudomonas aeruginosa PA01
cucgcgcaugaccuuca

SEQ ID NO: 1529203 - RNA, 22 nt, Pseudomonas aeruginosa PA01
cucgcgcaugaucgccucggcg

SEQ ID NO: 1529204 - RNA, 19 nt, Pseudomonas aeruginosa PA01
cucgcgccgcgccagcagg

SEQ ID NO: 1529205 - RNA, 14 nt, Pseudomonas aeruginosa PA01
cucgcgcuuccggc

SEQ ID NO: 1529206 - RNA, 13 nt, Pseudomonas aeruginosa PA01
cucgcgcuggacc

SEQ ID NO: 1529207 - RNA, 15 nt, Pseudomonas aeruginosa PA01
cucaagucuccagcg

SEQ ID NO: 1529208 - RNA, 14 nt, Pseudomonas aeruginosa PA01
cucaccaggcccgc

SEQ ID NO: 1529209 - RNA, 20 nt, Pseudomonas aeruginosa PA01
cucagcucucccgaggcgau

SEQ ID NO: 1529210 - RNA, 17 nt, Pseudomonas aeruginosa PA01
cucagcccucggcccgg

SEQ ID NO: 1529211 - RNA, 20 nt, Pseudomonas aeruginosa PA01
cucagccgaggucgccgcca

SEQ ID NO: 1529212 - RNA, 21 nt, Pseudomonas aeruginosa PA01
cucagccgaggucgccgccag

SEQ ID NO: 1529213 - RNA, 22 nt, Pseudomonas aeruginosa PA01
cucagccgaggucgccgccagc

SEQ ID NO: 1529214 - RNA, 21 nt, Pseudomonas aeruginosa PA01
cucagcuggauagaguacucg

SEQ ID NO: 1529215 - RNA, 15 nt, Pseudomonas aeruginosa PA01
cucagcugggagagc

SEQ ID NO: 1529216 - RNA, 15 nt, Pseudomonas aeruginosa PA01
cucaggagcgccgcg

SEQ ID NO: 1529217 - RNA, 18 nt, Pseudomonas aeruginosa PA01
cucaggacguccuggccg

SEQ ID NO: 1529218 - RNA, 22 nt, Pseudomonas aeruginosa PA01
cucaggaugcgaugcugucagc

SEQ ID NO: 1529219 - RNA, 13 nt, Pseudomonas aeruginosa PA01
cucaggaccuucc

SEQ ID NO: 1529220 - RNA, 18 nt, Pseudomonas aeruginosa PA01
cucaggaccuuccgccag

SEQ ID NO: 1529221 - RNA, 22 nt, Pseudomonas aeruginosa PA01
cucaggaccuuccgccagcagg

SEQ ID NO: 1529222 - RNA, 19 nt, Pseudomonas aeruginosa PA01
cucaggaagaagccucgcg

SEQ ID NO: 1529223 - RNA, 17 nt, Pseudomonas aeruginosa PA01
cucagccucacccugcu

SEQ ID NO: 1529224 - RNA, 21 nt, Pseudomonas aeruginosa PA01
cucagccucacccugcugggc

SEQ ID NO: 1529225 - RNA, 15 nt, Pseudomonas aeruginosa PA01
cucagccccucgcca

SEQ ID NO: 1529226 - RNA, 16 nt, Pseudomonas aeruginosa PA01
cucagccagcggcgcu

SEQ ID NO: 1529227 - RNA, 16 nt, Pseudomonas aeruginosa PA01
cucagcagcgccgccc

SEQ ID NO: 1529228 - RNA, 13 nt, Pseudomonas aeruginosa PA01
cucagcaccuugu

SEQ ID NO: 1529229 - RNA, 19 nt, Pseudomonas aeruginosa PA01
cucagcaccuugugcugcc

SEQ ID NO: 1529230 - RNA, 21 nt, Pseudomonas aeruginosa PA01
cucagcaccuugugcugccug

SEQ ID NO: 1529231 - RNA, 16 nt, Pseudomonas aeruginosa PA01
cucagcacccuggcca

SEQ ID NO: 1529232 - RNA, 19 nt, Pseudomonas aeruginosa PA01
cucagaggcgaccagccgg

SEQ ID NO: 1529233 - RNA, 20 nt, Pseudomonas aeruginosa PA01
cucagaggcgaccagccggg

SEQ ID NO: 1529234 - RNA, 20 nt, Pseudomonas aeruginosa PA01
cucagaaauccaccuugccg

SEQ ID NO: 1529235 - RNA, 23 nt, Pseudomonas aeruginosa PA01
cucagaaguauuucaaccaggcg

SEQ ID NO: 1529236 - RNA, 15 nt, Pseudomonas aeruginosa PA01
cucagaagucccagc

SEQ ID NO: 1529237 - RNA, 13 nt, Pseudomonas aeruginosa PA01
cucauguugcggg

SEQ ID NO: 1529238 - RNA, 21 nt, Pseudomonas aeruginosa PA01
cucauggaaaccccggccugg

SEQ ID NO: 1529239 - RNA, 19 nt, Pseudomonas aeruginosa PA01
cucauggaacagcagccag

SEQ ID NO: 1529240 - RNA, 20 nt, Pseudomonas aeruginosa PA01
cucauggaacagcagccagg

SEQ ID NO: 1529241 - RNA, 13 nt, Pseudomonas aeruginosa PA01
cucauggccgcag

SEQ ID NO: 1529242 - RNA, 22 nt, Pseudomonas aeruginosa PA01
cucauggccgcagcggcuguug

SEQ ID NO: 1529243 - RNA, 15 nt, Pseudomonas aeruginosa PA01
cucauggcgccgcca

SEQ ID NO: 1529244 - RNA, 22 nt, Pseudomonas aeruginosa PA01
cucauggcuguagcucugcugg

SEQ ID NO: 1529245 - RNA, 12 nt, Pseudomonas aeruginosa PA01
cucaucgcccau

SEQ ID NO: 1529246 - RNA, 14 nt, Pseudomonas aeruginosa PA01
cucaggucggcgcc

SEQ ID NO: 1529247 - RNA, 23 nt, Pseudomonas aeruginosa PA01
cuacggcaucaccggcgggaugu

SEQ ID NO: 1529248 - RNA, 20 nt, Pseudomonas aeruginosa PA01
cuacgguacaguucaggcug

SEQ ID NO: 1529249 - RNA, 21 nt, Pseudomonas aeruginosa PA01
cuacgguacaguucaggcugg

SEQ ID NO: 1529250 - RNA, 19 nt, Pseudomonas aeruginosa PA01
cuacggaggaaacccaugc

SEQ ID NO: 1529251 - RNA, 21 nt, Pseudomonas aeruginosa PA01
cuacggaggaaacccaugccc

SEQ ID NO: 1529252 - RNA, 15 nt, Pseudomonas aeruginosa PA01
cuacgaaagcgccuu

SEQ ID NO: 1529253 - RNA, 23 nt, Pseudomonas aeruginosa PA01
cuacgaaggcauauccccucuca

SEQ ID NO: 1529254 - RNA, 23 nt, Pseudomonas aeruginosa PA01
cuaccgucacgcggacccaguug

SEQ ID NO: 1529255 - RNA, 13 nt, Pseudomonas aeruginosa PA01
cuacguuccaggg

SEQ ID NO: 1529256 - RNA, 16 nt, Pseudomonas aeruginosa PA01
cuacguuccagggccu

SEQ ID NO: 1529257 - RNA, 15 nt, Pseudomonas aeruginosa PA01
cuagcccugcugcuc

SEQ ID NO: 1529258 - RNA, 12 nt, Pseudomonas aeruginosa PA01
cuagcgaaggcu

SEQ ID NO: 1529259 - RNA, 14 nt, Pseudomonas aeruginosa PA01
cuagcgccccggcc

SEQ ID NO: 1529260 - RNA, 15 nt, Pseudomonas aeruginosa PA01
cuauccuccaggccg

SEQ ID NO: 1529261 - RNA, 17 nt, Pseudomonas aeruginosa PA01
cuauccuccaggccgcc

SEQ ID NO: 1529262 - RNA, 15 nt, Pseudomonas aeruginosa PA01
cuaucgccgccgcag

SEQ ID NO: 1529263 - RNA, 19 nt, Pseudomonas aeruginosa PA01
cugauaccgcuggccaggu

SEQ ID NO: 1529264 - RNA, 19 nt, Pseudomonas aeruginosa PA01
cugauauucgacgguaugu

SEQ ID NO: 1529265 - RNA, 21 nt, Pseudomonas aeruginosa PA01
cugaucaguucggagaaggag

SEQ ID NO: 1529266 - RNA, 15 nt, Pseudomonas aeruginosa PA01
cugaucaucagcagg

SEQ ID NO: 1529267 - RNA, 21 nt, Pseudomonas aeruginosa PA01
cugaucaucagcagggucagg

SEQ ID NO: 1529268 - RNA, 12 nt, Pseudomonas aeruginosa PA01
cugaucaucugg

SEQ ID NO: 1529269 - RNA, 15 nt, Pseudomonas aeruginosa PA01
cugaucaucugggcc

SEQ ID NO: 1529270 - RNA, 16 nt, Pseudomonas aeruginosa PA01
cugaucaucugggcca

SEQ ID NO: 1529271 - RNA, 23 nt, Pseudomonas aeruginosa PA01
cucuaugcgcgggguaggggugg

SEQ ID NO: 1529272 - RNA, 22 nt, Pseudomonas aeruginosa PA01
cucuaucacacuguccagggcg

SEQ ID NO: 1529273 - RNA, 19 nt, Pseudomonas aeruginosa PA01
cugagcuguuucagcccac

SEQ ID NO: 1529274 - RNA, 17 nt, Pseudomonas aeruginosa PA01
cugagcuuaaggcaggu

SEQ ID NO: 1529275 - RNA, 16 nt, Pseudomonas aeruginosa PA01
cugagcugccgcuucg

SEQ ID NO: 1529276 - RNA, 19 nt, Pseudomonas aeruginosa PA01
cugaggauguagccggcuu

SEQ ID NO: 1529277 - RNA, 22 nt, Pseudomonas aeruginosa PA01
cugaggaucacgauggccggca

SEQ ID NO: 1529278 - RNA, 21 nt, Pseudomonas aeruginosa PA01
cugaggccgacgaacagccag

SEQ ID NO: 1529279 - RNA, 13 nt, Pseudomonas aeruginosa PA01
cugaggcguucca

SEQ ID NO: 1529280 - RNA, 21 nt, Pseudomonas aeruginosa PA01
cugaguuugcccagcgccgcc

SEQ ID NO: 1529281 - RNA, 12 nt, Pseudomonas aeruginosa PA01
cugaggggugag

SEQ ID NO: 1529282 - RNA, 17 nt, Pseudomonas aeruginosa PA01
cugcaggucgaggcgcu

SEQ ID NO: 1529283 - RNA, 20 nt, Pseudomonas aeruginosa PA01
cugcagguagcgcugcgccc

SEQ ID NO: 1529284 - RNA, 13 nt, Pseudomonas aeruginosa PA01
cugcagggcggcu

SEQ ID NO: 1529285 - RNA, 22 nt, Pseudomonas aeruginosa PA01
cugcagguggcguugcagggug

SEQ ID NO: 1529286 - RNA, 13 nt, Pseudomonas aeruginosa PA01
cugcaggcucagc

SEQ ID NO: 1529287 - RNA, 17 nt, Pseudomonas aeruginosa PA01
cugcaggcgcuccagac

SEQ ID NO: 1529288 - RNA, 14 nt, Pseudomonas aeruginosa PA01
cugcagggccaggg

SEQ ID NO: 1529289 - RNA, 18 nt, Pseudomonas aeruginosa PA01
cugcacggagugggccgc

SEQ ID NO: 1529290 - RNA, 21 nt, Pseudomonas aeruginosa PA01
cugcaaggcuucggcggucag

SEQ ID NO: 1529291 - RNA, 22 nt, Pseudomonas aeruginosa PA01
cugcaaggcuucggcggucagg

SEQ ID NO: 1529292 - RNA, 16 nt, Pseudomonas aeruginosa PA01
cugcaacuggccgaga

SEQ ID NO: 1529293 - RNA, 20 nt, Pseudomonas aeruginosa PA01
cugcaacucggcgucgcgcu

SEQ ID NO: 1529294 - RNA, 19 nt, Pseudomonas aeruginosa PA01
cugcaacguccucgcgccg

SEQ ID NO: 1529295 - RNA, 13 nt, Pseudomonas aeruginosa PA01
cugcaacgccagc

SEQ ID NO: 1529296 - RNA, 17 nt, Pseudomonas aeruginosa PA01
cugcaacgccuggugca

SEQ ID NO: 1529297 - RNA, 17 nt, Pseudomonas aeruginosa PA01
cugaucggccgccagug

SEQ ID NO: 1529298 - RNA, 19 nt, Pseudomonas aeruginosa PA01
cugccgaucgccgcgcggu

SEQ ID NO: 1529299 - RNA, 16 nt, Pseudomonas aeruginosa PA01
cugccgagcaggguca

SEQ ID NO: 1529300 - RNA, 15 nt, Pseudomonas aeruginosa PA01
cugccgagcaggugc

SEQ ID NO: 1529301 - RNA, 21 nt, Pseudomonas aeruginosa PA01
cugccgagaaucugcccggcc

SEQ ID NO: 1529302 - RNA, 11 nt, Pseudomonas aeruginosa PA01
cugcccggcuu

SEQ ID NO: 1529303 - RNA, 17 nt, Pseudomonas aeruginosa PA01
cugccgaacaggcgucc

SEQ ID NO: 1529304 - RNA, 22 nt, Pseudomonas aeruginosa PA01
cugccgaacaggcgucccaugg

SEQ ID NO: 1529305 - RNA, 16 nt, Pseudomonas aeruginosa PA01
cugccgaagggaaaca

SEQ ID NO: 1529306 - RNA, 20 nt, Pseudomonas aeruginosa PA01
cugccgaagggaaacaccag

SEQ ID NO: 1529307 - RNA, 22 nt, Pseudomonas aeruginosa PA01
cugccgaagaucgacaggccgc

SEQ ID NO: 1529308 - RNA, 13 nt, Pseudomonas aeruginosa PA01
cugccggccaggu

SEQ ID NO: 1529309 - RNA, 18 nt, Pseudomonas aeruginosa PA01
cugccgcucguuggcggc

SEQ ID NO: 1529310 - RNA, 15 nt, Pseudomonas aeruginosa PA01
cugccgcucuggcug

SEQ ID NO: 1529311 - RNA, 21 nt, Pseudomonas aeruginosa PA01
cugccgcucuggcugcuggcg

SEQ ID NO: 1529312 - RNA, 16 nt, Pseudomonas aeruginosa PA01
cugccgaugggccuuc

SEQ ID NO: 1529313 - RNA, 13 nt, Pseudomonas aeruginosa PA01
cugccguugcggc

SEQ ID NO: 1529314 - RNA, 18 nt, Pseudomonas aeruginosa PA01
cugccggcguccuugccg

SEQ ID NO: 1529315 - RNA, 18 nt, Pseudomonas aeruginosa PA01
cugccggcgucguccugc

SEQ ID NO: 1529316 - RNA, 23 nt, Pseudomonas aeruginosa PA01
cugccgguaauuggccaggcucg

SEQ ID NO: 1529317 - RNA, 23 nt, Pseudomonas aeruginosa PA01
cugccgggcguuuucguugccgc

SEQ ID NO: 1529318 - RNA, 20 nt, Pseudomonas aeruginosa PA01
cugccgggcucugguagccg

SEQ ID NO: 1529319 - RNA, 20 nt, Pseudomonas aeruginosa PA01
cugccgggcucuucggaggu

SEQ ID NO: 1529320 - RNA, 22 nt, Pseudomonas aeruginosa PA01
cugccgggcuuuuucaugggcg

SEQ ID NO: 1529321 - RNA, 13 nt, Pseudomonas aeruginosa PA01
cugccggugcucg

SEQ ID NO: 1529322 - RNA, 23 nt, Pseudomonas aeruginosa PA01
cugccggugugccgucaggcacc

SEQ ID NO: 1529323 - RNA, 21 nt, Pseudomonas aeruginosa PA01
cugccaccgagggcaggaacc

SEQ ID NO: 1529324 - RNA, 22 nt, Pseudomonas aeruginosa PA01
cugccaccgagggcaggaacca

SEQ ID NO: 1529325 - RNA, 23 nt, Pseudomonas aeruginosa PA01
cugccagaccgagauuggccgcc

SEQ ID NO: 1529326 - RNA, 19 nt, Pseudomonas aeruginosa PA01
cugccagaaggccugcgcu

SEQ ID NO: 1529327 - RNA, 14 nt, Pseudomonas aeruginosa PA01
cugccaguggcggc

SEQ ID NO: 1529328 - RNA, 20 nt, Pseudomonas aeruginosa PA01
cugccagguuggcaacugcg

SEQ ID NO: 1529329 - RNA, 23 nt, Pseudomonas aeruginosa PA01
cugccagguuggcaacugcgucc

SEQ ID NO: 1529330 - RNA, 14 nt, Pseudomonas aeruginosa PA01
cugccaggagcacg

SEQ ID NO: 1529331 - RNA, 15 nt, Pseudomonas aeruginosa PA01
cugccaggagcacgc

SEQ ID NO: 1529332 - RNA, 17 nt, Pseudomonas aeruginosa PA01
cugccaggagcacgccg

SEQ ID NO: 1529333 - RNA, 18 nt, Pseudomonas aeruginosa PA01
cugccaggagcacgccgu

SEQ ID NO: 1529334 - RNA, 12 nt, Pseudomonas aeruginosa PA01
cugccagcucuu

SEQ ID NO: 1529335 - RNA, 18 nt, Pseudomonas aeruginosa PA01
cugcccagcgccgccagc

SEQ ID NO: 1529336 - RNA, 14 nt, Pseudomonas aeruginosa PA01
cugcccagcccgcc

SEQ ID NO: 1529337 - RNA, 19 nt, Pseudomonas aeruginosa PA01
cugcccagcccgccuucca

SEQ ID NO: 1529338 - RNA, 21 nt, Pseudomonas aeruginosa PA01
cugcccagcccgccuuccagc

SEQ ID NO: 1529339 - RNA, 18 nt, Pseudomonas aeruginosa PA01
cugccaucgaugugagcc

SEQ ID NO: 1529340 - RNA, 14 nt, Pseudomonas aeruginosa PA01
cugcccaguugcgc

SEQ ID NO: 1529341 - RNA, 16 nt, Pseudomonas aeruginosa PA01
cugcccaucgccucca

SEQ ID NO: 1529342 - RNA, 17 nt, Pseudomonas aeruginosa PA01
cugcccaucgccuccac

SEQ ID NO: 1529343 - RNA, 18 nt, Pseudomonas aeruginosa PA01
cugcccaucgccuccacg

SEQ ID NO: 1529344 - RNA, 14 nt, Pseudomonas aeruginosa PA01
cugccccacaggcc

SEQ ID NO: 1529345 - RNA, 15 nt, Pseudomonas aeruginosa PA01
cugccccacaggccc

SEQ ID NO: 1529346 - RNA, 20 nt, Pseudomonas aeruginosa PA01
cugccccacaggcccugcag

SEQ ID NO: 1529347 - RNA, 13 nt, Pseudomonas aeruginosa PA01
cugccccacuucc

SEQ ID NO: 1529348 - RNA, 20 nt, Pseudomonas aeruginosa PA01
cugccccacuuccggcccgg

SEQ ID NO: 1529349 - RNA, 16 nt, Pseudomonas aeruginosa PA01
cugcccgccggcgccc

SEQ ID NO: 1529350 - RNA, 12 nt, Pseudomonas aeruginosa PA01
cugcccgcgccu

SEQ ID NO: 1529351 - RNA, 13 nt, Pseudomonas aeruginosa PA01
cugcccgcgccuc

SEQ ID NO: 1529352 - RNA, 15 nt, Pseudomonas aeruginosa PA01
cugcccgcgccucgc

SEQ ID NO: 1529353 - RNA, 19 nt, Pseudomonas aeruginosa PA01
cugcccggagcggcugccg

SEQ ID NO: 1529354 - RNA, 17 nt, Pseudomonas aeruginosa PA01
cugcccggcgcgacgcu

SEQ ID NO: 1529355 - RNA, 21 nt, Pseudomonas aeruginosa PA01
cugcccggcgcgacgcuccag

SEQ ID NO: 1529356 - RNA, 13 nt, Pseudomonas aeruginosa PA01
cugcgcgggacgc

SEQ ID NO: 1529357 - RNA, 20 nt, Pseudomonas aeruginosa PA01
cugcgcgggucguccuccac

SEQ ID NO: 1529358 - RNA, 17 nt, Pseudomonas aeruginosa PA01
cugcgcgccucuuccug

SEQ ID NO: 1529359 - RNA, 23 nt, Pseudomonas aeruginosa PA01
cugcgcgccucuuccuggaccuc

SEQ ID NO: 1529360 - RNA, 20 nt, Pseudomonas aeruginosa PA01
cugcgcgccaucuccucgcu

SEQ ID NO: 1529361 - RNA, 17 nt, Pseudomonas aeruginosa PA01
cugcgcgcaccaggccu

SEQ ID NO: 1529362 - RNA, 21 nt, Pseudomonas aeruginosa PA01
cugcgcgaagccaggaagcgg

SEQ ID NO: 1529363 - RNA, 13 nt, Pseudomonas aeruginosa PA01
cugcgccgcagcg

SEQ ID NO: 1529364 - RNA, 16 nt, Pseudomonas aeruginosa PA01
cugcgccgcagcggcc

SEQ ID NO: 1529365 - RNA, 15 nt, Pseudomonas aeruginosa PA01
cugccugcgcagggc

SEQ ID NO: 1529366 - RNA, 19 nt, Pseudomonas aeruginosa PA01
cugccugcgcagggcuucc

SEQ ID NO: 1529367 - RNA, 20 nt, Pseudomonas aeruginosa PA01
cugccucggaggccuuuucc

SEQ ID NO: 1529368 - RNA, 16 nt, Pseudomonas aeruginosa PA01
cugccugcaccgggcc

SEQ ID NO: 1529369 - RNA, 22 nt, Pseudomonas aeruginosa PA01
cugccucgguuuccggccaggc

SEQ ID NO: 1529370 - RNA, 16 nt, Pseudomonas aeruginosa PA01
cugcgcccccagcgcc

SEQ ID NO: 1529371 - RNA, 21 nt, Pseudomonas aeruginosa PA01
cugcgccccggucucgcgcag

SEQ ID NO: 1529372 - RNA, 22 nt, Pseudomonas aeruginosa PA01
cugcgccccggucucgcgcagc

SEQ ID NO: 1529373 - RNA, 23 nt, Pseudomonas aeruginosa PA01
cugcgccauucacuuccccuccc

SEQ ID NO: 1529374 - RNA, 13 nt, Pseudomonas aeruginosa PA01
cugcgcaggcugg

SEQ ID NO: 1529375 - RNA, 23 nt, Pseudomonas aeruginosa PA01
cugcgcaggcugguaugcagcaa

SEQ ID NO: 1529376 - RNA, 12 nt, Pseudomonas aeruginosa PA01
cugcgcagggcu

SEQ ID NO: 1529377 - RNA, 21 nt, Pseudomonas aeruginosa PA01
cugcgcagggcuuccuuggcg

SEQ ID NO: 1529378 - RNA, 13 nt, Pseudomonas aeruginosa PA01
cugcggaccacag

SEQ ID NO: 1529379 - RNA, 18 nt, Pseudomonas aeruginosa PA01
cugcggcuucgcgugcca

SEQ ID NO: 1529380 - RNA, 18 nt, Pseudomonas aeruginosa PA01
cugcggaucaacuccgcc

SEQ ID NO: 1529381 - RNA, 21 nt, Pseudomonas aeruginosa PA01
cugcgggaacuuggcgcgcag

SEQ ID NO: 1529382 - RNA, 17 nt, Pseudomonas aeruginosa PA01
cugcggaaaccgggaug

SEQ ID NO: 1529383 - RNA, 23 nt, Pseudomonas aeruginosa PA01
cugcggaagagguacggccuuca

SEQ ID NO: 1529384 - RNA, 19 nt, Pseudomonas aeruginosa PA01
cugcgggcguagcgcggca

SEQ ID NO: 1529385 - RNA, 17 nt, Pseudomonas aeruginosa PA01
cugcgggcugcgugcca

SEQ ID NO: 1529386 - RNA, 15 nt, Pseudomonas aeruginosa PA01
cugcggggcgcucag

SEQ ID NO: 1529387 - RNA, 19 nt, Pseudomonas aeruginosa PA01
cugcggggcgcucagggug

SEQ ID NO: 1529388 - RNA, 14 nt, Pseudomonas aeruginosa PA01
cugcgguaccagcg

SEQ ID NO: 1529389 - RNA, 20 nt, Pseudomonas aeruginosa PA01
cugcgguaccagcgcaccag

SEQ ID NO: 1529390 - RNA, 16 nt, Pseudomonas aeruginosa PA01
cugcggguucagucgg

SEQ ID NO: 1529391 - RNA, 20 nt, Pseudomonas aeruginosa PA01
cugcggguucggcgagaggu

SEQ ID NO: 1529392 - RNA, 16 nt, Pseudomonas aeruginosa PA01
cugcggucgggugaag

SEQ ID NO: 1529393 - RNA, 15 nt, Pseudomonas aeruginosa PA01
cugcgguaggugaug

SEQ ID NO: 1529394 - RNA, 15 nt, Pseudomonas aeruginosa PA01
cugcguucugcugcu

SEQ ID NO: 1529395 - RNA, 16 nt, Pseudomonas aeruginosa PA01
cugcguuucgccgggc

SEQ ID NO: 1529396 - RNA, 14 nt, Pseudomonas aeruginosa PA01
cugcgugcgccgcu

SEQ ID NO: 1529397 - RNA, 19 nt, Pseudomonas aeruginosa PA01
cugcguggaaccgcggcgc

SEQ ID NO: 1529398 - RNA, 17 nt, Pseudomonas aeruginosa PA01
cugcgguuuuccugccc

SEQ ID NO: 1529399 - RNA, 13 nt, Pseudomonas aeruginosa PA01
cugcgugccaggg

SEQ ID NO: 1529400 - RNA, 15 nt, Pseudomonas aeruginosa PA01
cugcgugccagggcu

SEQ ID NO: 1529401 - RNA, 23 nt, Pseudomonas aeruginosa PA01
cugguagucgcgguugcugugca

SEQ ID NO: 1529402 - RNA, 15 nt, Pseudomonas aeruginosa PA01
cugguagugcuggcg

SEQ ID NO: 1529403 - RNA, 15 nt, Pseudomonas aeruginosa PA01
cugguaggugcgcug

SEQ ID NO: 1529404 - RNA, 21 nt, Pseudomonas aeruginosa PA01
cugguaggugcgcuggcgcca

SEQ ID NO: 1529405 - RNA, 14 nt, Pseudomonas aeruginosa PA01
cugguagcuaccgu

SEQ ID NO: 1529406 - RNA, 19 nt, Pseudomonas aeruginosa PA01
cugguagcuaccgucggcc

SEQ ID NO: 1529407 - RNA, 22 nt, Pseudomonas aeruginosa PA01
cugguagcuaccgucggccugc

SEQ ID NO: 1529408 - RNA, 18 nt, Pseudomonas aeruginosa PA01
cugguaggccaugagguu

SEQ ID NO: 1529409 - RNA, 21 nt, Pseudomonas aeruginosa PA01
cugguagccgcaguccagggc

SEQ ID NO: 1529410 - RNA, 14 nt, Pseudomonas aeruginosa PA01
cugguagcccaggc

SEQ ID NO: 1529411 - RNA, 17 nt, Pseudomonas aeruginosa PA01
cugguaggacagggcca

SEQ ID NO: 1529412 - RNA, 19 nt, Pseudomonas aeruginosa PA01
cugguagcgggccaucagg

SEQ ID NO: 1529413 - RNA, 17 nt, Pseudomonas aeruginosa PA01
cugguagaaacgcuuga

SEQ ID NO: 1529414 - RNA, 16 nt, Pseudomonas aeruginosa PA01
cugguagaacuccuug

SEQ ID NO: 1529415 - RNA, 13 nt, Pseudomonas aeruginosa PA01
cugguacgccccc

SEQ ID NO: 1529416 - RNA, 22 nt, Pseudomonas aeruginosa PA01
cuggucaccgucugcaccgccc

SEQ ID NO: 1529417 - RNA, 16 nt, Pseudomonas aeruginosa PA01
cuggucaauaccaccc

SEQ ID NO: 1529418 - RNA, 18 nt, Pseudomonas aeruginosa PA01
cugguccucaauaccgaa

SEQ ID NO: 1529419 - RNA, 17 nt, Pseudomonas aeruginosa PA01
cugguccaccagcccgc

SEQ ID NO: 1529420 - RNA, 19 nt, Pseudomonas aeruginosa PA01
cuggucaguucggcccagc

SEQ ID NO: 1529421 - RNA, 13 nt, Pseudomonas aeruginosa PA01
cuggucguucagu

SEQ ID NO: 1529422 - RNA, 17 nt, Pseudomonas aeruginosa PA01
cuggucggccaguuccu

SEQ ID NO: 1529423 - RNA, 17 nt, Pseudomonas aeruginosa PA01
cuggucggcgcggcgcu

SEQ ID NO: 1529424 - RNA, 23 nt, Pseudomonas aeruginosa PA01
cuggucggcgcggcgcuccaggc

SEQ ID NO: 1529425 - RNA, 23 nt, Pseudomonas aeruginosa PA01
cuggucggggcgcaaggccagcg

SEQ ID NO: 1529426 - RNA, 18 nt, Pseudomonas aeruginosa PA01
cuggucgauccgcgccug

SEQ ID NO: 1529427 - RNA, 20 nt, Pseudomonas aeruginosa PA01
cuggucgauccgcgccugcu

SEQ ID NO: 1529428 - RNA, 21 nt, Pseudomonas aeruginosa PA01
cuggucgacauagcgcagcac

SEQ ID NO: 1529429 - RNA, 14 nt, Pseudomonas aeruginosa PA01
cugguccuuauucg

SEQ ID NO: 1529430 - RNA, 15 nt, Pseudomonas aeruginosa PA01
cuggugcccgaugcc

SEQ ID NO: 1529431 - RNA, 15 nt, Pseudomonas aeruginosa PA01
cuggugcaccuggcg

SEQ ID NO: 1529432 - RNA, 21 nt, Pseudomonas aeruginosa PA01
cuggugagcggaacgggacgc

SEQ ID NO: 1529433 - RNA, 14 nt, Pseudomonas aeruginosa PA01
cuggcggucgccgc

SEQ ID NO: 1529434 - RNA, 19 nt, Pseudomonas aeruginosa PA01
cuggcggucgccgccggcg

SEQ ID NO: 1529435 - RNA, 12 nt, Pseudomonas aeruginosa PA01
cuggcggcuggc

SEQ ID NO: 1529436 - RNA, 13 nt, Pseudomonas aeruginosa PA01
cuggcggcugagc

SEQ ID NO: 1529437 - RNA, 18 nt, Pseudomonas aeruginosa PA01
cuggcggcgcucacccac

SEQ ID NO: 1529438 - RNA, 19 nt, Pseudomonas aeruginosa PA01
cuggcggcguggcaccgcu

SEQ ID NO: 1529439 - RNA, 21 nt, Pseudomonas aeruginosa PA01
cuggcgucccggguucugcuc

SEQ ID NO: 1529440 - RNA, 24 nt, Pseudomonas aeruginosa PA01
cuggcguagcguugcgcgagcacc

SEQ ID NO: 1529441 - RNA, 23 nt, Pseudomonas aeruginosa PA01
cuggcguaccucgccaggcuggc

SEQ ID NO: 1529442 - RNA, 20 nt, Pseudomonas aeruginosa PA01
cuggcguagaagucguccuc

SEQ ID NO: 1529443 - RNA, 21 nt, Pseudomonas aeruginosa PA01
cuggcgucgaccgccugccag

SEQ ID NO: 1529444 - RNA, 17 nt, Pseudomonas aeruginosa PA01
cugggcgaccuucagcg

SEQ ID NO: 1529445 - RNA, 19 nt, Pseudomonas aeruginosa PA01
cugggcgacgcggacagcc

SEQ ID NO: 1529446 - RNA, 18 nt, Pseudomonas aeruginosa PA01
cugggcgaacagcaccca

SEQ ID NO: 1529447 - RNA, 13 nt, Pseudomonas aeruginosa PA01
cugggccuugagc

SEQ ID NO: 1529448 - RNA, 15 nt, Pseudomonas aeruginosa PA01
cugggccuugagcag

SEQ ID NO: 1529449 - RNA, 17 nt, Pseudomonas aeruginosa PA01
cugggccuugagcaggc

SEQ ID NO: 1529450 - RNA, 18 nt, Pseudomonas aeruginosa PA01
cugggccuugagcaggcg

SEQ ID NO: 1529451 - RNA, 20 nt, Pseudomonas aeruginosa PA01
cugggccuugaucaccacca

SEQ ID NO: 1529452 - RNA, 21 nt, Pseudomonas aeruginosa PA01
cugggccuuguucaggguggc

SEQ ID NO: 1529453 - RNA, 13 nt, Pseudomonas aeruginosa PA01
cugggcgcagccc

SEQ ID NO: 1529454 - RNA, 13 nt, Pseudomonas aeruginosa PA01
cugggcugggucg

SEQ ID NO: 1529455 - RNA, 14 nt, Pseudomonas aeruginosa PA01
cugggcgcccuuca

SEQ ID NO: 1529456 - RNA, 16 nt, Pseudomonas aeruginosa PA01
cugggcgccgccggug

SEQ ID NO: 1529457 - RNA, 13 nt, Pseudomonas aeruginosa PA01
cugggcgccggca

SEQ ID NO: 1529458 - RNA, 17 nt, Pseudomonas aeruginosa PA01
cugggcgccggcaggcc

SEQ ID NO: 1529459 - RNA, 23 nt, Pseudomonas aeruginosa PA01
cugggugucguuguugccgcgca

SEQ ID NO: 1529460 - RNA, 13 nt, Pseudomonas aeruginosa PA01
cugggugcuuucc

SEQ ID NO: 1529461 - RNA, 18 nt, Pseudomonas aeruginosa PA01
cugggugcuuuccugcuc

SEQ ID NO: 1529462 - RNA, 17 nt, Pseudomonas aeruginosa PA01
cuggguggaggcccaga

SEQ ID NO: 1529463 - RNA, 11 nt, Pseudomonas aeruginosa PA01
cugguacagca

SEQ ID NO: 1529464 - RNA, 20 nt, Pseudomonas aeruginosa PA01
cuggggaccgcaccuggugg

SEQ ID NO: 1529465 - RNA, 18 nt, Pseudomonas aeruginosa PA01
cugggcuucgcugaugcc

SEQ ID NO: 1529466 - RNA, 22 nt, Pseudomonas aeruginosa PA01
cugggcuucgcugaugccggcg

SEQ ID NO: 1529467 - RNA, 16 nt, Pseudomonas aeruginosa PA01
cugggcuucguccgcc

SEQ ID NO: 1529468 - RNA, 18 nt, Pseudomonas aeruginosa PA01
cugggcuucguccgccug

SEQ ID NO: 1529469 - RNA, 20 nt, Pseudomonas aeruginosa PA01
cugggcuucguccgccuggg

SEQ ID NO: 1529470 - RNA, 15 nt, Pseudomonas aeruginosa PA01
cuggggccggccugg

SEQ ID NO: 1529471 - RNA, 20 nt, Pseudomonas aeruginosa PA01
cuggggcaucucggccaccu

SEQ ID NO: 1529472 - RNA, 17 nt, Pseudomonas aeruginosa PA01
cuggguccuggugauca

SEQ ID NO: 1529473 - RNA, 22 nt, Pseudomonas aeruginosa PA01
cugggucgauuccugucuccgc

SEQ ID NO: 1529474 - RNA, 22 nt, Pseudomonas aeruginosa PA01
cugggucgcguacagcgggccg

SEQ ID NO: 1529475 - RNA, 14 nt, Pseudomonas aeruginosa PA01
cuguacgcaggagu

SEQ ID NO: 1529476 - RNA, 18 nt, Pseudomonas aeruginosa PA01
cuguaggugcccggcggg

SEQ ID NO: 1529477 - RNA, 19 nt, Pseudomonas aeruginosa PA01
cuguagugcuccggggcgc

SEQ ID NO: 1529478 - RNA, 20 nt, Pseudomonas aeruginosa PA01
cuguaguugauggauggcuu

SEQ ID NO: 1529479 - RNA, 22 nt, Pseudomonas aeruginosa PA01
cuguaguuguucggcugggcca

SEQ ID NO: 1529480 - RNA, 17 nt, Pseudomonas aeruginosa PA01
cuguagggucgcagcag

SEQ ID NO: 1529481 - RNA, 13 nt, Pseudomonas aeruginosa PA01
cuguaccgcuucc

SEQ ID NO: 1529482 - RNA, 19 nt, Pseudomonas aeruginosa PA01
cuguaccgcuuccugggcu

SEQ ID NO: 1529483 - RNA, 15 nt, Pseudomonas aeruginosa PA01
cuguaccaccgccau

SEQ ID NO: 1529484 - RNA, 12 nt, Pseudomonas aeruginosa PA01
cuguacagaaac

SEQ ID NO: 1529485 - RNA, 22 nt, Pseudomonas aeruginosa PA01
cuggugccgcuguaggacaggu

SEQ ID NO: 1529486 - RNA, 22 nt, Pseudomonas aeruginosa PA01
cuggugcccugggcggccucgu

SEQ ID NO: 1529487 - RNA, 12 nt, Pseudomonas aeruginosa PA01
cugucagggcuu

SEQ ID NO: 1529488 - RNA, 16 nt, Pseudomonas aeruginosa PA01
cugucacucaggcaug

SEQ ID NO: 1529489 - RNA, 20 nt, Pseudomonas aeruginosa PA01
cugucagcgcccggcugugc

SEQ ID NO: 1529490 - RNA, 16 nt, Pseudomonas aeruginosa PA01
cugucccgccgcgccg

SEQ ID NO: 1529491 - RNA, 19 nt, Pseudomonas aeruginosa PA01
cugucccgccgcgccgcuc

SEQ ID NO: 1529492 - RNA, 15 nt, Pseudomonas aeruginosa PA01
cugucguaguccugg

SEQ ID NO: 1529493 - RNA, 16 nt, Pseudomonas aeruginosa PA01
cugucgggggcugcgc

SEQ ID NO: 1529494 - RNA, 23 nt, Pseudomonas aeruginosa PA01
cugucgcggacccgcgccggcag

SEQ ID NO: 1529495 - RNA, 20 nt, Pseudomonas aeruginosa PA01
cugucgccguuggccuucac

SEQ ID NO: 1529496 - RNA, 14 nt, Pseudomonas aeruginosa PA01
cugucgcucagcgg

SEQ ID NO: 1529497 - RNA, 15 nt, Pseudomonas aeruginosa PA01
cugucgcuccggcag

SEQ ID NO: 1529498 - RNA, 18 nt, Pseudomonas aeruginosa PA01
cugucggagagggagcgc

SEQ ID NO: 1529499 - RNA, 19 nt, Pseudomonas aeruginosa PA01
cugucggagagggagcgcc

SEQ ID NO: 1529500 - RNA, 23 nt, Pseudomonas aeruginosa PA01
cugucggagagggagcgccuggc

SEQ ID NO: 1529501 - RNA, 16 nt, Pseudomonas aeruginosa PA01
cugucgauuucccccg

SEQ ID NO: 1529502 - RNA, 20 nt, Pseudomonas aeruginosa PA01
cugucccggccauuccuucc

SEQ ID NO: 1529503 - RNA, 21 nt, Pseudomonas aeruginosa PA01
cugucccggccauuccuucca

SEQ ID NO: 1529504 - RNA, 14 nt, Pseudomonas aeruginosa PA01
cugucccugggcca

SEQ ID NO: 1529505 - RNA, 14 nt, Pseudomonas aeruginosa PA01
cuguccgaccacuu

SEQ ID NO: 1529506 - RNA, 14 nt, Pseudomonas aeruginosa PA01
cugcuugaccacca

SEQ ID NO: 1529507 - RNA, 19 nt, Pseudomonas aeruginosa PA01
cugcuugaccuugcucuuc

SEQ ID NO: 1529508 - RNA, 13 nt, Pseudomonas aeruginosa PA01
cugcuugcgcacc

SEQ ID NO: 1529509 - RNA, 15 nt, Pseudomonas aeruginosa PA01
cugcuugcgcgccgc

SEQ ID NO: 1529510 - RNA, 16 nt, Pseudomonas aeruginosa PA01
cugcuugcgcgccgcc

SEQ ID NO: 1529511 - RNA, 19 nt, Pseudomonas aeruginosa PA01
cugcuugcgcgccgccgcc

SEQ ID NO: 1529512 - RNA, 12 nt, Pseudomonas aeruginosa PA01
cugcuuggccag

SEQ ID NO: 1529513 - RNA, 20 nt, Pseudomonas aeruginosa PA01
cugcuuggccagcgcggugc

SEQ ID NO: 1529514 - RNA, 16 nt, Pseudomonas aeruginosa PA01
cugcuuguccuuccag

SEQ ID NO: 1529515 - RNA, 15 nt, Pseudomonas aeruginosa PA01
cugcuuuccggccca

SEQ ID NO: 1529516 - RNA, 11 nt, Pseudomonas aeruginosa PA01
cugcucagcgc

SEQ ID NO: 1529517 - RNA, 14 nt, Pseudomonas aeruginosa PA01
cugcucagcgcgcu

SEQ ID NO: 1529518 - RNA, 20 nt, Pseudomonas aeruginosa PA01
cugcucagcgcgcucggccu

SEQ ID NO: 1529519 - RNA, 21 nt, Pseudomonas aeruginosa PA01
cugcucagcgcgcucggccug

SEQ ID NO: 1529520 - RNA, 22 nt, Pseudomonas aeruginosa PA01
cugcucagcgcgcucggccugg

SEQ ID NO: 1529521 - RNA, 20 nt, Pseudomonas aeruginosa PA01
cugcucagcggcccagcgcc

SEQ ID NO: 1529522 - RNA, 21 nt, Pseudomonas aeruginosa PA01
cugcucagcguccucagccuc

SEQ ID NO: 1529523 - RNA, 17 nt, Pseudomonas aeruginosa PA01
cugcucauucggccagc

SEQ ID NO: 1529524 - RNA, 20 nt, Pseudomonas aeruginosa PA01
cugcuucugguugcucacca

SEQ ID NO: 1529525 - RNA, 17 nt, Pseudomonas aeruginosa PA01
cugcuucugucccuggg

SEQ ID NO: 1529526 - RNA, 13 nt, Pseudomonas aeruginosa PA01
cugcuugaacacc

SEQ ID NO: 1529527 - RNA, 18 nt, Pseudomonas aeruginosa PA01
cuggacgugggaaaucac

SEQ ID NO: 1529528 - RNA, 12 nt, Pseudomonas aeruginosa PA01
cuggagcgccuc

SEQ ID NO: 1529529 - RNA, 16 nt, Pseudomonas aeruginosa PA01
cuggagcugcgcgcga

SEQ ID NO: 1529530 - RNA, 19 nt, Pseudomonas aeruginosa PA01
cuggagcagcagcgccgcg

SEQ ID NO: 1529531 - RNA, 14 nt, Pseudomonas aeruginosa PA01
cuggagcagaaccg

SEQ ID NO: 1529532 - RNA, 17 nt, Pseudomonas aeruginosa PA01
cuggacgcgcuuguccu

SEQ ID NO: 1529533 - RNA, 12 nt, Pseudomonas aeruginosa PA01
cuggaccuggcc

SEQ ID NO: 1529534 - RNA, 19 nt, Pseudomonas aeruginosa PA01
cuggacgaacgagaagccg

SEQ ID NO: 1529535 - RNA, 13 nt, Pseudomonas aeruginosa PA01
cuggacgaaggcc

SEQ ID NO: 1529536 - RNA, 13 nt, Pseudomonas aeruginosa PA01
cuggaccuccgcc

SEQ ID NO: 1529537 - RNA, 20 nt, Pseudomonas aeruginosa PA01
cuggacccgggccuccuggc

SEQ ID NO: 1529538 - RNA, 14 nt, Pseudomonas aeruginosa PA01
cuggaccccgcccu

SEQ ID NO: 1529539 - RNA, 20 nt, Pseudomonas aeruginosa PA01
cuggacaagguuugcgccgc

SEQ ID NO: 1529540 - RNA, 14 nt, Pseudomonas aeruginosa PA01
cuggacacggucca

SEQ ID NO: 1529541 - RNA, 15 nt, Pseudomonas aeruginosa PA01
cuggacaggcgcagg

SEQ ID NO: 1529542 - RNA, 20 nt, Pseudomonas aeruginosa PA01
cuggaccaccguggcgccgg

SEQ ID NO: 1529543 - RNA, 18 nt, Pseudomonas aeruginosa PA01
cuggaccaguucagcgcg

SEQ ID NO: 1529544 - RNA, 19 nt, Pseudomonas aeruginosa PA01
cuggaccaguucagcgcgc

SEQ ID NO: 1529545 - RNA, 14 nt, Pseudomonas aeruginosa PA01
cuggaacggccagg

SEQ ID NO: 1529546 - RNA, 15 nt, Pseudomonas aeruginosa PA01
cuggaacggccaggu

SEQ ID NO: 1529547 - RNA, 15 nt, Pseudomonas aeruginosa PA01
cuggaacagcgcguc

SEQ ID NO: 1529548 - RNA, 23 nt, Pseudomonas aeruginosa PA01
cuggaacaccaggccgcaagcgg

SEQ ID NO: 1529549 - RNA, 14 nt, Pseudomonas aeruginosa PA01
cuggaacuggucgg

SEQ ID NO: 1529550 - RNA, 14 nt, Pseudomonas aeruginosa PA01
cuggaacuagcccu

SEQ ID NO: 1529551 - RNA, 18 nt, Pseudomonas aeruginosa PA01
cuggaaaugguucaugaa

SEQ ID NO: 1529552 - RNA, 18 nt, Pseudomonas aeruginosa PA01
cuggaaaucggcguccug

SEQ ID NO: 1529553 - RNA, 15 nt, Pseudomonas aeruginosa PA01
cuggaaggcgcuggg

SEQ ID NO: 1529554 - RNA, 13 nt, Pseudomonas aeruginosa PA01
cuggaagcggguu

SEQ ID NO: 1529555 - RNA, 16 nt, Pseudomonas aeruginosa PA01
cuggaagccugccaga

SEQ ID NO: 1529556 - RNA, 19 nt, Pseudomonas aeruginosa PA01
cuggaagaaggcgaucauc

SEQ ID NO: 1529557 - RNA, 14 nt, Pseudomonas aeruginosa PA01
cuggaagccgcgcu

SEQ ID NO: 1529558 - RNA, 18 nt, Pseudomonas aeruginosa PA01
cuggaauaccccgcggac

SEQ ID NO: 1529559 - RNA, 20 nt, Pseudomonas aeruginosa PA01
cuggaagucgcccugcccgg

SEQ ID NO: 1529560 - RNA, 19 nt, Pseudomonas aeruginosa PA01
cuggaauucgccgcgcgcc

SEQ ID NO: 1529561 - RNA, 20 nt, Pseudomonas aeruginosa PA01
cuggaauucgccgcgcgcca

SEQ ID NO: 1529562 - RNA, 15 nt, Pseudomonas aeruginosa PA01
cuggcaggcucaccg

SEQ ID NO: 1529563 - RNA, 17 nt, Pseudomonas aeruginosa PA01
cuggagguucggcaggu

SEQ ID NO: 1529564 - RNA, 23 nt, Pseudomonas aeruginosa PA01
cuggagcuugccggcgacgccgu

SEQ ID NO: 1529565 - RNA, 21 nt, Pseudomonas aeruginosa PA01
cuggauaagccgcgccaucgg

SEQ ID NO: 1529566 - RNA, 19 nt, Pseudomonas aeruginosa PA01
cuggauacgcuuggccagg

SEQ ID NO: 1529567 - RNA, 15 nt, Pseudomonas aeruginosa PA01
cuggauacgggcgcc

SEQ ID NO: 1529568 - RNA, 18 nt, Pseudomonas aeruginosa PA01
cuggauacgggcgccagg

SEQ ID NO: 1529569 - RNA, 19 nt, Pseudomonas aeruginosa PA01
cuggauacgggcgccaggg

SEQ ID NO: 1529570 - RNA, 13 nt, Pseudomonas aeruginosa PA01
cuggccacgccau

SEQ ID NO: 1529571 - RNA, 14 nt, Pseudomonas aeruginosa PA01
cuggccaccgccag

SEQ ID NO: 1529572 - RNA, 22 nt, Pseudomonas aeruginosa PA01
cuggccaccgggaucagcggcg

SEQ ID NO: 1529573 - RNA, 13 nt, Pseudomonas aeruginosa PA01
cuggccacccuug

SEQ ID NO: 1529574 - RNA, 17 nt, Pseudomonas aeruginosa PA01
cuggccacccuuggagc

SEQ ID NO: 1529575 - RNA, 16 nt, Pseudomonas aeruginosa PA01
cuggccaccagcaccu

SEQ ID NO: 1529576 - RNA, 12 nt, Pseudomonas aeruginosa PA01
cuggcagucguc

SEQ ID NO: 1529577 - RNA, 14 nt, Pseudomonas aeruginosa PA01
cuggcagucgucgc

SEQ ID NO: 1529578 - RNA, 16 nt, Pseudomonas aeruginosa PA01
cuggcagugcgccggc

SEQ ID NO: 1529579 - RNA, 18 nt, Pseudomonas aeruginosa PA01
cuggcaguugcaguaccu

SEQ ID NO: 1529580 - RNA, 22 nt, Pseudomonas aeruginosa PA01
cuggcaguugcaguaccugcuc

SEQ ID NO: 1529581 - RNA, 15 nt, Pseudomonas aeruginosa PA01
cuggcagguccgacg

SEQ ID NO: 1529582 - RNA, 21 nt, Pseudomonas aeruginosa PA01
cuggcagguugauccugggcg

SEQ ID NO: 1529583 - RNA, 17 nt, Pseudomonas aeruginosa PA01
cuggcgcugggccuuga

SEQ ID NO: 1529584 - RNA, 18 nt, Pseudomonas aeruginosa PA01
cuggcgcugggccuugag

SEQ ID NO: 1529585 - RNA, 18 nt, Pseudomonas aeruginosa PA01
cuggcgcucagcgccgcu

SEQ ID NO: 1529586 - RNA, 20 nt, Pseudomonas aeruginosa PA01
cuggcgcucagcgccgcuuc

SEQ ID NO: 1529587 - RNA, 18 nt, Pseudomonas aeruginosa PA01
cuggcgcguugugccgcc

SEQ ID NO: 1529588 - RNA, 20 nt, Pseudomonas aeruginosa PA01
cuggcgcguugugccgccac

SEQ ID NO: 1529589 - RNA, 21 nt, Pseudomonas aeruginosa PA01
cuggcgcuaccgcgcauggcg

SEQ ID NO: 1529590 - RNA, 18 nt, Pseudomonas aeruginosa PA01
cuggcgaugcccuggccg

SEQ ID NO: 1529591 - RNA, 13 nt, Pseudomonas aeruginosa PA01
cuggcgcgcgccc

SEQ ID NO: 1529592 - RNA, 22 nt, Pseudomonas aeruginosa PA01
cuggcgcgucgcugccgccgcg

SEQ ID NO: 1529593 - RNA, 14 nt, Pseudomonas aeruginosa PA01
cuggcgcgucggcc

SEQ ID NO: 1529594 - RNA, 19 nt, Pseudomonas aeruginosa PA01
cuggcgcuugccgcgcccg

SEQ ID NO: 1529595 - RNA, 20 nt, Pseudomonas aeruginosa PA01
cuggcgcuguaggcgagcag

SEQ ID NO: 1529596 - RNA, 19 nt, Pseudomonas aeruginosa PA01
cuggcggcaucggcgccgc

SEQ ID NO: 1529597 - RNA, 13 nt, Pseudomonas aeruginosa PA01
cuggcggccaggg

SEQ ID NO: 1529598 - RNA, 18 nt, Pseudomonas aeruginosa PA01
cuggcccugcaacaggac

SEQ ID NO: 1529599 - RNA, 22 nt, Pseudomonas aeruginosa PA01
cuggcccugcaacaggacccag

SEQ ID NO: 1529600 - RNA, 18 nt, Pseudomonas aeruginosa PA01
cuggccgucggccugcuu

SEQ ID NO: 1529601 - RNA, 12 nt, Pseudomonas aeruginosa PA01
cuggccucguug

SEQ ID NO: 1529602 - RNA, 13 nt, Pseudomonas aeruginosa PA01
cuggccuggccac

SEQ ID NO: 1529603 - RNA, 14 nt, Pseudomonas aeruginosa PA01
cuggccuggccacc

SEQ ID NO: 1529604 - RNA, 15 nt, Pseudomonas aeruginosa PA01
cuggccuggccaccc

SEQ ID NO: 1529605 - RNA, 16 nt, Pseudomonas aeruginosa PA01
cuggcgaucaccaggg

SEQ ID NO: 1529606 - RNA, 23 nt, Pseudomonas aeruginosa PA01
cuggcgaucaccagggugcgcuc

SEQ ID NO: 1529607 - RNA, 16 nt, Pseudomonas aeruginosa PA01
cuggcgaucucggcgc

SEQ ID NO: 1529608 - RNA, 19 nt, Pseudomonas aeruginosa PA01
cuggcgaucaucgcgcacu

SEQ ID NO: 1529609 - RNA, 14 nt, Pseudomonas aeruginosa PA01
cuggcgaucaugcc

SEQ ID NO: 1529610 - RNA, 13 nt, Pseudomonas aeruginosa PA01
cuggcgagcaggg

SEQ ID NO: 1529611 - RNA, 21 nt, Pseudomonas aeruginosa PA01
cuggcgagcgucgagucgcgc

SEQ ID NO: 1529612 - RNA, 18 nt, Pseudomonas aeruginosa PA01
cuggcgaggaacacccag

SEQ ID NO: 1529613 - RNA, 21 nt, Pseudomonas aeruginosa PA01
cuggcgauguagcugccggcg

SEQ ID NO: 1529614 - RNA, 17 nt, Pseudomonas aeruginosa PA01
cuggcgcaacagaucuu

SEQ ID NO: 1529615 - RNA, 17 nt, Pseudomonas aeruginosa PA01
cuggcgauucuccuggg

SEQ ID NO: 1529616 - RNA, 14 nt, Pseudomonas aeruginosa PA01
cuggcgccuggccu

SEQ ID NO: 1529617 - RNA, 20 nt, Pseudomonas aeruginosa PA01
cuggcgcaacgccggcaggu

SEQ ID NO: 1529618 - RNA, 20 nt, Pseudomonas aeruginosa PA01
cuggcgcaacugcgccagcc

SEQ ID NO: 1529619 - RNA, 13 nt, Pseudomonas aeruginosa PA01
cuucugucuuguc

SEQ ID NO: 1529620 - RNA, 14 nt, Pseudomonas aeruginosa PA01
cuucugucuugucc

SEQ ID NO: 1529621 - RNA, 20 nt, Pseudomonas aeruginosa PA01
cuucuuccccgccacuucca

SEQ ID NO: 1529622 - RNA, 19 nt, Pseudomonas aeruginosa PA01
cuucuucccgcccaucaac

SEQ ID NO: 1529623 - RNA, 22 nt, Pseudomonas aeruginosa PA01
cuucuugucgagguagguccag

SEQ ID NO: 1529624 - RNA, 18 nt, Pseudomonas aeruginosa PA01
cuucucuuucaccugguc

SEQ ID NO: 1529625 - RNA, 16 nt, Pseudomonas aeruginosa PA01
cuucugcagggcggcu

SEQ ID NO: 1529626 - RNA, 23 nt, Pseudomonas aeruginosa PA01
cuucugcagggcggcuuccaggu

SEQ ID NO: 1529627 - RNA, 13 nt, Pseudomonas aeruginosa PA01
cuucugcgccucc

SEQ ID NO: 1529628 - RNA, 16 nt, Pseudomonas aeruginosa PA01
cuucugcgccuccucg

SEQ ID NO: 1529629 - RNA, 19 nt, Pseudomonas aeruginosa PA01
cuucugcuggauccucgcc

SEQ ID NO: 1529630 - RNA, 18 nt, Pseudomonas aeruginosa PA01
cuucugcuggccgcgcag

SEQ ID NO: 1529631 - RNA, 22 nt, Pseudomonas aeruginosa PA01
cuucugcuggccgcgcaggaag

SEQ ID NO: 1529632 - RNA, 19 nt, Pseudomonas aeruginosa PA01
cuucucccagaagucgcug

SEQ ID NO: 1529633 - RNA, 17 nt, Pseudomonas aeruginosa PA01
cuucgcgggccaggccg

SEQ ID NO: 1529634 - RNA, 23 nt, Pseudomonas aeruginosa PA01
cuucuccgauuccugcggcuugc

SEQ ID NO: 1529635 - RNA, 18 nt, Pseudomonas aeruginosa PA01
cuucuccgccagccagcc

SEQ ID NO: 1529636 - RNA, 21 nt, Pseudomonas aeruginosa PA01
cuucucgaagcgcgccugcuc

SEQ ID NO: 1529637 - RNA, 24 nt, Pseudomonas aeruginosa PA01
cuucucgaagcgcgccugcucuuc

SEQ ID NO: 1529638 - RNA, 17 nt, Pseudomonas aeruginosa PA01
cuucucgaacagcuccu

SEQ ID NO: 1529639 - RNA, 15 nt, Pseudomonas aeruginosa PA01
cuucucgucgaaggu

SEQ ID NO: 1529640 - RNA, 24 nt, Pseudomonas aeruginosa PA01
cuugaguucccagaccuggccgcu

SEQ ID NO: 1529641 - RNA, 20 nt, Pseudomonas aeruginosa PA01
cuugaggucguccaccucca

SEQ ID NO: 1529642 - RNA, 15 nt, Pseudomonas aeruginosa PA01
cuugcacaccugguc

SEQ ID NO: 1529643 - RNA, 18 nt, Pseudomonas aeruginosa PA01
cuugauggugugcagcag

SEQ ID NO: 1529644 - RNA, 20 nt, Pseudomonas aeruginosa PA01
cuugauggugugcagcagca

SEQ ID NO: 1529645 - RNA, 17 nt, Pseudomonas aeruginosa PA01
cuugaacagggucuugu

SEQ ID NO: 1529646 - RNA, 20 nt, Pseudomonas aeruginosa PA01
cuugagcaggguguugauca

SEQ ID NO: 1529647 - RNA, 15 nt, Pseudomonas aeruginosa PA01
cuugagccuugcccc

SEQ ID NO: 1529648 - RNA, 15 nt, Pseudomonas aeruginosa PA01
cuugagcggcgcccu

SEQ ID NO: 1529649 - RNA, 12 nt, Pseudomonas aeruginosa PA01
cuugagcuggcg

SEQ ID NO: 1529650 - RNA, 18 nt, Pseudomonas aeruginosa PA01
cuugaggaugucgcggcu

SEQ ID NO: 1529651 - RNA, 14 nt, Pseudomonas aeruginosa PA01
cuugaggcgggcca

SEQ ID NO: 1529652 - RNA, 18 nt, Pseudomonas aeruginosa PA01
cuugaggcgggccagcag

SEQ ID NO: 1529653 - RNA, 18 nt, Pseudomonas aeruginosa PA01
cuugaaaaucaaggauuu

SEQ ID NO: 1529654 - RNA, 22 nt, Pseudomonas aeruginosa PA01
cuugcagguagcugcuccagcc

SEQ ID NO: 1529655 - RNA, 11 nt, Pseudomonas aeruginosa PA01
cuugccggcau

SEQ ID NO: 1529656 - RNA, 15 nt, Pseudomonas aeruginosa PA01
cuugccggccgccag

SEQ ID NO: 1529657 - RNA, 18 nt, Pseudomonas aeruginosa PA01
cuugccggccgccagcag

SEQ ID NO: 1529658 - RNA, 13 nt, Pseudomonas aeruginosa PA01
cuugccggcgccu

SEQ ID NO: 1529659 - RNA, 22 nt, Pseudomonas aeruginosa PA01
cuugccgguuuguugcaggcug

SEQ ID NO: 1529660 - RNA, 17 nt, Pseudomonas aeruginosa PA01
cuugccguccagccggc

SEQ ID NO: 1529661 - RNA, 15 nt, Pseudomonas aeruginosa PA01
cuugccguccagcga

SEQ ID NO: 1529662 - RNA, 16 nt, Pseudomonas aeruginosa PA01
cuugcaggaguaggca

SEQ ID NO: 1529663 - RNA, 16 nt, Pseudomonas aeruginosa PA01
cuugcagcaccgccug

SEQ ID NO: 1529664 - RNA, 19 nt, Pseudomonas aeruginosa PA01
cuugccguugcucacgccg

SEQ ID NO: 1529665 - RNA, 22 nt, Pseudomonas aeruginosa PA01
cuugcgcaugguuaccucguug

SEQ ID NO: 1529666 - RNA, 14 nt, Pseudomonas aeruginosa PA01
cuugcgccaggccu

SEQ ID NO: 1529667 - RNA, 13 nt, Pseudomonas aeruginosa PA01
cuugcgcccggcg

SEQ ID NO: 1529668 - RNA, 16 nt, Pseudomonas aeruginosa PA01
cuugcgcgccaccagc

SEQ ID NO: 1529669 - RNA, 13 nt, Pseudomonas aeruginosa PA01
cuugcgcucuggc

SEQ ID NO: 1529670 - RNA, 13 nt, Pseudomonas aeruginosa PA01
cuugcgcgcggcg

SEQ ID NO: 1529671 - RNA, 22 nt, Pseudomonas aeruginosa PA01
cuugcugaucagguugccggcg

SEQ ID NO: 1529672 - RNA, 12 nt, Pseudomonas aeruginosa PA01
cuugcucuucug

SEQ ID NO: 1529673 - RNA, 18 nt, Pseudomonas aeruginosa PA01
cuugcugaagcccaggcg

SEQ ID NO: 1529674 - RNA, 14 nt, Pseudomonas aeruginosa PA01
cuugcugaagcccc

SEQ ID NO: 1529675 - RNA, 18 nt, Pseudomonas aeruginosa PA01
cuugcggcaguccucgcc

SEQ ID NO: 1529676 - RNA, 21 nt, Pseudomonas aeruginosa PA01
cuugcgucccugggccugcag

SEQ ID NO: 1529677 - RNA, 13 nt, Pseudomonas aeruginosa PA01
cuugcguuccucc

SEQ ID NO: 1529678 - RNA, 18 nt, Pseudomonas aeruginosa PA01
cuugcguucgcuccaguc

SEQ ID NO: 1529679 - RNA, 20 nt, Pseudomonas aeruginosa PA01
cuuguuggccagcagccagg

SEQ ID NO: 1529680 - RNA, 15 nt, Pseudomonas aeruginosa PA01
cuuguugagcuggcc

SEQ ID NO: 1529681 - RNA, 22 nt, Pseudomonas aeruginosa PA01
cuuguugcgcuccacccaggcg

SEQ ID NO: 1529682 - RNA, 16 nt, Pseudomonas aeruginosa PA01
cuuguuccaggcguug

SEQ ID NO: 1529683 - RNA, 19 nt, Pseudomonas aeruginosa PA01
cuuguuuuccuggcccugg

SEQ ID NO: 1529684 - RNA, 22 nt, Pseudomonas aeruginosa PA01
cuugugcugcucgcagagggcg

SEQ ID NO: 1529685 - RNA, 19 nt, Pseudomonas aeruginosa PA01
cuuguccaggguuuccugg

SEQ ID NO: 1529686 - RNA, 14 nt, Pseudomonas aeruginosa PA01
cuuguccagggccg

SEQ ID NO: 1529687 - RNA, 13 nt, Pseudomonas aeruginosa PA01
cuuguccaccacc

SEQ ID NO: 1529688 - RNA, 15 nt, Pseudomonas aeruginosa PA01
cuuguccggcccgga

SEQ ID NO: 1529689 - RNA, 21 nt, Pseudomonas aeruginosa PA01
cuuguccggcccggagcgcga

SEQ ID NO: 1529690 - RNA, 21 nt, Pseudomonas aeruginosa PA01
cuuguccucaucggggcugcu

SEQ ID NO: 1529691 - RNA, 14 nt, Pseudomonas aeruginosa PA01
cuuucaggugggcc

SEQ ID NO: 1529692 - RNA, 13 nt, Pseudomonas aeruginosa PA01
cuuucaggcgcuc

SEQ ID NO: 1529693 - RNA, 15 nt, Pseudomonas aeruginosa PA01
cuuucgcucaggccu

SEQ ID NO: 1529694 - RNA, 16 nt, Pseudomonas aeruginosa PA01
cuuucgcucaggccuc

SEQ ID NO: 1529695 - RNA, 16 nt, Pseudomonas aeruginosa PA01
cuuucgaagcgcuccc

SEQ ID NO: 1529696 - RNA, 23 nt, Pseudomonas aeruginosa PA01
cuuuccggcccacgcucagugcg

SEQ ID NO: 1529697 - RNA, 24 nt, Pseudomonas aeruginosa PA01
cuuuccggcgcggccugcagcgac

SEQ ID NO: 1529698 - RNA, 17 nt, Pseudomonas aeruginosa PA01
cuuuccugcgccucguc

SEQ ID NO: 1529699 - RNA, 16 nt, Pseudomonas aeruginosa PA01
cuuuccugcuccagca

SEQ ID NO: 1529700 - RNA, 17 nt, Pseudomonas aeruginosa PA01
cuuuccuggccgacccg

SEQ ID NO: 1529701 - RNA, 18 nt, Pseudomonas aeruginosa PA01
cuuuccuggccgacccgc

SEQ ID NO: 1529702 - RNA, 16 nt, Pseudomonas aeruginosa PA01
cuuuccagggccuggc

SEQ ID NO: 1529703 - RNA, 18 nt, Pseudomonas aeruginosa PA01
cuuccaguucguugcucu

SEQ ID NO: 1529704 - RNA, 22 nt, Pseudomonas aeruginosa PA01
cuuccagguaguccagcuccuc

SEQ ID NO: 1529705 - RNA, 16 nt, Pseudomonas aeruginosa PA01
cuuccgcgcugaccug

SEQ ID NO: 1529706 - RNA, 17 nt, Pseudomonas aeruginosa PA01
cuuccgcgcccaggcug

SEQ ID NO: 1529707 - RNA, 20 nt, Pseudomonas aeruginosa PA01
cuuccgcgcccaggcugccg

SEQ ID NO: 1529708 - RNA, 15 nt, Pseudomonas aeruginosa PA01
cuuccgccggcgccg

SEQ ID NO: 1529709 - RNA, 16 nt, Pseudomonas aeruginosa PA01
cuuccgccucgcgccg

SEQ ID NO: 1529710 - RNA, 20 nt, Pseudomonas aeruginosa PA01
cuuccgccgacugcaacugg

SEQ ID NO: 1529711 - RNA, 20 nt, Pseudomonas aeruginosa PA01
cuuccgccaggcgcagccag

SEQ ID NO: 1529712 - RNA, 19 nt, Pseudomonas aeruginosa PA01
cuuccgacucuccgcgccg

SEQ ID NO: 1529713 - RNA, 12 nt, Pseudomonas aeruginosa PA01
cuuccgacuggu

SEQ ID NO: 1529714 - RNA, 21 nt, Pseudomonas aeruginosa PA01
cuucccagacguccagcgcca

SEQ ID NO: 1529715 - RNA, 17 nt, Pseudomonas aeruginosa PA01
cuucccacuccagcgcg

SEQ ID NO: 1529716 - RNA, 18 nt, Pseudomonas aeruginosa PA01
cuucgcaaagcgagcgcc

SEQ ID NO: 1529717 - RNA, 17 nt, Pseudomonas aeruginosa PA01
cuuccugcacgcugcgc

SEQ ID NO: 1529718 - RNA, 14 nt, Pseudomonas aeruginosa PA01
cuuccucgcugccu

SEQ ID NO: 1529719 - RNA, 16 nt, Pseudomonas aeruginosa PA01
cuuccucgcugccuac

SEQ ID NO: 1529720 - RNA, 19 nt, Pseudomonas aeruginosa PA01
cuuccucggacuugcucca

SEQ ID NO: 1529721 - RNA, 16 nt, Pseudomonas aeruginosa PA01
cuuccuccucgccgcu

SEQ ID NO: 1529722 - RNA, 19 nt, Pseudomonas aeruginosa PA01
cuuccucggugucggccaa

SEQ ID NO: 1529723 - RNA, 21 nt, Pseudomonas aeruginosa PA01
cuuccugaaggcgcggggcga

SEQ ID NO: 1529724 - RNA, 21 nt, Pseudomonas aeruginosa PA01
cuuccggacugcccagcgccg

SEQ ID NO: 1529725 - RNA, 20 nt, Pseudomonas aeruginosa PA01
cuuccggcagccagccgccg

SEQ ID NO: 1529726 - RNA, 18 nt, Pseudomonas aeruginosa PA01
cuucgcgcagcucggcca

SEQ ID NO: 1529727 - RNA, 23 nt, Pseudomonas aeruginosa PA01
cuucgcgcgggguggccgugcag

SEQ ID NO: 1529728 - RNA, 15 nt, Pseudomonas aeruginosa PA01
cuucgcgcuccaggc

SEQ ID NO: 1529729 - RNA, 18 nt, Pseudomonas aeruginosa PA01
cuucgccgcccgcgccuc

SEQ ID NO: 1529730 - RNA, 14 nt, Pseudomonas aeruginosa PA01
cuucgccggccugc

SEQ ID NO: 1529731 - RNA, 21 nt, Pseudomonas aeruginosa PA01
cuucgccggguguuuuuccuc

SEQ ID NO: 1529732 - RNA, 22 nt, Pseudomonas aeruginosa PA01
cuucgccggguguuuuuccucg

SEQ ID NO: 1529733 - RNA, 18 nt, Pseudomonas aeruginosa PA01
cuucgccuccuucaucuu

SEQ ID NO: 1529734 - RNA, 17 nt, Pseudomonas aeruginosa PA01
cuucgccuugcccuggc

SEQ ID NO: 1529735 - RNA, 14 nt, Pseudomonas aeruginosa PA01
cuucgccuggcgcg

SEQ ID NO: 1529736 - RNA, 16 nt, Pseudomonas aeruginosa PA01
cuucgcccgccgccug

SEQ ID NO: 1529737 - RNA, 12 nt, Pseudomonas aeruginosa PA01
cuucgcccggcu

SEQ ID NO: 1529738 - RNA, 13 nt, Pseudomonas aeruginosa PA01
cuucgcccggcuc

SEQ ID NO: 1529739 - RNA, 22 nt, Pseudomonas aeruginosa PA01
cuucgccaguuccuugaggucg

SEQ ID NO: 1529740 - RNA, 15 nt, Pseudomonas aeruginosa PA01
cuucgcauuccaccu

SEQ ID NO: 1529741 - RNA, 15 nt, Pseudomonas aeruginosa PA01
cuucgcaccagccgg

SEQ ID NO: 1529742 - RNA, 18 nt, Pseudomonas aeruginosa PA01
cuucgcaccagccggccg

SEQ ID NO: 1529743 - RNA, 14 nt, Pseudomonas aeruginosa PA01
cuucagcuucuacu

SEQ ID NO: 1529744 - RNA, 18 nt, Pseudomonas aeruginosa PA01
cuucagcgguggcguugu

SEQ ID NO: 1529745 - RNA, 23 nt, Pseudomonas aeruginosa PA01
cuucaggagggaacgucuggcca

SEQ ID NO: 1529746 - RNA, 17 nt, Pseudomonas aeruginosa PA01
cuucaggccgcaguccg

SEQ ID NO: 1529747 - RNA, 22 nt, Pseudomonas aeruginosa PA01
cuucaggcgcgcggccagcgcg

SEQ ID NO: 1529748 - RNA, 19 nt, Pseudomonas aeruginosa PA01
cuucaggcgcuccuugagc

SEQ ID NO: 1529749 - RNA, 23 nt, Pseudomonas aeruginosa PA01
cuucaggcgcuccuugagcagcu

SEQ ID NO: 1529750 - RNA, 18 nt, Pseudomonas aeruginosa PA01
cuucaggcgugggccagc

SEQ ID NO: 1529751 - RNA, 22 nt, Pseudomonas aeruginosa PA01
cuucaggcgugggccagcccag

SEQ ID NO: 1529752 - RNA, 21 nt, Pseudomonas aeruginosa PA01
cuucaguaggccagcggcucc

SEQ ID NO: 1529753 - RNA, 23 nt, Pseudomonas aeruginosa PA01
cuucagguagcucaucggcgaca

SEQ ID NO: 1529754 - RNA, 23 nt, Pseudomonas aeruginosa PA01
cuucagguagugcaacaccuggc

SEQ ID NO: 1529755 - RNA, 17 nt, Pseudomonas aeruginosa PA01
cuucaggguggcgcugc

SEQ ID NO: 1529756 - RNA, 16 nt, Pseudomonas aeruginosa PA01
cuucagguaaggcacc

SEQ ID NO: 1529757 - RNA, 23 nt, Pseudomonas aeruginosa PA01
cuucagguaaggcaccaccgccg

SEQ ID NO: 1529758 - RNA, 14 nt, Pseudomonas aeruginosa PA01
cuucaucaccuugc

SEQ ID NO: 1529759 - RNA, 15 nt, Pseudomonas aeruginosa PA01
cuucaucaccuugcc

SEQ ID NO: 1529760 - RNA, 16 nt, Pseudomonas aeruginosa PA01
cuucaucaccuugccc

SEQ ID NO: 1529761 - RNA, 21 nt, Pseudomonas aeruginosa PA01
cuucaucgaggugcuugacag

SEQ ID NO: 1529762 - RNA, 13 nt, Pseudomonas aeruginosa PA01
cuucauccugcgc

SEQ ID NO: 1529763 - RNA, 23 nt, Pseudomonas aeruginosa PA01
cuucaucaggcggcacucggcga

SEQ ID NO: 1529764 - RNA, 13 nt, Pseudomonas aeruginosa PA01
cuucaccacccca

SEQ ID NO: 1529765 - RNA, 17 nt, Pseudomonas aeruginosa PA01
cuucaccaccccacaaa

SEQ ID NO: 1529766 - RNA, 21 nt, Pseudomonas aeruginosa PA01
cuucacauggugggcgccgcu

SEQ ID NO: 1529767 - RNA, 14 nt, Pseudomonas aeruginosa PA01
cuucagcacgccca

SEQ ID NO: 1529768 - RNA, 20 nt, Pseudomonas aeruginosa PA01
cuucagcaacucuuccaggg

SEQ ID NO: 1529769 - RNA, 16 nt, Pseudomonas aeruginosa PA01
cuucagcagcaggcgc

SEQ ID NO: 1529770 - RNA, 23 nt, Pseudomonas aeruginosa PA01
cuucagccagaccggcagcgccg

SEQ ID NO: 1529771 - RNA, 14 nt, Pseudomonas aeruginosa PA01
cuucagccccagca

SEQ ID NO: 1529772 - RNA, 15 nt, Pseudomonas aeruginosa PA01
cuucagcgccuccag

SEQ ID NO: 1529773 - RNA, 20 nt, Pseudomonas aeruginosa PA01
cuucagcgccuccagcaccg

SEQ ID NO: 1529774 - RNA, 23 nt, Pseudomonas aeruginosa PA01
cuucagagcagggugaagcugcg

SEQ ID NO: 1529775 - RNA, 21 nt, Pseudomonas aeruginosa PA01
cuucacguaguugacccgccc

SEQ ID NO: 1529776 - RNA, 23 nt, Pseudomonas aeruginosa PA01
cuucacguaguugacccgccccu

SEQ ID NO: 1529777 - RNA, 19 nt, Pseudomonas aeruginosa PA01
cuguugccagggauacuca

SEQ ID NO: 1529778 - RNA, 16 nt, Pseudomonas aeruginosa PA01
cuguugcccugggccg

SEQ ID NO: 1529779 - RNA, 18 nt, Pseudomonas aeruginosa PA01
cugucuccgcaccuaccc

SEQ ID NO: 1529780 - RNA, 17 nt, Pseudomonas aeruginosa PA01
cugucucgccagcccgg

SEQ ID NO: 1529781 - RNA, 20 nt, Pseudomonas aeruginosa PA01
cuguucgcugccuuccuuuu

SEQ ID NO: 1529782 - RNA, 13 nt, Pseudomonas aeruginosa PA01
cugucgugccucc

SEQ ID NO: 1529783 - RNA, 17 nt, Pseudomonas aeruginosa PA01
cugucgugccuccagcc

SEQ ID NO: 1529784 - RNA, 18 nt, Pseudomonas aeruginosa PA01
cugucgugccuccagccu

SEQ ID NO: 1529785 - RNA, 22 nt, Pseudomonas aeruginosa PA01
cugucuaucccgugccgggcca

SEQ ID NO: 1529786 - RNA, 22 nt, Pseudomonas aeruginosa PA01
cuguucgucuggcgccuggccu

SEQ ID NO: 1529787 - RNA, 18 nt, Pseudomonas aeruginosa PA01
cuguuucggguccaggcg

SEQ ID NO: 1529788 - RNA, 19 nt, Pseudomonas aeruginosa PA01
cuguuucggguccaggcgc

SEQ ID NO: 1529789 - RNA, 15 nt, Pseudomonas aeruginosa PA01
gaauauuucccauau

SEQ ID NO: 1529790 - RNA, 21 nt, Pseudomonas aeruginosa PA01
gaauaacucagcaucagugcu

SEQ ID NO: 1529791 - RNA, 20 nt, Pseudomonas aeruginosa PA01
gaauacgcgguugguuuugc

SEQ ID NO: 1529792 - RNA, 22 nt, Pseudomonas aeruginosa PA01
gaauaccgccagcucgcugucc

SEQ ID NO: 1529793 - RNA, 23 nt, Pseudomonas aeruginosa PA01
gaauaccugcgaauugcgcugga

SEQ ID NO: 1529794 - RNA, 21 nt, Pseudomonas aeruginosa PA01
gaaggguuggccgcagcagcg

SEQ ID NO: 1529795 - RNA, 16 nt, Pseudomonas aeruginosa PA01
gaaggggaaaccgagc

SEQ ID NO: 1529796 - RNA, 15 nt, Pseudomonas aeruginosa PA01
gaagggaucgaccgg

SEQ ID NO: 1529797 - RNA, 13 nt, Pseudomonas aeruginosa PA01
gaagggaacccgc

SEQ ID NO: 1529798 - RNA, 15 nt, Pseudomonas aeruginosa PA01
gaagggaaacaccag

SEQ ID NO: 1529799 - RNA, 12 nt, Pseudomonas aeruginosa PA01
gaagggcucagc

SEQ ID NO: 1529800 - RNA, 19 nt, Pseudomonas aeruginosa PA01
gaagggccgcagguuggcc

SEQ ID NO: 1529801 - RNA, 15 nt, Pseudomonas aeruginosa PA01
gaagggcaggccgau

SEQ ID NO: 1529802 - RNA, 14 nt, Pseudomonas aeruginosa PA01
gaaggcgugccgcu

SEQ ID NO: 1529803 - RNA, 16 nt, Pseudomonas aeruginosa PA01
gaaggcgucauccgcc

SEQ ID NO: 1529804 - RNA, 17 nt, Pseudomonas aeruginosa PA01
gaaggcgucauccgcca

SEQ ID NO: 1529805 - RNA, 14 nt, Pseudomonas aeruginosa PA01
gaaggcguccaggg

SEQ ID NO: 1529806 - RNA, 16 nt, Pseudomonas aeruginosa PA01
gaaggcgucggcuucg

SEQ ID NO: 1529807 - RNA, 15 nt, Pseudomonas aeruginosa PA01
gaaggcugccgggcu

SEQ ID NO: 1529808 - RNA, 18 nt, Pseudomonas aeruginosa PA01
gaaggcugccgggcucug

SEQ ID NO: 1529809 - RNA, 13 nt, Pseudomonas aeruginosa PA01
gaaggcuuccugg

SEQ ID NO: 1529810 - RNA, 15 nt, Pseudomonas aeruginosa PA01
gaaggcuucuuccug

SEQ ID NO: 1529811 - RNA, 18 nt, Pseudomonas aeruginosa PA01
gaaggcuccgcugcucag

SEQ ID NO: 1529812 - RNA, 16 nt, Pseudomonas aeruginosa PA01
gaaggcgcggggcgag

SEQ ID NO: 1529813 - RNA, 19 nt, Pseudomonas aeruginosa PA01
gaaggcgcuccggaacgcc

SEQ ID NO: 1529814 - RNA, 12 nt, Pseudomonas aeruginosa PA01
gaaggcgcuggc

SEQ ID NO: 1529815 - RNA, 11 nt, Pseudomonas aeruginosa PA01
gaaggcgccuu

SEQ ID NO: 1529816 - RNA, 14 nt, Pseudomonas aeruginosa PA01
gaaggcggauggcg

SEQ ID NO: 1529817 - RNA, 17 nt, Pseudomonas aeruginosa PA01
gaaggcggcagcgguga

SEQ ID NO: 1529818 - RNA, 16 nt, Pseudomonas aeruginosa PA01
gaaggcgccggcauug

SEQ ID NO: 1529819 - RNA, 16 nt, Pseudomonas aeruginosa PA01
gaaggcgaagccguug

SEQ ID NO: 1529820 - RNA, 20 nt, Pseudomonas aeruginosa PA01
gaaggccucggucaggcgcu

SEQ ID NO: 1529821 - RNA, 23 nt, Pseudomonas aeruginosa PA01
gaaggccucggucaggcgcuggu

SEQ ID NO: 1529822 - RNA, 18 nt, Pseudomonas aeruginosa PA01
gaaggccucgucgcccgg

SEQ ID NO: 1529823 - RNA, 17 nt, Pseudomonas aeruginosa PA01
gaagguuucguccccuu

SEQ ID NO: 1529824 - RNA, 19 nt, Pseudomonas aeruginosa PA01
gaagguggcgaccugguag

SEQ ID NO: 1529825 - RNA, 19 nt, Pseudomonas aeruginosa PA01
gaaggucggcggcagcugc

SEQ ID NO: 1529826 - RNA, 20 nt, Pseudomonas aeruginosa PA01
gaagguccuugggccaggca

SEQ ID NO: 1529827 - RNA, 19 nt, Pseudomonas aeruginosa PA01
gaaggucuugcccaacucc

SEQ ID NO: 1529828 - RNA, 20 nt, Pseudomonas aeruginosa PA01
gaagguaauguucuccuccc

SEQ ID NO: 1529829 - RNA, 16 nt, Pseudomonas aeruginosa PA01
gaaggugcaggccgcg

SEQ ID NO: 1529830 - RNA, 21 nt, Pseudomonas aeruginosa PA01
gaaguaguacugguccggguu

SEQ ID NO: 1529831 - RNA, 15 nt, Pseudomonas aeruginosa PA01
gaagucugccugucc

SEQ ID NO: 1529832 - RNA, 14 nt, Pseudomonas aeruginosa PA01
gaagugcgcugcuu

SEQ ID NO: 1529833 - RNA, 17 nt, Pseudomonas aeruginosa PA01
gaagucggcggccgccu

SEQ ID NO: 1529834 - RNA, 19 nt, Pseudomonas aeruginosa PA01
gaagucggcguaggccagu

SEQ ID NO: 1529835 - RNA, 15 nt, Pseudomonas aeruginosa PA01
gaagucgcuggccug

SEQ ID NO: 1529836 - RNA, 16 nt, Pseudomonas aeruginosa PA01
gaagucgcuggccugg

SEQ ID NO: 1529837 - RNA, 13 nt, Pseudomonas aeruginosa PA01
gaagucguccagc

SEQ ID NO: 1529838 - RNA, 21 nt, Pseudomonas aeruginosa PA01
gaagucgucguccaucgccgc

SEQ ID NO: 1529839 - RNA, 17 nt, Pseudomonas aeruginosa PA01
gaagucgacgaucuguu

SEQ ID NO: 1529840 - RNA, 17 nt, Pseudomonas aeruginosa PA01
gaagucgagcuggugga

SEQ ID NO: 1529841 - RNA, 22 nt, Pseudomonas aeruginosa PA01
gaagucgcagucguagcgcagu

SEQ ID NO: 1529842 - RNA, 18 nt, Pseudomonas aeruginosa PA01
gaaguauuucaaccaggc

SEQ ID NO: 1529843 - RNA, 17 nt, Pseudomonas aeruginosa PA01
gaaguccuggccgagca

SEQ ID NO: 1529844 - RNA, 23 nt, Pseudomonas aeruginosa PA01
gaaguucaccucggugagguagc

SEQ ID NO: 1529845 - RNA, 22 nt, Pseudomonas aeruginosa PA01
gaaguugccgccagcgcggcgc

SEQ ID NO: 1529846 - RNA, 13 nt, Pseudomonas aeruginosa PA01
gaaguguuacagc

SEQ ID NO: 1529847 - RNA, 16 nt, Pseudomonas aeruginosa PA01
gaaguuaucggggcca

SEQ ID NO: 1529848 - RNA, 16 nt, Pseudomonas aeruginosa PA01
gaauccagggccgagc

SEQ ID NO: 1529849 - RNA, 21 nt, Pseudomonas aeruginosa PA01
gaauccagggccgagcacagg

SEQ ID NO: 1529850 - RNA, 18 nt, Pseudomonas aeruginosa PA01
gaaucccuuggcugcucg

SEQ ID NO: 1529851 - RNA, 14 nt, Pseudomonas aeruginosa PA01
gaaucccccccucu

SEQ ID NO: 1529852 - RNA, 23 nt, Pseudomonas aeruginosa PA01
gaaucgcagccaugaaaaagccg

SEQ ID NO: 1529853 - RNA, 15 nt, Pseudomonas aeruginosa PA01
gaauccuccgccagc

SEQ ID NO: 1529854 - RNA, 19 nt, Pseudomonas aeruginosa PA01
gaauccuguccguccgaac

SEQ ID NO: 1529855 - RNA, 21 nt, Pseudomonas aeruginosa PA01
gaauccggucggacuccgccc

SEQ ID NO: 1529856 - RNA, 21 nt, Pseudomonas aeruginosa PA01
gaaucaccacucgccagcgcg

SEQ ID NO: 1529857 - RNA, 19 nt, Pseudomonas aeruginosa PA01
gaaucacgucgaucugcuc

SEQ ID NO: 1529858 - RNA, 23 nt, Pseudomonas aeruginosa PA01
gaaucgucacggcgugccgcagg

SEQ ID NO: 1529859 - RNA, 13 nt, Pseudomonas aeruginosa PA01
gaaucgccagcag

SEQ ID NO: 1529860 - RNA, 15 nt, Pseudomonas aeruginosa PA01
gaaucgccagcaggc

SEQ ID NO: 1529861 - RNA, 19 nt, Pseudomonas aeruginosa PA01
gaaucucccgcaggcgcuu

SEQ ID NO: 1529862 - RNA, 13 nt, Pseudomonas aeruginosa PA01
gaaugaagaagcc

SEQ ID NO: 1529863 - RNA, 14 nt, Pseudomonas aeruginosa PA01
gaaugaagaagccc

SEQ ID NO: 1529864 - RNA, 13 nt, Pseudomonas aeruginosa PA01
gaaugaaaaaggg

SEQ ID NO: 1529865 - RNA, 13 nt, Pseudomonas aeruginosa PA01
gaauggcagcagg

SEQ ID NO: 1529866 - RNA, 15 nt, Pseudomonas aeruginosa PA01
gaauggcagcaggca

SEQ ID NO: 1529867 - RNA, 15 nt, Pseudomonas aeruginosa PA01
gaauggacaggcgcc

SEQ ID NO: 1529868 - RNA, 15 nt, Pseudomonas aeruginosa PA01
gaaugcgccucccgc

SEQ ID NO: 1529869 - RNA, 18 nt, Pseudomonas aeruginosa PA01
gaaugcuccggggucagu

SEQ ID NO: 1529870 - RNA, 16 nt, Pseudomonas aeruginosa PA01
gaaugcuugccggcgc

SEQ ID NO: 1529871 - RNA, 14 nt, Pseudomonas aeruginosa PA01
gaaugcggcgugga

SEQ ID NO: 1529872 - RNA, 11 nt, Pseudomonas aeruginosa PA01
gaaugccuucg

SEQ ID NO: 1529873 - RNA, 21 nt, Pseudomonas aeruginosa PA01
gaaugccggccggggccggca

SEQ ID NO: 1529874 - RNA, 13 nt, Pseudomonas aeruginosa PA01
gaauuucacgccg

SEQ ID NO: 1529875 - RNA, 11 nt, Pseudomonas aeruginosa PA01
gaauugcugac

SEQ ID NO: 1529876 - RNA, 16 nt, Pseudomonas aeruginosa PA01
gaauugggucugcugg

SEQ ID NO: 1529877 - RNA, 14 nt, Pseudomonas aeruginosa PA01
gaauugcgcacgca

SEQ ID NO: 1529878 - RNA, 14 nt, Pseudomonas aeruginosa PA01
gaauucgucgccgc

SEQ ID NO: 1529879 - RNA, 19 nt, Pseudomonas aeruginosa PA01
gaauuccagcaggucggca

SEQ ID NO: 1529880 - RNA, 16 nt, Pseudomonas aeruginosa PA01
gaauuccgauuucagc

SEQ ID NO: 1529881 - RNA, 14 nt, Pseudomonas aeruginosa PA01
gaaccgauggccag

SEQ ID NO: 1529882 - RNA, 23 nt, Pseudomonas aeruginosa PA01
gaaccgauggccagggggccugg

SEQ ID NO: 1529883 - RNA, 15 nt, Pseudomonas aeruginosa PA01
gaaccgacgcgcagg

SEQ ID NO: 1529884 - RNA, 19 nt, Pseudomonas aeruginosa PA01
gaaccgagacccuggcgcu

SEQ ID NO: 1529885 - RNA, 21 nt, Pseudomonas aeruginosa PA01
gaacccggcuuuuuucgcccg

SEQ ID NO: 1529886 - RNA, 22 nt, Pseudomonas aeruginosa PA01
gaacccggcuuuuuucgcccgu

SEQ ID NO: 1529887 - RNA, 16 nt, Pseudomonas aeruginosa PA01
gaaccggccggcaggc

SEQ ID NO: 1529888 - RNA, 20 nt, Pseudomonas aeruginosa PA01
gaaccgcgagaccccggcgg

SEQ ID NO: 1529889 - RNA, 17 nt, Pseudomonas aeruginosa PA01
gaaccccgaacuucccc

SEQ ID NO: 1529890 - RNA, 15 nt, Pseudomonas aeruginosa PA01
gaaccacaccagguc

SEQ ID NO: 1529891 - RNA, 14 nt, Pseudomonas aeruginosa PA01
gaaccacaccugca

SEQ ID NO: 1529892 - RNA, 17 nt, Pseudomonas aeruginosa PA01
gaaccacugcgccaugc

SEQ ID NO: 1529893 - RNA, 13 nt, Pseudomonas aeruginosa PA01
gaaccagcagcag

SEQ ID NO: 1529894 - RNA, 17 nt, Pseudomonas aeruginosa PA01
gaaccaguugccgagcu

SEQ ID NO: 1529895 - RNA, 15 nt, Pseudomonas aeruginosa PA01
gaaccagugcgcggu

SEQ ID NO: 1529896 - RNA, 21 nt, Pseudomonas aeruginosa PA01
gaaccagcucagcuccaggcc

SEQ ID NO: 1529897 - RNA, 20 nt, Pseudomonas aeruginosa PA01
gaacgagaagccgaucaggu

SEQ ID NO: 1529898 - RNA, 16 nt, Pseudomonas aeruginosa PA01
gaacgagcccaggcag

SEQ ID NO: 1529899 - RNA, 15 nt, Pseudomonas aeruginosa PA01
gaacgaugccgcagg

SEQ ID NO: 1529900 - RNA, 16 nt, Pseudomonas aeruginosa PA01
gaacgccucugcgcug

SEQ ID NO: 1529901 - RNA, 22 nt, Pseudomonas aeruginosa PA01
gaacgccgggcaacgccaggcc

SEQ ID NO: 1529902 - RNA, 21 nt, Pseudomonas aeruginosa PA01
gaacgccgggucuucaguggg

SEQ ID NO: 1529903 - RNA, 12 nt, Pseudomonas aeruginosa PA01
gaacgccaggca

SEQ ID NO: 1529904 - RNA, 18 nt, Pseudomonas aeruginosa PA01
gaacgcccgcggcagcag

SEQ ID NO: 1529905 - RNA, 19 nt, Pseudomonas aeruginosa PA01
gaacgcccgcggcagcagc

SEQ ID NO: 1529906 - RNA, 23 nt, Pseudomonas aeruginosa PA01
gaacgcccuuguagaucgacagc

SEQ ID NO: 1529907 - RNA, 17 nt, Pseudomonas aeruginosa PA01
gaacgccgcagcucggc

SEQ ID NO: 1529908 - RNA, 14 nt, Pseudomonas aeruginosa PA01
gaaccucggcaggc

SEQ ID NO: 1529909 - RNA, 14 nt, Pseudomonas aeruginosa PA01
gaacgacagcacca

SEQ ID NO: 1529910 - RNA, 21 nt, Pseudomonas aeruginosa PA01
gaacgacagcaccaugcccuu

SEQ ID NO: 1529911 - RNA, 14 nt, Pseudomonas aeruginosa PA01
gaacgaagaagccg

SEQ ID NO: 1529912 - RNA, 20 nt, Pseudomonas aeruginosa PA01
gaacgaagaagccggccccu

SEQ ID NO: 1529913 - RNA, 20 nt, Pseudomonas aeruginosa PA01
gaacgacuccagcuucuucu

SEQ ID NO: 1529914 - RNA, 21 nt, Pseudomonas aeruginosa PA01
gaacggaucgcucucgcgcuu

SEQ ID NO: 1529915 - RNA, 12 nt, Pseudomonas aeruginosa PA01
gaacggcgcggu

SEQ ID NO: 1529916 - RNA, 16 nt, Pseudomonas aeruginosa PA01
gaacggcgcuucaacu

SEQ ID NO: 1529917 - RNA, 12 nt, Pseudomonas aeruginosa PA01
gaacgggaagua

SEQ ID NO: 1529918 - RNA, 17 nt, Pseudomonas aeruginosa PA01
gaacggguugaucaggu

SEQ ID NO: 1529919 - RNA, 19 nt, Pseudomonas aeruginosa PA01
gaacgcgcccggccaggcc

SEQ ID NO: 1529920 - RNA, 19 nt, Pseudomonas aeruginosa PA01
gaacgcgugaagcuggagc

SEQ ID NO: 1529921 - RNA, 21 nt, Pseudomonas aeruginosa PA01
gaacgcguaggggaccacccc

SEQ ID NO: 1529922 - RNA, 16 nt, Pseudomonas aeruginosa PA01
gaacuucaggccggcg

SEQ ID NO: 1529923 - RNA, 15 nt, Pseudomonas aeruginosa PA01
gaacugcacccgccg

SEQ ID NO: 1529924 - RNA, 21 nt, Pseudomonas aeruginosa PA01
gaacugcucgaaagccuccag

SEQ ID NO: 1529925 - RNA, 22 nt, Pseudomonas aeruginosa PA01
gaacugcucggcguccagcagg

SEQ ID NO: 1529926 - RNA, 16 nt, Pseudomonas aeruginosa PA01
gaacuggaagccugcc

SEQ ID NO: 1529927 - RNA, 18 nt, Pseudomonas aeruginosa PA01
gaacuggaagccugccag

SEQ ID NO: 1529928 - RNA, 22 nt, Pseudomonas aeruginosa PA01
gaacugggcgagcaucuucuuc

SEQ ID NO: 1529929 - RNA, 20 nt, Pseudomonas aeruginosa PA01
gaacuggaucggccccaccu

SEQ ID NO: 1529930 - RNA, 20 nt, Pseudomonas aeruginosa PA01
gaacucgacuucuucgcugg

SEQ ID NO: 1529931 - RNA, 14 nt, Pseudomonas aeruginosa PA01
gaacucaugcaggc

SEQ ID NO: 1529932 - RNA, 15 nt, Pseudomonas aeruginosa PA01
gaacucaugcaggcc

SEQ ID NO: 1529933 - RNA, 22 nt, Pseudomonas aeruginosa PA01
gaacuccaccgguuucgccagu

SEQ ID NO: 1529934 - RNA, 23 nt, Pseudomonas aeruginosa PA01
gaacuccgccagcaccacccggc

SEQ ID NO: 1529935 - RNA, 14 nt, Pseudomonas aeruginosa PA01
gaacuccgccagcu

SEQ ID NO: 1529936 - RNA, 15 nt, Pseudomonas aeruginosa PA01
gaacucgugcugcuu

SEQ ID NO: 1529937 - RNA, 19 nt, Pseudomonas aeruginosa PA01
gaacucggcgccgaucucc

SEQ ID NO: 1529938 - RNA, 16 nt, Pseudomonas aeruginosa PA01
gaacucguagacgaau

SEQ ID NO: 1529939 - RNA, 19 nt, Pseudomonas aeruginosa PA01
gaagcggcucggccagggc

SEQ ID NO: 1529940 - RNA, 18 nt, Pseudomonas aeruginosa PA01
gaagcggucguagcccau

SEQ ID NO: 1529941 - RNA, 19 nt, Pseudomonas aeruginosa PA01
gaagcgugggcggccggcc

SEQ ID NO: 1529942 - RNA, 20 nt, Pseudomonas aeruginosa PA01
gaagcucaccuugaagccuu

SEQ ID NO: 1529943 - RNA, 16 nt, Pseudomonas aeruginosa PA01
gaagcugacgaacauc

SEQ ID NO: 1529944 - RNA, 22 nt, Pseudomonas aeruginosa PA01
gaagcuggcgcaacugcgccag

SEQ ID NO: 1529945 - RNA, 18 nt, Pseudomonas aeruginosa PA01
gaagcugccccacaggcc

SEQ ID NO: 1529946 - RNA, 13 nt, Pseudomonas aeruginosa PA01
gaagcugccggca

SEQ ID NO: 1529947 - RNA, 19 nt, Pseudomonas aeruginosa PA01
gaagcugccuuccagcagg

SEQ ID NO: 1529948 - RNA, 17 nt, Pseudomonas aeruginosa PA01
gaaggacugugccugga

SEQ ID NO: 1529949 - RNA, 14 nt, Pseudomonas aeruginosa PA01
gaagcuguuggcca

SEQ ID NO: 1529950 - RNA, 15 nt, Pseudomonas aeruginosa PA01
gaagcuucgcugggu

SEQ ID NO: 1529951 - RNA, 12 nt, Pseudomonas aeruginosa PA01
gaaggccaggcc

SEQ ID NO: 1529952 - RNA, 16 nt, Pseudomonas aeruginosa PA01
gaaggccaggccggcg

SEQ ID NO: 1529953 - RNA, 17 nt, Pseudomonas aeruginosa PA01
gaaggccgcggucgggc

SEQ ID NO: 1529954 - RNA, 17 nt, Pseudomonas aeruginosa PA01
gaaggccacgccgccgu

SEQ ID NO: 1529955 - RNA, 14 nt, Pseudomonas aeruginosa PA01
gaaggaucgagcca

SEQ ID NO: 1529956 - RNA, 18 nt, Pseudomonas aeruginosa PA01
gaagcggccgaccaggcc

SEQ ID NO: 1529957 - RNA, 21 nt, Pseudomonas aeruginosa PA01
gaagcggccgagcaccacgcg

SEQ ID NO: 1529958 - RNA, 20 nt, Pseudomonas aeruginosa PA01
gaagcgcucgcgcuuccggc

SEQ ID NO: 1529959 - RNA, 20 nt, Pseudomonas aeruginosa PA01
gaagcgcgcgccagucccgc

SEQ ID NO: 1529960 - RNA, 20 nt, Pseudomonas aeruginosa PA01
gaagcgcgcgguacccagcu

SEQ ID NO: 1529961 - RNA, 17 nt, Pseudomonas aeruginosa PA01
gaagcgcucggucagcu

SEQ ID NO: 1529962 - RNA, 18 nt, Pseudomonas aeruginosa PA01
gaagcgcuucugcaggcc

SEQ ID NO: 1529963 - RNA, 16 nt, Pseudomonas aeruginosa PA01
gaagcgcuugcccagg

SEQ ID NO: 1529964 - RNA, 14 nt, Pseudomonas aeruginosa PA01
gaagcgcaggugca

SEQ ID NO: 1529965 - RNA, 18 nt, Pseudomonas aeruginosa PA01
gaagcgcaguacccggcc

SEQ ID NO: 1529966 - RNA, 13 nt, Pseudomonas aeruginosa PA01
gaagcgccgggcc

SEQ ID NO: 1529967 - RNA, 16 nt, Pseudomonas aeruginosa PA01
gaagcgccgggccgca

SEQ ID NO: 1529968 - RNA, 20 nt, Pseudomonas aeruginosa PA01
gaagcgcccucgcugagcag

SEQ ID NO: 1529969 - RNA, 14 nt, Pseudomonas aeruginosa PA01
gaagcgauccagcg

SEQ ID NO: 1529970 - RNA, 14 nt, Pseudomonas aeruginosa PA01
gaagcgcggcggcg

SEQ ID NO: 1529971 - RNA, 22 nt, Pseudomonas aeruginosa PA01
gaagcgcgaguaguaggucggu

SEQ ID NO: 1529972 - RNA, 22 nt, Pseudomonas aeruginosa PA01
gaagccgucggcgaucgccagu

SEQ ID NO: 1529973 - RNA, 19 nt, Pseudomonas aeruginosa PA01
gaagcgaccgaucaugccc

SEQ ID NO: 1529974 - RNA, 13 nt, Pseudomonas aeruginosa PA01
gaagcgacugcgc

SEQ ID NO: 1529975 - RNA, 14 nt, Pseudomonas aeruginosa PA01
gaagcgaaccaggc

SEQ ID NO: 1529976 - RNA, 15 nt, Pseudomonas aeruginosa PA01
gaagcgaaccaggca

SEQ ID NO: 1529977 - RNA, 14 nt, Pseudomonas aeruginosa PA01
gaagcgcagcaggu

SEQ ID NO: 1529978 - RNA, 22 nt, Pseudomonas aeruginosa PA01
gaagcgcaccaccugcaugcuu

SEQ ID NO: 1529979 - RNA, 11 nt, Pseudomonas aeruginosa PA01
gaagcccagcg

SEQ ID NO: 1529980 - RNA, 15 nt, Pseudomonas aeruginosa PA01
gaagcccagcgagcc

SEQ ID NO: 1529981 - RNA, 23 nt, Pseudomonas aeruginosa PA01
gaagcccagcgccugcaaagagg

SEQ ID NO: 1529982 - RNA, 22 nt, Pseudomonas aeruginosa PA01
gaagcccagggugacgcucuuc

SEQ ID NO: 1529983 - RNA, 13 nt, Pseudomonas aeruginosa PA01
gaagccccgcagc

SEQ ID NO: 1529984 - RNA, 16 nt, Pseudomonas aeruginosa PA01
gaagccccgcagccgc

SEQ ID NO: 1529985 - RNA, 15 nt, Pseudomonas aeruginosa PA01
gaagcauggccggcu

SEQ ID NO: 1529986 - RNA, 18 nt, Pseudomonas aeruginosa PA01
gaagccccuggcgcuggg

SEQ ID NO: 1529987 - RNA, 21 nt, Pseudomonas aeruginosa PA01
gaagccccgcuauggcggggc

SEQ ID NO: 1529988 - RNA, 23 nt, Pseudomonas aeruginosa PA01
gaagccgaggcuuuccagcaggc

SEQ ID NO: 1529989 - RNA, 22 nt, Pseudomonas aeruginosa PA01
gaagccggauucgcgcagcagg

SEQ ID NO: 1529990 - RNA, 17 nt, Pseudomonas aeruginosa PA01
gaagccggcagggauca

SEQ ID NO: 1529991 - RNA, 20 nt, Pseudomonas aeruginosa PA01
gaagccggccccugggccgg

SEQ ID NO: 1529992 - RNA, 17 nt, Pseudomonas aeruginosa PA01
gaagccggggcaggcau

SEQ ID NO: 1529993 - RNA, 17 nt, Pseudomonas aeruginosa PA01
gaagccgcacuuccagg

SEQ ID NO: 1529994 - RNA, 20 nt, Pseudomonas aeruginosa PA01
gaagccgcccacgggcggcu

SEQ ID NO: 1529995 - RNA, 22 nt, Pseudomonas aeruginosa PA01
gaagccgaucaccaccagcauc

SEQ ID NO: 1529996 - RNA, 20 nt, Pseudomonas aeruginosa PA01
gaagccgccgcccagcagca

SEQ ID NO: 1529997 - RNA, 16 nt, Pseudomonas aeruginosa PA01
gaagccgcgcaaggca

SEQ ID NO: 1529998 - RNA, 22 nt, Pseudomonas aeruginosa PA01
gaagccgcgcagcacuuccuga

SEQ ID NO: 1529999 - RNA, 19 nt, Pseudomonas aeruginosa PA01
gaagccgcgcccggccucc

SEQ ID NO: 1530000 - RNA, 21 nt, Pseudomonas aeruginosa PA01
gaagcacgcucuucuuacagc

SEQ ID NO: 1530001 - RNA, 21 nt, Pseudomonas aeruginosa PA01
gaagcagccguauggccccuc

SEQ ID NO: 1530002 - RNA, 16 nt, Pseudomonas aeruginosa PA01
gaagauuccgcugagg

SEQ ID NO: 1530003 - RNA, 15 nt, Pseudomonas aeruginosa PA01
gaagagcuggcggcc

SEQ ID NO: 1530004 - RNA, 18 nt, Pseudomonas aeruginosa PA01
gaagagcgccgcggcggc

SEQ ID NO: 1530005 - RNA, 18 nt, Pseudomonas aeruginosa PA01
gaagaggcccucggcgcc

SEQ ID NO: 1530006 - RNA, 22 nt, Pseudomonas aeruginosa PA01
gaagaggcccucggcgccgagc

SEQ ID NO: 1530007 - RNA, 23 nt, Pseudomonas aeruginosa PA01
gaagaggcccucggcgccgagca

SEQ ID NO: 1530008 - RNA, 20 nt, Pseudomonas aeruginosa PA01
gaagaucggauugaggacgc

SEQ ID NO: 1530009 - RNA, 17 nt, Pseudomonas aeruginosa PA01
gaagaucaucugggucc

SEQ ID NO: 1530010 - RNA, 20 nt, Pseudomonas aeruginosa PA01
gaagauaucgccuuccucgg

SEQ ID NO: 1530011 - RNA, 15 nt, Pseudomonas aeruginosa PA01
gaagaaggcucaccg

SEQ ID NO: 1530012 - RNA, 20 nt, Pseudomonas aeruginosa PA01
gaagaagcuucgcuggguuu

SEQ ID NO: 1530013 - RNA, 21 nt, Pseudomonas aeruginosa PA01
gaagaccuugaacucgcccgg

SEQ ID NO: 1530014 - RNA, 19 nt, Pseudomonas aeruginosa PA01
gaagaccuguugcagagcg

SEQ ID NO: 1530015 - RNA, 17 nt, Pseudomonas aeruginosa PA01
gaagaccagggugggga

SEQ ID NO: 1530016 - RNA, 19 nt, Pseudomonas aeruginosa PA01
gaagacccccugccgcccu

SEQ ID NO: 1530017 - RNA, 20 nt, Pseudomonas aeruginosa PA01
gaagacccccugccgcccuc

SEQ ID NO: 1530018 - RNA, 13 nt, Pseudomonas aeruginosa PA01
gaagacccggcgu

SEQ ID NO: 1530019 - RNA, 12 nt, Pseudomonas aeruginosa PA01
gaagacccugca

SEQ ID NO: 1530020 - RNA, 14 nt, Pseudomonas aeruginosa PA01
gaagaacgccagcc

SEQ ID NO: 1530021 - RNA, 19 nt, Pseudomonas aeruginosa PA01
gaagaagcugccccacagg

SEQ ID NO: 1530022 - RNA, 14 nt, Pseudomonas aeruginosa PA01
gaacuucuccgcca

SEQ ID NO: 1530023 - RNA, 15 nt, Pseudomonas aeruginosa PA01
gaacuugcgccgacc

SEQ ID NO: 1530024 - RNA, 22 nt, Pseudomonas aeruginosa PA01
gaacuugucgaccacgcucuug

SEQ ID NO: 1530025 - RNA, 14 nt, Pseudomonas aeruginosa PA01
gaacuugucgccgc

SEQ ID NO: 1530026 - RNA, 19 nt, Pseudomonas aeruginosa PA01
gaaaucgagcgccaggaac

SEQ ID NO: 1530027 - RNA, 18 nt, Pseudomonas aeruginosa PA01
gaaaucgcccaccagguc

SEQ ID NO: 1530028 - RNA, 22 nt, Pseudomonas aeruginosa PA01
gaaaucaggaaggucucgccgc

SEQ ID NO: 1530029 - RNA, 15 nt, Pseudomonas aeruginosa PA01
gaaauccaccagcac

SEQ ID NO: 1530030 - RNA, 16 nt, Pseudomonas aeruginosa PA01
gaaaucaccgccaccu

SEQ ID NO: 1530031 - RNA, 14 nt, Pseudomonas aeruginosa PA01
gaaaugguggacca

SEQ ID NO: 1530032 - RNA, 13 nt, Pseudomonas aeruginosa PA01
gaaaugccuggcu

SEQ ID NO: 1530033 - RNA, 14 nt, Pseudomonas aeruginosa PA01
gaaauggcaaccca

SEQ ID NO: 1530034 - RNA, 14 nt, Pseudomonas aeruginosa PA01
gaaauggcagaaca

SEQ ID NO: 1530035 - RNA, 17 nt, Pseudomonas aeruginosa PA01
gaaaugaaauagugcug

SEQ ID NO: 1530036 - RNA, 18 nt, Pseudomonas aeruginosa PA01
gaaaucggccacuccagc

SEQ ID NO: 1530037 - RNA, 11 nt, Pseudomonas aeruginosa PA01
gaaaugcaggc

SEQ ID NO: 1530038 - RNA, 15 nt, Pseudomonas aeruginosa PA01
gaaauucgcgcugga

SEQ ID NO: 1530039 - RNA, 22 nt, Pseudomonas aeruginosa PA01
gaaauugccuccgcucugcugg

SEQ ID NO: 1530040 - RNA, 23 nt, Pseudomonas aeruginosa PA01
gaacacgucguugggccccaccg

SEQ ID NO: 1530041 - RNA, 15 nt, Pseudomonas aeruginosa PA01
gaacacgcaaccccg

SEQ ID NO: 1530042 - RNA, 14 nt, Pseudomonas aeruginosa PA01
gaacacgccccaga

SEQ ID NO: 1530043 - RNA, 18 nt, Pseudomonas aeruginosa PA01
gaacacgccccagaagcc

SEQ ID NO: 1530044 - RNA, 22 nt, Pseudomonas aeruginosa PA01
gaacagccgcagcggcaugccc

SEQ ID NO: 1530045 - RNA, 15 nt, Pseudomonas aeruginosa PA01
gaacagcauggugaa

SEQ ID NO: 1530046 - RNA, 15 nt, Pseudomonas aeruginosa PA01
gaacagccaguaguc

SEQ ID NO: 1530047 - RNA, 21 nt, Pseudomonas aeruginosa PA01
gaacagcagcggcaccagcac

SEQ ID NO: 1530048 - RNA, 16 nt, Pseudomonas aeruginosa PA01
gaacagcagcucgccg

SEQ ID NO: 1530049 - RNA, 15 nt, Pseudomonas aeruginosa PA01
gaacagcagggaggc

SEQ ID NO: 1530050 - RNA, 20 nt, Pseudomonas aeruginosa PA01
gaacagcagggucaggguga

SEQ ID NO: 1530051 - RNA, 19 nt, Pseudomonas aeruginosa PA01
gaacagcaccgagcaggca

SEQ ID NO: 1530052 - RNA, 18 nt, Pseudomonas aeruginosa PA01
gaacagcaaagcgcaggu

SEQ ID NO: 1530053 - RNA, 19 nt, Pseudomonas aeruginosa PA01
gaacagcaacaccgcgcag

SEQ ID NO: 1530054 - RNA, 14 nt, Pseudomonas aeruginosa PA01
gaacagcaccuugg

SEQ ID NO: 1530055 - RNA, 14 nt, Pseudomonas aeruginosa PA01
gaacagcagccagg

SEQ ID NO: 1530056 - RNA, 15 nt, Pseudomonas aeruginosa PA01
gaacagcagccaggc

SEQ ID NO: 1530057 - RNA, 16 nt, Pseudomonas aeruginosa PA01
gaacagcagccaggcg

SEQ ID NO: 1530058 - RNA, 11 nt, Pseudomonas aeruginosa PA01
gaacagcagca

SEQ ID NO: 1530059 - RNA, 13 nt, Pseudomonas aeruginosa PA01
gaacagcagcaag

SEQ ID NO: 1530060 - RNA, 17 nt, Pseudomonas aeruginosa PA01
gaacacaucgaccaggu

SEQ ID NO: 1530061 - RNA, 15 nt, Pseudomonas aeruginosa PA01
gaacaccaggccgca

SEQ ID NO: 1530062 - RNA, 14 nt, Pseudomonas aeruginosa PA01
gaacaccaggcgcc

SEQ ID NO: 1530063 - RNA, 18 nt, Pseudomonas aeruginosa PA01
gaacaccucuucgccauc

SEQ ID NO: 1530064 - RNA, 14 nt, Pseudomonas aeruginosa PA01
gaacaaucccagcu

SEQ ID NO: 1530065 - RNA, 14 nt, Pseudomonas aeruginosa PA01
gaacaacuccugca

SEQ ID NO: 1530066 - RNA, 19 nt, Pseudomonas aeruginosa PA01
gaacaucagcagcgccagc

SEQ ID NO: 1530067 - RNA, 23 nt, Pseudomonas aeruginosa PA01
gaacaucgccugcuuggcggcgg

SEQ ID NO: 1530068 - RNA, 14 nt, Pseudomonas aeruginosa PA01
gaacauggccaccg

SEQ ID NO: 1530069 - RNA, 21 nt, Pseudomonas aeruginosa PA01
gaacaggcgacgguaccaggg

SEQ ID NO: 1530070 - RNA, 20 nt, Pseudomonas aeruginosa PA01
gaacaggcgauagccgacca

SEQ ID NO: 1530071 - RNA, 19 nt, Pseudomonas aeruginosa PA01
gaacagggucuucaggccg

SEQ ID NO: 1530072 - RNA, 21 nt, Pseudomonas aeruginosa PA01
gaacagggucuugucuuucug

SEQ ID NO: 1530073 - RNA, 18 nt, Pseudomonas aeruginosa PA01
gaacagggcgaaggccac

SEQ ID NO: 1530074 - RNA, 19 nt, Pseudomonas aeruginosa PA01
gaacagggcgaaggccacc

SEQ ID NO: 1530075 - RNA, 16 nt, Pseudomonas aeruginosa PA01
gaacagggcgagcagg

SEQ ID NO: 1530076 - RNA, 18 nt, Pseudomonas aeruginosa PA01
gaacagggcgagcagggc

SEQ ID NO: 1530077 - RNA, 21 nt, Pseudomonas aeruginosa PA01
gaacagggcgagcagggcgcu

SEQ ID NO: 1530078 - RNA, 20 nt, Pseudomonas aeruginosa PA01
gaacagguagcuggaaagcu

SEQ ID NO: 1530079 - RNA, 17 nt, Pseudomonas aeruginosa PA01
gaacagguggcuuucca

SEQ ID NO: 1530080 - RNA, 21 nt, Pseudomonas aeruginosa PA01
gaacaggcugugcgccaggcc

SEQ ID NO: 1530081 - RNA, 22 nt, Pseudomonas aeruginosa PA01
gaacaggcugugcgccaggccg

SEQ ID NO: 1530082 - RNA, 12 nt, Pseudomonas aeruginosa PA01
gaacaggaucuc

SEQ ID NO: 1530083 - RNA, 14 nt, Pseudomonas aeruginosa PA01
gaacagcuggcgcg

SEQ ID NO: 1530084 - RNA, 19 nt, Pseudomonas aeruginosa PA01
gaacagcgccagcggcagc

SEQ ID NO: 1530085 - RNA, 16 nt, Pseudomonas aeruginosa PA01
gaacagcgcuuccugg

SEQ ID NO: 1530086 - RNA, 11 nt, Pseudomonas aeruginosa PA01
gaacagcuccu

SEQ ID NO: 1530087 - RNA, 15 nt, Pseudomonas aeruginosa PA01
gaacagcuccuccag

SEQ ID NO: 1530088 - RNA, 21 nt, Pseudomonas aeruginosa PA01
gaacagcgggucgcggcuggc

SEQ ID NO: 1530089 - RNA, 14 nt, Pseudomonas aeruginosa PA01
gaacagcggcuggc

SEQ ID NO: 1530090 - RNA, 22 nt, Pseudomonas aeruginosa PA01
gaaauacagcacccgguagccg

SEQ ID NO: 1530091 - RNA, 17 nt, Pseudomonas aeruginosa PA01
gaaaggccgccacggcg

SEQ ID NO: 1530092 - RNA, 13 nt, Pseudomonas aeruginosa PA01
gaaagcuccucgg

SEQ ID NO: 1530093 - RNA, 17 nt, Pseudomonas aeruginosa PA01
gaaagggcggcagcacg

SEQ ID NO: 1530094 - RNA, 19 nt, Pseudomonas aeruginosa PA01
gaaagcaaaaaaagcccau

SEQ ID NO: 1530095 - RNA, 16 nt, Pseudomonas aeruginosa PA01
gaaagccaugcccaga

SEQ ID NO: 1530096 - RNA, 18 nt, Pseudomonas aeruginosa PA01
gaaagccaugcccagacg

SEQ ID NO: 1530097 - RNA, 13 nt, Pseudomonas aeruginosa PA01
gaaagcgccuucu

SEQ ID NO: 1530098 - RNA, 13 nt, Pseudomonas aeruginosa PA01
gaaagcgguaccg

SEQ ID NO: 1530099 - RNA, 22 nt, Pseudomonas aeruginosa PA01
gaaagcgguaccgggccaggca

SEQ ID NO: 1530100 - RNA, 13 nt, Pseudomonas aeruginosa PA01
gaaacggacccca

SEQ ID NO: 1530101 - RNA, 23 nt, Pseudomonas aeruginosa PA01
gaaacgcuugagcuggcgcuggu

SEQ ID NO: 1530102 - RNA, 13 nt, Pseudomonas aeruginosa PA01
gaaacgggcgcuc

SEQ ID NO: 1530103 - RNA, 14 nt, Pseudomonas aeruginosa PA01
gaaacggcaggcca

SEQ ID NO: 1530104 - RNA, 16 nt, Pseudomonas aeruginosa PA01
gaaacggcaggccagc

SEQ ID NO: 1530105 - RNA, 15 nt, Pseudomonas aeruginosa PA01
gaaacggcugccggu

SEQ ID NO: 1530106 - RNA, 19 nt, Pseudomonas aeruginosa PA01
gaaacucaucaggcugccg

SEQ ID NO: 1530107 - RNA, 14 nt, Pseudomonas aeruginosa PA01
gaaacuccagcagg

SEQ ID NO: 1530108 - RNA, 12 nt, Pseudomonas aeruginosa PA01
gaaacugcgcag

SEQ ID NO: 1530109 - RNA, 20 nt, Pseudomonas aeruginosa PA01
gaaagaccgaacaucagcag

SEQ ID NO: 1530110 - RNA, 13 nt, Pseudomonas aeruginosa PA01
gaaagaacaacuc

SEQ ID NO: 1530111 - RNA, 19 nt, Pseudomonas aeruginosa PA01
gaaagaagccgcacuucca

SEQ ID NO: 1530112 - RNA, 12 nt, Pseudomonas aeruginosa PA01
gaaaccccacca

SEQ ID NO: 1530113 - RNA, 21 nt, Pseudomonas aeruginosa PA01
gaaacccgugguccgccagca

SEQ ID NO: 1530114 - RNA, 14 nt, Pseudomonas aeruginosa PA01
gaaacccuuccagc

SEQ ID NO: 1530115 - RNA, 18 nt, Pseudomonas aeruginosa PA01
gaaaccggcgaaccagug

SEQ ID NO: 1530116 - RNA, 22 nt, Pseudomonas aeruginosa PA01
gaaaccggcgaugcucagcgcc

SEQ ID NO: 1530117 - RNA, 23 nt, Pseudomonas aeruginosa PA01
gaaaccuucgguggcgaccagga

SEQ ID NO: 1530118 - RNA, 14 nt, Pseudomonas aeruginosa PA01
gaaacgaagcuuca

SEQ ID NO: 1530119 - RNA, 17 nt, Pseudomonas aeruginosa PA01
gaaacccaugcccgccc

SEQ ID NO: 1530120 - RNA, 21 nt, Pseudomonas aeruginosa PA01
gaaacaccaggccgaugaacg

SEQ ID NO: 1530121 - RNA, 21 nt, Pseudomonas aeruginosa PA01
gaaaacaagaagccccgcuau

SEQ ID NO: 1530122 - RNA, 15 nt, Pseudomonas aeruginosa PA01
gaaaacgcucaggcc

SEQ ID NO: 1530123 - RNA, 20 nt, Pseudomonas aeruginosa PA01
gaaaacgcucaggccaagca

SEQ ID NO: 1530124 - RNA, 22 nt, Pseudomonas aeruginosa PA01
gaaaaagcccggccuggugccg

SEQ ID NO: 1530125 - RNA, 14 nt, Pseudomonas aeruginosa PA01
gaaaaagggaugcc

SEQ ID NO: 1530126 - RNA, 17 nt, Pseudomonas aeruginosa PA01
gaaaaaggcgcgccggu

SEQ ID NO: 1530127 - RNA, 18 nt, Pseudomonas aeruginosa PA01
gaaaaauauauuccuuua

SEQ ID NO: 1530128 - RNA, 17 nt, Pseudomonas aeruginosa PA01
gaaaagaaaaggccacc

SEQ ID NO: 1530129 - RNA, 17 nt, Pseudomonas aeruginosa PA01
gaaaagaaggcggaugg

SEQ ID NO: 1530130 - RNA, 21 nt, Pseudomonas aeruginosa PA01
gaaaagcccagguggcaggcc

SEQ ID NO: 1530131 - RNA, 20 nt, Pseudomonas aeruginosa PA01
gaaaagcgguuucgccaccu

SEQ ID NO: 1530132 - RNA, 20 nt, Pseudomonas aeruginosa PA01
cuuuuucaugcgcgggccga

SEQ ID NO: 1530133 - RNA, 13 nt, Pseudomonas aeruginosa PA01
cuuuucucugcau

SEQ ID NO: 1530134 - RNA, 20 nt, Pseudomonas aeruginosa PA01
cuuuucuuuauuccucccau

SEQ ID NO: 1530135 - RNA, 18 nt, Pseudomonas aeruginosa PA01
cuuuucgaugguggaauc

SEQ ID NO: 1530136 - RNA, 23 nt, Pseudomonas aeruginosa PA01
cuuuuccugcaacucgaaaaugu

SEQ ID NO: 1530137 - RNA, 20 nt, Pseudomonas aeruginosa PA01
cuuuugcaaucggcgagccg

SEQ ID NO: 1530138 - RNA, 18 nt, Pseudomonas aeruginosa PA01
cuuuucccgaucguuggc

SEQ ID NO: 1530139 - RNA, 20 nt, Pseudomonas aeruginosa PA01
cuuuuccuccagggugccga

SEQ ID NO: 1530140 - RNA, 16 nt, Pseudomonas aeruginosa PA01
cuuuuccggcgccggc

SEQ ID NO: 1530141 - RNA, 23 nt, Pseudomonas aeruginosa PA01
aaaaccagccuugagccuugccc

SEQ ID NO: 1530142 - RNA, 13 nt, Pseudomonas aeruginosa PA01
aaaaccgccccgg

SEQ ID NO: 1530143 - RNA, 15 nt, Pseudomonas aeruginosa PA01
aaaaccggucccucg

SEQ ID NO: 1530144 - RNA, 19 nt, Pseudomonas aeruginosa PA01
aaaaccuuagacccacuga

SEQ ID NO: 1530145 - RNA, 17 nt, Pseudomonas aeruginosa PA01
aaaaacccggcccaggc

SEQ ID NO: 1530146 - RNA, 16 nt, Pseudomonas aeruginosa PA01
aaaaacccaugcgguu

SEQ ID NO: 1530147 - RNA, 13 nt, Pseudomonas aeruginosa PA01
aaaaagccccgcu

SEQ ID NO: 1530148 - RNA, 15 nt, Pseudomonas aeruginosa PA01
aaaaagaagaaaaac

SEQ ID NO: 1530149 - RNA, 13 nt, Pseudomonas aeruginosa PA01
aaaaucauccaca

SEQ ID NO: 1530150 - RNA, 22 nt, Pseudomonas aeruginosa PA01
aaaaggauuuccgcggccggca

SEQ ID NO: 1530151 - RNA, 19 nt, Pseudomonas aeruginosa PA01
aaaagggaugccgccggca

SEQ ID NO: 1530152 - RNA, 13 nt, Pseudomonas aeruginosa PA01
aaaaggggaugcc

SEQ ID NO: 1530153 - RNA, 19 nt, Pseudomonas aeruginosa PA01
aaaaggggaugccauggca

SEQ ID NO: 1530154 - RNA, 20 nt, Pseudomonas aeruginosa PA01
aaaacgccgcgaagcccagc

SEQ ID NO: 1530155 - RNA, 14 nt, Pseudomonas aeruginosa PA01
aaaacgcauccguu

SEQ ID NO: 1530156 - RNA, 18 nt, Pseudomonas aeruginosa PA01
aaaacgccacacauccag

SEQ ID NO: 1530157 - RNA, 23 nt, Pseudomonas aeruginosa PA01
aaacccgugguccgccagcaggc

SEQ ID NO: 1530158 - RNA, 13 nt, Pseudomonas aeruginosa PA01
aaaccgagcacgu

SEQ ID NO: 1530159 - RNA, 22 nt, Pseudomonas aeruginosa PA01
aaacccgaauagaucugcacca

SEQ ID NO: 1530160 - RNA, 16 nt, Pseudomonas aeruginosa PA01
aacaagaauaggaaca

SEQ ID NO: 1530161 - RNA, 13 nt, Pseudomonas aeruginosa PA01
aacaaccgcuugu

SEQ ID NO: 1530162 - RNA, 14 nt, Pseudomonas aeruginosa PA01
aaauccaccagcac

SEQ ID NO: 1530163 - RNA, 17 nt, Pseudomonas aeruginosa PA01
aaaugacuguuaaucau

SEQ ID NO: 1530164 - RNA, 14 nt, Pseudomonas aeruginosa PA01
aaaaagcaggacgg

SEQ ID NO: 1530165 - RNA, 20 nt, Pseudomonas aeruginosa PA01
aaauggccgcuugaagcggc

SEQ ID NO: 1530166 - RNA, 14 nt, Pseudomonas aeruginosa PA01
aaauggcaacccag

SEQ ID NO: 1530167 - RNA, 13 nt, Pseudomonas aeruginosa PA01
aaauggcgcgccu

SEQ ID NO: 1530168 - RNA, 18 nt, Pseudomonas aeruginosa PA01
aaauggguucccagcagc

SEQ ID NO: 1530169 - RNA, 13 nt, Pseudomonas aeruginosa PA01
aaauaccccgggu

SEQ ID NO: 1530170 - RNA, 23 nt, Pseudomonas aeruginosa PA01
aaaccgguuucguggaugcugau

SEQ ID NO: 1530171 - RNA, 18 nt, Pseudomonas aeruginosa PA01
aaagaaaacgcccggcau

SEQ ID NO: 1530172 - RNA, 11 nt, Pseudomonas aeruginosa PA01
aaagaagaaaa

SEQ ID NO: 1530173 - RNA, 17 nt, Pseudomonas aeruginosa PA01
aaagaagccgcacuucc

SEQ ID NO: 1530174 - RNA, 18 nt, Pseudomonas aeruginosa PA01
aaagaagccgcacuucca

SEQ ID NO: 1530175 - RNA, 23 nt, Pseudomonas aeruginosa PA01
aaaggcucuugggcucugccuuc

SEQ ID NO: 1530176 - RNA, 13 nt, Pseudomonas aeruginosa PA01
aaagcgcugcgga

SEQ ID NO: 1530177 - RNA, 16 nt, Pseudomonas aeruginosa PA01
aaagcgcggaggguaa

SEQ ID NO: 1530178 - RNA, 21 nt, Pseudomonas aeruginosa PA01
aacagggcauuggccaucagc

SEQ ID NO: 1530179 - RNA, 15 nt, Pseudomonas aeruginosa PA01
aacagggcgagcagg

SEQ ID NO: 1530180 - RNA, 17 nt, Pseudomonas aeruginosa PA01
aacagggcgagcagggc

SEQ ID NO: 1530181 - RNA, 22 nt, Pseudomonas aeruginosa PA01
aacaggcucgaggccgagccgg

SEQ ID NO: 1530182 - RNA, 18 nt, Pseudomonas aeruginosa PA01
aacaggcugugcgccagg

SEQ ID NO: 1530183 - RNA, 16 nt, Pseudomonas aeruginosa PA01
aacaggcgcuucagcu

SEQ ID NO: 1530184 - RNA, 20 nt, Pseudomonas aeruginosa PA01
aacagguggcuuuccagcau

SEQ ID NO: 1530185 - RNA, 17 nt, Pseudomonas aeruginosa PA01
aacagguagcuggaaag

SEQ ID NO: 1530186 - RNA, 17 nt, Pseudomonas aeruginosa PA01
aacaggucaacaagaau

SEQ ID NO: 1530187 - RNA, 20 nt, Pseudomonas aeruginosa PA01
aacaggucgacgccauggcg

SEQ ID NO: 1530188 - RNA, 21 nt, Pseudomonas aeruginosa PA01
aacaggaaacucacccuggca

SEQ ID NO: 1530189 - RNA, 18 nt, Pseudomonas aeruginosa PA01
aacagcgggucgcggcug

SEQ ID NO: 1530190 - RNA, 18 nt, Pseudomonas aeruginosa PA01
aacagcggugugcucagg

SEQ ID NO: 1530191 - RNA, 16 nt, Pseudomonas aeruginosa PA01
aacagcggcccgaggg

SEQ ID NO: 1530192 - RNA, 13 nt, Pseudomonas aeruginosa PA01
aacaguugagcug

SEQ ID NO: 1530193 - RNA, 16 nt, Pseudomonas aeruginosa PA01
aacaguugagcugugg

SEQ ID NO: 1530194 - RNA, 17 nt, Pseudomonas aeruginosa PA01
aacaguucgaugggccg

SEQ ID NO: 1530195 - RNA, 16 nt, Pseudomonas aeruginosa PA01
aacagucgucgcgcag

SEQ ID NO: 1530196 - RNA, 16 nt, Pseudomonas aeruginosa PA01
aaccccuggaucuccu

SEQ ID NO: 1530197 - RNA, 15 nt, Pseudomonas aeruginosa PA01
aaccccgaacuuccc

SEQ ID NO: 1530198 - RNA, 16 nt, Pseudomonas aeruginosa PA01
aaccccgaacuucccc

SEQ ID NO: 1530199 - RNA, 22 nt, Pseudomonas aeruginosa PA01
aaccaggcgccgaugcccaggc

SEQ ID NO: 1530200 - RNA, 17 nt, Pseudomonas aeruginosa PA01
aaccagaccagcaggaa

SEQ ID NO: 1530201 - RNA, 18 nt, Pseudomonas aeruginosa PA01
aaccagaccagcaggaaa

SEQ ID NO: 1530202 - RNA, 16 nt, Pseudomonas aeruginosa PA01
aacgaaaaagggcggc

SEQ ID NO: 1530203 - RNA, 17 nt, Pseudomonas aeruginosa PA01
aaccuucucccuucagg

SEQ ID NO: 1530204 - RNA, 20 nt, Pseudomonas aeruginosa PA01
aaccuuagacccacugaaga

SEQ ID NO: 1530205 - RNA, 11 nt, Pseudomonas aeruginosa PA01
aaccucucccc

SEQ ID NO: 1530206 - RNA, 22 nt, Pseudomonas aeruginosa PA01
aaccucuccccagacccucucc

SEQ ID NO: 1530207 - RNA, 21 nt, Pseudomonas aeruginosa PA01
aaccugccgaucgccgcgcgg

SEQ ID NO: 1530208 - RNA, 13 nt, Pseudomonas aeruginosa PA01
aaccugccagaaa

SEQ ID NO: 1530209 - RNA, 19 nt, Pseudomonas aeruginosa PA01
aaccugccagaaaacccag

SEQ ID NO: 1530210 - RNA, 15 nt, Pseudomonas aeruginosa PA01
aaccguucugccgca

SEQ ID NO: 1530211 - RNA, 22 nt, Pseudomonas aeruginosa PA01
aaccucgccgaucuccuccgcc

SEQ ID NO: 1530212 - RNA, 20 nt, Pseudomonas aeruginosa PA01
aaccucgccggucagguagg

SEQ ID NO: 1530213 - RNA, 22 nt, Pseudomonas aeruginosa PA01
aacccgcccggcucaacugcuu

SEQ ID NO: 1530214 - RNA, 17 nt, Pseudomonas aeruginosa PA01
aaccggggcguuacagu

SEQ ID NO: 1530215 - RNA, 14 nt, Pseudomonas aeruginosa PA01
aaccgucgcccugg

SEQ ID NO: 1530216 - RNA, 19 nt, Pseudomonas aeruginosa PA01
aaccgucgcuggagcugcg

SEQ ID NO: 1530217 - RNA, 13 nt, Pseudomonas aeruginosa PA01
aaccguuccagcg

SEQ ID NO: 1530218 - RNA, 12 nt, Pseudomonas aeruginosa PA01
aacgcaggcgca

SEQ ID NO: 1530219 - RNA, 22 nt, Pseudomonas aeruginosa PA01
aacgcacuucguccgccaccac

SEQ ID NO: 1530220 - RNA, 20 nt, Pseudomonas aeruginosa PA01
aacgaggcgacccgggucag

SEQ ID NO: 1530221 - RNA, 23 nt, Pseudomonas aeruginosa PA01
aacgaguugggcgaccugcucga

SEQ ID NO: 1530222 - RNA, 13 nt, Pseudomonas aeruginosa PA01
aacgacuccagcu

SEQ ID NO: 1530223 - RNA, 20 nt, Pseudomonas aeruginosa PA01
aacgaccgcccaggcugccg

SEQ ID NO: 1530224 - RNA, 14 nt, Pseudomonas aeruginosa PA01
aacgacagcaccau

SEQ ID NO: 1530225 - RNA, 19 nt, Pseudomonas aeruginosa PA01
aacgacagccccggcccgg

SEQ ID NO: 1530226 - RNA, 20 nt, Pseudomonas aeruginosa PA01
aacgaaguguuacagcagga

SEQ ID NO: 1530227 - RNA, 18 nt, Pseudomonas aeruginosa PA01
aacgcgcccggccaggcc

SEQ ID NO: 1530228 - RNA, 17 nt, Pseudomonas aeruginosa PA01
aacgcgccuccggcagc

SEQ ID NO: 1530229 - RNA, 17 nt, Pseudomonas aeruginosa PA01
aacgcggauacuccuuc

SEQ ID NO: 1530230 - RNA, 13 nt, Pseudomonas aeruginosa PA01
aacgcgcccacuc

SEQ ID NO: 1530231 - RNA, 21 nt, Pseudomonas aeruginosa PA01
aacgcggguugcccggcucca

SEQ ID NO: 1530232 - RNA, 13 nt, Pseudomonas aeruginosa PA01
aacgccugggcgu

SEQ ID NO: 1530233 - RNA, 21 nt, Pseudomonas aeruginosa PA01
aacgccacacauccagugugg

SEQ ID NO: 1530234 - RNA, 22 nt, Pseudomonas aeruginosa PA01
aacgcgugaagcuggagcagca

SEQ ID NO: 1530235 - RNA, 15 nt, Pseudomonas aeruginosa PA01
aacggcaggccagca

SEQ ID NO: 1530236 - RNA, 17 nt, Pseudomonas aeruginosa PA01
aacggcaggccagcagg

SEQ ID NO: 1530237 - RNA, 12 nt, Pseudomonas aeruginosa PA01
aacggcccucac

SEQ ID NO: 1530238 - RNA, 23 nt, Pseudomonas aeruginosa PA01
aacugcccgcaggggcugccgua

SEQ ID NO: 1530239 - RNA, 18 nt, Pseudomonas aeruginosa PA01
aacugguuggccgccugg

SEQ ID NO: 1530240 - RNA, 21 nt, Pseudomonas aeruginosa PA01
aacugguuggccgccuggcgc

SEQ ID NO: 1530241 - RNA, 22 nt, Pseudomonas aeruginosa PA01
aacuuuaggucugccucgccga

SEQ ID NO: 1530242 - RNA, 23 nt, Pseudomonas aeruginosa PA01
aacuuuuuggaucagaggguuga

SEQ ID NO: 1530243 - RNA, 14 nt, Pseudomonas aeruginosa PA01
aagaaacaacgaag

SEQ ID NO: 1530244 - RNA, 17 nt, Pseudomonas aeruginosa PA01
aacucacccuggcaccg

SEQ ID NO: 1530245 - RNA, 15 nt, Pseudomonas aeruginosa PA01
aacucaucaggcugc

SEQ ID NO: 1530246 - RNA, 22 nt, Pseudomonas aeruginosa PA01
aacggcgcuuucaucaggcgcu

SEQ ID NO: 1530247 - RNA, 21 nt, Pseudomonas aeruginosa PA01
aacggcggaucgaucagcagc

SEQ ID NO: 1530248 - RNA, 23 nt, Pseudomonas aeruginosa PA01
aacggcgugccgggcagugcgcc

SEQ ID NO: 1530249 - RNA, 12 nt, Pseudomonas aeruginosa PA01
aacgggaaguag

SEQ ID NO: 1530250 - RNA, 12 nt, Pseudomonas aeruginosa PA01
aacggcuggucg

SEQ ID NO: 1530251 - RNA, 17 nt, Pseudomonas aeruginosa PA01
aacgggacgccuggcgu

SEQ ID NO: 1530252 - RNA, 13 nt, Pseudomonas aeruginosa PA01
aacucuggcggcg

SEQ ID NO: 1530253 - RNA, 22 nt, Pseudomonas aeruginosa PA01
aacucggcgcugccggccaggg

SEQ ID NO: 1530254 - RNA, 23 nt, Pseudomonas aeruginosa PA01
aacucggcgcugccggccagggu

SEQ ID NO: 1530255 - RNA, 19 nt, Pseudomonas aeruginosa PA01
aacucgccgucuuccacca

SEQ ID NO: 1530256 - RNA, 23 nt, Pseudomonas aeruginosa PA01
aacuccuccucgcuccagaggaa

SEQ ID NO: 1530257 - RNA, 16 nt, Pseudomonas aeruginosa PA01
aacuccgccagcacca

SEQ ID NO: 1530258 - RNA, 23 nt, Pseudomonas aeruginosa PA01
aacuccagagccaugggccggcc

SEQ ID NO: 1530259 - RNA, 21 nt, Pseudomonas aeruginosa PA01
aacuccaccgguuucgccagu

SEQ ID NO: 1530260 - RNA, 15 nt, Pseudomonas aeruginosa PA01
aagaccuugaacucg

SEQ ID NO: 1530261 - RNA, 23 nt, Pseudomonas aeruginosa PA01
aagaccugguccaacgggcucgu

SEQ ID NO: 1530262 - RNA, 20 nt, Pseudomonas aeruginosa PA01
aagaccgaccaguaccagca

SEQ ID NO: 1530263 - RNA, 23 nt, Pseudomonas aeruginosa PA01
aagaccgaacaucagcagcagga

SEQ ID NO: 1530264 - RNA, 21 nt, Pseudomonas aeruginosa PA01
aagacaaaauucucccgcucc

SEQ ID NO: 1530265 - RNA, 13 nt, Pseudomonas aeruginosa PA01
aagauaucgccuu

SEQ ID NO: 1530266 - RNA, 15 nt, Pseudomonas aeruginosa PA01
aagaguucgcugaag

SEQ ID NO: 1530267 - RNA, 23 nt, Pseudomonas aeruginosa PA01
aagagcagcgcggcggcggccag

SEQ ID NO: 1530268 - RNA, 18 nt, Pseudomonas aeruginosa PA01
aagagagcgccagcgaga

SEQ ID NO: 1530269 - RNA, 20 nt, Pseudomonas aeruginosa PA01
aauaaugcggcgcgaugccc

SEQ ID NO: 1530270 - RNA, 23 nt, Pseudomonas aeruginosa PA01
aaaaauggccgcuucaagcggcc

SEQ ID NO: 1530271 - RNA, 18 nt, Pseudomonas aeruginosa PA01
aauagugcagcuccaccg

SEQ ID NO: 1530272 - RNA, 22 nt, Pseudomonas aeruginosa PA01
aauauauuuuucuaaaauggcu

SEQ ID NO: 1530273 - RNA, 15 nt, Pseudomonas aeruginosa PA01
aaggggaugccaugg

SEQ ID NO: 1530274 - RNA, 14 nt, Pseudomonas aeruginosa PA01
aaggggcggcucgg

SEQ ID NO: 1530275 - RNA, 20 nt, Pseudomonas aeruginosa PA01
aaggggcggcucggcuccag

SEQ ID NO: 1530276 - RNA, 13 nt, Pseudomonas aeruginosa PA01
aagggcgucuggg

SEQ ID NO: 1530277 - RNA, 15 nt, Pseudomonas aeruginosa PA01
aagggcgucugggac

SEQ ID NO: 1530278 - RNA, 18 nt, Pseudomonas aeruginosa PA01
aagggcucagcccaggcg

SEQ ID NO: 1530279 - RNA, 12 nt, Pseudomonas aeruginosa PA01
aagggcgcgccc

SEQ ID NO: 1530280 - RNA, 19 nt, Pseudomonas aeruginosa PA01
aagggcggcagcacgauga

SEQ ID NO: 1530281 - RNA, 15 nt, Pseudomonas aeruginosa PA01
aagggccugcucagc

SEQ ID NO: 1530282 - RNA, 16 nt, Pseudomonas aeruginosa PA01
aaguauuucaaccagg

SEQ ID NO: 1530283 - RNA, 13 nt, Pseudomonas aeruginosa PA01
aagucagccaggu

SEQ ID NO: 1530284 - RNA, 15 nt, Pseudomonas aeruginosa PA01
aaguaggccuggccg

SEQ ID NO: 1530285 - RNA, 18 nt, Pseudomonas aeruginosa PA01
aaguccggguugagcacc

SEQ ID NO: 1530286 - RNA, 17 nt, Pseudomonas aeruginosa PA01
aaguccuggccgagcau

SEQ ID NO: 1530287 - RNA, 16 nt, Pseudomonas aeruginosa PA01
aagucagguccuuguu

SEQ ID NO: 1530288 - RNA, 22 nt, Pseudomonas aeruginosa PA01
aagucgaacuucacguccagcu

SEQ ID NO: 1530289 - RNA, 18 nt, Pseudomonas aeruginosa PA01
aagucggccugcaccagc

SEQ ID NO: 1530290 - RNA, 14 nt, Pseudomonas aeruginosa PA01
aagucgaagcagcc

SEQ ID NO: 1530291 - RNA, 19 nt, Pseudomonas aeruginosa PA01
aagucgccgucguccgggu

SEQ ID NO: 1530292 - RNA, 21 nt, Pseudomonas aeruginosa PA01
aagucguucccggccuggcgc

SEQ ID NO: 1530293 - RNA, 14 nt, Pseudomonas aeruginosa PA01
aaguguuacagcag

SEQ ID NO: 1530294 - RNA, 19 nt, Pseudomonas aeruginosa PA01
aaguuacugauuugauuga

SEQ ID NO: 1530295 - RNA, 15 nt, Pseudomonas aeruginosa PA01
aaguucccgccgcuc

SEQ ID NO: 1530296 - RNA, 10 nt, Pseudomonas aeruginosa PA01
aaggccaggg

SEQ ID NO: 1530297 - RNA, 18 nt, Pseudomonas aeruginosa PA01
aaggcccgcgagccgcgc

SEQ ID NO: 1530298 - RNA, 24 nt, Pseudomonas aeruginosa PA01
aaggccagcggcauccgccgcugg

SEQ ID NO: 1530299 - RNA, 12 nt, Pseudomonas aeruginosa PA01
aaggcuugccac

SEQ ID NO: 1530300 - RNA, 22 nt, Pseudomonas aeruginosa PA01
aaggcuugccacugcgcgccag

SEQ ID NO: 1530301 - RNA, 21 nt, Pseudomonas aeruginosa PA01
aaggccucgucgcccggauag

SEQ ID NO: 1530302 - RNA, 15 nt, Pseudomonas aeruginosa PA01
aaggccgccacggcg

SEQ ID NO: 1530303 - RNA, 21 nt, Pseudomonas aeruginosa PA01
aaggccgcuucgccgcccucg

SEQ ID NO: 1530304 - RNA, 13 nt, Pseudomonas aeruginosa PA01
aaggaccugcugc

SEQ ID NO: 1530305 - RNA, 14 nt, Pseudomonas aeruginosa PA01
aaggaucgccgcga

SEQ ID NO: 1530306 - RNA, 14 nt, Pseudomonas aeruginosa PA01
aaggaucgagccag

SEQ ID NO: 1530307 - RNA, 13 nt, Pseudomonas aeruginosa PA01
aaggaugcgccag

SEQ ID NO: 1530308 - RNA, 17 nt, Pseudomonas aeruginosa PA01
aagcuggagcagcagcg

SEQ ID NO: 1530309 - RNA, 12 nt, Pseudomonas aeruginosa PA01
aagcgguugagu

SEQ ID NO: 1530310 - RNA, 15 nt, Pseudomonas aeruginosa PA01
aagcggucgccggcg

SEQ ID NO: 1530311 - RNA, 19 nt, Pseudomonas aeruginosa PA01
aagcggucguagcccaugg

SEQ ID NO: 1530312 - RNA, 17 nt, Pseudomonas aeruginosa PA01
aagcggcucggccaggg

SEQ ID NO: 1530313 - RNA, 22 nt, Pseudomonas aeruginosa PA01
aagcggcucggccagggccgcu

SEQ ID NO: 1530314 - RNA, 18 nt, Pseudomonas aeruginosa PA01
aagcucaccuugaagccu

SEQ ID NO: 1530315 - RNA, 13 nt, Pseudomonas aeruginosa PA01
aagcggccuuuuc

SEQ ID NO: 1530316 - RNA, 20 nt, Pseudomonas aeruginosa PA01
aagcgcccggcgaacagcgc

SEQ ID NO: 1530317 - RNA, 18 nt, Pseudomonas aeruginosa PA01
aagcgccgcggcccggcg

SEQ ID NO: 1530318 - RNA, 20 nt, Pseudomonas aeruginosa PA01
aagcgccggcaacagcagca

SEQ ID NO: 1530319 - RNA, 14 nt, Pseudomonas aeruginosa PA01
aagcgcaccaccug

SEQ ID NO: 1530320 - RNA, 16 nt, Pseudomonas aeruginosa PA01
aagcgcaccaccugca

SEQ ID NO: 1530321 - RNA, 20 nt, Pseudomonas aeruginosa PA01
aagcgcagguagcggcgaag

SEQ ID NO: 1530322 - RNA, 23 nt, Pseudomonas aeruginosa PA01
aagcgcagcacgaugcacaggcg

SEQ ID NO: 1530323 - RNA, 17 nt, Pseudomonas aeruginosa PA01
aagccgggaagccgcuc

SEQ ID NO: 1530324 - RNA, 17 nt, Pseudomonas aeruginosa PA01
aagauccgcuccaggcu

SEQ ID NO: 1530325 - RNA, 16 nt, Pseudomonas aeruginosa PA01
aagcgaaccaggcaau

SEQ ID NO: 1530326 - RNA, 13 nt, Pseudomonas aeruginosa PA01
aagccuccagcag

SEQ ID NO: 1530327 - RNA, 12 nt, Pseudomonas aeruginosa PA01
acaagcccagcu

SEQ ID NO: 1530328 - RNA, 17 nt, Pseudomonas aeruginosa PA01
acaagcauucuggaugc

SEQ ID NO: 1530329 - RNA, 13 nt, Pseudomonas aeruginosa PA01
acaagaauaggaa

SEQ ID NO: 1530330 - RNA, 14 nt, Pseudomonas aeruginosa PA01
acaagccuccagcg

SEQ ID NO: 1530331 - RNA, 18 nt, Pseudomonas aeruginosa PA01
acacacgcuucugcuggc

SEQ ID NO: 1530332 - RNA, 18 nt, Pseudomonas aeruginosa PA01
acacaggacgagacgccg

SEQ ID NO: 1530333 - RNA, 17 nt, Pseudomonas aeruginosa PA01
acaccagcgccgccagg

SEQ ID NO: 1530334 - RNA, 21 nt, Pseudomonas aeruginosa PA01
acaccaggagcgccagcacca

SEQ ID NO: 1530335 - RNA, 14 nt, Pseudomonas aeruginosa PA01
acaccaggccggcg

SEQ ID NO: 1530336 - RNA, 21 nt, Pseudomonas aeruginosa PA01
acaccaggguggcgcgcacca

SEQ ID NO: 1530337 - RNA, 12 nt, Pseudomonas aeruginosa PA01
acagcaugguga

SEQ ID NO: 1530338 - RNA, 21 nt, Pseudomonas aeruginosa PA01
acagccccagccucggcaggg

SEQ ID NO: 1530339 - RNA, 23 nt, Pseudomonas aeruginosa PA01
acagccccagccucggcagggcg

SEQ ID NO: 1530340 - RNA, 20 nt, Pseudomonas aeruginosa PA01
acagcuggcgcgucgcugcc

SEQ ID NO: 1530341 - RNA, 14 nt, Pseudomonas aeruginosa PA01
acagcuucaggcgc

SEQ ID NO: 1530342 - RNA, 15 nt, Pseudomonas aeruginosa PA01
acaggacugugcuua

SEQ ID NO: 1530343 - RNA, 14 nt, Pseudomonas aeruginosa PA01
acagcugccagccc

SEQ ID NO: 1530344 - RNA, 16 nt, Pseudomonas aeruginosa PA01
acagcugccagccccg

SEQ ID NO: 1530345 - RNA, 18 nt, Pseudomonas aeruginosa PA01
acagcgugcagaccaggg

SEQ ID NO: 1530346 - RNA, 16 nt, Pseudomonas aeruginosa PA01
acagcguggccagcgc

SEQ ID NO: 1530347 - RNA, 15 nt, Pseudomonas aeruginosa PA01
acagcggcuggcccu

SEQ ID NO: 1530348 - RNA, 18 nt, Pseudomonas aeruginosa PA01
acagaucgccagcucgcc

SEQ ID NO: 1530349 - RNA, 14 nt, Pseudomonas aeruginosa PA01
acagcaccuuggcc

SEQ ID NO: 1530350 - RNA, 18 nt, Pseudomonas aeruginosa PA01
acagcaucagaggcaaca

SEQ ID NO: 1530351 - RNA, 18 nt, Pseudomonas aeruginosa PA01
acagcaccacgccgcugg

SEQ ID NO: 1530352 - RNA, 20 nt, Pseudomonas aeruginosa PA01
acagcaccgagcaggcaccc

SEQ ID NO: 1530353 - RNA, 14 nt, Pseudomonas aeruginosa PA01
acaccgaccgcgag

SEQ ID NO: 1530354 - RNA, 15 nt, Pseudomonas aeruginosa PA01
acaccgaccgcgagu

SEQ ID NO: 1530355 - RNA, 23 nt, Pseudomonas aeruginosa PA01
acaccgaccgcgaguucgccggc

SEQ ID NO: 1530356 - RNA, 20 nt, Pseudomonas aeruginosa PA01
acaccgaacuuccgccgaau

SEQ ID NO: 1530357 - RNA, 18 nt, Pseudomonas aeruginosa PA01
acaccgaagucgcccgcc

SEQ ID NO: 1530358 - RNA, 18 nt, Pseudomonas aeruginosa PA01
acacccgguccugcaacu

SEQ ID NO: 1530359 - RNA, 21 nt, Pseudomonas aeruginosa PA01
acagaaacaaagagcccgccu

SEQ ID NO: 1530360 - RNA, 14 nt, Pseudomonas aeruginosa PA01
acaggauggacagc

SEQ ID NO: 1530361 - RNA, 18 nt, Pseudomonas aeruginosa PA01
acaggccauucuucucca

SEQ ID NO: 1530362 - RNA, 19 nt, Pseudomonas aeruginosa PA01
acaggccgccguagaguuc

SEQ ID NO: 1530363 - RNA, 22 nt, Pseudomonas aeruginosa PA01
acauggaucggcaacuggcugg

SEQ ID NO: 1530364 - RNA, 22 nt, Pseudomonas aeruginosa PA01
acaugggaaccucggcaggcug

SEQ ID NO: 1530365 - RNA, 22 nt, Pseudomonas aeruginosa PA01
acaugcaggcucucgcgcagca

SEQ ID NO: 1530366 - RNA, 18 nt, Pseudomonas aeruginosa PA01
acaugcaggucgugcagc

SEQ ID NO: 1530367 - RNA, 13 nt, Pseudomonas aeruginosa PA01
acaucccgccgau

SEQ ID NO: 1530368 - RNA, 23 nt, Pseudomonas aeruginosa PA01
acauuuccuugaccaucuuuucc

SEQ ID NO: 1530369 - RNA, 16 nt, Pseudomonas aeruginosa PA01
accaagcggauguucu

SEQ ID NO: 1530370 - RNA, 20 nt, Pseudomonas aeruginosa PA01
accaaugccagugccucgcg

SEQ ID NO: 1530371 - RNA, 21 nt, Pseudomonas aeruginosa PA01
accacaccaggucgccgcaca

SEQ ID NO: 1530372 - RNA, 15 nt, Pseudomonas aeruginosa PA01
accacacaugcaggu

SEQ ID NO: 1530373 - RNA, 23 nt, Pseudomonas aeruginosa PA01
accacacaugcaggucgugcagc

SEQ ID NO: 1530374 - RNA, 14 nt, Pseudomonas aeruginosa PA01
accacauccuugcc

SEQ ID NO: 1530375 - RNA, 15 nt, Pseudomonas aeruginosa PA01
accacaugggugucc

SEQ ID NO: 1530376 - RNA, 18 nt, Pseudomonas aeruginosa PA01
accacaggcggcggaaga

SEQ ID NO: 1530377 - RNA, 21 nt, Pseudomonas aeruginosa PA01
accacaggcggcggaagaagc

SEQ ID NO: 1530378 - RNA, 23 nt, Pseudomonas aeruginosa PA01
accacaggcggcggaagaagccc

SEQ ID NO: 1530379 - RNA, 16 nt, Pseudomonas aeruginosa PA01
accacagcaccacgcu

SEQ ID NO: 1530380 - RNA, 15 nt, Pseudomonas aeruginosa PA01
accacgcaggcgcgu

SEQ ID NO: 1530381 - RNA, 12 nt, Pseudomonas aeruginosa PA01
accacuggaugg

SEQ ID NO: 1530382 - RNA, 13 nt, Pseudomonas aeruginosa PA01
accacuucgcgga

SEQ ID NO: 1530383 - RNA, 12 nt, Pseudomonas aeruginosa PA01
accacuccagcg

SEQ ID NO: 1530384 - RNA, 12 nt, Pseudomonas aeruginosa PA01
accaccagcagc

SEQ ID NO: 1530385 - RNA, 20 nt, Pseudomonas aeruginosa PA01
accaccaggaaggcgucgcc

SEQ ID NO: 1530386 - RNA, 20 nt, Pseudomonas aeruginosa PA01
accaccagcaggcccaguuc

SEQ ID NO: 1530387 - RNA, 20 nt, Pseudomonas aeruginosa PA01
accaccacgucgaugccuuc

SEQ ID NO: 1530388 - RNA, 18 nt, Pseudomonas aeruginosa PA01
accaccauuuccagcaac

SEQ ID NO: 1530389 - RNA, 15 nt, Pseudomonas aeruginosa PA01
accaccauggucuuu

SEQ ID NO: 1530390 - RNA, 19 nt, Pseudomonas aeruginosa PA01
accacgacguugcccuugu

SEQ ID NO: 1530391 - RNA, 17 nt, Pseudomonas aeruginosa PA01
accacgaagaacggcgc

SEQ ID NO: 1530392 - RNA, 22 nt, Pseudomonas aeruginosa PA01
accaccuucaggcugcucaugc

SEQ ID NO: 1530393 - RNA, 14 nt, Pseudomonas aeruginosa PA01
accaccugcaugcu

SEQ ID NO: 1530394 - RNA, 14 nt, Pseudomonas aeruginosa PA01
accaccgccaggcu

SEQ ID NO: 1530395 - RNA, 13 nt, Pseudomonas aeruginosa PA01
aauuucuuccauc

SEQ ID NO: 1530396 - RNA, 23 nt, Pseudomonas aeruginosa PA01
aauugcuccgguucggcaaggcg

SEQ ID NO: 1530397 - RNA, 17 nt, Pseudomonas aeruginosa PA01
aauuuucccuuugcaaa

SEQ ID NO: 1530398 - RNA, 16 nt, Pseudomonas aeruginosa PA01
aauuuucgaaaauaac

SEQ ID NO: 1530399 - RNA, 22 nt, Pseudomonas aeruginosa PA01
aauuugaacgcuguagaaugcg

SEQ ID NO: 1530400 - RNA, 15 nt, Pseudomonas aeruginosa PA01
aauugaccagguacg

SEQ ID NO: 1530401 - RNA, 22 nt, Pseudomonas aeruginosa PA01
aauugcaccgcuugccagccgc

SEQ ID NO: 1530402 - RNA, 20 nt, Pseudomonas aeruginosa PA01
aauugcgcacgcaauagugc

SEQ ID NO: 1530403 - RNA, 19 nt, Pseudomonas aeruginosa PA01
aauugcgagcgagcuugca

SEQ ID NO: 1530404 - RNA, 22 nt, Pseudomonas aeruginosa PA01
aauugcgagcgagcuugcaauc

SEQ ID NO: 1530405 - RNA, 18 nt, Pseudomonas aeruginosa PA01
aauucgucgccgccgagg

SEQ ID NO: 1530406 - RNA, 13 nt, Pseudomonas aeruginosa PA01
aaugaagaagccc

SEQ ID NO: 1530407 - RNA, 18 nt, Pseudomonas aeruginosa PA01
aaugacgaucucgaugac

SEQ ID NO: 1530408 - RNA, 18 nt, Pseudomonas aeruginosa PA01
aaugacuccggucaaggc

SEQ ID NO: 1530409 - RNA, 20 nt, Pseudomonas aeruginosa PA01
aauggcguggcuuggcccug

SEQ ID NO: 1530410 - RNA, 23 nt, Pseudomonas aeruginosa PA01
aaugcucgugcagguagccgcgc

SEQ ID NO: 1530411 - RNA, 22 nt, Pseudomonas aeruginosa PA01
aaugcguuccuguccauuucca

SEQ ID NO: 1530412 - RNA, 23 nt, Pseudomonas aeruginosa PA01
aaucggucgcccucggccaggca

SEQ ID NO: 1530413 - RNA, 22 nt, Pseudomonas aeruginosa PA01
aaucggcgagccgcagcggcuc

SEQ ID NO: 1530414 - RNA, 15 nt, Pseudomonas aeruginosa PA01
aaucggcaggcugca

SEQ ID NO: 1530415 - RNA, 19 nt, Pseudomonas aeruginosa PA01
aaucgcuugacggauaaaa

SEQ ID NO: 1530416 - RNA, 15 nt, Pseudomonas aeruginosa PA01
aauccuccgccagcg

SEQ ID NO: 1530417 - RNA, 15 nt, Pseudomonas aeruginosa PA01
aaucgccgucaccgc

SEQ ID NO: 1530418 - RNA, 21 nt, Pseudomonas aeruginosa PA01
acugagggucagccgcaggcc

SEQ ID NO: 1530419 - RNA, 20 nt, Pseudomonas aeruginosa PA01
acugcgccaugccguucagg

SEQ ID NO: 1530420 - RNA, 12 nt, Pseudomonas aeruginosa PA01
acugcgcgggca

SEQ ID NO: 1530421 - RNA, 23 nt, Pseudomonas aeruginosa PA01
acugcgcgggcaugcaccuacca

SEQ ID NO: 1530422 - RNA, 18 nt, Pseudomonas aeruginosa PA01
acuggaucggccccaccu

SEQ ID NO: 1530423 - RNA, 21 nt, Pseudomonas aeruginosa PA01
acugcucgggcgucuccugcc

SEQ ID NO: 1530424 - RNA, 19 nt, Pseudomonas aeruginosa PA01
acugcucgaacugcuccug

SEQ ID NO: 1530425 - RNA, 18 nt, Pseudomonas aeruginosa PA01
acugcgguuuuccugccc

SEQ ID NO: 1530426 - RNA, 19 nt, Pseudomonas aeruginosa PA01
acugcgguuuuccugcccc

SEQ ID NO: 1530427 - RNA, 21 nt, Pseudomonas aeruginosa PA01
acugcuggguacgguuggcca

SEQ ID NO: 1530428 - RNA, 22 nt, Pseudomonas aeruginosa PA01
acucccggccuggugacccgga

SEQ ID NO: 1530429 - RNA, 18 nt, Pseudomonas aeruginosa PA01
acuccggcagcacccgca

SEQ ID NO: 1530430 - RNA, 22 nt, Pseudomonas aeruginosa PA01
acuccggguugaccgccagaca

SEQ ID NO: 1530431 - RNA, 17 nt, Pseudomonas aeruginosa PA01
acuccgucuccagcaac

SEQ ID NO: 1530432 - RNA, 16 nt, Pseudomonas aeruginosa PA01
acuccuccagcaucca

SEQ ID NO: 1530433 - RNA, 15 nt, Pseudomonas aeruginosa PA01
acuccuccgccugca

SEQ ID NO: 1530434 - RNA, 18 nt, Pseudomonas aeruginosa PA01
acuccuccgccugcacgu

SEQ ID NO: 1530435 - RNA, 16 nt, Pseudomonas aeruginosa PA01
acucgagcaccaccac

SEQ ID NO: 1530436 - RNA, 14 nt, Pseudomonas aeruginosa PA01
acucgacgcgccag

SEQ ID NO: 1530437 - RNA, 16 nt, Pseudomonas aeruginosa PA01
acucgaaggccagcuc

SEQ ID NO: 1530438 - RNA, 20 nt, Pseudomonas aeruginosa PA01
acucgacaggccauucuucu

SEQ ID NO: 1530439 - RNA, 17 nt, Pseudomonas aeruginosa PA01
acucgcugccggcgcgc

SEQ ID NO: 1530440 - RNA, 13 nt, Pseudomonas aeruginosa PA01
acucggcgccgau

SEQ ID NO: 1530441 - RNA, 21 nt, Pseudomonas aeruginosa PA01
acucguugcacgcaggccgcu

SEQ ID NO: 1530442 - RNA, 18 nt, Pseudomonas aeruginosa PA01
acucguguuccggcagga

SEQ ID NO: 1530443 - RNA, 22 nt, Pseudomonas aeruginosa PA01
acucggcggggcgcagcaggau

SEQ ID NO: 1530444 - RNA, 23 nt, Pseudomonas aeruginosa PA01
acucggcggggcgcagcaggauc

SEQ ID NO: 1530445 - RNA, 19 nt, Pseudomonas aeruginosa PA01
acucggccagcaaugcccg

SEQ ID NO: 1530446 - RNA, 18 nt, Pseudomonas aeruginosa PA01
acucugguagcugcggcc

SEQ ID NO: 1530447 - RNA, 18 nt, Pseudomonas aeruginosa PA01
acucuuccagggucggca

SEQ ID NO: 1530448 - RNA, 19 nt, Pseudomonas aeruginosa PA01
acuucgaagccgagcugcc

SEQ ID NO: 1530449 - RNA, 19 nt, Pseudomonas aeruginosa PA01
acuucggcaagcaccuuga

SEQ ID NO: 1530450 - RNA, 22 nt, Pseudomonas aeruginosa PA01
acuucggcgcgcggcagcacca

SEQ ID NO: 1530451 - RNA, 22 nt, Pseudomonas aeruginosa PA01
acuucggcgguggggccgccga

SEQ ID NO: 1530452 - RNA, 13 nt, Pseudomonas aeruginosa PA01
acuucggcuucaa

SEQ ID NO: 1530453 - RNA, 15 nt, Pseudomonas aeruginosa PA01
acuucggcuucaacg

SEQ ID NO: 1530454 - RNA, 15 nt, Pseudomonas aeruginosa PA01
acuuccggcccggcc

SEQ ID NO: 1530455 - RNA, 17 nt, Pseudomonas aeruginosa PA01
acuuccggcccggccag

SEQ ID NO: 1530456 - RNA, 19 nt, Pseudomonas aeruginosa PA01
acuuccggcccggccaggc

SEQ ID NO: 1530457 - RNA, 20 nt, Pseudomonas aeruginosa PA01
acuuccggcccggccaggcg

SEQ ID NO: 1530458 - RNA, 20 nt, Pseudomonas aeruginosa PA01
acuucccaggugcccuggaa

SEQ ID NO: 1530459 - RNA, 23 nt, Pseudomonas aeruginosa PA01
acuuccaccggcuugccgggugc

SEQ ID NO: 1530460 - RNA, 15 nt, Pseudomonas aeruginosa PA01
acuuccagcugccag

SEQ ID NO: 1530461 - RNA, 11 nt, Pseudomonas aeruginosa PA01
acuuccaggcg

SEQ ID NO: 1530462 - RNA, 20 nt, Pseudomonas aeruginosa PA01
acuuccagguagcccaccuc

SEQ ID NO: 1530463 - RNA, 18 nt, Pseudomonas aeruginosa PA01
acuucucgaacagcuccu

SEQ ID NO: 1530464 - RNA, 16 nt, Pseudomonas aeruginosa PA01
acuucgguggauucga

SEQ ID NO: 1530465 - RNA, 15 nt, Pseudomonas aeruginosa PA01
acuugaacagggucu

SEQ ID NO: 1530466 - RNA, 14 nt, Pseudomonas aeruginosa PA01
acuucacguccagc

SEQ ID NO: 1530467 - RNA, 19 nt, Pseudomonas aeruginosa PA01
acuucagcgcauacgaaaa

SEQ ID NO: 1530468 - RNA, 12 nt, Pseudomonas aeruginosa PA01
acuguugcucgg

SEQ ID NO: 1530469 - RNA, 21 nt, Pseudomonas aeruginosa PA01
acuguuggggcugcccaccac

SEQ ID NO: 1530470 - RNA, 14 nt, Pseudomonas aeruginosa PA01
acuagcccucgacc

SEQ ID NO: 1530471 - RNA, 18 nt, Pseudomonas aeruginosa PA01
acuaccagguucugccag

SEQ ID NO: 1530472 - RNA, 20 nt, Pseudomonas aeruginosa PA01
acuaccagguucugccagag

SEQ ID NO: 1530473 - RNA, 15 nt, Pseudomonas aeruginosa PA01
acgucuugcaggcuc

SEQ ID NO: 1530474 - RNA, 18 nt, Pseudomonas aeruginosa PA01
acgugcccauuuuccaac

SEQ ID NO: 1530475 - RNA, 18 nt, Pseudomonas aeruginosa PA01
acgugaagccccuggcgc

SEQ ID NO: 1530476 - RNA, 19 nt, Pseudomonas aeruginosa PA01
acguaggagccggccaggc

SEQ ID NO: 1530477 - RNA, 23 nt, Pseudomonas aeruginosa PA01
acguagccgcccuuuuccggaua

SEQ ID NO: 1530478 - RNA, 16 nt, Pseudomonas aeruginosa PA01
acguugaacacaucga

SEQ ID NO: 1530479 - RNA, 17 nt, Pseudomonas aeruginosa PA01
acguugaacacaucgac

SEQ ID NO: 1530480 - RNA, 19 nt, Pseudomonas aeruginosa PA01
acguucuugaccuucugca

SEQ ID NO: 1530481 - RNA, 13 nt, Pseudomonas aeruginosa PA01
acguucaggcugu

SEQ ID NO: 1530482 - RNA, 14 nt, Pseudomonas aeruginosa PA01
acgugcggccugca

SEQ ID NO: 1530483 - RNA, 21 nt, Pseudomonas aeruginosa PA01
acguugcugcccuggcgcgcg

SEQ ID NO: 1530484 - RNA, 23 nt, Pseudomonas aeruginosa PA01
acguuggccgucuccaggcgcgc

SEQ ID NO: 1530485 - RNA, 13 nt, Pseudomonas aeruginosa PA01
acgcucaccacca

SEQ ID NO: 1530486 - RNA, 14 nt, Pseudomonas aeruginosa PA01
acgcucaccaccac

SEQ ID NO: 1530487 - RNA, 15 nt, Pseudomonas aeruginosa PA01
acgcucaccaccacc

SEQ ID NO: 1530488 - RNA, 15 nt, Pseudomonas aeruginosa PA01
acgcugaagaucgcc

SEQ ID NO: 1530489 - RNA, 23 nt, Pseudomonas aeruginosa PA01
acgcucaccggucgagagggaua

SEQ ID NO: 1530490 - RNA, 22 nt, Pseudomonas aeruginosa PA01
acgcucaggaagaagccucgcg

SEQ ID NO: 1530491 - RNA, 23 nt, Pseudomonas aeruginosa PA01
acgcuucgaagcucucgccgcgc

SEQ ID NO: 1530492 - RNA, 17 nt, Pseudomonas aeruginosa PA01
acgcuucgcagcauucg

SEQ ID NO: 1530493 - RNA, 17 nt, Pseudomonas aeruginosa PA01
acgcuguugguguugau

SEQ ID NO: 1530494 - RNA, 13 nt, Pseudomonas aeruginosa PA01
acgcuuccagcac

SEQ ID NO: 1530495 - RNA, 19 nt, Pseudomonas aeruginosa PA01
acgcugaucaucagcaggg

SEQ ID NO: 1530496 - RNA, 14 nt, Pseudomonas aeruginosa PA01
acgcugaugaugcc

SEQ ID NO: 1530497 - RNA, 15 nt, Pseudomonas aeruginosa PA01
acgcugaugccggcg

SEQ ID NO: 1530498 - RNA, 13 nt, Pseudomonas aeruginosa PA01
acgcugccagcag

SEQ ID NO: 1530499 - RNA, 14 nt, Pseudomonas aeruginosa PA01
acgcugccagcagg

SEQ ID NO: 1530500 - RNA, 20 nt, Pseudomonas aeruginosa PA01
acgcugcauguccgcaggca

SEQ ID NO: 1530501 - RNA, 17 nt, Pseudomonas aeruginosa PA01
acgcugacgccggcacc

SEQ ID NO: 1530502 - RNA, 18 nt, Pseudomonas aeruginosa PA01
acggaccgcgacaacccu

SEQ ID NO: 1530503 - RNA, 17 nt, Pseudomonas aeruginosa PA01
acggaaacgacaggcug

SEQ ID NO: 1530504 - RNA, 23 nt, Pseudomonas aeruginosa PA01
acgcuuggcgaucacggcgcccc

SEQ ID NO: 1530505 - RNA, 17 nt, Pseudomonas aeruginosa PA01
acgcuugagccccggca

SEQ ID NO: 1530506 - RNA, 18 nt, Pseudomonas aeruginosa PA01
acgcuugagccccggcag

SEQ ID NO: 1530507 - RNA, 15 nt, Pseudomonas aeruginosa PA01
acgcuucugcgccuc

SEQ ID NO: 1530508 - RNA, 13 nt, Pseudomonas aeruginosa PA01
acgguuggccucg

SEQ ID NO: 1530509 - RNA, 16 nt, Pseudomonas aeruginosa PA01
acguagaggaucucgc

SEQ ID NO: 1530510 - RNA, 15 nt, Pseudomonas aeruginosa PA01
acgguggaggcgggc

SEQ ID NO: 1530511 - RNA, 15 nt, Pseudomonas aeruginosa PA01
acggugaucaggcgc

SEQ ID NO: 1530512 - RNA, 15 nt, Pseudomonas aeruginosa PA01
acggugccauccgca

SEQ ID NO: 1530513 - RNA, 14 nt, Pseudomonas aeruginosa PA01
acggugcagccacc

SEQ ID NO: 1530514 - RNA, 20 nt, Pseudomonas aeruginosa PA01
acggugcagccacccagcag

SEQ ID NO: 1530515 - RNA, 15 nt, Pseudomonas aeruginosa PA01
acgggugccggagaa

SEQ ID NO: 1530516 - RNA, 21 nt, Pseudomonas aeruginosa PA01
acggguguuucggccgcugcc

SEQ ID NO: 1530517 - RNA, 13 nt, Pseudomonas aeruginosa PA01
acgguaaaacaag

SEQ ID NO: 1530518 - RNA, 15 nt, Pseudomonas aeruginosa PA01
acgggucgggucgag

SEQ ID NO: 1530519 - RNA, 16 nt, Pseudomonas aeruginosa PA01
acgggccgcgccgcaa

SEQ ID NO: 1530520 - RNA, 14 nt, Pseudomonas aeruginosa PA01
acgggcucacccac

SEQ ID NO: 1530521 - RNA, 15 nt, Pseudomonas aeruginosa PA01
acgggaaguaggccu

SEQ ID NO: 1530522 - RNA, 21 nt, Pseudomonas aeruginosa PA01
acgggcgaagacgaaguuggc

SEQ ID NO: 1530523 - RNA, 17 nt, Pseudomonas aeruginosa PA01
acggcuuguucagcucg

SEQ ID NO: 1530524 - RNA, 19 nt, Pseudomonas aeruginosa PA01
acggcuuguucagcucggc

SEQ ID NO: 1530525 - RNA, 22 nt, Pseudomonas aeruginosa PA01
acggcuucgcagaugucgguca

SEQ ID NO: 1530526 - RNA, 14 nt, Pseudomonas aeruginosa PA01
acggcuugcugaca

SEQ ID NO: 1530527 - RNA, 15 nt, Pseudomonas aeruginosa PA01
acgggaagcgaacca

SEQ ID NO: 1530528 - RNA, 13 nt, Pseudomonas aeruginosa PA01
acggcucuucccc

SEQ ID NO: 1530529 - RNA, 14 nt, Pseudomonas aeruginosa PA01
acggcucuuccccu

SEQ ID NO: 1530530 - RNA, 16 nt, Pseudomonas aeruginosa PA01
acggcuaucaggugag

SEQ ID NO: 1530531 - RNA, 16 nt, Pseudomonas aeruginosa PA01
acggcugcuccggauc

SEQ ID NO: 1530532 - RNA, 16 nt, Pseudomonas aeruginosa PA01
acggcaaggaccugcu

SEQ ID NO: 1530533 - RNA, 14 nt, Pseudomonas aeruginosa PA01
acggcgcagccgca

SEQ ID NO: 1530534 - RNA, 11 nt, Pseudomonas aeruginosa PA01
acggcgccccg

SEQ ID NO: 1530535 - RNA, 17 nt, Pseudomonas aeruginosa PA01
acggcgcccgagggcgc

SEQ ID NO: 1530536 - RNA, 13 nt, Pseudomonas aeruginosa PA01
acggcgcagggca

SEQ ID NO: 1530537 - RNA, 21 nt, Pseudomonas aeruginosa PA01
acggcgcggaacaucgcccgg

SEQ ID NO: 1530538 - RNA, 14 nt, Pseudomonas aeruginosa PA01
acggcgugccgggc

SEQ ID NO: 1530539 - RNA, 19 nt, Pseudomonas aeruginosa PA01
acggcgcugaacagcuggc

SEQ ID NO: 1530540 - RNA, 12 nt, Pseudomonas aeruginosa PA01
accucgccgguc

SEQ ID NO: 1530541 - RNA, 17 nt, Pseudomonas aeruginosa PA01
accucgcccaucgccag

SEQ ID NO: 1530542 - RNA, 14 nt, Pseudomonas aeruginosa PA01
accucggccaggcg

SEQ ID NO: 1530543 - RNA, 17 nt, Pseudomonas aeruginosa PA01
accucguuucccggcgc

SEQ ID NO: 1530544 - RNA, 18 nt, Pseudomonas aeruginosa PA01
accucggguuuggcgccc

SEQ ID NO: 1530545 - RNA, 16 nt, Pseudomonas aeruginosa PA01
accucgguagccggcc

SEQ ID NO: 1530546 - RNA, 17 nt, Pseudomonas aeruginosa PA01
accucgguagccggcca

SEQ ID NO: 1530547 - RNA, 17 nt, Pseudomonas aeruginosa PA01
accugaacgcgcccggc

SEQ ID NO: 1530548 - RNA, 23 nt, Pseudomonas aeruginosa PA01
accugaacgcgcccggccaggcc

SEQ ID NO: 1530549 - RNA, 22 nt, Pseudomonas aeruginosa PA01
accugagaucagcgcccggcac

SEQ ID NO: 1530550 - RNA, 21 nt, Pseudomonas aeruginosa PA01
accucuucgccauccuugagu

SEQ ID NO: 1530551 - RNA, 20 nt, Pseudomonas aeruginosa PA01
accucuggcugaagacccug

SEQ ID NO: 1530552 - RNA, 22 nt, Pseudomonas aeruginosa PA01
accucuggcugaagacccugca

SEQ ID NO: 1530553 - RNA, 23 nt, Pseudomonas aeruginosa PA01
accucuggcugaagacccugcac

SEQ ID NO: 1530554 - RNA, 18 nt, Pseudomonas aeruginosa PA01
accucugcguucugcugc

SEQ ID NO: 1530555 - RNA, 20 nt, Pseudomonas aeruginosa PA01
accggggccuucaggcgcuc

SEQ ID NO: 1530556 - RNA, 19 nt, Pseudomonas aeruginosa PA01
accucgaagcccagcgccu

SEQ ID NO: 1530557 - RNA, 21 nt, Pseudomonas aeruginosa PA01
accucgacgccgagccagccg

SEQ ID NO: 1530558 - RNA, 19 nt, Pseudomonas aeruginosa PA01
accucccgcgccagcucga

SEQ ID NO: 1530559 - RNA, 20 nt, Pseudomonas aeruginosa PA01
accucccgcgccagcucgaa

SEQ ID NO: 1530560 - RNA, 14 nt, Pseudomonas aeruginosa PA01
accuccgccagguc

SEQ ID NO: 1530561 - RNA, 13 nt, Pseudomonas aeruginosa PA01
accuccgccgcuu

SEQ ID NO: 1530562 - RNA, 17 nt, Pseudomonas aeruginosa PA01
accucauacuugggucg

SEQ ID NO: 1530563 - RNA, 18 nt, Pseudomonas aeruginosa PA01
acgaaaaagcccggcauu

SEQ ID NO: 1530564 - RNA, 16 nt, Pseudomonas aeruginosa PA01
acgaaaaaggcgcgcc

SEQ ID NO: 1530565 - RNA, 17 nt, Pseudomonas aeruginosa PA01
acgaaaaaggcgcgccg

SEQ ID NO: 1530566 - RNA, 14 nt, Pseudomonas aeruginosa PA01
acgaaccccgggcc

SEQ ID NO: 1530567 - RNA, 18 nt, Pseudomonas aeruginosa PA01
acgaaccccgggccgcgc

SEQ ID NO: 1530568 - RNA, 17 nt, Pseudomonas aeruginosa PA01
acgaacaucgccagcgc

SEQ ID NO: 1530569 - RNA, 11 nt, Pseudomonas aeruginosa PA01
acgaacagcuu

SEQ ID NO: 1530570 - RNA, 19 nt, Pseudomonas aeruginosa PA01
accuucgaggugucgucca

SEQ ID NO: 1530571 - RNA, 16 nt, Pseudomonas aeruginosa PA01
accuugcccuugaagc

SEQ ID NO: 1530572 - RNA, 18 nt, Pseudomonas aeruginosa PA01
accuugccgcgcccggcc

SEQ ID NO: 1530573 - RNA, 19 nt, Pseudomonas aeruginosa PA01
accuugcacauccagcccu

SEQ ID NO: 1530574 - RNA, 15 nt, Pseudomonas aeruginosa PA01
accuucgcccgcugc

SEQ ID NO: 1530575 - RNA, 22 nt, Pseudomonas aeruginosa PA01
accuucgaagacccccugccgc

SEQ ID NO: 1530576 - RNA, 16 nt, Pseudomonas aeruginosa PA01
accuucgaucacccgg

SEQ ID NO: 1530577 - RNA, 17 nt, Pseudomonas aeruginosa PA01
accuugcgguagcgcuc

SEQ ID NO: 1530578 - RNA, 17 nt, Pseudomonas aeruginosa PA01
accuugcgcaccgccug

SEQ ID NO: 1530579 - RNA, 16 nt, Pseudomonas aeruginosa PA01
accuugcgaaaagccc

SEQ ID NO: 1530580 - RNA, 18 nt, Pseudomonas aeruginosa PA01
accuuuagggauggauac

SEQ ID NO: 1530581 - RNA, 16 nt, Pseudomonas aeruginosa PA01
accuuccgccagcagg

SEQ ID NO: 1530582 - RNA, 22 nt, Pseudomonas aeruginosa PA01
accuguuucagcggguagcugc

SEQ ID NO: 1530583 - RNA, 20 nt, Pseudomonas aeruginosa PA01
accuggucuucgguggcggc

SEQ ID NO: 1530584 - RNA, 22 nt, Pseudomonas aeruginosa PA01
accugggauggggcugccggcc

SEQ ID NO: 1530585 - RNA, 15 nt, Pseudomonas aeruginosa PA01
accugggcaccagug

SEQ ID NO: 1530586 - RNA, 23 nt, Pseudomonas aeruginosa PA01
accuggguaccgacggucggcag

SEQ ID NO: 1530587 - RNA, 18 nt, Pseudomonas aeruginosa PA01
accuggggcggccucagg

SEQ ID NO: 1530588 - RNA, 18 nt, Pseudomonas aeruginosa PA01
accugggcguuggccagc

SEQ ID NO: 1530589 - RNA, 22 nt, Pseudomonas aeruginosa PA01
accugguagccgaagucggcgu

SEQ ID NO: 1530590 - RNA, 13 nt, Pseudomonas aeruginosa PA01
accugguagguca

SEQ ID NO: 1530591 - RNA, 22 nt, Pseudomonas aeruginosa PA01
accugguaggucacuuccguca

SEQ ID NO: 1530592 - RNA, 19 nt, Pseudomonas aeruginosa PA01
acgauggccggcagcagcg

SEQ ID NO: 1530593 - RNA, 14 nt, Pseudomonas aeruginosa PA01
acgauggccagccc

SEQ ID NO: 1530594 - RNA, 18 nt, Pseudomonas aeruginosa PA01
acgaugccguucaggcgc

SEQ ID NO: 1530595 - RNA, 13 nt, Pseudomonas aeruginosa PA01
acgaugcgcccca

SEQ ID NO: 1530596 - RNA, 12 nt, Pseudomonas aeruginosa PA01
acgaaggcgcgc

SEQ ID NO: 1530597 - RNA, 18 nt, Pseudomonas aeruginosa PA01
acgaaggcggcagcggug

SEQ ID NO: 1530598 - RNA, 21 nt, Pseudomonas aeruginosa PA01
acgaagcgcccucgcugagca

SEQ ID NO: 1530599 - RNA, 21 nt, Pseudomonas aeruginosa PA01
acgaagcgccggcggccugcc

SEQ ID NO: 1530600 - RNA, 18 nt, Pseudomonas aeruginosa PA01
acgaacucgacgcgccag

SEQ ID NO: 1530601 - RNA, 17 nt, Pseudomonas aeruginosa PA01
acgaagaaccccggcuc

SEQ ID NO: 1530602 - RNA, 20 nt, Pseudomonas aeruginosa PA01
acgaacggcaucuucaaucg

SEQ ID NO: 1530603 - RNA, 14 nt, Pseudomonas aeruginosa PA01
acgaaggcuggagc

SEQ ID NO: 1530604 - RNA, 22 nt, Pseudomonas aeruginosa PA01
acgaaggcuggagcgcugcgga

SEQ ID NO: 1530605 - RNA, 23 nt, Pseudomonas aeruginosa PA01
acgaagggcucagcccaggcgcc

SEQ ID NO: 1530606 - RNA, 23 nt, Pseudomonas aeruginosa PA01
acgacuucggcgacagccgggca

SEQ ID NO: 1530607 - RNA, 19 nt, Pseudomonas aeruginosa PA01
acgagaaaaagcccggcau

SEQ ID NO: 1530608 - RNA, 18 nt, Pseudomonas aeruginosa PA01
acgagaagccgaucaggu

SEQ ID NO: 1530609 - RNA, 23 nt, Pseudomonas aeruginosa PA01
acgaucauggugaagcccaccac

SEQ ID NO: 1530610 - RNA, 11 nt, Pseudomonas aeruginosa PA01
acgaucagccc

SEQ ID NO: 1530611 - RNA, 20 nt, Pseudomonas aeruginosa PA01
acgaucagcggcccgagcag

SEQ ID NO: 1530612 - RNA, 22 nt, Pseudomonas aeruginosa PA01
acgaucagcggcccgagcaggc

SEQ ID NO: 1530613 - RNA, 21 nt, Pseudomonas aeruginosa PA01
acgaucagcucguugcccggc

SEQ ID NO: 1530614 - RNA, 21 nt, Pseudomonas aeruginosa PA01
acgaggcgaggguggcgccca

SEQ ID NO: 1530615 - RNA, 16 nt, Pseudomonas aeruginosa PA01
acgaggcgggcuggaa

SEQ ID NO: 1530616 - RNA, 17 nt, Pseudomonas aeruginosa PA01
acgaggaacgccucgca

SEQ ID NO: 1530617 - RNA, 13 nt, Pseudomonas aeruginosa PA01
acgaggaaggcgc

SEQ ID NO: 1530618 - RNA, 23 nt, Pseudomonas aeruginosa PA01
acgagcuuggccacuccgggcug

SEQ ID NO: 1530619 - RNA, 21 nt, Pseudomonas aeruginosa PA01
acgagagguugcuguagaaug

SEQ ID NO: 1530620 - RNA, 12 nt, Pseudomonas aeruginosa PA01
acgcacucauag

SEQ ID NO: 1530621 - RNA, 12 nt, Pseudomonas aeruginosa PA01
acgcagaaggcg

SEQ ID NO: 1530622 - RNA, 21 nt, Pseudomonas aeruginosa PA01
acgcacugguugaagcgggag

SEQ ID NO: 1530623 - RNA, 11 nt, Pseudomonas aeruginosa PA01
acgcagcagcu

SEQ ID NO: 1530624 - RNA, 23 nt, Pseudomonas aeruginosa PA01
acgcagccguuggccagcaggcg

SEQ ID NO: 1530625 - RNA, 19 nt, Pseudomonas aeruginosa PA01
acgcagcgcgcgccgagca

SEQ ID NO: 1530626 - RNA, 20 nt, Pseudomonas aeruginosa PA01
acgcagcgcgcgccgagcaa

SEQ ID NO: 1530627 - RNA, 22 nt, Pseudomonas aeruginosa PA01
acgcagcgggucgaucaggcgc

SEQ ID NO: 1530628 - RNA, 23 nt, Pseudomonas aeruginosa PA01
acgcagccacccgcgggcagcag

SEQ ID NO: 1530629 - RNA, 21 nt, Pseudomonas aeruginosa PA01
acgcagccgggccgcagcgca

SEQ ID NO: 1530630 - RNA, 14 nt, Pseudomonas aeruginosa PA01
acgcaggccagcgc

SEQ ID NO: 1530631 - RNA, 17 nt, Pseudomonas aeruginosa PA01
acgcaggaacagcuccu

SEQ ID NO: 1530632 - RNA, 13 nt, Pseudomonas aeruginosa PA01
acgcaagugcccu

SEQ ID NO: 1530633 - RNA, 16 nt, Pseudomonas aeruginosa PA01
acgcacaaugaaaaag

SEQ ID NO: 1530634 - RNA, 18 nt, Pseudomonas aeruginosa PA01
acgcaccucgucgagcag

SEQ ID NO: 1530635 - RNA, 18 nt, Pseudomonas aeruginosa PA01
acgcagugggaagcucac

SEQ ID NO: 1530636 - RNA, 20 nt, Pseudomonas aeruginosa PA01
acgcaggcuuuccagcccgg

SEQ ID NO: 1530637 - RNA, 21 nt, Pseudomonas aeruginosa PA01
acgcaggcuuuccagcccggc

SEQ ID NO: 1530638 - RNA, 19 nt, Pseudomonas aeruginosa PA01
acgcauguucaugcgcugg

SEQ ID NO: 1530639 - RNA, 23 nt, Pseudomonas aeruginosa PA01
acgccagcggcgaucgccugguc

SEQ ID NO: 1530640 - RNA, 16 nt, Pseudomonas aeruginosa PA01
acgccagccgcccugg

SEQ ID NO: 1530641 - RNA, 16 nt, Pseudomonas aeruginosa PA01
acgccaggaucggcau

SEQ ID NO: 1530642 - RNA, 22 nt, Pseudomonas aeruginosa PA01
acgccaggcagucguaggucug

SEQ ID NO: 1530643 - RNA, 17 nt, Pseudomonas aeruginosa PA01
acgccaccagccaggcg

SEQ ID NO: 1530644 - RNA, 16 nt, Pseudomonas aeruginosa PA01
accgccgagggcgcca

SEQ ID NO: 1530645 - RNA, 14 nt, Pseudomonas aeruginosa PA01
accgcccccggcgc

SEQ ID NO: 1530646 - RNA, 20 nt, Pseudomonas aeruginosa PA01
accgcccaggcugccgccgc

SEQ ID NO: 1530647 - RNA, 22 nt, Pseudomonas aeruginosa PA01
accgcccaggcugccgccgccg

SEQ ID NO: 1530648 - RNA, 12 nt, Pseudomonas aeruginosa PA01
accgccagcagu

SEQ ID NO: 1530649 - RNA, 14 nt, Pseudomonas aeruginosa PA01
accgccagcccgcc

SEQ ID NO: 1530650 - RNA, 15 nt, Pseudomonas aeruginosa PA01
accgcccacccugcg

SEQ ID NO: 1530651 - RNA, 13 nt, Pseudomonas aeruginosa PA01
accgccaggcggc

SEQ ID NO: 1530652 - RNA, 15 nt, Pseudomonas aeruginosa PA01
accgccaggcggccg

SEQ ID NO: 1530653 - RNA, 20 nt, Pseudomonas aeruginosa PA01
accgcauaggucaugcccag

SEQ ID NO: 1530654 - RNA, 13 nt, Pseudomonas aeruginosa PA01
accgcaccgccag

SEQ ID NO: 1530655 - RNA, 15 nt, Pseudomonas aeruginosa PA01
accgcaccuggugga

SEQ ID NO: 1530656 - RNA, 19 nt, Pseudomonas aeruginosa PA01
accgcaagggugcucagga

SEQ ID NO: 1530657 - RNA, 19 nt, Pseudomonas aeruginosa PA01
accgcaaccgguccucgcc

SEQ ID NO: 1530658 - RNA, 15 nt, Pseudomonas aeruginosa PA01
accgauccagcaguc

SEQ ID NO: 1530659 - RNA, 19 nt, Pseudomonas aeruginosa PA01
accgagcagcggacgcagc

SEQ ID NO: 1530660 - RNA, 20 nt, Pseudomonas aeruginosa PA01
acccucuccccaaccuucuc

SEQ ID NO: 1530661 - RNA, 14 nt, Pseudomonas aeruginosa PA01
acccucggcgaggg

SEQ ID NO: 1530662 - RNA, 16 nt, Pseudomonas aeruginosa PA01
acccucggugcggccg

SEQ ID NO: 1530663 - RNA, 15 nt, Pseudomonas aeruginosa PA01
accgagacgcccugg

SEQ ID NO: 1530664 - RNA, 17 nt, Pseudomonas aeruginosa PA01
accgagacgcccuggau

SEQ ID NO: 1530665 - RNA, 21 nt, Pseudomonas aeruginosa PA01
accgagacgugaagccccugg

SEQ ID NO: 1530666 - RNA, 22 nt, Pseudomonas aeruginosa PA01
acccguugcgccucgccgcccg

SEQ ID NO: 1530667 - RNA, 20 nt, Pseudomonas aeruginosa PA01
acccucagucgcccccaccg

SEQ ID NO: 1530668 - RNA, 16 nt, Pseudomonas aeruginosa PA01
acccgugguccgccag

SEQ ID NO: 1530669 - RNA, 17 nt, Pseudomonas aeruginosa PA01
accggccgcagcagguu

SEQ ID NO: 1530670 - RNA, 23 nt, Pseudomonas aeruginosa PA01
accggccaggcgguccagccaga

SEQ ID NO: 1530671 - RNA, 14 nt, Pseudomonas aeruginosa PA01
accggaucgcccug

SEQ ID NO: 1530672 - RNA, 13 nt, Pseudomonas aeruginosa PA01
accgcugcggccg

SEQ ID NO: 1530673 - RNA, 17 nt, Pseudomonas aeruginosa PA01
accgcugcgugccaggg

SEQ ID NO: 1530674 - RNA, 17 nt, Pseudomonas aeruginosa PA01
accgggccgaccugccc

SEQ ID NO: 1530675 - RNA, 15 nt, Pseudomonas aeruginosa PA01
accgggcgccucguc

SEQ ID NO: 1530676 - RNA, 23 nt, Pseudomonas aeruginosa PA01
accggcucgucggcguugcugau

SEQ ID NO: 1530677 - RNA, 16 nt, Pseudomonas aeruginosa PA01
accggcugcuuggcca

SEQ ID NO: 1530678 - RNA, 19 nt, Pseudomonas aeruginosa PA01
accggcugcuuggccaggu

SEQ ID NO: 1530679 - RNA, 19 nt, Pseudomonas aeruginosa PA01
accggcgcgccggacaggc

SEQ ID NO: 1530680 - RNA, 14 nt, Pseudomonas aeruginosa PA01
accggccggcaggc

SEQ ID NO: 1530681 - RNA, 17 nt, Pseudomonas aeruginosa PA01
accggcgaaccagugca

SEQ ID NO: 1530682 - RNA, 22 nt, Pseudomonas aeruginosa PA01
accggcgaaccagugcaccgcc

SEQ ID NO: 1530683 - RNA, 20 nt, Pseudomonas aeruginosa PA01
accgcgcucggcggucaggc

SEQ ID NO: 1530684 - RNA, 11 nt, Pseudomonas aeruginosa PA01
accgcggcgcc

SEQ ID NO: 1530685 - RNA, 11 nt, Pseudomonas aeruginosa PA01
accgcggcgcu

SEQ ID NO: 1530686 - RNA, 17 nt, Pseudomonas aeruginosa PA01
accgcgguggaggcggc

SEQ ID NO: 1530687 - RNA, 22 nt, Pseudomonas aeruginosa PA01
accgcgggggucggaugcagcg

SEQ ID NO: 1530688 - RNA, 14 nt, Pseudomonas aeruginosa PA01
accgcgcagaugau

SEQ ID NO: 1530689 - RNA, 20 nt, Pseudomonas aeruginosa PA01
accgcgcagaugaucgccac

SEQ ID NO: 1530690 - RNA, 22 nt, Pseudomonas aeruginosa PA01
accgcgccgauguacggcacca

SEQ ID NO: 1530691 - RNA, 21 nt, Pseudomonas aeruginosa PA01
accgcgcgccugcaacgccag

SEQ ID NO: 1530692 - RNA, 13 nt, Pseudomonas aeruginosa PA01
accgcgcgcgcaa

SEQ ID NO: 1530693 - RNA, 18 nt, Pseudomonas aeruginosa PA01
accgcgccuuccagcccu

SEQ ID NO: 1530694 - RNA, 20 nt, Pseudomonas aeruginosa PA01
accgcgaauccgcggcccug

SEQ ID NO: 1530695 - RNA, 20 nt, Pseudomonas aeruginosa PA01
accgcgaauggcagcaggca

SEQ ID NO: 1530696 - RNA, 20 nt, Pseudomonas aeruginosa PA01
accgcgagcaugcucacugc

SEQ ID NO: 1530697 - RNA, 21 nt, Pseudomonas aeruginosa PA01
accgcgagcgccgccuugagc

SEQ ID NO: 1530698 - RNA, 21 nt, Pseudomonas aeruginosa PA01
accgccugcagcaccaccucg

SEQ ID NO: 1530699 - RNA, 17 nt, Pseudomonas aeruginosa PA01
accgccuggucgccggg

SEQ ID NO: 1530700 - RNA, 22 nt, Pseudomonas aeruginosa PA01
accgccucggagaacagcagcg

SEQ ID NO: 1530701 - RNA, 21 nt, Pseudomonas aeruginosa PA01
accgccggaaccuguccgaac

SEQ ID NO: 1530702 - RNA, 17 nt, Pseudomonas aeruginosa PA01
accgccgccagcaacag

SEQ ID NO: 1530703 - RNA, 18 nt, Pseudomonas aeruginosa PA01
accaucaccgccaucagc

SEQ ID NO: 1530704 - RNA, 21 nt, Pseudomonas aeruginosa PA01
accagaacgaaaaaggcgcgc

SEQ ID NO: 1530705 - RNA, 23 nt, Pseudomonas aeruginosa PA01
accagaacgaaaaaggcgcgccg

SEQ ID NO: 1530706 - RNA, 19 nt, Pseudomonas aeruginosa PA01
accaugcuccgccuggcgg

SEQ ID NO: 1530707 - RNA, 12 nt, Pseudomonas aeruginosa PA01
accauggucuuu

SEQ ID NO: 1530708 - RNA, 13 nt, Pseudomonas aeruginosa PA01
accaucagccagc

SEQ ID NO: 1530709 - RNA, 15 nt, Pseudomonas aeruginosa PA01
accaucagccagccc

SEQ ID NO: 1530710 - RNA, 13 nt, Pseudomonas aeruginosa PA01
accauccagccug

SEQ ID NO: 1530711 - RNA, 18 nt, Pseudomonas aeruginosa PA01
accauugcggcccgccac

SEQ ID NO: 1530712 - RNA, 21 nt, Pseudomonas aeruginosa PA01
accauugcggcccgccacaga

SEQ ID NO: 1530713 - RNA, 19 nt, Pseudomonas aeruginosa PA01
accauguucaccagcgcug

SEQ ID NO: 1530714 - RNA, 13 nt, Pseudomonas aeruginosa PA01
acccaaucacaac

SEQ ID NO: 1530715 - RNA, 14 nt, Pseudomonas aeruginosa PA01
acccccagcaggcc

SEQ ID NO: 1530716 - RNA, 15 nt, Pseudomonas aeruginosa PA01
accccccaauugccc

SEQ ID NO: 1530717 - RNA, 18 nt, Pseudomonas aeruginosa PA01
accccgcaaccgcagacu

SEQ ID NO: 1530718 - RNA, 18 nt, Pseudomonas aeruginosa PA01
accccgccgcuggcggca

SEQ ID NO: 1530719 - RNA, 17 nt, Pseudomonas aeruginosa PA01
acccaucugccggccac

SEQ ID NO: 1530720 - RNA, 17 nt, Pseudomonas aeruginosa PA01
acccaccgaccaccauc

SEQ ID NO: 1530721 - RNA, 18 nt, Pseudomonas aeruginosa PA01
acccaccgaccaccauca

SEQ ID NO: 1530722 - RNA, 21 nt, Pseudomonas aeruginosa PA01
accccuucgagcaacacaugc

SEQ ID NO: 1530723 - RNA, 22 nt, Pseudomonas aeruginosa PA01
accccuucggucgcgccccgcc

SEQ ID NO: 1530724 - RNA, 20 nt, Pseudomonas aeruginosa PA01
acccgccucgucgccaugcg

SEQ ID NO: 1530725 - RNA, 17 nt, Pseudomonas aeruginosa PA01
acccgcgaccacaggcg

SEQ ID NO: 1530726 - RNA, 16 nt, Pseudomonas aeruginosa PA01
acccgcgucccuugcg

SEQ ID NO: 1530727 - RNA, 20 nt, Pseudomonas aeruginosa PA01
acccgcgucccuugcgggua

SEQ ID NO: 1530728 - RNA, 14 nt, Pseudomonas aeruginosa PA01
acccgcggcgaggu

SEQ ID NO: 1530729 - RNA, 23 nt, Pseudomonas aeruginosa PA01
acccgcggcgagguugcccacgg

SEQ ID NO: 1530730 - RNA, 14 nt, Pseudomonas aeruginosa PA01
acccgcuccggcuc

SEQ ID NO: 1530731 - RNA, 15 nt, Pseudomonas aeruginosa PA01
acccgcuccggcucu

SEQ ID NO: 1530732 - RNA, 19 nt, Pseudomonas aeruginosa PA01
acccgcuccgucgcuucgc

SEQ ID NO: 1530733 - RNA, 23 nt, Pseudomonas aeruginosa PA01
acccgcgccgccgcggccagccc

SEQ ID NO: 1530734 - RNA, 15 nt, Pseudomonas aeruginosa PA01
acccgcgccugcagg

SEQ ID NO: 1530735 - RNA, 16 nt, Pseudomonas aeruginosa PA01
acccgcuguccgccgg

SEQ ID NO: 1530736 - RNA, 15 nt, Pseudomonas aeruginosa PA01
acccgcugcggaaga

SEQ ID NO: 1530737 - RNA, 23 nt, Pseudomonas aeruginosa PA01
acccgcucgccgggaaucgccag

SEQ ID NO: 1530738 - RNA, 13 nt, Pseudomonas aeruginosa PA01
acccggcagggcc

SEQ ID NO: 1530739 - RNA, 15 nt, Pseudomonas aeruginosa PA01
acccggcagggccag

SEQ ID NO: 1530740 - RNA, 13 nt, Pseudomonas aeruginosa PA01
acccggcccaugg

SEQ ID NO: 1530741 - RNA, 15 nt, Pseudomonas aeruginosa PA01
acccggccagcccgg

SEQ ID NO: 1530742 - RNA, 17 nt, Pseudomonas aeruginosa PA01
acccggccagcccggcc

SEQ ID NO: 1530743 - RNA, 13 nt, Pseudomonas aeruginosa PA01
acccggacagccu

SEQ ID NO: 1530744 - RNA, 17 nt, Pseudomonas aeruginosa PA01
acccggccgaccaggug

SEQ ID NO: 1530745 - RNA, 15 nt, Pseudomonas aeruginosa PA01
acccggcgcccggcg

SEQ ID NO: 1530746 - RNA, 16 nt, Pseudomonas aeruginosa PA01
acccggcgcccggcgc

SEQ ID NO: 1530747 - RNA, 16 nt, Pseudomonas aeruginosa PA01
acccgggcgaccugcu

SEQ ID NO: 1530748 - RNA, 17 nt, Pseudomonas aeruginosa PA01
acccgggcgaccugcuc

SEQ ID NO: 1530749 - RNA, 19 nt, Pseudomonas aeruginosa PA01
agaaagcgcaggaagcugc

SEQ ID NO: 1530750 - RNA, 22 nt, Pseudomonas aeruginosa PA01
agaaaccgaucagcaccgccac

SEQ ID NO: 1530751 - RNA, 11 nt, Pseudomonas aeruginosa PA01
agaaacugcag

SEQ ID NO: 1530752 - RNA, 12 nt, Pseudomonas aeruginosa PA01
agaaacugcagg

SEQ ID NO: 1530753 - RNA, 13 nt, Pseudomonas aeruginosa PA01
acuugaucagccg

SEQ ID NO: 1530754 - RNA, 12 nt, Pseudomonas aeruginosa PA01
agaaaacccugg

SEQ ID NO: 1530755 - RNA, 16 nt, Pseudomonas aeruginosa PA01
agaaaaggcccgcuga

SEQ ID NO: 1530756 - RNA, 23 nt, Pseudomonas aeruginosa PA01
agaagaugccaaguugccuggca

SEQ ID NO: 1530757 - RNA, 19 nt, Pseudomonas aeruginosa PA01
agaagcugccccacaggcc

SEQ ID NO: 1530758 - RNA, 22 nt, Pseudomonas aeruginosa PA01
agaacuccuugccguggcuccu

SEQ ID NO: 1530759 - RNA, 15 nt, Pseudomonas aeruginosa PA01
agaacccggccaggc

SEQ ID NO: 1530760 - RNA, 15 nt, Pseudomonas aeruginosa PA01
agaaccgccagcagu

SEQ ID NO: 1530761 - RNA, 16 nt, Pseudomonas aeruginosa PA01
agaaccgccagcagug

SEQ ID NO: 1530762 - RNA, 22 nt, Pseudomonas aeruginosa PA01
agaacaggcgcuucagcucgag

SEQ ID NO: 1530763 - RNA, 17 nt, Pseudomonas aeruginosa PA01
agaacaggcugccgcag

SEQ ID NO: 1530764 - RNA, 13 nt, Pseudomonas aeruginosa PA01
agaacagcagggu

SEQ ID NO: 1530765 - RNA, 13 nt, Pseudomonas aeruginosa PA01
agaacacccgggu

SEQ ID NO: 1530766 - RNA, 15 nt, Pseudomonas aeruginosa PA01
agacacaaaaaaccc

SEQ ID NO: 1530767 - RNA, 15 nt, Pseudomonas aeruginosa PA01
agaaugaaaaaggga

SEQ ID NO: 1530768 - RNA, 12 nt, Pseudomonas aeruginosa PA01
agaagucccagc

SEQ ID NO: 1530769 - RNA, 17 nt, Pseudomonas aeruginosa PA01
agaaggcguccagggcu

SEQ ID NO: 1530770 - RNA, 14 nt, Pseudomonas aeruginosa PA01
agaaggugcccagc

SEQ ID NO: 1530771 - RNA, 22 nt, Pseudomonas aeruginosa PA01
agaagguucucggccaccacca

SEQ ID NO: 1530772 - RNA, 21 nt, Pseudomonas aeruginosa PA01
agaccgacccucauggaaacc

SEQ ID NO: 1530773 - RNA, 17 nt, Pseudomonas aeruginosa PA01
agaccgcagcccaguuc

SEQ ID NO: 1530774 - RNA, 17 nt, Pseudomonas aeruginosa PA01
agaccuuccugccagcg

SEQ ID NO: 1530775 - RNA, 22 nt, Pseudomonas aeruginosa PA01
agaccuggccgcuguggaagua

SEQ ID NO: 1530776 - RNA, 23 nt, Pseudomonas aeruginosa PA01
agaccuggccgcuguggaaguac

SEQ ID NO: 1530777 - RNA, 21 nt, Pseudomonas aeruginosa PA01
agaccuggcugaauaccacgu

SEQ ID NO: 1530778 - RNA, 21 nt, Pseudomonas aeruginosa PA01
agaccugccgcccggccaggc

SEQ ID NO: 1530779 - RNA, 22 nt, Pseudomonas aeruginosa PA01
agaccugccgcccggccaggcc

SEQ ID NO: 1530780 - RNA, 14 nt, Pseudomonas aeruginosa PA01
agaccugcagcagg

SEQ ID NO: 1530781 - RNA, 20 nt, Pseudomonas aeruginosa PA01
agacgcagccguuggccagc

SEQ ID NO: 1530782 - RNA, 23 nt, Pseudomonas aeruginosa PA01
agacgcaggguucggggaacagc

SEQ ID NO: 1530783 - RNA, 16 nt, Pseudomonas aeruginosa PA01
agacgguucagcagcg

SEQ ID NO: 1530784 - RNA, 17 nt, Pseudomonas aeruginosa PA01
agacgguucagcagcgg

SEQ ID NO: 1530785 - RNA, 17 nt, Pseudomonas aeruginosa PA01
agacgcaccgagggcau

SEQ ID NO: 1530786 - RNA, 16 nt, Pseudomonas aeruginosa PA01
agacgcccagcagggc

SEQ ID NO: 1530787 - RNA, 17 nt, Pseudomonas aeruginosa PA01
agacgcccagcagggcc

SEQ ID NO: 1530788 - RNA, 20 nt, Pseudomonas aeruginosa PA01
agacgcccagcagggccagc

SEQ ID NO: 1530789 - RNA, 21 nt, Pseudomonas aeruginosa PA01
agacgccgaggagacgcggca

SEQ ID NO: 1530790 - RNA, 19 nt, Pseudomonas aeruginosa PA01
agacggggccucgcugccu

SEQ ID NO: 1530791 - RNA, 18 nt, Pseudomonas aeruginosa PA01
agacaggaaucgacccag

SEQ ID NO: 1530792 - RNA, 18 nt, Pseudomonas aeruginosa PA01
agaccaccgugcgcaccu

SEQ ID NO: 1530793 - RNA, 13 nt, Pseudomonas aeruginosa PA01
agaccaccagcag

SEQ ID NO: 1530794 - RNA, 15 nt, Pseudomonas aeruginosa PA01
agaccaccagcagca

SEQ ID NO: 1530795 - RNA, 13 nt, Pseudomonas aeruginosa PA01
agaccacgcaggc

SEQ ID NO: 1530796 - RNA, 20 nt, Pseudomonas aeruginosa PA01
agaccacgcaggccagcgcc

SEQ ID NO: 1530797 - RNA, 20 nt, Pseudomonas aeruginosa PA01
agaccagcagcgcaccaucc

SEQ ID NO: 1530798 - RNA, 21 nt, Pseudomonas aeruginosa PA01
agaccagcagcggcagccacu

SEQ ID NO: 1530799 - RNA, 12 nt, Pseudomonas aeruginosa PA01
agaccaucagcu

SEQ ID NO: 1530800 - RNA, 15 nt, Pseudomonas aeruginosa PA01
agaccagggugggga

SEQ ID NO: 1530801 - RNA, 24 nt, Pseudomonas aeruginosa PA01
agaccagcgcaagcggcggcuuca

SEQ ID NO: 1530802 - RNA, 18 nt, Pseudomonas aeruginosa PA01
agaccaggccgagcagga

SEQ ID NO: 1530803 - RNA, 20 nt, Pseudomonas aeruginosa PA01
agagcgcgcccugcaggccg

SEQ ID NO: 1530804 - RNA, 18 nt, Pseudomonas aeruginosa PA01
agagcgccaugacccgcg

SEQ ID NO: 1530805 - RNA, 14 nt, Pseudomonas aeruginosa PA01
agagcagcaccagc

SEQ ID NO: 1530806 - RNA, 15 nt, Pseudomonas aeruginosa PA01
agagcagcaccagca

SEQ ID NO: 1530807 - RNA, 16 nt, Pseudomonas aeruginosa PA01
agagcagcaccagcac

SEQ ID NO: 1530808 - RNA, 17 nt, Pseudomonas aeruginosa PA01
agagcagacacaaaaaa

SEQ ID NO: 1530809 - RNA, 16 nt, Pseudomonas aeruginosa PA01
agacgucuuccgggac

SEQ ID NO: 1530810 - RNA, 12 nt, Pseudomonas aeruginosa PA01
agacgugcuggu

SEQ ID NO: 1530811 - RNA, 14 nt, Pseudomonas aeruginosa PA01
agacgugcugguag

SEQ ID NO: 1530812 - RNA, 18 nt, Pseudomonas aeruginosa PA01
agagaugcaccggccacu

SEQ ID NO: 1530813 - RNA, 13 nt, Pseudomonas aeruginosa PA01
agagguugccgug

SEQ ID NO: 1530814 - RNA, 13 nt, Pseudomonas aeruginosa PA01
agagguugcgccc

SEQ ID NO: 1530815 - RNA, 14 nt, Pseudomonas aeruginosa PA01
agagguugcuguag

SEQ ID NO: 1530816 - RNA, 15 nt, Pseudomonas aeruginosa PA01
agaggucggcgcgcc

SEQ ID NO: 1530817 - RNA, 14 nt, Pseudomonas aeruginosa PA01
agaggggcgcucgu

SEQ ID NO: 1530818 - RNA, 15 nt, Pseudomonas aeruginosa PA01
agaggcugcgcucca

SEQ ID NO: 1530819 - RNA, 19 nt, Pseudomonas aeruginosa PA01
agaggcugcgcuccaggcg

SEQ ID NO: 1530820 - RNA, 12 nt, Pseudomonas aeruginosa PA01
agaggcucaacu

SEQ ID NO: 1530821 - RNA, 16 nt, Pseudomonas aeruginosa PA01
agaggcucggcggcca

SEQ ID NO: 1530822 - RNA, 19 nt, Pseudomonas aeruginosa PA01
agagcuugcugaagcccca

SEQ ID NO: 1530823 - RNA, 19 nt, Pseudomonas aeruginosa PA01
agagcuuggcucgguucau

SEQ ID NO: 1530824 - RNA, 22 nt, Pseudomonas aeruginosa PA01
agaggcaacaccaucggcccca

SEQ ID NO: 1530825 - RNA, 15 nt, Pseudomonas aeruginosa PA01
agaggaugccggccu

SEQ ID NO: 1530826 - RNA, 22 nt, Pseudomonas aeruginosa PA01
agaggaucuccgaguccugcug

SEQ ID NO: 1530827 - RNA, 12 nt, Pseudomonas aeruginosa PA01
agauccuggccg

SEQ ID NO: 1530828 - RNA, 18 nt, Pseudomonas aeruginosa PA01
agaguucgcugcgcgcca

SEQ ID NO: 1530829 - RNA, 17 nt, Pseudomonas aeruginosa PA01
aaaacccgcgucccuug

SEQ ID NO: 1530830 - RNA, 17 nt, Pseudomonas aeruginosa PA01
agaugacgauggccgcc

SEQ ID NO: 1530831 - RNA, 22 nt, Pseudomonas aeruginosa PA01
agaugccggugcuggugcggcc

SEQ ID NO: 1530832 - RNA, 23 nt, Pseudomonas aeruginosa PA01
agaugccgcccugcggcaggcgc

SEQ ID NO: 1530833 - RNA, 12 nt, Pseudomonas aeruginosa PA01
agauguccaggc

SEQ ID NO: 1530834 - RNA, 16 nt, Pseudomonas aeruginosa PA01
agaugucgaagucgaa

SEQ ID NO: 1530835 - RNA, 15 nt, Pseudomonas aeruginosa PA01
agauggcuaaacaag

SEQ ID NO: 1530836 - RNA, 17 nt, Pseudomonas aeruginosa PA01
agauggcacaguuccug

SEQ ID NO: 1530837 - RNA, 13 nt, Pseudomonas aeruginosa PA01
agauucugcaggc

SEQ ID NO: 1530838 - RNA, 22 nt, Pseudomonas aeruginosa PA01
agauuccuggaccccgcccuag

SEQ ID NO: 1530839 - RNA, 14 nt, Pseudomonas aeruginosa PA01
agcaacagcgccgc

SEQ ID NO: 1530840 - RNA, 22 nt, Pseudomonas aeruginosa PA01
agcaacagcgucgccaacgcgc

SEQ ID NO: 1530841 - RNA, 14 nt, Pseudomonas aeruginosa PA01
agcaacaccgcgca

SEQ ID NO: 1530842 - RNA, 16 nt, Pseudomonas aeruginosa PA01
agcaaacccgggccca

SEQ ID NO: 1530843 - RNA, 14 nt, Pseudomonas aeruginosa PA01
agcccgccaggugg

SEQ ID NO: 1530844 - RNA, 16 nt, Pseudomonas aeruginosa PA01
agcccgccagguggcg

SEQ ID NO: 1530845 - RNA, 13 nt, Pseudomonas aeruginosa PA01
agcccgccacgcu

SEQ ID NO: 1530846 - RNA, 16 nt, Pseudomonas aeruginosa PA01
agcccgagugcgccca

SEQ ID NO: 1530847 - RNA, 19 nt, Pseudomonas aeruginosa PA01
agcccgagugcgcccagca

SEQ ID NO: 1530848 - RNA, 21 nt, Pseudomonas aeruginosa PA01
agcccguagucguucagcgcc

SEQ ID NO: 1530849 - RNA, 13 nt, Pseudomonas aeruginosa PA01
agcccgucggccu

SEQ ID NO: 1530850 - RNA, 16 nt, Pseudomonas aeruginosa PA01
agcccgggcaacugcc

SEQ ID NO: 1530851 - RNA, 12 nt, Pseudomonas aeruginosa PA01
agcccggguugc

SEQ ID NO: 1530852 - RNA, 16 nt, Pseudomonas aeruginosa PA01
agcccggguugcccuc

SEQ ID NO: 1530853 - RNA, 23 nt, Pseudomonas aeruginosa PA01
agcccgccuucaggcgggcucuu

SEQ ID NO: 1530854 - RNA, 19 nt, Pseudomonas aeruginosa PA01
agcccgcgcgacagcucug

SEQ ID NO: 1530855 - RNA, 20 nt, Pseudomonas aeruginosa PA01
agcccgcgcgacagcucugg

SEQ ID NO: 1530856 - RNA, 19 nt, Pseudomonas aeruginosa PA01
agcccuucuccgccagcca

SEQ ID NO: 1530857 - RNA, 23 nt, Pseudomonas aeruginosa PA01
agcccuucuccgccagccagccg

SEQ ID NO: 1530858 - RNA, 17 nt, Pseudomonas aeruginosa PA01
agcccuucugucuuguc

SEQ ID NO: 1530859 - RNA, 23 nt, Pseudomonas aeruginosa PA01
agcccuucugucuuguccucauc

SEQ ID NO: 1530860 - RNA, 21 nt, Pseudomonas aeruginosa PA01
agcccgugggaucgccacgcc

SEQ ID NO: 1530861 - RNA, 23 nt, Pseudomonas aeruginosa PA01
agcccugcuggcgcagccaggcg

SEQ ID NO: 1530862 - RNA, 17 nt, Pseudomonas aeruginosa PA01
agcccuggaaaggccuc

SEQ ID NO: 1530863 - RNA, 19 nt, Pseudomonas aeruginosa PA01
agcccuggcgcagacaggc

SEQ ID NO: 1530864 - RNA, 18 nt, Pseudomonas aeruginosa PA01
agcccuggcguggccggc

SEQ ID NO: 1530865 - RNA, 11 nt, Pseudomonas aeruginosa PA01
agcccugggcg

SEQ ID NO: 1530866 - RNA, 16 nt, Pseudomonas aeruginosa PA01
agcccugggcgaugcg

SEQ ID NO: 1530867 - RNA, 16 nt, Pseudomonas aeruginosa PA01
agcccugguggugauc

SEQ ID NO: 1530868 - RNA, 23 nt, Pseudomonas aeruginosa PA01
agcccugguggugaucagcggcc

SEQ ID NO: 1530869 - RNA, 19 nt, Pseudomonas aeruginosa PA01
agccgacgccgagcagcac

SEQ ID NO: 1530870 - RNA, 21 nt, Pseudomonas aeruginosa PA01
agccgagcaggccacgcacca

SEQ ID NO: 1530871 - RNA, 16 nt, Pseudomonas aeruginosa PA01
agcccuucgcgcucga

SEQ ID NO: 1530872 - RNA, 20 nt, Pseudomonas aeruginosa PA01
agccgaggcuuuccagcagg

SEQ ID NO: 1530873 - RNA, 14 nt, Pseudomonas aeruginosa PA01
agccgaggcggccg

SEQ ID NO: 1530874 - RNA, 23 nt, Pseudomonas aeruginosa PA01
agccgaggugguauugcagcucg

SEQ ID NO: 1530875 - RNA, 21 nt, Pseudomonas aeruginosa PA01
agccgcagaugcuccagggag

SEQ ID NO: 1530876 - RNA, 23 nt, Pseudomonas aeruginosa PA01
agccgcagcggcaugcccugccg

SEQ ID NO: 1530877 - RNA, 22 nt, Pseudomonas aeruginosa PA01
agcccacucgauggugggcucu

SEQ ID NO: 1530878 - RNA, 15 nt, Pseudomonas aeruginosa PA01
agcccagaacagcaa

SEQ ID NO: 1530879 - RNA, 17 nt, Pseudomonas aeruginosa PA01
agcccagaacagcaaag

SEQ ID NO: 1530880 - RNA, 23 nt, Pseudomonas aeruginosa PA01
agcccaggcgucgcgccagcacc

SEQ ID NO: 1530881 - RNA, 12 nt, Pseudomonas aeruginosa PA01
agcccaggggca

SEQ ID NO: 1530882 - RNA, 12 nt, Pseudomonas aeruginosa PA01
agcccagcgccg

SEQ ID NO: 1530883 - RNA, 17 nt, Pseudomonas aeruginosa PA01
agcccaugaaaaagccc

SEQ ID NO: 1530884 - RNA, 18 nt, Pseudomonas aeruginosa PA01
agcccaucgacugcaaca

SEQ ID NO: 1530885 - RNA, 12 nt, Pseudomonas aeruginosa PA01
agcccagguggc

SEQ ID NO: 1530886 - RNA, 20 nt, Pseudomonas aeruginosa PA01
agcccagguggcaggccugg

SEQ ID NO: 1530887 - RNA, 21 nt, Pseudomonas aeruginosa PA01
agccccacuggaagaaggcga

SEQ ID NO: 1530888 - RNA, 15 nt, Pseudomonas aeruginosa PA01
agccccagaugggua

SEQ ID NO: 1530889 - RNA, 12 nt, Pseudomonas aeruginosa PA01
agccccagcacg

SEQ ID NO: 1530890 - RNA, 16 nt, Pseudomonas aeruginosa PA01
agccccagcccagggc

SEQ ID NO: 1530891 - RNA, 22 nt, Pseudomonas aeruginosa PA01
agccccagguaggcgaaggcga

SEQ ID NO: 1530892 - RNA, 16 nt, Pseudomonas aeruginosa PA01
agccccaugccguuca

SEQ ID NO: 1530893 - RNA, 22 nt, Pseudomonas aeruginosa PA01
agccccaugccguucagcgucc

SEQ ID NO: 1530894 - RNA, 22 nt, Pseudomonas aeruginosa PA01
agcccccggcgcccagaaaaaa

SEQ ID NO: 1530895 - RNA, 21 nt, Pseudomonas aeruginosa PA01
agccccgcguucgcggggcuu

SEQ ID NO: 1530896 - RNA, 15 nt, Pseudomonas aeruginosa PA01
agccccgccgaagcg

SEQ ID NO: 1530897 - RNA, 17 nt, Pseudomonas aeruginosa PA01
agccccgguuacucgcc

SEQ ID NO: 1530898 - RNA, 17 nt, Pseudomonas aeruginosa PA01
agccccggcaggcaggc

SEQ ID NO: 1530899 - RNA, 13 nt, Pseudomonas aeruginosa PA01
agccccugcgccu

SEQ ID NO: 1530900 - RNA, 14 nt, Pseudomonas aeruginosa PA01
agccccugcgccuc

SEQ ID NO: 1530901 - RNA, 17 nt, Pseudomonas aeruginosa PA01
agccccucggccaggac

SEQ ID NO: 1530902 - RNA, 15 nt, Pseudomonas aeruginosa PA01
agccccuugcgcucu

SEQ ID NO: 1530903 - RNA, 16 nt, Pseudomonas aeruginosa PA01
agccacgccggucucg

SEQ ID NO: 1530904 - RNA, 19 nt, Pseudomonas aeruginosa PA01
agccacggacgcgcagggu

SEQ ID NO: 1530905 - RNA, 21 nt, Pseudomonas aeruginosa PA01
agccacggauaugcgccgcca

SEQ ID NO: 1530906 - RNA, 16 nt, Pseudomonas aeruginosa PA01
agccacgaagccucuu

SEQ ID NO: 1530907 - RNA, 13 nt, Pseudomonas aeruginosa PA01
agccacccgcucg

SEQ ID NO: 1530908 - RNA, 14 nt, Pseudomonas aeruginosa PA01
agccacccagcagc

SEQ ID NO: 1530909 - RNA, 21 nt, Pseudomonas aeruginosa PA01
agccagcacaugcggugcggc

SEQ ID NO: 1530910 - RNA, 22 nt, Pseudomonas aeruginosa PA01
agccagacguccggcaggucuu

SEQ ID NO: 1530911 - RNA, 19 nt, Pseudomonas aeruginosa PA01
agccagagcuccagggcug

SEQ ID NO: 1530912 - RNA, 14 nt, Pseudomonas aeruginosa PA01
agccaacgcccggg

SEQ ID NO: 1530913 - RNA, 18 nt, Pseudomonas aeruginosa PA01
agccaaccgucgcccugg

SEQ ID NO: 1530914 - RNA, 14 nt, Pseudomonas aeruginosa PA01
agccaagccaccag

SEQ ID NO: 1530915 - RNA, 21 nt, Pseudomonas aeruginosa PA01
agcaugcccagcguggccagc

SEQ ID NO: 1530916 - RNA, 13 nt, Pseudomonas aeruginosa PA01
agcaugcccagcg

SEQ ID NO: 1530917 - RNA, 20 nt, Pseudomonas aeruginosa PA01
agcaugcucacugcgagcac

SEQ ID NO: 1530918 - RNA, 11 nt, Pseudomonas aeruginosa PA01
agcaugacgau

SEQ ID NO: 1530919 - RNA, 21 nt, Pseudomonas aeruginosa PA01
agcaugaugcaggcagugugc

SEQ ID NO: 1530920 - RNA, 13 nt, Pseudomonas aeruginosa PA01
agccauugagcgc

SEQ ID NO: 1530921 - RNA, 16 nt, Pseudomonas aeruginosa PA01
agccaugcaggcugcc

SEQ ID NO: 1530922 - RNA, 13 nt, Pseudomonas aeruginosa PA01
agccaugcccaga

SEQ ID NO: 1530923 - RNA, 18 nt, Pseudomonas aeruginosa PA01
agccauagaguugcuugg

SEQ ID NO: 1530924 - RNA, 22 nt, Pseudomonas aeruginosa PA01
agccaugcacacgcucccaaca

SEQ ID NO: 1530925 - RNA, 14 nt, Pseudomonas aeruginosa PA01
agccaggaagagcc

SEQ ID NO: 1530926 - RNA, 23 nt, Pseudomonas aeruginosa PA01
agccaggaagagcccgccacgcu

SEQ ID NO: 1530927 - RNA, 18 nt, Pseudomonas aeruginosa PA01
agccagucgagacgccag

SEQ ID NO: 1530928 - RNA, 15 nt, Pseudomonas aeruginosa PA01
agccaggcaccaccu

SEQ ID NO: 1530929 - RNA, 15 nt, Pseudomonas aeruginosa PA01
agcaccucgaccugg

SEQ ID NO: 1530930 - RNA, 16 nt, Pseudomonas aeruginosa PA01
agcaccucgaccuggu

SEQ ID NO: 1530931 - RNA, 17 nt, Pseudomonas aeruginosa PA01
agcaccguggucagcac

SEQ ID NO: 1530932 - RNA, 19 nt, Pseudomonas aeruginosa PA01
agcaccguggucagcacca

SEQ ID NO: 1530933 - RNA, 19 nt, Pseudomonas aeruginosa PA01
agcaccgggacgaagcgga

SEQ ID NO: 1530934 - RNA, 22 nt, Pseudomonas aeruginosa PA01
agcaccggcuuguugcgcucca

SEQ ID NO: 1530935 - RNA, 16 nt, Pseudomonas aeruginosa PA01
agcaccggccucaagc

SEQ ID NO: 1530936 - RNA, 16 nt, Pseudomonas aeruginosa PA01
agcaacacaugcaggc

SEQ ID NO: 1530937 - RNA, 17 nt, Pseudomonas aeruginosa PA01
agcaccuugagggccuu

SEQ ID NO: 1530938 - RNA, 21 nt, Pseudomonas aeruginosa PA01
agcaccuugagggccuuggcc

SEQ ID NO: 1530939 - RNA, 20 nt, Pseudomonas aeruginosa PA01
agcaccuucaucaccagguc

SEQ ID NO: 1530940 - RNA, 19 nt, Pseudomonas aeruginosa PA01
agcacguagccgcccuuuu

SEQ ID NO: 1530941 - RNA, 23 nt, Pseudomonas aeruginosa PA01
agcacgucgauauccagcggcag

SEQ ID NO: 1530942 - RNA, 23 nt, Pseudomonas aeruginosa PA01
agcacgguguuguggcuggccuc

SEQ ID NO: 1530943 - RNA, 15 nt, Pseudomonas aeruginosa PA01
agcacgucuugcagg

SEQ ID NO: 1530944 - RNA, 17 nt, Pseudomonas aeruginosa PA01
agcacgucguccagcgc

SEQ ID NO: 1530945 - RNA, 20 nt, Pseudomonas aeruginosa PA01
agcacgucguccagcgccga

SEQ ID NO: 1530946 - RNA, 22 nt, Pseudomonas aeruginosa PA01
agcacgucguccagcgccgaga

SEQ ID NO: 1530947 - RNA, 15 nt, Pseudomonas aeruginosa PA01
agcagagggcguccu

SEQ ID NO: 1530948 - RNA, 22 nt, Pseudomonas aeruginosa PA01
agcagccauagcaauacaacca

SEQ ID NO: 1530949 - RNA, 21 nt, Pseudomonas aeruginosa PA01
agcagccccgaggccagcagg

SEQ ID NO: 1530950 - RNA, 22 nt, Pseudomonas aeruginosa PA01
agcagcaugaugccgaggcggc

SEQ ID NO: 1530951 - RNA, 19 nt, Pseudomonas aeruginosa PA01
agcagccaaggaugcgcca

SEQ ID NO: 1530952 - RNA, 19 nt, Pseudomonas aeruginosa PA01
agcagcaccgcgagcaugc

SEQ ID NO: 1530953 - RNA, 14 nt, Pseudomonas aeruginosa PA01
agcagcaccaucag

SEQ ID NO: 1530954 - RNA, 16 nt, Pseudomonas aeruginosa PA01
agcagcaccaucagcc

SEQ ID NO: 1530955 - RNA, 21 nt, Pseudomonas aeruginosa PA01
agcagcacgguguuguggcug

SEQ ID NO: 1530956 - RNA, 15 nt, Pseudomonas aeruginosa PA01
agcagcacgcccugg

SEQ ID NO: 1530957 - RNA, 20 nt, Pseudomonas aeruginosa PA01
agcagcagaagggcggagaa

SEQ ID NO: 1530958 - RNA, 15 nt, Pseudomonas aeruginosa PA01
agcagguuggucugc

SEQ ID NO: 1530959 - RNA, 17 nt, Pseudomonas aeruginosa PA01
agcagguuggucugcuc

SEQ ID NO: 1530960 - RNA, 16 nt, Pseudomonas aeruginosa PA01
agcagggagaaccagg

SEQ ID NO: 1530961 - RNA, 21 nt, Pseudomonas aeruginosa PA01
agcagggaggcgcacaucacc

SEQ ID NO: 1530962 - RNA, 22 nt, Pseudomonas aeruginosa PA01
agcagggaggcgcacaucaccc

SEQ ID NO: 1530963 - RNA, 15 nt, Pseudomonas aeruginosa PA01
agcaggcuggcggca

SEQ ID NO: 1530964 - RNA, 13 nt, Pseudomonas aeruginosa PA01
agcaggcgcucgc

SEQ ID NO: 1530965 - RNA, 22 nt, Pseudomonas aeruginosa PA01
agcaggccuugcagggccgcca

SEQ ID NO: 1530966 - RNA, 16 nt, Pseudomonas aeruginosa PA01
agcaggcgacggucag

SEQ ID NO: 1530967 - RNA, 18 nt, Pseudomonas aeruginosa PA01
agcaggcgacggucaggc

SEQ ID NO: 1530968 - RNA, 15 nt, Pseudomonas aeruginosa PA01
agcaggcgcgcccug

SEQ ID NO: 1530969 - RNA, 17 nt, Pseudomonas aeruginosa PA01
agcaggccgaaggccag

SEQ ID NO: 1530970 - RNA, 19 nt, Pseudomonas aeruginosa PA01
agcaggccgaaggccagga

SEQ ID NO: 1530971 - RNA, 20 nt, Pseudomonas aeruginosa PA01
agcaggccgaaggccaggac

SEQ ID NO: 1530972 - RNA, 17 nt, Pseudomonas aeruginosa PA01
agcaggccgagcguggu

SEQ ID NO: 1530973 - RNA, 18 nt, Pseudomonas aeruginosa PA01
agcaggccgaggaggacg

SEQ ID NO: 1530974 - RNA, 15 nt, Pseudomonas aeruginosa PA01
agcaggccgaucacc

SEQ ID NO: 1530975 - RNA, 17 nt, Pseudomonas aeruginosa PA01
agcaggccgaucaccag

SEQ ID NO: 1530976 - RNA, 14 nt, Pseudomonas aeruginosa PA01
agcaggccaugggu

SEQ ID NO: 1530977 - RNA, 15 nt, Pseudomonas aeruginosa PA01
agcaggccgccgcgu

SEQ ID NO: 1530978 - RNA, 15 nt, Pseudomonas aeruginosa PA01
agcaggccggccagc

SEQ ID NO: 1530979 - RNA, 19 nt, Pseudomonas aeruginosa PA01
agcaggccggcgaccagcg

SEQ ID NO: 1530980 - RNA, 13 nt, Pseudomonas aeruginosa PA01
agcaggaugcagu

SEQ ID NO: 1530981 - RNA, 17 nt, Pseudomonas aeruginosa PA01
agcaggaugcugcacag

SEQ ID NO: 1530982 - RNA, 18 nt, Pseudomonas aeruginosa PA01
agcaggaugcugcacagc

SEQ ID NO: 1530983 - RNA, 14 nt, Pseudomonas aeruginosa PA01
agcaggcacagggc

SEQ ID NO: 1530984 - RNA, 20 nt, Pseudomonas aeruginosa PA01
agcaggcccaugauggucgg

SEQ ID NO: 1530985 - RNA, 16 nt, Pseudomonas aeruginosa PA01
agcaggcccagccauu

SEQ ID NO: 1530986 - RNA, 22 nt, Pseudomonas aeruginosa PA01
agcagcgggcguccggcgagca

SEQ ID NO: 1530987 - RNA, 15 nt, Pseudomonas aeruginosa PA01
agcagcucgccggcg

SEQ ID NO: 1530988 - RNA, 14 nt, Pseudomonas aeruginosa PA01
agcagcucgccggc

SEQ ID NO: 1530989 - RNA, 14 nt, Pseudomonas aeruginosa PA01
agcaggacgucgag

SEQ ID NO: 1530990 - RNA, 18 nt, Pseudomonas aeruginosa PA01
agcaggaccuggccguug

SEQ ID NO: 1530991 - RNA, 19 nt, Pseudomonas aeruginosa PA01
agcaggaauucgggaaggg

SEQ ID NO: 1530992 - RNA, 17 nt, Pseudomonas aeruginosa PA01
agcaggacagcaggguc

SEQ ID NO: 1530993 - RNA, 21 nt, Pseudomonas aeruginosa PA01
agcaggaucgagcccuggucg

SEQ ID NO: 1530994 - RNA, 20 nt, Pseudomonas aeruginosa PA01
agcaggagcgccaucagcga

SEQ ID NO: 1530995 - RNA, 14 nt, Pseudomonas aeruginosa PA01
agcagcggcucacg

SEQ ID NO: 1530996 - RNA, 19 nt, Pseudomonas aeruginosa PA01
agcagcggcucacgcccca

SEQ ID NO: 1530997 - RNA, 15 nt, Pseudomonas aeruginosa PA01
agcagcggacgcagc

SEQ ID NO: 1530998 - RNA, 16 nt, Pseudomonas aeruginosa PA01
agcagcggcaccagca

SEQ ID NO: 1530999 - RNA, 18 nt, Pseudomonas aeruginosa PA01
agcagcggcaccagcacg

SEQ ID NO: 1531000 - RNA, 19 nt, Pseudomonas aeruginosa PA01
agcagcggcacgcucuggc

SEQ ID NO: 1531001 - RNA, 16 nt, Pseudomonas aeruginosa PA01
agcagcgccagccagg

SEQ ID NO: 1531002 - RNA, 18 nt, Pseudomonas aeruginosa PA01
agcagcgccagccagggu

SEQ ID NO: 1531003 - RNA, 14 nt, Pseudomonas aeruginosa PA01
agcagcgccagggc

SEQ ID NO: 1531004 - RNA, 19 nt, Pseudomonas aeruginosa PA01
agcagcgccagggcccaca

SEQ ID NO: 1531005 - RNA, 13 nt, Pseudomonas aeruginosa PA01
agcagcgccuuca

SEQ ID NO: 1531006 - RNA, 16 nt, Pseudomonas aeruginosa PA01
agcaugaagugccauu

SEQ ID NO: 1531007 - RNA, 17 nt, Pseudomonas aeruginosa PA01
agcaugaagugccauug

SEQ ID NO: 1531008 - RNA, 22 nt, Pseudomonas aeruginosa PA01
agcaucggcgcggccuucuugc

SEQ ID NO: 1531009 - RNA, 23 nt, Pseudomonas aeruginosa PA01
agcaucaggcgcuccgggcucca

SEQ ID NO: 1531010 - RNA, 20 nt, Pseudomonas aeruginosa PA01
agcaucgcaucggcgaccuu

SEQ ID NO: 1531011 - RNA, 13 nt, Pseudomonas aeruginosa PA01
agcaucgccggca

SEQ ID NO: 1531012 - RNA, 17 nt, Pseudomonas aeruginosa PA01
agcaucaccgcggugga

SEQ ID NO: 1531013 - RNA, 19 nt, Pseudomonas aeruginosa PA01
agcaucagaggcaacacca

SEQ ID NO: 1531014 - RNA, 15 nt, Pseudomonas aeruginosa PA01
agcaucagcaggaag

SEQ ID NO: 1531015 - RNA, 20 nt, Pseudomonas aeruginosa PA01
agcaguagugcgacgcagca

SEQ ID NO: 1531016 - RNA, 18 nt, Pseudomonas aeruginosa PA01
agcagucgcacagccagg

SEQ ID NO: 1531017 - RNA, 23 nt, Pseudomonas aeruginosa PA01
agcagucgcacagccaggggcac

SEQ ID NO: 1531018 - RNA, 14 nt, Pseudomonas aeruginosa PA01
agccugggcggcuu

SEQ ID NO: 1531019 - RNA, 18 nt, Pseudomonas aeruginosa PA01
agccugucgauuuccccc

SEQ ID NO: 1531020 - RNA, 13 nt, Pseudomonas aeruginosa PA01
agcgaaagaacaa

SEQ ID NO: 1531021 - RNA, 15 nt, Pseudomonas aeruginosa PA01
agcgaaacggcgcug

SEQ ID NO: 1531022 - RNA, 18 nt, Pseudomonas aeruginosa PA01
agccugcuggccugggac

SEQ ID NO: 1531023 - RNA, 17 nt, Pseudomonas aeruginosa PA01
agccuggagcagggcgc

SEQ ID NO: 1531024 - RNA, 13 nt, Pseudomonas aeruginosa PA01
agccuggccagcg

SEQ ID NO: 1531025 - RNA, 13 nt, Pseudomonas aeruginosa PA01
agccuggccaggc

SEQ ID NO: 1531026 - RNA, 14 nt, Pseudomonas aeruginosa PA01
agccuggccaggcg

SEQ ID NO: 1531027 - RNA, 14 nt, Pseudomonas aeruginosa PA01
agccugcggccagc

SEQ ID NO: 1531028 - RNA, 15 nt, Pseudomonas aeruginosa PA01
agccugcggccagcg

SEQ ID NO: 1531029 - RNA, 21 nt, Pseudomonas aeruginosa PA01
agccugcggccagcgccagga

SEQ ID NO: 1531030 - RNA, 22 nt, Pseudomonas aeruginosa PA01
agccugcagccagcuucagccg

SEQ ID NO: 1531031 - RNA, 21 nt, Pseudomonas aeruginosa PA01
agccugccgggcaagcucgac

SEQ ID NO: 1531032 - RNA, 23 nt, Pseudomonas aeruginosa PA01
agccugacguugccgcgcgggcc

SEQ ID NO: 1531033 - RNA, 16 nt, Pseudomonas aeruginosa PA01
agccgcaguccagggc

SEQ ID NO: 1531034 - RNA, 22 nt, Pseudomonas aeruginosa PA01
agccgcagcgccccucccagcc

SEQ ID NO: 1531035 - RNA, 21 nt, Pseudomonas aeruginosa PA01
agccgcaggcugccguccagg

SEQ ID NO: 1531036 - RNA, 15 nt, Pseudomonas aeruginosa PA01
agcgacucgcucgcu

SEQ ID NO: 1531037 - RNA, 15 nt, Pseudomonas aeruginosa PA01
agcgacuccgccagu

SEQ ID NO: 1531038 - RNA, 22 nt, Pseudomonas aeruginosa PA01
agcgagaccucgcccaucgcca

SEQ ID NO: 1531039 - RNA, 23 nt, Pseudomonas aeruginosa PA01
agcgagcgggcgagggcggcgcg

SEQ ID NO: 1531040 - RNA, 13 nt, Pseudomonas aeruginosa PA01
agcgaggagccuu

SEQ ID NO: 1531041 - RNA, 17 nt, Pseudomonas aeruginosa PA01
agcgaaucugcagggca

SEQ ID NO: 1531042 - RNA, 20 nt, Pseudomonas aeruginosa PA01
agcgaauuugaacgcuguag

SEQ ID NO: 1531043 - RNA, 20 nt, Pseudomonas aeruginosa PA01
agcgaaugcuugccggcgcc

SEQ ID NO: 1531044 - RNA, 16 nt, Pseudomonas aeruginosa PA01
agcgacgcgacauccu

SEQ ID NO: 1531045 - RNA, 21 nt, Pseudomonas aeruginosa PA01
agcgacggaaggugcgguuga

SEQ ID NO: 1531046 - RNA, 18 nt, Pseudomonas aeruginosa PA01
agcgacuccagccaggcg

SEQ ID NO: 1531047 - RNA, 13 nt, Pseudomonas aeruginosa PA01
agcgacguggcag

SEQ ID NO: 1531048 - RNA, 23 nt, Pseudomonas aeruginosa PA01
agcgaggggaagaucuccggguc

SEQ ID NO: 1531049 - RNA, 19 nt, Pseudomonas aeruginosa PA01
agcgagucgacccaggccc

SEQ ID NO: 1531050 - RNA, 23 nt, Pseudomonas aeruginosa PA01
agcgagucgacccaggcccagcc

SEQ ID NO: 1531051 - RNA, 22 nt, Pseudomonas aeruginosa PA01
agcgaguaggcgaagcccagcg

SEQ ID NO: 1531052 - RNA, 15 nt, Pseudomonas aeruginosa PA01
agcgagugcaggaag

SEQ ID NO: 1531053 - RNA, 12 nt, Pseudomonas aeruginosa PA01
agcgauacaccu

SEQ ID NO: 1531054 - RNA, 21 nt, Pseudomonas aeruginosa PA01
agcgaugcgguuccuggcugg

SEQ ID NO: 1531055 - RNA, 21 nt, Pseudomonas aeruginosa PA01
agcgcauacgaaaacggcccu

SEQ ID NO: 1531056 - RNA, 14 nt, Pseudomonas aeruginosa PA01
agcgcaccaccugc

SEQ ID NO: 1531057 - RNA, 13 nt, Pseudomonas aeruginosa PA01
agcgccaggagca

SEQ ID NO: 1531058 - RNA, 15 nt, Pseudomonas aeruginosa PA01
agcgccaggagcagg

SEQ ID NO: 1531059 - RNA, 16 nt, Pseudomonas aeruginosa PA01
agcgccaggagcaggg

SEQ ID NO: 1531060 - RNA, 14 nt, Pseudomonas aeruginosa PA01
agcgccagccaggg

SEQ ID NO: 1531061 - RNA, 16 nt, Pseudomonas aeruginosa PA01
agcgccagggccaggg

SEQ ID NO: 1531062 - RNA, 18 nt, Pseudomonas aeruginosa PA01
agcgccagguaguccagc

SEQ ID NO: 1531063 - RNA, 11 nt, Pseudomonas aeruginosa PA01
agcgccaggcg

SEQ ID NO: 1531064 - RNA, 14 nt, Pseudomonas aeruginosa PA01
agcgccagggccag

SEQ ID NO: 1531065 - RNA, 21 nt, Pseudomonas aeruginosa PA01
agcgccaguuggacgcggccu

SEQ ID NO: 1531066 - RNA, 16 nt, Pseudomonas aeruginosa PA01
agcgccaucagcgacc

SEQ ID NO: 1531067 - RNA, 19 nt, Pseudomonas aeruginosa PA01
agcgccaucaggcccuuga

SEQ ID NO: 1531068 - RNA, 23 nt, Pseudomonas aeruginosa PA01
agcgccagcgagacgggcgaggc

SEQ ID NO: 1531069 - RNA, 14 nt, Pseudomonas aeruginosa PA01
agcgccagcaggcg

SEQ ID NO: 1531070 - RNA, 22 nt, Pseudomonas aeruginosa PA01
agcgccagcagguuggucugcu

SEQ ID NO: 1531071 - RNA, 17 nt, Pseudomonas aeruginosa PA01
agcgccacgcgagaagc

SEQ ID NO: 1531072 - RNA, 22 nt, Pseudomonas aeruginosa PA01
agcgcaugaggcuggccagcaa

SEQ ID NO: 1531073 - RNA, 21 nt, Pseudomonas aeruginosa PA01
agcgcggcgcggacauggcgc

SEQ ID NO: 1531074 - RNA, 16 nt, Pseudomonas aeruginosa PA01
agcgcggcgccccagg

SEQ ID NO: 1531075 - RNA, 18 nt, Pseudomonas aeruginosa PA01
agcgcggcgccccaggcg

SEQ ID NO: 1531076 - RNA, 21 nt, Pseudomonas aeruginosa PA01
agcgcgucggcacgccgaagu

SEQ ID NO: 1531077 - RNA, 21 nt, Pseudomonas aeruginosa PA01
agcgcgucgcggucuuccgcc

SEQ ID NO: 1531078 - RNA, 18 nt, Pseudomonas aeruginosa PA01
agcgcggcggcgcggaga

SEQ ID NO: 1531079 - RNA, 22 nt, Pseudomonas aeruginosa PA01
agcgcggcggacaggcagccgg

SEQ ID NO: 1531080 - RNA, 16 nt, Pseudomonas aeruginosa PA01
agcgcggccggccacg

SEQ ID NO: 1531081 - RNA, 19 nt, Pseudomonas aeruginosa PA01
agcgcgaaggcgccuucca

SEQ ID NO: 1531082 - RNA, 23 nt, Pseudomonas aeruginosa PA01
agcgcgaaggcgccuuccaggcg

SEQ ID NO: 1531083 - RNA, 22 nt, Pseudomonas aeruginosa PA01
agcgcgaacaguuccgacugcg

SEQ ID NO: 1531084 - RNA, 21 nt, Pseudomonas aeruginosa PA01
agcgccuuuucggcacucagg

SEQ ID NO: 1531085 - RNA, 13 nt, Pseudomonas aeruginosa PA01
agcgcgacaggcu

SEQ ID NO: 1531086 - RNA, 16 nt, Pseudomonas aeruginosa PA01
agcgcgccgagccagg

SEQ ID NO: 1531087 - RNA, 19 nt, Pseudomonas aeruginosa PA01
agcgcgccgagccagguac

SEQ ID NO: 1531088 - RNA, 19 nt, Pseudomonas aeruginosa PA01
agcgccugguucugcuccg

SEQ ID NO: 1531089 - RNA, 21 nt, Pseudomonas aeruginosa PA01
agcgccugguucugcuccgga

SEQ ID NO: 1531090 - RNA, 23 nt, Pseudomonas aeruginosa PA01
agcgccuucaccguucccagcag

SEQ ID NO: 1531091 - RNA, 12 nt, Pseudomonas aeruginosa PA01
agcgccuguucc

SEQ ID NO: 1531092 - RNA, 14 nt, Pseudomonas aeruginosa PA01
agcgccuguuccag

SEQ ID NO: 1531093 - RNA, 17 nt, Pseudomonas aeruginosa PA01
agcgccuguuccagggc

SEQ ID NO: 1531094 - RNA, 19 nt, Pseudomonas aeruginosa PA01
agcgccucguggaacagcg

SEQ ID NO: 1531095 - RNA, 16 nt, Pseudomonas aeruginosa PA01
agcgccucggcggcgu

SEQ ID NO: 1531096 - RNA, 13 nt, Pseudomonas aeruginosa PA01
agcgccugggccg

SEQ ID NO: 1531097 - RNA, 17 nt, Pseudomonas aeruginosa PA01
agcgccugcaaagaggc

SEQ ID NO: 1531098 - RNA, 20 nt, Pseudomonas aeruginosa PA01
agcgccuccucuaccaggcg

SEQ ID NO: 1531099 - RNA, 14 nt, Pseudomonas aeruginosa PA01
agcgccgaccagca

SEQ ID NO: 1531100 - RNA, 15 nt, Pseudomonas aeruginosa PA01
agcgugggcaacagg

SEQ ID NO: 1531101 - RNA, 18 nt, Pseudomonas aeruginosa PA01
agcguggccagcgcccag

SEQ ID NO: 1531102 - RNA, 15 nt, Pseudomonas aeruginosa PA01
agcgugcagaccagg

SEQ ID NO: 1531103 - RNA, 21 nt, Pseudomonas aeruginosa PA01
agcguccucagccucacccug

SEQ ID NO: 1531104 - RNA, 16 nt, Pseudomonas aeruginosa PA01
agcgucgacgccgagc

SEQ ID NO: 1531105 - RNA, 15 nt, Pseudomonas aeruginosa PA01
agcguccgccgccgu

SEQ ID NO: 1531106 - RNA, 19 nt, Pseudomonas aeruginosa PA01
agcguccgccgccguggcu

SEQ ID NO: 1531107 - RNA, 16 nt, Pseudomonas aeruginosa PA01
agcguccggcagggcc

SEQ ID NO: 1531108 - RNA, 15 nt, Pseudomonas aeruginosa PA01
agcguccgaacgcgc

SEQ ID NO: 1531109 - RNA, 13 nt, Pseudomonas aeruginosa PA01
agcgcgugcaggc

SEQ ID NO: 1531110 - RNA, 16 nt, Pseudomonas aeruginosa PA01
agcggcccgagcaggc

SEQ ID NO: 1531111 - RNA, 22 nt, Pseudomonas aeruginosa PA01
agcggcccgagggucgccuuga

SEQ ID NO: 1531112 - RNA, 20 nt, Pseudomonas aeruginosa PA01
agcggccagggcgaggccgc

SEQ ID NO: 1531113 - RNA, 16 nt, Pseudomonas aeruginosa PA01
agcgcuacgcaggccc

SEQ ID NO: 1531114 - RNA, 16 nt, Pseudomonas aeruginosa PA01
agcggccgagcaccac

SEQ ID NO: 1531115 - RNA, 19 nt, Pseudomonas aeruginosa PA01
agcggccgagcaggcgcgc

SEQ ID NO: 1531116 - RNA, 20 nt, Pseudomonas aeruginosa PA01
agcggccgagcaggcgcgcc

SEQ ID NO: 1531117 - RNA, 15 nt, Pseudomonas aeruginosa PA01
agcggccgaccaggc

SEQ ID NO: 1531118 - RNA, 18 nt, Pseudomonas aeruginosa PA01
agcggccgaccaggccgu

SEQ ID NO: 1531119 - RNA, 17 nt, Pseudomonas aeruginosa PA01
agcggcccggcaggcgc

SEQ ID NO: 1531120 - RNA, 22 nt, Pseudomonas aeruginosa PA01
agcggccgcgagcgcggccggc

SEQ ID NO: 1531121 - RNA, 17 nt, Pseudomonas aeruginosa PA01
agcggcggauacaggcg

SEQ ID NO: 1531122 - RNA, 20 nt, Pseudomonas aeruginosa PA01
agcggcgcuugcgggcgcgc

SEQ ID NO: 1531123 - RNA, 18 nt, Pseudomonas aeruginosa PA01
agcggcguaugcgccucc

SEQ ID NO: 1531124 - RNA, 23 nt, Pseudomonas aeruginosa PA01
agcggcguaugcgccuccaggua

SEQ ID NO: 1531125 - RNA, 19 nt, Pseudomonas aeruginosa PA01
agcggcgguacauggccuu

SEQ ID NO: 1531126 - RNA, 17 nt, Pseudomonas aeruginosa PA01
agcggcggucccaucag

SEQ ID NO: 1531127 - RNA, 12 nt, Pseudomonas aeruginosa PA01
agcgggccagca

SEQ ID NO: 1531128 - RNA, 13 nt, Pseudomonas aeruginosa PA01
agcgggccaggcg

SEQ ID NO: 1531129 - RNA, 16 nt, Pseudomonas aeruginosa PA01
agcgggcaaccuugca

SEQ ID NO: 1531130 - RNA, 20 nt, Pseudomonas aeruginosa PA01
agcgggcgguagaucuccac

SEQ ID NO: 1531131 - RNA, 22 nt, Pseudomonas aeruginosa PA01
agcgguuauucgcccuacgggg

SEQ ID NO: 1531132 - RNA, 16 nt, Pseudomonas aeruginosa PA01
agcggcuggcgggcga

SEQ ID NO: 1531133 - RNA, 18 nt, Pseudomonas aeruginosa PA01
agcggcuggcugaagccg

SEQ ID NO: 1531134 - RNA, 13 nt, Pseudomonas aeruginosa PA01
agcggcuggccgu

SEQ ID NO: 1531135 - RNA, 17 nt, Pseudomonas aeruginosa PA01
agcggcugccgaggcug

SEQ ID NO: 1531136 - RNA, 16 nt, Pseudomonas aeruginosa PA01
agcggcuccucggccu

SEQ ID NO: 1531137 - RNA, 21 nt, Pseudomonas aeruginosa PA01
agcggcucgccgaaaggccgu

SEQ ID NO: 1531138 - RNA, 22 nt, Pseudomonas aeruginosa PA01
agcggcguuucuuuuugccggu

SEQ ID NO: 1531139 - RNA, 16 nt, Pseudomonas aeruginosa PA01
agcucauggagcaaca

SEQ ID NO: 1531140 - RNA, 17 nt, Pseudomonas aeruginosa PA01
agcucauggagcaacag

SEQ ID NO: 1531141 - RNA, 23 nt, Pseudomonas aeruginosa PA01
agcucauggccaggucagccacc

SEQ ID NO: 1531142 - RNA, 19 nt, Pseudomonas aeruginosa PA01
agcucagcuggauagagua

SEQ ID NO: 1531143 - RNA, 14 nt, Pseudomonas aeruginosa PA01
agcucagcuccagg

SEQ ID NO: 1531144 - RNA, 15 nt, Pseudomonas aeruginosa PA01
agcucagcuccaggc

SEQ ID NO: 1531145 - RNA, 16 nt, Pseudomonas aeruginosa PA01
agcucagcuccaggcc

SEQ ID NO: 1531146 - RNA, 21 nt, Pseudomonas aeruginosa PA01
agcucagcugggagagcaucu

SEQ ID NO: 1531147 - RNA, 21 nt, Pseudomonas aeruginosa PA01
agcucagucgguagagcaaau

SEQ ID NO: 1531148 - RNA, 16 nt, Pseudomonas aeruginosa PA01
agcuaugcaaaagugc

SEQ ID NO: 1531149 - RNA, 16 nt, Pseudomonas aeruginosa PA01
agcguugcaggcaguc

SEQ ID NO: 1531150 - RNA, 15 nt, Pseudomonas aeruginosa PA01
agcguugggccucgc

SEQ ID NO: 1531151 - RNA, 14 nt, Pseudomonas aeruginosa PA01
agcguucgccgagg

SEQ ID NO: 1531152 - RNA, 21 nt, Pseudomonas aeruginosa PA01
agcuaccgucggccugcaaca

SEQ ID NO: 1531153 - RNA, 15 nt, Pseudomonas aeruginosa PA01
agguuggucugcucg

SEQ ID NO: 1531154 - RNA, 16 nt, Pseudomonas aeruginosa PA01
agguuguccagggcau

SEQ ID NO: 1531155 - RNA, 19 nt, Pseudomonas aeruginosa PA01
agguuggccuggcccggcg

SEQ ID NO: 1531156 - RNA, 17 nt, Pseudomonas aeruginosa PA01
agguugcgcuccaucca

SEQ ID NO: 1531157 - RNA, 18 nt, Pseudomonas aeruginosa PA01
agguugcgcuccauccag

SEQ ID NO: 1531158 - RNA, 16 nt, Pseudomonas aeruginosa PA01
agguugcuggcgagga

SEQ ID NO: 1531159 - RNA, 13 nt, Pseudomonas aeruginosa PA01
agguuggacaggu

SEQ ID NO: 1531160 - RNA, 22 nt, Pseudomonas aeruginosa PA01
agguuggacagguccuggaaca

SEQ ID NO: 1531161 - RNA, 17 nt, Pseudomonas aeruginosa PA01
agguugaucggguggga

SEQ ID NO: 1531162 - RNA, 13 nt, Pseudomonas aeruginosa PA01
agguugccgccga

SEQ ID NO: 1531163 - RNA, 12 nt, Pseudomonas aeruginosa PA01
agguugccggcg

SEQ ID NO: 1531164 - RNA, 16 nt, Pseudomonas aeruginosa PA01
agguugcgauugucca

SEQ ID NO: 1531165 - RNA, 15 nt, Pseudomonas aeruginosa PA01
agguggaggccgugg

SEQ ID NO: 1531166 - RNA, 15 nt, Pseudomonas aeruginosa PA01
agguggaugaacagc

SEQ ID NO: 1531167 - RNA, 14 nt, Pseudomonas aeruginosa PA01
agguggauugcagc

SEQ ID NO: 1531168 - RNA, 22 nt, Pseudomonas aeruginosa PA01
agguugacgaugcggcccgccg

SEQ ID NO: 1531169 - RNA, 15 nt, Pseudomonas aeruginosa PA01
agguggccggaaaaa

SEQ ID NO: 1531170 - RNA, 18 nt, Pseudomonas aeruginosa PA01
aguaccagcaaugcccag

SEQ ID NO: 1531171 - RNA, 20 nt, Pseudomonas aeruginosa PA01
aguaucgcuuagcgccagaa

SEQ ID NO: 1531172 - RNA, 21 nt, Pseudomonas aeruginosa PA01
aguagccgccgggacccuggu

SEQ ID NO: 1531173 - RNA, 17 nt, Pseudomonas aeruginosa PA01
aguagccggacuccgac

SEQ ID NO: 1531174 - RNA, 15 nt, Pseudomonas aeruginosa PA01
aguagccggcggcga

SEQ ID NO: 1531175 - RNA, 17 nt, Pseudomonas aeruginosa PA01
aguagcguuccuggcgc

SEQ ID NO: 1531176 - RNA, 18 nt, Pseudomonas aeruginosa PA01
aguaggcggcggagucgu

SEQ ID NO: 1531177 - RNA, 20 nt, Pseudomonas aeruginosa PA01
aguaggcgucguacuucagc

SEQ ID NO: 1531178 - RNA, 13 nt, Pseudomonas aeruginosa PA01
aguagguccaggc

SEQ ID NO: 1531179 - RNA, 20 nt, Pseudomonas aeruginosa PA01
aguagguuuucguugggugg

SEQ ID NO: 1531180 - RNA, 22 nt, Pseudomonas aeruginosa PA01
aguagguuuucguuggguggcu

SEQ ID NO: 1531181 - RNA, 19 nt, Pseudomonas aeruginosa PA01
aguagcuggaucugguuga

SEQ ID NO: 1531182 - RNA, 14 nt, Pseudomonas aeruginosa PA01
aguagugcagcugc

SEQ ID NO: 1531183 - RNA, 19 nt, Pseudomonas aeruginosa PA01
aggcuuuccaccgccagca

SEQ ID NO: 1531184 - RNA, 12 nt, Pseudomonas aeruginosa PA01
aggcuuuccagc

SEQ ID NO: 1531185 - RNA, 18 nt, Pseudomonas aeruginosa PA01
aggcuuuccagcaggcgc

SEQ ID NO: 1531186 - RNA, 17 nt, Pseudomonas aeruginosa PA01
aggcuuuccgccgagcg

SEQ ID NO: 1531187 - RNA, 19 nt, Pseudomonas aeruginosa PA01
aggcuuguccuuggccucc

SEQ ID NO: 1531188 - RNA, 12 nt, Pseudomonas aeruginosa PA01
aggcggcacucg

SEQ ID NO: 1531189 - RNA, 18 nt, Pseudomonas aeruginosa PA01
aggcggcagccgcggcug

SEQ ID NO: 1531190 - RNA, 17 nt, Pseudomonas aeruginosa PA01
aggcggaucgcccggcg

SEQ ID NO: 1531191 - RNA, 18 nt, Pseudomonas aeruginosa PA01
aggcggaucgcccggcgc

SEQ ID NO: 1531192 - RNA, 20 nt, Pseudomonas aeruginosa PA01
aggcggaagaaaagaaggcg

SEQ ID NO: 1531193 - RNA, 22 nt, Pseudomonas aeruginosa PA01
aggcgcuucagcucgaggccag

SEQ ID NO: 1531194 - RNA, 11 nt, Pseudomonas aeruginosa PA01
agggaaaucag

SEQ ID NO: 1531195 - RNA, 19 nt, Pseudomonas aeruginosa PA01
agggaaaagcccagguggc

SEQ ID NO: 1531196 - RNA, 15 nt, Pseudomonas aeruginosa PA01
agggacaggcuagga

SEQ ID NO: 1531197 - RNA, 13 nt, Pseudomonas aeruginosa PA01
agggagccaggcg

SEQ ID NO: 1531198 - RNA, 15 nt, Pseudomonas aeruginosa PA01
agggagcgacaccau

SEQ ID NO: 1531199 - RNA, 22 nt, Pseudomonas aeruginosa PA01
agggcugcuguccagcgcuccu

SEQ ID NO: 1531200 - RNA, 17 nt, Pseudomonas aeruginosa PA01
agggcugcuguugccag

SEQ ID NO: 1531201 - RNA, 22 nt, Pseudomonas aeruginosa PA01
agggcucgugccaucaggccgc

SEQ ID NO: 1531202 - RNA, 18 nt, Pseudomonas aeruginosa PA01
aggggcacgcuggcgaga

SEQ ID NO: 1531203 - RNA, 18 nt, Pseudomonas aeruginosa PA01
agggcuuccuuggcggga

SEQ ID NO: 1531204 - RNA, 14 nt, Pseudomonas aeruginosa PA01
agggguggccaggc

SEQ ID NO: 1531205 - RNA, 16 nt, Pseudomonas aeruginosa PA01
aggggcugaacagcgc

SEQ ID NO: 1531206 - RNA, 21 nt, Pseudomonas aeruginosa PA01
aggggcgagagacugaacucg

SEQ ID NO: 1531207 - RNA, 14 nt, Pseudomonas aeruginosa PA01
aggggccgaugccg

SEQ ID NO: 1531208 - RNA, 18 nt, Pseudomonas aeruginosa PA01
aggggccgaugccgggca

SEQ ID NO: 1531209 - RNA, 19 nt, Pseudomonas aeruginosa PA01
agggcaccgacgaugggca

SEQ ID NO: 1531210 - RNA, 21 nt, Pseudomonas aeruginosa PA01
agggcaccgacgaugggcacg

SEQ ID NO: 1531211 - RNA, 19 nt, Pseudomonas aeruginosa PA01
agggcaccgccgaggaaca

SEQ ID NO: 1531212 - RNA, 15 nt, Pseudomonas aeruginosa PA01
agggcacgugcagcg

SEQ ID NO: 1531213 - RNA, 15 nt, Pseudomonas aeruginosa PA01
agggcaaaggcgcgc

SEQ ID NO: 1531214 - RNA, 24 nt, Pseudomonas aeruginosa PA01
agggcccggggagggugccgugga

SEQ ID NO: 1531215 - RNA, 21 nt, Pseudomonas aeruginosa PA01
agggccgagcgcagcgccacc

SEQ ID NO: 1531216 - RNA, 20 nt, Pseudomonas aeruginosa PA01
agggccgccagccgccagga

SEQ ID NO: 1531217 - RNA, 13 nt, Pseudomonas aeruginosa PA01
agggccagcagcg

SEQ ID NO: 1531218 - RNA, 11 nt, Pseudomonas aeruginosa PA01
agggccaggcc

SEQ ID NO: 1531219 - RNA, 19 nt, Pseudomonas aeruginosa PA01
agggccauuguucuuuggc

SEQ ID NO: 1531220 - RNA, 20 nt, Pseudomonas aeruginosa PA01
agggcgucgucgaggcuguc

SEQ ID NO: 1531221 - RNA, 18 nt, Pseudomonas aeruginosa PA01
agggcguccugcuuccag

SEQ ID NO: 1531222 - RNA, 23 nt, Pseudomonas aeruginosa PA01
agggcguccugcuuccagaccuc

SEQ ID NO: 1531223 - RNA, 19 nt, Pseudomonas aeruginosa PA01
agggcgguuaccaggucug

SEQ ID NO: 1531224 - RNA, 18 nt, Pseudomonas aeruginosa PA01
agggcguagugcaucagc

SEQ ID NO: 1531225 - RNA, 19 nt, Pseudomonas aeruginosa PA01
agggcguggucggcggccu

SEQ ID NO: 1531226 - RNA, 20 nt, Pseudomonas aeruginosa PA01
agggcggcgcggagcugcau

SEQ ID NO: 1531227 - RNA, 22 nt, Pseudomonas aeruginosa PA01
agggcggcgcggagcugcauga

SEQ ID NO: 1531228 - RNA, 24 nt, Pseudomonas aeruginosa PA01
agggcggcgcgggcgcgcgccacc

SEQ ID NO: 1531229 - RNA, 15 nt, Pseudomonas aeruginosa PA01
agggcgggccgcucg

SEQ ID NO: 1531230 - RNA, 16 nt, Pseudomonas aeruginosa PA01
agggccgcgagagguu

SEQ ID NO: 1531231 - RNA, 19 nt, Pseudomonas aeruginosa PA01
aggugcuuggcaccgcgca

SEQ ID NO: 1531232 - RNA, 15 nt, Pseudomonas aeruginosa PA01
aggugcaggccgcgc

SEQ ID NO: 1531233 - RNA, 16 nt, Pseudomonas aeruginosa PA01
aggugcaggccgcgcg

SEQ ID NO: 1531234 - RNA, 18 nt, Pseudomonas aeruginosa PA01
aggugcaggaacagccag

SEQ ID NO: 1531235 - RNA, 17 nt, Pseudomonas aeruginosa PA01
aggugcaccgcgcugga

SEQ ID NO: 1531236 - RNA, 19 nt, Pseudomonas aeruginosa PA01
aggugcaccgcgcuggaga

SEQ ID NO: 1531237 - RNA, 16 nt, Pseudomonas aeruginosa PA01
aggugcacggccaggc

SEQ ID NO: 1531238 - RNA, 15 nt, Pseudomonas aeruginosa PA01
aggucguggaaggcu

SEQ ID NO: 1531239 - RNA, 14 nt, Pseudomonas aeruginosa PA01
aggugauguugcgc

SEQ ID NO: 1531240 - RNA, 17 nt, Pseudomonas aeruginosa PA01
aggugaugcggcccuug

SEQ ID NO: 1531241 - RNA, 22 nt, Pseudomonas aeruginosa PA01
aggucguugaaagucugcaccu

SEQ ID NO: 1531242 - RNA, 17 nt, Pseudomonas aeruginosa PA01
aggucguuggccaggcg

SEQ ID NO: 1531243 - RNA, 22 nt, Pseudomonas aeruginosa PA01
aggucgucgcgcuugagcaggg

SEQ ID NO: 1531244 - RNA, 13 nt, Pseudomonas aeruginosa PA01
aggucgucgagga

SEQ ID NO: 1531245 - RNA, 19 nt, Pseudomonas aeruginosa PA01
aggucguccaccuccaccu

SEQ ID NO: 1531246 - RNA, 18 nt, Pseudomonas aeruginosa PA01
aggucggcgccggugcug

SEQ ID NO: 1531247 - RNA, 12 nt, Pseudomonas aeruginosa PA01
aggucgcugccc

SEQ ID NO: 1531248 - RNA, 13 nt, Pseudomonas aeruginosa PA01
aggucggacaggc

SEQ ID NO: 1531249 - RNA, 15 nt, Pseudomonas aeruginosa PA01
aggucggcagcagcu

SEQ ID NO: 1531250 - RNA, 16 nt, Pseudomonas aeruginosa PA01
aggucgcgggccaggc

SEQ ID NO: 1531251 - RNA, 19 nt, Pseudomonas aeruginosa PA01
aggucgcuguccuccagcg

SEQ ID NO: 1531252 - RNA, 21 nt, Pseudomonas aeruginosa PA01
aggucgcugcccucgaccagg

SEQ ID NO: 1531253 - RNA, 15 nt, Pseudomonas aeruginosa PA01
aggucgcgacagguu

SEQ ID NO: 1531254 - RNA, 16 nt, Pseudomonas aeruginosa PA01
aggucgcgcagggcca

SEQ ID NO: 1531255 - RNA, 20 nt, Pseudomonas aeruginosa PA01
aggucgcgcagggccagggc

SEQ ID NO: 1531256 - RNA, 13 nt, Pseudomonas aeruginosa PA01
aggucgcggugca

SEQ ID NO: 1531257 - RNA, 14 nt, Pseudomonas aeruginosa PA01
aggucgccacgcag

SEQ ID NO: 1531258 - RNA, 13 nt, Pseudomonas aeruginosa PA01
aggucgccgggcu

SEQ ID NO: 1531259 - RNA, 22 nt, Pseudomonas aeruginosa PA01
aggucgccguagaacagcacgu

SEQ ID NO: 1531260 - RNA, 10 nt, Pseudomonas aeruginosa PA01
agguccaggc

SEQ ID NO: 1531261 - RNA, 15 nt, Pseudomonas aeruginosa PA01
agguccaccagccag

SEQ ID NO: 1531262 - RNA, 16 nt, Pseudomonas aeruginosa PA01
aggucaugaaggaaac

SEQ ID NO: 1531263 - RNA, 16 nt, Pseudomonas aeruginosa PA01
agguagugcucggcca

SEQ ID NO: 1531264 - RNA, 21 nt, Pseudomonas aeruginosa PA01
agguagccugcggccagcgcc

SEQ ID NO: 1531265 - RNA, 13 nt, Pseudomonas aeruginosa PA01
agguagccagggg

SEQ ID NO: 1531266 - RNA, 19 nt, Pseudomonas aeruginosa PA01
agguagcggucggguucuu

SEQ ID NO: 1531267 - RNA, 16 nt, Pseudomonas aeruginosa PA01
agguaggccagcccca

SEQ ID NO: 1531268 - RNA, 20 nt, Pseudomonas aeruginosa PA01
agguaggcgacgaagcuggc

SEQ ID NO: 1531269 - RNA, 21 nt, Pseudomonas aeruginosa PA01
agguaggcgcgggcguagccu

SEQ ID NO: 1531270 - RNA, 15 nt, Pseudomonas aeruginosa PA01
agguagagaugcagc

SEQ ID NO: 1531271 - RNA, 13 nt, Pseudomonas aeruginosa PA01
agguagagcagcc

SEQ ID NO: 1531272 - RNA, 20 nt, Pseudomonas aeruginosa PA01
agguagucgcucauggcgcc

SEQ ID NO: 1531273 - RNA, 17 nt, Pseudomonas aeruginosa PA01
agguagcugcgccgccu

SEQ ID NO: 1531274 - RNA, 24 nt, Pseudomonas aeruginosa PA01
agguagugcaacaccuggcgcucg

SEQ ID NO: 1531275 - RNA, 21 nt, Pseudomonas aeruginosa PA01
agguaccggccaggcggucca

SEQ ID NO: 1531276 - RNA, 17 nt, Pseudomonas aeruginosa PA01
agguaccagucuggaag

SEQ ID NO: 1531277 - RNA, 13 nt, Pseudomonas aeruginosa PA01
agguacugggcga

SEQ ID NO: 1531278 - RNA, 13 nt, Pseudomonas aeruginosa PA01
agguacagccgca

SEQ ID NO: 1531279 - RNA, 18 nt, Pseudomonas aeruginosa PA01
agguaauguucuccuccc

SEQ ID NO: 1531280 - RNA, 22 nt, Pseudomonas aeruginosa PA01
aggguggcgcgcaccaccuggc

SEQ ID NO: 1531281 - RNA, 19 nt, Pseudomonas aeruginosa PA01
aggguggcgccgagcagcg

SEQ ID NO: 1531282 - RNA, 17 nt, Pseudomonas aeruginosa PA01
aggguggaacccauggc

SEQ ID NO: 1531283 - RNA, 14 nt, Pseudomonas aeruginosa PA01
agguaauaucaccc

SEQ ID NO: 1531284 - RNA, 18 nt, Pseudomonas aeruginosa PA01
agguaauaucacccgcac

SEQ ID NO: 1531285 - RNA, 16 nt, Pseudomonas aeruginosa PA01
aggccguagaccacca

SEQ ID NO: 1531286 - RNA, 17 nt, Pseudomonas aeruginosa PA01
aggccguagaccaccag

SEQ ID NO: 1531287 - RNA, 16 nt, Pseudomonas aeruginosa PA01
aggccguagcgcucga

SEQ ID NO: 1531288 - RNA, 16 nt, Pseudomonas aeruginosa PA01
aggccgggcuggccac

SEQ ID NO: 1531289 - RNA, 19 nt, Pseudomonas aeruginosa PA01
aggccgggaauggagaugc

SEQ ID NO: 1531290 - RNA, 14 nt, Pseudomonas aeruginosa PA01
aggccgcccaggac

SEQ ID NO: 1531291 - RNA, 19 nt, Pseudomonas aeruginosa PA01
aggccgaccagcagggcca

SEQ ID NO: 1531292 - RNA, 18 nt, Pseudomonas aeruginosa PA01
aggccgacucgcgaucga

SEQ ID NO: 1531293 - RNA, 19 nt, Pseudomonas aeruginosa PA01
aggccgagaccgcagccca

SEQ ID NO: 1531294 - RNA, 21 nt, Pseudomonas aeruginosa PA01
aggccgagcaauccggcgcug

SEQ ID NO: 1531295 - RNA, 20 nt, Pseudomonas aeruginosa PA01
aggccgagcagcgccagcca

SEQ ID NO: 1531296 - RNA, 16 nt, Pseudomonas aeruginosa PA01
aggccgagcaggaaga

SEQ ID NO: 1531297 - RNA, 20 nt, Pseudomonas aeruginosa PA01
aggccgagcccgagugcgcc

SEQ ID NO: 1531298 - RNA, 14 nt, Pseudomonas aeruginosa PA01
aggccgagccggca

SEQ ID NO: 1531299 - RNA, 14 nt, Pseudomonas aeruginosa PA01
aggccgagcugcuc

SEQ ID NO: 1531300 - RNA, 13 nt, Pseudomonas aeruginosa PA01
aggccgagcgcgc

SEQ ID NO: 1531301 - RNA, 17 nt, Pseudomonas aeruginosa PA01
aggccgagcgcgccgcc

SEQ ID NO: 1531302 - RNA, 23 nt, Pseudomonas aeruginosa PA01
aggccgaucaccagcgccaggcc

SEQ ID NO: 1531303 - RNA, 14 nt, Pseudomonas aeruginosa PA01
aggccgcaggugaa

SEQ ID NO: 1531304 - RNA, 14 nt, Pseudomonas aeruginosa PA01
aggccgaucaggaa

SEQ ID NO: 1531305 - RNA, 22 nt, Pseudomonas aeruginosa PA01
aggccgaucucgugggccagca

SEQ ID NO: 1531306 - RNA, 21 nt, Pseudomonas aeruginosa PA01
aggccuuggcgaucucgugcu

SEQ ID NO: 1531307 - RNA, 19 nt, Pseudomonas aeruginosa PA01
aggccuugcagcaacucgc

SEQ ID NO: 1531308 - RNA, 13 nt, Pseudomonas aeruginosa PA01
aggccuugcaggg

SEQ ID NO: 1531309 - RNA, 23 nt, Pseudomonas aeruginosa PA01
aggccuugcagggccgccagccg

SEQ ID NO: 1531310 - RNA, 21 nt, Pseudomonas aeruginosa PA01
aggccuugccuucguuggccu

SEQ ID NO: 1531311 - RNA, 20 nt, Pseudomonas aeruginosa PA01
aggccuuggaggaucgagcc

SEQ ID NO: 1531312 - RNA, 16 nt, Pseudomonas aeruginosa PA01
aggcgaaaaaaagccc

SEQ ID NO: 1531313 - RNA, 21 nt, Pseudomonas aeruginosa PA01
aggccuuucuucugcugugcg

SEQ ID NO: 1531314 - RNA, 17 nt, Pseudomonas aeruginosa PA01
aggcgaaccacaccagg

SEQ ID NO: 1531315 - RNA, 22 nt, Pseudomonas aeruginosa PA01
aggcgaaccacaccaggucgcc

SEQ ID NO: 1531316 - RNA, 17 nt, Pseudomonas aeruginosa PA01
aggccuggaacaccagg

SEQ ID NO: 1531317 - RNA, 12 nt, Pseudomonas aeruginosa PA01
aggccuggaugu

SEQ ID NO: 1531318 - RNA, 20 nt, Pseudomonas aeruginosa PA01
aggccuggcccuggcgcagg

SEQ ID NO: 1531319 - RNA, 22 nt, Pseudomonas aeruginosa PA01
aggccuggccguugcgcaggcg

SEQ ID NO: 1531320 - RNA, 17 nt, Pseudomonas aeruginosa PA01
aggccuggcgcaacagg

SEQ ID NO: 1531321 - RNA, 19 nt, Pseudomonas aeruginosa PA01
aggccuggcgcaacaggcg

SEQ ID NO: 1531322 - RNA, 23 nt, Pseudomonas aeruginosa PA01
aggccucggucaggcgcugguga

SEQ ID NO: 1531323 - RNA, 17 nt, Pseudomonas aeruginosa PA01
aggccucgucguucagc

SEQ ID NO: 1531324 - RNA, 21 nt, Pseudomonas aeruginosa PA01
aggccucgucguucagcccac

SEQ ID NO: 1531325 - RNA, 22 nt, Pseudomonas aeruginosa PA01
aggccucgucguucagcccacc

SEQ ID NO: 1531326 - RNA, 13 nt, Pseudomonas aeruginosa PA01
aggccuccagcaa

SEQ ID NO: 1531327 - RNA, 17 nt, Pseudomonas aeruginosa PA01
aggccucccagccgugg

SEQ ID NO: 1531328 - RNA, 12 nt, Pseudomonas aeruginosa PA01
aggcgagcagcg

SEQ ID NO: 1531329 - RNA, 16 nt, Pseudomonas aeruginosa PA01
aggcgagcagcggcac

SEQ ID NO: 1531330 - RNA, 23 nt, Pseudomonas aeruginosa PA01
aggcgagucuugaggaagucgau

SEQ ID NO: 1531331 - RNA, 14 nt, Pseudomonas aeruginosa PA01
aggcgaauggaggg

SEQ ID NO: 1531332 - RNA, 15 nt, Pseudomonas aeruginosa PA01
aggcgaacggcaggu

SEQ ID NO: 1531333 - RNA, 22 nt, Pseudomonas aeruginosa PA01
aggcgaagaaagccccugccgu

SEQ ID NO: 1531334 - RNA, 14 nt, Pseudomonas aeruginosa PA01
aggcgaagcccagc

SEQ ID NO: 1531335 - RNA, 18 nt, Pseudomonas aeruginosa PA01
aggcgacaaaucggcauc

SEQ ID NO: 1531336 - RNA, 17 nt, Pseudomonas aeruginosa PA01
aggcgcagcguccugcc

SEQ ID NO: 1531337 - RNA, 14 nt, Pseudomonas aeruginosa PA01
aggcgcagugccug

SEQ ID NO: 1531338 - RNA, 16 nt, Pseudomonas aeruginosa PA01
aggcgcagccagcaca

SEQ ID NO: 1531339 - RNA, 13 nt, Pseudomonas aeruginosa PA01
aggcgcaccagca

SEQ ID NO: 1531340 - RNA, 13 nt, Pseudomonas aeruginosa PA01
aggcgcacaucac

SEQ ID NO: 1531341 - RNA, 15 nt, Pseudomonas aeruginosa PA01
aggcgcaccuccucg

SEQ ID NO: 1531342 - RNA, 17 nt, Pseudomonas aeruginosa PA01
aggcgauccacagcagg

SEQ ID NO: 1531343 - RNA, 15 nt, Pseudomonas aeruginosa PA01
aggcgauagccgacc

SEQ ID NO: 1531344 - RNA, 15 nt, Pseudomonas aeruginosa PA01
aggcgauaucccgcc

SEQ ID NO: 1531345 - RNA, 16 nt, Pseudomonas aeruginosa PA01
aggcgcgucuccagcu

SEQ ID NO: 1531346 - RNA, 16 nt, Pseudomonas aeruginosa PA01
aggcgcgcggccagcg

SEQ ID NO: 1531347 - RNA, 17 nt, Pseudomonas aeruginosa PA01
aggcgcgggcuggccac

SEQ ID NO: 1531348 - RNA, 19 nt, Pseudomonas aeruginosa PA01
aggcgcguugcuuccaggc

SEQ ID NO: 1531349 - RNA, 21 nt, Pseudomonas aeruginosa PA01
aggcgcguugcuuccaggcac

SEQ ID NO: 1531350 - RNA, 13 nt, Pseudomonas aeruginosa PA01
aggcgcgcagggc

SEQ ID NO: 1531351 - RNA, 13 nt, Pseudomonas aeruginosa PA01
aggcgcgcgccga

SEQ ID NO: 1531352 - RNA, 17 nt, Pseudomonas aeruginosa PA01
aggcgcgcucagcgcuu

SEQ ID NO: 1531353 - RNA, 12 nt, Pseudomonas aeruginosa PA01
aggcgcgcucgg

SEQ ID NO: 1531354 - RNA, 17 nt, Pseudomonas aeruginosa PA01
aggcgcugggcggcugg

SEQ ID NO: 1531355 - RNA, 15 nt, Pseudomonas aeruginosa PA01
aggcgcuggccagcg

SEQ ID NO: 1531356 - RNA, 17 nt, Pseudomonas aeruginosa PA01
aggcgcuggccagcgcu

SEQ ID NO: 1531357 - RNA, 22 nt, Pseudomonas aeruginosa PA01
aggcgcuggccagcgcuuccac

SEQ ID NO: 1531358 - RNA, 18 nt, Pseudomonas aeruginosa PA01
aggcgcucagggaaugga

SEQ ID NO: 1531359 - RNA, 16 nt, Pseudomonas aeruginosa PA01
aggcgcuccuccagcg

SEQ ID NO: 1531360 - RNA, 21 nt, Pseudomonas aeruginosa PA01
aggcgcucguagagcuugcug

SEQ ID NO: 1531361 - RNA, 16 nt, Pseudomonas aeruginosa PA01
aggcgcuccggaacgc

SEQ ID NO: 1531362 - RNA, 14 nt, Pseudomonas aeruginosa PA01
aggcgcuccgggcu

SEQ ID NO: 1531363 - RNA, 19 nt, Pseudomonas aeruginosa PA01
aggcgcuccaccagggccu

SEQ ID NO: 1531364 - RNA, 19 nt, Pseudomonas aeruginosa PA01
aggcgcucaacgccucgcg

SEQ ID NO: 1531365 - RNA, 18 nt, Pseudomonas aeruginosa PA01
aggcgcaguaacgccugu

SEQ ID NO: 1531366 - RNA, 13 nt, Pseudomonas aeruginosa PA01
aggcgcccaggca

SEQ ID NO: 1531367 - RNA, 16 nt, Pseudomonas aeruginosa PA01
aggcgccgaugcccag

SEQ ID NO: 1531368 - RNA, 20 nt, Pseudomonas aeruginosa PA01
aggcgcccggucagguugga

SEQ ID NO: 1531369 - RNA, 22 nt, Pseudomonas aeruginosa PA01
aggcgcaugcccagggccagca

SEQ ID NO: 1531370 - RNA, 21 nt, Pseudomonas aeruginosa PA01
aggcgccagccuacugggcgu

SEQ ID NO: 1531371 - RNA, 12 nt, Pseudomonas aeruginosa PA01
aggcgccaggcc

SEQ ID NO: 1531372 - RNA, 18 nt, Pseudomonas aeruginosa PA01
aggcgccggaccaacugc

SEQ ID NO: 1531373 - RNA, 15 nt, Pseudomonas aeruginosa PA01
aggcgccggcgcgcg

SEQ ID NO: 1531374 - RNA, 13 nt, Pseudomonas aeruginosa PA01
aggcgccuuccag

SEQ ID NO: 1531375 - RNA, 23 nt, Pseudomonas aeruginosa PA01
aggcgccuuccaggcgugccugu

SEQ ID NO: 1531376 - RNA, 21 nt, Pseudomonas aeruginosa PA01
aggcgccgggucgaugggccg

SEQ ID NO: 1531377 - RNA, 13 nt, Pseudomonas aeruginosa PA01
aggcgcgccgaca

SEQ ID NO: 1531378 - RNA, 21 nt, Pseudomonas aeruginosa PA01
aggccaccugcggguggccuu

SEQ ID NO: 1531379 - RNA, 14 nt, Pseudomonas aeruginosa PA01
aggccaagcaugaa

SEQ ID NO: 1531380 - RNA, 17 nt, Pseudomonas aeruginosa PA01
aggccaagucggccgcc

SEQ ID NO: 1531381 - RNA, 22 nt, Pseudomonas aeruginosa PA01
aggccaagucggccgcccagcg

SEQ ID NO: 1531382 - RNA, 23 nt, Pseudomonas aeruginosa PA01
aggccaagucggccgcccagcgg

SEQ ID NO: 1531383 - RNA, 13 nt, Pseudomonas aeruginosa PA01
aggcagaccugca

SEQ ID NO: 1531384 - RNA, 12 nt, Pseudomonas aeruginosa PA01
aggcagaccagg

SEQ ID NO: 1531385 - RNA, 19 nt, Pseudomonas aeruginosa PA01
aggcagaccaggccgagca

SEQ ID NO: 1531386 - RNA, 22 nt, Pseudomonas aeruginosa PA01
aggcagaccaggccgagcagga

SEQ ID NO: 1531387 - RNA, 20 nt, Pseudomonas aeruginosa PA01
aggcacgaaccguccgcagc

SEQ ID NO: 1531388 - RNA, 16 nt, Pseudomonas aeruginosa PA01
aggcacgcugccagca

SEQ ID NO: 1531389 - RNA, 19 nt, Pseudomonas aeruginosa PA01
aggcacgcugccagcaggc

SEQ ID NO: 1531390 - RNA, 15 nt, Pseudomonas aeruginosa PA01
aggcacggaagcgcu

SEQ ID NO: 1531391 - RNA, 21 nt, Pseudomonas aeruginosa PA01
aggcacggaagcgcugcucga

SEQ ID NO: 1531392 - RNA, 10 nt, Pseudomonas aeruginosa PA01
aggagcaggg

SEQ ID NO: 1531393 - RNA, 11 nt, Pseudomonas aeruginosa PA01
aggagcagggc

SEQ ID NO: 1531394 - RNA, 14 nt, Pseudomonas aeruginosa PA01
aggagcagggcgcc

SEQ ID NO: 1531395 - RNA, 19 nt, Pseudomonas aeruginosa PA01
aggagcgccaucagcgacc

SEQ ID NO: 1531396 - RNA, 19 nt, Pseudomonas aeruginosa PA01
aggagcaucggcgcggccu

SEQ ID NO: 1531397 - RNA, 16 nt, Pseudomonas aeruginosa PA01
aggaggaaauacagca

SEQ ID NO: 1531398 - RNA, 21 nt, Pseudomonas aeruginosa PA01
aggaggaaauacagcacccgg

SEQ ID NO: 1531399 - RNA, 13 nt, Pseudomonas aeruginosa PA01
aggaggaucgcca

SEQ ID NO: 1531400 - RNA, 23 nt, Pseudomonas aeruginosa PA01
aggauuuccgcgcccggcuggcc

SEQ ID NO: 1531401 - RNA, 13 nt, Pseudomonas aeruginosa PA01
aggauucagcagg

SEQ ID NO: 1531402 - RNA, 14 nt, Pseudomonas aeruginosa PA01
aggcaacagcccgc

SEQ ID NO: 1531403 - RNA, 15 nt, Pseudomonas aeruginosa PA01
aggcaacagcccgcg

SEQ ID NO: 1531404 - RNA, 21 nt, Pseudomonas aeruginosa PA01
aggauuuucuccggcgccggg

SEQ ID NO: 1531405 - RNA, 23 nt, Pseudomonas aeruginosa PA01
aggauuuucuccggcgccgggcu

SEQ ID NO: 1531406 - RNA, 14 nt, Pseudomonas aeruginosa PA01
aggcaacggagcug

SEQ ID NO: 1531407 - RNA, 22 nt, Pseudomonas aeruginosa PA01
aggcaagacgaaagagcccggc

SEQ ID NO: 1531408 - RNA, 18 nt, Pseudomonas aeruginosa PA01
aggcaaggucgucucaga

SEQ ID NO: 1531409 - RNA, 15 nt, Pseudomonas aeruginosa PA01
aggcacaggacccuu

SEQ ID NO: 1531410 - RNA, 16 nt, Pseudomonas aeruginosa PA01
aggcacagggcgacua

SEQ ID NO: 1531411 - RNA, 13 nt, Pseudomonas aeruginosa PA01
aggcaccaccgcc

SEQ ID NO: 1531412 - RNA, 13 nt, Pseudomonas aeruginosa PA01
agcugccagcccc

SEQ ID NO: 1531413 - RNA, 14 nt, Pseudomonas aeruginosa PA01
agcugccagugcuc

SEQ ID NO: 1531414 - RNA, 13 nt, Pseudomonas aeruginosa PA01
agcuccaccaaau

SEQ ID NO: 1531415 - RNA, 23 nt, Pseudomonas aeruginosa PA01
agcuccagcggaaucgcgcccuu

SEQ ID NO: 1531416 - RNA, 13 nt, Pseudomonas aeruginosa PA01
agcuccagggcug

SEQ ID NO: 1531417 - RNA, 16 nt, Pseudomonas aeruginosa PA01
agcugcucuaccgacu

SEQ ID NO: 1531418 - RNA, 12 nt, Pseudomonas aeruginosa PA01
agcugcgaggga

SEQ ID NO: 1531419 - RNA, 17 nt, Pseudomonas aeruginosa PA01
agcugccuuccagcagg

SEQ ID NO: 1531420 - RNA, 19 nt, Pseudomonas aeruginosa PA01
agcugccgggcgagcugca

SEQ ID NO: 1531421 - RNA, 13 nt, Pseudomonas aeruginosa PA01
agcugccggcauu

SEQ ID NO: 1531422 - RNA, 19 nt, Pseudomonas aeruginosa PA01
agcugccgcaccgccucga

SEQ ID NO: 1531423 - RNA, 16 nt, Pseudomonas aeruginosa PA01
agcugccccacaggcc

SEQ ID NO: 1531424 - RNA, 12 nt, Pseudomonas aeruginosa PA01
agcuggaaagcu

SEQ ID NO: 1531425 - RNA, 19 nt, Pseudomonas aeruginosa PA01
agcuggacgacgcuggccu

SEQ ID NO: 1531426 - RNA, 17 nt, Pseudomonas aeruginosa PA01
agcuggaaauggcgguc

SEQ ID NO: 1531427 - RNA, 19 nt, Pseudomonas aeruginosa PA01
agcuggucaauaccacccu

SEQ ID NO: 1531428 - RNA, 17 nt, Pseudomonas aeruginosa PA01
agcuguccgcgccgcgu

SEQ ID NO: 1531429 - RNA, 18 nt, Pseudomonas aeruginosa PA01
agcuguagcggcuugcag

SEQ ID NO: 1531430 - RNA, 21 nt, Pseudomonas aeruginosa PA01
agcugucguaguccugggccg

SEQ ID NO: 1531431 - RNA, 15 nt, Pseudomonas aeruginosa PA01
agcuuccaggcgcgc

SEQ ID NO: 1531432 - RNA, 14 nt, Pseudomonas aeruginosa PA01
agcuucgccgcccu

SEQ ID NO: 1531433 - RNA, 15 nt, Pseudomonas aeruginosa PA01
agcuucgccgcccug

SEQ ID NO: 1531434 - RNA, 16 nt, Pseudomonas aeruginosa PA01
agcuucgccgcccugg

SEQ ID NO: 1531435 - RNA, 22 nt, Pseudomonas aeruginosa PA01
agcuucgccgcgcaagcucguc

SEQ ID NO: 1531436 - RNA, 19 nt, Pseudomonas aeruginosa PA01
agcuucaucgaggugcuug

SEQ ID NO: 1531437 - RNA, 17 nt, Pseudomonas aeruginosa PA01
agcuugguauccaccuc

SEQ ID NO: 1531438 - RNA, 22 nt, Pseudomonas aeruginosa PA01
agcuugccgagguucuuccacu

SEQ ID NO: 1531439 - RNA, 20 nt, Pseudomonas aeruginosa PA01
agcuugccgcaggucuuguc

SEQ ID NO: 1531440 - RNA, 23 nt, Pseudomonas aeruginosa PA01
agcuugugggcaugcucggccag

SEQ ID NO: 1531441 - RNA, 16 nt, Pseudomonas aeruginosa PA01
agcuugaggucggccu

SEQ ID NO: 1531442 - RNA, 18 nt, Pseudomonas aeruginosa PA01
agcuugauguaggacagg

SEQ ID NO: 1531443 - RNA, 18 nt, Pseudomonas aeruginosa PA01
agcuucugguuguaagcg

SEQ ID NO: 1531444 - RNA, 19 nt, Pseudomonas aeruginosa PA01
agcuugacgaucuucugca

SEQ ID NO: 1531445 - RNA, 16 nt, Pseudomonas aeruginosa PA01
agcuucugcuggaucc

SEQ ID NO: 1531446 - RNA, 17 nt, Pseudomonas aeruginosa PA01
aggacaacgacagcccc

SEQ ID NO: 1531447 - RNA, 14 nt, Pseudomonas aeruginosa PA01
aggaaguggccggu

SEQ ID NO: 1531448 - RNA, 17 nt, Pseudomonas aeruginosa PA01
aggacagcacgcucagg

SEQ ID NO: 1531449 - RNA, 19 nt, Pseudomonas aeruginosa PA01
aggacagcacgcucaggca

SEQ ID NO: 1531450 - RNA, 15 nt, Pseudomonas aeruginosa PA01
aggacagggccaggc

SEQ ID NO: 1531451 - RNA, 17 nt, Pseudomonas aeruginosa PA01
aggacaggucgcggaag

SEQ ID NO: 1531452 - RNA, 16 nt, Pseudomonas aeruginosa PA01
aggaaggcuuccggcu

SEQ ID NO: 1531453 - RNA, 14 nt, Pseudomonas aeruginosa PA01
aggaaggccgggcc

SEQ ID NO: 1531454 - RNA, 16 nt, Pseudomonas aeruginosa PA01
aggaaggcgcgcacca

SEQ ID NO: 1531455 - RNA, 14 nt, Pseudomonas aeruginosa PA01
aggaaggccagcag

SEQ ID NO: 1531456 - RNA, 13 nt, Pseudomonas aeruginosa PA01
aggaaggccaggu

SEQ ID NO: 1531457 - RNA, 13 nt, Pseudomonas aeruginosa PA01
aggaaguggaucg

SEQ ID NO: 1531458 - RNA, 17 nt, Pseudomonas aeruginosa PA01
aggaaguggaucggccc

SEQ ID NO: 1531459 - RNA, 16 nt, Pseudomonas aeruginosa PA01
aggaagucggcggccg

SEQ ID NO: 1531460 - RNA, 23 nt, Pseudomonas aeruginosa PA01
aggagaucggcguuuacgcgcca

SEQ ID NO: 1531461 - RNA, 16 nt, Pseudomonas aeruginosa PA01
agcuuugcagggcgau

SEQ ID NO: 1531462 - RNA, 15 nt, Pseudomonas aeruginosa PA01
agcuuguuggccagc

SEQ ID NO: 1531463 - RNA, 18 nt, Pseudomonas aeruginosa PA01
agcuuguuggccagcagc

SEQ ID NO: 1531464 - RNA, 20 nt, Pseudomonas aeruginosa PA01
agcuuugcgcagccacccgc

SEQ ID NO: 1531465 - RNA, 13 nt, Pseudomonas aeruginosa PA01
aggaagcgggccu

SEQ ID NO: 1531466 - RNA, 22 nt, Pseudomonas aeruginosa PA01
aggaagcgucgugcgccggccu

SEQ ID NO: 1531467 - RNA, 23 nt, Pseudomonas aeruginosa PA01
aggaacuccuccucgcuccagag

SEQ ID NO: 1531468 - RNA, 13 nt, Pseudomonas aeruginosa PA01
aggaagagcagcg

SEQ ID NO: 1531469 - RNA, 22 nt, Pseudomonas aeruginosa PA01
aggaaccaggggucgacgcagg

SEQ ID NO: 1531470 - RNA, 18 nt, Pseudomonas aeruginosa PA01
aggaacccaaucacaacg

SEQ ID NO: 1531471 - RNA, 19 nt, Pseudomonas aeruginosa PA01
aggaacagcuccuccagcg

SEQ ID NO: 1531472 - RNA, 13 nt, Pseudomonas aeruginosa PA01
aggaacaggucga

SEQ ID NO: 1531473 - RNA, 19 nt, Pseudomonas aeruginosa PA01
aggaacagguucggcaggc

SEQ ID NO: 1531474 - RNA, 16 nt, Pseudomonas aeruginosa PA01
aggaacauccgcggcc

SEQ ID NO: 1531475 - RNA, 20 nt, Pseudomonas aeruginosa PA01
aggaacauccgcggccccgg

SEQ ID NO: 1531476 - RNA, 16 nt, Pseudomonas aeruginosa PA01
aggaacgccucgcaga

SEQ ID NO: 1531477 - RNA, 21 nt, Pseudomonas aeruginosa PA01
aggaacgugcggccugcaaca

SEQ ID NO: 1531478 - RNA, 18 nt, Pseudomonas aeruginosa PA01
auacacaugcaggcucga

SEQ ID NO: 1531479 - RNA, 11 nt, Pseudomonas aeruginosa PA01
auacagcagcc

SEQ ID NO: 1531480 - RNA, 19 nt, Pseudomonas aeruginosa PA01
agucuuucagcuucagggu

SEQ ID NO: 1531481 - RNA, 13 nt, Pseudomonas aeruginosa PA01
agucggugaccuc

SEQ ID NO: 1531482 - RNA, 11 nt, Pseudomonas aeruginosa PA01
agucuccagcg

SEQ ID NO: 1531483 - RNA, 13 nt, Pseudomonas aeruginosa PA01
agucggccaggcg

SEQ ID NO: 1531484 - RNA, 16 nt, Pseudomonas aeruginosa PA01
agucggaagcuucaga

SEQ ID NO: 1531485 - RNA, 14 nt, Pseudomonas aeruginosa PA01
agucgguagagcaa

SEQ ID NO: 1531486 - RNA, 14 nt, Pseudomonas aeruginosa PA01
agucgguagagcag

SEQ ID NO: 1531487 - RNA, 13 nt, Pseudomonas aeruginosa PA01
agucggggcaggc

SEQ ID NO: 1531488 - RNA, 18 nt, Pseudomonas aeruginosa PA01
agucggcgacgaugccgc

SEQ ID NO: 1531489 - RNA, 21 nt, Pseudomonas aeruginosa PA01
agucggcgacgaugccgccgc

SEQ ID NO: 1531490 - RNA, 18 nt, Pseudomonas aeruginosa PA01
aguccuccgcgcccaggc

SEQ ID NO: 1531491 - RNA, 14 nt, Pseudomonas aeruginosa PA01
agucgaagcagccc

SEQ ID NO: 1531492 - RNA, 21 nt, Pseudomonas aeruginosa PA01
agucgcgguugcugugcaccc

SEQ ID NO: 1531493 - RNA, 18 nt, Pseudomonas aeruginosa PA01
agucgcggggcggauugc

SEQ ID NO: 1531494 - RNA, 16 nt, Pseudomonas aeruginosa PA01
agucgcugcucggccu

SEQ ID NO: 1531495 - RNA, 14 nt, Pseudomonas aeruginosa PA01
agucgcugcuggcg

SEQ ID NO: 1531496 - RNA, 15 nt, Pseudomonas aeruginosa PA01
agucgaccgucgcca

SEQ ID NO: 1531497 - RNA, 17 nt, Pseudomonas aeruginosa PA01
agucgagacgccagccg

SEQ ID NO: 1531498 - RNA, 22 nt, Pseudomonas aeruginosa PA01
agucgagcaguucccccagcac

SEQ ID NO: 1531499 - RNA, 16 nt, Pseudomonas aeruginosa PA01
agucgaucaggucgcc

SEQ ID NO: 1531500 - RNA, 14 nt, Pseudomonas aeruginosa PA01
aguccgccagccgg

SEQ ID NO: 1531501 - RNA, 22 nt, Pseudomonas aeruginosa PA01
aguccgcgcgcgcgcuccucga

SEQ ID NO: 1531502 - RNA, 20 nt, Pseudomonas aeruginosa PA01
agugauggaagagcgccgcg

SEQ ID NO: 1531503 - RNA, 15 nt, Pseudomonas aeruginosa PA01
agugcaucggccgcc

SEQ ID NO: 1531504 - RNA, 20 nt, Pseudomonas aeruginosa PA01
agugcaucggccgccaggcu

SEQ ID NO: 1531505 - RNA, 19 nt, Pseudomonas aeruginosa PA01
agugccaggcucgccgcca

SEQ ID NO: 1531506 - RNA, 18 nt, Pseudomonas aeruginosa PA01
agugcacguuccagcucg

SEQ ID NO: 1531507 - RNA, 21 nt, Pseudomonas aeruginosa PA01
agugcuggguggaggcccaga

SEQ ID NO: 1531508 - RNA, 14 nt, Pseudomonas aeruginosa PA01
aguggaucggcccu

SEQ ID NO: 1531509 - RNA, 19 nt, Pseudomonas aeruginosa PA01
aguggucgcagcuccagcg

SEQ ID NO: 1531510 - RNA, 18 nt, Pseudomonas aeruginosa PA01
agugguuccaggagggcu

SEQ ID NO: 1531511 - RNA, 20 nt, Pseudomonas aeruginosa PA01
agugguuccaggagggcugc

SEQ ID NO: 1531512 - RNA, 18 nt, Pseudomonas aeruginosa PA01
agugcggcgggcgcccgc

SEQ ID NO: 1531513 - RNA, 20 nt, Pseudomonas aeruginosa PA01
agugcugaguuucacgucga

SEQ ID NO: 1531514 - RNA, 16 nt, Pseudomonas aeruginosa PA01
agugcgcccagcagca

SEQ ID NO: 1531515 - RNA, 22 nt, Pseudomonas aeruginosa PA01
agugccucgcgcguggccgcca

SEQ ID NO: 1531516 - RNA, 13 nt, Pseudomonas aeruginosa PA01
agugccugcacca

SEQ ID NO: 1531517 - RNA, 23 nt, Pseudomonas aeruginosa PA01
agugccggcgcgucgcugcgcaa

SEQ ID NO: 1531518 - RNA, 16 nt, Pseudomonas aeruginosa PA01
aguugcaggccagcgc

SEQ ID NO: 1531519 - RNA, 21 nt, Pseudomonas aeruginosa PA01
aguuguacagcgaggcccgcg

SEQ ID NO: 1531520 - RNA, 23 nt, Pseudomonas aeruginosa PA01
aguugcgauagaccaggaaggcc

SEQ ID NO: 1531521 - RNA, 14 nt, Pseudomonas aeruginosa PA01
aguugccuggcagg

SEQ ID NO: 1531522 - RNA, 19 nt, Pseudomonas aeruginosa PA01
aguuugccgaacugcaggg

SEQ ID NO: 1531523 - RNA, 17 nt, Pseudomonas aeruginosa PA01
aguuugcccagcgccgc

SEQ ID NO: 1531524 - RNA, 20 nt, Pseudomonas aeruginosa PA01
aguuucacgucgagcacgcc

SEQ ID NO: 1531525 - RNA, 23 nt, Pseudomonas aeruginosa PA01
aguuuccgcgaggaucagccacg

SEQ ID NO: 1531526 - RNA, 14 nt, Pseudomonas aeruginosa PA01
aguucugggcggcc

SEQ ID NO: 1531527 - RNA, 15 nt, Pseudomonas aeruginosa PA01
aguucuucagcagca

SEQ ID NO: 1531528 - RNA, 14 nt, Pseudomonas aeruginosa PA01
aguucuccagcaag

SEQ ID NO: 1531529 - RNA, 15 nt, Pseudomonas aeruginosa PA01
aguucuccagcaagc

SEQ ID NO: 1531530 - RNA, 14 nt, Pseudomonas aeruginosa PA01
aguucggcgaugac

SEQ ID NO: 1531531 - RNA, 16 nt, Pseudomonas aeruginosa PA01
aguucggugccgccgg

SEQ ID NO: 1531532 - RNA, 17 nt, Pseudomonas aeruginosa PA01
aguucggccagcggcag

SEQ ID NO: 1531533 - RNA, 23 nt, Pseudomonas aeruginosa PA01
aguuaaugcuuacaagagcagac

SEQ ID NO: 1531534 - RNA, 18 nt, Pseudomonas aeruginosa PA01
aguucacauuggcuuccg

SEQ ID NO: 1531535 - RNA, 20 nt, Pseudomonas aeruginosa PA01
aucuucgccuccuucaucuu

SEQ ID NO: 1531536 - RNA, 15 nt, Pseudomonas aeruginosa PA01
aucuuuccuccagag

SEQ ID NO: 1531537 - RNA, 16 nt, Pseudomonas aeruginosa PA01
augaaaaagcccggca

SEQ ID NO: 1531538 - RNA, 18 nt, Pseudomonas aeruginosa PA01
augaacagcgagaacagc

SEQ ID NO: 1531539 - RNA, 20 nt, Pseudomonas aeruginosa PA01
augaacaccgcuucgagcac

SEQ ID NO: 1531540 - RNA, 19 nt, Pseudomonas aeruginosa PA01
augaagcuuuuccagcgca

SEQ ID NO: 1531541 - RNA, 13 nt, Pseudomonas aeruginosa PA01
augaagcgguucu

SEQ ID NO: 1531542 - RNA, 21 nt, Pseudomonas aeruginosa PA01
augaagguucaggugaaaagc

SEQ ID NO: 1531543 - RNA, 19 nt, Pseudomonas aeruginosa PA01
augaggcuguccagcaggc

SEQ ID NO: 1531544 - RNA, 19 nt, Pseudomonas aeruginosa PA01
augagguuggccacguagg

SEQ ID NO: 1531545 - RNA, 14 nt, Pseudomonas aeruginosa PA01
augagcgcccggca

SEQ ID NO: 1531546 - RNA, 21 nt, Pseudomonas aeruginosa PA01
augagcugcucuaccgacuga

SEQ ID NO: 1531547 - RNA, 15 nt, Pseudomonas aeruginosa PA01
augaucaggccgagc

SEQ ID NO: 1531548 - RNA, 17 nt, Pseudomonas aeruginosa PA01
augaucaggccgagcac

SEQ ID NO: 1531549 - RNA, 21 nt, Pseudomonas aeruginosa PA01
augauccggugcaggccgagc

SEQ ID NO: 1531550 - RNA, 16 nt, Pseudomonas aeruginosa PA01
aucucaucgcccauga

SEQ ID NO: 1531551 - RNA, 22 nt, Pseudomonas aeruginosa PA01
aucucaucgcccaugaaaaagc

SEQ ID NO: 1531552 - RNA, 21 nt, Pseudomonas aeruginosa PA01
aucucgaacucgaaggccagc

SEQ ID NO: 1531553 - RNA, 12 nt, Pseudomonas aeruginosa PA01
aucuccuccucg

SEQ ID NO: 1531554 - RNA, 14 nt, Pseudomonas aeruginosa PA01
aucuccucgcugau

SEQ ID NO: 1531555 - RNA, 13 nt, Pseudomonas aeruginosa PA01
aucuccugcugga

SEQ ID NO: 1531556 - RNA, 14 nt, Pseudomonas aeruginosa PA01
aucuccugcuggac

SEQ ID NO: 1531557 - RNA, 23 nt, Pseudomonas aeruginosa PA01
aucuccugguagaacuccuugcc

SEQ ID NO: 1531558 - RNA, 18 nt, Pseudomonas aeruginosa PA01
aucucgcguuccagcacc

SEQ ID NO: 1531559 - RNA, 17 nt, Pseudomonas aeruginosa PA01
aucuauaaugcgccccc

SEQ ID NO: 1531560 - RNA, 13 nt, Pseudomonas aeruginosa PA01
aucuucagcagca

SEQ ID NO: 1531561 - RNA, 16 nt, Pseudomonas aeruginosa PA01
aucuggcugcccaggc

SEQ ID NO: 1531562 - RNA, 13 nt, Pseudomonas aeruginosa PA01
auccaccagcacg

SEQ ID NO: 1531563 - RNA, 20 nt, Pseudomonas aeruginosa PA01
auccagccggcauccagcau

SEQ ID NO: 1531564 - RNA, 21 nt, Pseudomonas aeruginosa PA01
auccagccaggcgcucucgcc

SEQ ID NO: 1531565 - RNA, 13 nt, Pseudomonas aeruginosa PA01
auccaccucgccc

SEQ ID NO: 1531566 - RNA, 14 nt, Pseudomonas aeruginosa PA01
auccagggccagga

SEQ ID NO: 1531567 - RNA, 15 nt, Pseudomonas aeruginosa PA01
auccagggccgagca

SEQ ID NO: 1531568 - RNA, 23 nt, Pseudomonas aeruginosa PA01
auccagggccgagcacaggguga

SEQ ID NO: 1531569 - RNA, 13 nt, Pseudomonas aeruginosa PA01
auccccuccucca

SEQ ID NO: 1531570 - RNA, 16 nt, Pseudomonas aeruginosa PA01
auccccgccucgacca

SEQ ID NO: 1531571 - RNA, 18 nt, Pseudomonas aeruginosa PA01
aucccggauucgccgagg

SEQ ID NO: 1531572 - RNA, 11 nt, Pseudomonas aeruginosa PA01
aucccccgccc

SEQ ID NO: 1531573 - RNA, 16 nt, Pseudomonas aeruginosa PA01
auccccccacccgucc

SEQ ID NO: 1531574 - RNA, 22 nt, Pseudomonas aeruginosa PA01
auccgcgaauagggcggcgcca

SEQ ID NO: 1531575 - RNA, 18 nt, Pseudomonas aeruginosa PA01
auccgccgcugugcaggg

SEQ ID NO: 1531576 - RNA, 19 nt, Pseudomonas aeruginosa PA01
auccgccggcugugcaggg

SEQ ID NO: 1531577 - RNA, 21 nt, Pseudomonas aeruginosa PA01
auccgccgucgggcuucggug

SEQ ID NO: 1531578 - RNA, 16 nt, Pseudomonas aeruginosa PA01
auccgccgccgggcuu

SEQ ID NO: 1531579 - RNA, 12 nt, Pseudomonas aeruginosa PA01
auccgccgcgca

SEQ ID NO: 1531580 - RNA, 19 nt, Pseudomonas aeruginosa PA01
auccgccgauugugcaggg

SEQ ID NO: 1531581 - RNA, 12 nt, Pseudomonas aeruginosa PA01
auccgccgcaga

SEQ ID NO: 1531582 - RNA, 17 nt, Pseudomonas aeruginosa PA01
auccgccgcagaccagc

SEQ ID NO: 1531583 - RNA, 13 nt, Pseudomonas aeruginosa PA01
auccgccagggag

SEQ ID NO: 1531584 - RNA, 23 nt, Pseudomonas aeruginosa PA01
auccgcaguacgguucagaguga

SEQ ID NO: 1531585 - RNA, 15 nt, Pseudomonas aeruginosa PA01
auccgacgccggcuu

SEQ ID NO: 1531586 - RNA, 14 nt, Pseudomonas aeruginosa PA01
aucccgugccgggc

SEQ ID NO: 1531587 - RNA, 20 nt, Pseudomonas aeruginosa PA01
aucccggcugagcgccaggc

SEQ ID NO: 1531588 - RNA, 18 nt, Pseudomonas aeruginosa PA01
aucccgguuuccgcagcg

SEQ ID NO: 1531589 - RNA, 13 nt, Pseudomonas aeruginosa PA01
aucccguagaugu

SEQ ID NO: 1531590 - RNA, 17 nt, Pseudomonas aeruginosa PA01
aucccuucgugcuggcg

SEQ ID NO: 1531591 - RNA, 14 nt, Pseudomonas aeruginosa PA01
aucccuuggcugcu

SEQ ID NO: 1531592 - RNA, 13 nt, Pseudomonas aeruginosa PA01
aucgcgccaggcc

SEQ ID NO: 1531593 - RNA, 13 nt, Pseudomonas aeruginosa PA01
aucgcgcuggcca

SEQ ID NO: 1531594 - RNA, 18 nt, Pseudomonas aeruginosa PA01
aucgcggcguaggcgcgc

SEQ ID NO: 1531595 - RNA, 19 nt, Pseudomonas aeruginosa PA01
aucgcccuggccucggcgu

SEQ ID NO: 1531596 - RNA, 23 nt, Pseudomonas aeruginosa PA01
aucgcccggcgcuccaacagcag

SEQ ID NO: 1531597 - RNA, 18 nt, Pseudomonas aeruginosa PA01
aucgccagcgguacccgc

SEQ ID NO: 1531598 - RNA, 17 nt, Pseudomonas aeruginosa PA01
aucggccaccuucgccc

SEQ ID NO: 1531599 - RNA, 16 nt, Pseudomonas aeruginosa PA01
aucggcauggccacgc

SEQ ID NO: 1531600 - RNA, 20 nt, Pseudomonas aeruginosa PA01
aucggcagccguccgcccag

SEQ ID NO: 1531601 - RNA, 15 nt, Pseudomonas aeruginosa PA01
aucggccccaccgca

SEQ ID NO: 1531602 - RNA, 13 nt, Pseudomonas aeruginosa PA01
aucggccccaccu

SEQ ID NO: 1531603 - RNA, 15 nt, Pseudomonas aeruginosa PA01
aucggccccaccugg

SEQ ID NO: 1531604 - RNA, 20 nt, Pseudomonas aeruginosa PA01
aucgcuuuccuggccgaccc

SEQ ID NO: 1531605 - RNA, 15 nt, Pseudomonas aeruginosa PA01
aucgcucccaggcuc

SEQ ID NO: 1531606 - RNA, 16 nt, Pseudomonas aeruginosa PA01
aucgcucccaggcuca

SEQ ID NO: 1531607 - RNA, 22 nt, Pseudomonas aeruginosa PA01
aucgcucaacggcgugccgggc

SEQ ID NO: 1531608 - RNA, 16 nt, Pseudomonas aeruginosa PA01
aucgguaggcucugcu

SEQ ID NO: 1531609 - RNA, 13 nt, Pseudomonas aeruginosa PA01
aucgggugggaca

SEQ ID NO: 1531610 - RNA, 20 nt, Pseudomonas aeruginosa PA01
aucggugaacgagcccaggc

SEQ ID NO: 1531611 - RNA, 23 nt, Pseudomonas aeruginosa PA01
aucggugccggcaggccuucgac

SEQ ID NO: 1531612 - RNA, 17 nt, Pseudomonas aeruginosa PA01
aucgguccccuccaggu

SEQ ID NO: 1531613 - RNA, 21 nt, Pseudomonas aeruginosa PA01
aucgggcagggcagccgccgc

SEQ ID NO: 1531614 - RNA, 20 nt, Pseudomonas aeruginosa PA01
aucggcuugccggcggcgcu

SEQ ID NO: 1531615 - RNA, 14 nt, Pseudomonas aeruginosa PA01
aucggcugcaacgc

SEQ ID NO: 1531616 - RNA, 20 nt, Pseudomonas aeruginosa PA01
aucggcguccgcggccugcu

SEQ ID NO: 1531617 - RNA, 23 nt, Pseudomonas aeruginosa PA01
aucggcguguucaggugcuggac

SEQ ID NO: 1531618 - RNA, 12 nt, Pseudomonas aeruginosa PA01
aucggccucgcg

SEQ ID NO: 1531619 - RNA, 19 nt, Pseudomonas aeruginosa PA01
aucggcgcccagcaccaca

SEQ ID NO: 1531620 - RNA, 19 nt, Pseudomonas aeruginosa PA01
aucggcgcgcagggccagc

SEQ ID NO: 1531621 - RNA, 17 nt, Pseudomonas aeruginosa PA01
auccuuggucagggugc

SEQ ID NO: 1531622 - RNA, 17 nt, Pseudomonas aeruginosa PA01
auccuggucgcguucca

SEQ ID NO: 1531623 - RNA, 16 nt, Pseudomonas aeruginosa PA01
auccuguggcugcagg

SEQ ID NO: 1531624 - RNA, 22 nt, Pseudomonas aeruginosa PA01
auccuucggaggucgagcagag

SEQ ID NO: 1531625 - RNA, 17 nt, Pseudomonas aeruginosa PA01
auccuugagcacccggg

SEQ ID NO: 1531626 - RNA, 14 nt, Pseudomonas aeruginosa PA01
auccgcuccagcag

SEQ ID NO: 1531627 - RNA, 14 nt, Pseudomonas aeruginosa PA01
auccgcuccaggcu

SEQ ID NO: 1531628 - RNA, 19 nt, Pseudomonas aeruginosa PA01
auccugcugguugaagccg

SEQ ID NO: 1531629 - RNA, 18 nt, Pseudomonas aeruginosa PA01
auccuggcccuggauauc

SEQ ID NO: 1531630 - RNA, 21 nt, Pseudomonas aeruginosa PA01
auccuggcgaucaggccaagc

SEQ ID NO: 1531631 - RNA, 13 nt, Pseudomonas aeruginosa PA01
aucgaucacugcc

SEQ ID NO: 1531632 - RNA, 13 nt, Pseudomonas aeruginosa PA01
aucgccagcaauu

SEQ ID NO: 1531633 - RNA, 14 nt, Pseudomonas aeruginosa PA01
aucgccacgccggc

SEQ ID NO: 1531634 - RNA, 24 nt, Pseudomonas aeruginosa PA01
aucgccaccccgccgcuggcggca

SEQ ID NO: 1531635 - RNA, 23 nt, Pseudomonas aeruginosa PA01
aucgccaccgcggauccacgccu

SEQ ID NO: 1531636 - RNA, 14 nt, Pseudomonas aeruginosa PA01
aucgagggccacga

SEQ ID NO: 1531637 - RNA, 14 nt, Pseudomonas aeruginosa PA01
aucgaggccauccc

SEQ ID NO: 1531638 - RNA, 12 nt, Pseudomonas aeruginosa PA01
aucgaggccgcc

SEQ ID NO: 1531639 - RNA, 13 nt, Pseudomonas aeruginosa PA01
aucgaggccgccc

SEQ ID NO: 1531640 - RNA, 17 nt, Pseudomonas aeruginosa PA01
aucgaggccgcccagcg

SEQ ID NO: 1531641 - RNA, 13 nt, Pseudomonas aeruginosa PA01
aucgaccccgccg

SEQ ID NO: 1531642 - RNA, 19 nt, Pseudomonas aeruginosa PA01
aucgaccagcagcggcuca

SEQ ID NO: 1531643 - RNA, 14 nt, Pseudomonas aeruginosa PA01
aucgacaggaugcg

SEQ ID NO: 1531644 - RNA, 12 nt, Pseudomonas aeruginosa PA01
aucgacagcagc

SEQ ID NO: 1531645 - RNA, 23 nt, Pseudomonas aeruginosa PA01
auacagcucgcugucgccgagca

SEQ ID NO: 1531646 - RNA, 17 nt, Pseudomonas aeruginosa PA01
auacaggcgcagcagca

SEQ ID NO: 1531647 - RNA, 20 nt, Pseudomonas aeruginosa PA01
auacgcucgggcccucccaa

SEQ ID NO: 1531648 - RNA, 16 nt, Pseudomonas aeruginosa PA01
auagaugccgcccugc

SEQ ID NO: 1531649 - RNA, 23 nt, Pseudomonas aeruginosa PA01
auagcaggucacgcccugcaccu

SEQ ID NO: 1531650 - RNA, 20 nt, Pseudomonas aeruginosa PA01
auagcagccauagcaauaca

SEQ ID NO: 1531651 - RNA, 19 nt, Pseudomonas aeruginosa PA01
auagccggcgaaccaggcg

SEQ ID NO: 1531652 - RNA, 12 nt, Pseudomonas aeruginosa PA01
auagccuccucc

SEQ ID NO: 1531653 - RNA, 15 nt, Pseudomonas aeruginosa PA01
auagugcggccaggc

SEQ ID NO: 1531654 - RNA, 17 nt, Pseudomonas aeruginosa PA01
auagcucagcuggauag

SEQ ID NO: 1531655 - RNA, 13 nt, Pseudomonas aeruginosa PA01
auaucgcaggcca

SEQ ID NO: 1531656 - RNA, 12 nt, Pseudomonas aeruginosa PA01
auaucugggcca

SEQ ID NO: 1531657 - RNA, 14 nt, Pseudomonas aeruginosa PA01
auaucugggccauc

SEQ ID NO: 1531658 - RNA, 22 nt, Pseudomonas aeruginosa PA01
auaucuugcgcaugguuaccuc

SEQ ID NO: 1531659 - RNA, 17 nt, Pseudomonas aeruginosa PA01
aucaggaacacccgguc

SEQ ID NO: 1531660 - RNA, 16 nt, Pseudomonas aeruginosa PA01
aucaggccuuccggga

SEQ ID NO: 1531661 - RNA, 13 nt, Pseudomonas aeruginosa PA01
aucaggcgcaugc

SEQ ID NO: 1531662 - RNA, 19 nt, Pseudomonas aeruginosa PA01
aucaggcgcaugcccaggg

SEQ ID NO: 1531663 - RNA, 17 nt, Pseudomonas aeruginosa PA01
aucaggcgcuccgggcu

SEQ ID NO: 1531664 - RNA, 18 nt, Pseudomonas aeruginosa PA01
aucaggcgcuccgggcuc

SEQ ID NO: 1531665 - RNA, 19 nt, Pseudomonas aeruginosa PA01
aucaguggucgcagcucca

SEQ ID NO: 1531666 - RNA, 22 nt, Pseudomonas aeruginosa PA01
aucaguggucgcagcuccagcg

SEQ ID NO: 1531667 - RNA, 15 nt, Pseudomonas aeruginosa PA01
aucagcuuguggucg

SEQ ID NO: 1531668 - RNA, 15 nt, Pseudomonas aeruginosa PA01
aucagcuucagcucc

SEQ ID NO: 1531669 - RNA, 20 nt, Pseudomonas aeruginosa PA01
aucagcuucucuuucaccug

SEQ ID NO: 1531670 - RNA, 15 nt, Pseudomonas aeruginosa PA01
aucagcgccagggca

SEQ ID NO: 1531671 - RNA, 12 nt, Pseudomonas aeruginosa PA01
aucagccagccc

SEQ ID NO: 1531672 - RNA, 18 nt, Pseudomonas aeruginosa PA01
aucacgucgaucugcucg

SEQ ID NO: 1531673 - RNA, 23 nt, Pseudomonas aeruginosa PA01
aucacgucgcgcaccuggcgguc

SEQ ID NO: 1531674 - RNA, 20 nt, Pseudomonas aeruginosa PA01
aucaccgcguccauccccgc

SEQ ID NO: 1531675 - RNA, 19 nt, Pseudomonas aeruginosa PA01
aucaccgccaaggccucgg

SEQ ID NO: 1531676 - RNA, 16 nt, Pseudomonas aeruginosa PA01
aucaccggcagcagcg

SEQ ID NO: 1531677 - RNA, 17 nt, Pseudomonas aeruginosa PA01
aucaccggcagcagcgg

SEQ ID NO: 1531678 - RNA, 18 nt, Pseudomonas aeruginosa PA01
aucaccggggccuucagg

SEQ ID NO: 1531679 - RNA, 17 nt, Pseudomonas aeruginosa PA01
aucaacgcggccagcag

SEQ ID NO: 1531680 - RNA, 18 nt, Pseudomonas aeruginosa PA01
aucaacgcggccagcagc

SEQ ID NO: 1531681 - RNA, 22 nt, Pseudomonas aeruginosa PA01
aucaaggauuuacggauucucu

SEQ ID NO: 1531682 - RNA, 18 nt, Pseudomonas aeruginosa PA01
auauugugcgagaccccc

SEQ ID NO: 1531683 - RNA, 14 nt, Pseudomonas aeruginosa PA01
auguccgguuggcg

SEQ ID NO: 1531684 - RNA, 20 nt, Pseudomonas aeruginosa PA01
auguccugcaggcucagcac

SEQ ID NO: 1531685 - RNA, 20 nt, Pseudomonas aeruginosa PA01
augucccggguguccuuugc

SEQ ID NO: 1531686 - RNA, 21 nt, Pseudomonas aeruginosa PA01
auguccgggugaugcccgguc

SEQ ID NO: 1531687 - RNA, 16 nt, Pseudomonas aeruginosa PA01
auguugcgcagggugc

SEQ ID NO: 1531688 - RNA, 13 nt, Pseudomonas aeruginosa PA01
auguugccgccgc

SEQ ID NO: 1531689 - RNA, 15 nt, Pseudomonas aeruginosa PA01
auguugccgccgccg

SEQ ID NO: 1531690 - RNA, 13 nt, Pseudomonas aeruginosa PA01
auucacuuccccu

SEQ ID NO: 1531691 - RNA, 11 nt, Pseudomonas aeruginosa PA01
auucagaugcg

SEQ ID NO: 1531692 - RNA, 12 nt, Pseudomonas aeruginosa PA01
auggccuggcgc

SEQ ID NO: 1531693 - RNA, 13 nt, Pseudomonas aeruginosa PA01
auggcgccgccga

SEQ ID NO: 1531694 - RNA, 23 nt, Pseudomonas aeruginosa PA01
auggccagcgcguagcuuuccgc

SEQ ID NO: 1531695 - RNA, 14 nt, Pseudomonas aeruginosa PA01
auggccagcucgac

SEQ ID NO: 1531696 - RNA, 12 nt, Pseudomonas aeruginosa PA01
auggccagcccg

SEQ ID NO: 1531697 - RNA, 13 nt, Pseudomonas aeruginosa PA01
auggccagggggc

SEQ ID NO: 1531698 - RNA, 23 nt, Pseudomonas aeruginosa PA01
auggcacaguuccuguaccaggg

SEQ ID NO: 1531699 - RNA, 17 nt, Pseudomonas aeruginosa PA01
augcugauaagcucggc

SEQ ID NO: 1531700 - RNA, 16 nt, Pseudomonas aeruginosa PA01
auggcggcgauggacu

SEQ ID NO: 1531701 - RNA, 16 nt, Pseudomonas aeruginosa PA01
auggcgcuugcgcagc

SEQ ID NO: 1531702 - RNA, 18 nt, Pseudomonas aeruginosa PA01
auggcgcgguccgcggua

SEQ ID NO: 1531703 - RNA, 15 nt, Pseudomonas aeruginosa PA01
auggcgcggggcccc

SEQ ID NO: 1531704 - RNA, 20 nt, Pseudomonas aeruginosa PA01
auggcgcggggccccggcaa

SEQ ID NO: 1531705 - RNA, 22 nt, Pseudomonas aeruginosa PA01
auggcgcuccagggcgcugacc

SEQ ID NO: 1531706 - RNA, 20 nt, Pseudomonas aeruginosa PA01
auggcgcugaggaagagcag

SEQ ID NO: 1531707 - RNA, 17 nt, Pseudomonas aeruginosa PA01
auggcggucggccaggc

SEQ ID NO: 1531708 - RNA, 14 nt, Pseudomonas aeruginosa PA01
auggcguccaccgc

SEQ ID NO: 1531709 - RNA, 15 nt, Pseudomonas aeruginosa PA01
auggcguccaccgcu

SEQ ID NO: 1531710 - RNA, 14 nt, Pseudomonas aeruginosa PA01
augggacgaccuca

SEQ ID NO: 1531711 - RNA, 18 nt, Pseudomonas aeruginosa PA01
augggcacgaucugcgcc

SEQ ID NO: 1531712 - RNA, 19 nt, Pseudomonas aeruginosa PA01
augggaaccucggcaggcu

SEQ ID NO: 1531713 - RNA, 23 nt, Pseudomonas aeruginosa PA01
augggggccagcagggccgccga

SEQ ID NO: 1531714 - RNA, 18 nt, Pseudomonas aeruginosa PA01
augggcauccugccgccu

SEQ ID NO: 1531715 - RNA, 14 nt, Pseudomonas aeruginosa PA01
auggguggcccuuu

SEQ ID NO: 1531716 - RNA, 19 nt, Pseudomonas aeruginosa PA01
auggguaucaugcgccccg

SEQ ID NO: 1531717 - RNA, 22 nt, Pseudomonas aeruginosa PA01
augguauggcggucggccaggc

SEQ ID NO: 1531718 - RNA, 23 nt, Pseudomonas aeruginosa PA01
augguauggcggucggccaggcg

SEQ ID NO: 1531719 - RNA, 16 nt, Pseudomonas aeruginosa PA01
auggugaacgccaggc

SEQ ID NO: 1531720 - RNA, 17 nt, Pseudomonas aeruginosa PA01
auggugaacgccaggca

SEQ ID NO: 1531721 - RNA, 16 nt, Pseudomonas aeruginosa PA01
augguuuaccaggacc

SEQ ID NO: 1531722 - RNA, 17 nt, Pseudomonas aeruginosa PA01
auggucaggaucacauc

SEQ ID NO: 1531723 - RNA, 13 nt, Pseudomonas aeruginosa PA01
auggucaggcugg

SEQ ID NO: 1531724 - RNA, 19 nt, Pseudomonas aeruginosa PA01
auggucgaaccagcucagc

SEQ ID NO: 1531725 - RNA, 14 nt, Pseudomonas aeruginosa PA01
auguacggcaccac

SEQ ID NO: 1531726 - RNA, 14 nt, Pseudomonas aeruginosa PA01
auguagagcaggcu

SEQ ID NO: 1531727 - RNA, 17 nt, Pseudomonas aeruginosa PA01
auguagcguugcaggca

SEQ ID NO: 1531728 - RNA, 19 nt, Pseudomonas aeruginosa PA01
auguauucgaacagcuuga

SEQ ID NO: 1531729 - RNA, 17 nt, Pseudomonas aeruginosa PA01
auguccagugccucccg

SEQ ID NO: 1531730 - RNA, 12 nt, Pseudomonas aeruginosa PA01
auguccagccag

SEQ ID NO: 1531731 - RNA, 11 nt, Pseudomonas aeruginosa PA01
auguccaggca

SEQ ID NO: 1531732 - RNA, 22 nt, Pseudomonas aeruginosa PA01
augcguggguccacgccgggca

SEQ ID NO: 1531733 - RNA, 14 nt, Pseudomonas aeruginosa PA01
augcgguucggcgu

SEQ ID NO: 1531734 - RNA, 13 nt, Pseudomonas aeruginosa PA01
augcgggcgggug

SEQ ID NO: 1531735 - RNA, 15 nt, Pseudomonas aeruginosa PA01
augcggcgcugccac

SEQ ID NO: 1531736 - RNA, 18 nt, Pseudomonas aeruginosa PA01
augccguugggccagggc

SEQ ID NO: 1531737 - RNA, 20 nt, Pseudomonas aeruginosa PA01
augccguuguggcaggcgcu

SEQ ID NO: 1531738 - RNA, 20 nt, Pseudomonas aeruginosa PA01
augccgucuucgaugaaggu

SEQ ID NO: 1531739 - RNA, 20 nt, Pseudomonas aeruginosa PA01
augcggcaggccuuccacgc

SEQ ID NO: 1531740 - RNA, 22 nt, Pseudomonas aeruginosa PA01
augcggcaggccuuccacgccu

SEQ ID NO: 1531741 - RNA, 18 nt, Pseudomonas aeruginosa PA01
augcgcaggccgggaaug

SEQ ID NO: 1531742 - RNA, 18 nt, Pseudomonas aeruginosa PA01
augcucaggcgcugcugg

SEQ ID NO: 1531743 - RNA, 18 nt, Pseudomonas aeruginosa PA01
augcucacugcgagcacc

SEQ ID NO: 1531744 - RNA, 19 nt, Pseudomonas aeruginosa PA01
augcucacugcgagcacca

SEQ ID NO: 1531745 - RNA, 16 nt, Pseudomonas aeruginosa PA01
augcacgugcagcucg

SEQ ID NO: 1531746 - RNA, 16 nt, Pseudomonas aeruginosa PA01
augcaggccagggcgg

SEQ ID NO: 1531747 - RNA, 20 nt, Pseudomonas aeruginosa PA01
augcaggcucucgcgcagca

SEQ ID NO: 1531748 - RNA, 22 nt, Pseudomonas aeruginosa PA01
augaucgccaccgcguccuuga

SEQ ID NO: 1531749 - RNA, 21 nt, Pseudomonas aeruginosa PA01
augaucgccgaaaaauucagc

SEQ ID NO: 1531750 - RNA, 12 nt, Pseudomonas aeruginosa PA01
augcagguggcg

SEQ ID NO: 1531751 - RNA, 17 nt, Pseudomonas aeruginosa PA01
augcccagcgcaggccg

SEQ ID NO: 1531752 - RNA, 12 nt, Pseudomonas aeruginosa PA01
augcccaggcuc

SEQ ID NO: 1531753 - RNA, 13 nt, Pseudomonas aeruginosa PA01
augcccagcuugg

SEQ ID NO: 1531754 - RNA, 12 nt, Pseudomonas aeruginosa PA01
augcccaccuga

SEQ ID NO: 1531755 - RNA, 23 nt, Pseudomonas aeruginosa PA01
augccauuuuuuaacgauauaca

SEQ ID NO: 1531756 - RNA, 19 nt, Pseudomonas aeruginosa PA01
augcccgcugggcaggugg

SEQ ID NO: 1531757 - RNA, 12 nt, Pseudomonas aeruginosa PA01
augcccuggccg

SEQ ID NO: 1531758 - RNA, 17 nt, Pseudomonas aeruginosa PA01
augcccuggucggcggu

SEQ ID NO: 1531759 - RNA, 22 nt, Pseudomonas aeruginosa PA01
augcccuuggcuuccuggcgcc

SEQ ID NO: 1531760 - RNA, 19 nt, Pseudomonas aeruginosa PA01
augccggaaagccuggccg

SEQ ID NO: 1531761 - RNA, 14 nt, Pseudomonas aeruginosa PA01
augccggugcuggu

SEQ ID NO: 1531762 - RNA, 15 nt, Pseudomonas aeruginosa PA01
augccggugcuggug

SEQ ID NO: 1531763 - RNA, 22 nt, Pseudomonas aeruginosa PA01
augccgggcuuuuucauuuccu

SEQ ID NO: 1531764 - RNA, 15 nt, Pseudomonas aeruginosa PA01
augccggccggggcc

SEQ ID NO: 1531765 - RNA, 21 nt, Pseudomonas aeruginosa PA01
augccggccgucgcgcaccac

SEQ ID NO: 1531766 - RNA, 13 nt, Pseudomonas aeruginosa PA01
augccggccagga

SEQ ID NO: 1531767 - RNA, 18 nt, Pseudomonas aeruginosa PA01
augccggccaggaaggcc

SEQ ID NO: 1531768 - RNA, 16 nt, Pseudomonas aeruginosa PA01
auuuacaggacugugc

SEQ ID NO: 1531769 - RNA, 12 nt, Pseudomonas aeruginosa PA01
auuuacaagccc

SEQ ID NO: 1531770 - RNA, 21 nt, Pseudomonas aeruginosa PA01
auuuaccugaguaguuucuga

SEQ ID NO: 1531771 - RNA, 15 nt, Pseudomonas aeruginosa PA01
auuuaaguaacuuau

SEQ ID NO: 1531772 - RNA, 17 nt, Pseudomonas aeruginosa PA01
auuggagaugaucagca

SEQ ID NO: 1531773 - RNA, 16 nt, Pseudomonas aeruginosa PA01
auuggagaugcucagg

SEQ ID NO: 1531774 - RNA, 14 nt, Pseudomonas aeruginosa PA01
auuggccgccugcu

SEQ ID NO: 1531775 - RNA, 20 nt, Pseudomonas aeruginosa PA01
auuggccgccugcucggccu

SEQ ID NO: 1531776 - RNA, 13 nt, Pseudomonas aeruginosa PA01
auuggccaggcuc

SEQ ID NO: 1531777 - RNA, 23 nt, Pseudomonas aeruginosa PA01
auuggccaggcucgcgaugcugu

SEQ ID NO: 1531778 - RNA, 15 nt, Pseudomonas aeruginosa PA01
auuggguuccucuaa

SEQ ID NO: 1531779 - RNA, 14 nt, Pseudomonas aeruginosa PA01
auugcgcccucccg

SEQ ID NO: 1531780 - RNA, 18 nt, Pseudomonas aeruginosa PA01
auugaaggaacguucagu

SEQ ID NO: 1531781 - RNA, 17 nt, Pseudomonas aeruginosa PA01
auugagggucagcuugc

SEQ ID NO: 1531782 - RNA, 18 nt, Pseudomonas aeruginosa PA01
auucuccagcaggcucuu

SEQ ID NO: 1531783 - RNA, 14 nt, Pseudomonas aeruginosa PA01
auucuccagccgca

SEQ ID NO: 1531784 - RNA, 16 nt, Pseudomonas aeruginosa PA01
auucggaguugcauug

SEQ ID NO: 1531785 - RNA, 13 nt, Pseudomonas aeruginosa PA01
auucggccugccg

SEQ ID NO: 1531786 - RNA, 21 nt, Pseudomonas aeruginosa PA01
auucgcccagugguuccagga

SEQ ID NO: 1531787 - RNA, 14 nt, Pseudomonas aeruginosa PA01
auucgcccuacccc

SEQ ID NO: 1531788 - RNA, 23 nt, Pseudomonas aeruginosa PA01
auucgcccuacggccccaggcug

SEQ ID NO: 1531789 - RNA, 14 nt, Pseudomonas aeruginosa PA01
auucgaagcucggc

SEQ ID NO: 1531790 - RNA, 17 nt, Pseudomonas aeruginosa PA01
auucgacgcgcggcugc

SEQ ID NO: 1531791 - RNA, 20 nt, Pseudomonas aeruginosa PA01
auucgacgguauguuucugg

SEQ ID NO: 1531792 - RNA, 22 nt, Pseudomonas aeruginosa PA01
auuccugcggcuugcccaucuu

SEQ ID NO: 1531793 - RNA, 22 nt, Pseudomonas aeruginosa PA01
auuccgcgcaggaccacgcugg

SEQ ID NO: 1531794 - RNA, 18 nt, Pseudomonas aeruginosa PA01
auuccgggcacggaaucg

SEQ ID NO: 1531795 - RNA, 20 nt, Pseudomonas aeruginosa PA01
auuccgcugaggauguagcc

SEQ ID NO: 1531796 - RNA, 18 nt, Pseudomonas aeruginosa PA01
caaaaaugcccuuggcuu

SEQ ID NO: 1531797 - RNA, 12 nt, Pseudomonas aeruginosa PA01
auuugccgccga

SEQ ID NO: 1531798 - RNA, 16 nt, Pseudomonas aeruginosa PA01
auuugcccggcgaggu

SEQ ID NO: 1531799 - RNA, 17 nt, Pseudomonas aeruginosa PA01
auuucuacuucccugcc

SEQ ID NO: 1531800 - RNA, 22 nt, Pseudomonas aeruginosa PA01
cacaccgaagucgcccgccggc

SEQ ID NO: 1531801 - RNA, 18 nt, Pseudomonas aeruginosa PA01
cacaccaggucgccgcac

SEQ ID NO: 1531802 - RNA, 13 nt, Pseudomonas aeruginosa PA01
cacaccagcuccc

SEQ ID NO: 1531803 - RNA, 14 nt, Pseudomonas aeruginosa PA01
cacagacgcagccg

SEQ ID NO: 1531804 - RNA, 21 nt, Pseudomonas aeruginosa PA01
cacaggacgagacgccgagga

SEQ ID NO: 1531805 - RNA, 21 nt, Pseudomonas aeruginosa PA01
cacagcgcccagacacgccuc

SEQ ID NO: 1531806 - RNA, 19 nt, Pseudomonas aeruginosa PA01
cacagugccaggcucgccg

SEQ ID NO: 1531807 - RNA, 22 nt, Pseudomonas aeruginosa PA01
cacagugccaggcucgccgcca

SEQ ID NO: 1531808 - RNA, 19 nt, Pseudomonas aeruginosa PA01
cacaggcccugcagcgcca

SEQ ID NO: 1531809 - RNA, 12 nt, Pseudomonas aeruginosa PA01
cacaggccggcu

SEQ ID NO: 1531810 - RNA, 14 nt, Pseudomonas aeruginosa PA01
cacaggcuggccag

SEQ ID NO: 1531811 - RNA, 17 nt, Pseudomonas aeruginosa PA01
cacaggcggcuguugcc

SEQ ID NO: 1531812 - RNA, 21 nt, Pseudomonas aeruginosa PA01
cacaggcguuauccgccgccg

SEQ ID NO: 1531813 - RNA, 18 nt, Pseudomonas aeruginosa PA01
cacaaaaaaaccgccccg

SEQ ID NO: 1531814 - RNA, 22 nt, Pseudomonas aeruginosa PA01
cacaaacucaggguggucgaug

SEQ ID NO: 1531815 - RNA, 22 nt, Pseudomonas aeruginosa PA01
caaugcguuccuguccauuucc

SEQ ID NO: 1531816 - RNA, 12 nt, Pseudomonas aeruginosa PA01
cacaguuccugu

SEQ ID NO: 1531817 - RNA, 19 nt, Pseudomonas aeruginosa PA01
cacaguuccuguaccaggg

SEQ ID NO: 1531818 - RNA, 13 nt, Pseudomonas aeruginosa PA01
cacauacaccuug

SEQ ID NO: 1531819 - RNA, 19 nt, Pseudomonas aeruginosa PA01
cacaugcaccaccugcuug

SEQ ID NO: 1531820 - RNA, 13 nt, Pseudomonas aeruginosa PA01
cacaugcaggcuc

SEQ ID NO: 1531821 - RNA, 20 nt, Pseudomonas aeruginosa PA01
cacaugcaggucgugcagcc

SEQ ID NO: 1531822 - RNA, 20 nt, Pseudomonas aeruginosa PA01
caccaagcggauguucuuca

SEQ ID NO: 1531823 - RNA, 23 nt, Pseudomonas aeruginosa PA01
caccaagcggauguucuucaccu

SEQ ID NO: 1531824 - RNA, 23 nt, Pseudomonas aeruginosa PA01
cacauggaucggcaacuggcugg

SEQ ID NO: 1531825 - RNA, 19 nt, Pseudomonas aeruginosa PA01
caccaccaggucggcgcgc

SEQ ID NO: 1531826 - RNA, 19 nt, Pseudomonas aeruginosa PA01
caccaccgagagcggcgcc

SEQ ID NO: 1531827 - RNA, 19 nt, Pseudomonas aeruginosa PA01
caccacccggcgcacgccg

SEQ ID NO: 1531828 - RNA, 11 nt, Pseudomonas aeruginosa PA01
caccaccaucg

SEQ ID NO: 1531829 - RNA, 14 nt, Pseudomonas aeruginosa PA01
caccaccggcuggc

SEQ ID NO: 1531830 - RNA, 21 nt, Pseudomonas aeruginosa PA01
caccaccgggaugaacugcag

SEQ ID NO: 1531831 - RNA, 19 nt, Pseudomonas aeruginosa PA01
caccaccgugaccagcaug

SEQ ID NO: 1531832 - RNA, 14 nt, Pseudomonas aeruginosa PA01
caccaccgcgccga

SEQ ID NO: 1531833 - RNA, 12 nt, Pseudomonas aeruginosa PA01
caccaccgccgc

SEQ ID NO: 1531834 - RNA, 14 nt, Pseudomonas aeruginosa PA01
caccaccgccgcca

SEQ ID NO: 1531835 - RNA, 19 nt, Pseudomonas aeruginosa PA01
caccaccggaccgggcgcc

SEQ ID NO: 1531836 - RNA, 14 nt, Pseudomonas aeruginosa PA01
caccaccucgccaa

SEQ ID NO: 1531837 - RNA, 13 nt, Pseudomonas aeruginosa PA01
caccaccuggcag

SEQ ID NO: 1531838 - RNA, 18 nt, Pseudomonas aeruginosa PA01
caccaccuggcagguauc

SEQ ID NO: 1531839 - RNA, 23 nt, Pseudomonas aeruginosa PA01
caccaucgcggcgauggccgcca

SEQ ID NO: 1531840 - RNA, 22 nt, Pseudomonas aeruginosa PA01
caccaucacgucgcgcaccugg

SEQ ID NO: 1531841 - RNA, 23 nt, Pseudomonas aeruginosa PA01
caccaggucgcuguccuccagcg

SEQ ID NO: 1531842 - RNA, 20 nt, Pseudomonas aeruginosa PA01
caccaggguggcgcgcacca

SEQ ID NO: 1531843 - RNA, 20 nt, Pseudomonas aeruginosa PA01
caccaggucgccgcacaccg

SEQ ID NO: 1531844 - RNA, 20 nt, Pseudomonas aeruginosa PA01
caccaggucgcggaucaggc

SEQ ID NO: 1531845 - RNA, 22 nt, Pseudomonas aeruginosa PA01
caccaggucgauccugaccccg

SEQ ID NO: 1531846 - RNA, 23 nt, Pseudomonas aeruginosa PA01
caccaggucgauccugaccccgg

SEQ ID NO: 1531847 - RNA, 22 nt, Pseudomonas aeruginosa PA01
caccaggguaucgcugucgccc

SEQ ID NO: 1531848 - RNA, 18 nt, Pseudomonas aeruginosa PA01
caccagggucgccagggg

SEQ ID NO: 1531849 - RNA, 20 nt, Pseudomonas aeruginosa PA01
caccagggucgguucgcggc

SEQ ID NO: 1531850 - RNA, 18 nt, Pseudomonas aeruginosa PA01
caccauagcgagccgcgc

SEQ ID NO: 1531851 - RNA, 21 nt, Pseudomonas aeruginosa PA01
caccauaccgacaugccccgc

SEQ ID NO: 1531852 - RNA, 14 nt, Pseudomonas aeruginosa PA01
caccagggccagga

SEQ ID NO: 1531853 - RNA, 11 nt, Pseudomonas aeruginosa PA01
caccagggcuu

SEQ ID NO: 1531854 - RNA, 12 nt, Pseudomonas aeruginosa PA01
caccaggcgcca

SEQ ID NO: 1531855 - RNA, 14 nt, Pseudomonas aeruginosa PA01
caccaggccgcugc

SEQ ID NO: 1531856 - RNA, 20 nt, Pseudomonas aeruginosa PA01
caccaggccgcugccgccgc

SEQ ID NO: 1531857 - RNA, 15 nt, Pseudomonas aeruginosa PA01
caccaggcgccaggg

SEQ ID NO: 1531858 - RNA, 15 nt, Pseudomonas aeruginosa PA01
caccaggcccugcuc

SEQ ID NO: 1531859 - RNA, 17 nt, Pseudomonas aeruginosa PA01
caccaggcccugcuccu

SEQ ID NO: 1531860 - RNA, 16 nt, Pseudomonas aeruginosa PA01
caccaggccaggcugc

SEQ ID NO: 1531861 - RNA, 17 nt, Pseudomonas aeruginosa PA01
caccaggccaggcugcg

SEQ ID NO: 1531862 - RNA, 22 nt, Pseudomonas aeruginosa PA01
caccaggccagguggucgaucu

SEQ ID NO: 1531863 - RNA, 16 nt, Pseudomonas aeruginosa PA01
caccaggaagccccag

SEQ ID NO: 1531864 - RNA, 19 nt, Pseudomonas aeruginosa PA01
caccagcgaagugcgcugc

SEQ ID NO: 1531865 - RNA, 23 nt, Pseudomonas aeruginosa PA01
caccagcgagucgacccaggccc

SEQ ID NO: 1531866 - RNA, 15 nt, Pseudomonas aeruginosa PA01
caccagcuccccguc

SEQ ID NO: 1531867 - RNA, 16 nt, Pseudomonas aeruginosa PA01
caccagcuccccgucc

SEQ ID NO: 1531868 - RNA, 12 nt, Pseudomonas aeruginosa PA01
caccagcucccg

SEQ ID NO: 1531869 - RNA, 22 nt, Pseudomonas aeruginosa PA01
caccagcgacgcgacauccucc

SEQ ID NO: 1531870 - RNA, 23 nt, Pseudomonas aeruginosa PA01
caccagcgacgcgacauccucca

SEQ ID NO: 1531871 - RNA, 19 nt, Pseudomonas aeruginosa PA01
caccagccuuccggcacca

SEQ ID NO: 1531872 - RNA, 15 nt, Pseudomonas aeruginosa PA01
caccagccggccgcg

SEQ ID NO: 1531873 - RNA, 18 nt, Pseudomonas aeruginosa PA01
caccagacgcagcauguc

SEQ ID NO: 1531874 - RNA, 23 nt, Pseudomonas aeruginosa PA01
cacccucggcuucguccugcugc

SEQ ID NO: 1531875 - RNA, 12 nt, Pseudomonas aeruginosa PA01
cacccucuuccg

SEQ ID NO: 1531876 - RNA, 13 nt, Pseudomonas aeruginosa PA01
cacccggccgcgc

SEQ ID NO: 1531877 - RNA, 20 nt, Pseudomonas aeruginosa PA01
cacccguuccuugcgcggca

SEQ ID NO: 1531878 - RNA, 21 nt, Pseudomonas aeruginosa PA01
cacccggaccuuguccagggu

SEQ ID NO: 1531879 - RNA, 14 nt, Pseudomonas aeruginosa PA01
cacccgcgccugca

SEQ ID NO: 1531880 - RNA, 21 nt, Pseudomonas aeruginosa PA01
cacccgcaccagccggcgcuc

SEQ ID NO: 1531881 - RNA, 12 nt, Pseudomonas aeruginosa PA01
cacccggcgccc

SEQ ID NO: 1531882 - RNA, 15 nt, Pseudomonas aeruginosa PA01
cacccggcgcccggc

SEQ ID NO: 1531883 - RNA, 17 nt, Pseudomonas aeruginosa PA01
caccccuugcagccagc

SEQ ID NO: 1531884 - RNA, 14 nt, Pseudomonas aeruginosa PA01
cacccacauggcgg

SEQ ID NO: 1531885 - RNA, 14 nt, Pseudomonas aeruginosa PA01
caccgcccagccga

SEQ ID NO: 1531886 - RNA, 19 nt, Pseudomonas aeruginosa PA01
caccgcccccgcauccucc

SEQ ID NO: 1531887 - RNA, 22 nt, Pseudomonas aeruginosa PA01
caccgccgaggaacauccgcgg

SEQ ID NO: 1531888 - RNA, 22 nt, Pseudomonas aeruginosa PA01
caccgccagcgucgccgccgcg

SEQ ID NO: 1531889 - RNA, 13 nt, Pseudomonas aeruginosa PA01
caccgccagcacc

SEQ ID NO: 1531890 - RNA, 14 nt, Pseudomonas aeruginosa PA01
caccgccagcaccu

SEQ ID NO: 1531891 - RNA, 16 nt, Pseudomonas aeruginosa PA01
caccgauggcgcgcuu

SEQ ID NO: 1531892 - RNA, 15 nt, Pseudomonas aeruginosa PA01
caccgauugcgcccu

SEQ ID NO: 1531893 - RNA, 14 nt, Pseudomonas aeruginosa PA01
caccgaacuuccgc

SEQ ID NO: 1531894 - RNA, 23 nt, Pseudomonas aeruginosa PA01
caccgaauccuugaucaccuugc

SEQ ID NO: 1531895 - RNA, 21 nt, Pseudomonas aeruginosa PA01
caccgugcccgccggcgcgcc

SEQ ID NO: 1531896 - RNA, 20 nt, Pseudomonas aeruginosa PA01
caccguagcggcugcgguag

SEQ ID NO: 1531897 - RNA, 15 nt, Pseudomonas aeruginosa PA01
caccguggagagguc

SEQ ID NO: 1531898 - RNA, 22 nt, Pseudomonas aeruginosa PA01
caccguggcgacgaugcgcccc

SEQ ID NO: 1531899 - RNA, 16 nt, Pseudomonas aeruginosa PA01
caccguggucagcacc

SEQ ID NO: 1531900 - RNA, 15 nt, Pseudomonas aeruginosa PA01
caccucgacccuggc

SEQ ID NO: 1531901 - RNA, 17 nt, Pseudomonas aeruginosa PA01
caccucgaaccccuggc

SEQ ID NO: 1531902 - RNA, 15 nt, Pseudomonas aeruginosa PA01
caccucgacgcccgc

SEQ ID NO: 1531903 - RNA, 16 nt, Pseudomonas aeruginosa PA01
caccucgacgcccgcu

SEQ ID NO: 1531904 - RNA, 22 nt, Pseudomonas aeruginosa PA01
caccucgacggcgaucucagcc

SEQ ID NO: 1531905 - RNA, 23 nt, Pseudomonas aeruginosa PA01
caccucgaugaacagugcgcccg

SEQ ID NO: 1531906 - RNA, 14 nt, Pseudomonas aeruginosa PA01
caccucggccaggc

SEQ ID NO: 1531907 - RNA, 17 nt, Pseudomonas aeruginosa PA01
caccucgcccucgcucc

SEQ ID NO: 1531908 - RNA, 20 nt, Pseudomonas aeruginosa PA01
caccucgcccuugcugccca

SEQ ID NO: 1531909 - RNA, 14 nt, Pseudomonas aeruginosa PA01
caccugcaucacca

SEQ ID NO: 1531910 - RNA, 20 nt, Pseudomonas aeruginosa PA01
caccugcaacgcccgcgagc

SEQ ID NO: 1531911 - RNA, 18 nt, Pseudomonas aeruginosa PA01
caccgcgccuuccagccc

SEQ ID NO: 1531912 - RNA, 21 nt, Pseudomonas aeruginosa PA01
caccggaccgggcgccucguc

SEQ ID NO: 1531913 - RNA, 15 nt, Pseudomonas aeruginosa PA01
caccgcgccgcgcuu

SEQ ID NO: 1531914 - RNA, 14 nt, Pseudomonas aeruginosa PA01
caccgcgcagacca

SEQ ID NO: 1531915 - RNA, 21 nt, Pseudomonas aeruginosa PA01
caccgcgcagcgucaccgcgu

SEQ ID NO: 1531916 - RNA, 17 nt, Pseudomonas aeruginosa PA01
caccggacggcugaggc

SEQ ID NO: 1531917 - RNA, 19 nt, Pseudomonas aeruginosa PA01
caccggacggcugaggcug

SEQ ID NO: 1531918 - RNA, 16 nt, Pseudomonas aeruginosa PA01
caccggaucgaugccc

SEQ ID NO: 1531919 - RNA, 21 nt, Pseudomonas aeruginosa PA01
caccggaucgcccuggcgcca

SEQ ID NO: 1531920 - RNA, 23 nt, Pseudomonas aeruginosa PA01
caccggaucgcccuggcgccagc

SEQ ID NO: 1531921 - RNA, 13 nt, Pseudomonas aeruginosa PA01
caccggcgccgcc

SEQ ID NO: 1531922 - RNA, 17 nt, Pseudomonas aeruginosa PA01
caccggcgauggccggc

SEQ ID NO: 1531923 - RNA, 14 nt, Pseudomonas aeruginosa PA01
caccggcgccaccc

SEQ ID NO: 1531924 - RNA, 15 nt, Pseudomonas aeruginosa PA01
caccggccucaagca

SEQ ID NO: 1531925 - RNA, 16 nt, Pseudomonas aeruginosa PA01
caccggccucaagcaa

SEQ ID NO: 1531926 - RNA, 17 nt, Pseudomonas aeruginosa PA01
caccggcgccgccuggc

SEQ ID NO: 1531927 - RNA, 21 nt, Pseudomonas aeruginosa PA01
caccgggccgaccugcccgcu

SEQ ID NO: 1531928 - RNA, 13 nt, Pseudomonas aeruginosa PA01
caccggcgcgccg

SEQ ID NO: 1531929 - RNA, 14 nt, Pseudomonas aeruginosa PA01
caccgggccgccgg

SEQ ID NO: 1531930 - RNA, 18 nt, Pseudomonas aeruginosa PA01
caccggucgagagggaua

SEQ ID NO: 1531931 - RNA, 22 nt, Pseudomonas aeruginosa PA01
caccgggugcagguucaccgcc

SEQ ID NO: 1531932 - RNA, 19 nt, Pseudomonas aeruginosa PA01
caccgguagagggggagua

SEQ ID NO: 1531933 - RNA, 15 nt, Pseudomonas aeruginosa PA01
caccgguuucgccag

SEQ ID NO: 1531934 - RNA, 16 nt, Pseudomonas aeruginosa PA01
cacgcaggcgcuggcc

SEQ ID NO: 1531935 - RNA, 15 nt, Pseudomonas aeruginosa PA01
cacgcaggccagcgc

SEQ ID NO: 1531936 - RNA, 16 nt, Pseudomonas aeruginosa PA01
cacgcaggccagcgcc

SEQ ID NO: 1531937 - RNA, 21 nt, Pseudomonas aeruginosa PA01
cacgcaggccagcgccagggg

SEQ ID NO: 1531938 - RNA, 15 nt, Pseudomonas aeruginosa PA01
cacgcagcgccgcgu

SEQ ID NO: 1531939 - RNA, 12 nt, Pseudomonas aeruginosa PA01
cacgcagcagcu

SEQ ID NO: 1531940 - RNA, 14 nt, Pseudomonas aeruginosa PA01
cacgcagaaggcgc

SEQ ID NO: 1531941 - RNA, 17 nt, Pseudomonas aeruginosa PA01
cacgcauugucgggcgu

SEQ ID NO: 1531942 - RNA, 20 nt, Pseudomonas aeruginosa PA01
cacgcaguacagcugcaccg

SEQ ID NO: 1531943 - RNA, 21 nt, Pseudomonas aeruginosa PA01
cacgcaguacagcugcaccgc

SEQ ID NO: 1531944 - RNA, 21 nt, Pseudomonas aeruginosa PA01
cacgcaccucgucgagcagcg

SEQ ID NO: 1531945 - RNA, 16 nt, Pseudomonas aeruginosa PA01
cacgcaccaccagguc

SEQ ID NO: 1531946 - RNA, 13 nt, Pseudomonas aeruginosa PA01
cacgccauucgaa

SEQ ID NO: 1531947 - RNA, 22 nt, Pseudomonas aeruginosa PA01
cacgcccaggcgcucggcgacc

SEQ ID NO: 1531948 - RNA, 14 nt, Pseudomonas aeruginosa PA01
cacgcccaucgcca

SEQ ID NO: 1531949 - RNA, 23 nt, Pseudomonas aeruginosa PA01
cacgcccgcgguauucuccagca

SEQ ID NO: 1531950 - RNA, 22 nt, Pseudomonas aeruginosa PA01
cacgccgcgaccgaagccgcgc

SEQ ID NO: 1531951 - RNA, 17 nt, Pseudomonas aeruginosa PA01
cacgccgcggaaggccc

SEQ ID NO: 1531952 - RNA, 15 nt, Pseudomonas aeruginosa PA01
cacgccgcucugccc

SEQ ID NO: 1531953 - RNA, 19 nt, Pseudomonas aeruginosa PA01
cacgccgcucugcccgacc

SEQ ID NO: 1531954 - RNA, 20 nt, Pseudomonas aeruginosa PA01
cacgccgcugucguccagcg

SEQ ID NO: 1531955 - RNA, 15 nt, Pseudomonas aeruginosa PA01
caccuugugcugccu

SEQ ID NO: 1531956 - RNA, 17 nt, Pseudomonas aeruginosa PA01
caccuugcgaaaagccc

SEQ ID NO: 1531957 - RNA, 19 nt, Pseudomonas aeruginosa PA01
caccuugcggaacccgcgc

SEQ ID NO: 1531958 - RNA, 15 nt, Pseudomonas aeruginosa PA01
caccuugccgcgccc

SEQ ID NO: 1531959 - RNA, 22 nt, Pseudomonas aeruginosa PA01
caccuugccgcgcccggccuuc

SEQ ID NO: 1531960 - RNA, 13 nt, Pseudomonas aeruginosa PA01
caccuugcccugc

SEQ ID NO: 1531961 - RNA, 22 nt, Pseudomonas aeruginosa PA01
caccuugggguguccgauucuu

SEQ ID NO: 1531962 - RNA, 22 nt, Pseudomonas aeruginosa PA01
caccuuggcuugcagguagcug

SEQ ID NO: 1531963 - RNA, 23 nt, Pseudomonas aeruginosa PA01
caccuucgcccgcugcgcugcca

SEQ ID NO: 1531964 - RNA, 13 nt, Pseudomonas aeruginosa PA01
caccuucgcccuc

SEQ ID NO: 1531965 - RNA, 20 nt, Pseudomonas aeruginosa PA01
caccugcgggcugcgugcca

SEQ ID NO: 1531966 - RNA, 12 nt, Pseudomonas aeruginosa PA01
caccugcgggug

SEQ ID NO: 1531967 - RNA, 21 nt, Pseudomonas aeruginosa PA01
cacgacccgcucuuccuuguc

SEQ ID NO: 1531968 - RNA, 16 nt, Pseudomonas aeruginosa PA01
cacgagucgaggcgau

SEQ ID NO: 1531969 - RNA, 22 nt, Pseudomonas aeruginosa PA01
cacgacgaacucaacgaaguga

SEQ ID NO: 1531970 - RNA, 22 nt, Pseudomonas aeruginosa PA01
cacgacgccggugccaggacca

SEQ ID NO: 1531971 - RNA, 15 nt, Pseudomonas aeruginosa PA01
cacggcgggacagga

SEQ ID NO: 1531972 - RNA, 11 nt, Pseudomonas aeruginosa PA01
cacggccaggc

SEQ ID NO: 1531973 - RNA, 20 nt, Pseudomonas aeruginosa PA01
cacggcauucucucuucagc

SEQ ID NO: 1531974 - RNA, 20 nt, Pseudomonas aeruginosa PA01
cacggcauaaccgucgcugg

SEQ ID NO: 1531975 - RNA, 24 nt, Pseudomonas aeruginosa PA01
cacggaagcgcugcucgaccaccu

SEQ ID NO: 1531976 - RNA, 17 nt, Pseudomonas aeruginosa PA01
cacggaaggccacgccg

SEQ ID NO: 1531977 - RNA, 15 nt, Pseudomonas aeruginosa PA01
cacgcuuuccggcuu

SEQ ID NO: 1531978 - RNA, 13 nt, Pseudomonas aeruginosa PA01
cacgcuucugcug

SEQ ID NO: 1531979 - RNA, 21 nt, Pseudomonas aeruginosa PA01
cacgcuucugcuggccgcgca

SEQ ID NO: 1531980 - RNA, 20 nt, Pseudomonas aeruginosa PA01
cacgcugugcggcagcaggc

SEQ ID NO: 1531981 - RNA, 16 nt, Pseudomonas aeruginosa PA01
cacgcugccagcaggc

SEQ ID NO: 1531982 - RNA, 20 nt, Pseudomonas aeruginosa PA01
cacgcugaucaucagcaggg

SEQ ID NO: 1531983 - RNA, 16 nt, Pseudomonas aeruginosa PA01
cacgcugcucgcagcc

SEQ ID NO: 1531984 - RNA, 18 nt, Pseudomonas aeruginosa PA01
cacgcuggcgaggacgcc

SEQ ID NO: 1531985 - RNA, 18 nt, Pseudomonas aeruginosa PA01
cacgccggcgcuccuccu

SEQ ID NO: 1531986 - RNA, 16 nt, Pseudomonas aeruginosa PA01
cacgcucuccaaccga

SEQ ID NO: 1531987 - RNA, 23 nt, Pseudomonas aeruginosa PA01
cacgcucucgaacagcagcaagc

SEQ ID NO: 1531988 - RNA, 23 nt, Pseudomonas aeruginosa PA01
cacgcugaagaucgccacgauca

SEQ ID NO: 1531989 - RNA, 20 nt, Pseudomonas aeruginosa PA01
cacguccagguugugcucga

SEQ ID NO: 1531990 - RNA, 15 nt, Pseudomonas aeruginosa PA01
cacguccagaugaaa

SEQ ID NO: 1531991 - RNA, 15 nt, Pseudomonas aeruginosa PA01
cacguacuccagcaa

SEQ ID NO: 1531992 - RNA, 14 nt, Pseudomonas aeruginosa PA01
cacguaggacaggu

SEQ ID NO: 1531993 - RNA, 16 nt, Pseudomonas aeruginosa PA01
cacggugaggaccugg

SEQ ID NO: 1531994 - RNA, 14 nt, Pseudomonas aeruginosa PA01
cacggucugcucgg

SEQ ID NO: 1531995 - RNA, 19 nt, Pseudomonas aeruginosa PA01
cacgguagagacggcggcg

SEQ ID NO: 1531996 - RNA, 17 nt, Pseudomonas aeruginosa PA01
caaacgccauccgccuu

SEQ ID NO: 1531997 - RNA, 18 nt, Pseudomonas aeruginosa PA01
caaacgauugcggcagaa

SEQ ID NO: 1531998 - RNA, 22 nt, Pseudomonas aeruginosa PA01
caaaaccagccuugagccuugc

SEQ ID NO: 1531999 - RNA, 12 nt, Pseudomonas aeruginosa PA01
caaagcucgcgc

SEQ ID NO: 1532000 - RNA, 18 nt, Pseudomonas aeruginosa PA01
caaagcucgcgcaagcgc

SEQ ID NO: 1532001 - RNA, 21 nt, Pseudomonas aeruginosa PA01
caaagcauuucuucaccaccc

SEQ ID NO: 1532002 - RNA, 20 nt, Pseudomonas aeruginosa PA01
caacaccuugcgcaccgccu

SEQ ID NO: 1532003 - RNA, 22 nt, Pseudomonas aeruginosa PA01
caacaccuugcgcaccgccugc

SEQ ID NO: 1532004 - RNA, 15 nt, Pseudomonas aeruginosa PA01
caacaccggaagcgu

SEQ ID NO: 1532005 - RNA, 14 nt, Pseudomonas aeruginosa PA01
caacgacagccccg

SEQ ID NO: 1532006 - RNA, 16 nt, Pseudomonas aeruginosa PA01
caacgaccgcccaggc

SEQ ID NO: 1532007 - RNA, 15 nt, Pseudomonas aeruginosa PA01
caacgcaggcgcaug

SEQ ID NO: 1532008 - RNA, 17 nt, Pseudomonas aeruginosa PA01
caacgaaaagagccgcg

SEQ ID NO: 1532009 - RNA, 14 nt, Pseudomonas aeruginosa PA01
caaccuucucccuu

SEQ ID NO: 1532010 - RNA, 17 nt, Pseudomonas aeruginosa PA01
caaccgcagacuccggc

SEQ ID NO: 1532011 - RNA, 20 nt, Pseudomonas aeruginosa PA01
caaccgcgcucggcggucag

SEQ ID NO: 1532012 - RNA, 13 nt, Pseudomonas aeruginosa PA01
caacaggacccag

SEQ ID NO: 1532013 - RNA, 15 nt, Pseudomonas aeruginosa PA01
caaccacuccagcgg

SEQ ID NO: 1532014 - RNA, 16 nt, Pseudomonas aeruginosa PA01
caaccagauccgggaa

SEQ ID NO: 1532015 - RNA, 20 nt, Pseudomonas aeruginosa PA01
caaccccuggaucuccuggg

SEQ ID NO: 1532016 - RNA, 14 nt, Pseudomonas aeruginosa PA01
caacccggccagcc

SEQ ID NO: 1532017 - RNA, 15 nt, Pseudomonas aeruginosa PA01
caacccggccagccc

SEQ ID NO: 1532018 - RNA, 21 nt, Pseudomonas aeruginosa PA01
caacccggccagcccggccuc

SEQ ID NO: 1532019 - RNA, 21 nt, Pseudomonas aeruginosa PA01
caaucgcgcaacggcagcgcu

SEQ ID NO: 1532020 - RNA, 14 nt, Pseudomonas aeruginosa PA01
caauccggcgcugc

SEQ ID NO: 1532021 - RNA, 18 nt, Pseudomonas aeruginosa PA01
caauccggcgcugccgaa

SEQ ID NO: 1532022 - RNA, 16 nt, Pseudomonas aeruginosa PA01
caauccgggcgugggg

SEQ ID NO: 1532023 - RNA, 14 nt, Pseudomonas aeruginosa PA01
caauccgcgccggu

SEQ ID NO: 1532024 - RNA, 14 nt, Pseudomonas aeruginosa PA01
caaugaaaaaggga

SEQ ID NO: 1532025 - RNA, 14 nt, Pseudomonas aeruginosa PA01
caaugcggccugca

SEQ ID NO: 1532026 - RNA, 14 nt, Pseudomonas aeruginosa PA01
caaugcggcgaugg

SEQ ID NO: 1532027 - RNA, 12 nt, Pseudomonas aeruginosa PA01
caaugccagcgc

SEQ ID NO: 1532028 - RNA, 13 nt, Pseudomonas aeruginosa PA01
caaugcccagcgc

SEQ ID NO: 1532029 - RNA, 15 nt, Pseudomonas aeruginosa PA01
caauaccacccuugg

SEQ ID NO: 1532030 - RNA, 18 nt, Pseudomonas aeruginosa PA01
caaggucgucucagaccu

SEQ ID NO: 1532031 - RNA, 17 nt, Pseudomonas aeruginosa PA01
caagggcacgugcagcg

SEQ ID NO: 1532032 - RNA, 18 nt, Pseudomonas aeruginosa PA01
caagggccugcucagcgu

SEQ ID NO: 1532033 - RNA, 14 nt, Pseudomonas aeruginosa PA01
caaggggccgcgcu

SEQ ID NO: 1532034 - RNA, 21 nt, Pseudomonas aeruginosa PA01
caaggggccgcgcuucaccag

SEQ ID NO: 1532035 - RNA, 13 nt, Pseudomonas aeruginosa PA01
caaggcggggcuu

SEQ ID NO: 1532036 - RNA, 18 nt, Pseudomonas aeruginosa PA01
caaggcggggcuuuuucg

SEQ ID NO: 1532037 - RNA, 20 nt, Pseudomonas aeruginosa PA01
caaggcgucauagcagcgcc

SEQ ID NO: 1532038 - RNA, 22 nt, Pseudomonas aeruginosa PA01
caaggcuucggcggucaggcuc

SEQ ID NO: 1532039 - RNA, 20 nt, Pseudomonas aeruginosa PA01
caaggagcgcgagcggcaga

SEQ ID NO: 1532040 - RNA, 17 nt, Pseudomonas aeruginosa PA01
caagcggauaucccccc

SEQ ID NO: 1532041 - RNA, 17 nt, Pseudomonas aeruginosa PA01
caagcggauguucuuca

SEQ ID NO: 1532042 - RNA, 15 nt, Pseudomonas aeruginosa PA01
caagcccaagggcuc

SEQ ID NO: 1532043 - RNA, 22 nt, Pseudomonas aeruginosa PA01
caagaggucgacgguucgaucc

SEQ ID NO: 1532044 - RNA, 20 nt, Pseudomonas aeruginosa PA01
caagacgaaagagcccggca

SEQ ID NO: 1532045 - RNA, 13 nt, Pseudomonas aeruginosa PA01
caagacggucccc

SEQ ID NO: 1532046 - RNA, 22 nt, Pseudomonas aeruginosa PA01
caacgcccgcgagccguccugc

SEQ ID NO: 1532047 - RNA, 16 nt, Pseudomonas aeruginosa PA01
caacgccagcaggcgc

SEQ ID NO: 1532048 - RNA, 16 nt, Pseudomonas aeruginosa PA01
caacuccgccugucca

SEQ ID NO: 1532049 - RNA, 17 nt, Pseudomonas aeruginosa PA01
caacuccgccuguccac

SEQ ID NO: 1532050 - RNA, 14 nt, Pseudomonas aeruginosa PA01
caacuccgccaggc

SEQ ID NO: 1532051 - RNA, 20 nt, Pseudomonas aeruginosa PA01
caacuccgccaggcgcucca

SEQ ID NO: 1532052 - RNA, 17 nt, Pseudomonas aeruginosa PA01
caacugccaaccgcgcu

SEQ ID NO: 1532053 - RNA, 12 nt, Pseudomonas aeruginosa PA01
caacucgccgcc

SEQ ID NO: 1532054 - RNA, 13 nt, Pseudomonas aeruginosa PA01
caacucgccgccg

SEQ ID NO: 1532055 - RNA, 16 nt, Pseudomonas aeruginosa PA01
caacucggccuggaac

SEQ ID NO: 1532056 - RNA, 20 nt, Pseudomonas aeruginosa PA01
caacugggccuugaggaugu

SEQ ID NO: 1532057 - RNA, 20 nt, Pseudomonas aeruginosa PA01
caacugguuggccgccuggc

SEQ ID NO: 1532058 - RNA, 23 nt, Pseudomonas aeruginosa PA01
cagcgcgauaucgcaggccaggc

SEQ ID NO: 1532059 - RNA, 17 nt, Pseudomonas aeruginosa PA01
cagcgcgauacccuggc

SEQ ID NO: 1532060 - RNA, 12 nt, Pseudomonas aeruginosa PA01
cagcgcgagcgu

SEQ ID NO: 1532061 - RNA, 22 nt, Pseudomonas aeruginosa PA01
cagcgccuuuuccgcaucuccc

SEQ ID NO: 1532062 - RNA, 17 nt, Pseudomonas aeruginosa PA01
cagcgcgacaucggcga

SEQ ID NO: 1532063 - RNA, 20 nt, Pseudomonas aeruginosa PA01
cagcgccucggcaucgacca

SEQ ID NO: 1532064 - RNA, 16 nt, Pseudomonas aeruginosa PA01
cagcgccucguggaac

SEQ ID NO: 1532065 - RNA, 17 nt, Pseudomonas aeruginosa PA01
cagcgccucguggaaca

SEQ ID NO: 1532066 - RNA, 19 nt, Pseudomonas aeruginosa PA01
cagcgccucguggaacagc

SEQ ID NO: 1532067 - RNA, 22 nt, Pseudomonas aeruginosa PA01
cagcgccuccucuaccaggcgg

SEQ ID NO: 1532068 - RNA, 17 nt, Pseudomonas aeruginosa PA01
cagcgccucgaccagau

SEQ ID NO: 1532069 - RNA, 22 nt, Pseudomonas aeruginosa PA01
cagcgccucgaccagaucggca

SEQ ID NO: 1532070 - RNA, 12 nt, Pseudomonas aeruginosa PA01
cagcgcgcggcc

SEQ ID NO: 1532071 - RNA, 12 nt, Pseudomonas aeruginosa PA01
cagcgcgcggcu

SEQ ID NO: 1532072 - RNA, 19 nt, Pseudomonas aeruginosa PA01
cagcgcggcggacaggcag

SEQ ID NO: 1532073 - RNA, 21 nt, Pseudomonas aeruginosa PA01
cagcgcgcccggcgccacccc

SEQ ID NO: 1532074 - RNA, 17 nt, Pseudomonas aeruginosa PA01
cagcgccgcuccuccuc

SEQ ID NO: 1532075 - RNA, 19 nt, Pseudomonas aeruginosa PA01
cagcgccgcuccuccucgc

SEQ ID NO: 1532076 - RNA, 22 nt, Pseudomonas aeruginosa PA01
cagcgccgcuccuccucgcucu

SEQ ID NO: 1532077 - RNA, 23 nt, Pseudomonas aeruginosa PA01
cagcgccgcucggcgagccgccg

SEQ ID NO: 1532078 - RNA, 21 nt, Pseudomonas aeruginosa PA01
cagcgccgcuucuucccgccc

SEQ ID NO: 1532079 - RNA, 13 nt, Pseudomonas aeruginosa PA01
cagcgccgcggcu

SEQ ID NO: 1532080 - RNA, 16 nt, Pseudomonas aeruginosa PA01
cagcgccgcggcuggc

SEQ ID NO: 1532081 - RNA, 21 nt, Pseudomonas aeruginosa PA01
cagcgccggccauugccgcca

SEQ ID NO: 1532082 - RNA, 16 nt, Pseudomonas aeruginosa PA01
cagcgccggccagggg

SEQ ID NO: 1532083 - RNA, 14 nt, Pseudomonas aeruginosa PA01
cagcgccuccagca

SEQ ID NO: 1532084 - RNA, 23 nt, Pseudomonas aeruginosa PA01
cagcgccgucaccagcagccccg

SEQ ID NO: 1532085 - RNA, 22 nt, Pseudomonas aeruginosa PA01
cagcgccgggucgaccuugccg

SEQ ID NO: 1532086 - RNA, 12 nt, Pseudomonas aeruginosa PA01
cagcgccgccuc

SEQ ID NO: 1532087 - RNA, 18 nt, Pseudomonas aeruginosa PA01
cagcgccgccucgaaggc

SEQ ID NO: 1532088 - RNA, 13 nt, Pseudomonas aeruginosa PA01
cagcgccgcgcug

SEQ ID NO: 1532089 - RNA, 14 nt, Pseudomonas aeruginosa PA01
cagcgccgcgcgcu

SEQ ID NO: 1532090 - RNA, 13 nt, Pseudomonas aeruginosa PA01
cagcgccgccaac

SEQ ID NO: 1532091 - RNA, 17 nt, Pseudomonas aeruginosa PA01
cagcgccgccagcaggu

SEQ ID NO: 1532092 - RNA, 14 nt, Pseudomonas aeruginosa PA01
cagcgccgccaggc

SEQ ID NO: 1532093 - RNA, 15 nt, Pseudomonas aeruginosa PA01
cagcgccgccaggcg

SEQ ID NO: 1532094 - RNA, 14 nt, Pseudomonas aeruginosa PA01
cagcgccgccgcgu

SEQ ID NO: 1532095 - RNA, 14 nt, Pseudomonas aeruginosa PA01
cagcgccgccgcug

SEQ ID NO: 1532096 - RNA, 18 nt, Pseudomonas aeruginosa PA01
cagcgcccggcugugcuc

SEQ ID NO: 1532097 - RNA, 13 nt, Pseudomonas aeruginosa PA01
cagcgcaccgccc

SEQ ID NO: 1532098 - RNA, 16 nt, Pseudomonas aeruginosa PA01
cagcgcaccagggucg

SEQ ID NO: 1532099 - RNA, 16 nt, Pseudomonas aeruginosa PA01
cagcgcaccauccucg

SEQ ID NO: 1532100 - RNA, 13 nt, Pseudomonas aeruginosa PA01
cagcgagacccgg

SEQ ID NO: 1532101 - RNA, 17 nt, Pseudomonas aeruginosa PA01
cagcgagaccucgccca

SEQ ID NO: 1532102 - RNA, 14 nt, Pseudomonas aeruginosa PA01
cagcgacuccagcc

SEQ ID NO: 1532103 - RNA, 15 nt, Pseudomonas aeruginosa PA01
cagcgacucgaugcg

SEQ ID NO: 1532104 - RNA, 24 nt, Pseudomonas aeruginosa PA01
cagcgacucgaugcgcagcuugcu

SEQ ID NO: 1532105 - RNA, 14 nt, Pseudomonas aeruginosa PA01
cagcgccccuccca

SEQ ID NO: 1532106 - RNA, 18 nt, Pseudomonas aeruginosa PA01
cagcgcccagacacgccu

SEQ ID NO: 1532107 - RNA, 13 nt, Pseudomonas aeruginosa PA01
cagcgcccaggcc

SEQ ID NO: 1532108 - RNA, 22 nt, Pseudomonas aeruginosa PA01
cagcgccccagcaccucgccgu

SEQ ID NO: 1532109 - RNA, 16 nt, Pseudomonas aeruginosa PA01
cagcgccaucaggccc

SEQ ID NO: 1532110 - RNA, 20 nt, Pseudomonas aeruginosa PA01
cagcgccagguuggccuggc

SEQ ID NO: 1532111 - RNA, 22 nt, Pseudomonas aeruginosa PA01
cagcgccagguuggccuggccc

SEQ ID NO: 1532112 - RNA, 20 nt, Pseudomonas aeruginosa PA01
cagcgccagggguaggagga

SEQ ID NO: 1532113 - RNA, 15 nt, Pseudomonas aeruginosa PA01
cagcgccagcggcag

SEQ ID NO: 1532114 - RNA, 16 nt, Pseudomonas aeruginosa PA01
cagcgccagcggcagc

SEQ ID NO: 1532115 - RNA, 18 nt, Pseudomonas aeruginosa PA01
cagcgccagcaacccgcc

SEQ ID NO: 1532116 - RNA, 13 nt, Pseudomonas aeruginosa PA01
cagcgccagcagu

SEQ ID NO: 1532117 - RNA, 15 nt, Pseudomonas aeruginosa PA01
cagcgccagccaggg

SEQ ID NO: 1532118 - RNA, 16 nt, Pseudomonas aeruginosa PA01
cagcgccagccagggu

SEQ ID NO: 1532119 - RNA, 15 nt, Pseudomonas aeruginosa PA01
cagcgccacgccgcu

SEQ ID NO: 1532120 - RNA, 13 nt, Pseudomonas aeruginosa PA01
cagcgccaccagc

SEQ ID NO: 1532121 - RNA, 14 nt, Pseudomonas aeruginosa PA01
cagcgccaccagca

SEQ ID NO: 1532122 - RNA, 16 nt, Pseudomonas aeruginosa PA01
cagcgccaccagcagg

SEQ ID NO: 1532123 - RNA, 18 nt, Pseudomonas aeruginosa PA01
cagcgccaccagcagggc

SEQ ID NO: 1532124 - RNA, 15 nt, Pseudomonas aeruginosa PA01
cagcgccaccagcau

SEQ ID NO: 1532125 - RNA, 15 nt, Pseudomonas aeruginosa PA01
cagcgccacuuccag

SEQ ID NO: 1532126 - RNA, 23 nt, Pseudomonas aeruginosa PA01
cagccgaccaccuucaggcugcu

SEQ ID NO: 1532127 - RNA, 21 nt, Pseudomonas aeruginosa PA01
cagcccuugcaaccgccgccg

SEQ ID NO: 1532128 - RNA, 22 nt, Pseudomonas aeruginosa PA01
cagcccuugcaaccgccgccgc

SEQ ID NO: 1532129 - RNA, 20 nt, Pseudomonas aeruginosa PA01
cagcccguguucggccagcc

SEQ ID NO: 1532130 - RNA, 15 nt, Pseudomonas aeruginosa PA01
cagccgcacgccccu

SEQ ID NO: 1532131 - RNA, 16 nt, Pseudomonas aeruginosa PA01
cagccgcagcggcaug

SEQ ID NO: 1532132 - RNA, 15 nt, Pseudomonas aeruginosa PA01
cagccgcagcccggu

SEQ ID NO: 1532133 - RNA, 13 nt, Pseudomonas aeruginosa PA01
cagccgaugcucg

SEQ ID NO: 1532134 - RNA, 18 nt, Pseudomonas aeruginosa PA01
cagccgaugcucgcgcca

SEQ ID NO: 1532135 - RNA, 21 nt, Pseudomonas aeruginosa PA01
cagccgcaaggccagggcggc

SEQ ID NO: 1532136 - RNA, 18 nt, Pseudomonas aeruginosa PA01
cagccgaggucgccgcca

SEQ ID NO: 1532137 - RNA, 18 nt, Pseudomonas aeruginosa PA01
cagccgagguucuugccc

SEQ ID NO: 1532138 - RNA, 23 nt, Pseudomonas aeruginosa PA01
cagccgagguucuugcccagcaa

SEQ ID NO: 1532139 - RNA, 16 nt, Pseudomonas aeruginosa PA01
cagccgcccuggcucu

SEQ ID NO: 1532140 - RNA, 15 nt, Pseudomonas aeruginosa PA01
cagccgcgcaaccgu

SEQ ID NO: 1532141 - RNA, 20 nt, Pseudomonas aeruginosa PA01
cagccgcuuccggcgcucca

SEQ ID NO: 1532142 - RNA, 13 nt, Pseudomonas aeruginosa PA01
cagccgcaggcag

SEQ ID NO: 1532143 - RNA, 14 nt, Pseudomonas aeruginosa PA01
cagccgcaggaugc

SEQ ID NO: 1532144 - RNA, 21 nt, Pseudomonas aeruginosa PA01
cagccucggcagggcgcccgc

SEQ ID NO: 1532145 - RNA, 18 nt, Pseudomonas aeruginosa PA01
cagccucagcgacauccc

SEQ ID NO: 1532146 - RNA, 13 nt, Pseudomonas aeruginosa PA01
cagccucacccug

SEQ ID NO: 1532147 - RNA, 15 nt, Pseudomonas aeruginosa PA01
cagccucacccugcu

SEQ ID NO: 1532148 - RNA, 16 nt, Pseudomonas aeruginosa PA01
cagccucacccugcug

SEQ ID NO: 1532149 - RNA, 18 nt, Pseudomonas aeruginosa PA01
cagccucacccugcuggg

SEQ ID NO: 1532150 - RNA, 14 nt, Pseudomonas aeruginosa PA01
cagccggaccagcc

SEQ ID NO: 1532151 - RNA, 15 nt, Pseudomonas aeruginosa PA01
cagccggccauccag

SEQ ID NO: 1532152 - RNA, 16 nt, Pseudomonas aeruginosa PA01
cagccggcccauccgc

SEQ ID NO: 1532153 - RNA, 18 nt, Pseudomonas aeruginosa PA01
cagcgaaccgccggccuc

SEQ ID NO: 1532154 - RNA, 14 nt, Pseudomonas aeruginosa PA01
cagcgaauggacag

SEQ ID NO: 1532155 - RNA, 16 nt, Pseudomonas aeruginosa PA01
cagcgaauggacaggc

SEQ ID NO: 1532156 - RNA, 20 nt, Pseudomonas aeruginosa PA01
cagcgaauggacaggcgccc

SEQ ID NO: 1532157 - RNA, 16 nt, Pseudomonas aeruginosa PA01
cagcgacacaacgcug

SEQ ID NO: 1532158 - RNA, 18 nt, Pseudomonas aeruginosa PA01
cagcgacacaacgcugca

SEQ ID NO: 1532159 - RNA, 21 nt, Pseudomonas aeruginosa PA01
cagccuggcugcaacgagagg

SEQ ID NO: 1532160 - RNA, 23 nt, Pseudomonas aeruginosa PA01
cagccuggggugcagcagguucc

SEQ ID NO: 1532161 - RNA, 22 nt, Pseudomonas aeruginosa PA01
cagcgaaagcgucagcgcgcca

SEQ ID NO: 1532162 - RNA, 22 nt, Pseudomonas aeruginosa PA01
cagcgaaacucgugcuccaccu

SEQ ID NO: 1532163 - RNA, 21 nt, Pseudomonas aeruginosa PA01
cagccuuuuuugugcccgccc

SEQ ID NO: 1532164 - RNA, 23 nt, Pseudomonas aeruginosa PA01
cagccuuuuuugugcccgccccu

SEQ ID NO: 1532165 - RNA, 13 nt, Pseudomonas aeruginosa PA01
cagcagagcgcca

SEQ ID NO: 1532166 - RNA, 13 nt, Pseudomonas aeruginosa PA01
cagcagcgccgcc

SEQ ID NO: 1532167 - RNA, 17 nt, Pseudomonas aeruginosa PA01
cagcagcgccagcaggu

SEQ ID NO: 1532168 - RNA, 16 nt, Pseudomonas aeruginosa PA01
cagcagcgccaggaag

SEQ ID NO: 1532169 - RNA, 21 nt, Pseudomonas aeruginosa PA01
cagcagcgucgcgucggccug

SEQ ID NO: 1532170 - RNA, 21 nt, Pseudomonas aeruginosa PA01
cagcagcggaucggcggugcc

SEQ ID NO: 1532171 - RNA, 20 nt, Pseudomonas aeruginosa PA01
cagcagcggcacccggcugg

SEQ ID NO: 1532172 - RNA, 17 nt, Pseudomonas aeruginosa PA01
cagcaggagaagcgccu

SEQ ID NO: 1532173 - RNA, 20 nt, Pseudomonas aeruginosa PA01
cagcaggagaagcgccucgc

SEQ ID NO: 1532174 - RNA, 22 nt, Pseudomonas aeruginosa PA01
cagcaggagaagcgccucgccu

SEQ ID NO: 1532175 - RNA, 11 nt, Pseudomonas aeruginosa PA01
cagcaggagca

SEQ ID NO: 1532176 - RNA, 12 nt, Pseudomonas aeruginosa PA01
cagcaggagcgc

SEQ ID NO: 1532177 - RNA, 14 nt, Pseudomonas aeruginosa PA01
cagcaggagcgcca

SEQ ID NO: 1532178 - RNA, 17 nt, Pseudomonas aeruginosa PA01
cagcaggaucgacagca

SEQ ID NO: 1532179 - RNA, 20 nt, Pseudomonas aeruginosa PA01
cagcaggaucgacagcagcg

SEQ ID NO: 1532180 - RNA, 23 nt, Pseudomonas aeruginosa PA01
cagcaggaucgacagcagcgcca

SEQ ID NO: 1532181 - RNA, 18 nt, Pseudomonas aeruginosa PA01
cagcaggaaaacgcucag

SEQ ID NO: 1532182 - RNA, 15 nt, Pseudomonas aeruginosa PA01
cagcagcuucggcgc

SEQ ID NO: 1532183 - RNA, 21 nt, Pseudomonas aeruginosa PA01
cagcagcuucggcgcgacgcu

SEQ ID NO: 1532184 - RNA, 16 nt, Pseudomonas aeruginosa PA01
cagcagcuccgggcug

SEQ ID NO: 1532185 - RNA, 21 nt, Pseudomonas aeruginosa PA01
cagcagcuucaguagguagag

SEQ ID NO: 1532186 - RNA, 13 nt, Pseudomonas aeruginosa PA01
cagcaggcggccc

SEQ ID NO: 1532187 - RNA, 13 nt, Pseudomonas aeruginosa PA01
cagcaggcgcgcc

SEQ ID NO: 1532188 - RNA, 14 nt, Pseudomonas aeruginosa PA01
cagcaggcgcgccc

SEQ ID NO: 1532189 - RNA, 15 nt, Pseudomonas aeruginosa PA01
cagcaggcgcucgcu

SEQ ID NO: 1532190 - RNA, 14 nt, Pseudomonas aeruginosa PA01
cagcaggccggcca

SEQ ID NO: 1532191 - RNA, 21 nt, Pseudomonas aeruginosa PA01
cagcaggcgcaaccagaccag

SEQ ID NO: 1532192 - RNA, 16 nt, Pseudomonas aeruginosa PA01
cagcaggccgaaggcc

SEQ ID NO: 1532193 - RNA, 17 nt, Pseudomonas aeruginosa PA01
cagcaggccgaaggcca

SEQ ID NO: 1532194 - RNA, 23 nt, Pseudomonas aeruginosa PA01
cagcaggccgaaggccaggaccg

SEQ ID NO: 1532195 - RNA, 21 nt, Pseudomonas aeruginosa PA01
cagcaggccgagcccgagugc

SEQ ID NO: 1532196 - RNA, 15 nt, Pseudomonas aeruginosa PA01
cagcaggccgaucac

SEQ ID NO: 1532197 - RNA, 18 nt, Pseudomonas aeruginosa PA01
cagcaggccgaucagcgg

SEQ ID NO: 1532198 - RNA, 15 nt, Pseudomonas aeruginosa PA01
cagcaggcccagcca

SEQ ID NO: 1532199 - RNA, 20 nt, Pseudomonas aeruginosa PA01
cagcaggaugcagucggcac

SEQ ID NO: 1532200 - RNA, 19 nt, Pseudomonas aeruginosa PA01
cagcaggaugcugcacagc

SEQ ID NO: 1532201 - RNA, 21 nt, Pseudomonas aeruginosa PA01
cagcaggcacagggcgacuac

SEQ ID NO: 1532202 - RNA, 16 nt, Pseudomonas aeruginosa PA01
cagcaggguaccgcug

SEQ ID NO: 1532203 - RNA, 20 nt, Pseudomonas aeruginosa PA01
cagcagggucagcagcgcca

SEQ ID NO: 1532204 - RNA, 21 nt, Pseudomonas aeruginosa PA01
cagcagggucagcagcgccag

SEQ ID NO: 1532205 - RNA, 13 nt, Pseudomonas aeruginosa PA01
cagcagggucagg

SEQ ID NO: 1532206 - RNA, 16 nt, Pseudomonas aeruginosa PA01
cagcagggucagggug

SEQ ID NO: 1532207 - RNA, 20 nt, Pseudomonas aeruginosa PA01
cagcagggucuucaggcgcc

SEQ ID NO: 1532208 - RNA, 22 nt, Pseudomonas aeruginosa PA01
cagcagggucuucaggcgccgu

SEQ ID NO: 1532209 - RNA, 14 nt, Pseudomonas aeruginosa PA01
cagcagggucgcgc

SEQ ID NO: 1532210 - RNA, 18 nt, Pseudomonas aeruginosa PA01
cagcagggucgcgccguc

SEQ ID NO: 1532211 - RNA, 17 nt, Pseudomonas aeruginosa PA01
cagcaggguggccaggg

SEQ ID NO: 1532212 - RNA, 20 nt, Pseudomonas aeruginosa PA01
cagcaggguggccagggucc

SEQ ID NO: 1532213 - RNA, 12 nt, Pseudomonas aeruginosa PA01
cagcagguagaa

SEQ ID NO: 1532214 - RNA, 17 nt, Pseudomonas aeruginosa PA01
cagcagguagaccacgc

SEQ ID NO: 1532215 - RNA, 23 nt, Pseudomonas aeruginosa PA01
cagcagguagaccacgcaggcca

SEQ ID NO: 1532216 - RNA, 13 nt, Pseudomonas aeruginosa PA01
cagcagguagacg

SEQ ID NO: 1532217 - RNA, 19 nt, Pseudomonas aeruginosa PA01
cagcagggccagccagagc

SEQ ID NO: 1532218 - RNA, 19 nt, Pseudomonas aeruginosa PA01
cagcagggccagcgccugg

SEQ ID NO: 1532219 - RNA, 11 nt, Pseudomonas aeruginosa PA01
cagcaggcugc

SEQ ID NO: 1532220 - RNA, 12 nt, Pseudomonas aeruginosa PA01
cagcaggcugcc

SEQ ID NO: 1532221 - RNA, 13 nt, Pseudomonas aeruginosa PA01
cagcaggcugccg

SEQ ID NO: 1532222 - RNA, 21 nt, Pseudomonas aeruginosa PA01
cagcaggcugccguugcggcc

SEQ ID NO: 1532223 - RNA, 17 nt, Pseudomonas aeruginosa PA01
cagcaggcucaucgccc

SEQ ID NO: 1532224 - RNA, 11 nt, Pseudomonas aeruginosa PA01
cagcaggcugu

SEQ ID NO: 1532225 - RNA, 17 nt, Pseudomonas aeruginosa PA01
cagcaggcuguacagca

SEQ ID NO: 1532226 - RNA, 21 nt, Pseudomonas aeruginosa PA01
cagcaggcuguacagcaggag

SEQ ID NO: 1532227 - RNA, 20 nt, Pseudomonas aeruginosa PA01
cagcagguggcaagccucgc

SEQ ID NO: 1532228 - RNA, 20 nt, Pseudomonas aeruginosa PA01
cagcagguuccuccugggcc

SEQ ID NO: 1532229 - RNA, 21 nt, Pseudomonas aeruginosa PA01
cagcagguucggcgguagcgc

SEQ ID NO: 1532230 - RNA, 14 nt, Pseudomonas aeruginosa PA01
cagcaggucgcgca

SEQ ID NO: 1532231 - RNA, 16 nt, Pseudomonas aeruginosa PA01
cagcaggucggccugc

SEQ ID NO: 1532232 - RNA, 17 nt, Pseudomonas aeruginosa PA01
cagcaggucggccugcu

SEQ ID NO: 1532233 - RNA, 19 nt, Pseudomonas aeruginosa PA01
cagcagguagugcggcggg

SEQ ID NO: 1532234 - RNA, 20 nt, Pseudomonas aeruginosa PA01
cagcagguagccugcggcca

SEQ ID NO: 1532235 - RNA, 17 nt, Pseudomonas aeruginosa PA01
cagcaggucgcggcccc

SEQ ID NO: 1532236 - RNA, 21 nt, Pseudomonas aeruginosa PA01
cagcaggucgcggccccagca

SEQ ID NO: 1532237 - RNA, 22 nt, Pseudomonas aeruginosa PA01
cagcaggucgcggccccagcac

SEQ ID NO: 1532238 - RNA, 15 nt, Pseudomonas aeruginosa PA01
cagcagucgcggccc

SEQ ID NO: 1532239 - RNA, 18 nt, Pseudomonas aeruginosa PA01
cagcagucgcggcccugg

SEQ ID NO: 1532240 - RNA, 16 nt, Pseudomonas aeruginosa PA01
cagcaguugcaacagc

SEQ ID NO: 1532241 - RNA, 21 nt, Pseudomonas aeruginosa PA01
cagccacagaggucgcugacc

SEQ ID NO: 1532242 - RNA, 15 nt, Pseudomonas aeruginosa PA01
cagccacaggcgcca

SEQ ID NO: 1532243 - RNA, 13 nt, Pseudomonas aeruginosa PA01
cagccacgaagcc

SEQ ID NO: 1532244 - RNA, 13 nt, Pseudomonas aeruginosa PA01
cagccacccgcuc

SEQ ID NO: 1532245 - RNA, 20 nt, Pseudomonas aeruginosa PA01
cagccaggcgauggugcgcu

SEQ ID NO: 1532246 - RNA, 18 nt, Pseudomonas aeruginosa PA01
cagccaggccuugugcgc

SEQ ID NO: 1532247 - RNA, 20 nt, Pseudomonas aeruginosa PA01
cagccaggcgaaggcgaucc

SEQ ID NO: 1532248 - RNA, 20 nt, Pseudomonas aeruginosa PA01
cagccaggaagagcccgcca

SEQ ID NO: 1532249 - RNA, 16 nt, Pseudomonas aeruginosa PA01
cagccagguguucggc

SEQ ID NO: 1532250 - RNA, 22 nt, Pseudomonas aeruginosa PA01
cagccagguguucggccccggc

SEQ ID NO: 1532251 - RNA, 20 nt, Pseudomonas aeruginosa PA01
cagccagggcaacgccaggc

SEQ ID NO: 1532252 - RNA, 21 nt, Pseudomonas aeruginosa PA01
cagccagggcaacgccaggcu

SEQ ID NO: 1532253 - RNA, 17 nt, Pseudomonas aeruginosa PA01
cagccagggcagcaggu

SEQ ID NO: 1532254 - RNA, 20 nt, Pseudomonas aeruginosa PA01
cagccagggccgcgagaggu

SEQ ID NO: 1532255 - RNA, 17 nt, Pseudomonas aeruginosa PA01
cagccaggggcacgcug

SEQ ID NO: 1532256 - RNA, 19 nt, Pseudomonas aeruginosa PA01
cagccaggggcacgcuggc

SEQ ID NO: 1532257 - RNA, 14 nt, Pseudomonas aeruginosa PA01
cagccaggcuggcu

SEQ ID NO: 1532258 - RNA, 17 nt, Pseudomonas aeruginosa PA01
cagccagccgcgcgccg

SEQ ID NO: 1532259 - RNA, 11 nt, Pseudomonas aeruginosa PA01
cagccagccgc

SEQ ID NO: 1532260 - RNA, 14 nt, Pseudomonas aeruginosa PA01
cagccagcgcggcu

SEQ ID NO: 1532261 - RNA, 14 nt, Pseudomonas aeruginosa PA01
cagccagcggcgcu

SEQ ID NO: 1532262 - RNA, 15 nt, Pseudomonas aeruginosa PA01
cagccacgggcgcca

SEQ ID NO: 1532263 - RNA, 19 nt, Pseudomonas aeruginosa PA01
cagccacgggcgccagcgg

SEQ ID NO: 1532264 - RNA, 20 nt, Pseudomonas aeruginosa PA01
cagccacgggcgccagcggu

SEQ ID NO: 1532265 - RNA, 13 nt, Pseudomonas aeruginosa PA01
cagccagcccggc

SEQ ID NO: 1532266 - RNA, 13 nt, Pseudomonas aeruginosa PA01
cagccacggacgc

SEQ ID NO: 1532267 - RNA, 23 nt, Pseudomonas aeruginosa PA01
cagccacggacgcgcagggucag

SEQ ID NO: 1532268 - RNA, 22 nt, Pseudomonas aeruginosa PA01
cagcauggccuugccggcaucg

SEQ ID NO: 1532269 - RNA, 15 nt, Pseudomonas aeruginosa PA01
cagcauggcgggcca

SEQ ID NO: 1532270 - RNA, 13 nt, Pseudomonas aeruginosa PA01
cagcaugcccagc

SEQ ID NO: 1532271 - RNA, 14 nt, Pseudomonas aeruginosa PA01
cagcaugcccagcg

SEQ ID NO: 1532272 - RNA, 16 nt, Pseudomonas aeruginosa PA01
cagcaucagcaggaag

SEQ ID NO: 1532273 - RNA, 16 nt, Pseudomonas aeruginosa PA01
cagcaucaggcgcucc

SEQ ID NO: 1532274 - RNA, 13 nt, Pseudomonas aeruginosa PA01
cagcaucaggucg

SEQ ID NO: 1532275 - RNA, 11 nt, Pseudomonas aeruginosa PA01
cagcaucacca

SEQ ID NO: 1532276 - RNA, 18 nt, Pseudomonas aeruginosa PA01
cagcaucucggugcgccc

SEQ ID NO: 1532277 - RNA, 21 nt, Pseudomonas aeruginosa PA01
cagcaucgccggcagcgccgc

SEQ ID NO: 1532278 - RNA, 22 nt, Pseudomonas aeruginosa PA01
cagcaucgccggcagcgccgcg

SEQ ID NO: 1532279 - RNA, 15 nt, Pseudomonas aeruginosa PA01
cagcaaucaggaacg

SEQ ID NO: 1532280 - RNA, 15 nt, Pseudomonas aeruginosa PA01
cagcaaugccagcgc

SEQ ID NO: 1532281 - RNA, 14 nt, Pseudomonas aeruginosa PA01
cagcaaugcccagc

SEQ ID NO: 1532282 - RNA, 19 nt, Pseudomonas aeruginosa PA01
cagcaagucgaacaggccc

SEQ ID NO: 1532283 - RNA, 23 nt, Pseudomonas aeruginosa PA01
cagcaaggcgucauagcagcgcc

SEQ ID NO: 1532284 - RNA, 21 nt, Pseudomonas aeruginosa PA01
cagcaauuccacgcgacagcg

SEQ ID NO: 1532285 - RNA, 13 nt, Pseudomonas aeruginosa PA01
cagcaacccggcc

SEQ ID NO: 1532286 - RNA, 15 nt, Pseudomonas aeruginosa PA01
cagcaacgccgcccc

SEQ ID NO: 1532287 - RNA, 20 nt, Pseudomonas aeruginosa PA01
cagcaacgccgcccccagcg

SEQ ID NO: 1532288 - RNA, 18 nt, Pseudomonas aeruginosa PA01
cagcaagccgcagcgccc

SEQ ID NO: 1532289 - RNA, 17 nt, Pseudomonas aeruginosa PA01
cagcacagccccagccu

SEQ ID NO: 1532290 - RNA, 17 nt, Pseudomonas aeruginosa PA01
cagcacccgcaccagcc

SEQ ID NO: 1532291 - RNA, 11 nt, Pseudomonas aeruginosa PA01
cagcacccagg

SEQ ID NO: 1532292 - RNA, 12 nt, Pseudomonas aeruginosa PA01
cagcacccagga

SEQ ID NO: 1532293 - RNA, 20 nt, Pseudomonas aeruginosa PA01
cagcacccaggauuuguccg

SEQ ID NO: 1532294 - RNA, 13 nt, Pseudomonas aeruginosa PA01
cagcacccccagc

SEQ ID NO: 1532295 - RNA, 16 nt, Pseudomonas aeruginosa PA01
cagcacccccagcagg

SEQ ID NO: 1532296 - RNA, 20 nt, Pseudomonas aeruginosa PA01
cagcacccggaccuugucca

SEQ ID NO: 1532297 - RNA, 14 nt, Pseudomonas aeruginosa PA01
cagcaccgcgcgcu

SEQ ID NO: 1532298 - RNA, 19 nt, Pseudomonas aeruginosa PA01
cagcaccgcuuucaccagg

SEQ ID NO: 1532299 - RNA, 20 nt, Pseudomonas aeruginosa PA01
cagcaccgcuuucaccaggg

SEQ ID NO: 1532300 - RNA, 19 nt, Pseudomonas aeruginosa PA01
cagcacgagcuuggccacu

SEQ ID NO: 1532301 - RNA, 24 nt, Pseudomonas aeruginosa PA01
cagcacgagcuuggccacuccggg

SEQ ID NO: 1532302 - RNA, 21 nt, Pseudomonas aeruginosa PA01
cagcaccguggucagcaccag

SEQ ID NO: 1532303 - RNA, 17 nt, Pseudomonas aeruginosa PA01
cagcaccggcggcgcca

SEQ ID NO: 1532304 - RNA, 13 nt, Pseudomonas aeruginosa PA01
cagcacgcggagg

SEQ ID NO: 1532305 - RNA, 19 nt, Pseudomonas aeruginosa PA01
cagcacgcguccgaccauu

SEQ ID NO: 1532306 - RNA, 14 nt, Pseudomonas aeruginosa PA01
cagcacgccuucca

SEQ ID NO: 1532307 - RNA, 17 nt, Pseudomonas aeruginosa PA01
cagcacuucggcgcgcg

SEQ ID NO: 1532308 - RNA, 20 nt, Pseudomonas aeruginosa PA01
cagcacuucggcgcgcggca

SEQ ID NO: 1532309 - RNA, 21 nt, Pseudomonas aeruginosa PA01
cagaucgccgcguagcgccag

SEQ ID NO: 1532310 - RNA, 22 nt, Pseudomonas aeruginosa PA01
cagaucgccagcgccagcaggu

SEQ ID NO: 1532311 - RNA, 19 nt, Pseudomonas aeruginosa PA01
cagaucgccaccccgccgc

SEQ ID NO: 1532312 - RNA, 20 nt, Pseudomonas aeruginosa PA01
cagaucgccaccccgccgcu

SEQ ID NO: 1532313 - RNA, 13 nt, Pseudomonas aeruginosa PA01
cagauaacgucgc

SEQ ID NO: 1532314 - RNA, 15 nt, Pseudomonas aeruginosa PA01
cagaugaaacugccc

SEQ ID NO: 1532315 - RNA, 12 nt, Pseudomonas aeruginosa PA01
cagaugaucagg

SEQ ID NO: 1532316 - RNA, 13 nt, Pseudomonas aeruginosa PA01
cagauguccaggc

SEQ ID NO: 1532317 - RNA, 12 nt, Pseudomonas aeruginosa PA01
cagagcagaguc

SEQ ID NO: 1532318 - RNA, 12 nt, Pseudomonas aeruginosa PA01
cagaguccaugc

SEQ ID NO: 1532319 - RNA, 16 nt, Pseudomonas aeruginosa PA01
cagagugcgcagcagc

SEQ ID NO: 1532320 - RNA, 17 nt, Pseudomonas aeruginosa PA01
cagagugcgcagcagcg

SEQ ID NO: 1532321 - RNA, 13 nt, Pseudomonas aeruginosa PA01
cagaggcaacacc

SEQ ID NO: 1532322 - RNA, 16 nt, Pseudomonas aeruginosa PA01
cagagcuccagggcug

SEQ ID NO: 1532323 - RNA, 19 nt, Pseudomonas aeruginosa PA01
cagagcccgccgaacagca

SEQ ID NO: 1532324 - RNA, 16 nt, Pseudomonas aeruginosa PA01
cagagccagccgcagc

SEQ ID NO: 1532325 - RNA, 18 nt, Pseudomonas aeruginosa PA01
cagagcagggugaagcug

SEQ ID NO: 1532326 - RNA, 19 nt, Pseudomonas aeruginosa PA01
cagagacauccggccaugu

SEQ ID NO: 1532327 - RNA, 18 nt, Pseudomonas aeruginosa PA01
cagacuccggcgcagccc

SEQ ID NO: 1532328 - RNA, 18 nt, Pseudomonas aeruginosa PA01
cagacgcugccgaggaac

SEQ ID NO: 1532329 - RNA, 20 nt, Pseudomonas aeruginosa PA01
cagacgcucggccagcgucc

SEQ ID NO: 1532330 - RNA, 15 nt, Pseudomonas aeruginosa PA01
cagacgaucuggcag

SEQ ID NO: 1532331 - RNA, 17 nt, Pseudomonas aeruginosa PA01
cagaccaggccgagcag

SEQ ID NO: 1532332 - RNA, 18 nt, Pseudomonas aeruginosa PA01
cagaccaggccgagcagg

SEQ ID NO: 1532333 - RNA, 19 nt, Pseudomonas aeruginosa PA01
cagaccaggccgagcagga

SEQ ID NO: 1532334 - RNA, 12 nt, Pseudomonas aeruginosa PA01
cagaccagcagc

SEQ ID NO: 1532335 - RNA, 21 nt, Pseudomonas aeruginosa PA01
cagaccagcagcgcaccaucc

SEQ ID NO: 1532336 - RNA, 15 nt, Pseudomonas aeruginosa PA01
cagaccagcaggaaa

SEQ ID NO: 1532337 - RNA, 16 nt, Pseudomonas aeruginosa PA01
cagaccagcaggaaaa

SEQ ID NO: 1532338 - RNA, 17 nt, Pseudomonas aeruginosa PA01
cagaccagcccuggcgc

SEQ ID NO: 1532339 - RNA, 21 nt, Pseudomonas aeruginosa PA01
cagaccagcccuggcgcggca

SEQ ID NO: 1532340 - RNA, 14 nt, Pseudomonas aeruginosa PA01
cagaccacccggcu

SEQ ID NO: 1532341 - RNA, 12 nt, Pseudomonas aeruginosa PA01
cagaccacgccc

SEQ ID NO: 1532342 - RNA, 16 nt, Pseudomonas aeruginosa PA01
cagaccacgcccugcg

SEQ ID NO: 1532343 - RNA, 15 nt, Pseudomonas aeruginosa PA01
cagacaccaccaggu

SEQ ID NO: 1532344 - RNA, 15 nt, Pseudomonas aeruginosa PA01
cagaauuccagcagg

SEQ ID NO: 1532345 - RNA, 16 nt, Pseudomonas aeruginosa PA01
cagaauuccagcaggu

SEQ ID NO: 1532346 - RNA, 24 nt, Pseudomonas aeruginosa PA01
cagacaggccagcucgcccgccuc

SEQ ID NO: 1532347 - RNA, 19 nt, Pseudomonas aeruginosa PA01
cagacaggccuccagcaac

SEQ ID NO: 1532348 - RNA, 14 nt, Pseudomonas aeruginosa PA01
cagaacacccgggu

SEQ ID NO: 1532349 - RNA, 22 nt, Pseudomonas aeruginosa PA01
cagaagacgcccagcagggcca

SEQ ID NO: 1532350 - RNA, 16 nt, Pseudomonas aeruginosa PA01
cagaagccggccgggu

SEQ ID NO: 1532351 - RNA, 16 nt, Pseudomonas aeruginosa PA01
cagaagcgacugucca

SEQ ID NO: 1532352 - RNA, 19 nt, Pseudomonas aeruginosa PA01
cagaagccccagagcccgc

SEQ ID NO: 1532353 - RNA, 16 nt, Pseudomonas aeruginosa PA01
cacgucguuucucggc

SEQ ID NO: 1532354 - RNA, 16 nt, Pseudomonas aeruginosa PA01
cacgucguccagcgcc

SEQ ID NO: 1532355 - RNA, 20 nt, Pseudomonas aeruginosa PA01
cacgucguccggcgccaacu

SEQ ID NO: 1532356 - RNA, 22 nt, Pseudomonas aeruginosa PA01
cacgucgaugccuucggcggcc

SEQ ID NO: 1532357 - RNA, 15 nt, Pseudomonas aeruginosa PA01
cacgucgccccaggg

SEQ ID NO: 1532358 - RNA, 22 nt, Pseudomonas aeruginosa PA01
cagcucgaucucauggucgggc

SEQ ID NO: 1532359 - RNA, 16 nt, Pseudomonas aeruginosa PA01
cagcucgcccgccucg

SEQ ID NO: 1532360 - RNA, 14 nt, Pseudomonas aeruginosa PA01
cagcucgccgaaga

SEQ ID NO: 1532361 - RNA, 14 nt, Pseudomonas aeruginosa PA01
cagcucgacccgcc

SEQ ID NO: 1532362 - RNA, 17 nt, Pseudomonas aeruginosa PA01
cagcucgaacagcaccg

SEQ ID NO: 1532363 - RNA, 20 nt, Pseudomonas aeruginosa PA01
cagcuccuugcgcuccuugg

SEQ ID NO: 1532364 - RNA, 23 nt, Pseudomonas aeruginosa PA01
cagcuccuugcgcuccuuggcug

SEQ ID NO: 1532365 - RNA, 16 nt, Pseudomonas aeruginosa PA01
cagcuccuugcucucg

SEQ ID NO: 1532366 - RNA, 24 nt, Pseudomonas aeruginosa PA01
cagcuccuugcucucgcgcacgcu

SEQ ID NO: 1532367 - RNA, 23 nt, Pseudomonas aeruginosa PA01
cagcuccgucuguucggccaggg

SEQ ID NO: 1532368 - RNA, 19 nt, Pseudomonas aeruginosa PA01
cagcuccgggcuggccacc

SEQ ID NO: 1532369 - RNA, 17 nt, Pseudomonas aeruginosa PA01
cagcucgccgcgcucca

SEQ ID NO: 1532370 - RNA, 13 nt, Pseudomonas aeruginosa PA01
cagcucgccgcuc

SEQ ID NO: 1532371 - RNA, 17 nt, Pseudomonas aeruginosa PA01
cagcucgccgcuccaca

SEQ ID NO: 1532372 - RNA, 22 nt, Pseudomonas aeruginosa PA01
cagcucggacaagggccagagc

SEQ ID NO: 1532373 - RNA, 21 nt, Pseudomonas aeruginosa PA01
cagcucgcuaugcagcaggua

SEQ ID NO: 1532374 - RNA, 20 nt, Pseudomonas aeruginosa PA01
cagcucggccaucagcgcca

SEQ ID NO: 1532375 - RNA, 23 nt, Pseudomonas aeruginosa PA01
cagcucggccaucagcgccaggg

SEQ ID NO: 1532376 - RNA, 20 nt, Pseudomonas aeruginosa PA01
cagcucguugcacagcgccc

SEQ ID NO: 1532377 - RNA, 21 nt, Pseudomonas aeruginosa PA01
cagcucguugcacagcgccca

SEQ ID NO: 1532378 - RNA, 21 nt, Pseudomonas aeruginosa PA01
cagcuccaccgauggcgcgcu

SEQ ID NO: 1532379 - RNA, 21 nt, Pseudomonas aeruginosa PA01
cagcuccagcagucgcacagc

SEQ ID NO: 1532380 - RNA, 22 nt, Pseudomonas aeruginosa PA01
cagcuccagcagucgcacagcc

SEQ ID NO: 1532381 - RNA, 14 nt, Pseudomonas aeruginosa PA01
cagcuccagcaccg

SEQ ID NO: 1532382 - RNA, 16 nt, Pseudomonas aeruginosa PA01
cagcuccagcaccggc

SEQ ID NO: 1532383 - RNA, 23 nt, Pseudomonas aeruginosa PA01
cagcuccagcaccggcggcgcca

SEQ ID NO: 1532384 - RNA, 16 nt, Pseudomonas aeruginosa PA01
cagcuccgagccacgg

SEQ ID NO: 1532385 - RNA, 13 nt, Pseudomonas aeruginosa PA01
cagcuccgccucg

SEQ ID NO: 1532386 - RNA, 14 nt, Pseudomonas aeruginosa PA01
cagcuccgccugac

SEQ ID NO: 1532387 - RNA, 14 nt, Pseudomonas aeruginosa PA01
cagcuccggcagca

SEQ ID NO: 1532388 - RNA, 13 nt, Pseudomonas aeruginosa PA01
cagcuccagcgcc

SEQ ID NO: 1532389 - RNA, 18 nt, Pseudomonas aeruginosa PA01
cagcuccaggccgcgggu

SEQ ID NO: 1532390 - RNA, 16 nt, Pseudomonas aeruginosa PA01
cagcucagcuccaggc

SEQ ID NO: 1532391 - RNA, 19 nt, Pseudomonas aeruginosa PA01
cagcgcuccuuucccagcg

SEQ ID NO: 1532392 - RNA, 16 nt, Pseudomonas aeruginosa PA01
cagcgcucguagccgg

SEQ ID NO: 1532393 - RNA, 17 nt, Pseudomonas aeruginosa PA01
cagcgcggugcgcgcca

SEQ ID NO: 1532394 - RNA, 15 nt, Pseudomonas aeruginosa PA01
cagcgcggcggcggc

SEQ ID NO: 1532395 - RNA, 20 nt, Pseudomonas aeruginosa PA01
cagcgcggcggcggccagca

SEQ ID NO: 1532396 - RNA, 15 nt, Pseudomonas aeruginosa PA01
cagcgcuuccucggg

SEQ ID NO: 1532397 - RNA, 21 nt, Pseudomonas aeruginosa PA01
cagcgcuucguugcuccugcg

SEQ ID NO: 1532398 - RNA, 15 nt, Pseudomonas aeruginosa PA01
cagcgcuuccaccgc

SEQ ID NO: 1532399 - RNA, 22 nt, Pseudomonas aeruginosa PA01
cagcgcuuccaccgccugcccc

SEQ ID NO: 1532400 - RNA, 14 nt, Pseudomonas aeruginosa PA01
cagcuuccaggcgc

SEQ ID NO: 1532401 - RNA, 17 nt, Pseudomonas aeruginosa PA01
cagcuuccaggcgcgcu

SEQ ID NO: 1532402 - RNA, 15 nt, Pseudomonas aeruginosa PA01
cagcucuggccgucc

SEQ ID NO: 1532403 - RNA, 19 nt, Pseudomonas aeruginosa PA01
cagcucggcacgcagcagc

SEQ ID NO: 1532404 - RNA, 15 nt, Pseudomonas aeruginosa PA01
cagcucugcgacugg

SEQ ID NO: 1532405 - RNA, 21 nt, Pseudomonas aeruginosa PA01
cagcucugucuccugugccuu

SEQ ID NO: 1532406 - RNA, 16 nt, Pseudomonas aeruginosa PA01
caggaaaaagcccgcg

SEQ ID NO: 1532407 - RNA, 20 nt, Pseudomonas aeruginosa PA01
cagcuugaaccgcgagaccc

SEQ ID NO: 1532408 - RNA, 15 nt, Pseudomonas aeruginosa PA01
cagcuugccgcugcg

SEQ ID NO: 1532409 - RNA, 20 nt, Pseudomonas aeruginosa PA01
cagcuugauguaggacaggc

SEQ ID NO: 1532410 - RNA, 14 nt, Pseudomonas aeruginosa PA01
cagcuugccuucca

SEQ ID NO: 1532411 - RNA, 22 nt, Pseudomonas aeruginosa PA01
caggacgagaguguccgagccg

SEQ ID NO: 1532412 - RNA, 15 nt, Pseudomonas aeruginosa PA01
caggacgaggaaggc

SEQ ID NO: 1532413 - RNA, 15 nt, Pseudomonas aeruginosa PA01
caggacgcuccugcg

SEQ ID NO: 1532414 - RNA, 23 nt, Pseudomonas aeruginosa PA01
caggacgcuccugcgccggcucg

SEQ ID NO: 1532415 - RNA, 19 nt, Pseudomonas aeruginosa PA01
caggagcaucggcgcggcc

SEQ ID NO: 1532416 - RNA, 13 nt, Pseudomonas aeruginosa PA01
caggagcagggcg

SEQ ID NO: 1532417 - RNA, 11 nt, Pseudomonas aeruginosa PA01
caggagcgcca

SEQ ID NO: 1532418 - RNA, 16 nt, Pseudomonas aeruginosa PA01
caggagcgccaucagc

SEQ ID NO: 1532419 - RNA, 13 nt, Pseudomonas aeruginosa PA01
caggagcgccgcg

SEQ ID NO: 1532420 - RNA, 22 nt, Pseudomonas aeruginosa PA01
caggagcaugucuucgucgcgc

SEQ ID NO: 1532421 - RNA, 19 nt, Pseudomonas aeruginosa PA01
caggagccaucgcuccagc

SEQ ID NO: 1532422 - RNA, 13 nt, Pseudomonas aeruginosa PA01
caggaaggccggg

SEQ ID NO: 1532423 - RNA, 18 nt, Pseudomonas aeruginosa PA01
caggaaggccuggaacac

SEQ ID NO: 1532424 - RNA, 23 nt, Pseudomonas aeruginosa PA01
caggaaggccuggaacaccaggc

SEQ ID NO: 1532425 - RNA, 12 nt, Pseudomonas aeruginosa PA01
caggaaccagac

SEQ ID NO: 1532426 - RNA, 16 nt, Pseudomonas aeruginosa PA01
caggaacgccucugcg

SEQ ID NO: 1532427 - RNA, 16 nt, Pseudomonas aeruginosa PA01
cagggaagcgcgcgcc

SEQ ID NO: 1532428 - RNA, 22 nt, Pseudomonas aeruginosa PA01
caggcuuacccgcgaccacagg

SEQ ID NO: 1532429 - RNA, 14 nt, Pseudomonas aeruginosa PA01
caggcugucggcca

SEQ ID NO: 1532430 - RNA, 17 nt, Pseudomonas aeruginosa PA01
caggcugucggccagcc

SEQ ID NO: 1532431 - RNA, 13 nt, Pseudomonas aeruginosa PA01
caggcuggcuggu

SEQ ID NO: 1532432 - RNA, 17 nt, Pseudomonas aeruginosa PA01
caggcuguggcgcggcu

SEQ ID NO: 1532433 - RNA, 16 nt, Pseudomonas aeruginosa PA01
caggcuguugcccugg

SEQ ID NO: 1532434 - RNA, 21 nt, Pseudomonas aeruginosa PA01
caggcugccggccagguagcg

SEQ ID NO: 1532435 - RNA, 22 nt, Pseudomonas aeruginosa PA01
caggcugccguugcggcccuuc

SEQ ID NO: 1532436 - RNA, 14 nt, Pseudomonas aeruginosa PA01
caggcugcgcaccu

SEQ ID NO: 1532437 - RNA, 16 nt, Pseudomonas aeruginosa PA01
caggcugcgcaccucg

SEQ ID NO: 1532438 - RNA, 23 nt, Pseudomonas aeruginosa PA01
caggcugcgcaccucggccaggc

SEQ ID NO: 1532439 - RNA, 21 nt, Pseudomonas aeruginosa PA01
caggcugcgggcgacaaggcu

SEQ ID NO: 1532440 - RNA, 18 nt, Pseudomonas aeruginosa PA01
caggcugcggcggaaggc

SEQ ID NO: 1532441 - RNA, 18 nt, Pseudomonas aeruginosa PA01
caggcugcgcuugcugcc

SEQ ID NO: 1532442 - RNA, 17 nt, Pseudomonas aeruginosa PA01
caggcugcgccgcugcg

SEQ ID NO: 1532443 - RNA, 19 nt, Pseudomonas aeruginosa PA01
caggcuggccuuggccaug

SEQ ID NO: 1532444 - RNA, 17 nt, Pseudomonas aeruginosa PA01
caggcuggcggccaggg

SEQ ID NO: 1532445 - RNA, 23 nt, Pseudomonas aeruginosa PA01
caggcuggcgucgacgccgaagc

SEQ ID NO: 1532446 - RNA, 14 nt, Pseudomonas aeruginosa PA01
caggcuggcucccc

SEQ ID NO: 1532447 - RNA, 21 nt, Pseudomonas aeruginosa PA01
caggcugggccgaaccggggc

SEQ ID NO: 1532448 - RNA, 17 nt, Pseudomonas aeruginosa PA01
caggcugguaugcagca

SEQ ID NO: 1532449 - RNA, 15 nt, Pseudomonas aeruginosa PA01
caggcuggugccgcu

SEQ ID NO: 1532450 - RNA, 12 nt, Pseudomonas aeruginosa PA01
caggcugcugcu

SEQ ID NO: 1532451 - RNA, 14 nt, Pseudomonas aeruginosa PA01
caggcuggccccgg

SEQ ID NO: 1532452 - RNA, 15 nt, Pseudomonas aeruginosa PA01
caggcuggccacgaa

SEQ ID NO: 1532453 - RNA, 17 nt, Pseudomonas aeruginosa PA01
caggcuggccacgaaca

SEQ ID NO: 1532454 - RNA, 20 nt, Pseudomonas aeruginosa PA01
caggcuggccacgaacaggc

SEQ ID NO: 1532455 - RNA, 18 nt, Pseudomonas aeruginosa PA01
caggcucaucgcccgccc

SEQ ID NO: 1532456 - RNA, 13 nt, Pseudomonas aeruginosa PA01
caggcuccgacug

SEQ ID NO: 1532457 - RNA, 17 nt, Pseudomonas aeruginosa PA01
caggcucaggccgggca

SEQ ID NO: 1532458 - RNA, 19 nt, Pseudomonas aeruginosa PA01
caggcucacgcaucccuuc

SEQ ID NO: 1532459 - RNA, 13 nt, Pseudomonas aeruginosa PA01
caggcucaggguc

SEQ ID NO: 1532460 - RNA, 21 nt, Pseudomonas aeruginosa PA01
caggcucagggucucgcgggc

SEQ ID NO: 1532461 - RNA, 17 nt, Pseudomonas aeruginosa PA01
caggcucaguucggcca

SEQ ID NO: 1532462 - RNA, 12 nt, Pseudomonas aeruginosa PA01
caggcucagcgc

SEQ ID NO: 1532463 - RNA, 15 nt, Pseudomonas aeruginosa PA01
caggcgucccauggc

SEQ ID NO: 1532464 - RNA, 19 nt, Pseudomonas aeruginosa PA01
caggcgucccgcuccagcc

SEQ ID NO: 1532465 - RNA, 21 nt, Pseudomonas aeruginosa PA01
caggcgucccgcuccagccgg

SEQ ID NO: 1532466 - RNA, 23 nt, Pseudomonas aeruginosa PA01
caggcgucccuggagcagggcga

SEQ ID NO: 1532467 - RNA, 19 nt, Pseudomonas aeruginosa PA01
caggcguccgcuggccugc

SEQ ID NO: 1532468 - RNA, 14 nt, Pseudomonas aeruginosa PA01
caggcgucgcaccu

SEQ ID NO: 1532469 - RNA, 17 nt, Pseudomonas aeruginosa PA01
caggcgucgcaccuggg

SEQ ID NO: 1532470 - RNA, 14 nt, Pseudomonas aeruginosa PA01
caggcgucgcgcca

SEQ ID NO: 1532471 - RNA, 20 nt, Pseudomonas aeruginosa PA01
caggcgucgcgccagcaccg

SEQ ID NO: 1532472 - RNA, 16 nt, Pseudomonas aeruginosa PA01
caggcgguccagccag

SEQ ID NO: 1532473 - RNA, 19 nt, Pseudomonas aeruginosa PA01
caggcggucgccgaacagc

SEQ ID NO: 1532474 - RNA, 14 nt, Pseudomonas aeruginosa PA01
caggcggucggcca

SEQ ID NO: 1532475 - RNA, 14 nt, Pseudomonas aeruginosa PA01
caggcgguggagca

SEQ ID NO: 1532476 - RNA, 16 nt, Pseudomonas aeruginosa PA01
caggcgguugcggaac

SEQ ID NO: 1532477 - RNA, 21 nt, Pseudomonas aeruginosa PA01
caggcgguuggcccgcgccgu

SEQ ID NO: 1532478 - RNA, 23 nt, Pseudomonas aeruginosa PA01
caggcguaccagcuugucgccuu

SEQ ID NO: 1532479 - RNA, 14 nt, Pseudomonas aeruginosa PA01
caggcgcagcagcg

SEQ ID NO: 1532480 - RNA, 17 nt, Pseudomonas aeruginosa PA01
caggcgguagcgccgcg

SEQ ID NO: 1532481 - RNA, 16 nt, Pseudomonas aeruginosa PA01
caggcgguaguagggu

SEQ ID NO: 1532482 - RNA, 22 nt, Pseudomonas aeruginosa PA01
caggcgcaggucggccucggcg

SEQ ID NO: 1532483 - RNA, 19 nt, Pseudomonas aeruginosa PA01
caggcgcaguaggccuggu

SEQ ID NO: 1532484 - RNA, 16 nt, Pseudomonas aeruginosa PA01
caggcgcacgcgcagu

SEQ ID NO: 1532485 - RNA, 17 nt, Pseudomonas aeruginosa PA01
caggcgcagcguccugc

SEQ ID NO: 1532486 - RNA, 20 nt, Pseudomonas aeruginosa PA01
caggcgcagcguccugcccu

SEQ ID NO: 1532487 - RNA, 14 nt, Pseudomonas aeruginosa PA01
caggcgcaccuggc

SEQ ID NO: 1532488 - RNA, 20 nt, Pseudomonas aeruginosa PA01
cagggcaccgccgaggaaca

SEQ ID NO: 1532489 - RNA, 13 nt, Pseudomonas aeruginosa PA01
cagggcagcaggu

SEQ ID NO: 1532490 - RNA, 14 nt, Pseudomonas aeruginosa PA01
cagggcagcagguc

SEQ ID NO: 1532491 - RNA, 18 nt, Pseudomonas aeruginosa PA01
cagggacgcccggagcgc

SEQ ID NO: 1532492 - RNA, 17 nt, Pseudomonas aeruginosa PA01
cagggacgcgcagcggc

SEQ ID NO: 1532493 - RNA, 21 nt, Pseudomonas aeruginosa PA01
cagggaggagggcgaggucac

SEQ ID NO: 1532494 - RNA, 13 nt, Pseudomonas aeruginosa PA01
cagggaggcgcac

SEQ ID NO: 1532495 - RNA, 20 nt, Pseudomonas aeruginosa PA01
cagggaggcgcacaucaccc

SEQ ID NO: 1532496 - RNA, 19 nt, Pseudomonas aeruginosa PA01
cagggaggcgcuggccagc

SEQ ID NO: 1532497 - RNA, 17 nt, Pseudomonas aeruginosa PA01
cagggagaacagcaggg

SEQ ID NO: 1532498 - RNA, 15 nt, Pseudomonas aeruginosa PA01
cagggagaaccaggc

SEQ ID NO: 1532499 - RNA, 20 nt, Pseudomonas aeruginosa PA01
cagggcaugggucagcgcca

SEQ ID NO: 1532500 - RNA, 16 nt, Pseudomonas aeruginosa PA01
cagggcauguuccucc

SEQ ID NO: 1532501 - RNA, 14 nt, Pseudomonas aeruginosa PA01
cagggcauuggcca

SEQ ID NO: 1532502 - RNA, 20 nt, Pseudomonas aeruginosa PA01
cagggcauauucauagccgu

SEQ ID NO: 1532503 - RNA, 19 nt, Pseudomonas aeruginosa PA01
cagggcccagagcagcacc

SEQ ID NO: 1532504 - RNA, 22 nt, Pseudomonas aeruginosa PA01
cagggcccagagcagcaccagc

SEQ ID NO: 1532505 - RNA, 23 nt, Pseudomonas aeruginosa PA01
cagggcccagagcagcaccagca

SEQ ID NO: 1532506 - RNA, 17 nt, Pseudomonas aeruginosa PA01
cagggccaggccgagcg

SEQ ID NO: 1532507 - RNA, 20 nt, Pseudomonas aeruginosa PA01
cagggccaggagcaucggcg

SEQ ID NO: 1532508 - RNA, 13 nt, Pseudomonas aeruginosa PA01
cagggccagcaac

SEQ ID NO: 1532509 - RNA, 16 nt, Pseudomonas aeruginosa PA01
cagggccagcagcgcu

SEQ ID NO: 1532510 - RNA, 17 nt, Pseudomonas aeruginosa PA01
cagggccagcagcggcg

SEQ ID NO: 1532511 - RNA, 19 nt, Pseudomonas aeruginosa PA01
cagggccagcgccuggcgc

SEQ ID NO: 1532512 - RNA, 17 nt, Pseudomonas aeruginosa PA01
cagggccgagcacaggg

SEQ ID NO: 1532513 - RNA, 19 nt, Pseudomonas aeruginosa PA01
cagggccgagcgcagcgcc

SEQ ID NO: 1532514 - RNA, 19 nt, Pseudomonas aeruginosa PA01
cagggccggaugccaccgc

SEQ ID NO: 1532515 - RNA, 15 nt, Pseudomonas aeruginosa PA01
cagggccgccagccg

SEQ ID NO: 1532516 - RNA, 13 nt, Pseudomonas aeruginosa PA01
cagggccucgggc

SEQ ID NO: 1532517 - RNA, 14 nt, Pseudomonas aeruginosa PA01
cagggcgucgccgg

SEQ ID NO: 1532518 - RNA, 22 nt, Pseudomonas aeruginosa PA01
cagggcuccgaugaagcaggcg

SEQ ID NO: 1532519 - RNA, 18 nt, Pseudomonas aeruginosa PA01
cagggcgucgaaggcggc

SEQ ID NO: 1532520 - RNA, 15 nt, Pseudomonas aeruginosa PA01
cagggcgggccgcuc

SEQ ID NO: 1532521 - RNA, 23 nt, Pseudomonas aeruginosa PA01
cagggcgggccgcucgcgcggca

SEQ ID NO: 1532522 - RNA, 17 nt, Pseudomonas aeruginosa PA01
cagggcggucggccagg

SEQ ID NO: 1532523 - RNA, 23 nt, Pseudomonas aeruginosa PA01
cagggcggugagguugccgccga

SEQ ID NO: 1532524 - RNA, 16 nt, Pseudomonas aeruginosa PA01
cagggcggcgccgaac

SEQ ID NO: 1532525 - RNA, 18 nt, Pseudomonas aeruginosa PA01
cagggcggcgccuggagc

SEQ ID NO: 1532526 - RNA, 19 nt, Pseudomonas aeruginosa PA01
cagggcggcgccuggagca

SEQ ID NO: 1532527 - RNA, 22 nt, Pseudomonas aeruginosa PA01
cagggcggauaaucgcagcgcg

SEQ ID NO: 1532528 - RNA, 15 nt, Pseudomonas aeruginosa PA01
caggcauuccuccag

SEQ ID NO: 1532529 - RNA, 16 nt, Pseudomonas aeruginosa PA01
caggcauuccuccagg

SEQ ID NO: 1532530 - RNA, 16 nt, Pseudomonas aeruginosa PA01
caggcaugcggccccg

SEQ ID NO: 1532531 - RNA, 16 nt, Pseudomonas aeruginosa PA01
caggaucacaucgccc

SEQ ID NO: 1532532 - RNA, 17 nt, Pseudomonas aeruginosa PA01
caggaucuccucggcca

SEQ ID NO: 1532533 - RNA, 16 nt, Pseudomonas aeruginosa PA01
caggauaucgcccagg

SEQ ID NO: 1532534 - RNA, 20 nt, Pseudomonas aeruginosa PA01
caggaucugcugcaacaugg

SEQ ID NO: 1532535 - RNA, 23 nt, Pseudomonas aeruginosa PA01
caggaucugcugcaacauggcgu

SEQ ID NO: 1532536 - RNA, 13 nt, Pseudomonas aeruginosa PA01
caggaugaccagg

SEQ ID NO: 1532537 - RNA, 14 nt, Pseudomonas aeruginosa PA01
caggaugaccaggc

SEQ ID NO: 1532538 - RNA, 16 nt, Pseudomonas aeruginosa PA01
caggaugaccaggcug

SEQ ID NO: 1532539 - RNA, 14 nt, Pseudomonas aeruginosa PA01
caggccaugggugu

SEQ ID NO: 1532540 - RNA, 23 nt, Pseudomonas aeruginosa PA01
caggccagcagguagccugcggc

SEQ ID NO: 1532541 - RNA, 22 nt, Pseudomonas aeruginosa PA01
caggccacggccggcgaggcgu

SEQ ID NO: 1532542 - RNA, 13 nt, Pseudomonas aeruginosa PA01
caggccagcgcca

SEQ ID NO: 1532543 - RNA, 18 nt, Pseudomonas aeruginosa PA01
caggccagcgggcugucg

SEQ ID NO: 1532544 - RNA, 17 nt, Pseudomonas aeruginosa PA01
caggccagcgccagggg

SEQ ID NO: 1532545 - RNA, 12 nt, Pseudomonas aeruginosa PA01
caggccaggccc

SEQ ID NO: 1532546 - RNA, 17 nt, Pseudomonas aeruginosa PA01
caggccaggccccaggg

SEQ ID NO: 1532547 - RNA, 17 nt, Pseudomonas aeruginosa PA01
caggcccagcgcggcgc

SEQ ID NO: 1532548 - RNA, 13 nt, Pseudomonas aeruginosa PA01
caggcccagccgg

SEQ ID NO: 1532549 - RNA, 15 nt, Pseudomonas aeruginosa PA01
caggcccggccgccu

SEQ ID NO: 1532550 - RNA, 18 nt, Pseudomonas aeruginosa PA01
caggcccggccgccugcc

SEQ ID NO: 1532551 - RNA, 16 nt, Pseudomonas aeruginosa PA01
caggcccggcgcugcu

SEQ ID NO: 1532552 - RNA, 17 nt, Pseudomonas aeruginosa PA01
caggcccgccgcggcga

SEQ ID NO: 1532553 - RNA, 15 nt, Pseudomonas aeruginosa PA01
caggccccagggccg

SEQ ID NO: 1532554 - RNA, 23 nt, Pseudomonas aeruginosa PA01
caggcccauuucguagcccaggc

SEQ ID NO: 1532555 - RNA, 18 nt, Pseudomonas aeruginosa PA01
caggccgcuuuccacccg

SEQ ID NO: 1532556 - RNA, 16 nt, Pseudomonas aeruginosa PA01
caggccggagccgcgu

SEQ ID NO: 1532557 - RNA, 23 nt, Pseudomonas aeruginosa PA01
caggccggaguccacggugaucc

SEQ ID NO: 1532558 - RNA, 23 nt, Pseudomonas aeruginosa PA01
caggccgcggggaggaagcuccc

SEQ ID NO: 1532559 - RNA, 22 nt, Pseudomonas aeruginosa PA01
caggccgcggcccugcgccgca

SEQ ID NO: 1532560 - RNA, 21 nt, Pseudomonas aeruginosa PA01
caggccgcgucguaguugccu

SEQ ID NO: 1532561 - RNA, 17 nt, Pseudomonas aeruginosa PA01
caggccgcugccgccgc

SEQ ID NO: 1532562 - RNA, 23 nt, Pseudomonas aeruginosa PA01
caggccgcugccgccgcgcaggc

SEQ ID NO: 1532563 - RNA, 14 nt, Pseudomonas aeruginosa PA01
caggccgcccagga

SEQ ID NO: 1532564 - RNA, 18 nt, Pseudomonas aeruginosa PA01
caggccgcgcagucccgc

SEQ ID NO: 1532565 - RNA, 16 nt, Pseudomonas aeruginosa PA01
caggccgcgcagcaac

SEQ ID NO: 1532566 - RNA, 13 nt, Pseudomonas aeruginosa PA01
caggccgauggcc

SEQ ID NO: 1532567 - RNA, 15 nt, Pseudomonas aeruginosa PA01
caggccgauggcccc

SEQ ID NO: 1532568 - RNA, 16 nt, Pseudomonas aeruginosa PA01
caggccgauggccccg

SEQ ID NO: 1532569 - RNA, 17 nt, Pseudomonas aeruginosa PA01
caggccgccgccugcuc

SEQ ID NO: 1532570 - RNA, 20 nt, Pseudomonas aeruginosa PA01
caggccgccggcggccaggg

SEQ ID NO: 1532571 - RNA, 13 nt, Pseudomonas aeruginosa PA01
caggcccugcagc

SEQ ID NO: 1532572 - RNA, 14 nt, Pseudomonas aeruginosa PA01
caggcccugccagu

SEQ ID NO: 1532573 - RNA, 13 nt, Pseudomonas aeruginosa PA01
caggcccugcucc

SEQ ID NO: 1532574 - RNA, 23 nt, Pseudomonas aeruginosa PA01
caggcccugcuucuguaguugau

SEQ ID NO: 1532575 - RNA, 19 nt, Pseudomonas aeruginosa PA01
caggcccuggaucaccgcg

SEQ ID NO: 1532576 - RNA, 15 nt, Pseudomonas aeruginosa PA01
caggcccuugaggaa

SEQ ID NO: 1532577 - RNA, 17 nt, Pseudomonas aeruginosa PA01
caggcccuugaggaagu

SEQ ID NO: 1532578 - RNA, 17 nt, Pseudomonas aeruginosa PA01
caggccgacccgcaggc

SEQ ID NO: 1532579 - RNA, 16 nt, Pseudomonas aeruginosa PA01
caggccgacgaagacc

SEQ ID NO: 1532580 - RNA, 18 nt, Pseudomonas aeruginosa PA01
caggccgacgaagaccuu

SEQ ID NO: 1532581 - RNA, 17 nt, Pseudomonas aeruginosa PA01
caggccgagcagcgcca

SEQ ID NO: 1532582 - RNA, 22 nt, Pseudomonas aeruginosa PA01
caggccgagcagcgccagccag

SEQ ID NO: 1532583 - RNA, 23 nt, Pseudomonas aeruginosa PA01
caggccgagcgccagggccaggg

SEQ ID NO: 1532584 - RNA, 16 nt, Pseudomonas aeruginosa PA01
caggccgagcgcgccg

SEQ ID NO: 1532585 - RNA, 20 nt, Pseudomonas aeruginosa PA01
caggccgaccagcagggcca

SEQ ID NO: 1532586 - RNA, 20 nt, Pseudomonas aeruginosa PA01
caggccgaccagcgccgacu

SEQ ID NO: 1532587 - RNA, 17 nt, Pseudomonas aeruginosa PA01
caggccgaacgggaagu

SEQ ID NO: 1532588 - RNA, 19 nt, Pseudomonas aeruginosa PA01
caggccgaaggccaggacc

SEQ ID NO: 1532589 - RNA, 16 nt, Pseudomonas aeruginosa PA01
caggccgaggcgcuuc

SEQ ID NO: 1532590 - RNA, 21 nt, Pseudomonas aeruginosa PA01
caggccgaggcgcuucugcuc

SEQ ID NO: 1532591 - RNA, 14 nt, Pseudomonas aeruginosa PA01
caggccgaggagga

SEQ ID NO: 1532592 - RNA, 20 nt, Pseudomonas aeruginosa PA01
caggccgaggaugcucgccu

SEQ ID NO: 1532593 - RNA, 23 nt, Pseudomonas aeruginosa PA01
caggccgaggaugcucgccuggu

SEQ ID NO: 1532594 - RNA, 18 nt, Pseudomonas aeruginosa PA01
caggccgaucaccaccag

SEQ ID NO: 1532595 - RNA, 17 nt, Pseudomonas aeruginosa PA01
caggccgaucaggaaau

SEQ ID NO: 1532596 - RNA, 16 nt, Pseudomonas aeruginosa PA01
caggccgaguccgcgc

SEQ ID NO: 1532597 - RNA, 18 nt, Pseudomonas aeruginosa PA01
caggccgaguccgcgcgc

SEQ ID NO: 1532598 - RNA, 14 nt, Pseudomonas aeruginosa PA01
caggccuugcagca

SEQ ID NO: 1532599 - RNA, 21 nt, Pseudomonas aeruginosa PA01
caggccuucgacuucgacgaa

SEQ ID NO: 1532600 - RNA, 19 nt, Pseudomonas aeruginosa PA01
caggccuguggauagaaaa

SEQ ID NO: 1532601 - RNA, 14 nt, Pseudomonas aeruginosa PA01
caggccuggagcgc

SEQ ID NO: 1532602 - RNA, 19 nt, Pseudomonas aeruginosa PA01
caggccuggagcgccucga

SEQ ID NO: 1532603 - RNA, 16 nt, Pseudomonas aeruginosa PA01
caggcgaugcgccgga

SEQ ID NO: 1532604 - RNA, 18 nt, Pseudomonas aeruginosa PA01
caggcgaugaccgccccg

SEQ ID NO: 1532605 - RNA, 20 nt, Pseudomonas aeruginosa PA01
caggcgaugaccgccccggc

SEQ ID NO: 1532606 - RNA, 18 nt, Pseudomonas aeruginosa PA01
caggcgaugaucagcccu

SEQ ID NO: 1532607 - RNA, 18 nt, Pseudomonas aeruginosa PA01
caggcgauaucccgccgc

SEQ ID NO: 1532608 - RNA, 18 nt, Pseudomonas aeruginosa PA01
caggccuugugcgccagc

SEQ ID NO: 1532609 - RNA, 16 nt, Pseudomonas aeruginosa PA01
caggccuugcgcggcg

SEQ ID NO: 1532610 - RNA, 21 nt, Pseudomonas aeruginosa PA01
caggccuugcgcggcgccggu

SEQ ID NO: 1532611 - RNA, 23 nt, Pseudomonas aeruginosa PA01
caggccuugcugaucagguugcc

SEQ ID NO: 1532612 - RNA, 13 nt, Pseudomonas aeruginosa PA01
caggccggcgccu

SEQ ID NO: 1532613 - RNA, 18 nt, Pseudomonas aeruginosa PA01
caggccguagaccaccag

SEQ ID NO: 1532614 - RNA, 16 nt, Pseudomonas aeruginosa PA01
caggccguagcugcgc

SEQ ID NO: 1532615 - RNA, 20 nt, Pseudomonas aeruginosa PA01
caggccgggcggacgcuggg

SEQ ID NO: 1532616 - RNA, 21 nt, Pseudomonas aeruginosa PA01
caggccggcuaaccgcgaagc

SEQ ID NO: 1532617 - RNA, 16 nt, Pseudomonas aeruginosa PA01
caggccggcgaccagc

SEQ ID NO: 1532618 - RNA, 23 nt, Pseudomonas aeruginosa PA01
caggccggcgagggcggcgaccu

SEQ ID NO: 1532619 - RNA, 13 nt, Pseudomonas aeruginosa PA01
caggccggccucc

SEQ ID NO: 1532620 - RNA, 20 nt, Pseudomonas aeruginosa PA01
caggccggccuccagcgccu

SEQ ID NO: 1532621 - RNA, 21 nt, Pseudomonas aeruginosa PA01
cagucuggaagguaaagguaa

SEQ ID NO: 1532622 - RNA, 21 nt, Pseudomonas aeruginosa PA01
cagugcaccgccggguacagc

SEQ ID NO: 1532623 - RNA, 18 nt, Pseudomonas aeruginosa PA01
cagugcagccguugcccc

SEQ ID NO: 1532624 - RNA, 16 nt, Pseudomonas aeruginosa PA01
cagugagccccggcgu

SEQ ID NO: 1532625 - RNA, 20 nt, Pseudomonas aeruginosa PA01
cagugagaagauccuguagu

SEQ ID NO: 1532626 - RNA, 13 nt, Pseudomonas aeruginosa PA01
caguccuggaccc

SEQ ID NO: 1532627 - RNA, 16 nt, Pseudomonas aeruginosa PA01
caguccuggacccguu

SEQ ID NO: 1532628 - RNA, 14 nt, Pseudomonas aeruginosa PA01
cagucgcacagcca

SEQ ID NO: 1532629 - RNA, 16 nt, Pseudomonas aeruginosa PA01
cagucgcacagccagg

SEQ ID NO: 1532630 - RNA, 19 nt, Pseudomonas aeruginosa PA01
cagucgcacagccaggggc

SEQ ID NO: 1532631 - RNA, 15 nt, Pseudomonas aeruginosa PA01
caguccuugagcgcc

SEQ ID NO: 1532632 - RNA, 22 nt, Pseudomonas aeruginosa PA01
caguccuugagcgccagcaggu

SEQ ID NO: 1532633 - RNA, 20 nt, Pseudomonas aeruginosa PA01
cagucgagcaguucccccag

SEQ ID NO: 1532634 - RNA, 23 nt, Pseudomonas aeruginosa PA01
cagucccuucagcgcaccgcccu

SEQ ID NO: 1532635 - RNA, 18 nt, Pseudomonas aeruginosa PA01
caguccggguugacccag

SEQ ID NO: 1532636 - RNA, 16 nt, Pseudomonas aeruginosa PA01
caguccgguagcgcgc

SEQ ID NO: 1532637 - RNA, 18 nt, Pseudomonas aeruginosa PA01
cagucccgcaaagcccgc

SEQ ID NO: 1532638 - RNA, 20 nt, Pseudomonas aeruginosa PA01
cagucccgcaaagcccgcuc

SEQ ID NO: 1532639 - RNA, 15 nt, Pseudomonas aeruginosa PA01
cagucccugccaggg

SEQ ID NO: 1532640 - RNA, 15 nt, Pseudomonas aeruginosa PA01
cagucccuggccggc

SEQ ID NO: 1532641 - RNA, 22 nt, Pseudomonas aeruginosa PA01
cagucgguagaaauccuccgga

SEQ ID NO: 1532642 - RNA, 16 nt, Pseudomonas aeruginosa PA01
cagucgguagagcagu

SEQ ID NO: 1532643 - RNA, 20 nt, Pseudomonas aeruginosa PA01
cagucgucgcgcagcuccuc

SEQ ID NO: 1532644 - RNA, 22 nt, Pseudomonas aeruginosa PA01
cagucgucgcgcagcuccucgg

SEQ ID NO: 1532645 - RNA, 17 nt, Pseudomonas aeruginosa PA01
cagucggccaggcgcca

SEQ ID NO: 1532646 - RNA, 23 nt, Pseudomonas aeruginosa PA01
cagucgcauaaaaaagccccgcu

SEQ ID NO: 1532647 - RNA, 17 nt, Pseudomonas aeruginosa PA01
cagucgcagcucgguga

SEQ ID NO: 1532648 - RNA, 19 nt, Pseudomonas aeruginosa PA01
cagucccagaaggccaggg

SEQ ID NO: 1532649 - RNA, 15 nt, Pseudomonas aeruginosa PA01
caguagucuuccugg

SEQ ID NO: 1532650 - RNA, 18 nt, Pseudomonas aeruginosa PA01
caguagggggugaagcgc

SEQ ID NO: 1532651 - RNA, 19 nt, Pseudomonas aeruginosa PA01
caguaguccuccgcgccca

SEQ ID NO: 1532652 - RNA, 15 nt, Pseudomonas aeruginosa PA01
caguaggccagcggc

SEQ ID NO: 1532653 - RNA, 15 nt, Pseudomonas aeruginosa PA01
caguaggcgcugccg

SEQ ID NO: 1532654 - RNA, 19 nt, Pseudomonas aeruginosa PA01
caguagcuguugugucccg

SEQ ID NO: 1532655 - RNA, 15 nt, Pseudomonas aeruginosa PA01
caguagcggaagcac

SEQ ID NO: 1532656 - RNA, 21 nt, Pseudomonas aeruginosa PA01
caguagcgggcauccagcgga

SEQ ID NO: 1532657 - RNA, 19 nt, Pseudomonas aeruginosa PA01
caguaccuggcgguacagc

SEQ ID NO: 1532658 - RNA, 17 nt, Pseudomonas aeruginosa PA01
caguacgaucagccagg

SEQ ID NO: 1532659 - RNA, 23 nt, Pseudomonas aeruginosa PA01
caguacguggcgcuugagcagcc

SEQ ID NO: 1532660 - RNA, 16 nt, Pseudomonas aeruginosa PA01
caguacgucgagaccg

SEQ ID NO: 1532661 - RNA, 16 nt, Pseudomonas aeruginosa PA01
caguacuuggccagca

SEQ ID NO: 1532662 - RNA, 18 nt, Pseudomonas aeruginosa PA01
caguacuuggccagcagc

SEQ ID NO: 1532663 - RNA, 12 nt, Pseudomonas aeruginosa PA01
caguagaagcag

SEQ ID NO: 1532664 - RNA, 17 nt, Pseudomonas aeruginosa PA01
caggugcacggccaggc

SEQ ID NO: 1532665 - RNA, 19 nt, Pseudomonas aeruginosa PA01
caggugcacggccaggcca

SEQ ID NO: 1532666 - RNA, 21 nt, Pseudomonas aeruginosa PA01
caggugagggcgacccagcgc

SEQ ID NO: 1532667 - RNA, 16 nt, Pseudomonas aeruginosa PA01
caggucuucuggaaau

SEQ ID NO: 1532668 - RNA, 21 nt, Pseudomonas aeruginosa PA01
caggugaaaagcgcugacgaa

SEQ ID NO: 1532669 - RNA, 14 nt, Pseudomonas aeruginosa PA01
caggugcaggaaca

SEQ ID NO: 1532670 - RNA, 15 nt, Pseudomonas aeruginosa PA01
caggugcaggaacag

SEQ ID NO: 1532671 - RNA, 15 nt, Pseudomonas aeruginosa PA01
caggugcgccgagcg

SEQ ID NO: 1532672 - RNA, 19 nt, Pseudomonas aeruginosa PA01
caggugcugguggcccugg

SEQ ID NO: 1532673 - RNA, 20 nt, Pseudomonas aeruginosa PA01
caggugcugguggcccuggg

SEQ ID NO: 1532674 - RNA, 13 nt, Pseudomonas aeruginosa PA01
cagguucagggug

SEQ ID NO: 1532675 - RNA, 23 nt, Pseudomonas aeruginosa PA01
cagguucaucgccgccaggcaga

SEQ ID NO: 1532676 - RNA, 20 nt, Pseudomonas aeruginosa PA01
cagguguucguccagaugcu

SEQ ID NO: 1532677 - RNA, 15 nt, Pseudomonas aeruginosa PA01
cagguggcuuuccag

SEQ ID NO: 1532678 - RNA, 15 nt, Pseudomonas aeruginosa PA01
cagguggcaggccug

SEQ ID NO: 1532679 - RNA, 14 nt, Pseudomonas aeruginosa PA01
cagguggucgaugg

SEQ ID NO: 1532680 - RNA, 20 nt, Pseudomonas aeruginosa PA01
cagguggucguugcgcgcca

SEQ ID NO: 1532681 - RNA, 15 nt, Pseudomonas aeruginosa PA01
cagguggcgcagccg

SEQ ID NO: 1532682 - RNA, 17 nt, Pseudomonas aeruginosa PA01
caggugcuuggcaccgc

SEQ ID NO: 1532683 - RNA, 20 nt, Pseudomonas aeruginosa PA01
caggugcuggacucgcgcca

SEQ ID NO: 1532684 - RNA, 23 nt, Pseudomonas aeruginosa PA01
caggugcuucacgaauacccggu

SEQ ID NO: 1532685 - RNA, 15 nt, Pseudomonas aeruginosa PA01
cagguccuugaucac

SEQ ID NO: 1532686 - RNA, 19 nt, Pseudomonas aeruginosa PA01
cagguccuuguuccugggc

SEQ ID NO: 1532687 - RNA, 13 nt, Pseudomonas aeruginosa PA01
cagguccuggaac

SEQ ID NO: 1532688 - RNA, 12 nt, Pseudomonas aeruginosa PA01
cagguccuggcc

SEQ ID NO: 1532689 - RNA, 21 nt, Pseudomonas aeruginosa PA01
caggucaugcccuggccgacg

SEQ ID NO: 1532690 - RNA, 19 nt, Pseudomonas aeruginosa PA01
cagguccgccacuucaagc

SEQ ID NO: 1532691 - RNA, 14 nt, Pseudomonas aeruginosa PA01
cagguccagcaagg

SEQ ID NO: 1532692 - RNA, 17 nt, Pseudomonas aeruginosa PA01
caggucaucaggaucag

SEQ ID NO: 1532693 - RNA, 17 nt, Pseudomonas aeruginosa PA01
caggggcgcggcgcgga

SEQ ID NO: 1532694 - RNA, 17 nt, Pseudomonas aeruginosa PA01
caggggcgagagacuga

SEQ ID NO: 1532695 - RNA, 15 nt, Pseudomonas aeruginosa PA01
caggggcugaacagc

SEQ ID NO: 1532696 - RNA, 18 nt, Pseudomonas aeruginosa PA01
caggggcugaacagcgcc

SEQ ID NO: 1532697 - RNA, 19 nt, Pseudomonas aeruginosa PA01
caggggcugaacagcgcca

SEQ ID NO: 1532698 - RNA, 20 nt, Pseudomonas aeruginosa PA01
cagguauucgccggccaggu

SEQ ID NO: 1532699 - RNA, 19 nt, Pseudomonas aeruginosa PA01
cagggguucgaguccccua

SEQ ID NO: 1532700 - RNA, 19 nt, Pseudomonas aeruginosa PA01
caggucgccgcacaccgcg

SEQ ID NO: 1532701 - RNA, 20 nt, Pseudomonas aeruginosa PA01
caggucgcgcggcgccugcu

SEQ ID NO: 1532702 - RNA, 13 nt, Pseudomonas aeruginosa PA01
caggucgcggaag

SEQ ID NO: 1532703 - RNA, 17 nt, Pseudomonas aeruginosa PA01
caggucgcggagccaac

SEQ ID NO: 1532704 - RNA, 14 nt, Pseudomonas aeruginosa PA01
caggucgcgcaggg

SEQ ID NO: 1532705 - RNA, 18 nt, Pseudomonas aeruginosa PA01
caggucgcgcaguucguc

SEQ ID NO: 1532706 - RNA, 16 nt, Pseudomonas aeruginosa PA01
caggucgccagcgccu

SEQ ID NO: 1532707 - RNA, 23 nt, Pseudomonas aeruginosa PA01
caggucgcccugcagcgcgcgcu

SEQ ID NO: 1532708 - RNA, 23 nt, Pseudomonas aeruginosa PA01
caggucgacaugcaccaggccgc

SEQ ID NO: 1532709 - RNA, 16 nt, Pseudomonas aeruginosa PA01
caggucgacgccaugg

SEQ ID NO: 1532710 - RNA, 18 nt, Pseudomonas aeruginosa PA01
caggucgacgccauggcg

SEQ ID NO: 1532711 - RNA, 16 nt, Pseudomonas aeruginosa PA01
caggucgacgccgccg

SEQ ID NO: 1532712 - RNA, 22 nt, Pseudomonas aeruginosa PA01
caggucgacgaccuugcccacc

SEQ ID NO: 1532713 - RNA, 22 nt, Pseudomonas aeruginosa PA01
caggucgagacgcgggcccagc

SEQ ID NO: 1532714 - RNA, 17 nt, Pseudomonas aeruginosa PA01
caggucgagcaguuccg

SEQ ID NO: 1532715 - RNA, 17 nt, Pseudomonas aeruginosa PA01
caggucgaggcgcucca

SEQ ID NO: 1532716 - RNA, 18 nt, Pseudomonas aeruginosa PA01
caggucgauccccaaccc

SEQ ID NO: 1532717 - RNA, 23 nt, Pseudomonas aeruginosa PA01
caggucgauccccaacccggcca

SEQ ID NO: 1532718 - RNA, 21 nt, Pseudomonas aeruginosa PA01
caggucgauccugaccccggc

SEQ ID NO: 1532719 - RNA, 23 nt, Pseudomonas aeruginosa PA01
caggucgauccugaccccggccu

SEQ ID NO: 1532720 - RNA, 18 nt, Pseudomonas aeruginosa PA01
caggucggcgaaauccuc

SEQ ID NO: 1532721 - RNA, 19 nt, Pseudomonas aeruginosa PA01
caggucggcgaaauccucg

SEQ ID NO: 1532722 - RNA, 13 nt, Pseudomonas aeruginosa PA01
caggucggacagg

SEQ ID NO: 1532723 - RNA, 14 nt, Pseudomonas aeruginosa PA01
caggucggacaggc

SEQ ID NO: 1532724 - RNA, 23 nt, Pseudomonas aeruginosa PA01
caggucgcuggcaccggccaggc

SEQ ID NO: 1532725 - RNA, 16 nt, Pseudomonas aeruginosa PA01
caggucgcuguccucc

SEQ ID NO: 1532726 - RNA, 15 nt, Pseudomonas aeruginosa PA01
caggucggucggcgg

SEQ ID NO: 1532727 - RNA, 21 nt, Pseudomonas aeruginosa PA01
caggucgucgaggaucuucuc

SEQ ID NO: 1532728 - RNA, 14 nt, Pseudomonas aeruginosa PA01
caggucgugcagcc

SEQ ID NO: 1532729 - RNA, 15 nt, Pseudomonas aeruginosa PA01
caggucguggaaggc

SEQ ID NO: 1532730 - RNA, 17 nt, Pseudomonas aeruginosa PA01
caggucguugcgccggc

SEQ ID NO: 1532731 - RNA, 20 nt, Pseudomonas aeruginosa PA01
aaacaacgaaguguuacagc

SEQ ID NO: 1532732 - RNA, 14 nt, Pseudomonas aeruginosa PA01
cagguuggucugcu

SEQ ID NO: 1532733 - RNA, 14 nt, Pseudomonas aeruginosa PA01
cagguuguccaggg

SEQ ID NO: 1532734 - RNA, 14 nt, Pseudomonas aeruginosa PA01
cagguuggacaggu

SEQ ID NO: 1532735 - RNA, 14 nt, Pseudomonas aeruginosa PA01
cagguugcucgccu

SEQ ID NO: 1532736 - RNA, 16 nt, Pseudomonas aeruginosa PA01
cagguuggccuggccc

SEQ ID NO: 1532737 - RNA, 13 nt, Pseudomonas aeruginosa PA01
cagguuggccagu

SEQ ID NO: 1532738 - RNA, 21 nt, Pseudomonas aeruginosa PA01
cagguuggccccgccgaggaa

SEQ ID NO: 1532739 - RNA, 17 nt, Pseudomonas aeruginosa PA01
cagguucugccagagcg

SEQ ID NO: 1532740 - RNA, 13 nt, Pseudomonas aeruginosa PA01
cagguuccuccug

SEQ ID NO: 1532741 - RNA, 15 nt, Pseudomonas aeruginosa PA01
cagguuccuccuggg

SEQ ID NO: 1532742 - RNA, 16 nt, Pseudomonas aeruginosa PA01
cagguuccuccugggc

SEQ ID NO: 1532743 - RNA, 17 nt, Pseudomonas aeruginosa PA01
cagguuccuccugggcc

SEQ ID NO: 1532744 - RNA, 19 nt, Pseudomonas aeruginosa PA01
cagguugcgcaaccagcgc

SEQ ID NO: 1532745 - RNA, 24 nt, Pseudomonas aeruginosa PA01
cagguugauccugggcgccagccg

SEQ ID NO: 1532746 - RNA, 20 nt, Pseudomonas aeruginosa PA01
cagguugaagagcagcacca

SEQ ID NO: 1532747 - RNA, 21 nt, Pseudomonas aeruginosa PA01
cagguugaagaacggcccgcu

SEQ ID NO: 1532748 - RNA, 19 nt, Pseudomonas aeruginosa PA01
cagguugaccccgcggccg

SEQ ID NO: 1532749 - RNA, 12 nt, Pseudomonas aeruginosa PA01
caguaccagcaa

SEQ ID NO: 1532750 - RNA, 19 nt, Pseudomonas aeruginosa PA01
caguaacgccugucgcucc

SEQ ID NO: 1532751 - RNA, 14 nt, Pseudomonas aeruginosa PA01
ccaaagaaaaggcc

SEQ ID NO: 1532752 - RNA, 21 nt, Pseudomonas aeruginosa PA01
ccaagguacggggcugcggcc

SEQ ID NO: 1532753 - RNA, 14 nt, Pseudomonas aeruginosa PA01
ccaaggggccgcgc

SEQ ID NO: 1532754 - RNA, 21 nt, Pseudomonas aeruginosa PA01
ccaagggccugggcgccgcca

SEQ ID NO: 1532755 - RNA, 15 nt, Pseudomonas aeruginosa PA01
ccaagggcgccgccg

SEQ ID NO: 1532756 - RNA, 12 nt, Pseudomonas aeruginosa PA01
ccaacuccagcu

SEQ ID NO: 1532757 - RNA, 19 nt, Pseudomonas aeruginosa PA01
ccaacucagucgagguaga

SEQ ID NO: 1532758 - RNA, 13 nt, Pseudomonas aeruginosa PA01
ccaaccucucccc

SEQ ID NO: 1532759 - RNA, 17 nt, Pseudomonas aeruginosa PA01
ccaaagccuggagcagg

SEQ ID NO: 1532760 - RNA, 14 nt, Pseudomonas aeruginosa PA01
ccaaccaccggcgc

SEQ ID NO: 1532761 - RNA, 14 nt, Pseudomonas aeruginosa PA01
ccaacccggccagc

SEQ ID NO: 1532762 - RNA, 19 nt, Pseudomonas aeruginosa PA01
ccaccgugcccgccggcgc

SEQ ID NO: 1532763 - RNA, 15 nt, Pseudomonas aeruginosa PA01
ccaccgucuggcgca

SEQ ID NO: 1532764 - RNA, 12 nt, Pseudomonas aeruginosa PA01
ccaccguggcgc

SEQ ID NO: 1532765 - RNA, 16 nt, Pseudomonas aeruginosa PA01
ccaccgugcgcaccuc

SEQ ID NO: 1532766 - RNA, 13 nt, Pseudomonas aeruginosa PA01
ccaccggccgcgc

SEQ ID NO: 1532767 - RNA, 16 nt, Pseudomonas aeruginosa PA01
ccaccgcgcgcccucg

SEQ ID NO: 1532768 - RNA, 24 nt, Pseudomonas aeruginosa PA01
ccaccgcgggggucggaugcagcg

SEQ ID NO: 1532769 - RNA, 18 nt, Pseudomonas aeruginosa PA01
ccaccgcggccucgcugg

SEQ ID NO: 1532770 - RNA, 19 nt, Pseudomonas aeruginosa PA01
ccaccgcuuucagcgccgc

SEQ ID NO: 1532771 - RNA, 21 nt, Pseudomonas aeruginosa PA01
ccaccggaucgcccuggcgcc

SEQ ID NO: 1532772 - RNA, 21 nt, Pseudomonas aeruginosa PA01
ccacgaacaggcugugcgcca

SEQ ID NO: 1532773 - RNA, 23 nt, Pseudomonas aeruginosa PA01
ccacgcaggaacagcuccuccag

SEQ ID NO: 1532774 - RNA, 18 nt, Pseudomonas aeruginosa PA01
ccacgcaggccagcgcca

SEQ ID NO: 1532775 - RNA, 18 nt, Pseudomonas aeruginosa PA01
ccacgaaaaagcccggca

SEQ ID NO: 1532776 - RNA, 15 nt, Pseudomonas aeruginosa PA01
ccaccuguuccacga

SEQ ID NO: 1532777 - RNA, 13 nt, Pseudomonas aeruginosa PA01
ccaccuguagcag

SEQ ID NO: 1532778 - RNA, 16 nt, Pseudomonas aeruginosa PA01
ccaccuugccgcgccc

SEQ ID NO: 1532779 - RNA, 12 nt, Pseudomonas aeruginosa PA01
ccaccuucuaca

SEQ ID NO: 1532780 - RNA, 21 nt, Pseudomonas aeruginosa PA01
ccaccugguaggucacuuccg

SEQ ID NO: 1532781 - RNA, 22 nt, Pseudomonas aeruginosa PA01
ccaccugguaggucacuuccgu

SEQ ID NO: 1532782 - RNA, 18 nt, Pseudomonas aeruginosa PA01
ccaccugcggguggccuu

SEQ ID NO: 1532783 - RNA, 21 nt, Pseudomonas aeruginosa PA01
ccaccaacggcguguccaggg

SEQ ID NO: 1532784 - RNA, 15 nt, Pseudomonas aeruginosa PA01
ccaccaccacgaucu

SEQ ID NO: 1532785 - RNA, 12 nt, Pseudomonas aeruginosa PA01
ccacccagcagc

SEQ ID NO: 1532786 - RNA, 15 nt, Pseudomonas aeruginosa PA01
ccaccagcguggcgc

SEQ ID NO: 1532787 - RNA, 15 nt, Pseudomonas aeruginosa PA01
ccacccgcgggcagc

SEQ ID NO: 1532788 - RNA, 20 nt, Pseudomonas aeruginosa PA01
ccacccgcucgaccuugccg

SEQ ID NO: 1532789 - RNA, 23 nt, Pseudomonas aeruginosa PA01
ccacccgcaucgaggccgcccag

SEQ ID NO: 1532790 - RNA, 23 nt, Pseudomonas aeruginosa PA01
ccacccccgcaaccgcugccgcc

SEQ ID NO: 1532791 - RNA, 18 nt, Pseudomonas aeruginosa PA01
ccacccccggcccggcca

SEQ ID NO: 1532792 - RNA, 14 nt, Pseudomonas aeruginosa PA01
ccaccgauggcgcg

SEQ ID NO: 1532793 - RNA, 22 nt, Pseudomonas aeruginosa PA01
ccaccgagagcggcgccaggcg

SEQ ID NO: 1532794 - RNA, 13 nt, Pseudomonas aeruginosa PA01
ccacccggcgccc

SEQ ID NO: 1532795 - RNA, 17 nt, Pseudomonas aeruginosa PA01
ccaccgacggcuccgga

SEQ ID NO: 1532796 - RNA, 23 nt, Pseudomonas aeruginosa PA01
ccacccgcuccgcggccggcuuc

SEQ ID NO: 1532797 - RNA, 17 nt, Pseudomonas aeruginosa PA01
ccaccgacgccggacgc

SEQ ID NO: 1532798 - RNA, 20 nt, Pseudomonas aeruginosa PA01
ccacaaggugggcagcagcg

SEQ ID NO: 1532799 - RNA, 15 nt, Pseudomonas aeruginosa PA01
ccacauccuugccgu

SEQ ID NO: 1532800 - RNA, 15 nt, Pseudomonas aeruginosa PA01
ccacaucggccaguc

SEQ ID NO: 1532801 - RNA, 16 nt, Pseudomonas aeruginosa PA01
ccacaguuucauggug

SEQ ID NO: 1532802 - RNA, 16 nt, Pseudomonas aeruginosa PA01
ccacagugccaggcuc

SEQ ID NO: 1532803 - RNA, 17 nt, Pseudomonas aeruginosa PA01
ccacuggcggaccgccu

SEQ ID NO: 1532804 - RNA, 18 nt, Pseudomonas aeruginosa PA01
ccacuggcggaccgccuc

SEQ ID NO: 1532805 - RNA, 18 nt, Pseudomonas aeruginosa PA01
ccacugcgcgccagucca

SEQ ID NO: 1532806 - RNA, 15 nt, Pseudomonas aeruginosa PA01
ccacugcuuggccag

SEQ ID NO: 1532807 - RNA, 19 nt, Pseudomonas aeruginosa PA01
ccacuucguccggccgccc

SEQ ID NO: 1532808 - RNA, 17 nt, Pseudomonas aeruginosa PA01
ccacuuccggcccggcc

SEQ ID NO: 1532809 - RNA, 18 nt, Pseudomonas aeruginosa PA01
ccacuuccggcccggcca

SEQ ID NO: 1532810 - RNA, 15 nt, Pseudomonas aeruginosa PA01
ccacuuccagcacgc

SEQ ID NO: 1532811 - RNA, 15 nt, Pseudomonas aeruginosa PA01
ccacuugccgccgcc

SEQ ID NO: 1532812 - RNA, 12 nt, Pseudomonas aeruginosa PA01
ccacuugcgccg

SEQ ID NO: 1532813 - RNA, 17 nt, Pseudomonas aeruginosa PA01
ccacuugaacaccgugg

SEQ ID NO: 1532814 - RNA, 14 nt, Pseudomonas aeruginosa PA01
ccagaaucucccgc

SEQ ID NO: 1532815 - RNA, 14 nt, Pseudomonas aeruginosa PA01
ccagaaggccaggg

SEQ ID NO: 1532816 - RNA, 15 nt, Pseudomonas aeruginosa PA01
ccagaaggccagggc

SEQ ID NO: 1532817 - RNA, 16 nt, Pseudomonas aeruginosa PA01
ccagaagucgcuggcc

SEQ ID NO: 1532818 - RNA, 12 nt, Pseudomonas aeruginosa PA01
ccagaagcccca

SEQ ID NO: 1532819 - RNA, 21 nt, Pseudomonas aeruginosa PA01
ccagaagaucgccugcuggcc

SEQ ID NO: 1532820 - RNA, 17 nt, Pseudomonas aeruginosa PA01
ccagaacaccugcgugg

SEQ ID NO: 1532821 - RNA, 21 nt, Pseudomonas aeruginosa PA01
ccagaacaccugcguggcgaa

SEQ ID NO: 1532822 - RNA, 22 nt, Pseudomonas aeruginosa PA01
ccagaacgaaaaaggcgcgccg

SEQ ID NO: 1532823 - RNA, 13 nt, Pseudomonas aeruginosa PA01
ccagaacagcaaa

SEQ ID NO: 1532824 - RNA, 20 nt, Pseudomonas aeruginosa PA01
ccagaugaaacugcccggcu

SEQ ID NO: 1532825 - RNA, 16 nt, Pseudomonas aeruginosa PA01
ccagaugaucaggccg

SEQ ID NO: 1532826 - RNA, 19 nt, Pseudomonas aeruginosa PA01
ccagaucgccaccccgccg

SEQ ID NO: 1532827 - RNA, 15 nt, Pseudomonas aeruginosa PA01
ccagaucgccagcgc

SEQ ID NO: 1532828 - RNA, 17 nt, Pseudomonas aeruginosa PA01
ccagaucgccagcgcca

SEQ ID NO: 1532829 - RNA, 20 nt, Pseudomonas aeruginosa PA01
ccagaucauguagagcaggc

SEQ ID NO: 1532830 - RNA, 20 nt, Pseudomonas aeruginosa PA01
ccagagugcgcagcagcguc

SEQ ID NO: 1532831 - RNA, 22 nt, Pseudomonas aeruginosa PA01
ccagaguucgcccagcucgccg

SEQ ID NO: 1532832 - RNA, 18 nt, Pseudomonas aeruginosa PA01
ccagaguugccuguccag

SEQ ID NO: 1532833 - RNA, 20 nt, Pseudomonas aeruginosa PA01
ccagaguugccuguccagcu

SEQ ID NO: 1532834 - RNA, 14 nt, Pseudomonas aeruginosa PA01
ccagacgcucggcc

SEQ ID NO: 1532835 - RNA, 17 nt, Pseudomonas aeruginosa PA01
ccagacgcucggccagc

SEQ ID NO: 1532836 - RNA, 18 nt, Pseudomonas aeruginosa PA01
ccagacgcucggccagcg

SEQ ID NO: 1532837 - RNA, 11 nt, Pseudomonas aeruginosa PA01
ccagacgccgc

SEQ ID NO: 1532838 - RNA, 14 nt, Pseudomonas aeruginosa PA01
ccagaccggcagcg

SEQ ID NO: 1532839 - RNA, 16 nt, Pseudomonas aeruginosa PA01
ccagaccggcagcgcc

SEQ ID NO: 1532840 - RNA, 15 nt, Pseudomonas aeruginosa PA01
ccagaccuccaggua

SEQ ID NO: 1532841 - RNA, 15 nt, Pseudomonas aeruginosa PA01
ccagaccugccgccc

SEQ ID NO: 1532842 - RNA, 20 nt, Pseudomonas aeruginosa PA01
ccagaccuggccgcugugga

SEQ ID NO: 1532843 - RNA, 17 nt, Pseudomonas aeruginosa PA01
ccagacaggccagcucg

SEQ ID NO: 1532844 - RNA, 22 nt, Pseudomonas aeruginosa PA01
ccagacauccggguccagcggc

SEQ ID NO: 1532845 - RNA, 15 nt, Pseudomonas aeruginosa PA01
ccagacagcccucca

SEQ ID NO: 1532846 - RNA, 17 nt, Pseudomonas aeruginosa PA01
ccagaccagcaggaaaa

SEQ ID NO: 1532847 - RNA, 20 nt, Pseudomonas aeruginosa PA01
ccagaccagccccagucccu

SEQ ID NO: 1532848 - RNA, 15 nt, Pseudomonas aeruginosa PA01
ccagaccccggcgau

SEQ ID NO: 1532849 - RNA, 17 nt, Pseudomonas aeruginosa PA01
ccagaggcugcgcucca

SEQ ID NO: 1532850 - RNA, 18 nt, Pseudomonas aeruginosa PA01
ccagaggcugcgcuccag

SEQ ID NO: 1532851 - RNA, 15 nt, Pseudomonas aeruginosa PA01
ccagaggaucggcca

SEQ ID NO: 1532852 - RNA, 21 nt, Pseudomonas aeruginosa PA01
ccagaggcauucaucaccagc

SEQ ID NO: 1532853 - RNA, 14 nt, Pseudomonas aeruginosa PA01
ccagagcuugagga

SEQ ID NO: 1532854 - RNA, 20 nt, Pseudomonas aeruginosa PA01
ccagagcccgccgaacagca

SEQ ID NO: 1532855 - RNA, 19 nt, Pseudomonas aeruginosa PA01
ccagagccagucgagagcg

SEQ ID NO: 1532856 - RNA, 21 nt, Pseudomonas aeruginosa PA01
ccagagcccgucgaagccagg

SEQ ID NO: 1532857 - RNA, 15 nt, Pseudomonas aeruginosa PA01
ccagacuuccgggcu

SEQ ID NO: 1532858 - RNA, 16 nt, Pseudomonas aeruginosa PA01
ccagagcagcaccagc

SEQ ID NO: 1532859 - RNA, 23 nt, Pseudomonas aeruginosa PA01
ccagcagcacgcccugggacagg

SEQ ID NO: 1532860 - RNA, 12 nt, Pseudomonas aeruginosa PA01
ccagcagcaaca

SEQ ID NO: 1532861 - RNA, 19 nt, Pseudomonas aeruginosa PA01
ccagcagcaacagcgccgc

SEQ ID NO: 1532862 - RNA, 13 nt, Pseudomonas aeruginosa PA01
ccagcagcaccau

SEQ ID NO: 1532863 - RNA, 17 nt, Pseudomonas aeruginosa PA01
ccagcagcaggccggcg

SEQ ID NO: 1532864 - RNA, 18 nt, Pseudomonas aeruginosa PA01
ccagcagcaucggaccgg

SEQ ID NO: 1532865 - RNA, 13 nt, Pseudomonas aeruginosa PA01
ccagcagcagcgg

SEQ ID NO: 1532866 - RNA, 15 nt, Pseudomonas aeruginosa PA01
ccagcagcuccaugu

SEQ ID NO: 1532867 - RNA, 16 nt, Pseudomonas aeruginosa PA01
ccagcagcggcggcgc

SEQ ID NO: 1532868 - RNA, 14 nt, Pseudomonas aeruginosa PA01
ccagcagcggcagc

SEQ ID NO: 1532869 - RNA, 17 nt, Pseudomonas aeruginosa PA01
ccagcagcgcacgcuuc

SEQ ID NO: 1532870 - RNA, 16 nt, Pseudomonas aeruginosa PA01
ccagcagcgcaccauc

SEQ ID NO: 1532871 - RNA, 17 nt, Pseudomonas aeruginosa PA01
ccagcaccucgccgucg

SEQ ID NO: 1532872 - RNA, 17 nt, Pseudomonas aeruginosa PA01
ccagcaccguggucagc

SEQ ID NO: 1532873 - RNA, 20 nt, Pseudomonas aeruginosa PA01
ccagcaccucccccagcggg

SEQ ID NO: 1532874 - RNA, 22 nt, Pseudomonas aeruginosa PA01
ccagcaccggcggcgccaggcc

SEQ ID NO: 1532875 - RNA, 21 nt, Pseudomonas aeruginosa PA01
ccagcaccuggacgaaugccc

SEQ ID NO: 1532876 - RNA, 18 nt, Pseudomonas aeruginosa PA01
ccagcaccuggcagugcg

SEQ ID NO: 1532877 - RNA, 14 nt, Pseudomonas aeruginosa PA01
ccagcaccgccugc

SEQ ID NO: 1532878 - RNA, 17 nt, Pseudomonas aeruginosa PA01
ccagcaccgccugcaac

SEQ ID NO: 1532879 - RNA, 18 nt, Pseudomonas aeruginosa PA01
ccagcaccgccugcaacu

SEQ ID NO: 1532880 - RNA, 16 nt, Pseudomonas aeruginosa PA01
ccagcaccgagcugau

SEQ ID NO: 1532881 - RNA, 21 nt, Pseudomonas aeruginosa PA01
ccagcacggugaaccaggcgc

SEQ ID NO: 1532882 - RNA, 19 nt, Pseudomonas aeruginosa PA01
ccagcacggaugcccagcc

SEQ ID NO: 1532883 - RNA, 14 nt, Pseudomonas aeruginosa PA01
ccagcacucgcucc

SEQ ID NO: 1532884 - RNA, 15 nt, Pseudomonas aeruginosa PA01
ccagcaacgccgccc

SEQ ID NO: 1532885 - RNA, 17 nt, Pseudomonas aeruginosa PA01
ccagcaacgccgccccc

SEQ ID NO: 1532886 - RNA, 16 nt, Pseudomonas aeruginosa PA01
ccagcaacgccuucug

SEQ ID NO: 1532887 - RNA, 17 nt, Pseudomonas aeruginosa PA01
ccagcaacaccggaagc

SEQ ID NO: 1532888 - RNA, 16 nt, Pseudomonas aeruginosa PA01
ccagcaacaguugccg

SEQ ID NO: 1532889 - RNA, 20 nt, Pseudomonas aeruginosa PA01
ccagcaacaguugccgcagc

SEQ ID NO: 1532890 - RNA, 15 nt, Pseudomonas aeruginosa PA01
ccagcaacggcaucg

SEQ ID NO: 1532891 - RNA, 17 nt, Pseudomonas aeruginosa PA01
ccagcaacggcaucgcu

SEQ ID NO: 1532892 - RNA, 17 nt, Pseudomonas aeruginosa PA01
ccagcaacgggucgggc

SEQ ID NO: 1532893 - RNA, 17 nt, Pseudomonas aeruginosa PA01
ccagcaaacgggacagg

SEQ ID NO: 1532894 - RNA, 16 nt, Pseudomonas aeruginosa PA01
ccagcaaacccgggcc

SEQ ID NO: 1532895 - RNA, 18 nt, Pseudomonas aeruginosa PA01
ccagcaaacccgggccca

SEQ ID NO: 1532896 - RNA, 18 nt, Pseudomonas aeruginosa PA01
ccagcaacaaaccucgag

SEQ ID NO: 1532897 - RNA, 15 nt, Pseudomonas aeruginosa PA01
ccagcaccacccggc

SEQ ID NO: 1532898 - RNA, 16 nt, Pseudomonas aeruginosa PA01
ccagcaccacccggcc

SEQ ID NO: 1532899 - RNA, 15 nt, Pseudomonas aeruginosa PA01
ccagcacccagucuu

SEQ ID NO: 1532900 - RNA, 19 nt, Pseudomonas aeruginosa PA01
ccagcaccaucggguugau

SEQ ID NO: 1532901 - RNA, 14 nt, Pseudomonas aeruginosa PA01
ccagcaccagcagg

SEQ ID NO: 1532902 - RNA, 15 nt, Pseudomonas aeruginosa PA01
ccagcaccagcagga

SEQ ID NO: 1532903 - RNA, 16 nt, Pseudomonas aeruginosa PA01
ccagcaccagcaggag

SEQ ID NO: 1532904 - RNA, 19 nt, Pseudomonas aeruginosa PA01
ccagcaaggugcgggcgac

SEQ ID NO: 1532905 - RNA, 12 nt, Pseudomonas aeruginosa PA01
ccagcaagccgu

SEQ ID NO: 1532906 - RNA, 21 nt, Pseudomonas aeruginosa PA01
ccagcaaugccagcgccacgc

SEQ ID NO: 1532907 - RNA, 21 nt, Pseudomonas aeruginosa PA01
ccagcaauuccacgcgacagc

SEQ ID NO: 1532908 - RNA, 19 nt, Pseudomonas aeruginosa PA01
ccagcaauugccgcugcac

SEQ ID NO: 1532909 - RNA, 21 nt, Pseudomonas aeruginosa PA01
ccagcaauugccgcugcacgc

SEQ ID NO: 1532910 - RNA, 22 nt, Pseudomonas aeruginosa PA01
ccagcaauugccgcugcacgcc

SEQ ID NO: 1532911 - RNA, 17 nt, Pseudomonas aeruginosa PA01
ccagcaauugccggcgu

SEQ ID NO: 1532912 - RNA, 11 nt, Pseudomonas aeruginosa PA01
ccagccagccc

SEQ ID NO: 1532913 - RNA, 14 nt, Pseudomonas aeruginosa PA01
ccagccagcccgca

SEQ ID NO: 1532914 - RNA, 15 nt, Pseudomonas aeruginosa PA01
ccagccagcccggcg

SEQ ID NO: 1532915 - RNA, 17 nt, Pseudomonas aeruginosa PA01
ccagccacucccggccc

SEQ ID NO: 1532916 - RNA, 15 nt, Pseudomonas aeruginosa PA01
ccagccagccgcgcg

SEQ ID NO: 1532917 - RNA, 21 nt, Pseudomonas aeruginosa PA01
ccagccaggaagagcccgcca

SEQ ID NO: 1532918 - RNA, 17 nt, Pseudomonas aeruginosa PA01
ccagccagcgcggcucg

SEQ ID NO: 1532919 - RNA, 16 nt, Pseudomonas aeruginosa PA01
ccagccagggcagcag

SEQ ID NO: 1532920 - RNA, 15 nt, Pseudomonas aeruginosa PA01
ccagccagggccgcg

SEQ ID NO: 1532921 - RNA, 15 nt, Pseudomonas aeruginosa PA01
ccagccagugcaugc

SEQ ID NO: 1532922 - RNA, 14 nt, Pseudomonas aeruginosa PA01
ccagccgagcaacu

SEQ ID NO: 1532923 - RNA, 14 nt, Pseudomonas aeruginosa PA01
ccagccgaggcagc

SEQ ID NO: 1532924 - RNA, 14 nt, Pseudomonas aeruginosa PA01
ccagccgcacgccc

SEQ ID NO: 1532925 - RNA, 20 nt, Pseudomonas aeruginosa PA01
ccagcccuggaaaggccucg

SEQ ID NO: 1532926 - RNA, 14 nt, Pseudomonas aeruginosa PA01
ccagcccuggcgca

SEQ ID NO: 1532927 - RNA, 14 nt, Pseudomonas aeruginosa PA01
ccagcccuggcgcg

SEQ ID NO: 1532928 - RNA, 14 nt, Pseudomonas aeruginosa PA01
ccagcccguagucg

SEQ ID NO: 1532929 - RNA, 13 nt, Pseudomonas aeruginosa PA01
ccagcccggcucg

SEQ ID NO: 1532930 - RNA, 17 nt, Pseudomonas aeruginosa PA01
ccagcccggccauccug

SEQ ID NO: 1532931 - RNA, 12 nt, Pseudomonas aeruginosa PA01
ccagcccggccu

SEQ ID NO: 1532932 - RNA, 13 nt, Pseudomonas aeruginosa PA01
ccagcccagaaca

SEQ ID NO: 1532933 - RNA, 15 nt, Pseudomonas aeruginosa PA01
ccagcccaguucguu

SEQ ID NO: 1532934 - RNA, 20 nt, Pseudomonas aeruginosa PA01
ccagccauugcgccaggacc

SEQ ID NO: 1532935 - RNA, 13 nt, Pseudomonas aeruginosa PA01
ccagccccacugg

SEQ ID NO: 1532936 - RNA, 9 nt, Pseudomonas aeruginosa PA01
ccagccccc

SEQ ID NO: 1532937 - RNA, 16 nt, Pseudomonas aeruginosa PA01
ccagcccccucgcccu

SEQ ID NO: 1532938 - RNA, 18 nt, Pseudomonas aeruginosa PA01
ccagccccugcggaccgc

SEQ ID NO: 1532939 - RNA, 15 nt, Pseudomonas aeruginosa PA01
ccagcaggucggcgc

SEQ ID NO: 1532940 - RNA, 17 nt, Pseudomonas aeruginosa PA01
ccagcagucgcacagcc

SEQ ID NO: 1532941 - RNA, 22 nt, Pseudomonas aeruginosa PA01
ccagcagucgcacagccagggg

SEQ ID NO: 1532942 - RNA, 17 nt, Pseudomonas aeruginosa PA01
ccagcagucgcggcccu

SEQ ID NO: 1532943 - RNA, 15 nt, Pseudomonas aeruginosa PA01
ccagcaguugcaaca

SEQ ID NO: 1532944 - RNA, 14 nt, Pseudomonas aeruginosa PA01
ccagcagguacagc

SEQ ID NO: 1532945 - RNA, 23 nt, Pseudomonas aeruginosa PA01
ccagcagguagccugcggccagc

SEQ ID NO: 1532946 - RNA, 17 nt, Pseudomonas aeruginosa PA01
ccagcaggccgagcccg

SEQ ID NO: 1532947 - RNA, 20 nt, Pseudomonas aeruginosa PA01
ccagcaggccgagcccgagu

SEQ ID NO: 1532948 - RNA, 18 nt, Pseudomonas aeruginosa PA01
ccagcaggccgaucagcg

SEQ ID NO: 1532949 - RNA, 22 nt, Pseudomonas aeruginosa PA01
ccagcaggccgugggccggcgc

SEQ ID NO: 1532950 - RNA, 18 nt, Pseudomonas aeruginosa PA01
ccagcaggcgcagcagcg

SEQ ID NO: 1532951 - RNA, 23 nt, Pseudomonas aeruginosa PA01
ccagcaggcgcaggucggccucg

SEQ ID NO: 1532952 - RNA, 17 nt, Pseudomonas aeruginosa PA01
ccagcaggcgcgggcug

SEQ ID NO: 1532953 - RNA, 21 nt, Pseudomonas aeruginosa PA01
ccagcaggaugcugcacagcc

SEQ ID NO: 1532954 - RNA, 23 nt, Pseudomonas aeruginosa PA01
ccagcaggaaaacgcucaggcca

SEQ ID NO: 1532955 - RNA, 15 nt, Pseudomonas aeruginosa PA01
ccagcaggcccagcc

SEQ ID NO: 1532956 - RNA, 14 nt, Pseudomonas aeruginosa PA01
ccagcaggccagcc

SEQ ID NO: 1532957 - RNA, 15 nt, Pseudomonas aeruginosa PA01
ccagcaggcaggcgc

SEQ ID NO: 1532958 - RNA, 14 nt, Pseudomonas aeruginosa PA01
ccagcagggccgcc

SEQ ID NO: 1532959 - RNA, 20 nt, Pseudomonas aeruginosa PA01
ccagcaggcguugcagugcg

SEQ ID NO: 1532960 - RNA, 18 nt, Pseudomonas aeruginosa PA01
ccagcaggguggccaggg

SEQ ID NO: 1532961 - RNA, 19 nt, Pseudomonas aeruginosa PA01
ccagcagggucgccugggu

SEQ ID NO: 1532962 - RNA, 15 nt, Pseudomonas aeruginosa PA01
ccagcagggccagca

SEQ ID NO: 1532963 - RNA, 17 nt, Pseudomonas aeruginosa PA01
ccagcagggccagcagc

SEQ ID NO: 1532964 - RNA, 18 nt, Pseudomonas aeruginosa PA01
ccagcagggccagcagcg

SEQ ID NO: 1532965 - RNA, 18 nt, Pseudomonas aeruginosa PA01
ccagcagggccagccaga

SEQ ID NO: 1532966 - RNA, 15 nt, Pseudomonas aeruginosa PA01
ccagcagggccagcg

SEQ ID NO: 1532967 - RNA, 15 nt, Pseudomonas aeruginosa PA01
ccagcagggccaggc

SEQ ID NO: 1532968 - RNA, 16 nt, Pseudomonas aeruginosa PA01
ccagcagggccaggcc

SEQ ID NO: 1532969 - RNA, 17 nt, Pseudomonas aeruginosa PA01
ccagcagggccaggccg

SEQ ID NO: 1532970 - RNA, 14 nt, Pseudomonas aeruginosa PA01
ccagcaugcccagc

SEQ ID NO: 1532971 - RNA, 22 nt, Pseudomonas aeruginosa PA01
ccagcauguccugcaggcucag

SEQ ID NO: 1532972 - RNA, 19 nt, Pseudomonas aeruginosa PA01
ccagcaucagcaggaagcu

SEQ ID NO: 1532973 - RNA, 20 nt, Pseudomonas aeruginosa PA01
ccagcaucagcaggaagcug

SEQ ID NO: 1532974 - RNA, 22 nt, Pseudomonas aeruginosa PA01
ccagcaucaugaucugguagac

SEQ ID NO: 1532975 - RNA, 22 nt, Pseudomonas aeruginosa PA01
cauagaaacgcagggccucuuc

SEQ ID NO: 1532976 - RNA, 13 nt, Pseudomonas aeruginosa PA01
cauagaccagcag

SEQ ID NO: 1532977 - RNA, 15 nt, Pseudomonas aeruginosa PA01
cauagaccagcagcg

SEQ ID NO: 1532978 - RNA, 16 nt, Pseudomonas aeruginosa PA01
cauagaugccgcccug

SEQ ID NO: 1532979 - RNA, 22 nt, Pseudomonas aeruginosa PA01
cagugcaucggccgccaggcug

SEQ ID NO: 1532980 - RNA, 12 nt, Pseudomonas aeruginosa PA01
cauaggucaggu

SEQ ID NO: 1532981 - RNA, 18 nt, Pseudomonas aeruginosa PA01
cauaggaggcgcuuuccc

SEQ ID NO: 1532982 - RNA, 13 nt, Pseudomonas aeruginosa PA01
cauagcgcagcac

SEQ ID NO: 1532983 - RNA, 15 nt, Pseudomonas aeruginosa PA01
cauagcgcagcaccg

SEQ ID NO: 1532984 - RNA, 12 nt, Pseudomonas aeruginosa PA01
cauagcgcagcc

SEQ ID NO: 1532985 - RNA, 13 nt, Pseudomonas aeruginosa PA01
cauagcgcagccg

SEQ ID NO: 1532986 - RNA, 23 nt, Pseudomonas aeruginosa PA01
cauagcagcgccgcgccugcugc

SEQ ID NO: 1532987 - RNA, 19 nt, Pseudomonas aeruginosa PA01
cauagccggcgcgcccggc

SEQ ID NO: 1532988 - RNA, 16 nt, Pseudomonas aeruginosa PA01
cauagcucagcuggau

SEQ ID NO: 1532989 - RNA, 18 nt, Pseudomonas aeruginosa PA01
cauaggacugccaacugg

SEQ ID NO: 1532990 - RNA, 19 nt, Pseudomonas aeruginosa PA01
cauaggacugccaacuggc

SEQ ID NO: 1532991 - RNA, 23 nt, Pseudomonas aeruginosa PA01
caucagcacgaaagccaugccca

SEQ ID NO: 1532992 - RNA, 22 nt, Pseudomonas aeruginosa PA01
caucagcaccaggaagccccag

SEQ ID NO: 1532993 - RNA, 23 nt, Pseudomonas aeruginosa PA01
caucaccgcgguuggcgccucgc

SEQ ID NO: 1532994 - RNA, 15 nt, Pseudomonas aeruginosa PA01
caucaccgccaucag

SEQ ID NO: 1532995 - RNA, 18 nt, Pseudomonas aeruginosa PA01
caucaccgccaucagcac

SEQ ID NO: 1532996 - RNA, 14 nt, Pseudomonas aeruginosa PA01
caucaccaggcugc

SEQ ID NO: 1532997 - RNA, 16 nt, Pseudomonas aeruginosa PA01
caucaccuucgcccuc

SEQ ID NO: 1532998 - RNA, 15 nt, Pseudomonas aeruginosa PA01
caucaccccgcaacc

SEQ ID NO: 1532999 - RNA, 17 nt, Pseudomonas aeruginosa PA01
caucaccccgcaaccgc

SEQ ID NO: 1533000 - RNA, 15 nt, Pseudomonas aeruginosa PA01
caucggcgguacgcc

SEQ ID NO: 1533001 - RNA, 13 nt, Pseudomonas aeruginosa PA01
caucggcgcgccg

SEQ ID NO: 1533002 - RNA, 13 nt, Pseudomonas aeruginosa PA01
caucggcgccgcg

SEQ ID NO: 1533003 - RNA, 16 nt, Pseudomonas aeruginosa PA01
caucgucugcgcggcg

SEQ ID NO: 1533004 - RNA, 20 nt, Pseudomonas aeruginosa PA01
caucggucgcgcccccaucu

SEQ ID NO: 1533005 - RNA, 13 nt, Pseudomonas aeruginosa PA01
caucgcccugcac

SEQ ID NO: 1533006 - RNA, 18 nt, Pseudomonas aeruginosa PA01
caucgcuuucaggcgcuc

SEQ ID NO: 1533007 - RNA, 13 nt, Pseudomonas aeruginosa PA01
caucggccgccag

SEQ ID NO: 1533008 - RNA, 15 nt, Pseudomonas aeruginosa PA01
caucggcccggcuuc

SEQ ID NO: 1533009 - RNA, 15 nt, Pseudomonas aeruginosa PA01
caucggccaccuucg

SEQ ID NO: 1533010 - RNA, 14 nt, Pseudomonas aeruginosa PA01
caucgccaccagca

SEQ ID NO: 1533011 - RNA, 19 nt, Pseudomonas aeruginosa PA01
caucgccaccagcaggaag

SEQ ID NO: 1533012 - RNA, 14 nt, Pseudomonas aeruginosa PA01
caucgccagcgcca

SEQ ID NO: 1533013 - RNA, 16 nt, Pseudomonas aeruginosa PA01
caucgccagggucuug

SEQ ID NO: 1533014 - RNA, 15 nt, Pseudomonas aeruginosa PA01
caucgagcggcggcc

SEQ ID NO: 1533015 - RNA, 16 nt, Pseudomonas aeruginosa PA01
caucgcaucggcgacc

SEQ ID NO: 1533016 - RNA, 16 nt, Pseudomonas aeruginosa PA01
caucgacugcaacaga

SEQ ID NO: 1533017 - RNA, 13 nt, Pseudomonas aeruginosa PA01
caucgaaggcgcc

SEQ ID NO: 1533018 - RNA, 18 nt, Pseudomonas aeruginosa PA01
caucgaaggcgccggcau

SEQ ID NO: 1533019 - RNA, 15 nt, Pseudomonas aeruginosa PA01
caucgaagcgcacca

SEQ ID NO: 1533020 - RNA, 14 nt, Pseudomonas aeruginosa PA01
cauccggcucgacg

SEQ ID NO: 1533021 - RNA, 14 nt, Pseudomonas aeruginosa PA01
cauccgccgcuggg

SEQ ID NO: 1533022 - RNA, 23 nt, Pseudomonas aeruginosa PA01
cauccgccuuuuuugugcccggc

SEQ ID NO: 1533023 - RNA, 20 nt, Pseudomonas aeruginosa PA01
cauccgcgccgaccagccgc

SEQ ID NO: 1533024 - RNA, 12 nt, Pseudomonas aeruginosa PA01
cauccgcccugc

SEQ ID NO: 1533025 - RNA, 15 nt, Pseudomonas aeruginosa PA01
cauccgccgcagacc

SEQ ID NO: 1533026 - RNA, 13 nt, Pseudomonas aeruginosa PA01
caucccaguagcc

SEQ ID NO: 1533027 - RNA, 19 nt, Pseudomonas aeruginosa PA01
cauccccgaggcgacgccc

SEQ ID NO: 1533028 - RNA, 20 nt, Pseudomonas aeruginosa PA01
cauccccgaggcgacgcccu

SEQ ID NO: 1533029 - RNA, 20 nt, Pseudomonas aeruginosa PA01
caucccgcccggucucagcc

SEQ ID NO: 1533030 - RNA, 21 nt, Pseudomonas aeruginosa PA01
caucccgcccggucucagccg

SEQ ID NO: 1533031 - RNA, 18 nt, Pseudomonas aeruginosa PA01
cauccagucuucgccggc

SEQ ID NO: 1533032 - RNA, 15 nt, Pseudomonas aeruginosa PA01
cauccaguguggcgg

SEQ ID NO: 1533033 - RNA, 18 nt, Pseudomonas aeruginosa PA01
cauccaguguggcggcgu

SEQ ID NO: 1533034 - RNA, 17 nt, Pseudomonas aeruginosa PA01
cauccaguuccugcacc

SEQ ID NO: 1533035 - RNA, 14 nt, Pseudomonas aeruginosa PA01
caucagcaggguca

SEQ ID NO: 1533036 - RNA, 15 nt, Pseudomonas aeruginosa PA01
cauccagcaccgcuu

SEQ ID NO: 1533037 - RNA, 13 nt, Pseudomonas aeruginosa PA01
cauccagccccca

SEQ ID NO: 1533038 - RNA, 14 nt, Pseudomonas aeruginosa PA01
cauccagcgccugg

SEQ ID NO: 1533039 - RNA, 17 nt, Pseudomonas aeruginosa PA01
cauccagcggacgcuug

SEQ ID NO: 1533040 - RNA, 22 nt, Pseudomonas aeruginosa PA01
cauccagcggacgcuuguccuu

SEQ ID NO: 1533041 - RNA, 18 nt, Pseudomonas aeruginosa PA01
caucuugcggcaauucuu

SEQ ID NO: 1533042 - RNA, 15 nt, Pseudomonas aeruginosa PA01
caucuugcccagccg

SEQ ID NO: 1533043 - RNA, 13 nt, Pseudomonas aeruginosa PA01
caucguucuuucc

SEQ ID NO: 1533044 - RNA, 14 nt, Pseudomonas aeruginosa PA01
caucguggccaugg

SEQ ID NO: 1533045 - RNA, 22 nt, Pseudomonas aeruginosa PA01
caucuucucgaagcgcgccugc

SEQ ID NO: 1533046 - RNA, 24 nt, Pseudomonas aeruginosa PA01
caucuucucgaagcgcgccugcuc

SEQ ID NO: 1533047 - RNA, 23 nt, Pseudomonas aeruginosa PA01
caucuucugcgcguugcagcgcc

SEQ ID NO: 1533048 - RNA, 16 nt, Pseudomonas aeruginosa PA01
caugaaacaguuggac

SEQ ID NO: 1533049 - RNA, 15 nt, Pseudomonas aeruginosa PA01
caugaaaaagccccu

SEQ ID NO: 1533050 - RNA, 16 nt, Pseudomonas aeruginosa PA01
caugaaaaaggccggu

SEQ ID NO: 1533051 - RNA, 19 nt, Pseudomonas aeruginosa PA01
caugaaugccuugaggccu

SEQ ID NO: 1533052 - RNA, 19 nt, Pseudomonas aeruginosa PA01
caugaagccgcgcgccgag

SEQ ID NO: 1533053 - RNA, 18 nt, Pseudomonas aeruginosa PA01
caugaaggcgcugagcgc

SEQ ID NO: 1533054 - RNA, 16 nt, Pseudomonas aeruginosa PA01
caugaccagagccgcc

SEQ ID NO: 1533055 - RNA, 15 nt, Pseudomonas aeruginosa PA01
caugacccgcggcag

SEQ ID NO: 1533056 - RNA, 14 nt, Pseudomonas aeruginosa PA01
caugaccgccgcuc

SEQ ID NO: 1533057 - RNA, 19 nt, Pseudomonas aeruginosa PA01
caugaccgccgcucaucug

SEQ ID NO: 1533058 - RNA, 17 nt, Pseudomonas aeruginosa PA01
caugaccgucagccagg

SEQ ID NO: 1533059 - RNA, 20 nt, Pseudomonas aeruginosa PA01
caugaccucggccagccagg

SEQ ID NO: 1533060 - RNA, 15 nt, Pseudomonas aeruginosa PA01
caugagguucaggcc

SEQ ID NO: 1533061 - RNA, 15 nt, Pseudomonas aeruginosa PA01
caugaggggaaucgc

SEQ ID NO: 1533062 - RNA, 14 nt, Pseudomonas aeruginosa PA01
caugauaaggcaaa

SEQ ID NO: 1533063 - RNA, 18 nt, Pseudomonas aeruginosa PA01
caugacgggcgguaugcc

SEQ ID NO: 1533064 - RNA, 21 nt, Pseudomonas aeruginosa PA01
caugaccuucagguagauguc

SEQ ID NO: 1533065 - RNA, 14 nt, Pseudomonas aeruginosa PA01
caugacgaagcgca

SEQ ID NO: 1533066 - RNA, 17 nt, Pseudomonas aeruginosa PA01
caugccgcuagcccugc

SEQ ID NO: 1533067 - RNA, 21 nt, Pseudomonas aeruginosa PA01
caugccgcuagcccugcugcu

SEQ ID NO: 1533068 - RNA, 15 nt, Pseudomonas aeruginosa PA01
caugccgcaggaacc

SEQ ID NO: 1533069 - RNA, 22 nt, Pseudomonas aeruginosa PA01
caugccgcaggaaccgacgcgc

SEQ ID NO: 1533070 - RNA, 22 nt, Pseudomonas aeruginosa PA01
caugccguacaggucggcgccg

SEQ ID NO: 1533071 - RNA, 19 nt, Pseudomonas aeruginosa PA01
caugccgguucccgcagcg

SEQ ID NO: 1533072 - RNA, 19 nt, Pseudomonas aeruginosa PA01
caugccggggaaccacacc

SEQ ID NO: 1533073 - RNA, 13 nt, Pseudomonas aeruginosa PA01
caugcgcagcgcg

SEQ ID NO: 1533074 - RNA, 21 nt, Pseudomonas aeruginosa PA01
caugcgaaaacggcgacccug

SEQ ID NO: 1533075 - RNA, 17 nt, Pseudomonas aeruginosa PA01
caugccuugcagcgcca

SEQ ID NO: 1533076 - RNA, 18 nt, Pseudomonas aeruginosa PA01
caugcccagacgccgcuc

SEQ ID NO: 1533077 - RNA, 19 nt, Pseudomonas aeruginosa PA01
caugcccuuguccggcccg

SEQ ID NO: 1533078 - RNA, 23 nt, Pseudomonas aeruginosa PA01
caugcccuugucgcccuucuucc

SEQ ID NO: 1533079 - RNA, 14 nt, Pseudomonas aeruginosa PA01
caugcccggcuggc

SEQ ID NO: 1533080 - RNA, 22 nt, Pseudomonas aeruginosa PA01
caugcccuggccgacgcugagg

SEQ ID NO: 1533081 - RNA, 14 nt, Pseudomonas aeruginosa PA01
caugcccugccggc

SEQ ID NO: 1533082 - RNA, 14 nt, Pseudomonas aeruginosa PA01
caugcccgcugggc

SEQ ID NO: 1533083 - RNA, 16 nt, Pseudomonas aeruginosa PA01
caugcccgcugggcag

SEQ ID NO: 1533084 - RNA, 22 nt, Pseudomonas aeruginosa PA01
caugcccgucgaccaucaccag

SEQ ID NO: 1533085 - RNA, 22 nt, Pseudomonas aeruginosa PA01
caugcccagcguggccagcgaa

SEQ ID NO: 1533086 - RNA, 12 nt, Pseudomonas aeruginosa PA01
caugcccagcuu

SEQ ID NO: 1533087 - RNA, 14 nt, Pseudomonas aeruginosa PA01
caugcccgccccgc

SEQ ID NO: 1533088 - RNA, 17 nt, Pseudomonas aeruginosa PA01
caugccccgccgacugg

SEQ ID NO: 1533089 - RNA, 14 nt, Pseudomonas aeruginosa PA01
caugcaggccaggg

SEQ ID NO: 1533090 - RNA, 14 nt, Pseudomonas aeruginosa PA01
caugcaggccggcc

SEQ ID NO: 1533091 - RNA, 20 nt, Pseudomonas aeruginosa PA01
caugcaggccggccuccagc

SEQ ID NO: 1533092 - RNA, 18 nt, Pseudomonas aeruginosa PA01
caugcaggcucgacaggu

SEQ ID NO: 1533093 - RNA, 19 nt, Pseudomonas aeruginosa PA01
caugcaggcucgacagguc

SEQ ID NO: 1533094 - RNA, 13 nt, Pseudomonas aeruginosa PA01
caugcaggcucuc

SEQ ID NO: 1533095 - RNA, 16 nt, Pseudomonas aeruginosa PA01
caugcaccaccugcuu

SEQ ID NO: 1533096 - RNA, 20 nt, Pseudomonas aeruginosa PA01
caugauuucguuggcccaga

SEQ ID NO: 1533097 - RNA, 22 nt, Pseudomonas aeruginosa PA01
caugauuucguuggcccagacc

SEQ ID NO: 1533098 - RNA, 20 nt, Pseudomonas aeruginosa PA01
caugaugccgugcagcuugg

SEQ ID NO: 1533099 - RNA, 14 nt, Pseudomonas aeruginosa PA01
cauggcgaguucca

SEQ ID NO: 1533100 - RNA, 12 nt, Pseudomonas aeruginosa PA01
cauggccuggaa

SEQ ID NO: 1533101 - RNA, 14 nt, Pseudomonas aeruginosa PA01
cauggccuggcgcu

SEQ ID NO: 1533102 - RNA, 16 nt, Pseudomonas aeruginosa PA01
caugcucagccgcgcc

SEQ ID NO: 1533103 - RNA, 14 nt, Pseudomonas aeruginosa PA01
cauggccgcuccca

SEQ ID NO: 1533104 - RNA, 23 nt, Pseudomonas aeruginosa PA01
cauggccgcucccaccgcuuuca

SEQ ID NO: 1533105 - RNA, 11 nt, Pseudomonas aeruginosa PA01
cauggccggcu

SEQ ID NO: 1533106 - RNA, 20 nt, Pseudomonas aeruginosa PA01
caugcgugcauccuuuuucc

SEQ ID NO: 1533107 - RNA, 21 nt, Pseudomonas aeruginosa PA01
caugcgugcgauucagaugcg

SEQ ID NO: 1533108 - RNA, 23 nt, Pseudomonas aeruginosa PA01
caugcgugcgggaacgaugccgc

SEQ ID NO: 1533109 - RNA, 16 nt, Pseudomonas aeruginosa PA01
caugcgcggcaggaaa

SEQ ID NO: 1533110 - RNA, 18 nt, Pseudomonas aeruginosa PA01
caugcgcggcaggaucag

SEQ ID NO: 1533111 - RNA, 20 nt, Pseudomonas aeruginosa PA01
caugcgcggcaggaucaggc

SEQ ID NO: 1533112 - RNA, 23 nt, Pseudomonas aeruginosa PA01
caugcggcaggccuuccacgccu

SEQ ID NO: 1533113 - RNA, 13 nt, Pseudomonas aeruginosa PA01
caugcggaacacc

SEQ ID NO: 1533114 - RNA, 20 nt, Pseudomonas aeruginosa PA01
caugcggaaggcuuccuggu

SEQ ID NO: 1533115 - RNA, 22 nt, Pseudomonas aeruginosa PA01
caugcggaaggcuuccuggugg

SEQ ID NO: 1533116 - RNA, 21 nt, Pseudomonas aeruginosa PA01
caugguguugggcaggguguc

SEQ ID NO: 1533117 - RNA, 21 nt, Pseudomonas aeruginosa PA01
caugggggccagcagggccgc

SEQ ID NO: 1533118 - RNA, 22 nt, Pseudomonas aeruginosa PA01
caugggggccagcagggccgcc

SEQ ID NO: 1533119 - RNA, 23 nt, Pseudomonas aeruginosa PA01
caugggcucgcgcggggcgcgcu

SEQ ID NO: 1533120 - RNA, 17 nt, Pseudomonas aeruginosa PA01
caugggccaguuccggc

SEQ ID NO: 1533121 - RNA, 18 nt, Pseudomonas aeruginosa PA01
caugggcauccugccgcc

SEQ ID NO: 1533122 - RNA, 21 nt, Pseudomonas aeruginosa PA01
caugggcauccugccgccugu

SEQ ID NO: 1533123 - RNA, 15 nt, Pseudomonas aeruginosa PA01
cauguagcgcuccuc

SEQ ID NO: 1533124 - RNA, 15 nt, Pseudomonas aeruginosa PA01
cauguugcggcccag

SEQ ID NO: 1533125 - RNA, 21 nt, Pseudomonas aeruginosa PA01
cauguuguucgcgcaccuugg

SEQ ID NO: 1533126 - RNA, 22 nt, Pseudomonas aeruginosa PA01
cauucauggcgccacucggcgu

SEQ ID NO: 1533127 - RNA, 14 nt, Pseudomonas aeruginosa PA01
cauucuccagccgc

SEQ ID NO: 1533128 - RNA, 12 nt, Pseudomonas aeruginosa PA01
cauucucccucg

SEQ ID NO: 1533129 - RNA, 18 nt, Pseudomonas aeruginosa PA01
cauucucgcgacccuggc

SEQ ID NO: 1533130 - RNA, 16 nt, Pseudomonas aeruginosa PA01
ccugcagguccggguu

SEQ ID NO: 1533131 - RNA, 21 nt, Pseudomonas aeruginosa PA01
ccugcaggucgaggcgcucca

SEQ ID NO: 1533132 - RNA, 23 nt, Pseudomonas aeruginosa PA01
ccugcaccgggccgaccugcccg

SEQ ID NO: 1533133 - RNA, 21 nt, Pseudomonas aeruginosa PA01
ccugcacggauaccacccgca

SEQ ID NO: 1533134 - RNA, 15 nt, Pseudomonas aeruginosa PA01
ccugcacaucaccuu

SEQ ID NO: 1533135 - RNA, 13 nt, Pseudomonas aeruginosa PA01
ccucgggccgcag

SEQ ID NO: 1533136 - RNA, 19 nt, Pseudomonas aeruginosa PA01
ccucgggcgagcgcagacg

SEQ ID NO: 1533137 - RNA, 20 nt, Pseudomonas aeruginosa PA01
ccucggcuucguccugcugc

SEQ ID NO: 1533138 - RNA, 15 nt, Pseudomonas aeruginosa PA01
ccucggcggcggccu

SEQ ID NO: 1533139 - RNA, 14 nt, Pseudomonas aeruginosa PA01
ccucgggcagcccc

SEQ ID NO: 1533140 - RNA, 14 nt, Pseudomonas aeruginosa PA01
ccucgggcagcuug

SEQ ID NO: 1533141 - RNA, 20 nt, Pseudomonas aeruginosa PA01
ccucgggcagcuuggcgguc

SEQ ID NO: 1533142 - RNA, 22 nt, Pseudomonas aeruginosa PA01
ccugccaucgaugugagcccca

SEQ ID NO: 1533143 - RNA, 19 nt, Pseudomonas aeruginosa PA01
ccugccccacuuccggccc

SEQ ID NO: 1533144 - RNA, 20 nt, Pseudomonas aeruginosa PA01
ccugccccacuuccggcccg

SEQ ID NO: 1533145 - RNA, 13 nt, Pseudomonas aeruginosa PA01
ccugcccgguggg

SEQ ID NO: 1533146 - RNA, 16 nt, Pseudomonas aeruginosa PA01
ccugccagaaaaccca

SEQ ID NO: 1533147 - RNA, 21 nt, Pseudomonas aeruginosa PA01
ccugcagguagcgcugcgccc

SEQ ID NO: 1533148 - RNA, 22 nt, Pseudomonas aeruginosa PA01
ccugccagcgcgucggcacgcc

SEQ ID NO: 1533149 - RNA, 19 nt, Pseudomonas aeruginosa PA01
ccugccugcgcagggcuuc

SEQ ID NO: 1533150 - RNA, 19 nt, Pseudomonas aeruginosa PA01
ccugcggguuggucggcac

SEQ ID NO: 1533151 - RNA, 23 nt, Pseudomonas aeruginosa PA01
ccugcggggcggcgucccggcgc

SEQ ID NO: 1533152 - RNA, 21 nt, Pseudomonas aeruginosa PA01
ccugcucagcguccucagccu

SEQ ID NO: 1533153 - RNA, 20 nt, Pseudomonas aeruginosa PA01
ccugcggccgcaaccagccc

SEQ ID NO: 1533154 - RNA, 17 nt, Pseudomonas aeruginosa PA01
ccugcggccagcgccag

SEQ ID NO: 1533155 - RNA, 23 nt, Pseudomonas aeruginosa PA01
ccugcggccagcgccaggagcag

SEQ ID NO: 1533156 - RNA, 21 nt, Pseudomonas aeruginosa PA01
ccugcggccccaaggggccgc

SEQ ID NO: 1533157 - RNA, 15 nt, Pseudomonas aeruginosa PA01
ccugcuccugaagga

SEQ ID NO: 1533158 - RNA, 16 nt, Pseudomonas aeruginosa PA01
ccugcuccugaaggac

SEQ ID NO: 1533159 - RNA, 15 nt, Pseudomonas aeruginosa PA01
ccugcuccuccaggc

SEQ ID NO: 1533160 - RNA, 12 nt, Pseudomonas aeruginosa PA01
ccugcuccuccg

SEQ ID NO: 1533161 - RNA, 15 nt, Pseudomonas aeruginosa PA01
ccugcucccuggcgg

SEQ ID NO: 1533162 - RNA, 12 nt, Pseudomonas aeruginosa PA01
ccugcuccagca

SEQ ID NO: 1533163 - RNA, 14 nt, Pseudomonas aeruginosa PA01
ccugcuccagcagg

SEQ ID NO: 1533164 - RNA, 18 nt, Pseudomonas aeruginosa PA01
ccugcuccagcagggcca

SEQ ID NO: 1533165 - RNA, 24 nt, Pseudomonas aeruginosa PA01
ccugcuccagcagggccagcgccu

SEQ ID NO: 1533166 - RNA, 13 nt, Pseudomonas aeruginosa PA01
ccugcuccagcgg

SEQ ID NO: 1533167 - RNA, 16 nt, Pseudomonas aeruginosa PA01
ccugcugcgccggcac

SEQ ID NO: 1533168 - RNA, 19 nt, Pseudomonas aeruginosa PA01
ccugcuggccggugccgcc

SEQ ID NO: 1533169 - RNA, 20 nt, Pseudomonas aeruginosa PA01
ccugcuggccggugccgccc

SEQ ID NO: 1533170 - RNA, 22 nt, Pseudomonas aeruginosa PA01
ccugcuggccggugccgcccug

SEQ ID NO: 1533171 - RNA, 19 nt, Pseudomonas aeruginosa PA01
ccugcuggcgcagccaggc

SEQ ID NO: 1533172 - RNA, 17 nt, Pseudomonas aeruginosa PA01
ccugcuguguccggcgg

SEQ ID NO: 1533173 - RNA, 17 nt, Pseudomonas aeruginosa PA01
ccugcuucagcccggca

SEQ ID NO: 1533174 - RNA, 22 nt, Pseudomonas aeruginosa PA01
ccugcuucaggaguuucaucuc

SEQ ID NO: 1533175 - RNA, 18 nt, Pseudomonas aeruginosa PA01
ccugcuucaggucgucgg

SEQ ID NO: 1533176 - RNA, 20 nt, Pseudomonas aeruginosa PA01
ccugcuucaggucgucgggc

SEQ ID NO: 1533177 - RNA, 15 nt, Pseudomonas aeruginosa PA01
ccugcuuccagaccu

SEQ ID NO: 1533178 - RNA, 17 nt, Pseudomonas aeruginosa PA01
ccugcuuccagaccucg

SEQ ID NO: 1533179 - RNA, 18 nt, Pseudomonas aeruginosa PA01
ccuggaacaccaggccgc

SEQ ID NO: 1533180 - RNA, 18 nt, Pseudomonas aeruginosa PA01
ccuggaacuagcccucga

SEQ ID NO: 1533181 - RNA, 22 nt, Pseudomonas aeruginosa PA01
ccuggaauaccccgcggacgau

SEQ ID NO: 1533182 - RNA, 17 nt, Pseudomonas aeruginosa PA01
ccuggaauucaggcuuc

SEQ ID NO: 1533183 - RNA, 16 nt, Pseudomonas aeruginosa PA01
ccugcuugaccuugcu

SEQ ID NO: 1533184 - RNA, 20 nt, Pseudomonas aeruginosa PA01
ccugcuugucgauggucagg

SEQ ID NO: 1533185 - RNA, 18 nt, Pseudomonas aeruginosa PA01
ccuggagguagcugcgcc

SEQ ID NO: 1533186 - RNA, 21 nt, Pseudomonas aeruginosa PA01
ccuggagguagcugcgccgcc

SEQ ID NO: 1533187 - RNA, 22 nt, Pseudomonas aeruginosa PA01
ccuggagguagcugcgccgccu

SEQ ID NO: 1533188 - RNA, 19 nt, Pseudomonas aeruginosa PA01
ccuggacgugggaaaucac

SEQ ID NO: 1533189 - RNA, 23 nt, Pseudomonas aeruginosa PA01
ccuggacccgggccuccuggcgg

SEQ ID NO: 1533190 - RNA, 12 nt, Pseudomonas aeruginosa PA01
ccuggaccuccg

SEQ ID NO: 1533191 - RNA, 19 nt, Pseudomonas aeruginosa PA01
ccuggauaucaccuccugu

SEQ ID NO: 1533192 - RNA, 17 nt, Pseudomonas aeruginosa PA01
ccuggauaagccgcgcc

SEQ ID NO: 1533193 - RNA, 15 nt, Pseudomonas aeruginosa PA01
ccuggauacgggcgc

SEQ ID NO: 1533194 - RNA, 21 nt, Pseudomonas aeruginosa PA01
ccuggauacgggcgccagggg

SEQ ID NO: 1533195 - RNA, 19 nt, Pseudomonas aeruginosa PA01
ccuggaucgccuugcgcgu

SEQ ID NO: 1533196 - RNA, 23 nt, Pseudomonas aeruginosa PA01
ccuggaucucggcggccaggcgg

SEQ ID NO: 1533197 - RNA, 20 nt, Pseudomonas aeruginosa PA01
ccuggaugaucucgcaguac

SEQ ID NO: 1533198 - RNA, 21 nt, Pseudomonas aeruginosa PA01
ccuggccauucgcuucggcca

SEQ ID NO: 1533199 - RNA, 13 nt, Pseudomonas aeruginosa PA01
ccuggccaggcgc

SEQ ID NO: 1533200 - RNA, 16 nt, Pseudomonas aeruginosa PA01
ccuggccacguccagc

SEQ ID NO: 1533201 - RNA, 15 nt, Pseudomonas aeruginosa PA01
ccuggcagguccgac

SEQ ID NO: 1533202 - RNA, 15 nt, Pseudomonas aeruginosa PA01
ccuggccgacccgca

SEQ ID NO: 1533203 - RNA, 18 nt, Pseudomonas aeruginosa PA01
ccuggccgacccgcagcg

SEQ ID NO: 1533204 - RNA, 17 nt, Pseudomonas aeruginosa PA01
ccuggccgagcaucagc

SEQ ID NO: 1533205 - RNA, 13 nt, Pseudomonas aeruginosa PA01
ccuggccgagccg

SEQ ID NO: 1533206 - RNA, 18 nt, Pseudomonas aeruginosa PA01
ccuggccgagcgggaagc

SEQ ID NO: 1533207 - RNA, 13 nt, Pseudomonas aeruginosa PA01
ccuggccggccuc

SEQ ID NO: 1533208 - RNA, 12 nt, Pseudomonas aeruginosa PA01
ccuggccgcgcg

SEQ ID NO: 1533209 - RNA, 16 nt, Pseudomonas aeruginosa PA01
ccuggccgcgcggcuu

SEQ ID NO: 1533210 - RNA, 11 nt, Pseudomonas aeruginosa PA01
ccuggccggcg

SEQ ID NO: 1533211 - RNA, 20 nt, Pseudomonas aeruginosa PA01
ccuggccggcgauggccgcc

SEQ ID NO: 1533212 - RNA, 22 nt, Pseudomonas aeruginosa PA01
ccuggccggcgauggccgccug

SEQ ID NO: 1533213 - RNA, 13 nt, Pseudomonas aeruginosa PA01
ccuggccggcggc

SEQ ID NO: 1533214 - RNA, 18 nt, Pseudomonas aeruginosa PA01
ccuggccggucguucgcc

SEQ ID NO: 1533215 - RNA, 22 nt, Pseudomonas aeruginosa PA01
ccuggcgagggcgucccgcugc

SEQ ID NO: 1533216 - RNA, 19 nt, Pseudomonas aeruginosa PA01
ccuggcgaucaggccaagc

SEQ ID NO: 1533217 - RNA, 16 nt, Pseudomonas aeruginosa PA01
ccuggccguugcgcag

SEQ ID NO: 1533218 - RNA, 19 nt, Pseudomonas aeruginosa PA01
ccuggccguugcgcaggcg

SEQ ID NO: 1533219 - RNA, 14 nt, Pseudomonas aeruginosa PA01
ccuggcgcugggcc

SEQ ID NO: 1533220 - RNA, 22 nt, Pseudomonas aeruginosa PA01
ccuggcgcugggccuugagcag

SEQ ID NO: 1533221 - RNA, 17 nt, Pseudomonas aeruginosa PA01
ccuggcgguacagcccc

SEQ ID NO: 1533222 - RNA, 18 nt, Pseudomonas aeruginosa PA01
ccuggcgguacagccccc

SEQ ID NO: 1533223 - RNA, 16 nt, Pseudomonas aeruginosa PA01
ccuggcgcagcggcag

SEQ ID NO: 1533224 - RNA, 20 nt, Pseudomonas aeruginosa PA01
ccuggcgcagcggcagcgcc

SEQ ID NO: 1533225 - RNA, 13 nt, Pseudomonas aeruginosa PA01
ccuggcgcaggcg

SEQ ID NO: 1533226 - RNA, 18 nt, Pseudomonas aeruginosa PA01
ccuggcgcaggcggcgcu

SEQ ID NO: 1533227 - RNA, 14 nt, Pseudomonas aeruginosa PA01
ccuggcgcagacag

SEQ ID NO: 1533228 - RNA, 22 nt, Pseudomonas aeruginosa PA01
ccuggcgcagacaggccuccag

SEQ ID NO: 1533229 - RNA, 23 nt, Pseudomonas aeruginosa PA01
ccuggcgcagacaggccuccagc

SEQ ID NO: 1533230 - RNA, 19 nt, Pseudomonas aeruginosa PA01
ccuggcgaugcccuggccg

SEQ ID NO: 1533231 - RNA, 20 nt, Pseudomonas aeruginosa PA01
ccuggcgaugcccuggccgc

SEQ ID NO: 1533232 - RNA, 21 nt, Pseudomonas aeruginosa PA01
ccuggcgaugcccuggccgcu

SEQ ID NO: 1533233 - RNA, 19 nt, Pseudomonas aeruginosa PA01
ccuggcgcaacgccggcag

SEQ ID NO: 1533234 - RNA, 14 nt, Pseudomonas aeruginosa PA01
ccuggcgcgcgccc

SEQ ID NO: 1533235 - RNA, 18 nt, Pseudomonas aeruginosa PA01
ccuggcgcgcggccgcgu

SEQ ID NO: 1533236 - RNA, 18 nt, Pseudomonas aeruginosa PA01
ccuggcgcgcugcggcag

SEQ ID NO: 1533237 - RNA, 20 nt, Pseudomonas aeruginosa PA01
ccuggcgcgcugcggcaggg

SEQ ID NO: 1533238 - RNA, 22 nt, Pseudomonas aeruginosa PA01
ccuggcgcgagaagccagccag

SEQ ID NO: 1533239 - RNA, 14 nt, Pseudomonas aeruginosa PA01
ccuggcgcagguag

SEQ ID NO: 1533240 - RNA, 21 nt, Pseudomonas aeruginosa PA01
ccuggcucgaucggcagggcg

SEQ ID NO: 1533241 - RNA, 16 nt, Pseudomonas aeruginosa PA01
ccuggcucaugucgug

SEQ ID NO: 1533242 - RNA, 19 nt, Pseudomonas aeruginosa PA01
ccuggcuccacugcuuggc

SEQ ID NO: 1533243 - RNA, 24 nt, Pseudomonas aeruginosa PA01
ccuggcuccacugcuuggccaggc

SEQ ID NO: 1533244 - RNA, 21 nt, Pseudomonas aeruginosa PA01
ccuggcgucgcacugcugcuu

SEQ ID NO: 1533245 - RNA, 21 nt, Pseudomonas aeruginosa PA01
ccuggcgugccgccaggccuu

SEQ ID NO: 1533246 - RNA, 22 nt, Pseudomonas aeruginosa PA01
ccuggcuuuccagggccuggcg

SEQ ID NO: 1533247 - RNA, 20 nt, Pseudomonas aeruginosa PA01
ccugggcguuggccagcgcc

SEQ ID NO: 1533248 - RNA, 13 nt, Pseudomonas aeruginosa PA01
ccugggcgccgcc

SEQ ID NO: 1533249 - RNA, 23 nt, Pseudomonas aeruginosa PA01
ccugggcgcgaauggcauucagc

SEQ ID NO: 1533250 - RNA, 19 nt, Pseudomonas aeruginosa PA01
ccugggcgccagccgccau

SEQ ID NO: 1533251 - RNA, 23 nt, Pseudomonas aeruginosa PA01
ccugggcgccagccgccaucacc

SEQ ID NO: 1533252 - RNA, 14 nt, Pseudomonas aeruginosa PA01
ccugggcggccucg

SEQ ID NO: 1533253 - RNA, 21 nt, Pseudomonas aeruginosa PA01
ccugggcggucggcucagccg

SEQ ID NO: 1533254 - RNA, 15 nt, Pseudomonas aeruginosa PA01
ccugggcgugcuugg

SEQ ID NO: 1533255 - RNA, 18 nt, Pseudomonas aeruginosa PA01
ccugggaauugcgcacgc

SEQ ID NO: 1533256 - RNA, 20 nt, Pseudomonas aeruginosa PA01
ccugggagaacuuuucccag

SEQ ID NO: 1533257 - RNA, 17 nt, Pseudomonas aeruginosa PA01
ccugggauggggcugcc

SEQ ID NO: 1533258 - RNA, 22 nt, Pseudomonas aeruginosa PA01
ccugggauggggcugccggccc

SEQ ID NO: 1533259 - RNA, 17 nt, Pseudomonas aeruginosa PA01
ccugggccaccuggcuc

SEQ ID NO: 1533260 - RNA, 13 nt, Pseudomonas aeruginosa PA01
ccugggccgcgcu

SEQ ID NO: 1533261 - RNA, 18 nt, Pseudomonas aeruginosa PA01
ccugggccggcgccagca

SEQ ID NO: 1533262 - RNA, 18 nt, Pseudomonas aeruginosa PA01
ccugggccggcuucuuuc

SEQ ID NO: 1533263 - RNA, 18 nt, Pseudomonas aeruginosa PA01
ccugggccccggccaggu

SEQ ID NO: 1533264 - RNA, 19 nt, Pseudomonas aeruginosa PA01
ccugggccccggccggcag

SEQ ID NO: 1533265 - RNA, 19 nt, Pseudomonas aeruginosa PA01
ccugggccgaaggccaggc

SEQ ID NO: 1533266 - RNA, 14 nt, Pseudomonas aeruginosa PA01
ccugggccugcagg

SEQ ID NO: 1533267 - RNA, 15 nt, Pseudomonas aeruginosa PA01
ccuggguacgcaccg

SEQ ID NO: 1533268 - RNA, 16 nt, Pseudomonas aeruginosa PA01
ccugggucgacugcug

SEQ ID NO: 1533269 - RNA, 17 nt, Pseudomonas aeruginosa PA01
ccuggucgaucucgucg

SEQ ID NO: 1533270 - RNA, 19 nt, Pseudomonas aeruginosa PA01
ccuggucggggccggcgau

SEQ ID NO: 1533271 - RNA, 19 nt, Pseudomonas aeruginosa PA01
ccuggucgucguaguggcc

SEQ ID NO: 1533272 - RNA, 18 nt, Pseudomonas aeruginosa PA01
ccuggugacccggacagc

SEQ ID NO: 1533273 - RNA, 23 nt, Pseudomonas aeruginosa PA01
ccuggugagcggaacgggacgcc

SEQ ID NO: 1533274 - RNA, 19 nt, Pseudomonas aeruginosa PA01
ccuggucuucgguggcggc

SEQ ID NO: 1533275 - RNA, 16 nt, Pseudomonas aeruginosa PA01
ccugguggcgccggcu

SEQ ID NO: 1533276 - RNA, 14 nt, Pseudomonas aeruginosa PA01
ccuggugucgggug

SEQ ID NO: 1533277 - RNA, 20 nt, Pseudomonas aeruginosa PA01
ccugguggaacagccgcagc

SEQ ID NO: 1533278 - RNA, 17 nt, Pseudomonas aeruginosa PA01
ccugguggacacccugc

SEQ ID NO: 1533279 - RNA, 13 nt, Pseudomonas aeruginosa PA01
ccuggugcaccug

SEQ ID NO: 1533280 - RNA, 15 nt, Pseudomonas aeruginosa PA01
ccuggugcaccuggc

SEQ ID NO: 1533281 - RNA, 21 nt, Pseudomonas aeruginosa PA01
ccuggugcccgaugccgcgcc

SEQ ID NO: 1533282 - RNA, 17 nt, Pseudomonas aeruginosa PA01
ccuggugcggcaccagc

SEQ ID NO: 1533283 - RNA, 19 nt, Pseudomonas aeruginosa PA01
ccuggugcggcaccagcca

SEQ ID NO: 1533284 - RNA, 13 nt, Pseudomonas aeruginosa PA01
ccuucaccggcgg

SEQ ID NO: 1533285 - RNA, 18 nt, Pseudomonas aeruginosa PA01
ccuucaccgcgccgcgcu

SEQ ID NO: 1533286 - RNA, 19 nt, Pseudomonas aeruginosa PA01
ccuucaccggacggcugag

SEQ ID NO: 1533287 - RNA, 24 nt, Pseudomonas aeruginosa PA01
ccuucaccucguuuuccucauagu

SEQ ID NO: 1533288 - RNA, 19 nt, Pseudomonas aeruginosa PA01
ccuucaaccacuccagcgg

SEQ ID NO: 1533289 - RNA, 20 nt, Pseudomonas aeruginosa PA01
ccuucaaccacuccagcggg

SEQ ID NO: 1533290 - RNA, 15 nt, Pseudomonas aeruginosa PA01
ccuucaacggcgacc

SEQ ID NO: 1533291 - RNA, 13 nt, Pseudomonas aeruginosa PA01
ccuguagcagggu

SEQ ID NO: 1533292 - RNA, 19 nt, Pseudomonas aeruginosa PA01
ccuguaccgcuccccacuc

SEQ ID NO: 1533293 - RNA, 18 nt, Pseudomonas aeruginosa PA01
ccuguaccccguagcgcu

SEQ ID NO: 1533294 - RNA, 22 nt, Pseudomonas aeruginosa PA01
ccuguacagaaacaaagagccc

SEQ ID NO: 1533295 - RNA, 18 nt, Pseudomonas aeruginosa PA01
ccuucggcaggaccucgg

SEQ ID NO: 1533296 - RNA, 21 nt, Pseudomonas aeruginosa PA01
ccuucggcgccggagcugguc

SEQ ID NO: 1533297 - RNA, 15 nt, Pseudomonas aeruginosa PA01
ccuucggcggcgccu

SEQ ID NO: 1533298 - RNA, 19 nt, Pseudomonas aeruginosa PA01
ccuucuuuuuuucaccgcu

SEQ ID NO: 1533299 - RNA, 19 nt, Pseudomonas aeruginosa PA01
ccuugaaaccggcgaacca

SEQ ID NO: 1533300 - RNA, 21 nt, Pseudomonas aeruginosa PA01
ccuugaacucgcccggcucgg

SEQ ID NO: 1533301 - RNA, 14 nt, Pseudomonas aeruginosa PA01
ccuuccugcuucag

SEQ ID NO: 1533302 - RNA, 21 nt, Pseudomonas aeruginosa PA01
ccuuccuucucgaagccgagg

SEQ ID NO: 1533303 - RNA, 18 nt, Pseudomonas aeruginosa PA01
ccuuccuugucgaucagg

SEQ ID NO: 1533304 - RNA, 21 nt, Pseudomonas aeruginosa PA01
ccuucgacaugggccgcgcag

SEQ ID NO: 1533305 - RNA, 17 nt, Pseudomonas aeruginosa PA01
ccuucgagcaacacaug

SEQ ID NO: 1533306 - RNA, 21 nt, Pseudomonas aeruginosa PA01
ccuucgaagacccccugccgc

SEQ ID NO: 1533307 - RNA, 21 nt, Pseudomonas aeruginosa PA01
ccuucgccagcggccagggcg

SEQ ID NO: 1533308 - RNA, 20 nt, Pseudomonas aeruginosa PA01
ccuucgcccucagcagcgcc

SEQ ID NO: 1533309 - RNA, 14 nt, Pseudomonas aeruginosa PA01
ccuucgccgaccag

SEQ ID NO: 1533310 - RNA, 20 nt, Pseudomonas aeruginosa PA01
ccuucgcaaagcgagcgccc

SEQ ID NO: 1533311 - RNA, 18 nt, Pseudomonas aeruginosa PA01
ccuucgagccuggccagg

SEQ ID NO: 1533312 - RNA, 14 nt, Pseudomonas aeruginosa PA01
ccuucagcgccucc

SEQ ID NO: 1533313 - RNA, 19 nt, Pseudomonas aeruginosa PA01
ccuucagcgggucgagcca

SEQ ID NO: 1533314 - RNA, 15 nt, Pseudomonas aeruginosa PA01
ccuucagccccagca

SEQ ID NO: 1533315 - RNA, 16 nt, Pseudomonas aeruginosa PA01
ccuucagccccagcac

SEQ ID NO: 1533316 - RNA, 17 nt, Pseudomonas aeruginosa PA01
ccuucagccccagcacg

SEQ ID NO: 1533317 - RNA, 15 nt, Pseudomonas aeruginosa PA01
ccuucaggcgcuccu

SEQ ID NO: 1533318 - RNA, 16 nt, Pseudomonas aeruginosa PA01
ccuuccgccagcaggc

SEQ ID NO: 1533319 - RNA, 18 nt, Pseudomonas aeruginosa PA01
ccuuccucggccgccagg

SEQ ID NO: 1533320 - RNA, 21 nt, Pseudomonas aeruginosa PA01
ccuuguggccgaucuccuggu

SEQ ID NO: 1533321 - RNA, 15 nt, Pseudomonas aeruginosa PA01
ccuuguuccugggcg

SEQ ID NO: 1533322 - RNA, 14 nt, Pseudomonas aeruginosa PA01
ccuuguugacguuc

SEQ ID NO: 1533323 - RNA, 18 nt, Pseudomonas aeruginosa PA01
ccuuguccugcggccggg

SEQ ID NO: 1533324 - RNA, 14 nt, Pseudomonas aeruginosa PA01
ccuuguccaggcgc

SEQ ID NO: 1533325 - RNA, 18 nt, Pseudomonas aeruginosa PA01
ccuuguccagggccggau

SEQ ID NO: 1533326 - RNA, 13 nt, Pseudomonas aeruginosa PA01
ccuugucgcugac

SEQ ID NO: 1533327 - RNA, 22 nt, Pseudomonas aeruginosa PA01
ccuugucgcugaccggccgcag

SEQ ID NO: 1533328 - RNA, 23 nt, Pseudomonas aeruginosa PA01
ccuuggccaugaugugcgcaggc

SEQ ID NO: 1533329 - RNA, 16 nt, Pseudomonas aeruginosa PA01
ccuuggccacgacccu

SEQ ID NO: 1533330 - RNA, 14 nt, Pseudomonas aeruginosa PA01
ccuuggccagcacc

SEQ ID NO: 1533331 - RNA, 15 nt, Pseudomonas aeruginosa PA01
ccuuggccagcacca

SEQ ID NO: 1533332 - RNA, 17 nt, Pseudomonas aeruginosa PA01
ccuuggcaucgccgccc

SEQ ID NO: 1533333 - RNA, 14 nt, Pseudomonas aeruginosa PA01
ccuugcucgacccg

SEQ ID NO: 1533334 - RNA, 15 nt, Pseudomonas aeruginosa PA01
ccuugcguccugccu

SEQ ID NO: 1533335 - RNA, 11 nt, Pseudomonas aeruginosa PA01
ccuugcuggcg

SEQ ID NO: 1533336 - RNA, 14 nt, Pseudomonas aeruginosa PA01
ccuugagcaggcgg

SEQ ID NO: 1533337 - RNA, 22 nt, Pseudomonas aeruginosa PA01
ccuugagcaugauggugccgcc

SEQ ID NO: 1533338 - RNA, 16 nt, Pseudomonas aeruginosa PA01
ccuugaccccaccggu

SEQ ID NO: 1533339 - RNA, 16 nt, Pseudomonas aeruginosa PA01
ccuugaccaccgccag

SEQ ID NO: 1533340 - RNA, 17 nt, Pseudomonas aeruginosa PA01
ccuugaccaccgccagg

SEQ ID NO: 1533341 - RNA, 21 nt, Pseudomonas aeruginosa PA01
ccuugaccaccgccaggcugg

SEQ ID NO: 1533342 - RNA, 15 nt, Pseudomonas aeruginosa PA01
ccuugacccucuggu

SEQ ID NO: 1533343 - RNA, 20 nt, Pseudomonas aeruginosa PA01
ccuugacccgguacagcgcc

SEQ ID NO: 1533344 - RNA, 18 nt, Pseudomonas aeruginosa PA01
ccuugaccugcugggcca

SEQ ID NO: 1533345 - RNA, 12 nt, Pseudomonas aeruginosa PA01
ccuugaccucga

SEQ ID NO: 1533346 - RNA, 14 nt, Pseudomonas aeruginosa PA01
cgacggcggccgcc

SEQ ID NO: 1533347 - RNA, 14 nt, Pseudomonas aeruginosa PA01
cgacggcggcggcg

SEQ ID NO: 1533348 - RNA, 21 nt, Pseudomonas aeruginosa PA01
cgacggcccugacauccuugg

SEQ ID NO: 1533349 - RNA, 21 nt, Pseudomonas aeruginosa PA01
cgacgggaagcgaaccaggca

SEQ ID NO: 1533350 - RNA, 19 nt, Pseudomonas aeruginosa PA01
cgacgcugucguggacgcc

SEQ ID NO: 1533351 - RNA, 16 nt, Pseudomonas aeruginosa PA01
cgacgcuggccugccg

SEQ ID NO: 1533352 - RNA, 18 nt, Pseudomonas aeruginosa PA01
cgacgcuggucaggcuga

SEQ ID NO: 1533353 - RNA, 16 nt, Pseudomonas aeruginosa PA01
cgacgcugcccagccc

SEQ ID NO: 1533354 - RNA, 21 nt, Pseudomonas aeruginosa PA01
cgacgcugcccagcccgccuu

SEQ ID NO: 1533355 - RNA, 12 nt, Pseudomonas aeruginosa PA01
cgacgcucugcu

SEQ ID NO: 1533356 - RNA, 13 nt, Pseudomonas aeruginosa PA01
cgacgcuccagcg

SEQ ID NO: 1533357 - RNA, 14 nt, Pseudomonas aeruginosa PA01
cgacgcgcuggacc

SEQ ID NO: 1533358 - RNA, 15 nt, Pseudomonas aeruginosa PA01
cgacgcgcggcugcu

SEQ ID NO: 1533359 - RNA, 20 nt, Pseudomonas aeruginosa PA01
cgacgcgccacgcaggaaca

SEQ ID NO: 1533360 - RNA, 13 nt, Pseudomonas aeruginosa PA01
cgacgcgcaggag

SEQ ID NO: 1533361 - RNA, 14 nt, Pseudomonas aeruginosa PA01
cgacgcgaccuccg

SEQ ID NO: 1533362 - RNA, 17 nt, Pseudomonas aeruginosa PA01
cgacgccuugcccggcg

SEQ ID NO: 1533363 - RNA, 13 nt, Pseudomonas aeruginosa PA01
cgacgccgagcag

SEQ ID NO: 1533364 - RNA, 14 nt, Pseudomonas aeruginosa PA01
cgacgccgagcagc

SEQ ID NO: 1533365 - RNA, 15 nt, Pseudomonas aeruginosa PA01
cgacgccgagcagca

SEQ ID NO: 1533366 - RNA, 20 nt, Pseudomonas aeruginosa PA01
cgacgccgagccagccgcgg

SEQ ID NO: 1533367 - RNA, 11 nt, Pseudomonas aeruginosa PA01
cgacgccgccg

SEQ ID NO: 1533368 - RNA, 15 nt, Pseudomonas aeruginosa PA01
cgacgccgcuggcgg

SEQ ID NO: 1533369 - RNA, 13 nt, Pseudomonas aeruginosa PA01
cgacgccgcgcug

SEQ ID NO: 1533370 - RNA, 14 nt, Pseudomonas aeruginosa PA01
cgacgccgcgcugc

SEQ ID NO: 1533371 - RNA, 20 nt, Pseudomonas aeruginosa PA01
cgacgagauugaugaagcgc

SEQ ID NO: 1533372 - RNA, 16 nt, Pseudomonas aeruginosa PA01
cgacgagcagcucgcc

SEQ ID NO: 1533373 - RNA, 21 nt, Pseudomonas aeruginosa PA01
cgacgagcagcucgccggcgu

SEQ ID NO: 1533374 - RNA, 18 nt, Pseudomonas aeruginosa PA01
cgacgagguugcucuggg

SEQ ID NO: 1533375 - RNA, 19 nt, Pseudomonas aeruginosa PA01
cgacgaguaaaacggcagg

SEQ ID NO: 1533376 - RNA, 18 nt, Pseudomonas aeruginosa PA01
cgacgacaguaccuucca

SEQ ID NO: 1533377 - RNA, 20 nt, Pseudomonas aeruginosa PA01
cgacgaugccgccgccgccc

SEQ ID NO: 1533378 - RNA, 14 nt, Pseudomonas aeruginosa PA01
cgacgaugcgcccc

SEQ ID NO: 1533379 - RNA, 19 nt, Pseudomonas aeruginosa PA01
cgacgccaccagccaggcg

SEQ ID NO: 1533380 - RNA, 13 nt, Pseudomonas aeruginosa PA01
cgacgccagcggc

SEQ ID NO: 1533381 - RNA, 16 nt, Pseudomonas aeruginosa PA01
cgacgccagcucggcc

SEQ ID NO: 1533382 - RNA, 18 nt, Pseudomonas aeruginosa PA01
cgacgccagcucggccgg

SEQ ID NO: 1533383 - RNA, 12 nt, Pseudomonas aeruginosa PA01
cgacgccacccg

SEQ ID NO: 1533384 - RNA, 13 nt, Pseudomonas aeruginosa PA01
cgacgccauggcg

SEQ ID NO: 1533385 - RNA, 15 nt, Pseudomonas aeruginosa PA01
cgacgcagccgggcc

SEQ ID NO: 1533386 - RNA, 11 nt, Pseudomonas aeruginosa PA01
cgacgaaggcg

SEQ ID NO: 1533387 - RNA, 20 nt, Pseudomonas aeruginosa PA01
cgacgaagugaccgcgcgcc

SEQ ID NO: 1533388 - RNA, 17 nt, Pseudomonas aeruginosa PA01
cgacgaacucgacgcgc

SEQ ID NO: 1533389 - RNA, 17 nt, Pseudomonas aeruginosa PA01
cgacgaacaggaagcgc

SEQ ID NO: 1533390 - RNA, 13 nt, Pseudomonas aeruginosa PA01
cgacgaagcccuc

SEQ ID NO: 1533391 - RNA, 15 nt, Pseudomonas aeruginosa PA01
cgacgaagacgcugc

SEQ ID NO: 1533392 - RNA, 17 nt, Pseudomonas aeruginosa PA01
cgaccuuguccaggcgc

SEQ ID NO: 1533393 - RNA, 18 nt, Pseudomonas aeruginosa PA01
cgaccuucaucaggcggc

SEQ ID NO: 1533394 - RNA, 15 nt, Pseudomonas aeruginosa PA01
cgaccuucaccacca

SEQ ID NO: 1533395 - RNA, 12 nt, Pseudomonas aeruginosa PA01
cgaccugggcgu

SEQ ID NO: 1533396 - RNA, 20 nt, Pseudomonas aeruginosa PA01
cgaccugggcgucgcuguag

SEQ ID NO: 1533397 - RNA, 17 nt, Pseudomonas aeruginosa PA01
cgaccuggggcggccuc

SEQ ID NO: 1533398 - RNA, 17 nt, Pseudomonas aeruginosa PA01
cgaccuggguaccgacg

SEQ ID NO: 1533399 - RNA, 13 nt, Pseudomonas aeruginosa PA01
cgaccugguagcc

SEQ ID NO: 1533400 - RNA, 18 nt, Pseudomonas aeruginosa PA01
cgaccucagaccacgccc

SEQ ID NO: 1533401 - RNA, 23 nt, Pseudomonas aeruginosa PA01
cgaccuccgccgcuuccgccagg

SEQ ID NO: 1533402 - RNA, 21 nt, Pseudomonas aeruginosa PA01
cgacaugcaguagagcccucg

SEQ ID NO: 1533403 - RNA, 14 nt, Pseudomonas aeruginosa PA01
cgacaucuccaggc

SEQ ID NO: 1533404 - RNA, 16 nt, Pseudomonas aeruginosa PA01
cgacaucuccaggccg

SEQ ID NO: 1533405 - RNA, 16 nt, Pseudomonas aeruginosa PA01
cgaccacacaugcagg

SEQ ID NO: 1533406 - RNA, 15 nt, Pseudomonas aeruginosa PA01
cgaccaccaucaccg

SEQ ID NO: 1533407 - RNA, 16 nt, Pseudomonas aeruginosa PA01
cgaccacaucggccag

SEQ ID NO: 1533408 - RNA, 14 nt, Pseudomonas aeruginosa PA01
cgaccaacagggcg

SEQ ID NO: 1533409 - RNA, 15 nt, Pseudomonas aeruginosa PA01
cgaccacggccuucg

SEQ ID NO: 1533410 - RNA, 21 nt, Pseudomonas aeruginosa PA01
cgaccacgcucuugaucgucu

SEQ ID NO: 1533411 - RNA, 14 nt, Pseudomonas aeruginosa PA01
cgaccaucggcggc

SEQ ID NO: 1533412 - RNA, 15 nt, Pseudomonas aeruginosa PA01
cgaccagcagggcca

SEQ ID NO: 1533413 - RNA, 15 nt, Pseudomonas aeruginosa PA01
cgaccacuuccaggu

SEQ ID NO: 1533414 - RNA, 12 nt, Pseudomonas aeruginosa PA01
cgaccagcgcca

SEQ ID NO: 1533415 - RNA, 22 nt, Pseudomonas aeruginosa PA01
cgaccagcggcgguagcuccag

SEQ ID NO: 1533416 - RNA, 14 nt, Pseudomonas aeruginosa PA01
cgacccagcgcugg

SEQ ID NO: 1533417 - RNA, 14 nt, Pseudomonas aeruginosa PA01
cgacccgcugaagg

SEQ ID NO: 1533418 - RNA, 17 nt, Pseudomonas aeruginosa PA01
cgacccaugccgcuagc

SEQ ID NO: 1533419 - RNA, 12 nt, Pseudomonas aeruginosa PA01
cgacccaggccc

SEQ ID NO: 1533420 - RNA, 17 nt, Pseudomonas aeruginosa PA01
cgacccaggccgacagc

SEQ ID NO: 1533421 - RNA, 15 nt, Pseudomonas aeruginosa PA01
cgacccagaccugcc

SEQ ID NO: 1533422 - RNA, 22 nt, Pseudomonas aeruginosa PA01
cgacccagaccugccgcccggc

SEQ ID NO: 1533423 - RNA, 18 nt, Pseudomonas aeruginosa PA01
cgacccgggucaggccga

SEQ ID NO: 1533424 - RNA, 18 nt, Pseudomonas aeruginosa PA01
cgacccgguuaccggcga

SEQ ID NO: 1533425 - RNA, 22 nt, Pseudomonas aeruginosa PA01
cgacccucauggaaaccccggc

SEQ ID NO: 1533426 - RNA, 19 nt, Pseudomonas aeruginosa PA01
cgacccuggcgccgaccuc

SEQ ID NO: 1533427 - RNA, 21 nt, Pseudomonas aeruginosa PA01
cgacccuggcgccgaccucca

SEQ ID NO: 1533428 - RNA, 19 nt, Pseudomonas aeruginosa PA01
cgaccgccaggcggccgcu

SEQ ID NO: 1533429 - RNA, 16 nt, Pseudomonas aeruginosa PA01
cgaccgcaccgccagc

SEQ ID NO: 1533430 - RNA, 16 nt, Pseudomonas aeruginosa PA01
cgaccgaacagcgcgc

SEQ ID NO: 1533431 - RNA, 21 nt, Pseudomonas aeruginosa PA01
cgacccuucaacggcgaccgc

SEQ ID NO: 1533432 - RNA, 13 nt, Pseudomonas aeruginosa PA01
cgaccgagcagcg

SEQ ID NO: 1533433 - RNA, 15 nt, Pseudomonas aeruginosa PA01
cgaccgcccaggcug

SEQ ID NO: 1533434 - RNA, 17 nt, Pseudomonas aeruginosa PA01
cgaccgcccaggcugcc

SEQ ID NO: 1533435 - RNA, 18 nt, Pseudomonas aeruginosa PA01
cgaccgcgaguucgccgg

SEQ ID NO: 1533436 - RNA, 21 nt, Pseudomonas aeruginosa PA01
cgaccgcgaguucgccggcca

SEQ ID NO: 1533437 - RNA, 17 nt, Pseudomonas aeruginosa PA01
cgaccgccugccagacc

SEQ ID NO: 1533438 - RNA, 18 nt, Pseudomonas aeruginosa PA01
cgaccgcgcgccugcaac

SEQ ID NO: 1533439 - RNA, 14 nt, Pseudomonas aeruginosa PA01
cgaccgcgccggcg

SEQ ID NO: 1533440 - RNA, 13 nt, Pseudomonas aeruginosa PA01
cgaccggcgcgcc

SEQ ID NO: 1533441 - RNA, 14 nt, Pseudomonas aeruginosa PA01
cgaccggcgcgccu

SEQ ID NO: 1533442 - RNA, 15 nt, Pseudomonas aeruginosa PA01
cgaccggcgcgccuu

SEQ ID NO: 1533443 - RNA, 15 nt, Pseudomonas aeruginosa PA01
cgaccgucgccacgc

SEQ ID NO: 1533444 - RNA, 18 nt, Pseudomonas aeruginosa PA01
cgaagcguugcagcgucu

SEQ ID NO: 1533445 - RNA, 22 nt, Pseudomonas aeruginosa PA01
cgaagcuggccaguugcaccgc

SEQ ID NO: 1533446 - RNA, 21 nt, Pseudomonas aeruginosa PA01
cgaagcggucgccggcgcgca

SEQ ID NO: 1533447 - RNA, 23 nt, Pseudomonas aeruginosa PA01
cgaagcggucgccggcgcgcacg

SEQ ID NO: 1533448 - RNA, 14 nt, Pseudomonas aeruginosa PA01
cgaagcccaggcug

SEQ ID NO: 1533449 - RNA, 17 nt, Pseudomonas aeruginosa PA01
cgaagcccaucgacugc

SEQ ID NO: 1533450 - RNA, 12 nt, Pseudomonas aeruginosa PA01
cgaacugcaggg

SEQ ID NO: 1533451 - RNA, 14 nt, Pseudomonas aeruginosa PA01
cgaacugaccacca

SEQ ID NO: 1533452 - RNA, 16 nt, Pseudomonas aeruginosa PA01
cgaacugaccaccagg

SEQ ID NO: 1533453 - RNA, 18 nt, Pseudomonas aeruginosa PA01
cgaacuucuccgccaccc

SEQ ID NO: 1533454 - RNA, 22 nt, Pseudomonas aeruginosa PA01
cgaagaacaccacgcggugcca

SEQ ID NO: 1533455 - RNA, 18 nt, Pseudomonas aeruginosa PA01
cgaagaaccacuggaugg

SEQ ID NO: 1533456 - RNA, 20 nt, Pseudomonas aeruginosa PA01
cgaagauuccgcugaggaug

SEQ ID NO: 1533457 - RNA, 21 nt, Pseudomonas aeruginosa PA01
cgaagauuccgcugaggaugu

SEQ ID NO: 1533458 - RNA, 16 nt, Pseudomonas aeruginosa PA01
cgaaccguccgcagcg

SEQ ID NO: 1533459 - RNA, 16 nt, Pseudomonas aeruginosa PA01
ccuuuuucauggccug

SEQ ID NO: 1533460 - RNA, 20 nt, Pseudomonas aeruginosa PA01
cgaaccguggcggccgccgc

SEQ ID NO: 1533461 - RNA, 21 nt, Pseudomonas aeruginosa PA01
cgaacuccgccagcaccaccc

SEQ ID NO: 1533462 - RNA, 16 nt, Pseudomonas aeruginosa PA01
cgaaguugaaacggcg

SEQ ID NO: 1533463 - RNA, 14 nt, Pseudomonas aeruginosa PA01
cgaaguucuccagc

SEQ ID NO: 1533464 - RNA, 20 nt, Pseudomonas aeruginosa PA01
cgaagcugucggcccgcgcc

SEQ ID NO: 1533465 - RNA, 19 nt, Pseudomonas aeruginosa PA01
cgaagcuucuucggcagcc

SEQ ID NO: 1533466 - RNA, 18 nt, Pseudomonas aeruginosa PA01
cgaaggcaacagcccgcg

SEQ ID NO: 1533467 - RNA, 14 nt, Pseudomonas aeruginosa PA01
cgaaggacaggccg

SEQ ID NO: 1533468 - RNA, 15 nt, Pseudomonas aeruginosa PA01
cgaagugaagcgauc

SEQ ID NO: 1533469 - RNA, 15 nt, Pseudomonas aeruginosa PA01
cgaaggccaggaccg

SEQ ID NO: 1533470 - RNA, 16 nt, Pseudomonas aeruginosa PA01
cgaauaacgccaccgg

SEQ ID NO: 1533471 - RNA, 20 nt, Pseudomonas aeruginosa PA01
cgaaucgccuaccagaccgc

SEQ ID NO: 1533472 - RNA, 22 nt, Pseudomonas aeruginosa PA01
cgaauggagggaucgcgcggcu

SEQ ID NO: 1533473 - RNA, 20 nt, Pseudomonas aeruginosa PA01
cgaauggcagcaggcacagg

SEQ ID NO: 1533474 - RNA, 17 nt, Pseudomonas aeruginosa PA01
cgacaggcagcgccgcc

SEQ ID NO: 1533475 - RNA, 19 nt, Pseudomonas aeruginosa PA01
cgacaggccauucuucucc

SEQ ID NO: 1533476 - RNA, 19 nt, Pseudomonas aeruginosa PA01
cgacaggucggccggcagc

SEQ ID NO: 1533477 - RNA, 20 nt, Pseudomonas aeruginosa PA01
cgacaggucggccggcagcu

SEQ ID NO: 1533478 - RNA, 23 nt, Pseudomonas aeruginosa PA01
cgacaggucggccggcagcuccg

SEQ ID NO: 1533479 - RNA, 13 nt, Pseudomonas aeruginosa PA01
cgacaguugcggu

SEQ ID NO: 1533480 - RNA, 18 nt, Pseudomonas aeruginosa PA01
cgacauagcgcagcaccg

SEQ ID NO: 1533481 - RNA, 19 nt, Pseudomonas aeruginosa PA01
cgacauagcggcugcuguc

SEQ ID NO: 1533482 - RNA, 23 nt, Pseudomonas aeruginosa PA01
cgacagcgaaugcuugccggcgc

SEQ ID NO: 1533483 - RNA, 13 nt, Pseudomonas aeruginosa PA01
cgacagccccggc

SEQ ID NO: 1533484 - RNA, 11 nt, Pseudomonas aeruginosa PA01
cgacagcaggu

SEQ ID NO: 1533485 - RNA, 16 nt, Pseudomonas aeruginosa PA01
cgacagcagguggcug

SEQ ID NO: 1533486 - RNA, 12 nt, Pseudomonas aeruginosa PA01
cgacagcaucug

SEQ ID NO: 1533487 - RNA, 14 nt, Pseudomonas aeruginosa PA01
cgacagcagcgcca

SEQ ID NO: 1533488 - RNA, 17 nt, Pseudomonas aeruginosa PA01
cgacaccucgaucagcg

SEQ ID NO: 1533489 - RNA, 21 nt, Pseudomonas aeruginosa PA01
cgacaccucgaucagcgggua

SEQ ID NO: 1533490 - RNA, 16 nt, Pseudomonas aeruginosa PA01
cgaauuggacagcagg

SEQ ID NO: 1533491 - RNA, 21 nt, Pseudomonas aeruginosa PA01
cgaauuuccugcuggcgagcg

SEQ ID NO: 1533492 - RNA, 16 nt, Pseudomonas aeruginosa PA01
cgacacccgcgccgcc

SEQ ID NO: 1533493 - RNA, 18 nt, Pseudomonas aeruginosa PA01
cgacacccgcgccgccgc

SEQ ID NO: 1533494 - RNA, 20 nt, Pseudomonas aeruginosa PA01
cgacaccgaucaccuggccg

SEQ ID NO: 1533495 - RNA, 16 nt, Pseudomonas aeruginosa PA01
cgacaccgccagcacc

SEQ ID NO: 1533496 - RNA, 21 nt, Pseudomonas aeruginosa PA01
cgacacgcacucauagcucag

SEQ ID NO: 1533497 - RNA, 15 nt, Pseudomonas aeruginosa PA01
cgacaaggagcgcga

SEQ ID NO: 1533498 - RNA, 15 nt, Pseudomonas aeruginosa PA01
cgacaagccuccagc

SEQ ID NO: 1533499 - RNA, 17 nt, Pseudomonas aeruginosa PA01
cgacaaucagcggcggg

SEQ ID NO: 1533500 - RNA, 12 nt, Pseudomonas aeruginosa PA01
ccggucaccacc

SEQ ID NO: 1533501 - RNA, 17 nt, Pseudomonas aeruginosa PA01
ccggucaccacccagcc

SEQ ID NO: 1533502 - RNA, 21 nt, Pseudomonas aeruginosa PA01
ccggucaccacccagccgcgg

SEQ ID NO: 1533503 - RNA, 23 nt, Pseudomonas aeruginosa PA01
ccggucaaaccauggcguagggc

SEQ ID NO: 1533504 - RNA, 23 nt, Pseudomonas aeruginosa PA01
ccggucaaaucguagcguagggc

SEQ ID NO: 1533505 - RNA, 23 nt, Pseudomonas aeruginosa PA01
ccgguagcggcgcaccgacgccg

SEQ ID NO: 1533506 - RNA, 13 nt, Pseudomonas aeruginosa PA01
ccgguagccggcg

SEQ ID NO: 1533507 - RNA, 15 nt, Pseudomonas aeruginosa PA01
ccgguagccggcgau

SEQ ID NO: 1533508 - RNA, 17 nt, Pseudomonas aeruginosa PA01
ccgguacgcucaccacc

SEQ ID NO: 1533509 - RNA, 20 nt, Pseudomonas aeruginosa PA01
ccgguacgcucaccaccacc

SEQ ID NO: 1533510 - RNA, 18 nt, Pseudomonas aeruginosa PA01
ccgguacucgccgggcgu

SEQ ID NO: 1533511 - RNA, 17 nt, Pseudomonas aeruginosa PA01
ccgguacugcugggccu

SEQ ID NO: 1533512 - RNA, 17 nt, Pseudomonas aeruginosa PA01
ccgguagacgccuccca

SEQ ID NO: 1533513 - RNA, 18 nt, Pseudomonas aeruginosa PA01
ccggucgcugaccagccc

SEQ ID NO: 1533514 - RNA, 20 nt, Pseudomonas aeruginosa PA01
ccggucgcugaccagcccgg

SEQ ID NO: 1533515 - RNA, 19 nt, Pseudomonas aeruginosa PA01
ccggucggacuccgcccag

SEQ ID NO: 1533516 - RNA, 21 nt, Pseudomonas aeruginosa PA01
ccggucagcuucgccgcccug

SEQ ID NO: 1533517 - RNA, 20 nt, Pseudomonas aeruginosa PA01
ccggucaaccgcgggcgagg

SEQ ID NO: 1533518 - RNA, 13 nt, Pseudomonas aeruginosa PA01
ccggugcucggcc

SEQ ID NO: 1533519 - RNA, 20 nt, Pseudomonas aeruginosa PA01
ccggugcggguggucgccgc

SEQ ID NO: 1533520 - RNA, 16 nt, Pseudomonas aeruginosa PA01
ccgguggacugguuga

SEQ ID NO: 1533521 - RNA, 22 nt, Pseudomonas aeruginosa PA01
ccggugugcgcugcaucggcgc

SEQ ID NO: 1533522 - RNA, 13 nt, Pseudomonas aeruginosa PA01
ccgguggccagga

SEQ ID NO: 1533523 - RNA, 13 nt, Pseudomonas aeruginosa PA01
ccgguggccaggc

SEQ ID NO: 1533524 - RNA, 23 nt, Pseudomonas aeruginosa PA01
ccgguggccuccugcaacgccug

SEQ ID NO: 1533525 - RNA, 18 nt, Pseudomonas aeruginosa PA01
ccgguggcgcccagccag

SEQ ID NO: 1533526 - RNA, 16 nt, Pseudomonas aeruginosa PA01
ccggugaggcgcagca

SEQ ID NO: 1533527 - RNA, 18 nt, Pseudomonas aeruginosa PA01
ccggugaucgagccgccg

SEQ ID NO: 1533528 - RNA, 19 nt, Pseudomonas aeruginosa PA01
ccggugaucgagccgccgg

SEQ ID NO: 1533529 - RNA, 21 nt, Pseudomonas aeruginosa PA01
ccggucggccuugaggcgggc

SEQ ID NO: 1533530 - RNA, 22 nt, Pseudomonas aeruginosa PA01
ccggucgagguugcgcggcagg

SEQ ID NO: 1533531 - RNA, 19 nt, Pseudomonas aeruginosa PA01
ccggugccaggaccagccc

SEQ ID NO: 1533532 - RNA, 21 nt, Pseudomonas aeruginosa PA01
ccggugccagggcggucggcc

SEQ ID NO: 1533533 - RNA, 22 nt, Pseudomonas aeruginosa PA01
ccggugcagaagacgcccagca

SEQ ID NO: 1533534 - RNA, 19 nt, Pseudomonas aeruginosa PA01
ccggugcaggaacagguuc

SEQ ID NO: 1533535 - RNA, 23 nt, Pseudomonas aeruginosa PA01
ccgggcguuuucguugccgcgcu

SEQ ID NO: 1533536 - RNA, 20 nt, Pseudomonas aeruginosa PA01
ccgggcguugguacagcucg

SEQ ID NO: 1533537 - RNA, 19 nt, Pseudomonas aeruginosa PA01
ccgggcucacucccgucca

SEQ ID NO: 1533538 - RNA, 15 nt, Pseudomonas aeruginosa PA01
ccgggcucagcgcgc

SEQ ID NO: 1533539 - RNA, 14 nt, Pseudomonas aeruginosa PA01
ccgggcgggucugg

SEQ ID NO: 1533540 - RNA, 20 nt, Pseudomonas aeruginosa PA01
ccgggcgggucuggcggaac

SEQ ID NO: 1533541 - RNA, 14 nt, Pseudomonas aeruginosa PA01
ccgggcgcccggcc

SEQ ID NO: 1533542 - RNA, 17 nt, Pseudomonas aeruginosa PA01
ccgggcgcccggccgga

SEQ ID NO: 1533543 - RNA, 21 nt, Pseudomonas aeruginosa PA01
ccgggucgaugggccguaggu

SEQ ID NO: 1533544 - RNA, 21 nt, Pseudomonas aeruginosa PA01
ccgggucgacuucgcaccagc

SEQ ID NO: 1533545 - RNA, 14 nt, Pseudomonas aeruginosa PA01
ccgggucgccgcag

SEQ ID NO: 1533546 - RNA, 15 nt, Pseudomonas aeruginosa PA01
ccgggucgcagccgg

SEQ ID NO: 1533547 - RNA, 14 nt, Pseudomonas aeruginosa PA01
ccgggucgcgcagc

SEQ ID NO: 1533548 - RNA, 18 nt, Pseudomonas aeruginosa PA01
ccgggucgcgcagcggcu

SEQ ID NO: 1533549 - RNA, 17 nt, Pseudomonas aeruginosa PA01
ccgggucgcugcucagg

SEQ ID NO: 1533550 - RNA, 21 nt, Pseudomonas aeruginosa PA01
ccgggucgcugcucagggccg

SEQ ID NO: 1533551 - RNA, 22 nt, Pseudomonas aeruginosa PA01
ccgggucgcugcucagggccgc

SEQ ID NO: 1533552 - RNA, 15 nt, Pseudomonas aeruginosa PA01
ccgggcuccaccagu

SEQ ID NO: 1533553 - RNA, 19 nt, Pseudomonas aeruginosa PA01
ccggguccagcggccgcgc

SEQ ID NO: 1533554 - RNA, 13 nt, Pseudomonas aeruginosa PA01
ccgggucauuggc

SEQ ID NO: 1533555 - RNA, 14 nt, Pseudomonas aeruginosa PA01
ccgggucauuggcg

SEQ ID NO: 1533556 - RNA, 14 nt, Pseudomonas aeruginosa PA01
ccggguucugcucg

SEQ ID NO: 1533557 - RNA, 14 nt, Pseudomonas aeruginosa PA01
ccggguugaccuug

SEQ ID NO: 1533558 - RNA, 20 nt, Pseudomonas aeruginosa PA01
ccgggucguacaccagaugg

SEQ ID NO: 1533559 - RNA, 21 nt, Pseudomonas aeruginosa PA01
ccgggucguacaccagauggc

SEQ ID NO: 1533560 - RNA, 13 nt, Pseudomonas aeruginosa PA01
ccgggucuucagu

SEQ ID NO: 1533561 - RNA, 16 nt, Pseudomonas aeruginosa PA01
ccgggugccccaggcg

SEQ ID NO: 1533562 - RNA, 20 nt, Pseudomonas aeruginosa PA01
ccgggugccuuccgcgccca

SEQ ID NO: 1533563 - RNA, 21 nt, Pseudomonas aeruginosa PA01
ccggguugcccucgcagccgg

SEQ ID NO: 1533564 - RNA, 24 nt, Pseudomonas aeruginosa PA01
ccggguugagguagagcacgccgu

SEQ ID NO: 1533565 - RNA, 23 nt, Pseudomonas aeruginosa PA01
ccggguugguggccgcgccgccc

SEQ ID NO: 1533566 - RNA, 22 nt, Pseudomonas aeruginosa PA01
ccggguugucguugcgcagcuu

SEQ ID NO: 1533567 - RNA, 23 nt, Pseudomonas aeruginosa PA01
ccgguacagcgccuggucggcgg

SEQ ID NO: 1533568 - RNA, 19 nt, Pseudomonas aeruginosa PA01
ccgguacagcuguccgcgc

SEQ ID NO: 1533569 - RNA, 22 nt, Pseudomonas aeruginosa PA01
ccggcugugcucgacgggcgcu

SEQ ID NO: 1533570 - RNA, 13 nt, Pseudomonas aeruginosa PA01
ccggcuggucaga

SEQ ID NO: 1533571 - RNA, 19 nt, Pseudomonas aeruginosa PA01
ccgggaugcucaccgcgcu

SEQ ID NO: 1533572 - RNA, 14 nt, Pseudomonas aeruginosa PA01
ccgggcaacugccg

SEQ ID NO: 1533573 - RNA, 19 nt, Pseudomonas aeruginosa PA01
ccgggcaacgccaggccgc

SEQ ID NO: 1533574 - RNA, 20 nt, Pseudomonas aeruginosa PA01
ccggcugcuccgggcggcug

SEQ ID NO: 1533575 - RNA, 18 nt, Pseudomonas aeruginosa PA01
ccggcucgaccuugcugg

SEQ ID NO: 1533576 - RNA, 13 nt, Pseudomonas aeruginosa PA01
ccggcuccuugcg

SEQ ID NO: 1533577 - RNA, 19 nt, Pseudomonas aeruginosa PA01
ccggcucagcgcuucggcu

SEQ ID NO: 1533578 - RNA, 22 nt, Pseudomonas aeruginosa PA01
ccgggcauucgcagcggccccg

SEQ ID NO: 1533579 - RNA, 14 nt, Pseudomonas aeruginosa PA01
ccgggcccaggcug

SEQ ID NO: 1533580 - RNA, 14 nt, Pseudomonas aeruginosa PA01
ccgggcccugcuuc

SEQ ID NO: 1533581 - RNA, 14 nt, Pseudomonas aeruginosa PA01
ccgggcgaccugcu

SEQ ID NO: 1533582 - RNA, 21 nt, Pseudomonas aeruginosa PA01
ccgggcccaagccgagcggca

SEQ ID NO: 1533583 - RNA, 22 nt, Pseudomonas aeruginosa PA01
ccgggcagacuucgccgugcuc

SEQ ID NO: 1533584 - RNA, 22 nt, Pseudomonas aeruginosa PA01
ccgggcagcagccggaccagcc

SEQ ID NO: 1533585 - RNA, 15 nt, Pseudomonas aeruginosa PA01
ccgggcagcggcgca

SEQ ID NO: 1533586 - RNA, 17 nt, Pseudomonas aeruginosa PA01
ccggcgguggacgucgg

SEQ ID NO: 1533587 - RNA, 17 nt, Pseudomonas aeruginosa PA01
ccggcguacuucggcgc

SEQ ID NO: 1533588 - RNA, 15 nt, Pseudomonas aeruginosa PA01
ccggcgggcgguagc

SEQ ID NO: 1533589 - RNA, 19 nt, Pseudomonas aeruginosa PA01
ccggcggguucagcccgcc

SEQ ID NO: 1533590 - RNA, 13 nt, Pseudomonas aeruginosa PA01
ccggcgcacugcg

SEQ ID NO: 1533591 - RNA, 17 nt, Pseudomonas aeruginosa PA01
ccggcgcagaacugccg

SEQ ID NO: 1533592 - RNA, 20 nt, Pseudomonas aeruginosa PA01
ccggcgauguucgcccccuu

SEQ ID NO: 1533593 - RNA, 19 nt, Pseudomonas aeruginosa PA01
ccggcgaugcucagcgccg

SEQ ID NO: 1533594 - RNA, 15 nt, Pseudomonas aeruginosa PA01
ccggcgauggcccag

SEQ ID NO: 1533595 - RNA, 15 nt, Pseudomonas aeruginosa PA01
ccggcgauggccgcc

SEQ ID NO: 1533596 - RNA, 17 nt, Pseudomonas aeruginosa PA01
ccggcgaugcccaggcc

SEQ ID NO: 1533597 - RNA, 20 nt, Pseudomonas aeruginosa PA01
ccggcgaugccgcccagcac

SEQ ID NO: 1533598 - RNA, 19 nt, Pseudomonas aeruginosa PA01
ccggcgaucgccaggcgau

SEQ ID NO: 1533599 - RNA, 19 nt, Pseudomonas aeruginosa PA01
ccggcgaaguccggguuga

SEQ ID NO: 1533600 - RNA, 19 nt, Pseudomonas aeruginosa PA01
ccggcggccugagccggcc

SEQ ID NO: 1533601 - RNA, 19 nt, Pseudomonas aeruginosa PA01
ccggcgcacgccggccucg

SEQ ID NO: 1533602 - RNA, 12 nt, Pseudomonas aeruginosa PA01
ccggcgcagccc

SEQ ID NO: 1533603 - RNA, 21 nt, Pseudomonas aeruginosa PA01
ccggcggcgaugaagcugaug

SEQ ID NO: 1533604 - RNA, 22 nt, Pseudomonas aeruginosa PA01
ccggcggcgacccagaccugcc

SEQ ID NO: 1533605 - RNA, 23 nt, Pseudomonas aeruginosa PA01
ccggcggccugccccgccggcgc

SEQ ID NO: 1533606 - RNA, 20 nt, Pseudomonas aeruginosa PA01
ccggcgucucauggaacagc

SEQ ID NO: 1533607 - RNA, 17 nt, Pseudomonas aeruginosa PA01
ccggcguccacuccggc

SEQ ID NO: 1533608 - RNA, 16 nt, Pseudomonas aeruginosa PA01
ccggcguccccuuccu

SEQ ID NO: 1533609 - RNA, 22 nt, Pseudomonas aeruginosa PA01
ccggcguccgggugccccaggc

SEQ ID NO: 1533610 - RNA, 24 nt, Pseudomonas aeruginosa PA01
ccggcguggacccacgcauuggcu

SEQ ID NO: 1533611 - RNA, 23 nt, Pseudomonas aeruginosa PA01
ccggcgugguggcggggaacagc

SEQ ID NO: 1533612 - RNA, 16 nt, Pseudomonas aeruginosa PA01
ccggccaaccaccggc

SEQ ID NO: 1533613 - RNA, 17 nt, Pseudomonas aeruginosa PA01
ccggcaugcucagccgc

SEQ ID NO: 1533614 - RNA, 21 nt, Pseudomonas aeruginosa PA01
ccggcaugcucagccgcgccg

SEQ ID NO: 1533615 - RNA, 14 nt, Pseudomonas aeruginosa PA01
ccggcaucgugccg

SEQ ID NO: 1533616 - RNA, 17 nt, Pseudomonas aeruginosa PA01
ccggcaucgugccgcgg

SEQ ID NO: 1533617 - RNA, 14 nt, Pseudomonas aeruginosa PA01
ccggcaucgaccag

SEQ ID NO: 1533618 - RNA, 18 nt, Pseudomonas aeruginosa PA01
ccggcaucgaccagcagc

SEQ ID NO: 1533619 - RNA, 20 nt, Pseudomonas aeruginosa PA01
ccggcaucgaccagcagcgg

SEQ ID NO: 1533620 - RNA, 23 nt, Pseudomonas aeruginosa PA01
ccggcaucgaccagcagcggcuc

SEQ ID NO: 1533621 - RNA, 18 nt, Pseudomonas aeruginosa PA01
ccggccaggcccucagcg

SEQ ID NO: 1533622 - RNA, 13 nt, Pseudomonas aeruginosa PA01
ccggccaggccgc

SEQ ID NO: 1533623 - RNA, 17 nt, Pseudomonas aeruginosa PA01
ccggccaggccgcccag

SEQ ID NO: 1533624 - RNA, 18 nt, Pseudomonas aeruginosa PA01
ccggccaggccgcccagg

SEQ ID NO: 1533625 - RNA, 10 nt, Pseudomonas aeruginosa PA01
ccggccaggu

SEQ ID NO: 1533626 - RNA, 17 nt, Pseudomonas aeruginosa PA01
ccggccagguagcggcg

SEQ ID NO: 1533627 - RNA, 23 nt, Pseudomonas aeruginosa PA01
ccggccagguagcggcguucgcc

SEQ ID NO: 1533628 - RNA, 13 nt, Pseudomonas aeruginosa PA01
ccggccccgcggu

SEQ ID NO: 1533629 - RNA, 12 nt, Pseudomonas aeruginosa PA01
ccggccaucagc

SEQ ID NO: 1533630 - RNA, 22 nt, Pseudomonas aeruginosa PA01
ccggccaggucguugcgccggc

SEQ ID NO: 1533631 - RNA, 12 nt, Pseudomonas aeruginosa PA01
ccggccaggugg

SEQ ID NO: 1533632 - RNA, 14 nt, Pseudomonas aeruginosa PA01
ccggccccugggcc

SEQ ID NO: 1533633 - RNA, 19 nt, Pseudomonas aeruginosa PA01
ccggcccgggcguuggcuc

SEQ ID NO: 1533634 - RNA, 16 nt, Pseudomonas aeruginosa PA01
ccggccggcaggagga

SEQ ID NO: 1533635 - RNA, 15 nt, Pseudomonas aeruginosa PA01
ccggccggcaggccg

SEQ ID NO: 1533636 - RNA, 22 nt, Pseudomonas aeruginosa PA01
ccggccggauuggccgaggugg

SEQ ID NO: 1533637 - RNA, 17 nt, Pseudomonas aeruginosa PA01
ccggccggggcgcgccc

SEQ ID NO: 1533638 - RNA, 13 nt, Pseudomonas aeruginosa PA01
ccggccgucgcgc

SEQ ID NO: 1533639 - RNA, 13 nt, Pseudomonas aeruginosa PA01
ccggccgucccag

SEQ ID NO: 1533640 - RNA, 18 nt, Pseudomonas aeruginosa PA01
ccggccugguaggccucg

SEQ ID NO: 1533641 - RNA, 23 nt, Pseudomonas aeruginosa PA01
ccggccgugcggagggucaggcc

SEQ ID NO: 1533642 - RNA, 16 nt, Pseudomonas aeruginosa PA01
ccggcgaacgcuugag

SEQ ID NO: 1533643 - RNA, 16 nt, Pseudomonas aeruginosa PA01
ccggcgaaccaggcgg

SEQ ID NO: 1533644 - RNA, 21 nt, Pseudomonas aeruginosa PA01
ccggcgaaccagugcaccgcc

SEQ ID NO: 1533645 - RNA, 20 nt, Pseudomonas aeruginosa PA01
ccggcagucccugccagggg

SEQ ID NO: 1533646 - RNA, 17 nt, Pseudomonas aeruginosa PA01
ccggcauaggcgccagc

SEQ ID NO: 1533647 - RNA, 18 nt, Pseudomonas aeruginosa PA01
ccggcauaggcgccagcc

SEQ ID NO: 1533648 - RNA, 16 nt, Pseudomonas aeruginosa PA01
ccggcaggaucggcgc

SEQ ID NO: 1533649 - RNA, 22 nt, Pseudomonas aeruginosa PA01
ccggcagcucccuugccgccgg

SEQ ID NO: 1533650 - RNA, 14 nt, Pseudomonas aeruginosa PA01
ccggcagcuccggc

SEQ ID NO: 1533651 - RNA, 18 nt, Pseudomonas aeruginosa PA01
ccggcaggccuucggcgc

SEQ ID NO: 1533652 - RNA, 15 nt, Pseudomonas aeruginosa PA01
ccggcagggccucgg

SEQ ID NO: 1533653 - RNA, 13 nt, Pseudomonas aeruginosa PA01
ccggcagggcgau

SEQ ID NO: 1533654 - RNA, 12 nt, Pseudomonas aeruginosa PA01
ccggcagcgccg

SEQ ID NO: 1533655 - RNA, 15 nt, Pseudomonas aeruginosa PA01
ccggcagcgccgcca

SEQ ID NO: 1533656 - RNA, 18 nt, Pseudomonas aeruginosa PA01
ccggcagccggguuccca

SEQ ID NO: 1533657 - RNA, 15 nt, Pseudomonas aeruginosa PA01
ccggcagcgaccacc

SEQ ID NO: 1533658 - RNA, 13 nt, Pseudomonas aeruginosa PA01
ccggcagcggcug

SEQ ID NO: 1533659 - RNA, 15 nt, Pseudomonas aeruginosa PA01
ccggcagcggcuggc

SEQ ID NO: 1533660 - RNA, 17 nt, Pseudomonas aeruginosa PA01
ccggcagcagcgccagg

SEQ ID NO: 1533661 - RNA, 18 nt, Pseudomonas aeruginosa PA01
ccggcagcagcgccagga

SEQ ID NO: 1533662 - RNA, 20 nt, Pseudomonas aeruginosa PA01
ccggcagcacccgcaccagc

SEQ ID NO: 1533663 - RNA, 17 nt, Pseudomonas aeruginosa PA01
ccggcaaggcggccuca

SEQ ID NO: 1533664 - RNA, 18 nt, Pseudomonas aeruginosa PA01
ccggcaccaccaccggac

SEQ ID NO: 1533665 - RNA, 18 nt, Pseudomonas aeruginosa PA01
ccggcaccaccagcgcgc

SEQ ID NO: 1533666 - RNA, 20 nt, Pseudomonas aeruginosa PA01
ccggcacggaaacgccgaga

SEQ ID NO: 1533667 - RNA, 21 nt, Pseudomonas aeruginosa PA01
ccggcaccuugcgaaaagccc

SEQ ID NO: 1533668 - RNA, 21 nt, Pseudomonas aeruginosa PA01
ccggcaccgucgagcaccagg

SEQ ID NO: 1533669 - RNA, 23 nt, Pseudomonas aeruginosa PA01
ccggacaggaaaaagcccgcguc

SEQ ID NO: 1533670 - RNA, 15 nt, Pseudomonas aeruginosa PA01
ccggacaggccaccc

SEQ ID NO: 1533671 - RNA, 17 nt, Pseudomonas aeruginosa PA01
ccggacaggccacccgc

SEQ ID NO: 1533672 - RNA, 18 nt, Pseudomonas aeruginosa PA01
ccggaaaaauccucgccu

SEQ ID NO: 1533673 - RNA, 16 nt, Pseudomonas aeruginosa PA01
ccggaaaagaagccgc

SEQ ID NO: 1533674 - RNA, 17 nt, Pseudomonas aeruginosa PA01
ccggaccagccgguccc

SEQ ID NO: 1533675 - RNA, 16 nt, Pseudomonas aeruginosa PA01
ccggaccagccguccg

SEQ ID NO: 1533676 - RNA, 15 nt, Pseudomonas aeruginosa PA01
ccggaccagggcgcc

SEQ ID NO: 1533677 - RNA, 23 nt, Pseudomonas aeruginosa PA01
ccggacacaaaaaaaccgccccg

SEQ ID NO: 1533678 - RNA, 12 nt, Pseudomonas aeruginosa PA01
ccggacccggcu

SEQ ID NO: 1533679 - RNA, 17 nt, Pseudomonas aeruginosa PA01
ccggaccgggcggcagg

SEQ ID NO: 1533680 - RNA, 18 nt, Pseudomonas aeruginosa PA01
ccggaccuuguccagggu

SEQ ID NO: 1533681 - RNA, 15 nt, Pseudomonas aeruginosa PA01
ccggacgacgaaaga

SEQ ID NO: 1533682 - RNA, 17 nt, Pseudomonas aeruginosa PA01
ccggacgacgaaagaag

SEQ ID NO: 1533683 - RNA, 16 nt, Pseudomonas aeruginosa PA01
ccgcuguccgccgccg

SEQ ID NO: 1533684 - RNA, 19 nt, Pseudomonas aeruginosa PA01
ccgcuguccgccgccgcgg

SEQ ID NO: 1533685 - RNA, 16 nt, Pseudomonas aeruginosa PA01
ccgcuguccgccggcc

SEQ ID NO: 1533686 - RNA, 23 nt, Pseudomonas aeruginosa PA01
ccgccucgaagaaaaggcccggc

SEQ ID NO: 1533687 - RNA, 19 nt, Pseudomonas aeruginosa PA01
ccgccucgaccagcgccgc

SEQ ID NO: 1533688 - RNA, 21 nt, Pseudomonas aeruginosa PA01
ccgccucgaccagcgccgcgg

SEQ ID NO: 1533689 - RNA, 19 nt, Pseudomonas aeruginosa PA01
ccgccucgaucuucuuccc

SEQ ID NO: 1533690 - RNA, 16 nt, Pseudomonas aeruginosa PA01
ccgccucgauggcggc

SEQ ID NO: 1533691 - RNA, 14 nt, Pseudomonas aeruginosa PA01
ccgccucgcgcaac

SEQ ID NO: 1533692 - RNA, 23 nt, Pseudomonas aeruginosa PA01
ccgccucgcgccgcgccagcagg

SEQ ID NO: 1533693 - RNA, 18 nt, Pseudomonas aeruginosa PA01
ccgccucgcugggcgggc

SEQ ID NO: 1533694 - RNA, 14 nt, Pseudomonas aeruginosa PA01
ccgcuucgccgccc

SEQ ID NO: 1533695 - RNA, 14 nt, Pseudomonas aeruginosa PA01
ccgcuuccugggcu

SEQ ID NO: 1533696 - RNA, 16 nt, Pseudomonas aeruginosa PA01
ccgcuucagcgcgccg

SEQ ID NO: 1533697 - RNA, 21 nt, Pseudomonas aeruginosa PA01
ccgcuuccgccggcgccgccu

SEQ ID NO: 1533698 - RNA, 14 nt, Pseudomonas aeruginosa PA01
ccgcuuccggcccg

SEQ ID NO: 1533699 - RNA, 18 nt, Pseudomonas aeruginosa PA01
ccgcuguuggcgugacug

SEQ ID NO: 1533700 - RNA, 19 nt, Pseudomonas aeruginosa PA01
ccgcuguuucuccaguucg

SEQ ID NO: 1533701 - RNA, 19 nt, Pseudomonas aeruginosa PA01
ccggaucgcccuggcgcca

SEQ ID NO: 1533702 - RNA, 20 nt, Pseudomonas aeruginosa PA01
ccggaucggccuuggcgaug

SEQ ID NO: 1533703 - RNA, 14 nt, Pseudomonas aeruginosa PA01
ccggaugccaccgc

SEQ ID NO: 1533704 - RNA, 16 nt, Pseudomonas aeruginosa PA01
ccggauuggccgaggu

SEQ ID NO: 1533705 - RNA, 19 nt, Pseudomonas aeruginosa PA01
ccggauggcugacccgcug

SEQ ID NO: 1533706 - RNA, 15 nt, Pseudomonas aeruginosa PA01
ccggaugggcgagcu

SEQ ID NO: 1533707 - RNA, 13 nt, Pseudomonas aeruginosa PA01
ccggcaaaguauu

SEQ ID NO: 1533708 - RNA, 14 nt, Pseudomonas aeruginosa PA01
ccggauugccgcgg

SEQ ID NO: 1533709 - RNA, 23 nt, Pseudomonas aeruginosa PA01
ccggcaagcgccggcaacagcag

SEQ ID NO: 1533710 - RNA, 13 nt, Pseudomonas aeruginosa PA01
ccuacccgacagg

SEQ ID NO: 1533711 - RNA, 17 nt, Pseudomonas aeruginosa PA01
ccuaccauuagaggaac

SEQ ID NO: 1533712 - RNA, 14 nt, Pseudomonas aeruginosa PA01
ccuaccccaggggu

SEQ ID NO: 1533713 - RNA, 17 nt, Pseudomonas aeruginosa PA01
ccuaccaguaguucucc

SEQ ID NO: 1533714 - RNA, 14 nt, Pseudomonas aeruginosa PA01
ccuacaucuuggca

SEQ ID NO: 1533715 - RNA, 15 nt, Pseudomonas aeruginosa PA01
ccuagcacccgggua

SEQ ID NO: 1533716 - RNA, 21 nt, Pseudomonas aeruginosa PA01
ccuagcacccggguauagaaa

SEQ ID NO: 1533717 - RNA, 20 nt, Pseudomonas aeruginosa PA01
ccuacuugaucagccgcagg

SEQ ID NO: 1533718 - RNA, 23 nt, Pseudomonas aeruginosa PA01
ccuacuugaucagccgcaggcag

SEQ ID NO: 1533719 - RNA, 22 nt, Pseudomonas aeruginosa PA01
ccuacgaaggcauauccccucu

SEQ ID NO: 1533720 - RNA, 17 nt, Pseudomonas aeruginosa PA01
ccucaagucuccagcga

SEQ ID NO: 1533721 - RNA, 17 nt, Pseudomonas aeruginosa PA01
ccucagcagcgccgccc

SEQ ID NO: 1533722 - RNA, 10 nt, Pseudomonas aeruginosa PA01
ccucagaggc

SEQ ID NO: 1533723 - RNA, 19 nt, Pseudomonas aeruginosa PA01
ccucagaggcgaccagccg

SEQ ID NO: 1533724 - RNA, 21 nt, Pseudomonas aeruginosa PA01
ccucagaggcgaccagccggg

SEQ ID NO: 1533725 - RNA, 17 nt, Pseudomonas aeruginosa PA01
ccucagaccacgcccug

SEQ ID NO: 1533726 - RNA, 20 nt, Pseudomonas aeruginosa PA01
ccucagaccacgcccugcgc

SEQ ID NO: 1533727 - RNA, 23 nt, Pseudomonas aeruginosa PA01
ccucagaccacgcccugcgccag

SEQ ID NO: 1533728 - RNA, 22 nt, Pseudomonas aeruginosa PA01
ccucagaaguauuucaaccagg

SEQ ID NO: 1533729 - RNA, 16 nt, Pseudomonas aeruginosa PA01
ccucaucuccugugga

SEQ ID NO: 1533730 - RNA, 19 nt, Pseudomonas aeruginosa PA01
ccucagccucacccugcug

SEQ ID NO: 1533731 - RNA, 23 nt, Pseudomonas aeruginosa PA01
ccucagccucacccugcugggcg

SEQ ID NO: 1533732 - RNA, 17 nt, Pseudomonas aeruginosa PA01
ccuccaccagcgccggc

SEQ ID NO: 1533733 - RNA, 23 nt, Pseudomonas aeruginosa PA01
ccuccacccccaucgcccgcagc

SEQ ID NO: 1533734 - RNA, 14 nt, Pseudomonas aeruginosa PA01
ccuccacccgcgaa

SEQ ID NO: 1533735 - RNA, 17 nt, Pseudomonas aeruginosa PA01
ccuccagguaggcgccc

SEQ ID NO: 1533736 - RNA, 18 nt, Pseudomonas aeruginosa PA01
ccuccaggcgcgccugga

SEQ ID NO: 1533737 - RNA, 14 nt, Pseudomonas aeruginosa PA01
ccuccagggccagc

SEQ ID NO: 1533738 - RNA, 19 nt, Pseudomonas aeruginosa PA01
ccuccagguagaccuugcc

SEQ ID NO: 1533739 - RNA, 12 nt, Pseudomonas aeruginosa PA01
ccuccaguuccu

SEQ ID NO: 1533740 - RNA, 21 nt, Pseudomonas aeruginosa PA01
ccuccaguuccugcuccuccg

SEQ ID NO: 1533741 - RNA, 16 nt, Pseudomonas aeruginosa PA01
ccuccggcacgcugcc

SEQ ID NO: 1533742 - RNA, 20 nt, Pseudomonas aeruginosa PA01
ccuccggcacgcugccgccg

SEQ ID NO: 1533743 - RNA, 14 nt, Pseudomonas aeruginosa PA01
ccucccagccgugg

SEQ ID NO: 1533744 - RNA, 14 nt, Pseudomonas aeruginosa PA01
ccuccggacgccga

SEQ ID NO: 1533745 - RNA, 17 nt, Pseudomonas aeruginosa PA01
ccuccuucgagccuggc

SEQ ID NO: 1533746 - RNA, 21 nt, Pseudomonas aeruginosa PA01
ccuccuggaaagaccggcgcc

SEQ ID NO: 1533747 - RNA, 22 nt, Pseudomonas aeruginosa PA01
ccuccuggauacgcucggccaa

SEQ ID NO: 1533748 - RNA, 22 nt, Pseudomonas aeruginosa PA01
ccuccugggccgacgcuuccuc

SEQ ID NO: 1533749 - RNA, 21 nt, Pseudomonas aeruginosa PA01
ccuccuggggaaucugcgcca

SEQ ID NO: 1533750 - RNA, 14 nt, Pseudomonas aeruginosa PA01
ccucgcgcaacgcc

SEQ ID NO: 1533751 - RNA, 15 nt, Pseudomonas aeruginosa PA01
ccucggagaacagca

SEQ ID NO: 1533752 - RNA, 14 nt, Pseudomonas aeruginosa PA01
ccucgcugccgccg

SEQ ID NO: 1533753 - RNA, 19 nt, Pseudomonas aeruginosa PA01
ccucggauaugccgcucag

SEQ ID NO: 1533754 - RNA, 17 nt, Pseudomonas aeruginosa PA01
ccucggaugccgcacag

SEQ ID NO: 1533755 - RNA, 17 nt, Pseudomonas aeruginosa PA01
ccucgcugagcaggaac

SEQ ID NO: 1533756 - RNA, 17 nt, Pseudomonas aeruginosa PA01
ccucggcacucagccag

SEQ ID NO: 1533757 - RNA, 15 nt, Pseudomonas aeruginosa PA01
ccucggcagggcgcc

SEQ ID NO: 1533758 - RNA, 16 nt, Pseudomonas aeruginosa PA01
ccucggcauccucgcc

SEQ ID NO: 1533759 - RNA, 18 nt, Pseudomonas aeruginosa PA01
ccucggccaacggccgcu

SEQ ID NO: 1533760 - RNA, 14 nt, Pseudomonas aeruginosa PA01
ccucggccagccag

SEQ ID NO: 1533761 - RNA, 17 nt, Pseudomonas aeruginosa PA01
ccucggccagcgccgcc

SEQ ID NO: 1533762 - RNA, 20 nt, Pseudomonas aeruginosa PA01
ccucggccagcgccgccgcu

SEQ ID NO: 1533763 - RNA, 20 nt, Pseudomonas aeruginosa PA01
ccucgccguuggcgaggacu

SEQ ID NO: 1533764 - RNA, 16 nt, Pseudomonas aeruginosa PA01
ccucgccugcggcgcc

SEQ ID NO: 1533765 - RNA, 21 nt, Pseudomonas aeruginosa PA01
ccucgccgaaaagaagccccg

SEQ ID NO: 1533766 - RNA, 14 nt, Pseudomonas aeruginosa PA01
ccucgccgaggcgg

SEQ ID NO: 1533767 - RNA, 17 nt, Pseudomonas aeruginosa PA01
ccucgccgaucuccucc

SEQ ID NO: 1533768 - RNA, 20 nt, Pseudomonas aeruginosa PA01
ccucgccgaucuccuccgcc

SEQ ID NO: 1533769 - RNA, 17 nt, Pseudomonas aeruginosa PA01
ccucgccgaugucguag

SEQ ID NO: 1533770 - RNA, 13 nt, Pseudomonas aeruginosa PA01
ccucgauggcggc

SEQ ID NO: 1533771 - RNA, 21 nt, Pseudomonas aeruginosa PA01
ccucgcccucgaagcccugca

SEQ ID NO: 1533772 - RNA, 19 nt, Pseudomonas aeruginosa PA01
ccucgaugauccgcucgau

SEQ ID NO: 1533773 - RNA, 15 nt, Pseudomonas aeruginosa PA01
ccucgaucuucuucc

SEQ ID NO: 1533774 - RNA, 16 nt, Pseudomonas aeruginosa PA01
ccucgaugaaacgcag

SEQ ID NO: 1533775 - RNA, 15 nt, Pseudomonas aeruginosa PA01
ccucgaugaauggcu

SEQ ID NO: 1533776 - RNA, 20 nt, Pseudomonas aeruginosa PA01
ccucgaucgccucgggcgag

SEQ ID NO: 1533777 - RNA, 15 nt, Pseudomonas aeruginosa PA01
ccucgauccgcuggg

SEQ ID NO: 1533778 - RNA, 18 nt, Pseudomonas aeruginosa PA01
ccucgauccgcugggccu

SEQ ID NO: 1533779 - RNA, 20 nt, Pseudomonas aeruginosa PA01
ccucgaccaucggcggcggc

SEQ ID NO: 1533780 - RNA, 17 nt, Pseudomonas aeruginosa PA01
ccucgaccgcgccggcg

SEQ ID NO: 1533781 - RNA, 18 nt, Pseudomonas aeruginosa PA01
ccucgaccuggccacgcc

SEQ ID NO: 1533782 - RNA, 20 nt, Pseudomonas aeruginosa PA01
ccucgaagcggaucucgucg

SEQ ID NO: 1533783 - RNA, 15 nt, Pseudomonas aeruginosa PA01
ccucgaaagccgccg

SEQ ID NO: 1533784 - RNA, 15 nt, Pseudomonas aeruginosa PA01
ccucgacgcucuccg

SEQ ID NO: 1533785 - RNA, 17 nt, Pseudomonas aeruginosa PA01
ccucgauaaacggcgcu

SEQ ID NO: 1533786 - RNA, 22 nt, Pseudomonas aeruginosa PA01
ccucgaggaucuugcgcccggc

SEQ ID NO: 1533787 - RNA, 22 nt, Pseudomonas aeruginosa PA01
ccucgacgaaauaaugcggcgc

SEQ ID NO: 1533788 - RNA, 14 nt, Pseudomonas aeruginosa PA01
ccguugcggcccuu

SEQ ID NO: 1533789 - RNA, 19 nt, Pseudomonas aeruginosa PA01
ccguuggccagcaggcgcc

SEQ ID NO: 1533790 - RNA, 21 nt, Pseudomonas aeruginosa PA01
ccguuggcguuaugcgcccua

SEQ ID NO: 1533791 - RNA, 20 nt, Pseudomonas aeruginosa PA01
ccguuggcgaacuucaggcc

SEQ ID NO: 1533792 - RNA, 19 nt, Pseudomonas aeruginosa PA01
ccguuggcgaggacuuucu

SEQ ID NO: 1533793 - RNA, 16 nt, Pseudomonas aeruginosa PA01
ccguuguggcggcgcu

SEQ ID NO: 1533794 - RNA, 15 nt, Pseudomonas aeruginosa PA01
ccguugaccagcgcg

SEQ ID NO: 1533795 - RNA, 16 nt, Pseudomonas aeruginosa PA01
ccguugaggccgucga

SEQ ID NO: 1533796 - RNA, 20 nt, Pseudomonas aeruginosa PA01
ccguugaggcguucgaucuc

SEQ ID NO: 1533797 - RNA, 22 nt, Pseudomonas aeruginosa PA01
ccguucugccgcagcgccuccc

SEQ ID NO: 1533798 - RNA, 19 nt, Pseudomonas aeruginosa PA01
ccguucugcacaugcacca

SEQ ID NO: 1533799 - RNA, 14 nt, Pseudomonas aeruginosa PA01
ccguucuccagguc

SEQ ID NO: 1533800 - RNA, 19 nt, Pseudomonas aeruginosa PA01
ccguucgucaccggcgcca

SEQ ID NO: 1533801 - RNA, 16 nt, Pseudomonas aeruginosa PA01
ccguucaaagcccgcc

SEQ ID NO: 1533802 - RNA, 18 nt, Pseudomonas aeruginosa PA01
ccguucagcucccaggcg

SEQ ID NO: 1533803 - RNA, 16 nt, Pseudomonas aeruginosa PA01
ccguucaggccggcgc

SEQ ID NO: 1533804 - RNA, 12 nt, Pseudomonas aeruginosa PA01
ccguucccagca

SEQ ID NO: 1533805 - RNA, 17 nt, Pseudomonas aeruginosa PA01
ccguucccagcagcgcc

SEQ ID NO: 1533806 - RNA, 16 nt, Pseudomonas aeruginosa PA01
ccguucgccggccucc

SEQ ID NO: 1533807 - RNA, 22 nt, Pseudomonas aeruginosa PA01
ccguuccaccgccuggaccagg

SEQ ID NO: 1533808 - RNA, 14 nt, Pseudomonas aeruginosa PA01
ccguucgcccgcca

SEQ ID NO: 1533809 - RNA, 18 nt, Pseudomonas aeruginosa PA01
ccguuccgcucaccaggc

SEQ ID NO: 1533810 - RNA, 15 nt, Pseudomonas aeruginosa PA01
ccguuccggcgcagc

SEQ ID NO: 1533811 - RNA, 19 nt, Pseudomonas aeruginosa PA01
ccguuccuugcgcggcagg

SEQ ID NO: 1533812 - RNA, 19 nt, Pseudomonas aeruginosa PA01
ccguuaccgcgggcucagg

SEQ ID NO: 1533813 - RNA, 16 nt, Pseudomonas aeruginosa PA01
ccguuaccuuggccac

SEQ ID NO: 1533814 - RNA, 18 nt, Pseudomonas aeruginosa PA01
ccguguugaucgccgcgc

SEQ ID NO: 1533815 - RNA, 17 nt, Pseudomonas aeruginosa PA01
ccguuugccgucggcgc

SEQ ID NO: 1533816 - RNA, 14 nt, Pseudomonas aeruginosa PA01
ccguuucgccgccg

SEQ ID NO: 1533817 - RNA, 15 nt, Pseudomonas aeruginosa PA01
ccgguuggcgcccca

SEQ ID NO: 1533818 - RNA, 15 nt, Pseudomonas aeruginosa PA01
ccgguugcugcugcg

SEQ ID NO: 1533819 - RNA, 23 nt, Pseudomonas aeruginosa PA01
ccgguuggcuacccgcagggcuc

SEQ ID NO: 1533820 - RNA, 16 nt, Pseudomonas aeruginosa PA01
ccgucgagccagccca

SEQ ID NO: 1533821 - RNA, 19 nt, Pseudomonas aeruginosa PA01
ccgucgagcaccagcaggu

SEQ ID NO: 1533822 - RNA, 15 nt, Pseudomonas aeruginosa PA01
ccgguugaccccgcg

SEQ ID NO: 1533823 - RNA, 23 nt, Pseudomonas aeruginosa PA01
ccgguuaccggcgaccaccgccg

SEQ ID NO: 1533824 - RNA, 18 nt, Pseudomonas aeruginosa PA01
ccgucgucaccucggcgc

SEQ ID NO: 1533825 - RNA, 12 nt, Pseudomonas aeruginosa PA01
ccgucgcgcacc

SEQ ID NO: 1533826 - RNA, 23 nt, Pseudomonas aeruginosa PA01
ccgugguucucggucgggcgggc

SEQ ID NO: 1533827 - RNA, 15 nt, Pseudomonas aeruginosa PA01
ccguggcugugcugg

SEQ ID NO: 1533828 - RNA, 13 nt, Pseudomonas aeruginosa PA01
ccgugggccgccg

SEQ ID NO: 1533829 - RNA, 18 nt, Pseudomonas aeruginosa PA01
ccgugggccggcgcgccg

SEQ ID NO: 1533830 - RNA, 23 nt, Pseudomonas aeruginosa PA01
ccgugggucgccucgaacauggc

SEQ ID NO: 1533831 - RNA, 20 nt, Pseudomonas aeruginosa PA01
ccgugggguauuccaggcga

SEQ ID NO: 1533832 - RNA, 16 nt, Pseudomonas aeruginosa PA01
ccguggucagcaccag

SEQ ID NO: 1533833 - RNA, 18 nt, Pseudomonas aeruginosa PA01
ccguggucauggcgcaga

SEQ ID NO: 1533834 - RNA, 15 nt, Pseudomonas aeruginosa PA01
ccguggucgccgcuc

SEQ ID NO: 1533835 - RNA, 17 nt, Pseudomonas aeruginosa PA01
ccguggauuucagcagg

SEQ ID NO: 1533836 - RNA, 14 nt, Pseudomonas aeruginosa PA01
ccguggcaggcgcc

SEQ ID NO: 1533837 - RNA, 21 nt, Pseudomonas aeruginosa PA01
ccguggcgcgaauccuguccg

SEQ ID NO: 1533838 - RNA, 15 nt, Pseudomonas aeruginosa PA01
ccguggcggcgcgcg

SEQ ID NO: 1533839 - RNA, 13 nt, Pseudomonas aeruginosa PA01
ccguggcgcccca

SEQ ID NO: 1533840 - RNA, 20 nt, Pseudomonas aeruginosa PA01
ccguggcgccccaggcgggc

SEQ ID NO: 1533841 - RNA, 14 nt, Pseudomonas aeruginosa PA01
ccguggcgacgaug

SEQ ID NO: 1533842 - RNA, 18 nt, Pseudomonas aeruginosa PA01
ccguggcucggcggcagg

SEQ ID NO: 1533843 - RNA, 16 nt, Pseudomonas aeruginosa PA01
ccguggcgggccagca

SEQ ID NO: 1533844 - RNA, 22 nt, Pseudomonas aeruginosa PA01
ccguggcgggccagcaggcgcu

SEQ ID NO: 1533845 - RNA, 19 nt, Pseudomonas aeruginosa PA01
ccguggcgguacuccgggu

SEQ ID NO: 1533846 - RNA, 16 nt, Pseudomonas aeruginosa PA01
ccguggaacgcagggg

SEQ ID NO: 1533847 - RNA, 16 nt, Pseudomonas aeruginosa PA01
ccgugcuggccggcag

SEQ ID NO: 1533848 - RNA, 23 nt, Pseudomonas aeruginosa PA01
ccgugcaucaccggcagcagcgg

SEQ ID NO: 1533849 - RNA, 19 nt, Pseudomonas aeruginosa PA01
ccgugcuucaucggcccgg

SEQ ID NO: 1533850 - RNA, 18 nt, Pseudomonas aeruginosa PA01
ccguggaccaacagccgg

SEQ ID NO: 1533851 - RNA, 13 nt, Pseudomonas aeruginosa PA01
ccgugccaggcgc

SEQ ID NO: 1533852 - RNA, 13 nt, Pseudomonas aeruginosa PA01
ccgugcagcagcg

SEQ ID NO: 1533853 - RNA, 14 nt, Pseudomonas aeruginosa PA01
ccgugcagcccucg

SEQ ID NO: 1533854 - RNA, 13 nt, Pseudomonas aeruginosa PA01
ccgucuccaggcg

SEQ ID NO: 1533855 - RNA, 23 nt, Pseudomonas aeruginosa PA01
ccgucuccaggcgcgccgugcgg

SEQ ID NO: 1533856 - RNA, 23 nt, Pseudomonas aeruginosa PA01
ccgucguucggcuguuucaggcc

SEQ ID NO: 1533857 - RNA, 21 nt, Pseudomonas aeruginosa PA01
ccgucguuuuguccggcggcu

SEQ ID NO: 1533858 - RNA, 15 nt, Pseudomonas aeruginosa PA01
ccgccguagccgucg

SEQ ID NO: 1533859 - RNA, 17 nt, Pseudomonas aeruginosa PA01
ccgccgucauggcgggc

SEQ ID NO: 1533860 - RNA, 16 nt, Pseudomonas aeruginosa PA01
ccgccgugaggcgcgc

SEQ ID NO: 1533861 - RNA, 23 nt, Pseudomonas aeruginosa PA01
ccgccgugaggcgcgcgccgaac

SEQ ID NO: 1533862 - RNA, 16 nt, Pseudomonas aeruginosa PA01
ccgccgucuccgccgc

SEQ ID NO: 1533863 - RNA, 20 nt, Pseudomonas aeruginosa PA01
ccgccguggcugugcuggcc

SEQ ID NO: 1533864 - RNA, 23 nt, Pseudomonas aeruginosa PA01
ccgccguuccuccucgccgccga

SEQ ID NO: 1533865 - RNA, 15 nt, Pseudomonas aeruginosa PA01
ccgccguucgcccgc

SEQ ID NO: 1533866 - RNA, 13 nt, Pseudomonas aeruginosa PA01
ccgccucaggccg

SEQ ID NO: 1533867 - RNA, 20 nt, Pseudomonas aeruginosa PA01
ccgccuaccggggcgcgggc

SEQ ID NO: 1533868 - RNA, 18 nt, Pseudomonas aeruginosa PA01
ccgccggucaccacugga

SEQ ID NO: 1533869 - RNA, 16 nt, Pseudomonas aeruginosa PA01
ccgccggugcaccagg

SEQ ID NO: 1533870 - RNA, 15 nt, Pseudomonas aeruginosa PA01
ccgccggggcgcagg

SEQ ID NO: 1533871 - RNA, 20 nt, Pseudomonas aeruginosa PA01
ccgccggggcgugcaggccg

SEQ ID NO: 1533872 - RNA, 17 nt, Pseudomonas aeruginosa PA01
ccgccggggaagcugcc

SEQ ID NO: 1533873 - RNA, 22 nt, Pseudomonas aeruginosa PA01
ccgccggggaagcugccuucca

SEQ ID NO: 1533874 - RNA, 18 nt, Pseudomonas aeruginosa PA01
ccgccggguacagcgcca

SEQ ID NO: 1533875 - RNA, 12 nt, Pseudomonas aeruginosa PA01
ccgccgggccgc

SEQ ID NO: 1533876 - RNA, 14 nt, Pseudomonas aeruginosa PA01
ccgccgggcgcgcg

SEQ ID NO: 1533877 - RNA, 15 nt, Pseudomonas aeruginosa PA01
ccgccggcgcccugc

SEQ ID NO: 1533878 - RNA, 19 nt, Pseudomonas aeruginosa PA01
ccgccggcgcccugcucug

SEQ ID NO: 1533879 - RNA, 16 nt, Pseudomonas aeruginosa PA01
ccgccggcgccgccuc

SEQ ID NO: 1533880 - RNA, 19 nt, Pseudomonas aeruginosa PA01
ccgccgcagagccagccgc

SEQ ID NO: 1533881 - RNA, 20 nt, Pseudomonas aeruginosa PA01
ccgccgcagagccagccgca

SEQ ID NO: 1533882 - RNA, 23 nt, Pseudomonas aeruginosa PA01
ccgccgcagagccagccgcagcc

SEQ ID NO: 1533883 - RNA, 13 nt, Pseudomonas aeruginosa PA01
ccgccgcagacca

SEQ ID NO: 1533884 - RNA, 16 nt, Pseudomonas aeruginosa PA01
ccgccgcagaccagcg

SEQ ID NO: 1533885 - RNA, 16 nt, Pseudomonas aeruginosa PA01
ccgccgccagcaacag

SEQ ID NO: 1533886 - RNA, 18 nt, Pseudomonas aeruginosa PA01
ccgccgcgagcgccgccg

SEQ ID NO: 1533887 - RNA, 12 nt, Pseudomonas aeruginosa PA01
ccgccgcgcagc

SEQ ID NO: 1533888 - RNA, 20 nt, Pseudomonas aeruginosa PA01
ccgccgcgcaucaccccgca

SEQ ID NO: 1533889 - RNA, 13 nt, Pseudomonas aeruginosa PA01
ccgccgccgcggu

SEQ ID NO: 1533890 - RNA, 15 nt, Pseudomonas aeruginosa PA01
ccgccgccgcggucu

SEQ ID NO: 1533891 - RNA, 22 nt, Pseudomonas aeruginosa PA01
ccgccgccgucgacaccgauca

SEQ ID NO: 1533892 - RNA, 14 nt, Pseudomonas aeruginosa PA01
ccgccgccgacagg

SEQ ID NO: 1533893 - RNA, 20 nt, Pseudomonas aeruginosa PA01
ccgccgccgagaacccggcc

SEQ ID NO: 1533894 - RNA, 15 nt, Pseudomonas aeruginosa PA01
ccgccgccgccccag

SEQ ID NO: 1533895 - RNA, 14 nt, Pseudomonas aeruginosa PA01
ccgccgccgcgccg

SEQ ID NO: 1533896 - RNA, 18 nt, Pseudomonas aeruginosa PA01
ccgccggccggggcgcgc

SEQ ID NO: 1533897 - RNA, 18 nt, Pseudomonas aeruginosa PA01
ccgccggcgaccgcgcgc

SEQ ID NO: 1533898 - RNA, 22 nt, Pseudomonas aeruginosa PA01
ccgccggcgaugcccaggccgc

SEQ ID NO: 1533899 - RNA, 15 nt, Pseudomonas aeruginosa PA01
ccgccggccaugccg

SEQ ID NO: 1533900 - RNA, 15 nt, Pseudomonas aeruginosa PA01
ccgccggccagccgc

SEQ ID NO: 1533901 - RNA, 17 nt, Pseudomonas aeruginosa PA01
ccgccggccagccgcgc

SEQ ID NO: 1533902 - RNA, 13 nt, Pseudomonas aeruginosa PA01
ccgccggcauccc

SEQ ID NO: 1533903 - RNA, 15 nt, Pseudomonas aeruginosa PA01
ccgccggacuuggag

SEQ ID NO: 1533904 - RNA, 17 nt, Pseudomonas aeruginosa PA01
ccgccggaaccugcaug

SEQ ID NO: 1533905 - RNA, 17 nt, Pseudomonas aeruginosa PA01
ccgccgcuggggaccgc

SEQ ID NO: 1533906 - RNA, 14 nt, Pseudomonas aeruginosa PA01
ccgccgcuggcggc

SEQ ID NO: 1533907 - RNA, 22 nt, Pseudomonas aeruginosa PA01
ccgccggaagacggaaacgcgc

SEQ ID NO: 1533908 - RNA, 23 nt, Pseudomonas aeruginosa PA01
ccgccgcuuccgccaggcgcagc

SEQ ID NO: 1533909 - RNA, 16 nt, Pseudomonas aeruginosa PA01
ccgccgcgccuugaaa

SEQ ID NO: 1533910 - RNA, 16 nt, Pseudomonas aeruginosa PA01
ccgccgcgccgcucag

SEQ ID NO: 1533911 - RNA, 16 nt, Pseudomonas aeruginosa PA01
ccgccgcggccagccc

SEQ ID NO: 1533912 - RNA, 18 nt, Pseudomonas aeruginosa PA01
ccgccgcggccagccccc

SEQ ID NO: 1533913 - RNA, 14 nt, Pseudomonas aeruginosa PA01
ccgccgcggccagc

SEQ ID NO: 1533914 - RNA, 16 nt, Pseudomonas aeruginosa PA01
ccgccgcuaucgccgc

SEQ ID NO: 1533915 - RNA, 21 nt, Pseudomonas aeruginosa PA01
ccgccgcucugcuggccgccc

SEQ ID NO: 1533916 - RNA, 14 nt, Pseudomonas aeruginosa PA01
ccgcccgccgucgc

SEQ ID NO: 1533917 - RNA, 17 nt, Pseudomonas aeruginosa PA01
ccgcccgcgccuccagg

SEQ ID NO: 1533918 - RNA, 20 nt, Pseudomonas aeruginosa PA01
ccgcccgcggaccgggcggc

SEQ ID NO: 1533919 - RNA, 22 nt, Pseudomonas aeruginosa PA01
ccgccccgcaccagccagcccg

SEQ ID NO: 1533920 - RNA, 22 nt, Pseudomonas aeruginosa PA01
ccgcccccagcgcgccgccgag

SEQ ID NO: 1533921 - RNA, 18 nt, Pseudomonas aeruginosa PA01
ccgccccggaggcggucu

SEQ ID NO: 1533922 - RNA, 20 nt, Pseudomonas aeruginosa PA01
ccgccccggcaagcgccggc

SEQ ID NO: 1533923 - RNA, 22 nt, Pseudomonas aeruginosa PA01
ccgcccaguucuucgccgcccg

SEQ ID NO: 1533924 - RNA, 23 nt, Pseudomonas aeruginosa PA01
ccgcccaguucuucgccgcccgc

SEQ ID NO: 1533925 - RNA, 23 nt, Pseudomonas aeruginosa PA01
ccgcccauugcccggccaggcgc

SEQ ID NO: 1533926 - RNA, 13 nt, Pseudomonas aeruginosa PA01
ccgccccaccacc

SEQ ID NO: 1533927 - RNA, 14 nt, Pseudomonas aeruginosa PA01
ccgccccaccacca

SEQ ID NO: 1533928 - RNA, 12 nt, Pseudomonas aeruginosa PA01
ccgccccagccu

SEQ ID NO: 1533929 - RNA, 13 nt, Pseudomonas aeruginosa PA01
ccgccccagccuc

SEQ ID NO: 1533930 - RNA, 14 nt, Pseudomonas aeruginosa PA01
ccgcccagcgcagc

SEQ ID NO: 1533931 - RNA, 19 nt, Pseudomonas aeruginosa PA01
ccgcccaggcugccgccgc

SEQ ID NO: 1533932 - RNA, 14 nt, Pseudomonas aeruginosa PA01
ccgcccagcagcac

SEQ ID NO: 1533933 - RNA, 19 nt, Pseudomonas aeruginosa PA01
ccgcccagcagcaccauca

SEQ ID NO: 1533934 - RNA, 24 nt, Pseudomonas aeruginosa PA01
ccgccaugguuuaccaggaccagc

SEQ ID NO: 1533935 - RNA, 17 nt, Pseudomonas aeruginosa PA01
ccgcccuagcgguccgg

SEQ ID NO: 1533936 - RNA, 22 nt, Pseudomonas aeruginosa PA01
ccgcccugcgcgaucccccgcc

SEQ ID NO: 1533937 - RNA, 16 nt, Pseudomonas aeruginosa PA01
ccgcccggaaccaccg

SEQ ID NO: 1533938 - RNA, 18 nt, Pseudomonas aeruginosa PA01
ccgcccggaaccaccggu

SEQ ID NO: 1533939 - RNA, 18 nt, Pseudomonas aeruginosa PA01
ccgcccggcaccaccggu

SEQ ID NO: 1533940 - RNA, 17 nt, Pseudomonas aeruginosa PA01
ccgcccgucgcgccggc

SEQ ID NO: 1533941 - RNA, 22 nt, Pseudomonas aeruginosa PA01
ccgcccuugucgaugagccagc

SEQ ID NO: 1533942 - RNA, 16 nt, Pseudomonas aeruginosa PA01
ccgcccuugcggcccg

SEQ ID NO: 1533943 - RNA, 22 nt, Pseudomonas aeruginosa PA01
ccgcccuucgaacccgcccucg

SEQ ID NO: 1533944 - RNA, 21 nt, Pseudomonas aeruginosa PA01
ccgcccuugccauccuccagc

SEQ ID NO: 1533945 - RNA, 22 nt, Pseudomonas aeruginosa PA01
ccgcccuugccauccuccagca

SEQ ID NO: 1533946 - RNA, 20 nt, Pseudomonas aeruginosa PA01
ccgccgaccggacuccgcgg

SEQ ID NO: 1533947 - RNA, 22 nt, Pseudomonas aeruginosa PA01
ccgccgaacagcaacaccgcgc

SEQ ID NO: 1533948 - RNA, 19 nt, Pseudomonas aeruginosa PA01
ccgccgaucugcuggguca

SEQ ID NO: 1533949 - RNA, 16 nt, Pseudomonas aeruginosa PA01
ccgccgauacaccacc

SEQ ID NO: 1533950 - RNA, 16 nt, Pseudomonas aeruginosa PA01
ccgccgauaccucguu

SEQ ID NO: 1533951 - RNA, 22 nt, Pseudomonas aeruginosa PA01
ccgccgagcguugggccucgcu

SEQ ID NO: 1533952 - RNA, 22 nt, Pseudomonas aeruginosa PA01
ccgccgaggaacauccgcggcc

SEQ ID NO: 1533953 - RNA, 14 nt, Pseudomonas aeruginosa PA01
ccgccgagcgccug

SEQ ID NO: 1533954 - RNA, 16 nt, Pseudomonas aeruginosa PA01
ccgccgagcgccuggc

SEQ ID NO: 1533955 - RNA, 18 nt, Pseudomonas aeruginosa PA01
ccgccgacugcaacuggc

SEQ ID NO: 1533956 - RNA, 13 nt, Pseudomonas aeruginosa PA01
ccgccgagacucc

SEQ ID NO: 1533957 - RNA, 14 nt, Pseudomonas aeruginosa PA01
ccgccgaggcgcgc

SEQ ID NO: 1533958 - RNA, 16 nt, Pseudomonas aeruginosa PA01
ccgccgagggcaccga

SEQ ID NO: 1533959 - RNA, 15 nt, Pseudomonas aeruginosa PA01
ccgccgagggcgcca

SEQ ID NO: 1533960 - RNA, 17 nt, Pseudomonas aeruginosa PA01
ccgccagaaagccucag

SEQ ID NO: 1533961 - RNA, 17 nt, Pseudomonas aeruginosa PA01
ccgccagaugcgcgucg

SEQ ID NO: 1533962 - RNA, 23 nt, Pseudomonas aeruginosa PA01
ccgccagaugcgcgucgccgaac

SEQ ID NO: 1533963 - RNA, 12 nt, Pseudomonas aeruginosa PA01
ccgccagcaaca

SEQ ID NO: 1533964 - RNA, 14 nt, Pseudomonas aeruginosa PA01
ccgccaccugcccc

SEQ ID NO: 1533965 - RNA, 19 nt, Pseudomonas aeruginosa PA01
ccgccagcaccacccggcc

SEQ ID NO: 1533966 - RNA, 21 nt, Pseudomonas aeruginosa PA01
ccgccagcaccacccggccgc

SEQ ID NO: 1533967 - RNA, 18 nt, Pseudomonas aeruginosa PA01
ccgccagcagacggcacg

SEQ ID NO: 1533968 - RNA, 14 nt, Pseudomonas aeruginosa PA01
ccgccagcaggccg

SEQ ID NO: 1533969 - RNA, 17 nt, Pseudomonas aeruginosa PA01
ccgccagcaggccgaag

SEQ ID NO: 1533970 - RNA, 21 nt, Pseudomonas aeruginosa PA01
ccgccagcaggccgaaggcca

SEQ ID NO: 1533971 - RNA, 14 nt, Pseudomonas aeruginosa PA01
ccgccagcaggcgc

SEQ ID NO: 1533972 - RNA, 18 nt, Pseudomonas aeruginosa PA01
ccgccagcaggcgccggc

SEQ ID NO: 1533973 - RNA, 19 nt, Pseudomonas aeruginosa PA01
ccgccagcaggcgcgggcu

SEQ ID NO: 1533974 - RNA, 14 nt, Pseudomonas aeruginosa PA01
ccgccagcaggcgu

SEQ ID NO: 1533975 - RNA, 15 nt, Pseudomonas aeruginosa PA01
ccgccagccgccagg

SEQ ID NO: 1533976 - RNA, 18 nt, Pseudomonas aeruginosa PA01
ccgccagccgccaggacg

SEQ ID NO: 1533977 - RNA, 13 nt, Pseudomonas aeruginosa PA01
ccgccagccagcc

SEQ ID NO: 1533978 - RNA, 21 nt, Pseudomonas aeruginosa PA01
ccgccaaaguucaguagcggc

SEQ ID NO: 1533979 - RNA, 22 nt, Pseudomonas aeruginosa PA01
ccgcauugcggggcguucuuuu

SEQ ID NO: 1533980 - RNA, 14 nt, Pseudomonas aeruginosa PA01
ccgcauuggccagg

SEQ ID NO: 1533981 - RNA, 15 nt, Pseudomonas aeruginosa PA01
ccgccaaggccucgg

SEQ ID NO: 1533982 - RNA, 22 nt, Pseudomonas aeruginosa PA01
ccgccaaggucggucucgccac

SEQ ID NO: 1533983 - RNA, 15 nt, Pseudomonas aeruginosa PA01
ccgccaccagccagu

SEQ ID NO: 1533984 - RNA, 13 nt, Pseudomonas aeruginosa PA01
ccgccaccccgcc

SEQ ID NO: 1533985 - RNA, 15 nt, Pseudomonas aeruginosa PA01
ccgccagcuaccggc

SEQ ID NO: 1533986 - RNA, 20 nt, Pseudomonas aeruginosa PA01
ccgccagcuaccggcagggu

SEQ ID NO: 1533987 - RNA, 16 nt, Pseudomonas aeruginosa PA01
ccgccaggaccuccug

SEQ ID NO: 1533988 - RNA, 22 nt, Pseudomonas aeruginosa PA01
ccgccaggaccucgaagcuggc

SEQ ID NO: 1533989 - RNA, 18 nt, Pseudomonas aeruginosa PA01
ccgccaggacggcagggu

SEQ ID NO: 1533990 - RNA, 22 nt, Pseudomonas aeruginosa PA01
ccgccagcucauggagcaacag

SEQ ID NO: 1533991 - RNA, 19 nt, Pseudomonas aeruginosa PA01
ccgccagcuuguccgccgg

SEQ ID NO: 1533992 - RNA, 14 nt, Pseudomonas aeruginosa PA01
ccgccaggcagacc

SEQ ID NO: 1533993 - RNA, 22 nt, Pseudomonas aeruginosa PA01
ccgccaggcagaccugcagcag

SEQ ID NO: 1533994 - RNA, 14 nt, Pseudomonas aeruginosa PA01
ccgccaucgccucg

SEQ ID NO: 1533995 - RNA, 18 nt, Pseudomonas aeruginosa PA01
ccgccauagagugcccag

SEQ ID NO: 1533996 - RNA, 20 nt, Pseudomonas aeruginosa PA01
ccgccaguucggccaucagc

SEQ ID NO: 1533997 - RNA, 13 nt, Pseudomonas aeruginosa PA01
ccgccagucggcc

SEQ ID NO: 1533998 - RNA, 15 nt, Pseudomonas aeruginosa PA01
ccgccagucggccug

SEQ ID NO: 1533999 - RNA, 18 nt, Pseudomonas aeruginosa PA01
ccgccagucggccuggcu

SEQ ID NO: 1534000 - RNA, 22 nt, Pseudomonas aeruginosa PA01
ccgccagguccaggcucagcuc

SEQ ID NO: 1534001 - RNA, 14 nt, Pseudomonas aeruginosa PA01
ccgccagguggcgg

SEQ ID NO: 1534002 - RNA, 13 nt, Pseudomonas aeruginosa PA01
ccgccaggccucg

SEQ ID NO: 1534003 - RNA, 17 nt, Pseudomonas aeruginosa PA01
ccgccaggccucggcgc

SEQ ID NO: 1534004 - RNA, 11 nt, Pseudomonas aeruginosa PA01
ccgccaggcgc

SEQ ID NO: 1534005 - RNA, 23 nt, Pseudomonas aeruginosa PA01
ccgccaggcgcgucgcggccucu

SEQ ID NO: 1534006 - RNA, 20 nt, Pseudomonas aeruginosa PA01
ccgccaggcgcgucuccagc

SEQ ID NO: 1534007 - RNA, 14 nt, Pseudomonas aeruginosa PA01
ccgccaggcggagc

SEQ ID NO: 1534008 - RNA, 22 nt, Pseudomonas aeruginosa PA01
ccgccaggcggcaagggcgucu

SEQ ID NO: 1534009 - RNA, 15 nt, Pseudomonas aeruginosa PA01
ccgccaggcggccgc

SEQ ID NO: 1534010 - RNA, 15 nt, Pseudomonas aeruginosa PA01
ccgccaggcaggccg

SEQ ID NO: 1534011 - RNA, 20 nt, Pseudomonas aeruginosa PA01
ccgccaggcuggguuggcgc

SEQ ID NO: 1534012 - RNA, 17 nt, Pseudomonas aeruginosa PA01
ccgcaccacguagccgg

SEQ ID NO: 1534013 - RNA, 15 nt, Pseudomonas aeruginosa PA01
ccgcacaggcuggcc

SEQ ID NO: 1534014 - RNA, 19 nt, Pseudomonas aeruginosa PA01
ccgcacaggcuggccagaa

SEQ ID NO: 1534015 - RNA, 22 nt, Pseudomonas aeruginosa PA01
ccgcacaguugcgcgccggcgg

SEQ ID NO: 1534016 - RNA, 20 nt, Pseudomonas aeruginosa PA01
ccgcaccccauccucgccgg

SEQ ID NO: 1534017 - RNA, 16 nt, Pseudomonas aeruginosa PA01
ccgcaccauccgccgc

SEQ ID NO: 1534018 - RNA, 15 nt, Pseudomonas aeruginosa PA01
ccgcaaacccccugc

SEQ ID NO: 1534019 - RNA, 19 nt, Pseudomonas aeruginosa PA01
ccgcaaugcggggcguucu

SEQ ID NO: 1534020 - RNA, 23 nt, Pseudomonas aeruginosa PA01
ccgcaaugcggggcguucugcuu

SEQ ID NO: 1534021 - RNA, 19 nt, Pseudomonas aeruginosa PA01
ccgagcguugggccucgcu

SEQ ID NO: 1534022 - RNA, 23 nt, Pseudomonas aeruginosa PA01
ccgagcguuuuuggcaaaccucc

SEQ ID NO: 1534023 - RNA, 13 nt, Pseudomonas aeruginosa PA01
ccgagcggucgga

SEQ ID NO: 1534024 - RNA, 19 nt, Pseudomonas aeruginosa PA01
ccgagcugaccaccagggc

SEQ ID NO: 1534025 - RNA, 18 nt, Pseudomonas aeruginosa PA01
ccgagcugaucgcgcaga

SEQ ID NO: 1534026 - RNA, 19 nt, Pseudomonas aeruginosa PA01
ccgauguccucgaacagcu

SEQ ID NO: 1534027 - RNA, 19 nt, Pseudomonas aeruginosa PA01
ccgaugucguagccgcgcg

SEQ ID NO: 1534028 - RNA, 22 nt, Pseudomonas aeruginosa PA01
ccgaugucguagccgcgcgcca

SEQ ID NO: 1534029 - RNA, 16 nt, Pseudomonas aeruginosa PA01
ccgaugucgccggcau

SEQ ID NO: 1534030 - RNA, 16 nt, Pseudomonas aeruginosa PA01
ccgauuuccccaaggc

SEQ ID NO: 1534031 - RNA, 22 nt, Pseudomonas aeruginosa PA01
ccgauugccagaguugccuguc

SEQ ID NO: 1534032 - RNA, 19 nt, Pseudomonas aeruginosa PA01
ccgauugugcagggccgcg

SEQ ID NO: 1534033 - RNA, 23 nt, Pseudomonas aeruginosa PA01
ccgcagaaccagacgcucggcca

SEQ ID NO: 1534034 - RNA, 23 nt, Pseudomonas aeruginosa PA01
ccgcagaugcuccagggagcgcu

SEQ ID NO: 1534035 - RNA, 18 nt, Pseudomonas aeruginosa PA01
ccgcagggugcggcugcu

SEQ ID NO: 1534036 - RNA, 22 nt, Pseudomonas aeruginosa PA01
ccgcaggcugccguccaggcgc

SEQ ID NO: 1534037 - RNA, 15 nt, Pseudomonas aeruginosa PA01
ccgcaggcaguggcg

SEQ ID NO: 1534038 - RNA, 21 nt, Pseudomonas aeruginosa PA01
ccgcaguagaugccgcgucgg

SEQ ID NO: 1534039 - RNA, 18 nt, Pseudomonas aeruginosa PA01
ccgcagguugcacuugaa

SEQ ID NO: 1534040 - RNA, 19 nt, Pseudomonas aeruginosa PA01
ccgcagguagcugagcagg

SEQ ID NO: 1534041 - RNA, 18 nt, Pseudomonas aeruginosa PA01
ccgcaguucgccccgccg

SEQ ID NO: 1534042 - RNA, 18 nt, Pseudomonas aeruginosa PA01
ccgcauccuccacccccg

SEQ ID NO: 1534043 - RNA, 20 nt, Pseudomonas aeruginosa PA01
ccgcaucgaagcgcaccagg

SEQ ID NO: 1534044 - RNA, 16 nt, Pseudomonas aeruginosa PA01
ccgcaucgaaggcgcc

SEQ ID NO: 1534045 - RNA, 20 nt, Pseudomonas aeruginosa PA01
ccgcaucgaggccgcccagc

SEQ ID NO: 1534046 - RNA, 18 nt, Pseudomonas aeruginosa PA01
ccgcaucccaguagccgg

SEQ ID NO: 1534047 - RNA, 21 nt, Pseudomonas aeruginosa PA01
ccgcauaggucaugcccaggc

SEQ ID NO: 1534048 - RNA, 15 nt, Pseudomonas aeruginosa PA01
ccgcaucguuggcgc

SEQ ID NO: 1534049 - RNA, 15 nt, Pseudomonas aeruginosa PA01
ccgcaucgcgggcgu

SEQ ID NO: 1534050 - RNA, 18 nt, Pseudomonas aeruginosa PA01
ccgcaucgcgggcgugcu

SEQ ID NO: 1534051 - RNA, 23 nt, Pseudomonas aeruginosa PA01
ccgcaucgcgguuauccgccggc

SEQ ID NO: 1534052 - RNA, 14 nt, Pseudomonas aeruginosa PA01
ccgcaucggccacc

SEQ ID NO: 1534053 - RNA, 16 nt, Pseudomonas aeruginosa PA01
ccgcaucggccaccuu

SEQ ID NO: 1534054 - RNA, 23 nt, Pseudomonas aeruginosa PA01
ccgcaucggccaccuucgcccgc

SEQ ID NO: 1534055 - RNA, 20 nt, Pseudomonas aeruginosa PA01
cccuucagcgcaccgcccug

SEQ ID NO: 1534056 - RNA, 18 nt, Pseudomonas aeruginosa PA01
cccuucaaaaaccaugcg

SEQ ID NO: 1534057 - RNA, 19 nt, Pseudomonas aeruginosa PA01
cccuucaaaaaccaugcgg

SEQ ID NO: 1534058 - RNA, 13 nt, Pseudomonas aeruginosa PA01
cccuggucggcgg

SEQ ID NO: 1534059 - RNA, 22 nt, Pseudomonas aeruginosa PA01
cccuggucgacauagcgcagca

SEQ ID NO: 1534060 - RNA, 23 nt, Pseudomonas aeruginosa PA01
cccugguccaaccgggcaucgcc

SEQ ID NO: 1534061 - RNA, 24 nt, Pseudomonas aeruginosa PA01
cccugggcgcgaauggcauucagc

SEQ ID NO: 1534062 - RNA, 18 nt, Pseudomonas aeruginosa PA01
cccugggguuucugcugg

SEQ ID NO: 1534063 - RNA, 22 nt, Pseudomonas aeruginosa PA01
cccugggguuucugcuggccac

SEQ ID NO: 1534064 - RNA, 22 nt, Pseudomonas aeruginosa PA01
cccuuuuucgucgccagcccgg

SEQ ID NO: 1534065 - RNA, 21 nt, Pseudomonas aeruginosa PA01
aaacagccguuugugaaagga

SEQ ID NO: 1534066 - RNA, 20 nt, Pseudomonas aeruginosa PA01
ccgaagaucgacaggccgcc

SEQ ID NO: 1534067 - RNA, 20 nt, Pseudomonas aeruginosa PA01
ccgaagccgccgggaaucug

SEQ ID NO: 1534068 - RNA, 22 nt, Pseudomonas aeruginosa PA01
ccgaagcgcucggucagcuccc

SEQ ID NO: 1534069 - RNA, 21 nt, Pseudomonas aeruginosa PA01
ccgaaucgccuaccagaccgc

SEQ ID NO: 1534070 - RNA, 15 nt, Pseudomonas aeruginosa PA01
ccgaaucgaacaggg

SEQ ID NO: 1534071 - RNA, 13 nt, Pseudomonas aeruginosa PA01
ccgaaacagggcg

SEQ ID NO: 1534072 - RNA, 18 nt, Pseudomonas aeruginosa PA01
ccgaaacagggcgaccag

SEQ ID NO: 1534073 - RNA, 18 nt, Pseudomonas aeruginosa PA01
ccgaaacgguccaccagg

SEQ ID NO: 1534074 - RNA, 21 nt, Pseudomonas aeruginosa PA01
ccgaacuccgccagcaccacc

SEQ ID NO: 1534075 - RNA, 16 nt, Pseudomonas aeruginosa PA01
ccgagcaucagcgacu

SEQ ID NO: 1534076 - RNA, 14 nt, Pseudomonas aeruginosa PA01
ccgagcaggugcau

SEQ ID NO: 1534077 - RNA, 22 nt, Pseudomonas aeruginosa PA01
ccgagcaggccuugcagggccg

SEQ ID NO: 1534078 - RNA, 23 nt, Pseudomonas aeruginosa PA01
ccgagccacggauaugcgccgcc

SEQ ID NO: 1534079 - RNA, 24 nt, Pseudomonas aeruginosa PA01
ccgagccacggauaugcgccgcca

SEQ ID NO: 1534080 - RNA, 16 nt, Pseudomonas aeruginosa PA01
ccgagcaugcgcggca

SEQ ID NO: 1534081 - RNA, 16 nt, Pseudomonas aeruginosa PA01
ccgagcauguaggcgc

SEQ ID NO: 1534082 - RNA, 20 nt, Pseudomonas aeruginosa PA01
ccgagcauguaggcgcacca

SEQ ID NO: 1534083 - RNA, 13 nt, Pseudomonas aeruginosa PA01
ccgagcagcgcca

SEQ ID NO: 1534084 - RNA, 15 nt, Pseudomonas aeruginosa PA01
ccgagcagcgccagc

SEQ ID NO: 1534085 - RNA, 11 nt, Pseudomonas aeruginosa PA01
ccgagcagcac

SEQ ID NO: 1534086 - RNA, 19 nt, Pseudomonas aeruginosa PA01
ccgagcaccggcaggacga

SEQ ID NO: 1534087 - RNA, 13 nt, Pseudomonas aeruginosa PA01
ccgagcccagcgg

SEQ ID NO: 1534088 - RNA, 23 nt, Pseudomonas aeruginosa PA01
ccgagccccgguuacucgccggc

SEQ ID NO: 1534089 - RNA, 19 nt, Pseudomonas aeruginosa PA01
ccgagcccgagugcgccca

SEQ ID NO: 1534090 - RNA, 15 nt, Pseudomonas aeruginosa PA01
ccgagcccggccggg

SEQ ID NO: 1534091 - RNA, 16 nt, Pseudomonas aeruginosa PA01
ccgagcccggccggga

SEQ ID NO: 1534092 - RNA, 20 nt, Pseudomonas aeruginosa PA01
ccgagaagccggggcaggca

SEQ ID NO: 1534093 - RNA, 18 nt, Pseudomonas aeruginosa PA01
ccgagcaacucggcggcg

SEQ ID NO: 1534094 - RNA, 19 nt, Pseudomonas aeruginosa PA01
ccgagcaccacgcgcaagc

SEQ ID NO: 1534095 - RNA, 15 nt, Pseudomonas aeruginosa PA01
ccgagcacaggguga

SEQ ID NO: 1534096 - RNA, 16 nt, Pseudomonas aeruginosa PA01
ccgacgccgagcagca

SEQ ID NO: 1534097 - RNA, 21 nt, Pseudomonas aeruginosa PA01
ccgacgccgagcagcaccagg

SEQ ID NO: 1534098 - RNA, 23 nt, Pseudomonas aeruginosa PA01
ccgacgccggacgcaccagcagg

SEQ ID NO: 1534099 - RNA, 20 nt, Pseudomonas aeruginosa PA01
ccgacgcccgcagccagccu

SEQ ID NO: 1534100 - RNA, 16 nt, Pseudomonas aeruginosa PA01
ccgacgaacagccaga

SEQ ID NO: 1534101 - RNA, 16 nt, Pseudomonas aeruginosa PA01
ccgaccucggccgcca

SEQ ID NO: 1534102 - RNA, 18 nt, Pseudomonas aeruginosa PA01
ccgaccuucaccaccagc

SEQ ID NO: 1534103 - RNA, 19 nt, Pseudomonas aeruginosa PA01
ccgaccuucaccaccagcg

SEQ ID NO: 1534104 - RNA, 19 nt, Pseudomonas aeruginosa PA01
ccgacgagcagcucgccgg

SEQ ID NO: 1534105 - RNA, 16 nt, Pseudomonas aeruginosa PA01
ccgaccgguuccagcg

SEQ ID NO: 1534106 - RNA, 17 nt, Pseudomonas aeruginosa PA01
ccgaccuguaccgcucc

SEQ ID NO: 1534107 - RNA, 13 nt, Pseudomonas aeruginosa PA01
ccgaccggcgccg

SEQ ID NO: 1534108 - RNA, 20 nt, Pseudomonas aeruginosa PA01
ccgacaggccgaccagcagg

SEQ ID NO: 1534109 - RNA, 14 nt, Pseudomonas aeruginosa PA01
ccgacaggucggcc

SEQ ID NO: 1534110 - RNA, 16 nt, Pseudomonas aeruginosa PA01
ccgacagucccaggcc

SEQ ID NO: 1534111 - RNA, 17 nt, Pseudomonas aeruginosa PA01
ccgacagucccaggcca

SEQ ID NO: 1534112 - RNA, 23 nt, Pseudomonas aeruginosa PA01
ccgacaggccggugccgccggcc

SEQ ID NO: 1534113 - RNA, 14 nt, Pseudomonas aeruginosa PA01
ccgacagcggcugg

SEQ ID NO: 1534114 - RNA, 18 nt, Pseudomonas aeruginosa PA01
ccgacagagcggccggcg

SEQ ID NO: 1534115 - RNA, 22 nt, Pseudomonas aeruginosa PA01
ccgacauccugucgaggccucg

SEQ ID NO: 1534116 - RNA, 13 nt, Pseudomonas aeruginosa PA01
ccgaccagccgca

SEQ ID NO: 1534117 - RNA, 13 nt, Pseudomonas aeruginosa PA01
ccgaccagcaaca

SEQ ID NO: 1534118 - RNA, 18 nt, Pseudomonas aeruginosa PA01
ccgaccagcagggccagc

SEQ ID NO: 1534119 - RNA, 14 nt, Pseudomonas aeruginosa PA01
ccgaccacuuccag

SEQ ID NO: 1534120 - RNA, 16 nt, Pseudomonas aeruginosa PA01
ccgaccacuuccaggu

SEQ ID NO: 1534121 - RNA, 18 nt, Pseudomonas aeruginosa PA01
ccgacccagagcgcgccc

SEQ ID NO: 1534122 - RNA, 17 nt, Pseudomonas aeruginosa PA01
ccgacccgcaggccggc

SEQ ID NO: 1534123 - RNA, 18 nt, Pseudomonas aeruginosa PA01
ccgacccggccgaccagg

SEQ ID NO: 1534124 - RNA, 23 nt, Pseudomonas aeruginosa PA01
ccgaccgacuuggcagucgccgc

SEQ ID NO: 1534125 - RNA, 16 nt, Pseudomonas aeruginosa PA01
ccgaccggacuccgcg

SEQ ID NO: 1534126 - RNA, 13 nt, Pseudomonas aeruginosa PA01
cccggugucgacg

SEQ ID NO: 1534127 - RNA, 17 nt, Pseudomonas aeruginosa PA01
cccgguggccuccugca

SEQ ID NO: 1534128 - RNA, 21 nt, Pseudomonas aeruginosa PA01
cccggguugcccucgcagccg

SEQ ID NO: 1534129 - RNA, 16 nt, Pseudomonas aeruginosa PA01
cccggguuuccugccc

SEQ ID NO: 1534130 - RNA, 22 nt, Pseudomonas aeruginosa PA01
cccggguguccuuugccugaug

SEQ ID NO: 1534131 - RNA, 20 nt, Pseudomonas aeruginosa PA01
cccgggugccuuccgcgccc

SEQ ID NO: 1534132 - RNA, 16 nt, Pseudomonas aeruginosa PA01
cccggucaccacccag

SEQ ID NO: 1534133 - RNA, 15 nt, Pseudomonas aeruginosa PA01
cccgguauucagcca

SEQ ID NO: 1534134 - RNA, 20 nt, Pseudomonas aeruginosa PA01
cccggcuggcguaccucgcc

SEQ ID NO: 1534135 - RNA, 14 nt, Pseudomonas aeruginosa PA01
cccggcucgccgcc

SEQ ID NO: 1534136 - RNA, 15 nt, Pseudomonas aeruginosa PA01
cccggcucgccgccg

SEQ ID NO: 1534137 - RNA, 15 nt, Pseudomonas aeruginosa PA01
cccggcuccagccgg

SEQ ID NO: 1534138 - RNA, 18 nt, Pseudomonas aeruginosa PA01
cccggcuuuccucggcca

SEQ ID NO: 1534139 - RNA, 20 nt, Pseudomonas aeruginosa PA01
cccggcuuggcgggcucgcc

SEQ ID NO: 1534140 - RNA, 22 nt, Pseudomonas aeruginosa PA01
cccggcuucgcgggugaccugg

SEQ ID NO: 1534141 - RNA, 14 nt, Pseudomonas aeruginosa PA01
cccggcuucgcugg

SEQ ID NO: 1534142 - RNA, 22 nt, Pseudomonas aeruginosa PA01
cccgccggggcgugcaggccgc

SEQ ID NO: 1534143 - RNA, 16 nt, Pseudomonas aeruginosa PA01
cccggcguuucgccgg

SEQ ID NO: 1534144 - RNA, 20 nt, Pseudomonas aeruginosa PA01
cccggcguuucgccgggccu

SEQ ID NO: 1534145 - RNA, 17 nt, Pseudomonas aeruginosa PA01
cccgccgggagcggccg

SEQ ID NO: 1534146 - RNA, 19 nt, Pseudomonas aeruginosa PA01
cccgccggcgcgcccaggc

SEQ ID NO: 1534147 - RNA, 21 nt, Pseudomonas aeruginosa PA01
cccgccggccgggagcuacag

SEQ ID NO: 1534148 - RNA, 14 nt, Pseudomonas aeruginosa PA01
cccuacggccccag

SEQ ID NO: 1534149 - RNA, 18 nt, Pseudomonas aeruginosa PA01
cccuacggccccaggcug

SEQ ID NO: 1534150 - RNA, 14 nt, Pseudomonas aeruginosa PA01
cccuacuccagggg

SEQ ID NO: 1534151 - RNA, 18 nt, Pseudomonas aeruginosa PA01
cccuacagcccccccagc

SEQ ID NO: 1534152 - RNA, 17 nt, Pseudomonas aeruginosa PA01
cccuaccagcgcaaccg

SEQ ID NO: 1534153 - RNA, 14 nt, Pseudomonas aeruginosa PA01
cccuaccccagggg

SEQ ID NO: 1534154 - RNA, 14 nt, Pseudomonas aeruginosa PA01
cccuacgaugcugg

SEQ ID NO: 1534155 - RNA, 18 nt, Pseudomonas aeruginosa PA01
cccuaccgcccacccugc

SEQ ID NO: 1534156 - RNA, 16 nt, Pseudomonas aeruginosa PA01
cccuaccguccgcagc

SEQ ID NO: 1534157 - RNA, 16 nt, Pseudomonas aeruginosa PA01
cccuaccugucccgga

SEQ ID NO: 1534158 - RNA, 14 nt, Pseudomonas aeruginosa PA01
cccguguugcggag

SEQ ID NO: 1534159 - RNA, 13 nt, Pseudomonas aeruginosa PA01
cccguuccuugcg

SEQ ID NO: 1534160 - RNA, 21 nt, Pseudomonas aeruginosa PA01
cccguucgccggccuccagca

SEQ ID NO: 1534161 - RNA, 16 nt, Pseudomonas aeruginosa PA01
cccguuccaccgccug

SEQ ID NO: 1534162 - RNA, 21 nt, Pseudomonas aeruginosa PA01
cccguuccaccgccuggacca

SEQ ID NO: 1534163 - RNA, 14 nt, Pseudomonas aeruginosa PA01
cccguggcgggcca

SEQ ID NO: 1534164 - RNA, 15 nt, Pseudomonas aeruginosa PA01
cccguggcgggccag

SEQ ID NO: 1534165 - RNA, 15 nt, Pseudomonas aeruginosa PA01
cccgugguccgccag

SEQ ID NO: 1534166 - RNA, 14 nt, Pseudomonas aeruginosa PA01
cccgucuagcgcag

SEQ ID NO: 1534167 - RNA, 14 nt, Pseudomonas aeruginosa PA01
cccgucaucaccca

SEQ ID NO: 1534168 - RNA, 16 nt, Pseudomonas aeruginosa PA01
cccucaaccggcgucc

SEQ ID NO: 1534169 - RNA, 16 nt, Pseudomonas aeruginosa PA01
cccucaggcgccgcug

SEQ ID NO: 1534170 - RNA, 15 nt, Pseudomonas aeruginosa PA01
cccucagcagcgccg

SEQ ID NO: 1534171 - RNA, 18 nt, Pseudomonas aeruginosa PA01
cccucacggcgcgagaaa

SEQ ID NO: 1534172 - RNA, 18 nt, Pseudomonas aeruginosa PA01
cccucccuaucuccgccg

SEQ ID NO: 1534173 - RNA, 21 nt, Pseudomonas aeruginosa PA01
cccuccggcgcguuggcuggc

SEQ ID NO: 1534174 - RNA, 15 nt, Pseudomonas aeruginosa PA01
cccucccgcgccagc

SEQ ID NO: 1534175 - RNA, 12 nt, Pseudomonas aeruginosa PA01
cccuccagcacc

SEQ ID NO: 1534176 - RNA, 15 nt, Pseudomonas aeruginosa PA01
cccuccagcaccgcc

SEQ ID NO: 1534177 - RNA, 12 nt, Pseudomonas aeruginosa PA01
cccuccaggcga

SEQ ID NO: 1534178 - RNA, 22 nt, Pseudomonas aeruginosa PA01
cccuccagguaggggaaaccgu

SEQ ID NO: 1534179 - RNA, 20 nt, Pseudomonas aeruginosa PA01
cccuccaccucgacccuggc

SEQ ID NO: 1534180 - RNA, 23 nt, Pseudomonas aeruginosa PA01
cccuccaaagaaaagcccggcca

SEQ ID NO: 1534181 - RNA, 20 nt, Pseudomonas aeruginosa PA01
cccucaggggugcagcccug

SEQ ID NO: 1534182 - RNA, 20 nt, Pseudomonas aeruginosa PA01
cccucagucgcccccaccgc

SEQ ID NO: 1534183 - RNA, 18 nt, Pseudomonas aeruginosa PA01
cccucauggcuguagcuc

SEQ ID NO: 1534184 - RNA, 14 nt, Pseudomonas aeruginosa PA01
cccucggccaggac

SEQ ID NO: 1534185 - RNA, 22 nt, Pseudomonas aeruginosa PA01
cccucggccaggaccagggcgg

SEQ ID NO: 1534186 - RNA, 16 nt, Pseudomonas aeruginosa PA01
cccucgcuccaacgca

SEQ ID NO: 1534187 - RNA, 14 nt, Pseudomonas aeruginosa PA01
cccucgcggcggca

SEQ ID NO: 1534188 - RNA, 14 nt, Pseudomonas aeruginosa PA01
cccucggcgcccgc

SEQ ID NO: 1534189 - RNA, 18 nt, Pseudomonas aeruginosa PA01
cccucggcgcccgccugc

SEQ ID NO: 1534190 - RNA, 19 nt, Pseudomonas aeruginosa PA01
cccucggcuucguccugcu

SEQ ID NO: 1534191 - RNA, 22 nt, Pseudomonas aeruginosa PA01
cccucggugauaccgccggcgg

SEQ ID NO: 1534192 - RNA, 19 nt, Pseudomonas aeruginosa PA01
cccucggugcgguuggagc

SEQ ID NO: 1534193 - RNA, 11 nt, Pseudomonas aeruginosa PA01
cccucucccca

SEQ ID NO: 1534194 - RNA, 16 nt, Pseudomonas aeruginosa PA01
cccucucccugaaggg

SEQ ID NO: 1534195 - RNA, 14 nt, Pseudomonas aeruginosa PA01
cccucgaagcccug

SEQ ID NO: 1534196 - RNA, 19 nt, Pseudomonas aeruginosa PA01
cccuccuggaaagaccggc

SEQ ID NO: 1534197 - RNA, 13 nt, Pseudomonas aeruginosa PA01
cccucgaccuggc

SEQ ID NO: 1534198 - RNA, 17 nt, Pseudomonas aeruginosa PA01
cccucgaccuggcucca

SEQ ID NO: 1534199 - RNA, 15 nt, Pseudomonas aeruginosa PA01
cccucgauguaggcc

SEQ ID NO: 1534200 - RNA, 15 nt, Pseudomonas aeruginosa PA01
cccucgcaguacagc

SEQ ID NO: 1534201 - RNA, 13 nt, Pseudomonas aeruginosa PA01
cccucgccauucu

SEQ ID NO: 1534202 - RNA, 14 nt, Pseudomonas aeruginosa PA01
cccugaccagcagg

SEQ ID NO: 1534203 - RNA, 13 nt, Pseudomonas aeruginosa PA01
cccugacccgcac

SEQ ID NO: 1534204 - RNA, 14 nt, Pseudomonas aeruginosa PA01
cccugacccgcacc

SEQ ID NO: 1534205 - RNA, 20 nt, Pseudomonas aeruginosa PA01
cccugccguauccgcggcag

SEQ ID NO: 1534206 - RNA, 12 nt, Pseudomonas aeruginosa PA01
cccugcggcgcc

SEQ ID NO: 1534207 - RNA, 13 nt, Pseudomonas aeruginosa PA01
cccugcggcgccg

SEQ ID NO: 1534208 - RNA, 14 nt, Pseudomonas aeruginosa PA01
cccugcccgcgccu

SEQ ID NO: 1534209 - RNA, 13 nt, Pseudomonas aeruginosa PA01
cccugcccagugg

SEQ ID NO: 1534210 - RNA, 20 nt, Pseudomonas aeruginosa PA01
cccugccagcgggcgccgcc

SEQ ID NO: 1534211 - RNA, 12 nt, Pseudomonas aeruginosa PA01
cccugccagggg

SEQ ID NO: 1534212 - RNA, 13 nt, Pseudomonas aeruginosa PA01
cccugcaacacgu

SEQ ID NO: 1534213 - RNA, 20 nt, Pseudomonas aeruginosa PA01
cccugcaacacguagcgcag

SEQ ID NO: 1534214 - RNA, 12 nt, Pseudomonas aeruginosa PA01
cccugcaacagg

SEQ ID NO: 1534215 - RNA, 22 nt, Pseudomonas aeruginosa PA01
cccugcaacaggacccagccau

SEQ ID NO: 1534216 - RNA, 14 nt, Pseudomonas aeruginosa PA01
cccugcucgcgcag

SEQ ID NO: 1534217 - RNA, 19 nt, Pseudomonas aeruginosa PA01
cccugcucgcgcagggucg

SEQ ID NO: 1534218 - RNA, 10 nt, Pseudomonas aeruginosa PA01
cccugcucgu

SEQ ID NO: 1534219 - RNA, 17 nt, Pseudomonas aeruginosa PA01
cccugcucuuccagcgg

SEQ ID NO: 1534220 - RNA, 19 nt, Pseudomonas aeruginosa PA01
cccugggcggcgaccugcg

SEQ ID NO: 1534221 - RNA, 16 nt, Pseudomonas aeruginosa PA01
cccugggccggcgcca

SEQ ID NO: 1534222 - RNA, 21 nt, Pseudomonas aeruginosa PA01
cccugggccggcgccagcagg

SEQ ID NO: 1534223 - RNA, 15 nt, Pseudomonas aeruginosa PA01
cccugggccccggcc

SEQ ID NO: 1534224 - RNA, 20 nt, Pseudomonas aeruginosa PA01
cccugggccccggccggcag

SEQ ID NO: 1534225 - RNA, 15 nt, Pseudomonas aeruginosa PA01
cccugcugcucgcca

SEQ ID NO: 1534226 - RNA, 15 nt, Pseudomonas aeruginosa PA01
cccugcugcugcuca

SEQ ID NO: 1534227 - RNA, 17 nt, Pseudomonas aeruginosa PA01
cccugggacaggcgucc

SEQ ID NO: 1534228 - RNA, 16 nt, Pseudomonas aeruginosa PA01
cccugggagccgccgg

SEQ ID NO: 1534229 - RNA, 19 nt, Pseudomonas aeruginosa PA01
cccugggaugccgccaagc

SEQ ID NO: 1534230 - RNA, 12 nt, Pseudomonas aeruginosa PA01
cccccugcgcgg

SEQ ID NO: 1534231 - RNA, 12 nt, Pseudomonas aeruginosa PA01
cccccuguuucg

SEQ ID NO: 1534232 - RNA, 23 nt, Pseudomonas aeruginosa PA01
cccccguggcgacgcagcacggc

SEQ ID NO: 1534233 - RNA, 18 nt, Pseudomonas aeruginosa PA01
ccccgagcggcgcgaagu

SEQ ID NO: 1534234 - RNA, 15 nt, Pseudomonas aeruginosa PA01
cccccggcgcccaga

SEQ ID NO: 1534235 - RNA, 20 nt, Pseudomonas aeruginosa PA01
cccccgggaugcccggccgc

SEQ ID NO: 1534236 - RNA, 14 nt, Pseudomonas aeruginosa PA01
cccccuacgaaagc

SEQ ID NO: 1534237 - RNA, 13 nt, Pseudomonas aeruginosa PA01
ccccgccggccgg

SEQ ID NO: 1534238 - RNA, 14 nt, Pseudomonas aeruginosa PA01
cccccaccgccccc

SEQ ID NO: 1534239 - RNA, 22 nt, Pseudomonas aeruginosa PA01
cccccaucgcccgcagccacag

SEQ ID NO: 1534240 - RNA, 20 nt, Pseudomonas aeruginosa PA01
cccccaugaaaaaggcgccc

SEQ ID NO: 1534241 - RNA, 20 nt, Pseudomonas aeruginosa PA01
cccccaggcaccguaggcca

SEQ ID NO: 1534242 - RNA, 13 nt, Pseudomonas aeruginosa PA01
ccccagccuccac

SEQ ID NO: 1534243 - RNA, 15 nt, Pseudomonas aeruginosa PA01
ccccagccucggcag

SEQ ID NO: 1534244 - RNA, 14 nt, Pseudomonas aeruginosa PA01
ccccagcgccuggg

SEQ ID NO: 1534245 - RNA, 14 nt, Pseudomonas aeruginosa PA01
ccccauccgggcgg

SEQ ID NO: 1534246 - RNA, 21 nt, Pseudomonas aeruginosa PA01
cccauuucguagcccaggcgg

SEQ ID NO: 1534247 - RNA, 22 nt, Pseudomonas aeruginosa PA01
cccaugugcuugaccgccgccu

SEQ ID NO: 1534248 - RNA, 15 nt, Pseudomonas aeruginosa PA01
cccauguggcgcagc

SEQ ID NO: 1534249 - RNA, 22 nt, Pseudomonas aeruginosa PA01
cccauggcgguaguguugaagc

SEQ ID NO: 1534250 - RNA, 16 nt, Pseudomonas aeruginosa PA01
cccaugcgcggcgaga

SEQ ID NO: 1534251 - RNA, 16 nt, Pseudomonas aeruginosa PA01
cccaugaucgccaccg

SEQ ID NO: 1534252 - RNA, 19 nt, Pseudomonas aeruginosa PA01
cccaugccuugcagcgcca

SEQ ID NO: 1534253 - RNA, 15 nt, Pseudomonas aeruginosa PA01
cccaugccguucagc

SEQ ID NO: 1534254 - RNA, 23 nt, Pseudomonas aeruginosa PA01
cccaugccgcuagcccugcugcu

SEQ ID NO: 1534255 - RNA, 17 nt, Pseudomonas aeruginosa PA01
cccaugauggucggcac

SEQ ID NO: 1534256 - RNA, 13 nt, Pseudomonas aeruginosa PA01
cccaugcccgccc

SEQ ID NO: 1534257 - RNA, 19 nt, Pseudomonas aeruginosa PA01
cccaugaaaaauggccgcu

SEQ ID NO: 1534258 - RNA, 12 nt, Pseudomonas aeruginosa PA01
ccccagcacgcc

SEQ ID NO: 1534259 - RNA, 15 nt, Pseudomonas aeruginosa PA01
ccccagcaggcaggc

SEQ ID NO: 1534260 - RNA, 15 nt, Pseudomonas aeruginosa PA01
ccccagcaggccagc

SEQ ID NO: 1534261 - RNA, 14 nt, Pseudomonas aeruginosa PA01
ccccagcaccugga

SEQ ID NO: 1534262 - RNA, 19 nt, Pseudomonas aeruginosa PA01
ccccagaucgccagcgcca

SEQ ID NO: 1534263 - RNA, 13 nt, Pseudomonas aeruginosa PA01
ccccacccguccc

SEQ ID NO: 1534264 - RNA, 14 nt, Pseudomonas aeruginosa PA01
ccccacccgucccg

SEQ ID NO: 1534265 - RNA, 18 nt, Pseudomonas aeruginosa PA01
ccccaacccggccagccc

SEQ ID NO: 1534266 - RNA, 22 nt, Pseudomonas aeruginosa PA01
ccccacaggcccugcagcgcca

SEQ ID NO: 1534267 - RNA, 12 nt, Pseudomonas aeruginosa PA01
ccccaccaggcu

SEQ ID NO: 1534268 - RNA, 16 nt, Pseudomonas aeruginosa PA01
cccgccacuuccagca

SEQ ID NO: 1534269 - RNA, 23 nt, Pseudomonas aeruginosa PA01
cccgcagccgcgugcgcgccgcc

SEQ ID NO: 1534270 - RNA, 17 nt, Pseudomonas aeruginosa PA01
cccgcagccccgccgga

SEQ ID NO: 1534271 - RNA, 14 nt, Pseudomonas aeruginosa PA01
cccgcacgaggcgg

SEQ ID NO: 1534272 - RNA, 16 nt, Pseudomonas aeruginosa PA01
cccgcaccuugcccug

SEQ ID NO: 1534273 - RNA, 22 nt, Pseudomonas aeruginosa PA01
cccgcaccuugcccugcaucac

SEQ ID NO: 1534274 - RNA, 14 nt, Pseudomonas aeruginosa PA01
cccgcaccacuauc

SEQ ID NO: 1534275 - RNA, 14 nt, Pseudomonas aeruginosa PA01
cccgcaccagccgg

SEQ ID NO: 1534276 - RNA, 16 nt, Pseudomonas aeruginosa PA01
cccgcaaccgcugccg

SEQ ID NO: 1534277 - RNA, 23 nt, Pseudomonas aeruginosa PA01
cccgcaaggugcgggccgucguu

SEQ ID NO: 1534278 - RNA, 16 nt, Pseudomonas aeruginosa PA01
cccgagugcgcccagc

SEQ ID NO: 1534279 - RNA, 20 nt, Pseudomonas aeruginosa PA01
cccgaguucaccaccccgaa

SEQ ID NO: 1534280 - RNA, 16 nt, Pseudomonas aeruginosa PA01
cccgacaggcagcgcc

SEQ ID NO: 1534281 - RNA, 20 nt, Pseudomonas aeruginosa PA01
cccgacaggcagcgccgccc

SEQ ID NO: 1534282 - RNA, 19 nt, Pseudomonas aeruginosa PA01
ccccuuuuuuugcgcgcca

SEQ ID NO: 1534283 - RNA, 13 nt, Pseudomonas aeruginosa PA01
ccccuuggccagc

SEQ ID NO: 1534284 - RNA, 16 nt, Pseudomonas aeruginosa PA01
cccgacgcccuccagc

SEQ ID NO: 1534285 - RNA, 15 nt, Pseudomonas aeruginosa PA01
cccgaccgguuccag

SEQ ID NO: 1534286 - RNA, 19 nt, Pseudomonas aeruginosa PA01
cccgaggccagcaggccgu

SEQ ID NO: 1534287 - RNA, 14 nt, Pseudomonas aeruginosa PA01
ccccgucucgcugc

SEQ ID NO: 1534288 - RNA, 22 nt, Pseudomonas aeruginosa PA01
ccccuccuggaaagaccggcgc

SEQ ID NO: 1534289 - RNA, 21 nt, Pseudomonas aeruginosa PA01
ccccugcaugccggccgucgc

SEQ ID NO: 1534290 - RNA, 18 nt, Pseudomonas aeruginosa PA01
ccccugccgaaccgccuc

SEQ ID NO: 1534291 - RNA, 21 nt, Pseudomonas aeruginosa PA01
ccccuucggcugcaacuucca

SEQ ID NO: 1534292 - RNA, 23 nt, Pseudomonas aeruginosa PA01
ccccuucggcugcaacuuccacu

SEQ ID NO: 1534293 - RNA, 19 nt, Pseudomonas aeruginosa PA01
ccccuucggucgcgccccg

SEQ ID NO: 1534294 - RNA, 22 nt, Pseudomonas aeruginosa PA01
ccccugccgcggauacggcagg

SEQ ID NO: 1534295 - RNA, 23 nt, Pseudomonas aeruginosa PA01
ccccugcgaccgugaggcgcagg

SEQ ID NO: 1534296 - RNA, 20 nt, Pseudomonas aeruginosa PA01
ccccguagccaugcccggcu

SEQ ID NO: 1534297 - RNA, 19 nt, Pseudomonas aeruginosa PA01
ccccgucaacccuugcucc

SEQ ID NO: 1534298 - RNA, 15 nt, Pseudomonas aeruginosa PA01
ccccgucgacgcauc

SEQ ID NO: 1534299 - RNA, 22 nt, Pseudomonas aeruginosa PA01
cccaguucuucgccgcccgcgc

SEQ ID NO: 1534300 - RNA, 16 nt, Pseudomonas aeruginosa PA01
cccaucgccagggucu

SEQ ID NO: 1534301 - RNA, 22 nt, Pseudomonas aeruginosa PA01
cccaucgaugcucauccugccc

SEQ ID NO: 1534302 - RNA, 21 nt, Pseudomonas aeruginosa PA01
cccauccgacgccggcuucca

SEQ ID NO: 1534303 - RNA, 19 nt, Pseudomonas aeruginosa PA01
cccaucacggccccgagaa

SEQ ID NO: 1534304 - RNA, 18 nt, Pseudomonas aeruginosa PA01
cccagguggucgaccagg

SEQ ID NO: 1534305 - RNA, 19 nt, Pseudomonas aeruginosa PA01
cccagguggucgaccaggc

SEQ ID NO: 1534306 - RNA, 24 nt, Pseudomonas aeruginosa PA01
cccaguagcgcuucgcgcagcucg

SEQ ID NO: 1534307 - RNA, 14 nt, Pseudomonas aeruginosa PA01
cccagugcucccgc

SEQ ID NO: 1534308 - RNA, 15 nt, Pseudomonas aeruginosa PA01
cccagugcucccgca

SEQ ID NO: 1534309 - RNA, 18 nt, Pseudomonas aeruginosa PA01
cccaguucgccggccagc

SEQ ID NO: 1534310 - RNA, 21 nt, Pseudomonas aeruginosa PA01
cccaguucgcgcggagugcug

SEQ ID NO: 1534311 - RNA, 15 nt, Pseudomonas aeruginosa PA01
cccaguucaacugga

SEQ ID NO: 1534312 - RNA, 21 nt, Pseudomonas aeruginosa PA01
cccagugguuuuccugcaucu

SEQ ID NO: 1534313 - RNA, 17 nt, Pseudomonas aeruginosa PA01
cccagugggccaccggc

SEQ ID NO: 1534314 - RNA, 16 nt, Pseudomonas aeruginosa PA01
cccagguaagcggcgu

SEQ ID NO: 1534315 - RNA, 14 nt, Pseudomonas aeruginosa PA01
cccagguggcaggc

SEQ ID NO: 1534316 - RNA, 15 nt, Pseudomonas aeruginosa PA01
cccagguggcaggcc

SEQ ID NO: 1534317 - RNA, 13 nt, Pseudomonas aeruginosa PA01
cccaggugcagcg

SEQ ID NO: 1534318 - RNA, 14 nt, Pseudomonas aeruginosa PA01
cccaggugcccugg

SEQ ID NO: 1534319 - RNA, 15 nt, Pseudomonas aeruginosa PA01
cccaggugcccugga

SEQ ID NO: 1534320 - RNA, 17 nt, Pseudomonas aeruginosa PA01
cccaggugcccuggaag

SEQ ID NO: 1534321 - RNA, 17 nt, Pseudomonas aeruginosa PA01
cccaggugcgcaggcgc

SEQ ID NO: 1534322 - RNA, 15 nt, Pseudomonas aeruginosa PA01
cccaggucggcgggc

SEQ ID NO: 1534323 - RNA, 21 nt, Pseudomonas aeruginosa PA01
cccaggucggcgggcaccgcc

SEQ ID NO: 1534324 - RNA, 18 nt, Pseudomonas aeruginosa PA01
cccagguagucgcccagc

SEQ ID NO: 1534325 - RNA, 22 nt, Pseudomonas aeruginosa PA01
cccagguagucgcccagcgccu

SEQ ID NO: 1534326 - RNA, 19 nt, Pseudomonas aeruginosa PA01
cccagggccagcggguuga

SEQ ID NO: 1534327 - RNA, 20 nt, Pseudomonas aeruginosa PA01
cccagguagcgcugcgccag

SEQ ID NO: 1534328 - RNA, 15 nt, Pseudomonas aeruginosa PA01
cccagggcgcugccg

SEQ ID NO: 1534329 - RNA, 19 nt, Pseudomonas aeruginosa PA01
cccagggcguggucggcgg

SEQ ID NO: 1534330 - RNA, 15 nt, Pseudomonas aeruginosa PA01
cccagggacgcgccg

SEQ ID NO: 1534331 - RNA, 19 nt, Pseudomonas aeruginosa PA01
cccaggcuggcggccaggg

SEQ ID NO: 1534332 - RNA, 17 nt, Pseudomonas aeruginosa PA01
cccaggcuucggcgcgc

SEQ ID NO: 1534333 - RNA, 18 nt, Pseudomonas aeruginosa PA01
cccaggcuucggcgcgcu

SEQ ID NO: 1534334 - RNA, 19 nt, Pseudomonas aeruginosa PA01
cccaggcugccggccaggu

SEQ ID NO: 1534335 - RNA, 14 nt, Pseudomonas aeruginosa PA01
cccaggcgucgcgc

SEQ ID NO: 1534336 - RNA, 17 nt, Pseudomonas aeruginosa PA01
cccaggccgcuggcggc

SEQ ID NO: 1534337 - RNA, 21 nt, Pseudomonas aeruginosa PA01
cccaggccgcccuugacccca

SEQ ID NO: 1534338 - RNA, 14 nt, Pseudomonas aeruginosa PA01
cccaggccgcgcag

SEQ ID NO: 1534339 - RNA, 17 nt, Pseudomonas aeruginosa PA01
cccaggccgggucgcag

SEQ ID NO: 1534340 - RNA, 17 nt, Pseudomonas aeruginosa PA01
cccaggccuggguguug

SEQ ID NO: 1534341 - RNA, 14 nt, Pseudomonas aeruginosa PA01
cccaggcgcaccuc

SEQ ID NO: 1534342 - RNA, 12 nt, Pseudomonas aeruginosa PA01
cccaggcgccca

SEQ ID NO: 1534343 - RNA, 15 nt, Pseudomonas aeruginosa PA01
cccaggcgcccaggc

SEQ ID NO: 1534344 - RNA, 14 nt, Pseudomonas aeruginosa PA01
cccaggcgcggcgu

SEQ ID NO: 1534345 - RNA, 13 nt, Pseudomonas aeruginosa PA01
cccaaggggccgc

SEQ ID NO: 1534346 - RNA, 20 nt, Pseudomonas aeruginosa PA01
cccagaagaucgccugcugg

SEQ ID NO: 1534347 - RNA, 15 nt, Pseudomonas aeruginosa PA01
cccagaagccgaccu

SEQ ID NO: 1534348 - RNA, 21 nt, Pseudomonas aeruginosa PA01
cccagaaaccgaucagcaccg

SEQ ID NO: 1534349 - RNA, 16 nt, Pseudomonas aeruginosa PA01
cccagaaaaucggcag

SEQ ID NO: 1534350 - RNA, 19 nt, Pseudomonas aeruginosa PA01
cccagcaacugaccuggcc

SEQ ID NO: 1534351 - RNA, 18 nt, Pseudomonas aeruginosa PA01
cccagcaccacagcacca

SEQ ID NO: 1534352 - RNA, 12 nt, Pseudomonas aeruginosa PA01
cccagcaccugg

SEQ ID NO: 1534353 - RNA, 15 nt, Pseudomonas aeruginosa PA01
cccagccgcggccgu

SEQ ID NO: 1534354 - RNA, 16 nt, Pseudomonas aeruginosa PA01
cccagccgcggcgcca

SEQ ID NO: 1534355 - RNA, 14 nt, Pseudomonas aeruginosa PA01
cccagccgaggugg

SEQ ID NO: 1534356 - RNA, 14 nt, Pseudomonas aeruginosa PA01
cccagccgcacgcc

SEQ ID NO: 1534357 - RNA, 17 nt, Pseudomonas aeruginosa PA01
cccagcgacuccgccag

SEQ ID NO: 1534358 - RNA, 21 nt, Pseudomonas aeruginosa PA01
cccagccuugcuggacuuccc

SEQ ID NO: 1534359 - RNA, 14 nt, Pseudomonas aeruginosa PA01
cccagccucggcag

SEQ ID NO: 1534360 - RNA, 19 nt, Pseudomonas aeruginosa PA01
cccagcaggccagccaacu

SEQ ID NO: 1534361 - RNA, 17 nt, Pseudomonas aeruginosa PA01
cccagcaggccggccag

SEQ ID NO: 1534362 - RNA, 22 nt, Pseudomonas aeruginosa PA01
cccagcaggcugcugcugcggc

SEQ ID NO: 1534363 - RNA, 12 nt, Pseudomonas aeruginosa PA01
cccagcccggcc

SEQ ID NO: 1534364 - RNA, 17 nt, Pseudomonas aeruginosa PA01
cccagccccaccgccag

SEQ ID NO: 1534365 - RNA, 14 nt, Pseudomonas aeruginosa PA01
cccagcagcgccuc

SEQ ID NO: 1534366 - RNA, 18 nt, Pseudomonas aeruginosa PA01
cccagcagcaacagcgcc

SEQ ID NO: 1534367 - RNA, 15 nt, Pseudomonas aeruginosa PA01
cccagcagcaccauc

SEQ ID NO: 1534368 - RNA, 13 nt, Pseudomonas aeruginosa PA01
cccagcagcaggc

SEQ ID NO: 1534369 - RNA, 14 nt, Pseudomonas aeruginosa PA01
cccagcagcaggcc

SEQ ID NO: 1534370 - RNA, 22 nt, Pseudomonas aeruginosa PA01
cccagcagcaggccggcgacca

SEQ ID NO: 1534371 - RNA, 21 nt, Pseudomonas aeruginosa PA01
cccaggcaccguaggccaggc

SEQ ID NO: 1534372 - RNA, 18 nt, Pseudomonas aeruginosa PA01
cccaggcacggcuucagc

SEQ ID NO: 1534373 - RNA, 13 nt, Pseudomonas aeruginosa PA01
cccaggccagcgg

SEQ ID NO: 1534374 - RNA, 17 nt, Pseudomonas aeruginosa PA01
cccaggcccagcgcggc

SEQ ID NO: 1534375 - RNA, 19 nt, Pseudomonas aeruginosa PA01
cccagcucgccgcuccaca

SEQ ID NO: 1534376 - RNA, 14 nt, Pseudomonas aeruginosa PA01
cccagcgcggcgcc

SEQ ID NO: 1534377 - RNA, 21 nt, Pseudomonas aeruginosa PA01
cccagcgcggcgccccaggcg

SEQ ID NO: 1534378 - RNA, 15 nt, Pseudomonas aeruginosa PA01
cccagcgcgccgccg

SEQ ID NO: 1534379 - RNA, 12 nt, Pseudomonas aeruginosa PA01
cccagcgcgccg

SEQ ID NO: 1534380 - RNA, 14 nt, Pseudomonas aeruginosa PA01
cccagcggcgccag

SEQ ID NO: 1534381 - RNA, 21 nt, Pseudomonas aeruginosa PA01
cccagcggcgcggcguaccag

SEQ ID NO: 1534382 - RNA, 14 nt, Pseudomonas aeruginosa PA01
cccagcggcagguc

SEQ ID NO: 1534383 - RNA, 17 nt, Pseudomonas aeruginosa PA01
cccagcggcaggucguu

SEQ ID NO: 1534384 - RNA, 12 nt, Pseudomonas aeruginosa PA01
cccagcgcgugc

SEQ ID NO: 1534385 - RNA, 18 nt, Pseudomonas aeruginosa PA01
cccagcgcgugcaggcgc

SEQ ID NO: 1534386 - RNA, 14 nt, Pseudomonas aeruginosa PA01
cccagcgccccgcc

SEQ ID NO: 1534387 - RNA, 18 nt, Pseudomonas aeruginosa PA01
cccagcgcccgcaccacc

SEQ ID NO: 1534388 - RNA, 14 nt, Pseudomonas aeruginosa PA01
cccagcgccgccug

SEQ ID NO: 1534389 - RNA, 16 nt, Pseudomonas aeruginosa PA01
cccagcgccgccugcu

SEQ ID NO: 1534390 - RNA, 18 nt, Pseudomonas aeruginosa PA01
cccagcgccgccugcugg

SEQ ID NO: 1534391 - RNA, 14 nt, Pseudomonas aeruginosa PA01
cccagcgccgccag

SEQ ID NO: 1534392 - RNA, 15 nt, Pseudomonas aeruginosa PA01
cccagcgccgccagc

SEQ ID NO: 1534393 - RNA, 18 nt, Pseudomonas aeruginosa PA01
cccagcgccgccagcagg

SEQ ID NO: 1534394 - RNA, 17 nt, Pseudomonas aeruginosa PA01
cccagcgcagccugcug

SEQ ID NO: 1534395 - RNA, 21 nt, Pseudomonas aeruginosa PA01
ccaucgccucgcggaccucgg

SEQ ID NO: 1534396 - RNA, 15 nt, Pseudomonas aeruginosa PA01
ccaucgccuccacgg

SEQ ID NO: 1534397 - RNA, 15 nt, Pseudomonas aeruginosa PA01
ccaucgcccgcagcc

SEQ ID NO: 1534398 - RNA, 16 nt, Pseudomonas aeruginosa PA01
ccaucgcccgcagcca

SEQ ID NO: 1534399 - RNA, 13 nt, Pseudomonas aeruginosa PA01
ccaucgccggccc

SEQ ID NO: 1534400 - RNA, 18 nt, Pseudomonas aeruginosa PA01
ccaucgccaccagcagga

SEQ ID NO: 1534401 - RNA, 16 nt, Pseudomonas aeruginosa PA01
ccauccuccagcgccg

SEQ ID NO: 1534402 - RNA, 17 nt, Pseudomonas aeruginosa PA01
ccauccuccagcgccgc

SEQ ID NO: 1534403 - RNA, 12 nt, Pseudomonas aeruginosa PA01
ccauccagccag

SEQ ID NO: 1534404 - RNA, 22 nt, Pseudomonas aeruginosa PA01
ccauccagucuucgccggccug

SEQ ID NO: 1534405 - RNA, 15 nt, Pseudomonas aeruginosa PA01
ccaucaguugcgcgc

SEQ ID NO: 1534406 - RNA, 15 nt, Pseudomonas aeruginosa PA01
ccaucagggucggcc

SEQ ID NO: 1534407 - RNA, 16 nt, Pseudomonas aeruginosa PA01
ccaucagggucggccc

SEQ ID NO: 1534408 - RNA, 15 nt, Pseudomonas aeruginosa PA01
ccaucaggcucaggc

SEQ ID NO: 1534409 - RNA, 16 nt, Pseudomonas aeruginosa PA01
ccaucaggcucaggcg

SEQ ID NO: 1534410 - RNA, 17 nt, Pseudomonas aeruginosa PA01
ccaucaggcucaggcgu

SEQ ID NO: 1534411 - RNA, 23 nt, Pseudomonas aeruginosa PA01
ccaugcaugauuucguuggccca

SEQ ID NO: 1534412 - RNA, 21 nt, Pseudomonas aeruginosa PA01
ccaugcagcggcauggucagc

SEQ ID NO: 1534413 - RNA, 14 nt, Pseudomonas aeruginosa PA01
ccaugcacacgcuc

SEQ ID NO: 1534414 - RNA, 17 nt, Pseudomonas aeruginosa PA01
ccaugcacacgcuccca

SEQ ID NO: 1534415 - RNA, 18 nt, Pseudomonas aeruginosa PA01
ccaugaccucggccagcc

SEQ ID NO: 1534416 - RNA, 19 nt, Pseudomonas aeruginosa PA01
ccaugaccucggccagcca

SEQ ID NO: 1534417 - RNA, 23 nt, Pseudomonas aeruginosa PA01
ccaugccgcaagcuccccgccgc

SEQ ID NO: 1534418 - RNA, 23 nt, Pseudomonas aeruginosa PA01
ccaugcccgccccgcaccagcca

SEQ ID NO: 1534419 - RNA, 24 nt, Pseudomonas aeruginosa PA01
ccaugcccgccccgcaccagccag

SEQ ID NO: 1534420 - RNA, 20 nt, Pseudomonas aeruginosa PA01
ccaugcccuuguccggcccg

SEQ ID NO: 1534421 - RNA, 22 nt, Pseudomonas aeruginosa PA01
ccaugcccuuguccggcccgga

SEQ ID NO: 1534422 - RNA, 15 nt, Pseudomonas aeruginosa PA01
ccauggccgcugaaa

SEQ ID NO: 1534423 - RNA, 15 nt, Pseudomonas aeruginosa PA01
ccauggccgagccca

SEQ ID NO: 1534424 - RNA, 16 nt, Pseudomonas aeruginosa PA01
ccauggccgagcccag

SEQ ID NO: 1534425 - RNA, 13 nt, Pseudomonas aeruginosa PA01
ccauggcagagcu

SEQ ID NO: 1534426 - RNA, 14 nt, Pseudomonas aeruginosa PA01
ccauggcauccccu

SEQ ID NO: 1534427 - RNA, 13 nt, Pseudomonas aeruginosa PA01
ccaucuuuuccug

SEQ ID NO: 1534428 - RNA, 15 nt, Pseudomonas aeruginosa PA01
ccaugaacucuuccc

SEQ ID NO: 1534429 - RNA, 20 nt, Pseudomonas aeruginosa PA01
ccaugaaaaauggccgcuuc

SEQ ID NO: 1534430 - RNA, 17 nt, Pseudomonas aeruginosa PA01
ccaugaaugccuugagg

SEQ ID NO: 1534431 - RNA, 14 nt, Pseudomonas aeruginosa PA01
ccaucgcucaccgg

SEQ ID NO: 1534432 - RNA, 14 nt, Pseudomonas aeruginosa PA01
ccaucgcuccagcg

SEQ ID NO: 1534433 - RNA, 15 nt, Pseudomonas aeruginosa PA01
ccaucgcuccagcga

SEQ ID NO: 1534434 - RNA, 17 nt, Pseudomonas aeruginosa PA01
ccaucggcgucggcugg

SEQ ID NO: 1534435 - RNA, 22 nt, Pseudomonas aeruginosa PA01
ccaucggguugaucgacgccag

SEQ ID NO: 1534436 - RNA, 21 nt, Pseudomonas aeruginosa PA01
ccauggugaugcgcaugcugg

SEQ ID NO: 1534437 - RNA, 16 nt, Pseudomonas aeruginosa PA01
ccauguagaccaccag

SEQ ID NO: 1534438 - RNA, 20 nt, Pseudomonas aeruginosa PA01
ccauguggcgcagcaucauc

SEQ ID NO: 1534439 - RNA, 15 nt, Pseudomonas aeruginosa PA01
ccaugugcuccuuga

SEQ ID NO: 1534440 - RNA, 11 nt, Pseudomonas aeruginosa PA01
ccaugggugga

SEQ ID NO: 1534441 - RNA, 19 nt, Pseudomonas aeruginosa PA01
ccaugguuuaccaggacca

SEQ ID NO: 1534442 - RNA, 16 nt, Pseudomonas aeruginosa PA01
ccaugguuuccgccgg

SEQ ID NO: 1534443 - RNA, 14 nt, Pseudomonas aeruginosa PA01
ccauguaccucugg

SEQ ID NO: 1534444 - RNA, 16 nt, Pseudomonas aeruginosa PA01
ccauguaccucuggcu

SEQ ID NO: 1534445 - RNA, 23 nt, Pseudomonas aeruginosa PA01
ccaugggcacgccgguggccagg

SEQ ID NO: 1534446 - RNA, 22 nt, Pseudomonas aeruginosa PA01
ccauuccggaacucuguucguc

SEQ ID NO: 1534447 - RNA, 16 nt, Pseudomonas aeruginosa PA01
ccauuccuuccagggu

SEQ ID NO: 1534448 - RNA, 23 nt, Pseudomonas aeruginosa PA01
cccaacgucuucaggcgcuccug

SEQ ID NO: 1534449 - RNA, 13 nt, Pseudomonas aeruginosa PA01
cccaaggcacgcc

SEQ ID NO: 1534450 - RNA, 20 nt, Pseudomonas aeruginosa PA01
cccaacggaaaaaggcgccu

SEQ ID NO: 1534451 - RNA, 22 nt, Pseudomonas aeruginosa PA01
cccaacggggccuucgggcccc

SEQ ID NO: 1534452 - RNA, 13 nt, Pseudomonas aeruginosa PA01
cccaacuccagcu

SEQ ID NO: 1534453 - RNA, 15 nt, Pseudomonas aeruginosa PA01
cccaaccguucugcc

SEQ ID NO: 1534454 - RNA, 13 nt, Pseudomonas aeruginosa PA01
cccaaccuucucc

SEQ ID NO: 1534455 - RNA, 22 nt, Pseudomonas aeruginosa PA01
cccaaccuucucccuucaggga

SEQ ID NO: 1534456 - RNA, 18 nt, Pseudomonas aeruginosa PA01
ccauucgccgcgacgcuc

SEQ ID NO: 1534457 - RNA, 14 nt, Pseudomonas aeruginosa PA01
ccauucggcuuccu

SEQ ID NO: 1534458 - RNA, 14 nt, Pseudomonas aeruginosa PA01
ccauugcggcccgc

SEQ ID NO: 1534459 - RNA, 16 nt, Pseudomonas aeruginosa PA01
ccauugcggcccgcca

SEQ ID NO: 1534460 - RNA, 19 nt, Pseudomonas aeruginosa PA01
ccaguuggugcacgcgccg

SEQ ID NO: 1534461 - RNA, 17 nt, Pseudomonas aeruginosa PA01
ccaguugcccggccugg

SEQ ID NO: 1534462 - RNA, 14 nt, Pseudomonas aeruginosa PA01
ccaguugcgcuccg

SEQ ID NO: 1534463 - RNA, 14 nt, Pseudomonas aeruginosa PA01
ccauacagcgccca

SEQ ID NO: 1534464 - RNA, 13 nt, Pseudomonas aeruginosa PA01
ccauaccgccucg

SEQ ID NO: 1534465 - RNA, 15 nt, Pseudomonas aeruginosa PA01
ccauaccuccagcca

SEQ ID NO: 1534466 - RNA, 15 nt, Pseudomonas aeruginosa PA01
ccauagcgagccgcg

SEQ ID NO: 1534467 - RNA, 17 nt, Pseudomonas aeruginosa PA01
ccauagcgagccgcgcu

SEQ ID NO: 1534468 - RNA, 13 nt, Pseudomonas aeruginosa PA01
ccauagcgcgccg

SEQ ID NO: 1534469 - RNA, 23 nt, Pseudomonas aeruginosa PA01
ccauaguagagaugcaccggcca

SEQ ID NO: 1534470 - RNA, 14 nt, Pseudomonas aeruginosa PA01
ccagugcaccgccg

SEQ ID NO: 1534471 - RNA, 17 nt, Pseudomonas aeruginosa PA01
ccagugccucgcgcgug

SEQ ID NO: 1534472 - RNA, 17 nt, Pseudomonas aeruginosa PA01
ccaguucagggcgagca

SEQ ID NO: 1534473 - RNA, 16 nt, Pseudomonas aeruginosa PA01
ccaguucagcgcgcuc

SEQ ID NO: 1534474 - RNA, 18 nt, Pseudomonas aeruginosa PA01
ccaguucaucgagcaggu

SEQ ID NO: 1534475 - RNA, 14 nt, Pseudomonas aeruginosa PA01
ccagucccuggccg

SEQ ID NO: 1534476 - RNA, 19 nt, Pseudomonas aeruginosa PA01
ccagucgagacgccagccg

SEQ ID NO: 1534477 - RNA, 11 nt, Pseudomonas aeruginosa PA01
ccaguccugga

SEQ ID NO: 1534478 - RNA, 20 nt, Pseudomonas aeruginosa PA01
ccagucccgcaaagcccgcu

SEQ ID NO: 1534479 - RNA, 14 nt, Pseudomonas aeruginosa PA01
ccaguccugggugu

SEQ ID NO: 1534480 - RNA, 19 nt, Pseudomonas aeruginosa PA01
ccagucggcguccgccucg

SEQ ID NO: 1534481 - RNA, 18 nt, Pseudomonas aeruginosa PA01
ccagucggccguugcggg

SEQ ID NO: 1534482 - RNA, 11 nt, Pseudomonas aeruginosa PA01
ccagucggcgc

SEQ ID NO: 1534483 - RNA, 14 nt, Pseudomonas aeruginosa PA01
ccagucgcccgcuu

SEQ ID NO: 1534484 - RNA, 16 nt, Pseudomonas aeruginosa PA01
ccagucuucgccggcc

SEQ ID NO: 1534485 - RNA, 21 nt, Pseudomonas aeruginosa PA01
ccagguugcgcaaccagcgcu

SEQ ID NO: 1534486 - RNA, 17 nt, Pseudomonas aeruginosa PA01
ccagguuggccuggccc

SEQ ID NO: 1534487 - RNA, 19 nt, Pseudomonas aeruginosa PA01
ccagguuggcgaacaggca

SEQ ID NO: 1534488 - RNA, 22 nt, Pseudomonas aeruginosa PA01
ccaguaccacgcagccacccgc

SEQ ID NO: 1534489 - RNA, 14 nt, Pseudomonas aeruginosa PA01
ccaguaccagcaau

SEQ ID NO: 1534490 - RNA, 15 nt, Pseudomonas aeruginosa PA01
ccagucauugcgcuc

SEQ ID NO: 1534491 - RNA, 13 nt, Pseudomonas aeruginosa PA01
ccaguagcgccug

SEQ ID NO: 1534492 - RNA, 13 nt, Pseudomonas aeruginosa PA01
ccaguagcauccc

SEQ ID NO: 1534493 - RNA, 15 nt, Pseudomonas aeruginosa PA01
ccaguagggcccgug

SEQ ID NO: 1534494 - RNA, 19 nt, Pseudomonas aeruginosa PA01
ccaguagccggucaggcgc

SEQ ID NO: 1534495 - RNA, 21 nt, Pseudomonas aeruginosa PA01
ccaguagcggaagcacggcuc

SEQ ID NO: 1534496 - RNA, 15 nt, Pseudomonas aeruginosa PA01
ccaguagggggugaa

SEQ ID NO: 1534497 - RNA, 16 nt, Pseudomonas aeruginosa PA01
ccaguaguccuccgcg

SEQ ID NO: 1534498 - RNA, 18 nt, Pseudomonas aeruginosa PA01
ccagguggucgaccaggc

SEQ ID NO: 1534499 - RNA, 22 nt, Pseudomonas aeruginosa PA01
ccagguggucgaccaggcguuc

SEQ ID NO: 1534500 - RNA, 15 nt, Pseudomonas aeruginosa PA01
ccagguugaccaguu

SEQ ID NO: 1534501 - RNA, 20 nt, Pseudomonas aeruginosa PA01
ccagguucgcguggcccggc

SEQ ID NO: 1534502 - RNA, 16 nt, Pseudomonas aeruginosa PA01
ccagguacugggcgau

SEQ ID NO: 1534503 - RNA, 15 nt, Pseudomonas aeruginosa PA01
ccagguagagcagcc

SEQ ID NO: 1534504 - RNA, 18 nt, Pseudomonas aeruginosa PA01
ccagguagagcagcccgg

SEQ ID NO: 1534505 - RNA, 21 nt, Pseudomonas aeruginosa PA01
ccagguagagcagcccgggca

SEQ ID NO: 1534506 - RNA, 14 nt, Pseudomonas aeruginosa PA01
ccagguaccggcca

SEQ ID NO: 1534507 - RNA, 18 nt, Pseudomonas aeruginosa PA01
ccagguagccuggauacg

SEQ ID NO: 1534508 - RNA, 16 nt, Pseudomonas aeruginosa PA01
ccagguagcgcugcgc

SEQ ID NO: 1534509 - RNA, 16 nt, Pseudomonas aeruginosa PA01
ccagguagugccgccc

SEQ ID NO: 1534510 - RNA, 14 nt, Pseudomonas aeruginosa PA01
ccaggugcacggcc

SEQ ID NO: 1534511 - RNA, 13 nt, Pseudomonas aeruginosa PA01
ccaggugcagcga

SEQ ID NO: 1534512 - RNA, 20 nt, Pseudomonas aeruginosa PA01
ccagccgcccuggcucuggg

SEQ ID NO: 1534513 - RNA, 16 nt, Pseudomonas aeruginosa PA01
ccagccgccgaagggc

SEQ ID NO: 1534514 - RNA, 17 nt, Pseudomonas aeruginosa PA01
ccagccgcagcccgguc

SEQ ID NO: 1534515 - RNA, 13 nt, Pseudomonas aeruginosa PA01
ccagccgccagga

SEQ ID NO: 1534516 - RNA, 21 nt, Pseudomonas aeruginosa PA01
ccagccgccaggacggcaggg

SEQ ID NO: 1534517 - RNA, 14 nt, Pseudomonas aeruginosa PA01
ccagccgccaucac

SEQ ID NO: 1534518 - RNA, 15 nt, Pseudomonas aeruginosa PA01
ccagccggcaagcgu

SEQ ID NO: 1534519 - RNA, 16 nt, Pseudomonas aeruginosa PA01
ccagggguaggaggaa

SEQ ID NO: 1534520 - RNA, 15 nt, Pseudomonas aeruginosa PA01
ccaggggucaggccg

SEQ ID NO: 1534521 - RNA, 13 nt, Pseudomonas aeruginosa PA01
ccagccgcggccg

SEQ ID NO: 1534522 - RNA, 15 nt, Pseudomonas aeruginosa PA01
ccagccgcugcaggg

SEQ ID NO: 1534523 - RNA, 23 nt, Pseudomonas aeruginosa PA01
ccaggguguacuugacggcgccg

SEQ ID NO: 1534524 - RNA, 15 nt, Pseudomonas aeruginosa PA01
ccaggguuuccuggu

SEQ ID NO: 1534525 - RNA, 22 nt, Pseudomonas aeruginosa PA01
ccagguaaaggccaccagagcc

SEQ ID NO: 1534526 - RNA, 23 nt, Pseudomonas aeruginosa PA01
ccagguaaaggccaccagagcca

SEQ ID NO: 1534527 - RNA, 17 nt, Pseudomonas aeruginosa PA01
ccagggucuucagugca

SEQ ID NO: 1534528 - RNA, 18 nt, Pseudomonas aeruginosa PA01
ccagggucuucagugcac

SEQ ID NO: 1534529 - RNA, 15 nt, Pseudomonas aeruginosa PA01
ccaggguggcgcgca

SEQ ID NO: 1534530 - RNA, 21 nt, Pseudomonas aeruginosa PA01
ccagggucgguucgcggcgca

SEQ ID NO: 1534531 - RNA, 18 nt, Pseudomonas aeruginosa PA01
ccaggguaccgaaacagg

SEQ ID NO: 1534532 - RNA, 21 nt, Pseudomonas aeruginosa PA01
ccaggguacuucgugccacag

SEQ ID NO: 1534533 - RNA, 16 nt, Pseudomonas aeruginosa PA01
ccaggguagcgccgcg

SEQ ID NO: 1534534 - RNA, 20 nt, Pseudomonas aeruginosa PA01
ccaggguaucgcugucgccc

SEQ ID NO: 1534535 - RNA, 15 nt, Pseudomonas aeruginosa PA01
ccagggucacgccag

SEQ ID NO: 1534536 - RNA, 16 nt, Pseudomonas aeruginosa PA01
cggcggcgagcgccgc

SEQ ID NO: 1534537 - RNA, 23 nt, Pseudomonas aeruginosa PA01
cggcggcgaacaguuguuccggg

SEQ ID NO: 1534538 - RNA, 16 nt, Pseudomonas aeruginosa PA01
cggcggcgacccagac

SEQ ID NO: 1534539 - RNA, 19 nt, Pseudomonas aeruginosa PA01
cggcggcgaccccgaucac

SEQ ID NO: 1534540 - RNA, 21 nt, Pseudomonas aeruginosa PA01
cggcggcgaucuucuccgccg

SEQ ID NO: 1534541 - RNA, 20 nt, Pseudomonas aeruginosa PA01
cggcggcggaccuccgccag

SEQ ID NO: 1534542 - RNA, 14 nt, Pseudomonas aeruginosa PA01
cggcggcgcggcag

SEQ ID NO: 1534543 - RNA, 15 nt, Pseudomonas aeruginosa PA01
cggcggcgcggcagu

SEQ ID NO: 1534544 - RNA, 16 nt, Pseudomonas aeruginosa PA01
cggcggcgccuucgcc

SEQ ID NO: 1534545 - RNA, 18 nt, Pseudomonas aeruginosa PA01
cggcggcgccuucgccgg

SEQ ID NO: 1534546 - RNA, 20 nt, Pseudomonas aeruginosa PA01
cggcggcgccuugcggucca

SEQ ID NO: 1534547 - RNA, 17 nt, Pseudomonas aeruginosa PA01
cggcggcgccggcaggu

SEQ ID NO: 1534548 - RNA, 14 nt, Pseudomonas aeruginosa PA01
cggcggcgcgcagc

SEQ ID NO: 1534549 - RNA, 14 nt, Pseudomonas aeruginosa PA01
cggcggccgccucg

SEQ ID NO: 1534550 - RNA, 13 nt, Pseudomonas aeruginosa PA01
cggcggccgccuu

SEQ ID NO: 1534551 - RNA, 15 nt, Pseudomonas aeruginosa PA01
cggcggcccgcacag

SEQ ID NO: 1534552 - RNA, 21 nt, Pseudomonas aeruginosa PA01
cggcggccauugccgcgggcu

SEQ ID NO: 1534553 - RNA, 12 nt, Pseudomonas aeruginosa PA01
cggcggccaggc

SEQ ID NO: 1534554 - RNA, 21 nt, Pseudomonas aeruginosa PA01
cggcggccgccaucgcccggu

SEQ ID NO: 1534555 - RNA, 16 nt, Pseudomonas aeruginosa PA01
cggcggccugagccgg

SEQ ID NO: 1534556 - RNA, 22 nt, Pseudomonas aeruginosa PA01
cggcggccugcucgcgcagcca

SEQ ID NO: 1534557 - RNA, 21 nt, Pseudomonas aeruginosa PA01
cggcggccucggccucgucga

SEQ ID NO: 1534558 - RNA, 13 nt, Pseudomonas aeruginosa PA01
cggcggcggccgc

SEQ ID NO: 1534559 - RNA, 14 nt, Pseudomonas aeruginosa PA01
cggcggcggccgca

SEQ ID NO: 1534560 - RNA, 12 nt, Pseudomonas aeruginosa PA01
cggcggcggccu

SEQ ID NO: 1534561 - RNA, 15 nt, Pseudomonas aeruginosa PA01
cggcggcggccagca

SEQ ID NO: 1534562 - RNA, 18 nt, Pseudomonas aeruginosa PA01
cggcggcgugcaggguau

SEQ ID NO: 1534563 - RNA, 18 nt, Pseudomonas aeruginosa PA01
cggcggcuacccgcgccu

SEQ ID NO: 1534564 - RNA, 19 nt, Pseudomonas aeruginosa PA01
cggcggcucaacgggaccg

SEQ ID NO: 1534565 - RNA, 19 nt, Pseudomonas aeruginosa PA01
cggcggcucaggccgccgc

SEQ ID NO: 1534566 - RNA, 17 nt, Pseudomonas aeruginosa PA01
cggcgggacgcgcaugc

SEQ ID NO: 1534567 - RNA, 12 nt, Pseudomonas aeruginosa PA01
cggcgggaacgc

SEQ ID NO: 1534568 - RNA, 13 nt, Pseudomonas aeruginosa PA01
cggcgggaacgcc

SEQ ID NO: 1534569 - RNA, 20 nt, Pseudomonas aeruginosa PA01
cggcggcuucgcgcuccagg

SEQ ID NO: 1534570 - RNA, 16 nt, Pseudomonas aeruginosa PA01
cggcggcuucagccag

SEQ ID NO: 1534571 - RNA, 19 nt, Pseudomonas aeruginosa PA01
cggcgggcccguggcaggu

SEQ ID NO: 1534572 - RNA, 16 nt, Pseudomonas aeruginosa PA01
cggcgggcgcccgcca

SEQ ID NO: 1534573 - RNA, 20 nt, Pseudomonas aeruginosa PA01
cggcgggcgguagcgggcca

SEQ ID NO: 1534574 - RNA, 15 nt, Pseudomonas aeruginosa PA01
cggcgcguccaccug

SEQ ID NO: 1534575 - RNA, 24 nt, Pseudomonas aeruginosa PA01
cggcgcgucccugggcgcaggggc

SEQ ID NO: 1534576 - RNA, 21 nt, Pseudomonas aeruginosa PA01
cggcgcgucggcggugucggu

SEQ ID NO: 1534577 - RNA, 18 nt, Pseudomonas aeruginosa PA01
cggcgcgguuucgcagcg

SEQ ID NO: 1534578 - RNA, 20 nt, Pseudomonas aeruginosa PA01
cggcgcgguuucgcagcgcu

SEQ ID NO: 1534579 - RNA, 20 nt, Pseudomonas aeruginosa PA01
cggcgcggcuacccucuccc

SEQ ID NO: 1534580 - RNA, 22 nt, Pseudomonas aeruginosa PA01
cggcgcggcuacccucucccca

SEQ ID NO: 1534581 - RNA, 16 nt, Pseudomonas aeruginosa PA01
cggcgcgggcgcgcgc

SEQ ID NO: 1534582 - RNA, 20 nt, Pseudomonas aeruginosa PA01
cggcgcgggcgcgcgccacc

SEQ ID NO: 1534583 - RNA, 14 nt, Pseudomonas aeruginosa PA01
cggcgcgggcggcc

SEQ ID NO: 1534584 - RNA, 14 nt, Pseudomonas aeruginosa PA01
cggcgcggcgcagc

SEQ ID NO: 1534585 - RNA, 16 nt, Pseudomonas aeruginosa PA01
cggcgcggcgcagcca

SEQ ID NO: 1534586 - RNA, 15 nt, Pseudomonas aeruginosa PA01
cggcgcggcgcagcg

SEQ ID NO: 1534587 - RNA, 17 nt, Pseudomonas aeruginosa PA01
cggcgcggcgcuccagg

SEQ ID NO: 1534588 - RNA, 21 nt, Pseudomonas aeruginosa PA01
cggcgcggcgcuccaggcggg

SEQ ID NO: 1534589 - RNA, 19 nt, Pseudomonas aeruginosa PA01
cggcgcggcagugcucgau

SEQ ID NO: 1534590 - RNA, 23 nt, Pseudomonas aeruginosa PA01
cggcgcggccagcuucuccagca

SEQ ID NO: 1534591 - RNA, 14 nt, Pseudomonas aeruginosa PA01
cggcgcuccuccuc

SEQ ID NO: 1534592 - RNA, 15 nt, Pseudomonas aeruginosa PA01
cggcgcucgaggggc

SEQ ID NO: 1534593 - RNA, 15 nt, Pseudomonas aeruginosa PA01
cggcgcuccaacagc

SEQ ID NO: 1534594 - RNA, 18 nt, Pseudomonas aeruginosa PA01
cggcgcuccacagcugcc

SEQ ID NO: 1534595 - RNA, 13 nt, Pseudomonas aeruginosa PA01
cggcgcugaccuc

SEQ ID NO: 1534596 - RNA, 13 nt, Pseudomonas aeruginosa PA01
cggcgcugcuucu

SEQ ID NO: 1534597 - RNA, 19 nt, Pseudomonas aeruginosa PA01
cggcggcaucccuuuuuca

SEQ ID NO: 1534598 - RNA, 13 nt, Pseudomonas aeruginosa PA01
cggcggcaggccg

SEQ ID NO: 1534599 - RNA, 20 nt, Pseudomonas aeruginosa PA01
cggcggcaggcugcgccgcu

SEQ ID NO: 1534600 - RNA, 16 nt, Pseudomonas aeruginosa PA01
cggcggccagcagcac

SEQ ID NO: 1534601 - RNA, 17 nt, Pseudomonas aeruginosa PA01
cggcggauugccagcag

SEQ ID NO: 1534602 - RNA, 20 nt, Pseudomonas aeruginosa PA01
cggcggcaccacgugcagca

SEQ ID NO: 1534603 - RNA, 14 nt, Pseudomonas aeruginosa PA01
cggcggaucagccc

SEQ ID NO: 1534604 - RNA, 21 nt, Pseudomonas aeruginosa PA01
cggcggaucagcccgcugacc

SEQ ID NO: 1534605 - RNA, 20 nt, Pseudomonas aeruginosa PA01
cggcggaucgaucagcagca

SEQ ID NO: 1534606 - RNA, 18 nt, Pseudomonas aeruginosa PA01
cggcggauaaacggcaug

SEQ ID NO: 1534607 - RNA, 20 nt, Pseudomonas aeruginosa PA01
cggcggauaaacggcaugca

SEQ ID NO: 1534608 - RNA, 21 nt, Pseudomonas aeruginosa PA01
cggcggauaaccgcgagcggu

SEQ ID NO: 1534609 - RNA, 23 nt, Pseudomonas aeruginosa PA01
cggcggauaacgcuucgcagcau

SEQ ID NO: 1534610 - RNA, 19 nt, Pseudomonas aeruginosa PA01
cggcggauacaggcgcagc

SEQ ID NO: 1534611 - RNA, 20 nt, Pseudomonas aeruginosa PA01
cggcggauacaggcgcagca

SEQ ID NO: 1534612 - RNA, 19 nt, Pseudomonas aeruginosa PA01
cggcgcuguuugcggcgca

SEQ ID NO: 1534613 - RNA, 19 nt, Pseudomonas aeruginosa PA01
cggcggaacuugucgccgc

SEQ ID NO: 1534614 - RNA, 15 nt, Pseudomonas aeruginosa PA01
cggcggaagaagccc

SEQ ID NO: 1534615 - RNA, 21 nt, Pseudomonas aeruginosa PA01
cggcggaagaauaccgccagc

SEQ ID NO: 1534616 - RNA, 19 nt, Pseudomonas aeruginosa PA01
cggcgcuugcgggcgcgcc

SEQ ID NO: 1534617 - RNA, 19 nt, Pseudomonas aeruginosa PA01
cggcgcuuguagcccaggg

SEQ ID NO: 1534618 - RNA, 22 nt, Pseudomonas aeruginosa PA01
cggcgcuuguagcccaggggca

SEQ ID NO: 1534619 - RNA, 21 nt, Pseudomonas aeruginosa PA01
cggcgcuuucgcucuggucga

SEQ ID NO: 1534620 - RNA, 17 nt, Pseudomonas aeruginosa PA01
cggcgcuggccgcgcga

SEQ ID NO: 1534621 - RNA, 14 nt, Pseudomonas aeruginosa PA01
cggcgcuucaacug

SEQ ID NO: 1534622 - RNA, 15 nt, Pseudomonas aeruginosa PA01
cggcgcuucgcgcag

SEQ ID NO: 1534623 - RNA, 16 nt, Pseudomonas aeruginosa PA01
cggcgcuucgcgcagg

SEQ ID NO: 1534624 - RNA, 21 nt, Pseudomonas aeruginosa PA01
cggcggaggccuacuucucga

SEQ ID NO: 1534625 - RNA, 13 nt, Pseudomonas aeruginosa PA01
cggcggacagccc

SEQ ID NO: 1534626 - RNA, 14 nt, Pseudomonas aeruginosa PA01
cggcggacaggcag

SEQ ID NO: 1534627 - RNA, 21 nt, Pseudomonas aeruginosa PA01
cggcggacaggcagccggcca

SEQ ID NO: 1534628 - RNA, 13 nt, Pseudomonas aeruginosa PA01
cggcgguccaggg

SEQ ID NO: 1534629 - RNA, 12 nt, Pseudomonas aeruginosa PA01
cggcggucccag

SEQ ID NO: 1534630 - RNA, 20 nt, Pseudomonas aeruginosa PA01
cggcggucccagaccagcag

SEQ ID NO: 1534631 - RNA, 18 nt, Pseudomonas aeruginosa PA01
cggcggucccaucagcag

SEQ ID NO: 1534632 - RNA, 21 nt, Pseudomonas aeruginosa PA01
cggcggucccaucagcagucc

SEQ ID NO: 1534633 - RNA, 19 nt, Pseudomonas aeruginosa PA01
cggcggucgcgaucugcug

SEQ ID NO: 1534634 - RNA, 18 nt, Pseudomonas aeruginosa PA01
cggcggucaggcucagcu

SEQ ID NO: 1534635 - RNA, 21 nt, Pseudomonas aeruginosa PA01
cggcggucaggcucagcucgg

SEQ ID NO: 1534636 - RNA, 22 nt, Pseudomonas aeruginosa PA01
cggcggguauccgccgggccgc

SEQ ID NO: 1534637 - RNA, 15 nt, Pseudomonas aeruginosa PA01
cggcguaccaggaug

SEQ ID NO: 1534638 - RNA, 15 nt, Pseudomonas aeruginosa PA01
cggcgagcaggcggg

SEQ ID NO: 1534639 - RNA, 21 nt, Pseudomonas aeruginosa PA01
cggcgagcaucucggccaggc

SEQ ID NO: 1534640 - RNA, 23 nt, Pseudomonas aeruginosa PA01
cggcgagcaucucggccaggccc

SEQ ID NO: 1534641 - RNA, 18 nt, Pseudomonas aeruginosa PA01
cggcgagcgagcggcaga

SEQ ID NO: 1534642 - RNA, 15 nt, Pseudomonas aeruginosa PA01
cggcgagccgccggg

SEQ ID NO: 1534643 - RNA, 17 nt, Pseudomonas aeruginosa PA01
cggcgaggaucgccagc

SEQ ID NO: 1534644 - RNA, 18 nt, Pseudomonas aeruginosa PA01
cggcgaggaucgccagca

SEQ ID NO: 1534645 - RNA, 19 nt, Pseudomonas aeruginosa PA01
cggcgagcuggaucggcag

SEQ ID NO: 1534646 - RNA, 14 nt, Pseudomonas aeruginosa PA01
cggcgaggucgggg

SEQ ID NO: 1534647 - RNA, 20 nt, Pseudomonas aeruginosa PA01
cggcgaguaaccaccgcucu

SEQ ID NO: 1534648 - RNA, 16 nt, Pseudomonas aeruginosa PA01
cggcgauaggcgcgca

SEQ ID NO: 1534649 - RNA, 18 nt, Pseudomonas aeruginosa PA01
cggcgauaggcgcgcaac

SEQ ID NO: 1534650 - RNA, 17 nt, Pseudomonas aeruginosa PA01
cggcgauacccaggccg

SEQ ID NO: 1534651 - RNA, 16 nt, Pseudomonas aeruginosa PA01
cggcgaguucgcgcag

SEQ ID NO: 1534652 - RNA, 17 nt, Pseudomonas aeruginosa PA01
cggcgaguucgcgcagg

SEQ ID NO: 1534653 - RNA, 13 nt, Pseudomonas aeruginosa PA01
cggcgauauccuc

SEQ ID NO: 1534654 - RNA, 22 nt, Pseudomonas aeruginosa PA01
cggcgaugaccagcucggcggg

SEQ ID NO: 1534655 - RNA, 22 nt, Pseudomonas aeruginosa PA01
cggcgaugauggucaacaccag

SEQ ID NO: 1534656 - RNA, 18 nt, Pseudomonas aeruginosa PA01
cggcgcaggcggaucgcc

SEQ ID NO: 1534657 - RNA, 19 nt, Pseudomonas aeruginosa PA01
cggcgcagcuucuccaccg

SEQ ID NO: 1534658 - RNA, 14 nt, Pseudomonas aeruginosa PA01
cggcgcagcggagg

SEQ ID NO: 1534659 - RNA, 12 nt, Pseudomonas aeruginosa PA01
cggcgcaggcug

SEQ ID NO: 1534660 - RNA, 19 nt, Pseudomonas aeruginosa PA01
cggcgcaggcugucggcca

SEQ ID NO: 1534661 - RNA, 15 nt, Pseudomonas aeruginosa PA01
cggcgcagggcaucg

SEQ ID NO: 1534662 - RNA, 17 nt, Pseudomonas aeruginosa PA01
cggcgcauagccaccgc

SEQ ID NO: 1534663 - RNA, 20 nt, Pseudomonas aeruginosa PA01
cggcgcauagccaccgccga

SEQ ID NO: 1534664 - RNA, 16 nt, Pseudomonas aeruginosa PA01
cggcgcaugcgccggc

SEQ ID NO: 1534665 - RNA, 18 nt, Pseudomonas aeruginosa PA01
cggcgcaugcgccggcuu

SEQ ID NO: 1534666 - RNA, 22 nt, Pseudomonas aeruginosa PA01
cggcgcccaaugcaucggccgg

SEQ ID NO: 1534667 - RNA, 15 nt, Pseudomonas aeruginosa PA01
cggcgcccacaaccu

SEQ ID NO: 1534668 - RNA, 21 nt, Pseudomonas aeruginosa PA01
cggcgcccacaaccugccgau

SEQ ID NO: 1534669 - RNA, 15 nt, Pseudomonas aeruginosa PA01
cggcgccaccccgcc

SEQ ID NO: 1534670 - RNA, 16 nt, Pseudomonas aeruginosa PA01
cggcgccaccccgccg

SEQ ID NO: 1534671 - RNA, 18 nt, Pseudomonas aeruginosa PA01
cggcgcccacuccaacca

SEQ ID NO: 1534672 - RNA, 14 nt, Pseudomonas aeruginosa PA01
cggcgcccagcacc

SEQ ID NO: 1534673 - RNA, 23 nt, Pseudomonas aeruginosa PA01
cggcgaugccggagagcagcacg

SEQ ID NO: 1534674 - RNA, 17 nt, Pseudomonas aeruginosa PA01
cggcgaugcccaggccg

SEQ ID NO: 1534675 - RNA, 20 nt, Pseudomonas aeruginosa PA01
cggcgaugcccaggccgccg

SEQ ID NO: 1534676 - RNA, 14 nt, Pseudomonas aeruginosa PA01
cggcgaugccgccc

SEQ ID NO: 1534677 - RNA, 16 nt, Pseudomonas aeruginosa PA01
cggcgaugccgcccag

SEQ ID NO: 1534678 - RNA, 17 nt, Pseudomonas aeruginosa PA01
cggcgaugccgcccagc

SEQ ID NO: 1534679 - RNA, 17 nt, Pseudomonas aeruginosa PA01
cggcgcacgccggccuc

SEQ ID NO: 1534680 - RNA, 19 nt, Pseudomonas aeruginosa PA01
cggcgcacgccggccucgc

SEQ ID NO: 1534681 - RNA, 21 nt, Pseudomonas aeruginosa PA01
cggcgcacugagggucagccg

SEQ ID NO: 1534682 - RNA, 18 nt, Pseudomonas aeruginosa PA01
cggcgcgcggcagcacca

SEQ ID NO: 1534683 - RNA, 14 nt, Pseudomonas aeruginosa PA01
cggcgcggacggcc

SEQ ID NO: 1534684 - RNA, 14 nt, Pseudomonas aeruginosa PA01
cggcgcgccggccc

SEQ ID NO: 1534685 - RNA, 16 nt, Pseudomonas aeruginosa PA01
cggcgcgcugcgugcg

SEQ ID NO: 1534686 - RNA, 22 nt, Pseudomonas aeruginosa PA01
cggcgcgcugcgugcgccgcuc

SEQ ID NO: 1534687 - RNA, 15 nt, Pseudomonas aeruginosa PA01
cggcgcgcggggucu

SEQ ID NO: 1534688 - RNA, 12 nt, Pseudomonas aeruginosa PA01
cggcgcgcgccc

SEQ ID NO: 1534689 - RNA, 14 nt, Pseudomonas aeruginosa PA01
cggcgcgcgccccc

SEQ ID NO: 1534690 - RNA, 15 nt, Pseudomonas aeruginosa PA01
cggcgcgcgcccccu

SEQ ID NO: 1534691 - RNA, 21 nt, Pseudomonas aeruginosa PA01
cggcgcgcgucguccagggcg

SEQ ID NO: 1534692 - RNA, 17 nt, Pseudomonas aeruginosa PA01
cggcgcgcuccggcgcg

SEQ ID NO: 1534693 - RNA, 19 nt, Pseudomonas aeruginosa PA01
cggcgcgcuccggcgcgcc

SEQ ID NO: 1534694 - RNA, 20 nt, Pseudomonas aeruginosa PA01
cggcgcgcuccggcgcgcca

SEQ ID NO: 1534695 - RNA, 19 nt, Pseudomonas aeruginosa PA01
cggcgcgacggcccacggc

SEQ ID NO: 1534696 - RNA, 21 nt, Pseudomonas aeruginosa PA01
cggcgcgacuguucucuacgc

SEQ ID NO: 1534697 - RNA, 16 nt, Pseudomonas aeruginosa PA01
cggcgcgauccuccgc

SEQ ID NO: 1534698 - RNA, 18 nt, Pseudomonas aeruginosa PA01
cggcgcgauauccgccag

SEQ ID NO: 1534699 - RNA, 18 nt, Pseudomonas aeruginosa PA01
cggcgcgagaugaagcgc

SEQ ID NO: 1534700 - RNA, 22 nt, Pseudomonas aeruginosa PA01
cggcgcgagaugaagcgccgca

SEQ ID NO: 1534701 - RNA, 19 nt, Pseudomonas aeruginosa PA01
cggcgcgccccugcgccca

SEQ ID NO: 1534702 - RNA, 23 nt, Pseudomonas aeruginosa PA01
cggcgcgcaucuggugcgcgucc

SEQ ID NO: 1534703 - RNA, 24 nt, Pseudomonas aeruginosa PA01
cggcgcgcaucuggugcgcgucca

SEQ ID NO: 1534704 - RNA, 14 nt, Pseudomonas aeruginosa PA01
cggcgcgcccaggc

SEQ ID NO: 1534705 - RNA, 16 nt, Pseudomonas aeruginosa PA01
cggcgcgcccggcgca

SEQ ID NO: 1534706 - RNA, 20 nt, Pseudomonas aeruginosa PA01
cggcgcgcccggcgcagaac

SEQ ID NO: 1534707 - RNA, 20 nt, Pseudomonas aeruginosa PA01
cggcgcgcagggccagcaac

SEQ ID NO: 1534708 - RNA, 16 nt, Pseudomonas aeruginosa PA01
cggcgcgaaccagcag

SEQ ID NO: 1534709 - RNA, 18 nt, Pseudomonas aeruginosa PA01
cggcgcgcacggaggcgc

SEQ ID NO: 1534710 - RNA, 12 nt, Pseudomonas aeruginosa PA01
cggcgccccggg

SEQ ID NO: 1534711 - RNA, 14 nt, Pseudomonas aeruginosa PA01
cggcgccccgucca

SEQ ID NO: 1534712 - RNA, 16 nt, Pseudomonas aeruginosa PA01
cggcgccccugcggcg

SEQ ID NO: 1534713 - RNA, 17 nt, Pseudomonas aeruginosa PA01
cggcgccccugcggcgc

SEQ ID NO: 1534714 - RNA, 12 nt, Pseudomonas aeruginosa PA01
cggcgcccaggg

SEQ ID NO: 1534715 - RNA, 17 nt, Pseudomonas aeruginosa PA01
cggcgccccaggcgccc

SEQ ID NO: 1534716 - RNA, 21 nt, Pseudomonas aeruginosa PA01
cggcgccccaggcgcccaggc

SEQ ID NO: 1534717 - RNA, 17 nt, Pseudomonas aeruginosa PA01
cggcgccccggcccagc

SEQ ID NO: 1534718 - RNA, 24 nt, Pseudomonas aeruginosa PA01
cggcgccccggcccagccgcggcg

SEQ ID NO: 1534719 - RNA, 14 nt, Pseudomonas aeruginosa PA01
cggcgcccggcgca

SEQ ID NO: 1534720 - RNA, 16 nt, Pseudomonas aeruginosa PA01
cggcgccggagcuggu

SEQ ID NO: 1534721 - RNA, 21 nt, Pseudomonas aeruginosa PA01
cggcgccgcuagggcgcccuc

SEQ ID NO: 1534722 - RNA, 12 nt, Pseudomonas aeruginosa PA01
cggcgccgggcu

SEQ ID NO: 1534723 - RNA, 22 nt, Pseudomonas aeruginosa PA01
cggcgccgguugcugcugcggg

SEQ ID NO: 1534724 - RNA, 23 nt, Pseudomonas aeruginosa PA01
cggcgccggugcuggcgagcagg

SEQ ID NO: 1534725 - RNA, 12 nt, Pseudomonas aeruginosa PA01
cggcgccuucag

SEQ ID NO: 1534726 - RNA, 18 nt, Pseudomonas aeruginosa PA01
cggccucuucgucggcga

SEQ ID NO: 1534727 - RNA, 23 nt, Pseudomonas aeruginosa PA01
cggccugcaccugcucggggccg

SEQ ID NO: 1534728 - RNA, 19 nt, Pseudomonas aeruginosa PA01
cggccugcaacacccaggc

SEQ ID NO: 1534729 - RNA, 24 nt, Pseudomonas aeruginosa PA01
cggccugcaacacccaggccuggg

SEQ ID NO: 1534730 - RNA, 21 nt, Pseudomonas aeruginosa PA01
cggccucguaggcggcgcguu

SEQ ID NO: 1534731 - RNA, 23 nt, Pseudomonas aeruginosa PA01
cggccucgucgagcaucugccgg

SEQ ID NO: 1534732 - RNA, 14 nt, Pseudomonas aeruginosa PA01
cggccugaucaucu

SEQ ID NO: 1534733 - RNA, 17 nt, Pseudomonas aeruginosa PA01
cggccugaucaucuggg

SEQ ID NO: 1534734 - RNA, 20 nt, Pseudomonas aeruginosa PA01
cggccugaucaucugggcca

SEQ ID NO: 1534735 - RNA, 16 nt, Pseudomonas aeruginosa PA01
cggccucggccucguc

SEQ ID NO: 1534736 - RNA, 23 nt, Pseudomonas aeruginosa PA01
cggccucgcugccgccgcagagc

SEQ ID NO: 1534737 - RNA, 14 nt, Pseudomonas aeruginosa PA01
cggccucgcggcgc

SEQ ID NO: 1534738 - RNA, 15 nt, Pseudomonas aeruginosa PA01
cggccucgcggcgcu

SEQ ID NO: 1534739 - RNA, 16 nt, Pseudomonas aeruginosa PA01
cggccucgcggcgcuc

SEQ ID NO: 1534740 - RNA, 15 nt, Pseudomonas aeruginosa PA01
cggccguucuccggg

SEQ ID NO: 1534741 - RNA, 21 nt, Pseudomonas aeruginosa PA01
cggccguucuccgggucgggc

SEQ ID NO: 1534742 - RNA, 17 nt, Pseudomonas aeruginosa PA01
cggccguugcgggcgau

SEQ ID NO: 1534743 - RNA, 24 nt, Pseudomonas aeruginosa PA01
cggccucgacgcagagcgccauga

SEQ ID NO: 1534744 - RNA, 20 nt, Pseudomonas aeruginosa PA01
cggccucgaggaacaggucg

SEQ ID NO: 1534745 - RNA, 19 nt, Pseudomonas aeruginosa PA01
cggccucgaggucggccug

SEQ ID NO: 1534746 - RNA, 21 nt, Pseudomonas aeruginosa PA01
cggccucgaggucggccuggc

SEQ ID NO: 1534747 - RNA, 23 nt, Pseudomonas aeruginosa PA01
cggccucgaggucggccuggcug

SEQ ID NO: 1534748 - RNA, 20 nt, Pseudomonas aeruginosa PA01
cggccucgccggucgcgcuc

SEQ ID NO: 1534749 - RNA, 14 nt, Pseudomonas aeruginosa PA01
cggccucgcgcaac

SEQ ID NO: 1534750 - RNA, 12 nt, Pseudomonas aeruginosa PA01
cggccucgccgg

SEQ ID NO: 1534751 - RNA, 14 nt, Pseudomonas aeruginosa PA01
cggccugcagccug

SEQ ID NO: 1534752 - RNA, 14 nt, Pseudomonas aeruginosa PA01
cggccugcgcgcac

SEQ ID NO: 1534753 - RNA, 19 nt, Pseudomonas aeruginosa PA01
cggccugcgcgcaccaggc

SEQ ID NO: 1534754 - RNA, 19 nt, Pseudomonas aeruginosa PA01
cggcgaaauccucgcgcac

SEQ ID NO: 1534755 - RNA, 19 nt, Pseudomonas aeruginosa PA01
cggcgaaaugcaggccggu

SEQ ID NO: 1534756 - RNA, 15 nt, Pseudomonas aeruginosa PA01
cggcgaaaccggcca

SEQ ID NO: 1534757 - RNA, 16 nt, Pseudomonas aeruginosa PA01
cggccugcugcgccgg

SEQ ID NO: 1534758 - RNA, 19 nt, Pseudomonas aeruginosa PA01
cggccugcugcgccggcac

SEQ ID NO: 1534759 - RNA, 15 nt, Pseudomonas aeruginosa PA01
cggcgaacgacagca

SEQ ID NO: 1534760 - RNA, 21 nt, Pseudomonas aeruginosa PA01
cggcgaccagcucgaagccgc

SEQ ID NO: 1534761 - RNA, 14 nt, Pseudomonas aeruginosa PA01
cggcgacccugggg

SEQ ID NO: 1534762 - RNA, 18 nt, Pseudomonas aeruginosa PA01
cggcgaccgaacagcgcg

SEQ ID NO: 1534763 - RNA, 20 nt, Pseudomonas aeruginosa PA01
cggcgaccgaacagcgcgcc

SEQ ID NO: 1534764 - RNA, 13 nt, Pseudomonas aeruginosa PA01
cggcgaccauuca

SEQ ID NO: 1534765 - RNA, 15 nt, Pseudomonas aeruginosa PA01
cggcgaccacccggc

SEQ ID NO: 1534766 - RNA, 13 nt, Pseudomonas aeruginosa PA01
cggcgaccgcauc

SEQ ID NO: 1534767 - RNA, 14 nt, Pseudomonas aeruginosa PA01
cggcgaccgcgcgc

SEQ ID NO: 1534768 - RNA, 16 nt, Pseudomonas aeruginosa PA01
cggcgagcagcggcgc

SEQ ID NO: 1534769 - RNA, 19 nt, Pseudomonas aeruginosa PA01
cggcgacuucgcauuccac

SEQ ID NO: 1534770 - RNA, 17 nt, Pseudomonas aeruginosa PA01
cggccggcagcuccggc

SEQ ID NO: 1534771 - RNA, 23 nt, Pseudomonas aeruginosa PA01
cggccggccacgcgaccagcgcc

SEQ ID NO: 1534772 - RNA, 17 nt, Pseudomonas aeruginosa PA01
cggccguagcagauauc

SEQ ID NO: 1534773 - RNA, 14 nt, Pseudomonas aeruginosa PA01
cggccgucgcgcac

SEQ ID NO: 1534774 - RNA, 16 nt, Pseudomonas aeruginosa PA01
cggccgucgcgcacca

SEQ ID NO: 1534775 - RNA, 15 nt, Pseudomonas aeruginosa PA01
cggccgccuggcgug

SEQ ID NO: 1534776 - RNA, 13 nt, Pseudomonas aeruginosa PA01
cggccgccucggc

SEQ ID NO: 1534777 - RNA, 13 nt, Pseudomonas aeruginosa PA01
cggccgccugccu

SEQ ID NO: 1534778 - RNA, 15 nt, Pseudomonas aeruginosa PA01
cggccgcgccggcuc

SEQ ID NO: 1534779 - RNA, 17 nt, Pseudomonas aeruginosa PA01
cggccgcgccuugcuca

SEQ ID NO: 1534780 - RNA, 17 nt, Pseudomonas aeruginosa PA01
cggccgcugcgcaggcc

SEQ ID NO: 1534781 - RNA, 14 nt, Pseudomonas aeruginosa PA01
cggccgcugccggg

SEQ ID NO: 1534782 - RNA, 23 nt, Pseudomonas aeruginosa PA01
cggccggaggggaugugcucagc

SEQ ID NO: 1534783 - RNA, 23 nt, Pseudomonas aeruginosa PA01
cggccccaccgcacugguggcga

SEQ ID NO: 1534784 - RNA, 14 nt, Pseudomonas aeruginosa PA01
cggcccaugccucc

SEQ ID NO: 1534785 - RNA, 15 nt, Pseudomonas aeruginosa PA01
cggcccauggcgacg

SEQ ID NO: 1534786 - RNA, 11 nt, Pseudomonas aeruginosa PA01
cggccccaggc

SEQ ID NO: 1534787 - RNA, 16 nt, Pseudomonas aeruginosa PA01
cggccaucgagcgcuc

SEQ ID NO: 1534788 - RNA, 16 nt, Pseudomonas aeruginosa PA01
cggccauuacgccgag

SEQ ID NO: 1534789 - RNA, 17 nt, Pseudomonas aeruginosa PA01
cggccauugcccggugg

SEQ ID NO: 1534790 - RNA, 18 nt, Pseudomonas aeruginosa PA01
cggccauuccuuccaggg

SEQ ID NO: 1534791 - RNA, 12 nt, Pseudomonas aeruginosa PA01
cggccgcccagc

SEQ ID NO: 1534792 - RNA, 19 nt, Pseudomonas aeruginosa PA01
cggccgccgcgcagcacca

SEQ ID NO: 1534793 - RNA, 20 nt, Pseudomonas aeruginosa PA01
cggccgccggcgcccugcuc

SEQ ID NO: 1534794 - RNA, 15 nt, Pseudomonas aeruginosa PA01
cggccgcaugccggg

SEQ ID NO: 1534795 - RNA, 14 nt, Pseudomonas aeruginosa PA01
cggccgccagcagg

SEQ ID NO: 1534796 - RNA, 14 nt, Pseudomonas aeruginosa PA01
cggccgccaggcgc

SEQ ID NO: 1534797 - RNA, 16 nt, Pseudomonas aeruginosa PA01
cggccgccaggcuggg

SEQ ID NO: 1534798 - RNA, 20 nt, Pseudomonas aeruginosa PA01
cggcagugugccgcccugcu

SEQ ID NO: 1534799 - RNA, 15 nt, Pseudomonas aeruginosa PA01
cggcauaccgcccgu

SEQ ID NO: 1534800 - RNA, 15 nt, Pseudomonas aeruginosa PA01
cggcauagaugccgg

SEQ ID NO: 1534801 - RNA, 19 nt, Pseudomonas aeruginosa PA01
cggcauagaugccggccuc

SEQ ID NO: 1534802 - RNA, 15 nt, Pseudomonas aeruginosa PA01
cggcagguaguggcc

SEQ ID NO: 1534803 - RNA, 16 nt, Pseudomonas aeruginosa PA01
cggcagguaguggccc

SEQ ID NO: 1534804 - RNA, 18 nt, Pseudomonas aeruginosa PA01
cggcaggucgggcaacgg

SEQ ID NO: 1534805 - RNA, 11 nt, Pseudomonas aeruginosa PA01
cggcagguggc

SEQ ID NO: 1534806 - RNA, 15 nt, Pseudomonas aeruginosa PA01
cggcagguggcuggc

SEQ ID NO: 1534807 - RNA, 22 nt, Pseudomonas aeruginosa PA01
cggcagguggucguugcgcgcc

SEQ ID NO: 1534808 - RNA, 19 nt, Pseudomonas aeruginosa PA01
cggcagucgguagaaaucc

SEQ ID NO: 1534809 - RNA, 22 nt, Pseudomonas aeruginosa PA01
cggcagucgguagaaauccucc

SEQ ID NO: 1534810 - RNA, 15 nt, Pseudomonas aeruginosa PA01
cggcaguacgcucug

SEQ ID NO: 1534811 - RNA, 12 nt, Pseudomonas aeruginosa PA01
cggcaggcugca

SEQ ID NO: 1534812 - RNA, 13 nt, Pseudomonas aeruginosa PA01
cggcaggcuggcg

SEQ ID NO: 1534813 - RNA, 20 nt, Pseudomonas aeruginosa PA01
cggcagggccagcggaacga

SEQ ID NO: 1534814 - RNA, 14 nt, Pseudomonas aeruginosa PA01
cggcaggguggcgc

SEQ ID NO: 1534815 - RNA, 17 nt, Pseudomonas aeruginosa PA01
cggcagggccucgggcg

SEQ ID NO: 1534816 - RNA, 12 nt, Pseudomonas aeruginosa PA01
cggcagggcgcc

SEQ ID NO: 1534817 - RNA, 13 nt, Pseudomonas aeruginosa PA01
cggcagggcgccc

SEQ ID NO: 1534818 - RNA, 22 nt, Pseudomonas aeruginosa PA01
cggcagggcgcccgcccggcac

SEQ ID NO: 1534819 - RNA, 18 nt, Pseudomonas aeruginosa PA01
cggcagggcggcgaugac

SEQ ID NO: 1534820 - RNA, 16 nt, Pseudomonas aeruginosa PA01
cggcaggguagccacg

SEQ ID NO: 1534821 - RNA, 17 nt, Pseudomonas aeruginosa PA01
cggcaggguagccacgc

SEQ ID NO: 1534822 - RNA, 15 nt, Pseudomonas aeruginosa PA01
cggcagcgucucagc

SEQ ID NO: 1534823 - RNA, 19 nt, Pseudomonas aeruginosa PA01
cggcagcgucucggcugcc

SEQ ID NO: 1534824 - RNA, 20 nt, Pseudomonas aeruginosa PA01
cggcagcucggccgagggca

SEQ ID NO: 1534825 - RNA, 19 nt, Pseudomonas aeruginosa PA01
cggcagcgucggaaaaccc

SEQ ID NO: 1534826 - RNA, 16 nt, Pseudomonas aeruginosa PA01
cggcagcgccagguag

SEQ ID NO: 1534827 - RNA, 16 nt, Pseudomonas aeruginosa PA01
cggcagcgccgagguc

SEQ ID NO: 1534828 - RNA, 16 nt, Pseudomonas aeruginosa PA01
cggcagcgccgccagc

SEQ ID NO: 1534829 - RNA, 15 nt, Pseudomonas aeruginosa PA01
cggcagcgccucggc

SEQ ID NO: 1534830 - RNA, 19 nt, Pseudomonas aeruginosa PA01
cggcagcgccucggcggcg

SEQ ID NO: 1534831 - RNA, 20 nt, Pseudomonas aeruginosa PA01
cggcagcgcguagaccaccu

SEQ ID NO: 1534832 - RNA, 21 nt, Pseudomonas aeruginosa PA01
cggcagcgcuacgcaggcccu

SEQ ID NO: 1534833 - RNA, 21 nt, Pseudomonas aeruginosa PA01
cggcaggaaggccuggaacac

SEQ ID NO: 1534834 - RNA, 20 nt, Pseudomonas aeruginosa PA01
cggcagcugcggcggcacca

SEQ ID NO: 1534835 - RNA, 18 nt, Pseudomonas aeruginosa PA01
cggcaggacgaugaucac

SEQ ID NO: 1534836 - RNA, 15 nt, Pseudomonas aeruginosa PA01
cggcaggagcaugaa

SEQ ID NO: 1534837 - RNA, 20 nt, Pseudomonas aeruginosa PA01
cggcaggaggaucgcggccu

SEQ ID NO: 1534838 - RNA, 21 nt, Pseudomonas aeruginosa PA01
cggcaggaucggcgcggucgg

SEQ ID NO: 1534839 - RNA, 18 nt, Pseudomonas aeruginosa PA01
cggcaggcacgcugccag

SEQ ID NO: 1534840 - RNA, 18 nt, Pseudomonas aeruginosa PA01
cggcaggccagcagguag

SEQ ID NO: 1534841 - RNA, 17 nt, Pseudomonas aeruginosa PA01
cggcaggccgauggccc

SEQ ID NO: 1534842 - RNA, 20 nt, Pseudomonas aeruginosa PA01
cggcaggccgauguccucga

SEQ ID NO: 1534843 - RNA, 15 nt, Pseudomonas aeruginosa PA01
cggcaggcaggccug

SEQ ID NO: 1534844 - RNA, 20 nt, Pseudomonas aeruginosa PA01
cggcaggcagugccgggcgu

SEQ ID NO: 1534845 - RNA, 17 nt, Pseudomonas aeruginosa PA01
cggcaggccguccuuga

SEQ ID NO: 1534846 - RNA, 23 nt, Pseudomonas aeruginosa PA01
cggcaggcgccaaccgggcagca

SEQ ID NO: 1534847 - RNA, 19 nt, Pseudomonas aeruginosa PA01
cggcacgcuccagaucgcc

SEQ ID NO: 1534848 - RNA, 22 nt, Pseudomonas aeruginosa PA01
cggcacgcugcuugcgcaccuc

SEQ ID NO: 1534849 - RNA, 15 nt, Pseudomonas aeruginosa PA01
cggcacuucccgccc

SEQ ID NO: 1534850 - RNA, 17 nt, Pseudomonas aeruginosa PA01
cggcacuucccgccccc

SEQ ID NO: 1534851 - RNA, 13 nt, Pseudomonas aeruginosa PA01
cggcagccguccg

SEQ ID NO: 1534852 - RNA, 12 nt, Pseudomonas aeruginosa PA01
cggcagccgcgg

SEQ ID NO: 1534853 - RNA, 23 nt, Pseudomonas aeruginosa PA01
cggcagcgaccaccaccaggucg

SEQ ID NO: 1534854 - RNA, 21 nt, Pseudomonas aeruginosa PA01
cggcagccaucgcauagccgg

SEQ ID NO: 1534855 - RNA, 22 nt, Pseudomonas aeruginosa PA01
cgcuugacgaaaaagccggaag

SEQ ID NO: 1534856 - RNA, 22 nt, Pseudomonas aeruginosa PA01
cgcuugaggucgugcagcacau

SEQ ID NO: 1534857 - RNA, 14 nt, Pseudomonas aeruginosa PA01
cgcuugagccauuc

SEQ ID NO: 1534858 - RNA, 14 nt, Pseudomonas aeruginosa PA01
cgcuugagccccgg

SEQ ID NO: 1534859 - RNA, 20 nt, Pseudomonas aeruginosa PA01
cgcuugcggucauccgccgg

SEQ ID NO: 1534860 - RNA, 21 nt, Pseudomonas aeruginosa PA01
cgcuugcggucauccgccggc

SEQ ID NO: 1534861 - RNA, 20 nt, Pseudomonas aeruginosa PA01
cgcuugcgguuauccgccgc

SEQ ID NO: 1534862 - RNA, 14 nt, Pseudomonas aeruginosa PA01
cgcuugcgccgccu

SEQ ID NO: 1534863 - RNA, 15 nt, Pseudomonas aeruginosa PA01
cgcuugcgccgccuc

SEQ ID NO: 1534864 - RNA, 23 nt, Pseudomonas aeruginosa PA01
cgcuugcccagguagucgcccag

SEQ ID NO: 1534865 - RNA, 18 nt, Pseudomonas aeruginosa PA01
cgcuugccgcgcccggcc

SEQ ID NO: 1534866 - RNA, 14 nt, Pseudomonas aeruginosa PA01
cggcacgaccacau

SEQ ID NO: 1534867 - RNA, 15 nt, Pseudomonas aeruginosa PA01
cggcacgcagcagcu

SEQ ID NO: 1534868 - RNA, 20 nt, Pseudomonas aeruginosa PA01
cggcacgaugucgaccuggg

SEQ ID NO: 1534869 - RNA, 23 nt, Pseudomonas aeruginosa PA01
cgcuuggcgaucacggcgccccg

SEQ ID NO: 1534870 - RNA, 17 nt, Pseudomonas aeruginosa PA01
cgcuuggccauggcgcu

SEQ ID NO: 1534871 - RNA, 16 nt, Pseudomonas aeruginosa PA01
cggcaucguggccaug

SEQ ID NO: 1534872 - RNA, 16 nt, Pseudomonas aeruginosa PA01
cggcaucgcucugcug

SEQ ID NO: 1534873 - RNA, 16 nt, Pseudomonas aeruginosa PA01
cggcaucgaacucaca

SEQ ID NO: 1534874 - RNA, 14 nt, Pseudomonas aeruginosa PA01
cggcaucgaccagg

SEQ ID NO: 1534875 - RNA, 15 nt, Pseudomonas aeruginosa PA01
cggcaucgaccaggg

SEQ ID NO: 1534876 - RNA, 15 nt, Pseudomonas aeruginosa PA01
cggcauagcgcagcc

SEQ ID NO: 1534877 - RNA, 17 nt, Pseudomonas aeruginosa PA01
cggcauccucgccccgc

SEQ ID NO: 1534878 - RNA, 14 nt, Pseudomonas aeruginosa PA01
cggcauccagcauc

SEQ ID NO: 1534879 - RNA, 17 nt, Pseudomonas aeruginosa PA01
cggcauccgccgcuggg

SEQ ID NO: 1534880 - RNA, 20 nt, Pseudomonas aeruginosa PA01
cggcauguugugcuugacga

SEQ ID NO: 1534881 - RNA, 19 nt, Pseudomonas aeruginosa PA01
cggcaugggcauccugccg

SEQ ID NO: 1534882 - RNA, 24 nt, Pseudomonas aeruginosa PA01
cggcaugcucagccgcgccggggc

SEQ ID NO: 1534883 - RNA, 14 nt, Pseudomonas aeruginosa PA01
cggcaugccguugg

SEQ ID NO: 1534884 - RNA, 15 nt, Pseudomonas aeruginosa PA01
cggcaugcccugccg

SEQ ID NO: 1534885 - RNA, 16 nt, Pseudomonas aeruginosa PA01
cggccaaccucucccc

SEQ ID NO: 1534886 - RNA, 15 nt, Pseudomonas aeruginosa PA01
cggccaacggccgcu

SEQ ID NO: 1534887 - RNA, 23 nt, Pseudomonas aeruginosa PA01
cggccaccagcgaaagcgucagc

SEQ ID NO: 1534888 - RNA, 20 nt, Pseudomonas aeruginosa PA01
cggccauaccuccagccagc

SEQ ID NO: 1534889 - RNA, 15 nt, Pseudomonas aeruginosa PA01
cggccaucagcgcca

SEQ ID NO: 1534890 - RNA, 15 nt, Pseudomonas aeruginosa PA01
cggccaucagcacgu

SEQ ID NO: 1534891 - RNA, 16 nt, Pseudomonas aeruginosa PA01
cggccaucgccgucuc

SEQ ID NO: 1534892 - RNA, 17 nt, Pseudomonas aeruginosa PA01
cggccauccagccaggc

SEQ ID NO: 1534893 - RNA, 20 nt, Pseudomonas aeruginosa PA01
cggccauccagccaggcgcu

SEQ ID NO: 1534894 - RNA, 20 nt, Pseudomonas aeruginosa PA01
cggccauggucucgcugacc

SEQ ID NO: 1534895 - RNA, 17 nt, Pseudomonas aeruginosa PA01
cggccaucuggcugccg

SEQ ID NO: 1534896 - RNA, 15 nt, Pseudomonas aeruginosa PA01
cggccaugcaggcca

SEQ ID NO: 1534897 - RNA, 16 nt, Pseudomonas aeruginosa PA01
cggccaugcaggccag

SEQ ID NO: 1534898 - RNA, 15 nt, Pseudomonas aeruginosa PA01
cggccaugccgccga

SEQ ID NO: 1534899 - RNA, 18 nt, Pseudomonas aeruginosa PA01
cggccaugccggccagga

SEQ ID NO: 1534900 - RNA, 22 nt, Pseudomonas aeruginosa PA01
cggccaggccacggccggcgag

SEQ ID NO: 1534901 - RNA, 15 nt, Pseudomonas aeruginosa PA01
cggccaggcccacgc

SEQ ID NO: 1534902 - RNA, 13 nt, Pseudomonas aeruginosa PA01
cggccaggacgcc

SEQ ID NO: 1534903 - RNA, 14 nt, Pseudomonas aeruginosa PA01
cggccaggccgccc

SEQ ID NO: 1534904 - RNA, 15 nt, Pseudomonas aeruginosa PA01
cggccaggccgccca

SEQ ID NO: 1534905 - RNA, 17 nt, Pseudomonas aeruginosa PA01
cggccaggcgcggcgcc

SEQ ID NO: 1534906 - RNA, 21 nt, Pseudomonas aeruginosa PA01
cggccagggcgaacagcgccg

SEQ ID NO: 1534907 - RNA, 16 nt, Pseudomonas aeruginosa PA01
cggccagggcgaggcc

SEQ ID NO: 1534908 - RNA, 20 nt, Pseudomonas aeruginosa PA01
cggccaguucggggucggcc

SEQ ID NO: 1534909 - RNA, 17 nt, Pseudomonas aeruginosa PA01
cggccaguucgcggcgc

SEQ ID NO: 1534910 - RNA, 17 nt, Pseudomonas aeruginosa PA01
cggccaguuguuccggc

SEQ ID NO: 1534911 - RNA, 20 nt, Pseudomonas aeruginosa PA01
cggccaguuguuccggcugg

SEQ ID NO: 1534912 - RNA, 15 nt, Pseudomonas aeruginosa PA01
cggccagccgcgcca

SEQ ID NO: 1534913 - RNA, 12 nt, Pseudomonas aeruginosa PA01
cggccagccccc

SEQ ID NO: 1534914 - RNA, 13 nt, Pseudomonas aeruginosa PA01
cggccagcccccu

SEQ ID NO: 1534915 - RNA, 14 nt, Pseudomonas aeruginosa PA01
cggccagcccccuc

SEQ ID NO: 1534916 - RNA, 13 nt, Pseudomonas aeruginosa PA01
cggccagccaggc

SEQ ID NO: 1534917 - RNA, 20 nt, Pseudomonas aeruginosa PA01
cggccaccgacgcgcgcgca

SEQ ID NO: 1534918 - RNA, 15 nt, Pseudomonas aeruginosa PA01
cggccagcagcgccu

SEQ ID NO: 1534919 - RNA, 16 nt, Pseudomonas aeruginosa PA01
cggccagcagcgccuc

SEQ ID NO: 1534920 - RNA, 17 nt, Pseudomonas aeruginosa PA01
cggccagcagcgccucc

SEQ ID NO: 1534921 - RNA, 19 nt, Pseudomonas aeruginosa PA01
cggccagcagcgccuccuc

SEQ ID NO: 1534922 - RNA, 22 nt, Pseudomonas aeruginosa PA01
cggccaccaucacgucgcgcac

SEQ ID NO: 1534923 - RNA, 21 nt, Pseudomonas aeruginosa PA01
cggccagcguccuucggcgcu

SEQ ID NO: 1534924 - RNA, 21 nt, Pseudomonas aeruginosa PA01
cggccagcgugaagaccuggu

SEQ ID NO: 1534925 - RNA, 15 nt, Pseudomonas aeruginosa PA01
cggccagccccugcg

SEQ ID NO: 1534926 - RNA, 15 nt, Pseudomonas aeruginosa PA01
cggccagcgcggcgc

SEQ ID NO: 1534927 - RNA, 15 nt, Pseudomonas aeruginosa PA01
cgccgacccagagcg

SEQ ID NO: 1534928 - RNA, 14 nt, Pseudomonas aeruginosa PA01
cgccgaccagcacg

SEQ ID NO: 1534929 - RNA, 19 nt, Pseudomonas aeruginosa PA01
cgccgaccgcaccgccagc

SEQ ID NO: 1534930 - RNA, 18 nt, Pseudomonas aeruginosa PA01
cgccgacggacguccucc

SEQ ID NO: 1534931 - RNA, 15 nt, Pseudomonas aeruginosa PA01
cgccgaugcccaggc

SEQ ID NO: 1534932 - RNA, 12 nt, Pseudomonas aeruginosa PA01
cgccgaugcccg

SEQ ID NO: 1534933 - RNA, 17 nt, Pseudomonas aeruginosa PA01
cgccgaucagcgcgccu

SEQ ID NO: 1534934 - RNA, 15 nt, Pseudomonas aeruginosa PA01
cgccgaucaccccgc

SEQ ID NO: 1534935 - RNA, 23 nt, Pseudomonas aeruginosa PA01
cgccgaucccgacgcccuccagc

SEQ ID NO: 1534936 - RNA, 21 nt, Pseudomonas aeruginosa PA01
cgccgauccaggaaccggcca

SEQ ID NO: 1534937 - RNA, 21 nt, Pseudomonas aeruginosa PA01
cgccgaugccggccggcagcg

SEQ ID NO: 1534938 - RNA, 15 nt, Pseudomonas aeruginosa PA01
cgccgcacaccgcgc

SEQ ID NO: 1534939 - RNA, 18 nt, Pseudomonas aeruginosa PA01
cgccgcacaccgcgcgcg

SEQ ID NO: 1534940 - RNA, 21 nt, Pseudomonas aeruginosa PA01
cgccgauugugcagggccgcg

SEQ ID NO: 1534941 - RNA, 18 nt, Pseudomonas aeruginosa PA01
cgccgccagguccgccug

SEQ ID NO: 1534942 - RNA, 20 nt, Pseudomonas aeruginosa PA01
cgccgccaggcgcgucucca

SEQ ID NO: 1534943 - RNA, 14 nt, Pseudomonas aeruginosa PA01
cgccgccaggcgcu

SEQ ID NO: 1534944 - RNA, 21 nt, Pseudomonas aeruginosa PA01
cgccgcccggcucgccgccgg

SEQ ID NO: 1534945 - RNA, 13 nt, Pseudomonas aeruginosa PA01
cgccgccagcaac

SEQ ID NO: 1534946 - RNA, 13 nt, Pseudomonas aeruginosa PA01
cgccgccagcagg

SEQ ID NO: 1534947 - RNA, 21 nt, Pseudomonas aeruginosa PA01
cgccgccagcaggucggccug

SEQ ID NO: 1534948 - RNA, 13 nt, Pseudomonas aeruginosa PA01
cgccgccagccag

SEQ ID NO: 1534949 - RNA, 13 nt, Pseudomonas aeruginosa PA01
cgccgaacccgcc

SEQ ID NO: 1534950 - RNA, 17 nt, Pseudomonas aeruginosa PA01
cgccgaacagccgcccc

SEQ ID NO: 1534951 - RNA, 22 nt, Pseudomonas aeruginosa PA01
cgccgaacagccgccccaccac

SEQ ID NO: 1534952 - RNA, 14 nt, Pseudomonas aeruginosa PA01
cgccgaacaggguu

SEQ ID NO: 1534953 - RNA, 19 nt, Pseudomonas aeruginosa PA01
cgccgacaggccggugccg

SEQ ID NO: 1534954 - RNA, 19 nt, Pseudomonas aeruginosa PA01
cgccgacacccgcgccgcc

SEQ ID NO: 1534955 - RNA, 21 nt, Pseudomonas aeruginosa PA01
cgccgaaaugcugcaggccga

SEQ ID NO: 1534956 - RNA, 19 nt, Pseudomonas aeruginosa PA01
cgcccuuuuucgucgccag

SEQ ID NO: 1534957 - RNA, 22 nt, Pseudomonas aeruginosa PA01
cgcccuuuuucgucgccagccc

SEQ ID NO: 1534958 - RNA, 18 nt, Pseudomonas aeruginosa PA01
cgcccuugcucgcggcgu

SEQ ID NO: 1534959 - RNA, 19 nt, Pseudomonas aeruginosa PA01
cgcccuuguagaucgacag

SEQ ID NO: 1534960 - RNA, 20 nt, Pseudomonas aeruginosa PA01
cgcccuugccauccuccagc

SEQ ID NO: 1534961 - RNA, 19 nt, Pseudomonas aeruginosa PA01
cgcccuugaccccaccggu

SEQ ID NO: 1534962 - RNA, 21 nt, Pseudomonas aeruginosa PA01
cgcccuugacguucaggcugu

SEQ ID NO: 1534963 - RNA, 13 nt, Pseudomonas aeruginosa PA01
cgcccuucuucca

SEQ ID NO: 1534964 - RNA, 14 nt, Pseudomonas aeruginosa PA01
cgcccuugccuguc

SEQ ID NO: 1534965 - RNA, 18 nt, Pseudomonas aeruginosa PA01
cgcccuugcgccgcgguu

SEQ ID NO: 1534966 - RNA, 17 nt, Pseudomonas aeruginosa PA01
cgcccuugcggcgcggc

SEQ ID NO: 1534967 - RNA, 19 nt, Pseudomonas aeruginosa PA01
cgcccuugcggcgcggccc

SEQ ID NO: 1534968 - RNA, 17 nt, Pseudomonas aeruginosa PA01
cgcccugcagcgcgcgc

SEQ ID NO: 1534969 - RNA, 12 nt, Pseudomonas aeruginosa PA01
cgcccugcggau

SEQ ID NO: 1534970 - RNA, 22 nt, Pseudomonas aeruginosa PA01
cgcccugcggauggcgcggggc

SEQ ID NO: 1534971 - RNA, 15 nt, Pseudomonas aeruginosa PA01
cgcccugcggcaggc

SEQ ID NO: 1534972 - RNA, 24 nt, Pseudomonas aeruginosa PA01
cgcccugcguggaaccgcggcgcc

SEQ ID NO: 1534973 - RNA, 17 nt, Pseudomonas aeruginosa PA01
cgcccuucgaacccgcc

SEQ ID NO: 1534974 - RNA, 14 nt, Pseudomonas aeruginosa PA01
cgcccggccaggcc

SEQ ID NO: 1534975 - RNA, 22 nt, Pseudomonas aeruginosa PA01
cgcccggccaggccacggcgga

SEQ ID NO: 1534976 - RNA, 18 nt, Pseudomonas aeruginosa PA01
cgcccggccaggccgccc

SEQ ID NO: 1534977 - RNA, 19 nt, Pseudomonas aeruginosa PA01
cgcccggccuucaccgcgc

SEQ ID NO: 1534978 - RNA, 19 nt, Pseudomonas aeruginosa PA01
cgcccggcgaacagcgcuu

SEQ ID NO: 1534979 - RNA, 12 nt, Pseudomonas aeruginosa PA01
cgcccggccucc

SEQ ID NO: 1534980 - RNA, 16 nt, Pseudomonas aeruginosa PA01
cgcccgguucguagag

SEQ ID NO: 1534981 - RNA, 16 nt, Pseudomonas aeruginosa PA01
cgcccgucgcgccggc

SEQ ID NO: 1534982 - RNA, 14 nt, Pseudomonas aeruginosa PA01
cgcccgugccucgg

SEQ ID NO: 1534983 - RNA, 17 nt, Pseudomonas aeruginosa PA01
cgcccaucggcgucggc

SEQ ID NO: 1534984 - RNA, 17 nt, Pseudomonas aeruginosa PA01
cgcccaucgccaccagc

SEQ ID NO: 1534985 - RNA, 13 nt, Pseudomonas aeruginosa PA01
cgcccaucgccag

SEQ ID NO: 1534986 - RNA, 23 nt, Pseudomonas aeruginosa PA01
cgcccaucaacgagccgagcagg

SEQ ID NO: 1534987 - RNA, 14 nt, Pseudomonas aeruginosa PA01
cgcccaggcccagc

SEQ ID NO: 1534988 - RNA, 17 nt, Pseudomonas aeruginosa PA01
cgcccaugccuugcagc

SEQ ID NO: 1534989 - RNA, 13 nt, Pseudomonas aeruginosa PA01
cgcccaugcgcgg

SEQ ID NO: 1534990 - RNA, 14 nt, Pseudomonas aeruginosa PA01
cgcccaugccgccc

SEQ ID NO: 1534991 - RNA, 15 nt, Pseudomonas aeruginosa PA01
cgcccaugccgcccg

SEQ ID NO: 1534992 - RNA, 17 nt, Pseudomonas aeruginosa PA01
cgcccaugccgcccggc

SEQ ID NO: 1534993 - RNA, 17 nt, Pseudomonas aeruginosa PA01
cgcccaucugcgcauug

SEQ ID NO: 1534994 - RNA, 23 nt, Pseudomonas aeruginosa PA01
cgcccaugaaaaauggccgcuuc

SEQ ID NO: 1534995 - RNA, 20 nt, Pseudomonas aeruginosa PA01
cgcccauggcacgcagggcu

SEQ ID NO: 1534996 - RNA, 19 nt, Pseudomonas aeruginosa PA01
cgccccagcaacugaccug

SEQ ID NO: 1534997 - RNA, 19 nt, Pseudomonas aeruginosa PA01
cgccccagcaccucgccgu

SEQ ID NO: 1534998 - RNA, 20 nt, Pseudomonas aeruginosa PA01
cgccccagcgccugggccgc

SEQ ID NO: 1534999 - RNA, 12 nt, Pseudomonas aeruginosa PA01
cgcccagcgccu

SEQ ID NO: 1535000 - RNA, 14 nt, Pseudomonas aeruginosa PA01
cgcccagcgccugu

SEQ ID NO: 1535001 - RNA, 15 nt, Pseudomonas aeruginosa PA01
cgcccagcggcuggc

SEQ ID NO: 1535002 - RNA, 24 nt, Pseudomonas aeruginosa PA01
cgcccagcggcuggcgggcgaccg

SEQ ID NO: 1535003 - RNA, 16 nt, Pseudomonas aeruginosa PA01
cgcccagcucgccgcu

SEQ ID NO: 1535004 - RNA, 17 nt, Pseudomonas aeruginosa PA01
cgcccagcucgccgcuc

SEQ ID NO: 1535005 - RNA, 16 nt, Pseudomonas aeruginosa PA01
cgcccaggcagcagag

SEQ ID NO: 1535006 - RNA, 18 nt, Pseudomonas aeruginosa PA01
cgcccaggccgcuggcgg

SEQ ID NO: 1535007 - RNA, 19 nt, Pseudomonas aeruginosa PA01
cgcccaggccgcuggcggc

SEQ ID NO: 1535008 - RNA, 23 nt, Pseudomonas aeruginosa PA01
cgcccaggacaacgacagccccg

SEQ ID NO: 1535009 - RNA, 15 nt, Pseudomonas aeruginosa PA01
cgcccccuccccugu

SEQ ID NO: 1535010 - RNA, 12 nt, Pseudomonas aeruginosa PA01
cgccccggcggc

SEQ ID NO: 1535011 - RNA, 18 nt, Pseudomonas aeruginosa PA01
cgccccgggucgcugcuc

SEQ ID NO: 1535012 - RNA, 18 nt, Pseudomonas aeruginosa PA01
cgccccguuugccgucgg

SEQ ID NO: 1535013 - RNA, 18 nt, Pseudomonas aeruginosa PA01
cgccccaggcgcccaggc

SEQ ID NO: 1535014 - RNA, 12 nt, Pseudomonas aeruginosa PA01
cgccccaggugc

SEQ ID NO: 1535015 - RNA, 12 nt, Pseudomonas aeruginosa PA01
cgcccgcgccuc

SEQ ID NO: 1535016 - RNA, 13 nt, Pseudomonas aeruginosa PA01
cgcccgcgccucc

SEQ ID NO: 1535017 - RNA, 17 nt, Pseudomonas aeruginosa PA01
cgcccgcgccuccaggc

SEQ ID NO: 1535018 - RNA, 14 nt, Pseudomonas aeruginosa PA01
cgcccgcgggcagc

SEQ ID NO: 1535019 - RNA, 14 nt, Pseudomonas aeruginosa PA01
cgcccgcgccucga

SEQ ID NO: 1535020 - RNA, 22 nt, Pseudomonas aeruginosa PA01
cgcccgcgcauggagacggccc

SEQ ID NO: 1535021 - RNA, 18 nt, Pseudomonas aeruginosa PA01
cgcccgccugauggcgaa

SEQ ID NO: 1535022 - RNA, 19 nt, Pseudomonas aeruginosa PA01
cgcccgccuuguucgccag

SEQ ID NO: 1535023 - RNA, 18 nt, Pseudomonas aeruginosa PA01
cgcccgaacgccgaccga

SEQ ID NO: 1535024 - RNA, 13 nt, Pseudomonas aeruginosa PA01
cgccccugcggcg

SEQ ID NO: 1535025 - RNA, 18 nt, Pseudomonas aeruginosa PA01
cgccccuuggccagcacc

SEQ ID NO: 1535026 - RNA, 16 nt, Pseudomonas aeruginosa PA01
cgccccuuuccgccgg

SEQ ID NO: 1535027 - RNA, 13 nt, Pseudomonas aeruginosa PA01
cgccccucuucca

SEQ ID NO: 1535028 - RNA, 23 nt, Pseudomonas aeruginosa PA01
cgccccgucggcccuccccuggc

SEQ ID NO: 1535029 - RNA, 13 nt, Pseudomonas aeruginosa PA01
cgccccugcgccc

SEQ ID NO: 1535030 - RNA, 18 nt, Pseudomonas aeruginosa PA01
cgccauucacuuccccuc

SEQ ID NO: 1535031 - RNA, 21 nt, Pseudomonas aeruginosa PA01
cgccauucgaauggcgccggc

SEQ ID NO: 1535032 - RNA, 16 nt, Pseudomonas aeruginosa PA01
cgccauuucaaggcga

SEQ ID NO: 1535033 - RNA, 18 nt, Pseudomonas aeruginosa PA01
cgccauuggccaggguca

SEQ ID NO: 1535034 - RNA, 23 nt, Pseudomonas aeruginosa PA01
cgccauuggccagggucacgcca

SEQ ID NO: 1535035 - RNA, 16 nt, Pseudomonas aeruginosa PA01
cgccauugccgccagg

SEQ ID NO: 1535036 - RNA, 17 nt, Pseudomonas aeruginosa PA01
cgcccagaaaaaagccc

SEQ ID NO: 1535037 - RNA, 12 nt, Pseudomonas aeruginosa PA01
cgcccacuccaa

SEQ ID NO: 1535038 - RNA, 14 nt, Pseudomonas aeruginosa PA01
cgcccacuccuccg

SEQ ID NO: 1535039 - RNA, 14 nt, Pseudomonas aeruginosa PA01
cgcccacgggcggc

SEQ ID NO: 1535040 - RNA, 15 nt, Pseudomonas aeruginosa PA01
cgcccacgggcggcu

SEQ ID NO: 1535041 - RNA, 18 nt, Pseudomonas aeruginosa PA01
cgcccaacgucuucaggc

SEQ ID NO: 1535042 - RNA, 20 nt, Pseudomonas aeruginosa PA01
cgccaucaccagcggcgagc

SEQ ID NO: 1535043 - RNA, 16 nt, Pseudomonas aeruginosa PA01
cgccaucagcacgaaa

SEQ ID NO: 1535044 - RNA, 21 nt, Pseudomonas aeruginosa PA01
cgccaucagcacgaaagccau

SEQ ID NO: 1535045 - RNA, 20 nt, Pseudomonas aeruginosa PA01
cgccaucaacggauaucccc

SEQ ID NO: 1535046 - RNA, 20 nt, Pseudomonas aeruginosa PA01
cgccaucgacguagaggauc

SEQ ID NO: 1535047 - RNA, 21 nt, Pseudomonas aeruginosa PA01
cgccaucgaucagcagcgcca

SEQ ID NO: 1535048 - RNA, 23 nt, Pseudomonas aeruginosa PA01
cgccauguuggccuugagcaggc

SEQ ID NO: 1535049 - RNA, 15 nt, Pseudomonas aeruginosa PA01
cgccauccuccagcg

SEQ ID NO: 1535050 - RNA, 13 nt, Pseudomonas aeruginosa PA01
cgccauaggccag

SEQ ID NO: 1535051 - RNA, 19 nt, Pseudomonas aeruginosa PA01
cgccaguuggacgcggccu

SEQ ID NO: 1535052 - RNA, 20 nt, Pseudomonas aeruginosa PA01
cgccaguuggacgcggccug

SEQ ID NO: 1535053 - RNA, 21 nt, Pseudomonas aeruginosa PA01
cgccaguuggacgcggccugg

SEQ ID NO: 1535054 - RNA, 17 nt, Pseudomonas aeruginosa PA01
cgccaguucucgcagca

SEQ ID NO: 1535055 - RNA, 18 nt, Pseudomonas aeruginosa PA01
cgccagguagccuggaua

SEQ ID NO: 1535056 - RNA, 18 nt, Pseudomonas aeruginosa PA01
cgccagguagugccgccc

SEQ ID NO: 1535057 - RNA, 23 nt, Pseudomonas aeruginosa PA01
cgccagguccaggcucagcucuc

SEQ ID NO: 1535058 - RNA, 22 nt, Pseudomonas aeruginosa PA01
cgccaggucgagacgcgggccc

SEQ ID NO: 1535059 - RNA, 20 nt, Pseudomonas aeruginosa PA01
cgccagguggaagcgcgcgu

SEQ ID NO: 1535060 - RNA, 22 nt, Pseudomonas aeruginosa PA01
cgccagguggaagcgcgcgucg

SEQ ID NO: 1535061 - RNA, 20 nt, Pseudomonas aeruginosa PA01
cgccagggacgcgcagcggc

SEQ ID NO: 1535062 - RNA, 13 nt, Pseudomonas aeruginosa PA01
cgccagggccggg

SEQ ID NO: 1535063 - RNA, 20 nt, Pseudomonas aeruginosa PA01
cgccagggcccacagugcca

SEQ ID NO: 1535064 - RNA, 17 nt, Pseudomonas aeruginosa PA01
cgccagggugcugccca

SEQ ID NO: 1535065 - RNA, 17 nt, Pseudomonas aeruginosa PA01
cgccaggggugccuugc

SEQ ID NO: 1535066 - RNA, 19 nt, Pseudomonas aeruginosa PA01
cgccaggggugccuugcca

SEQ ID NO: 1535067 - RNA, 20 nt, Pseudomonas aeruginosa PA01
cgccaggcgaagaaagcccc

SEQ ID NO: 1535068 - RNA, 23 nt, Pseudomonas aeruginosa PA01
cgccaggcgaagaaagccccugc

SEQ ID NO: 1535069 - RNA, 23 nt, Pseudomonas aeruginosa PA01
cgccaggcgcgguugccgcugcg

SEQ ID NO: 1535070 - RNA, 18 nt, Pseudomonas aeruginosa PA01
cgccaggcgcgucgcggc

SEQ ID NO: 1535071 - RNA, 20 nt, Pseudomonas aeruginosa PA01
cgccaggcgcgucgcggccu

SEQ ID NO: 1535072 - RNA, 20 nt, Pseudomonas aeruginosa PA01
cgccaggcgcgucuccagcu

SEQ ID NO: 1535073 - RNA, 18 nt, Pseudomonas aeruginosa PA01
cgccaggcggagcauggu

SEQ ID NO: 1535074 - RNA, 15 nt, Pseudomonas aeruginosa PA01
cgccaggcggccgcu

SEQ ID NO: 1535075 - RNA, 17 nt, Pseudomonas aeruginosa PA01
cgccaggcgcagccagc

SEQ ID NO: 1535076 - RNA, 17 nt, Pseudomonas aeruginosa PA01
cgccaggcuuuccgccg

SEQ ID NO: 1535077 - RNA, 14 nt, Pseudomonas aeruginosa PA01
cgccaggcugaucc

SEQ ID NO: 1535078 - RNA, 19 nt, Pseudomonas aeruginosa PA01
cgccaggcuggcuaucuuu

SEQ ID NO: 1535079 - RNA, 18 nt, Pseudomonas aeruginosa PA01
cgccaggcgugcagaccg

SEQ ID NO: 1535080 - RNA, 15 nt, Pseudomonas aeruginosa PA01
cgccagcgccggcca

SEQ ID NO: 1535081 - RNA, 13 nt, Pseudomonas aeruginosa PA01
cgccagcgccgcc

SEQ ID NO: 1535082 - RNA, 18 nt, Pseudomonas aeruginosa PA01
cgccagcgccagcaggua

SEQ ID NO: 1535083 - RNA, 19 nt, Pseudomonas aeruginosa PA01
cgccagcgccagcagguac

SEQ ID NO: 1535084 - RNA, 11 nt, Pseudomonas aeruginosa PA01
cgccagccucg

SEQ ID NO: 1535085 - RNA, 13 nt, Pseudomonas aeruginosa PA01
cgccagccucggc

SEQ ID NO: 1535086 - RNA, 14 nt, Pseudomonas aeruginosa PA01
cgccagcggcagcg

SEQ ID NO: 1535087 - RNA, 12 nt, Pseudomonas aeruginosa PA01
cgccagcgcggc

SEQ ID NO: 1535088 - RNA, 20 nt, Pseudomonas aeruginosa PA01
cgccagcucgccgcgcucca

SEQ ID NO: 1535089 - RNA, 18 nt, Pseudomonas aeruginosa PA01
cgccagcuccagcgccca

SEQ ID NO: 1535090 - RNA, 21 nt, Pseudomonas aeruginosa PA01
cgccagcucgcuguccagcac

SEQ ID NO: 1535091 - RNA, 20 nt, Pseudomonas aeruginosa PA01
cgccagcgguacccgccggc

SEQ ID NO: 1535092 - RNA, 22 nt, Pseudomonas aeruginosa PA01
cgccagcgguacccgccggcca

SEQ ID NO: 1535093 - RNA, 14 nt, Pseudomonas aeruginosa PA01
cgccagcuaccggc

SEQ ID NO: 1535094 - RNA, 17 nt, Pseudomonas aeruginosa PA01
cgccagcuaccggcagg

SEQ ID NO: 1535095 - RNA, 14 nt, Pseudomonas aeruginosa PA01
cgccaggcagacca

SEQ ID NO: 1535096 - RNA, 19 nt, Pseudomonas aeruginosa PA01
cgccaggcagaccaggccg

SEQ ID NO: 1535097 - RNA, 16 nt, Pseudomonas aeruginosa PA01
cgccaggcagaccugc

SEQ ID NO: 1535098 - RNA, 23 nt, Pseudomonas aeruginosa PA01
cgccaggcagucguaggucugcc

SEQ ID NO: 1535099 - RNA, 14 nt, Pseudomonas aeruginosa PA01
cgccaggaucggca

SEQ ID NO: 1535100 - RNA, 17 nt, Pseudomonas aeruginosa PA01
cgccaggcccacgccca

SEQ ID NO: 1535101 - RNA, 13 nt, Pseudomonas aeruginosa PA01
cgccaggccgccg

SEQ ID NO: 1535102 - RNA, 16 nt, Pseudomonas aeruginosa PA01
cgccaggccgccgaag

SEQ ID NO: 1535103 - RNA, 17 nt, Pseudomonas aeruginosa PA01
cgccaggccgccgaaga

SEQ ID NO: 1535104 - RNA, 16 nt, Pseudomonas aeruginosa PA01
cgccaggccguagacc

SEQ ID NO: 1535105 - RNA, 14 nt, Pseudomonas aeruginosa PA01
cgccaggccucggc

SEQ ID NO: 1535106 - RNA, 13 nt, Pseudomonas aeruginosa PA01
cgccaggccuugc

SEQ ID NO: 1535107 - RNA, 21 nt, Pseudomonas aeruginosa PA01
cgccaggaacgccucugcgcu

SEQ ID NO: 1535108 - RNA, 20 nt, Pseudomonas aeruginosa PA01
cgccaggaagccgcgcccca

SEQ ID NO: 1535109 - RNA, 14 nt, Pseudomonas aeruginosa PA01
cgccaggagcaggg

SEQ ID NO: 1535110 - RNA, 15 nt, Pseudomonas aeruginosa PA01
cgccaggagcagggc

SEQ ID NO: 1535111 - RNA, 23 nt, Pseudomonas aeruginosa PA01
cgcauaacgccccucuuccacgc

SEQ ID NO: 1535112 - RNA, 20 nt, Pseudomonas aeruginosa PA01
cgccaccagcaugcccagcg

SEQ ID NO: 1535113 - RNA, 22 nt, Pseudomonas aeruginosa PA01
cgccaccagcguggcgcgcauc

SEQ ID NO: 1535114 - RNA, 13 nt, Pseudomonas aeruginosa PA01
cgccaccaggccg

SEQ ID NO: 1535115 - RNA, 17 nt, Pseudomonas aeruginosa PA01
cgccaccaggccgcugc

SEQ ID NO: 1535116 - RNA, 22 nt, Pseudomonas aeruginosa PA01
cgccaccaggccgcugccgccg

SEQ ID NO: 1535117 - RNA, 17 nt, Pseudomonas aeruginosa PA01
cgccaccagcaggaagc

SEQ ID NO: 1535118 - RNA, 20 nt, Pseudomonas aeruginosa PA01
cgcaucgaagcgcaccaggg

SEQ ID NO: 1535119 - RNA, 21 nt, Pseudomonas aeruginosa PA01
cgcauccguaaaauggcgcgc

SEQ ID NO: 1535120 - RNA, 23 nt, Pseudomonas aeruginosa PA01
cgcauccguaaaauggcgcgccu

SEQ ID NO: 1535121 - RNA, 15 nt, Pseudomonas aeruginosa PA01
cgcauccuccacccc

SEQ ID NO: 1535122 - RNA, 13 nt, Pseudomonas aeruginosa PA01
cgccacuuccagc

SEQ ID NO: 1535123 - RNA, 22 nt, Pseudomonas aeruginosa PA01
cgccacugaacuggaucggccc

SEQ ID NO: 1535124 - RNA, 23 nt, Pseudomonas aeruginosa PA01
cgccacggguaacgguagcggca

SEQ ID NO: 1535125 - RNA, 22 nt, Pseudomonas aeruginosa PA01
cgccacgcaguucgcgggccgc

SEQ ID NO: 1535126 - RNA, 23 nt, Pseudomonas aeruginosa PA01
cgccacgcaguucgcgggccgcg

SEQ ID NO: 1535127 - RNA, 18 nt, Pseudomonas aeruginosa PA01
cgccaccugccccgggcg

SEQ ID NO: 1535128 - RNA, 17 nt, Pseudomonas aeruginosa PA01
cgccagcccucgcccag

SEQ ID NO: 1535129 - RNA, 20 nt, Pseudomonas aeruginosa PA01
cgccagccccaggccgcccu

SEQ ID NO: 1535130 - RNA, 21 nt, Pseudomonas aeruginosa PA01
cgccagccccaggccgcccuu

SEQ ID NO: 1535131 - RNA, 16 nt, Pseudomonas aeruginosa PA01
cgccagccaggguacu

SEQ ID NO: 1535132 - RNA, 16 nt, Pseudomonas aeruginosa PA01
cgccagccagcccggc

SEQ ID NO: 1535133 - RNA, 14 nt, Pseudomonas aeruginosa PA01
cgccagccagccgc

SEQ ID NO: 1535134 - RNA, 16 nt, Pseudomonas aeruginosa PA01
cgccagccagcgcggc

SEQ ID NO: 1535135 - RNA, 19 nt, Pseudomonas aeruginosa PA01
cgccagccacucccggccc

SEQ ID NO: 1535136 - RNA, 13 nt, Pseudomonas aeruginosa PA01
cgccagccagagc

SEQ ID NO: 1535137 - RNA, 14 nt, Pseudomonas aeruginosa PA01
cgccagcaggccga

SEQ ID NO: 1535138 - RNA, 23 nt, Pseudomonas aeruginosa PA01
cgccagcaggccgaaggccagga

SEQ ID NO: 1535139 - RNA, 20 nt, Pseudomonas aeruginosa PA01
cgccagcaggcgccggcgga

SEQ ID NO: 1535140 - RNA, 18 nt, Pseudomonas aeruginosa PA01
cgccagcaggcgcgggcu

SEQ ID NO: 1535141 - RNA, 14 nt, Pseudomonas aeruginosa PA01
cgccagcaggcugu

SEQ ID NO: 1535142 - RNA, 14 nt, Pseudomonas aeruginosa PA01
cgccagcaccaccc

SEQ ID NO: 1535143 - RNA, 19 nt, Pseudomonas aeruginosa PA01
cgccagcaauugccgcugc

SEQ ID NO: 1535144 - RNA, 17 nt, Pseudomonas aeruginosa PA01
cgccagcaacgccuucu

SEQ ID NO: 1535145 - RNA, 19 nt, Pseudomonas aeruginosa PA01
cgccagcaacgccuucugc

SEQ ID NO: 1535146 - RNA, 22 nt, Pseudomonas aeruginosa PA01
cgccagaugacgauggccgccg

SEQ ID NO: 1535147 - RNA, 19 nt, Pseudomonas aeruginosa PA01
cgccagaagcgacugucca

SEQ ID NO: 1535148 - RNA, 21 nt, Pseudomonas aeruginosa PA01
cgccagaaagccucaggcgcu

SEQ ID NO: 1535149 - RNA, 21 nt, Pseudomonas aeruginosa PA01
cgccagagaucgcccagcggc

SEQ ID NO: 1535150 - RNA, 15 nt, Pseudomonas aeruginosa PA01
cgccagagcgcgcua

SEQ ID NO: 1535151 - RNA, 20 nt, Pseudomonas aeruginosa PA01
cgccagagcgcgcuacucag

SEQ ID NO: 1535152 - RNA, 16 nt, Pseudomonas aeruginosa PA01
cgccagacaggccagc

SEQ ID NO: 1535153 - RNA, 16 nt, Pseudomonas aeruginosa PA01
cgccagaccagcccca

SEQ ID NO: 1535154 - RNA, 20 nt, Pseudomonas aeruginosa PA01
cgcagacgaucuccugcugg

SEQ ID NO: 1535155 - RNA, 15 nt, Pseudomonas aeruginosa PA01
cgcagacggggccuc

SEQ ID NO: 1535156 - RNA, 14 nt, Pseudomonas aeruginosa PA01
cgcagacgggugcu

SEQ ID NO: 1535157 - RNA, 21 nt, Pseudomonas aeruginosa PA01
cgcagaccagcgaaccgccgg

SEQ ID NO: 1535158 - RNA, 19 nt, Pseudomonas aeruginosa PA01
cgcagcaacuggucgccgc

SEQ ID NO: 1535159 - RNA, 12 nt, Pseudomonas aeruginosa PA01
cgcagaggcgcu

SEQ ID NO: 1535160 - RNA, 17 nt, Pseudomonas aeruginosa PA01
cgcagagaucggcggcg

SEQ ID NO: 1535161 - RNA, 20 nt, Pseudomonas aeruginosa PA01
cgcagagccagccgcagccc

SEQ ID NO: 1535162 - RNA, 16 nt, Pseudomonas aeruginosa PA01
cgcagagcgccagcca

SEQ ID NO: 1535163 - RNA, 18 nt, Pseudomonas aeruginosa PA01
cgcagagcgccagccagc

SEQ ID NO: 1535164 - RNA, 14 nt, Pseudomonas aeruginosa PA01
cgcacucuuccugg

SEQ ID NO: 1535165 - RNA, 18 nt, Pseudomonas aeruginosa PA01
cgcacucuuccugggucg

SEQ ID NO: 1535166 - RNA, 12 nt, Pseudomonas aeruginosa PA01
cgcacugcugcu

SEQ ID NO: 1535167 - RNA, 20 nt, Pseudomonas aeruginosa PA01
cgcacuggucggccaguucc

SEQ ID NO: 1535168 - RNA, 16 nt, Pseudomonas aeruginosa PA01
cgcacuuccucggcga

SEQ ID NO: 1535169 - RNA, 23 nt, Pseudomonas aeruginosa PA01
cgcacuuccucggcgaccaccgc

SEQ ID NO: 1535170 - RNA, 21 nt, Pseudomonas aeruginosa PA01
cgcaccguagcggcugcggua

SEQ ID NO: 1535171 - RNA, 18 nt, Pseudomonas aeruginosa PA01
cgcacggaggcgcucagg

SEQ ID NO: 1535172 - RNA, 16 nt, Pseudomonas aeruginosa PA01
cgcacggaucgcgcug

SEQ ID NO: 1535173 - RNA, 20 nt, Pseudomonas aeruginosa PA01
cgcacggaucgcgcugggcg

SEQ ID NO: 1535174 - RNA, 20 nt, Pseudomonas aeruginosa PA01
cgcacggucguccugcggau

SEQ ID NO: 1535175 - RNA, 12 nt, Pseudomonas aeruginosa PA01
cgcacggccugc

SEQ ID NO: 1535176 - RNA, 23 nt, Pseudomonas aeruginosa PA01
cgcacggcgaagaacagcggguc

SEQ ID NO: 1535177 - RNA, 14 nt, Pseudomonas aeruginosa PA01
cgcacggcgacgcu

SEQ ID NO: 1535178 - RNA, 15 nt, Pseudomonas aeruginosa PA01
cgcaccgcggcgagc

SEQ ID NO: 1535179 - RNA, 13 nt, Pseudomonas aeruginosa PA01
cgcaccgcggcca

SEQ ID NO: 1535180 - RNA, 15 nt, Pseudomonas aeruginosa PA01
cgcaccggcgcgccg

SEQ ID NO: 1535181 - RNA, 15 nt, Pseudomonas aeruginosa PA01
cgcaccgccagcagu

SEQ ID NO: 1535182 - RNA, 13 nt, Pseudomonas aeruginosa PA01
cgcaauccucggu

SEQ ID NO: 1535183 - RNA, 19 nt, Pseudomonas aeruginosa PA01
cgcaaucagggcugggcgc

SEQ ID NO: 1535184 - RNA, 15 nt, Pseudomonas aeruginosa PA01
cgcaauugcaccgcu

SEQ ID NO: 1535185 - RNA, 13 nt, Pseudomonas aeruginosa PA01
cgcaccagcuccc

SEQ ID NO: 1535186 - RNA, 17 nt, Pseudomonas aeruginosa PA01
cgcaccaugcccgcugg

SEQ ID NO: 1535187 - RNA, 19 nt, Pseudomonas aeruginosa PA01
cgcaccagggucgggccgc

SEQ ID NO: 1535188 - RNA, 15 nt, Pseudomonas aeruginosa PA01
cgcaccagggccagg

SEQ ID NO: 1535189 - RNA, 19 nt, Pseudomonas aeruginosa PA01
cgcaccagggccaggagca

SEQ ID NO: 1535190 - RNA, 12 nt, Pseudomonas aeruginosa PA01
cgcaccaggcca

SEQ ID NO: 1535191 - RNA, 15 nt, Pseudomonas aeruginosa PA01
cgcaccaggccaggc

SEQ ID NO: 1535192 - RNA, 15 nt, Pseudomonas aeruginosa PA01
cgcaccaggccaggu

SEQ ID NO: 1535193 - RNA, 23 nt, Pseudomonas aeruginosa PA01
cgcaccaggccucccagccgugg

SEQ ID NO: 1535194 - RNA, 17 nt, Pseudomonas aeruginosa PA01
cgcaagugcccugggcg

SEQ ID NO: 1535195 - RNA, 17 nt, Pseudomonas aeruginosa PA01
cgcaaggugcgggccgu

SEQ ID NO: 1535196 - RNA, 21 nt, Pseudomonas aeruginosa PA01
cgcaagucggccugcaccagc

SEQ ID NO: 1535197 - RNA, 19 nt, Pseudomonas aeruginosa PA01
cgcaagggugcucaggacg

SEQ ID NO: 1535198 - RNA, 19 nt, Pseudomonas aeruginosa PA01
cgcaagcuccccgccgcca

SEQ ID NO: 1535199 - RNA, 15 nt, Pseudomonas aeruginosa PA01
cgcaagggcgccgcc

SEQ ID NO: 1535200 - RNA, 16 nt, Pseudomonas aeruginosa PA01
cgauuucccccggucc

SEQ ID NO: 1535201 - RNA, 18 nt, Pseudomonas aeruginosa PA01
cgcaagcgcucggccugc

SEQ ID NO: 1535202 - RNA, 17 nt, Pseudomonas aeruginosa PA01
cgcaagcggauaucccc

SEQ ID NO: 1535203 - RNA, 13 nt, Pseudomonas aeruginosa PA01
cgcaaggccaggg

SEQ ID NO: 1535204 - RNA, 16 nt, Pseudomonas aeruginosa PA01
cgcaagcgcccggcga

SEQ ID NO: 1535205 - RNA, 13 nt, Pseudomonas aeruginosa PA01
cgcagccgcgcaa

SEQ ID NO: 1535206 - RNA, 15 nt, Pseudomonas aeruginosa PA01
cgcagccgcugcugc

SEQ ID NO: 1535207 - RNA, 20 nt, Pseudomonas aeruginosa PA01
cgcagccgcgugcgcgccgc

SEQ ID NO: 1535208 - RNA, 21 nt, Pseudomonas aeruginosa PA01
cgcagcccuugcaaccgccgc

SEQ ID NO: 1535209 - RNA, 20 nt, Pseudomonas aeruginosa PA01
cgcagcccgguccguccagc

SEQ ID NO: 1535210 - RNA, 14 nt, Pseudomonas aeruginosa PA01
cgcagccccgccgg

SEQ ID NO: 1535211 - RNA, 15 nt, Pseudomonas aeruginosa PA01
cgcagcgaagaucuu

SEQ ID NO: 1535212 - RNA, 19 nt, Pseudomonas aeruginosa PA01
cgcagcgacacaacgcugc

SEQ ID NO: 1535213 - RNA, 16 nt, Pseudomonas aeruginosa PA01
cgcagcgaacgggcgu

SEQ ID NO: 1535214 - RNA, 20 nt, Pseudomonas aeruginosa PA01
cgcagccugcuggccuggga

SEQ ID NO: 1535215 - RNA, 23 nt, Pseudomonas aeruginosa PA01
cgcagccguuggccagcaggcgc

SEQ ID NO: 1535216 - RNA, 20 nt, Pseudomonas aeruginosa PA01
cgcagccgguggucuucagc

SEQ ID NO: 1535217 - RNA, 18 nt, Pseudomonas aeruginosa PA01
cgcagcucggccaacugg

SEQ ID NO: 1535218 - RNA, 16 nt, Pseudomonas aeruginosa PA01
cgcagcucggugagca

SEQ ID NO: 1535219 - RNA, 22 nt, Pseudomonas aeruginosa PA01
cgcagcucugcgaucagggccu

SEQ ID NO: 1535220 - RNA, 23 nt, Pseudomonas aeruginosa PA01
cgcagcggcaggccacggccgcu

SEQ ID NO: 1535221 - RNA, 13 nt, Pseudomonas aeruginosa PA01
cgcagcggcagcg

SEQ ID NO: 1535222 - RNA, 18 nt, Pseudomonas aeruginosa PA01
cgcagcuccggcagcagg

SEQ ID NO: 1535223 - RNA, 22 nt, Pseudomonas aeruginosa PA01
cgcagcuccggcagcaggguca

SEQ ID NO: 1535224 - RNA, 16 nt, Pseudomonas aeruginosa PA01
cgcagcggcaugcccu

SEQ ID NO: 1535225 - RNA, 19 nt, Pseudomonas aeruginosa PA01
cgcagcggcaugcccugcc

SEQ ID NO: 1535226 - RNA, 13 nt, Pseudomonas aeruginosa PA01
cgcagcgccucca

SEQ ID NO: 1535227 - RNA, 14 nt, Pseudomonas aeruginosa PA01
cgcagcgcgcgccg

SEQ ID NO: 1535228 - RNA, 17 nt, Pseudomonas aeruginosa PA01
cgcagcgcggucauccg

SEQ ID NO: 1535229 - RNA, 13 nt, Pseudomonas aeruginosa PA01
cgcagcgcagccg

SEQ ID NO: 1535230 - RNA, 13 nt, Pseudomonas aeruginosa PA01
cgcagcgccgccg

SEQ ID NO: 1535231 - RNA, 15 nt, Pseudomonas aeruginosa PA01
cgcagcgccaccagg

SEQ ID NO: 1535232 - RNA, 20 nt, Pseudomonas aeruginosa PA01
cgcagcaggucuuccaccgc

SEQ ID NO: 1535233 - RNA, 12 nt, Pseudomonas aeruginosa PA01
cgcagccacccg

SEQ ID NO: 1535234 - RNA, 13 nt, Pseudomonas aeruginosa PA01
cgcagccacccgc

SEQ ID NO: 1535235 - RNA, 14 nt, Pseudomonas aeruginosa PA01
cgcagcaccggcuu

SEQ ID NO: 1535236 - RNA, 16 nt, Pseudomonas aeruginosa PA01
cgcagcaccacauggg

SEQ ID NO: 1535237 - RNA, 16 nt, Pseudomonas aeruginosa PA01
cgcagcacccggucga

SEQ ID NO: 1535238 - RNA, 13 nt, Pseudomonas aeruginosa PA01
cgcagcacagccc

SEQ ID NO: 1535239 - RNA, 17 nt, Pseudomonas aeruginosa PA01
cgcagcacagccccagc

SEQ ID NO: 1535240 - RNA, 14 nt, Pseudomonas aeruginosa PA01
cgcagcagcagguu

SEQ ID NO: 1535241 - RNA, 18 nt, Pseudomonas aeruginosa PA01
cgcagcagcgccaguugg

SEQ ID NO: 1535242 - RNA, 18 nt, Pseudomonas aeruginosa PA01
cgcagcagcggcaaaggc

SEQ ID NO: 1535243 - RNA, 21 nt, Pseudomonas aeruginosa PA01
cgcagcagcggcgacaccgcc

SEQ ID NO: 1535244 - RNA, 11 nt, Pseudomonas aeruginosa PA01
cgcagcagggc

SEQ ID NO: 1535245 - RNA, 13 nt, Pseudomonas aeruginosa PA01
cgcagcaggaucu

SEQ ID NO: 1535246 - RNA, 23 nt, Pseudomonas aeruginosa PA01
cgcaguuccucgccgcugcuggc

SEQ ID NO: 1535247 - RNA, 15 nt, Pseudomonas aeruginosa PA01
cgcaguucgccccgc

SEQ ID NO: 1535248 - RNA, 16 nt, Pseudomonas aeruginosa PA01
cgcaguucgccccgcc

SEQ ID NO: 1535249 - RNA, 20 nt, Pseudomonas aeruginosa PA01
cgcaguucgccccgccgcca

SEQ ID NO: 1535250 - RNA, 15 nt, Pseudomonas aeruginosa PA01
cgcaguucgccgccg

SEQ ID NO: 1535251 - RNA, 22 nt, Pseudomonas aeruginosa PA01
cgcagugucgcgaacucggcgc

SEQ ID NO: 1535252 - RNA, 23 nt, Pseudomonas aeruginosa PA01
cgcaguagaugccgcgucggcuc

SEQ ID NO: 1535253 - RNA, 22 nt, Pseudomonas aeruginosa PA01
cgcaguagcuggaucugguuga

SEQ ID NO: 1535254 - RNA, 16 nt, Pseudomonas aeruginosa PA01
cgcaguaggcgcugcc

SEQ ID NO: 1535255 - RNA, 17 nt, Pseudomonas aeruginosa PA01
cgcaguaggcgcugccg

SEQ ID NO: 1535256 - RNA, 17 nt, Pseudomonas aeruginosa PA01
cgcaguacagcucggcg

SEQ ID NO: 1535257 - RNA, 20 nt, Pseudomonas aeruginosa PA01
cgcaguacagcucggcgccc

SEQ ID NO: 1535258 - RNA, 21 nt, Pseudomonas aeruginosa PA01
cgcaguacagcugcaccgcgc

SEQ ID NO: 1535259 - RNA, 20 nt, Pseudomonas aeruginosa PA01
cgcaguccgguagcgcgccu

SEQ ID NO: 1535260 - RNA, 15 nt, Pseudomonas aeruginosa PA01
cgcaguccagggcga

SEQ ID NO: 1535261 - RNA, 16 nt, Pseudomonas aeruginosa PA01
cgcaguacccggccgc

SEQ ID NO: 1535262 - RNA, 20 nt, Pseudomonas aeruginosa PA01
cgcagguugcgcuggcgcag

SEQ ID NO: 1535263 - RNA, 17 nt, Pseudomonas aeruginosa PA01
cgcagguuggccccgcc

SEQ ID NO: 1535264 - RNA, 18 nt, Pseudomonas aeruginosa PA01
cgcagguuggccccgccg

SEQ ID NO: 1535265 - RNA, 19 nt, Pseudomonas aeruginosa PA01
cgcagguuggccccgccga

SEQ ID NO: 1535266 - RNA, 22 nt, Pseudomonas aeruginosa PA01
cgcaggucggccucggcgagga

SEQ ID NO: 1535267 - RNA, 14 nt, Pseudomonas aeruginosa PA01
cgcaggugaagcuu

SEQ ID NO: 1535268 - RNA, 21 nt, Pseudomonas aeruginosa PA01
cgcaggucgcuggcgucgacc

SEQ ID NO: 1535269 - RNA, 19 nt, Pseudomonas aeruginosa PA01
cgcaggucgcgacagguuc

SEQ ID NO: 1535270 - RNA, 14 nt, Pseudomonas aeruginosa PA01
cgcagguagucgcu

SEQ ID NO: 1535271 - RNA, 19 nt, Pseudomonas aeruginosa PA01
cgcagguagcugagcaggc

SEQ ID NO: 1535272 - RNA, 15 nt, Pseudomonas aeruginosa PA01
cgcagggucaggccc

SEQ ID NO: 1535273 - RNA, 20 nt, Pseudomonas aeruginosa PA01
cgcagguagaaggugcccag

SEQ ID NO: 1535274 - RNA, 13 nt, Pseudomonas aeruginosa PA01
cgcagggcggcgc

SEQ ID NO: 1535275 - RNA, 22 nt, Pseudomonas aeruginosa PA01
cgcagggcgucgaaggcggcgc

SEQ ID NO: 1535276 - RNA, 16 nt, Pseudomonas aeruginosa PA01
cgcaggggcaccggcg

SEQ ID NO: 1535277 - RNA, 18 nt, Pseudomonas aeruginosa PA01
cgcaggggcaccggcgga

SEQ ID NO: 1535278 - RNA, 16 nt, Pseudomonas aeruginosa PA01
cgcagcuugccuucca

SEQ ID NO: 1535279 - RNA, 22 nt, Pseudomonas aeruginosa PA01
cgcagcuugccuuccaggcugu

SEQ ID NO: 1535280 - RNA, 18 nt, Pseudomonas aeruginosa PA01
cgcagcuucugcagggcg

SEQ ID NO: 1535281 - RNA, 17 nt, Pseudomonas aeruginosa PA01
cgcagcuucuccaccgg

SEQ ID NO: 1535282 - RNA, 15 nt, Pseudomonas aeruginosa PA01
cgauaggccuugccu

SEQ ID NO: 1535283 - RNA, 16 nt, Pseudomonas aeruginosa PA01
cgaucaccaccuggau

SEQ ID NO: 1535284 - RNA, 18 nt, Pseudomonas aeruginosa PA01
cgaucaccaccuggaugg

SEQ ID NO: 1535285 - RNA, 12 nt, Pseudomonas aeruginosa PA01
cgaucaccagca

SEQ ID NO: 1535286 - RNA, 14 nt, Pseudomonas aeruginosa PA01
cgaucaccccgccc

SEQ ID NO: 1535287 - RNA, 14 nt, Pseudomonas aeruginosa PA01
cgaucaccaccacg

SEQ ID NO: 1535288 - RNA, 16 nt, Pseudomonas aeruginosa PA01
cgaucaccaccagcau

SEQ ID NO: 1535289 - RNA, 15 nt, Pseudomonas aeruginosa PA01
cgaucaccaccagcg

SEQ ID NO: 1535290 - RNA, 16 nt, Pseudomonas aeruginosa PA01
cgauaucgcaggccag

SEQ ID NO: 1535291 - RNA, 14 nt, Pseudomonas aeruginosa PA01
cgaucaccuugccc

SEQ ID NO: 1535292 - RNA, 19 nt, Pseudomonas aeruginosa PA01
cgaucacgccgcgcaccag

SEQ ID NO: 1535293 - RNA, 11 nt, Pseudomonas aeruginosa PA01
cgaucagaacg

SEQ ID NO: 1535294 - RNA, 18 nt, Pseudomonas aeruginosa PA01
cgauacccugggagccgc

SEQ ID NO: 1535295 - RNA, 14 nt, Pseudomonas aeruginosa PA01
cgauacggaacaca

SEQ ID NO: 1535296 - RNA, 18 nt, Pseudomonas aeruginosa PA01
cgacguccuccaggacca

SEQ ID NO: 1535297 - RNA, 21 nt, Pseudomonas aeruginosa PA01
cgaucgaagaaggcucaccgg

SEQ ID NO: 1535298 - RNA, 17 nt, Pseudomonas aeruginosa PA01
cgauccuccgccagccc

SEQ ID NO: 1535299 - RNA, 16 nt, Pseudomonas aeruginosa PA01
cgaucgagcggcccgc

SEQ ID NO: 1535300 - RNA, 22 nt, Pseudomonas aeruginosa PA01
cgaucgccucgucgagcgcagc

SEQ ID NO: 1535301 - RNA, 19 nt, Pseudomonas aeruginosa PA01
cgaucgcguuccagcaacg

SEQ ID NO: 1535302 - RNA, 21 nt, Pseudomonas aeruginosa PA01
cgauccgcgcauaggaggcgc

SEQ ID NO: 1535303 - RNA, 23 nt, Pseudomonas aeruginosa PA01
cgaucccggcggcgacccagacc

SEQ ID NO: 1535304 - RNA, 15 nt, Pseudomonas aeruginosa PA01
cgauccagccggcau

SEQ ID NO: 1535305 - RNA, 20 nt, Pseudomonas aeruginosa PA01
cgaucccccgccccucacuc

SEQ ID NO: 1535306 - RNA, 15 nt, Pseudomonas aeruginosa PA01
cgaucagcgcggcca

SEQ ID NO: 1535307 - RNA, 15 nt, Pseudomonas aeruginosa PA01
cgaucagccagggca

SEQ ID NO: 1535308 - RNA, 12 nt, Pseudomonas aeruginosa PA01
cgaucagcgccg

SEQ ID NO: 1535309 - RNA, 13 nt, Pseudomonas aeruginosa PA01
cgaucagcccgcc

SEQ ID NO: 1535310 - RNA, 12 nt, Pseudomonas aeruginosa PA01
cgaucaggcuga

SEQ ID NO: 1535311 - RNA, 13 nt, Pseudomonas aeruginosa PA01
cgaucaggcugaa

SEQ ID NO: 1535312 - RNA, 18 nt, Pseudomonas aeruginosa PA01
cgaucaggucgcgcgccu

SEQ ID NO: 1535313 - RNA, 16 nt, Pseudomonas aeruginosa PA01
cgaucaucggcugguc

SEQ ID NO: 1535314 - RNA, 15 nt, Pseudomonas aeruginosa PA01
cgaucaucgccaccg

SEQ ID NO: 1535315 - RNA, 13 nt, Pseudomonas aeruginosa PA01
cgaucaucgccag

SEQ ID NO: 1535316 - RNA, 19 nt, Pseudomonas aeruginosa PA01
cgaucaucgccagcggcgu

SEQ ID NO: 1535317 - RNA, 20 nt, Pseudomonas aeruginosa PA01
cgauccagcagucgcggccc

SEQ ID NO: 1535318 - RNA, 16 nt, Pseudomonas aeruginosa PA01
cgauccaggcgugggg

SEQ ID NO: 1535319 - RNA, 15 nt, Pseudomonas aeruginosa PA01
cgauccaccgccagg

SEQ ID NO: 1535320 - RNA, 12 nt, Pseudomonas aeruginosa PA01
cgaugaggcugu

SEQ ID NO: 1535321 - RNA, 19 nt, Pseudomonas aeruginosa PA01
cgaugaggcuguccagcag

SEQ ID NO: 1535322 - RNA, 19 nt, Pseudomonas aeruginosa PA01
cgaugacguugcugcccug

SEQ ID NO: 1535323 - RNA, 22 nt, Pseudomonas aeruginosa PA01
cgaugacggugauucguccgga

SEQ ID NO: 1535324 - RNA, 23 nt, Pseudomonas aeruginosa PA01
cgaugaccgccccggcagccacc

SEQ ID NO: 1535325 - RNA, 16 nt, Pseudomonas aeruginosa PA01
cgaugaagcugaugcc

SEQ ID NO: 1535326 - RNA, 19 nt, Pseudomonas aeruginosa PA01
cgaugaacagugcgcccgu

SEQ ID NO: 1535327 - RNA, 15 nt, Pseudomonas aeruginosa PA01
cgaucuucugcaccc

SEQ ID NO: 1535328 - RNA, 15 nt, Pseudomonas aeruginosa PA01
cgaucggcccgggcg

SEQ ID NO: 1535329 - RNA, 14 nt, Pseudomonas aeruginosa PA01
cgaucggcagggcg

SEQ ID NO: 1535330 - RNA, 12 nt, Pseudomonas aeruginosa PA01
cgaucucaucgc

SEQ ID NO: 1535331 - RNA, 22 nt, Pseudomonas aeruginosa PA01
cgaucugucgauaccagcgccg

SEQ ID NO: 1535332 - RNA, 14 nt, Pseudomonas aeruginosa PA01
cgaucugcgccgca

SEQ ID NO: 1535333 - RNA, 13 nt, Pseudomonas aeruginosa PA01
cgaucuggcugcc

SEQ ID NO: 1535334 - RNA, 17 nt, Pseudomonas aeruginosa PA01
cgaucuggcugcccagg

SEQ ID NO: 1535335 - RNA, 18 nt, Pseudomonas aeruginosa PA01
cgaucuggcugcccaggc

SEQ ID NO: 1535336 - RNA, 15 nt, Pseudomonas aeruginosa PA01
cgaucucucagucca

SEQ ID NO: 1535337 - RNA, 18 nt, Pseudomonas aeruginosa PA01
cgaucucgugggccagca

SEQ ID NO: 1535338 - RNA, 20 nt, Pseudomonas aeruginosa PA01
cgaucucgugggccagcagg

SEQ ID NO: 1535339 - RNA, 22 nt, Pseudomonas aeruginosa PA01
cgaucucgcccaguaccgccac

SEQ ID NO: 1535340 - RNA, 18 nt, Pseudomonas aeruginosa PA01
cgaucucgugcuuggugu

SEQ ID NO: 1535341 - RNA, 15 nt, Pseudomonas aeruginosa PA01
cgaucucuucccggc

SEQ ID NO: 1535342 - RNA, 19 nt, Pseudomonas aeruginosa PA01
cgaucuccuccgccccggc

SEQ ID NO: 1535343 - RNA, 13 nt, Pseudomonas aeruginosa PA01
cgaucuccuccuc

SEQ ID NO: 1535344 - RNA, 20 nt, Pseudomonas aeruginosa PA01
cgaucucgaagaccagcgga

SEQ ID NO: 1535345 - RNA, 14 nt, Pseudomonas aeruginosa PA01
cgaucucggugggc

SEQ ID NO: 1535346 - RNA, 18 nt, Pseudomonas aeruginosa PA01
cgaucucgguuuccagga

SEQ ID NO: 1535347 - RNA, 20 nt, Pseudomonas aeruginosa PA01
cgauguuggcgucgaacagc

SEQ ID NO: 1535348 - RNA, 21 nt, Pseudomonas aeruginosa PA01
cgauguuguugcccaccagcg

SEQ ID NO: 1535349 - RNA, 19 nt, Pseudomonas aeruginosa PA01
cgauucuccugggcggucu

SEQ ID NO: 1535350 - RNA, 18 nt, Pseudomonas aeruginosa PA01
cgauucccagugcucccg

SEQ ID NO: 1535351 - RNA, 17 nt, Pseudomonas aeruginosa PA01
cgauucgacgcagcgcg

SEQ ID NO: 1535352 - RNA, 11 nt, Pseudomonas aeruginosa PA01
cgauuccucua

SEQ ID NO: 1535353 - RNA, 12 nt, Pseudomonas aeruginosa PA01
cgauuccucuau

SEQ ID NO: 1535354 - RNA, 17 nt, Pseudomonas aeruginosa PA01
cgauguccccggccagc

SEQ ID NO: 1535355 - RNA, 13 nt, Pseudomonas aeruginosa PA01
cgauggcggccgc

SEQ ID NO: 1535356 - RNA, 13 nt, Pseudomonas aeruginosa PA01
cgauggcgccgcc

SEQ ID NO: 1535357 - RNA, 15 nt, Pseudomonas aeruginosa PA01
cgauggcgaagcgcu

SEQ ID NO: 1535358 - RNA, 16 nt, Pseudomonas aeruginosa PA01
cgauggccgccagcag

SEQ ID NO: 1535359 - RNA, 15 nt, Pseudomonas aeruginosa PA01
cgauggccggcacca

SEQ ID NO: 1535360 - RNA, 17 nt, Pseudomonas aeruginosa PA01
cgauggccggcagcagc

SEQ ID NO: 1535361 - RNA, 20 nt, Pseudomonas aeruginosa PA01
cgauggccggcagcagcgcc

SEQ ID NO: 1535362 - RNA, 15 nt, Pseudomonas aeruginosa PA01
cgauggaugacccgc

SEQ ID NO: 1535363 - RNA, 20 nt, Pseudomonas aeruginosa PA01
cgauggaugacccgcucgcc

SEQ ID NO: 1535364 - RNA, 12 nt, Pseudomonas aeruginosa PA01
cgauggcccaga

SEQ ID NO: 1535365 - RNA, 20 nt, Pseudomonas aeruginosa PA01
cgauggccagggggccuggc

SEQ ID NO: 1535366 - RNA, 17 nt, Pseudomonas aeruginosa PA01
cgauggccaucaggguc

SEQ ID NO: 1535367 - RNA, 23 nt, Pseudomonas aeruginosa PA01
cgaugcccggcugguugccagca

SEQ ID NO: 1535368 - RNA, 20 nt, Pseudomonas aeruginosa PA01
cgaugcccaccugaacgcgc

SEQ ID NO: 1535369 - RNA, 17 nt, Pseudomonas aeruginosa PA01
cgaugcccgccagcagg

SEQ ID NO: 1535370 - RNA, 14 nt, Pseudomonas aeruginosa PA01
cgaugcccgccucg

SEQ ID NO: 1535371 - RNA, 14 nt, Pseudomonas aeruginosa PA01
cgaugccgcccagc

SEQ ID NO: 1535372 - RNA, 15 nt, Pseudomonas aeruginosa PA01
cgaugccgcccagca

SEQ ID NO: 1535373 - RNA, 17 nt, Pseudomonas aeruginosa PA01
cgaugccgcccagcacc

SEQ ID NO: 1535374 - RNA, 21 nt, Pseudomonas aeruginosa PA01
cgaugccgccgccgccccagc

SEQ ID NO: 1535375 - RNA, 23 nt, Pseudomonas aeruginosa PA01
cgaugccgcgccaggcgcaguag

SEQ ID NO: 1535376 - RNA, 22 nt, Pseudomonas aeruginosa PA01
cgaugccgcgcgccuggcuggc

SEQ ID NO: 1535377 - RNA, 20 nt, Pseudomonas aeruginosa PA01
cgcucgcgguuauccgccgc

SEQ ID NO: 1535378 - RNA, 18 nt, Pseudomonas aeruginosa PA01
cgcucgcgggccgccugg

SEQ ID NO: 1535379 - RNA, 19 nt, Pseudomonas aeruginosa PA01
cgcucggaucaggcgggcu

SEQ ID NO: 1535380 - RNA, 15 nt, Pseudomonas aeruginosa PA01
cgcucggccaaugcc

SEQ ID NO: 1535381 - RNA, 16 nt, Pseudomonas aeruginosa PA01
cgcucgcggaccucug

SEQ ID NO: 1535382 - RNA, 21 nt, Pseudomonas aeruginosa PA01
cgcucgcggaccucugcguuc

SEQ ID NO: 1535383 - RNA, 19 nt, Pseudomonas aeruginosa PA01
cgcucgcccuugcgccgcg

SEQ ID NO: 1535384 - RNA, 23 nt, Pseudomonas aeruginosa PA01
cgcucgccuaccggcgccgcccc

SEQ ID NO: 1535385 - RNA, 21 nt, Pseudomonas aeruginosa PA01
cgcucgccgggaaucgccagc

SEQ ID NO: 1535386 - RNA, 21 nt, Pseudomonas aeruginosa PA01
cgcucgccgggucgccgcagc

SEQ ID NO: 1535387 - RNA, 20 nt, Pseudomonas aeruginosa PA01
cgcucggccgccuggcgugc

SEQ ID NO: 1535388 - RNA, 20 nt, Pseudomonas aeruginosa PA01
cgcucggcgaguucgcgcag

SEQ ID NO: 1535389 - RNA, 16 nt, Pseudomonas aeruginosa PA01
cgcucgggcccuccca

SEQ ID NO: 1535390 - RNA, 20 nt, Pseudomonas aeruginosa PA01
cgcucggcggguauccgccg

SEQ ID NO: 1535391 - RNA, 18 nt, Pseudomonas aeruginosa PA01
cgcucggcguagccggcg

SEQ ID NO: 1535392 - RNA, 21 nt, Pseudomonas aeruginosa PA01
cgcucggggauguccgccgcc

SEQ ID NO: 1535393 - RNA, 20 nt, Pseudomonas aeruginosa PA01
cgcucggcggccucgcgggu

SEQ ID NO: 1535394 - RNA, 15 nt, Pseudomonas aeruginosa PA01
cgcucguagccggcg

SEQ ID NO: 1535395 - RNA, 21 nt, Pseudomonas aeruginosa PA01
cgcucggugccuucccagccg

SEQ ID NO: 1535396 - RNA, 13 nt, Pseudomonas aeruginosa PA01
cgcucugcagugc

SEQ ID NO: 1535397 - RNA, 18 nt, Pseudomonas aeruginosa PA01
cgcucuggccgcgcucca

SEQ ID NO: 1535398 - RNA, 14 nt, Pseudomonas aeruginosa PA01
cgcucugcgccgcg

SEQ ID NO: 1535399 - RNA, 18 nt, Pseudomonas aeruginosa PA01
cgcucugcgccgcggcgu

SEQ ID NO: 1535400 - RNA, 20 nt, Pseudomonas aeruginosa PA01
cgcucugcugaauucccgcu

SEQ ID NO: 1535401 - RNA, 19 nt, Pseudomonas aeruginosa PA01
cgcucugcuggccacccuu

SEQ ID NO: 1535402 - RNA, 16 nt, Pseudomonas aeruginosa PA01
cgcucugcuggccgcc

SEQ ID NO: 1535403 - RNA, 14 nt, Pseudomonas aeruginosa PA01
cgcucuucagcacg

SEQ ID NO: 1535404 - RNA, 20 nt, Pseudomonas aeruginosa PA01
cgcucuguagggucgcagca

SEQ ID NO: 1535405 - RNA, 22 nt, Pseudomonas aeruginosa PA01
cgcucuaucgacgguuucaggc

SEQ ID NO: 1535406 - RNA, 18 nt, Pseudomonas aeruginosa PA01
cgcucucgaacagcagca

SEQ ID NO: 1535407 - RNA, 21 nt, Pseudomonas aeruginosa PA01
cgcucucgagcaugccugcuu

SEQ ID NO: 1535408 - RNA, 19 nt, Pseudomonas aeruginosa PA01
cgcugaaggucgccgcgcu

SEQ ID NO: 1535409 - RNA, 13 nt, Pseudomonas aeruginosa PA01
cgcugaccacccg

SEQ ID NO: 1535410 - RNA, 17 nt, Pseudomonas aeruginosa PA01
cgcugaaguccuggccg

SEQ ID NO: 1535411 - RNA, 18 nt, Pseudomonas aeruginosa PA01
cgcugacccagcgcacgc

SEQ ID NO: 1535412 - RNA, 22 nt, Pseudomonas aeruginosa PA01
cgcugaaccgcgucaugcucuc

SEQ ID NO: 1535413 - RNA, 15 nt, Pseudomonas aeruginosa PA01
cgcugaaacgcgcgu

SEQ ID NO: 1535414 - RNA, 17 nt, Pseudomonas aeruginosa PA01
cgcugaaacgcgcgucc

SEQ ID NO: 1535415 - RNA, 15 nt, Pseudomonas aeruginosa PA01
cgcuccggugccagg

SEQ ID NO: 1535416 - RNA, 19 nt, Pseudomonas aeruginosa PA01
cgcuccucagaggcgacca

SEQ ID NO: 1535417 - RNA, 19 nt, Pseudomonas aeruginosa PA01
cgcuccuccucgcucugcg

SEQ ID NO: 1535418 - RNA, 15 nt, Pseudomonas aeruginosa PA01
cgcuccucgcgcugc

SEQ ID NO: 1535419 - RNA, 13 nt, Pseudomonas aeruginosa PA01
cgcuccggcgcgc

SEQ ID NO: 1535420 - RNA, 17 nt, Pseudomonas aeruginosa PA01
cgcuccggaacgccugc

SEQ ID NO: 1535421 - RNA, 17 nt, Pseudomonas aeruginosa PA01
cgcuccggcucuccccg

SEQ ID NO: 1535422 - RNA, 16 nt, Pseudomonas aeruginosa PA01
cgcuccggcugcgcgg

SEQ ID NO: 1535423 - RNA, 14 nt, Pseudomonas aeruginosa PA01
cgcuccgcaucuuc

SEQ ID NO: 1535424 - RNA, 22 nt, Pseudomonas aeruginosa PA01
cgcuccccugccgaaccgccuc

SEQ ID NO: 1535425 - RNA, 15 nt, Pseudomonas aeruginosa PA01
cgcuccgcggccggc

SEQ ID NO: 1535426 - RNA, 23 nt, Pseudomonas aeruginosa PA01
cgcuccgccaggccgcgcagucc

SEQ ID NO: 1535427 - RNA, 16 nt, Pseudomonas aeruginosa PA01
cgcuccugcgccggcu

SEQ ID NO: 1535428 - RNA, 17 nt, Pseudomonas aeruginosa PA01
cgcuccugcgccggcuc

SEQ ID NO: 1535429 - RNA, 13 nt, Pseudomonas aeruginosa PA01
cgcuccuggaggu

SEQ ID NO: 1535430 - RNA, 18 nt, Pseudomonas aeruginosa PA01
cgcuccuguugcuggccg

SEQ ID NO: 1535431 - RNA, 22 nt, Pseudomonas aeruginosa PA01
cgcuccuucuccggggcccggc

SEQ ID NO: 1535432 - RNA, 16 nt, Pseudomonas aeruginosa PA01
cgcuccuugcgccagg

SEQ ID NO: 1535433 - RNA, 17 nt, Pseudomonas aeruginosa PA01
cgcuccuugcgccaggc

SEQ ID NO: 1535434 - RNA, 22 nt, Pseudomonas aeruginosa PA01
cgcuccuuggcuggccagcccu

SEQ ID NO: 1535435 - RNA, 13 nt, Pseudomonas aeruginosa PA01
cgcuccuuuccca

SEQ ID NO: 1535436 - RNA, 15 nt, Pseudomonas aeruginosa PA01
cgcuccuuucccagc

SEQ ID NO: 1535437 - RNA, 21 nt, Pseudomonas aeruginosa PA01
cgcuccuuuggcgucgaugcg

SEQ ID NO: 1535438 - RNA, 20 nt, Pseudomonas aeruginosa PA01
cgcucgacauacuccgccgc

SEQ ID NO: 1535439 - RNA, 14 nt, Pseudomonas aeruginosa PA01
cgcucgaucccggc

SEQ ID NO: 1535440 - RNA, 18 nt, Pseudomonas aeruginosa PA01
cgcucgaugcccgccagc

SEQ ID NO: 1535441 - RNA, 16 nt, Pseudomonas aeruginosa PA01
cgcucgagccggcuga

SEQ ID NO: 1535442 - RNA, 21 nt, Pseudomonas aeruginosa PA01
cgcucagucgagcaugucgcu

SEQ ID NO: 1535443 - RNA, 18 nt, Pseudomonas aeruginosa PA01
cgcucaugagauccgcca

SEQ ID NO: 1535444 - RNA, 20 nt, Pseudomonas aeruginosa PA01
cgcucaugagauccgccagc

SEQ ID NO: 1535445 - RNA, 16 nt, Pseudomonas aeruginosa PA01
cgcucauggcgccgcc

SEQ ID NO: 1535446 - RNA, 15 nt, Pseudomonas aeruginosa PA01
cgcucaugcgcgugu

SEQ ID NO: 1535447 - RNA, 15 nt, Pseudomonas aeruginosa PA01
cgcuccagcggcagc

SEQ ID NO: 1535448 - RNA, 16 nt, Pseudomonas aeruginosa PA01
cgcuccagaccuccag

SEQ ID NO: 1535449 - RNA, 19 nt, Pseudomonas aeruginosa PA01
cgcuccagggcauccucgc

SEQ ID NO: 1535450 - RNA, 19 nt, Pseudomonas aeruginosa PA01
cgcuccagucggggcaggc

SEQ ID NO: 1535451 - RNA, 22 nt, Pseudomonas aeruginosa PA01
cgcuccaggugcacggccaggc

SEQ ID NO: 1535452 - RNA, 20 nt, Pseudomonas aeruginosa PA01
cgcuccauccagucggcgcu

SEQ ID NO: 1535453 - RNA, 17 nt, Pseudomonas aeruginosa PA01
cgcuccagcuccuccag

SEQ ID NO: 1535454 - RNA, 18 nt, Pseudomonas aeruginosa PA01
cgcuccagcuccuccagc

SEQ ID NO: 1535455 - RNA, 18 nt, Pseudomonas aeruginosa PA01
cgcuccacagcugccagc

SEQ ID NO: 1535456 - RNA, 16 nt, Pseudomonas aeruginosa PA01
cgcuccacccaggcgc

SEQ ID NO: 1535457 - RNA, 17 nt, Pseudomonas aeruginosa PA01
cgcuccacccaggcgcc

SEQ ID NO: 1535458 - RNA, 20 nt, Pseudomonas aeruginosa PA01
cgcuccacccaggcgccgau

SEQ ID NO: 1535459 - RNA, 14 nt, Pseudomonas aeruginosa PA01
cgcuccaccgcccc

SEQ ID NO: 1535460 - RNA, 16 nt, Pseudomonas aeruginosa PA01
cgcuaugggcaccgcg

SEQ ID NO: 1535461 - RNA, 21 nt, Pseudomonas aeruginosa PA01
cgcucaccaccaccgcgccga

SEQ ID NO: 1535462 - RNA, 15 nt, Pseudomonas aeruginosa PA01
cgcucagggacaccc

SEQ ID NO: 1535463 - RNA, 19 nt, Pseudomonas aeruginosa PA01
cgcucaggcgucccgcucc

SEQ ID NO: 1535464 - RNA, 23 nt, Pseudomonas aeruginosa PA01
cgcucaggcgucccgcuccagcc

SEQ ID NO: 1535465 - RNA, 24 nt, Pseudomonas aeruginosa PA01
cgcucagcgcgagggggccucggc

SEQ ID NO: 1535466 - RNA, 16 nt, Pseudomonas aeruginosa PA01
cgcucagcgggccgau

SEQ ID NO: 1535467 - RNA, 21 nt, Pseudomonas aeruginosa PA01
cgcucaggcgcagcguccugc

SEQ ID NO: 1535468 - RNA, 15 nt, Pseudomonas aeruginosa PA01
cgcucagcacccugg

SEQ ID NO: 1535469 - RNA, 23 nt, Pseudomonas aeruginosa PA01
cgcucagccgaggucgccgccag

SEQ ID NO: 1535470 - RNA, 14 nt, Pseudomonas aeruginosa PA01
cgcucagcgcuucu

SEQ ID NO: 1535471 - RNA, 21 nt, Pseudomonas aeruginosa PA01
cgcucagcgcuucucggcagc

SEQ ID NO: 1535472 - RNA, 19 nt, Pseudomonas aeruginosa PA01
cgcuaucgccgccgcagcc

SEQ ID NO: 1535473 - RNA, 17 nt, Pseudomonas aeruginosa PA01
cgcuagcccugcugcuc

SEQ ID NO: 1535474 - RNA, 21 nt, Pseudomonas aeruginosa PA01
cgcuagcgcauggcgaccugg

SEQ ID NO: 1535475 - RNA, 20 nt, Pseudomonas aeruginosa PA01
cgcuacgaaggcgugccgcu

SEQ ID NO: 1535476 - RNA, 14 nt, Pseudomonas aeruginosa PA01
cgcuacgcggcggg

SEQ ID NO: 1535477 - RNA, 18 nt, Pseudomonas aeruginosa PA01
cgcuacgcggcgggaggu

SEQ ID NO: 1535478 - RNA, 22 nt, Pseudomonas aeruginosa PA01
cgcgucaugccgccgucgcggc

SEQ ID NO: 1535479 - RNA, 19 nt, Pseudomonas aeruginosa PA01
cgcgucaucaggcucaggc

SEQ ID NO: 1535480 - RNA, 21 nt, Pseudomonas aeruginosa PA01
cgcgucaucaggcucaggccg

SEQ ID NO: 1535481 - RNA, 18 nt, Pseudomonas aeruginosa PA01
cgcgggcgcgcagcaggu

SEQ ID NO: 1535482 - RNA, 14 nt, Pseudomonas aeruginosa PA01
cgcggcucggcggg

SEQ ID NO: 1535483 - RNA, 12 nt, Pseudomonas aeruginosa PA01
cgcgggccaggc

SEQ ID NO: 1535484 - RNA, 14 nt, Pseudomonas aeruginosa PA01
cgcgggccaggccg

SEQ ID NO: 1535485 - RNA, 15 nt, Pseudomonas aeruginosa PA01
cgcgggccaggccga

SEQ ID NO: 1535486 - RNA, 21 nt, Pseudomonas aeruginosa PA01
cgcgggcgacgugggccugcu

SEQ ID NO: 1535487 - RNA, 21 nt, Pseudomonas aeruginosa PA01
cgcgggcgaacggcagcgucu

SEQ ID NO: 1535488 - RNA, 21 nt, Pseudomonas aeruginosa PA01
cgcgggcgaaggccucgucga

SEQ ID NO: 1535489 - RNA, 22 nt, Pseudomonas aeruginosa PA01
cgcgggccgacggcccuccggc

SEQ ID NO: 1535490 - RNA, 18 nt, Pseudomonas aeruginosa PA01
cgcguccauccccgccuc

SEQ ID NO: 1535491 - RNA, 19 nt, Pseudomonas aeruginosa PA01
cgcguccauccccgccucg

SEQ ID NO: 1535492 - RNA, 14 nt, Pseudomonas aeruginosa PA01
cgcguccagcucca

SEQ ID NO: 1535493 - RNA, 15 nt, Pseudomonas aeruginosa PA01
cgcguccagcuccac

SEQ ID NO: 1535494 - RNA, 22 nt, Pseudomonas aeruginosa PA01
cgcgucgcacccggcccauggc

SEQ ID NO: 1535495 - RNA, 15 nt, Pseudomonas aeruginosa PA01
cgcgucgccgccagc

SEQ ID NO: 1535496 - RNA, 15 nt, Pseudomonas aeruginosa PA01
cgcgucgcgcgcggc

SEQ ID NO: 1535497 - RNA, 17 nt, Pseudomonas aeruginosa PA01
cgcgucgcugccgccgc

SEQ ID NO: 1535498 - RNA, 14 nt, Pseudomonas aeruginosa PA01
cgcguugcagcgcc

SEQ ID NO: 1535499 - RNA, 21 nt, Pseudomonas aeruginosa PA01
cgcguugcagcgccuguucca

SEQ ID NO: 1535500 - RNA, 23 nt, Pseudomonas aeruginosa PA01
cgcguugaccgugaugcccagcg

SEQ ID NO: 1535501 - RNA, 20 nt, Pseudomonas aeruginosa PA01
cgcguucggcgaugccgcgc

SEQ ID NO: 1535502 - RNA, 16 nt, Pseudomonas aeruginosa PA01
cgcgugcaggcgcccu

SEQ ID NO: 1535503 - RNA, 21 nt, Pseudomonas aeruginosa PA01
cgcgugccccguggcgggcca

SEQ ID NO: 1535504 - RNA, 22 nt, Pseudomonas aeruginosa PA01
cgcgugcuccgugucggcggcg

SEQ ID NO: 1535505 - RNA, 17 nt, Pseudomonas aeruginosa PA01
cgcugccgccgcgcagg

SEQ ID NO: 1535506 - RNA, 16 nt, Pseudomonas aeruginosa PA01
cgcugccgccgcgccc

SEQ ID NO: 1535507 - RNA, 21 nt, Pseudomonas aeruginosa PA01
cgcugccgccgcgcugcaggc

SEQ ID NO: 1535508 - RNA, 21 nt, Pseudomonas aeruginosa PA01
cgcugccgaacagcagggagg

SEQ ID NO: 1535509 - RNA, 21 nt, Pseudomonas aeruginosa PA01
cgcugccggucaggcuggugc

SEQ ID NO: 1535510 - RNA, 22 nt, Pseudomonas aeruginosa PA01
cgcugccguacagcccccgccg

SEQ ID NO: 1535511 - RNA, 16 nt, Pseudomonas aeruginosa PA01
cgcugccgcucuggcu

SEQ ID NO: 1535512 - RNA, 23 nt, Pseudomonas aeruginosa PA01
cgcugccggccagggucgccagc

SEQ ID NO: 1535513 - RNA, 15 nt, Pseudomonas aeruginosa PA01
cgcugcgccaggccg

SEQ ID NO: 1535514 - RNA, 19 nt, Pseudomonas aeruginosa PA01
cgcugccguucgcccgcgg

SEQ ID NO: 1535515 - RNA, 15 nt, Pseudomonas aeruginosa PA01
cgcugccuuccuuuu

SEQ ID NO: 1535516 - RNA, 19 nt, Pseudomonas aeruginosa PA01
cgcugcgaaucgucgccgg

SEQ ID NO: 1535517 - RNA, 14 nt, Pseudomonas aeruginosa PA01
cgcugcgaccuggc

SEQ ID NO: 1535518 - RNA, 21 nt, Pseudomonas aeruginosa PA01
cgcugcggaucaacuccgcca

SEQ ID NO: 1535519 - RNA, 22 nt, Pseudomonas aeruginosa PA01
cgcugcggaucaacuccgccag

SEQ ID NO: 1535520 - RNA, 21 nt, Pseudomonas aeruginosa PA01
cgcugcgcgccaucuccucgc

SEQ ID NO: 1535521 - RNA, 14 nt, Pseudomonas aeruginosa PA01
cgcuggacccgcac

SEQ ID NO: 1535522 - RNA, 21 nt, Pseudomonas aeruginosa PA01
cgcuggacccgcaccuggacc

SEQ ID NO: 1535523 - RNA, 23 nt, Pseudomonas aeruginosa PA01
cgcuggcagguugcacggccggu

SEQ ID NO: 1535524 - RNA, 18 nt, Pseudomonas aeruginosa PA01
cgcugcuugcgcaccucc

SEQ ID NO: 1535525 - RNA, 16 nt, Pseudomonas aeruginosa PA01
cgcugcuggcgccgcu

SEQ ID NO: 1535526 - RNA, 21 nt, Pseudomonas aeruginosa PA01
cgcugcucgacggcaccagcg

SEQ ID NO: 1535527 - RNA, 15 nt, Pseudomonas aeruginosa PA01
cgcugcucgcagccg

SEQ ID NO: 1535528 - RNA, 21 nt, Pseudomonas aeruginosa PA01
cgcugcugccauccgcgccga

SEQ ID NO: 1535529 - RNA, 13 nt, Pseudomonas aeruginosa PA01
cgcugcggccggc

SEQ ID NO: 1535530 - RNA, 15 nt, Pseudomonas aeruginosa PA01
cgcugcggccggcgc

SEQ ID NO: 1535531 - RNA, 13 nt, Pseudomonas aeruginosa PA01
cgcugcgugcgcc

SEQ ID NO: 1535532 - RNA, 15 nt, Pseudomonas aeruginosa PA01
cgcugcguuccuguu

SEQ ID NO: 1535533 - RNA, 23 nt, Pseudomonas aeruginosa PA01
cgcugcguaguugagccccaggu

SEQ ID NO: 1535534 - RNA, 14 nt, Pseudomonas aeruginosa PA01
cgcugcucaccagg

SEQ ID NO: 1535535 - RNA, 14 nt, Pseudomonas aeruginosa PA01
cgcugaccgggcgg

SEQ ID NO: 1535536 - RNA, 19 nt, Pseudomonas aeruginosa PA01
cgcugaccgcucccaggca

SEQ ID NO: 1535537 - RNA, 14 nt, Pseudomonas aeruginosa PA01
cgcugaccggccgc

SEQ ID NO: 1535538 - RNA, 15 nt, Pseudomonas aeruginosa PA01
cgcugaccggccgca

SEQ ID NO: 1535539 - RNA, 15 nt, Pseudomonas aeruginosa PA01
cgcugaccucgagcu

SEQ ID NO: 1535540 - RNA, 16 nt, Pseudomonas aeruginosa PA01
cgcugacgaaacggug

SEQ ID NO: 1535541 - RNA, 22 nt, Pseudomonas aeruginosa PA01
cgcugacgaaacggugacgggc

SEQ ID NO: 1535542 - RNA, 18 nt, Pseudomonas aeruginosa PA01
cgcugacgaggacgccgc

SEQ ID NO: 1535543 - RNA, 21 nt, Pseudomonas aeruginosa PA01
cgcugagcaguugcgggcgca

SEQ ID NO: 1535544 - RNA, 14 nt, Pseudomonas aeruginosa PA01
cgcugagcaucugg

SEQ ID NO: 1535545 - RNA, 18 nt, Pseudomonas aeruginosa PA01
cgcugagcaucugggucu

SEQ ID NO: 1535546 - RNA, 17 nt, Pseudomonas aeruginosa PA01
cgcugacuuccaucagc

SEQ ID NO: 1535547 - RNA, 21 nt, Pseudomonas aeruginosa PA01
cgcugacuuccaucagcucca

SEQ ID NO: 1535548 - RNA, 18 nt, Pseudomonas aeruginosa PA01
cgcugaggccgcccuggc

SEQ ID NO: 1535549 - RNA, 15 nt, Pseudomonas aeruginosa PA01
cgcugagcgccucga

SEQ ID NO: 1535550 - RNA, 20 nt, Pseudomonas aeruginosa PA01
cgcugagcggaaacaagcuc

SEQ ID NO: 1535551 - RNA, 14 nt, Pseudomonas aeruginosa PA01
cgcugaggaagagc

SEQ ID NO: 1535552 - RNA, 19 nt, Pseudomonas aeruginosa PA01
cgcugaggaagagcagcgc

SEQ ID NO: 1535553 - RNA, 18 nt, Pseudomonas aeruginosa PA01
cgcugaugaucgcgucgu

SEQ ID NO: 1535554 - RNA, 20 nt, Pseudomonas aeruginosa PA01
cgcugaugaugccgcggcga

SEQ ID NO: 1535555 - RNA, 23 nt, Pseudomonas aeruginosa PA01
cgcugaucaguaccggcagcgcc

SEQ ID NO: 1535556 - RNA, 23 nt, Pseudomonas aeruginosa PA01
cgcugaguuugcccagcgccgcc

SEQ ID NO: 1535557 - RNA, 19 nt, Pseudomonas aeruginosa PA01
cgcugcaggcgguagcgcc

SEQ ID NO: 1535558 - RNA, 17 nt, Pseudomonas aeruginosa PA01
cgcugcagggcggcgcu

SEQ ID NO: 1535559 - RNA, 15 nt, Pseudomonas aeruginosa PA01
cgcugcagccacugu

SEQ ID NO: 1535560 - RNA, 16 nt, Pseudomonas aeruginosa PA01
cgcugcaccgcggcgc

SEQ ID NO: 1535561 - RNA, 18 nt, Pseudomonas aeruginosa PA01
cgcugcacgcacgcgccu

SEQ ID NO: 1535562 - RNA, 21 nt, Pseudomonas aeruginosa PA01
cgcugcaauucgucggccugc

SEQ ID NO: 1535563 - RNA, 17 nt, Pseudomonas aeruginosa PA01
cgcugccagcaggccga

SEQ ID NO: 1535564 - RNA, 16 nt, Pseudomonas aeruginosa PA01
cgcugccagcgccgcc

SEQ ID NO: 1535565 - RNA, 22 nt, Pseudomonas aeruginosa PA01
cgcugccagguuggcaacugcg

SEQ ID NO: 1535566 - RNA, 16 nt, Pseudomonas aeruginosa PA01
cgcugccaguggcggc

SEQ ID NO: 1535567 - RNA, 16 nt, Pseudomonas aeruginosa PA01
cgcugcccagcccgcc

SEQ ID NO: 1535568 - RNA, 15 nt, Pseudomonas aeruginosa PA01
cgcuguaggcgagca

SEQ ID NO: 1535569 - RNA, 18 nt, Pseudomonas aeruginosa PA01
cgcuguagaccagauaga

SEQ ID NO: 1535570 - RNA, 13 nt, Pseudomonas aeruginosa PA01
cgcuguccgccgc

SEQ ID NO: 1535571 - RNA, 15 nt, Pseudomonas aeruginosa PA01
cgcuguccgccgccg

SEQ ID NO: 1535572 - RNA, 13 nt, Pseudomonas aeruginosa PA01
cgcugucccggcc

SEQ ID NO: 1535573 - RNA, 20 nt, Pseudomonas aeruginosa PA01
cgcuguccgccaucccucua

SEQ ID NO: 1535574 - RNA, 17 nt, Pseudomonas aeruginosa PA01
cgcugucaaucgcgcaa

SEQ ID NO: 1535575 - RNA, 23 nt, Pseudomonas aeruginosa PA01
cgcugugaggugggcgcgccgca

SEQ ID NO: 1535576 - RNA, 23 nt, Pseudomonas aeruginosa PA01
cgcugucgagcagggagaaccag

SEQ ID NO: 1535577 - RNA, 23 nt, Pseudomonas aeruginosa PA01
cgcugucgcccgggcgccaccga

SEQ ID NO: 1535578 - RNA, 15 nt, Pseudomonas aeruginosa PA01
cgcugucgucggcgc

SEQ ID NO: 1535579 - RNA, 20 nt, Pseudomonas aeruginosa PA01
cgcugucgucggcgcggccg

SEQ ID NO: 1535580 - RNA, 18 nt, Pseudomonas aeruginosa PA01
cgcuggucguaggcgcgg

SEQ ID NO: 1535581 - RNA, 19 nt, Pseudomonas aeruginosa PA01
cgcugguaccugccggcac

SEQ ID NO: 1535582 - RNA, 23 nt, Pseudomonas aeruginosa PA01
cgcugguccagcuggcgcagccg

SEQ ID NO: 1535583 - RNA, 22 nt, Pseudomonas aeruginosa PA01
cgcuggugccgacgcugaucau

SEQ ID NO: 1535584 - RNA, 16 nt, Pseudomonas aeruginosa PA01
cgcugguugcccaggg

SEQ ID NO: 1535585 - RNA, 13 nt, Pseudomonas aeruginosa PA01
cgcuggcgccgau

SEQ ID NO: 1535586 - RNA, 13 nt, Pseudomonas aeruginosa PA01
cgcuggcgacgcu

SEQ ID NO: 1535587 - RNA, 16 nt, Pseudomonas aeruginosa PA01
cgcuggcgaucaccag

SEQ ID NO: 1535588 - RNA, 15 nt, Pseudomonas aeruginosa PA01
cgcuggcgaucucgg

SEQ ID NO: 1535589 - RNA, 20 nt, Pseudomonas aeruginosa PA01
cgcuggcgaauauccucguc

SEQ ID NO: 1535590 - RNA, 17 nt, Pseudomonas aeruginosa PA01
cgcuggcgccaguaaug

SEQ ID NO: 1535591 - RNA, 18 nt, Pseudomonas aeruginosa PA01
cgcuggcgcccaacgucu

SEQ ID NO: 1535592 - RNA, 23 nt, Pseudomonas aeruginosa PA01
cgcuggcgcccaacgucuucagg

SEQ ID NO: 1535593 - RNA, 16 nt, Pseudomonas aeruginosa PA01
cgcuggcgcagcagca

SEQ ID NO: 1535594 - RNA, 14 nt, Pseudomonas aeruginosa PA01
cgcuggcgcagccg

SEQ ID NO: 1535595 - RNA, 12 nt, Pseudomonas aeruginosa PA01
cgcuggccagcu

SEQ ID NO: 1535596 - RNA, 23 nt, Pseudomonas aeruginosa PA01
cgcuggcccaacagcggugugcu

SEQ ID NO: 1535597 - RNA, 16 nt, Pseudomonas aeruginosa PA01
cgcuggcggcaugccg

SEQ ID NO: 1535598 - RNA, 13 nt, Pseudomonas aeruginosa PA01
cgcuggcggcgcu

SEQ ID NO: 1535599 - RNA, 23 nt, Pseudomonas aeruginosa PA01
cgcuggcggccgaguucgcgcag

SEQ ID NO: 1535600 - RNA, 14 nt, Pseudomonas aeruginosa PA01
cgcuggcggccuuc

SEQ ID NO: 1535601 - RNA, 17 nt, Pseudomonas aeruginosa PA01
cgcugggcgccggcagg

SEQ ID NO: 1535602 - RNA, 24 nt, Pseudomonas aeruginosa PA01
cgcugggccuugagcaggcguucc

SEQ ID NO: 1535603 - RNA, 15 nt, Pseudomonas aeruginosa PA01
cgcugggcgcagccc

SEQ ID NO: 1535604 - RNA, 14 nt, Pseudomonas aeruginosa PA01
cgcuucaagcggcc

SEQ ID NO: 1535605 - RNA, 14 nt, Pseudomonas aeruginosa PA01
cgcuguucuucagu

SEQ ID NO: 1535606 - RNA, 12 nt, Pseudomonas aeruginosa PA01
cgcuucagcucg

SEQ ID NO: 1535607 - RNA, 16 nt, Pseudomonas aeruginosa PA01
cgcuuccaccgccugc

SEQ ID NO: 1535608 - RNA, 23 nt, Pseudomonas aeruginosa PA01
cgcuuccucggcacucagccagc

SEQ ID NO: 1535609 - RNA, 14 nt, Pseudomonas aeruginosa PA01
cgcuuccgccaggc

SEQ ID NO: 1535610 - RNA, 15 nt, Pseudomonas aeruginosa PA01
cgcuuccgccaggcg

SEQ ID NO: 1535611 - RNA, 20 nt, Pseudomonas aeruginosa PA01
cgcuuccgccggcgccgccu

SEQ ID NO: 1535612 - RNA, 21 nt, Pseudomonas aeruginosa PA01
cgcuuccgccggcgccgccuc

SEQ ID NO: 1535613 - RNA, 22 nt, Pseudomonas aeruginosa PA01
cgcuuccggcagccagccgccg

SEQ ID NO: 1535614 - RNA, 13 nt, Pseudomonas aeruginosa PA01
cgcuuccggcccg

SEQ ID NO: 1535615 - RNA, 15 nt, Pseudomonas aeruginosa PA01
cgcuuccggcccggc

SEQ ID NO: 1535616 - RNA, 14 nt, Pseudomonas aeruginosa PA01
cgcuuccggcgcca

SEQ ID NO: 1535617 - RNA, 14 nt, Pseudomonas aeruginosa PA01
cgcuuccugggcuu

SEQ ID NO: 1535618 - RNA, 14 nt, Pseudomonas aeruginosa PA01
cgcuuccuugcccu

SEQ ID NO: 1535619 - RNA, 14 nt, Pseudomonas aeruginosa PA01
cgcuucgagcaccc

SEQ ID NO: 1535620 - RNA, 23 nt, Pseudomonas aeruginosa PA01
cgcuucgggagucaacgccuggc

SEQ ID NO: 1535621 - RNA, 17 nt, Pseudomonas aeruginosa PA01
cgcuucuucccgcccau

SEQ ID NO: 1535622 - RNA, 17 nt, Pseudomonas aeruginosa PA01
cgcuugaacgcgcgccu

SEQ ID NO: 1535623 - RNA, 20 nt, Pseudomonas aeruginosa PA01
cgcuucugcgagccgcgcgu

SEQ ID NO: 1535624 - RNA, 20 nt, Pseudomonas aeruginosa PA01
cgcuucugcgccuccucggc

SEQ ID NO: 1535625 - RNA, 20 nt, Pseudomonas aeruginosa PA01
cgcuucugcuggccgcgcag

SEQ ID NO: 1535626 - RNA, 19 nt, Pseudomonas aeruginosa PA01
cgcggauuggccgggccga

SEQ ID NO: 1535627 - RNA, 18 nt, Pseudomonas aeruginosa PA01
cgcggauguucaccaggu

SEQ ID NO: 1535628 - RNA, 21 nt, Pseudomonas aeruginosa PA01
cgcggauaucgcuggcgccca

SEQ ID NO: 1535629 - RNA, 17 nt, Pseudomonas aeruginosa PA01
cgcggaucuggcccuuu

SEQ ID NO: 1535630 - RNA, 16 nt, Pseudomonas aeruginosa PA01
cgcggcccugcucgcc

SEQ ID NO: 1535631 - RNA, 13 nt, Pseudomonas aeruginosa PA01
cgcggcccguccg

SEQ ID NO: 1535632 - RNA, 20 nt, Pseudomonas aeruginosa PA01
cgcggccgaacucuggcggc

SEQ ID NO: 1535633 - RNA, 20 nt, Pseudomonas aeruginosa PA01
cgcggccgccgccgacaggu

SEQ ID NO: 1535634 - RNA, 23 nt, Pseudomonas aeruginosa PA01
cgcggcgagccgcgacggcugcu

SEQ ID NO: 1535635 - RNA, 14 nt, Pseudomonas aeruginosa PA01
cgcggcgagccggu

SEQ ID NO: 1535636 - RNA, 12 nt, Pseudomonas aeruginosa PA01
cgcggcgacgau

SEQ ID NO: 1535637 - RNA, 16 nt, Pseudomonas aeruginosa PA01
cgcggcgcuccaggcg

SEQ ID NO: 1535638 - RNA, 20 nt, Pseudomonas aeruginosa PA01
cgcggcgcguuccgggucgc

SEQ ID NO: 1535639 - RNA, 19 nt, Pseudomonas aeruginosa PA01
cgcggcggaugccggcgcu

SEQ ID NO: 1535640 - RNA, 22 nt, Pseudomonas aeruginosa PA01
cgcggcggaagaauaccgccag

SEQ ID NO: 1535641 - RNA, 23 nt, Pseudomonas aeruginosa PA01
cgcggcggaagaauaccgccagc

SEQ ID NO: 1535642 - RNA, 14 nt, Pseudomonas aeruginosa PA01
cgcggcgcggcggg

SEQ ID NO: 1535643 - RNA, 18 nt, Pseudomonas aeruginosa PA01
cgcggcgccacgcucacc

SEQ ID NO: 1535644 - RNA, 23 nt, Pseudomonas aeruginosa PA01
cgcggcguuagccgccugcggcg

SEQ ID NO: 1535645 - RNA, 22 nt, Pseudomonas aeruginosa PA01
cgcggcguggccggcgaccagc

SEQ ID NO: 1535646 - RNA, 17 nt, Pseudomonas aeruginosa PA01
cgcggcguugucggcca

SEQ ID NO: 1535647 - RNA, 22 nt, Pseudomonas aeruginosa PA01
cgcggcguugucggccagcagc

SEQ ID NO: 1535648 - RNA, 16 nt, Pseudomonas aeruginosa PA01
cgcggcuccagccgcu

SEQ ID NO: 1535649 - RNA, 19 nt, Pseudomonas aeruginosa PA01
cgcggcugaucggccgcca

SEQ ID NO: 1535650 - RNA, 20 nt, Pseudomonas aeruginosa PA01
cgcggcugaagaagcugccc

SEQ ID NO: 1535651 - RNA, 16 nt, Pseudomonas aeruginosa PA01
cgcgcugcgccaggcc

SEQ ID NO: 1535652 - RNA, 16 nt, Pseudomonas aeruginosa PA01
cgcgcucucgccggcc

SEQ ID NO: 1535653 - RNA, 22 nt, Pseudomonas aeruginosa PA01
cgcggaauggcgcgcaaaaaaa

SEQ ID NO: 1535654 - RNA, 20 nt, Pseudomonas aeruginosa PA01
cgcggaauccuucgcggcgg

SEQ ID NO: 1535655 - RNA, 22 nt, Pseudomonas aeruginosa PA01
cgcggaauccuucgcggcggcg

SEQ ID NO: 1535656 - RNA, 15 nt, Pseudomonas aeruginosa PA01
cgcggaaggcccgcg

SEQ ID NO: 1535657 - RNA, 19 nt, Pseudomonas aeruginosa PA01
cgcgcuuuccggcgcggcc

SEQ ID NO: 1535658 - RNA, 16 nt, Pseudomonas aeruginosa PA01
cgcgcuggccaguucc

SEQ ID NO: 1535659 - RNA, 15 nt, Pseudomonas aeruginosa PA01
cgcgcugggcgcagc

SEQ ID NO: 1535660 - RNA, 19 nt, Pseudomonas aeruginosa PA01
cgcgcugcgugcgccgcuc

SEQ ID NO: 1535661 - RNA, 22 nt, Pseudomonas aeruginosa PA01
cgcgcugcguggguagccgccc

SEQ ID NO: 1535662 - RNA, 14 nt, Pseudomonas aeruginosa PA01
cgcgcuggaccugg

SEQ ID NO: 1535663 - RNA, 20 nt, Pseudomonas aeruginosa PA01
cgcgcuggaccuggccggcg

SEQ ID NO: 1535664 - RNA, 21 nt, Pseudomonas aeruginosa PA01
cgcgcuggaguaucgcccugg

SEQ ID NO: 1535665 - RNA, 17 nt, Pseudomonas aeruginosa PA01
cgcgcggggcgcgcugc

SEQ ID NO: 1535666 - RNA, 19 nt, Pseudomonas aeruginosa PA01
cgcgcggcugcuugccgcu

SEQ ID NO: 1535667 - RNA, 21 nt, Pseudomonas aeruginosa PA01
cgcgcgggguggccgugcagc

SEQ ID NO: 1535668 - RNA, 20 nt, Pseudomonas aeruginosa PA01
cgcgcggucgagcagcgccg

SEQ ID NO: 1535669 - RNA, 13 nt, Pseudomonas aeruginosa PA01
cgcgcgucggcgg

SEQ ID NO: 1535670 - RNA, 21 nt, Pseudomonas aeruginosa PA01
cgcgcguucgcgcgaggcgcu

SEQ ID NO: 1535671 - RNA, 14 nt, Pseudomonas aeruginosa PA01
cgcgcguuccaggu

SEQ ID NO: 1535672 - RNA, 17 nt, Pseudomonas aeruginosa PA01
cgcgcguuucagcgcuu

SEQ ID NO: 1535673 - RNA, 14 nt, Pseudomonas aeruginosa PA01
cgcgcuccaggccc

SEQ ID NO: 1535674 - RNA, 15 nt, Pseudomonas aeruginosa PA01
cgcgcuccggcgcgc

SEQ ID NO: 1535675 - RNA, 17 nt, Pseudomonas aeruginosa PA01
cgcgcuccggcgcgcca

SEQ ID NO: 1535676 - RNA, 16 nt, Pseudomonas aeruginosa PA01
cgcgcucagcgcuucu

SEQ ID NO: 1535677 - RNA, 19 nt, Pseudomonas aeruginosa PA01
cgcgcaucgcggacaccgc

SEQ ID NO: 1535678 - RNA, 14 nt, Pseudomonas aeruginosa PA01
cgcgcaucgugcag

SEQ ID NO: 1535679 - RNA, 22 nt, Pseudomonas aeruginosa PA01
cgcgcagcgaacgggcguugcc

SEQ ID NO: 1535680 - RNA, 13 nt, Pseudomonas aeruginosa PA01
cgcgcagcgccgc

SEQ ID NO: 1535681 - RNA, 15 nt, Pseudomonas aeruginosa PA01
cgcgcagcgcggcgc

SEQ ID NO: 1535682 - RNA, 16 nt, Pseudomonas aeruginosa PA01
cgcgcagcgcggcgcu

SEQ ID NO: 1535683 - RNA, 16 nt, Pseudomonas aeruginosa PA01
cgcgcaguuccuucac

SEQ ID NO: 1535684 - RNA, 20 nt, Pseudomonas aeruginosa PA01
cgcgcaguucgucuuccagc

SEQ ID NO: 1535685 - RNA, 13 nt, Pseudomonas aeruginosa PA01
cgcgccaccuggu

SEQ ID NO: 1535686 - RNA, 17 nt, Pseudomonas aeruginosa PA01
cgcgccacgcucuccgu

SEQ ID NO: 1535687 - RNA, 21 nt, Pseudomonas aeruginosa PA01
cgcgccaccagcguggcgcgc

SEQ ID NO: 1535688 - RNA, 13 nt, Pseudomonas aeruginosa PA01
cgcgccaccaccg

SEQ ID NO: 1535689 - RNA, 12 nt, Pseudomonas aeruginosa PA01
cgcgccaccagc

SEQ ID NO: 1535690 - RNA, 23 nt, Pseudomonas aeruginosa PA01
cgcgcauggagacggcccgcccc

SEQ ID NO: 1535691 - RNA, 12 nt, Pseudomonas aeruginosa PA01
cgcgccagccac

SEQ ID NO: 1535692 - RNA, 16 nt, Pseudomonas aeruginosa PA01
cgcgccaccgccuggu

SEQ ID NO: 1535693 - RNA, 21 nt, Pseudomonas aeruginosa PA01
cgcgccagagaucgcccagcg

SEQ ID NO: 1535694 - RNA, 20 nt, Pseudomonas aeruginosa PA01
cgcgcacaaaaaagcccgcc

SEQ ID NO: 1535695 - RNA, 13 nt, Pseudomonas aeruginosa PA01
cgcgcaagcgccc

SEQ ID NO: 1535696 - RNA, 13 nt, Pseudomonas aeruginosa PA01
cgcgcaccagcgg

SEQ ID NO: 1535697 - RNA, 21 nt, Pseudomonas aeruginosa PA01
cgcgcaccaggccucccagcc

SEQ ID NO: 1535698 - RNA, 20 nt, Pseudomonas aeruginosa PA01
cgcgcagcaggauccaggug

SEQ ID NO: 1535699 - RNA, 15 nt, Pseudomonas aeruginosa PA01
cgcgcagaucgccgc

SEQ ID NO: 1535700 - RNA, 18 nt, Pseudomonas aeruginosa PA01
cgcgaguccuucggcgca

SEQ ID NO: 1535701 - RNA, 21 nt, Pseudomonas aeruginosa PA01
cgcgcaacuggucgcggcugc

SEQ ID NO: 1535702 - RNA, 18 nt, Pseudomonas aeruginosa PA01
cgcgagguggaugaacag

SEQ ID NO: 1535703 - RNA, 20 nt, Pseudomonas aeruginosa PA01
cgcgagggggccucggccag

SEQ ID NO: 1535704 - RNA, 13 nt, Pseudomonas aeruginosa PA01
cgcgagcgcggcc

SEQ ID NO: 1535705 - RNA, 15 nt, Pseudomonas aeruginosa PA01
cgcgaggaucagcca

SEQ ID NO: 1535706 - RNA, 16 nt, Pseudomonas aeruginosa PA01
cgcgccuuucgcucag

SEQ ID NO: 1535707 - RNA, 15 nt, Pseudomonas aeruginosa PA01
cgcgccuucagcccc

SEQ ID NO: 1535708 - RNA, 18 nt, Pseudomonas aeruginosa PA01
cgcgccuucagccccagc

SEQ ID NO: 1535709 - RNA, 15 nt, Pseudomonas aeruginosa PA01
cgcgccuucagcgcc

SEQ ID NO: 1535710 - RNA, 18 nt, Pseudomonas aeruginosa PA01
cgcgccuucagcgccagc

SEQ ID NO: 1535711 - RNA, 20 nt, Pseudomonas aeruginosa PA01
cgcgccuucagcgccuccag

SEQ ID NO: 1535712 - RNA, 20 nt, Pseudomonas aeruginosa PA01
cgcgccuggaucagcgccuc

SEQ ID NO: 1535713 - RNA, 16 nt, Pseudomonas aeruginosa PA01
cgcgccuggcccuggc

SEQ ID NO: 1535714 - RNA, 21 nt, Pseudomonas aeruginosa PA01
cgcgccugcaggucgaggcgc

SEQ ID NO: 1535715 - RNA, 22 nt, Pseudomonas aeruginosa PA01
cgcgccugcaggucgaggcgcu

SEQ ID NO: 1535716 - RNA, 14 nt, Pseudomonas aeruginosa PA01
cgcgccugagcugg

SEQ ID NO: 1535717 - RNA, 18 nt, Pseudomonas aeruginosa PA01
cgcgccugcaacgccagc

SEQ ID NO: 1535718 - RNA, 13 nt, Pseudomonas aeruginosa PA01
cgcgcgaggcgcu

SEQ ID NO: 1535719 - RNA, 21 nt, Pseudomonas aeruginosa PA01
cgcgcgauaaaaagccccgcu

SEQ ID NO: 1535720 - RNA, 14 nt, Pseudomonas aeruginosa PA01
cgcgcgcaggacca

SEQ ID NO: 1535721 - RNA, 16 nt, Pseudomonas aeruginosa PA01
cgcgcggcccuucgac

SEQ ID NO: 1535722 - RNA, 17 nt, Pseudomonas aeruginosa PA01
cgcgccgacagcacgau

SEQ ID NO: 1535723 - RNA, 21 nt, Pseudomonas aeruginosa PA01
cgcgccgagauagcggcaacg

SEQ ID NO: 1535724 - RNA, 17 nt, Pseudomonas aeruginosa PA01
cgcgccgagcccccggc

SEQ ID NO: 1535725 - RNA, 17 nt, Pseudomonas aeruginosa PA01
cgcgccagccccaggcg

SEQ ID NO: 1535726 - RNA, 17 nt, Pseudomonas aeruginosa PA01
cgcgccagcgccacggc

SEQ ID NO: 1535727 - RNA, 13 nt, Pseudomonas aeruginosa PA01
cgcgccagcgccg

SEQ ID NO: 1535728 - RNA, 13 nt, Pseudomonas aeruginosa PA01
cgcgccggcagcu

SEQ ID NO: 1535729 - RNA, 17 nt, Pseudomonas aeruginosa PA01
cgcgccggcgaucgcca

SEQ ID NO: 1535730 - RNA, 20 nt, Pseudomonas aeruginosa PA01
cgcgccggcgaucgccaggc

SEQ ID NO: 1535731 - RNA, 16 nt, Pseudomonas aeruginosa PA01
cgcgccgggcuggccg

SEQ ID NO: 1535732 - RNA, 16 nt, Pseudomonas aeruginosa PA01
cgcgccggggcagcag

SEQ ID NO: 1535733 - RNA, 21 nt, Pseudomonas aeruginosa PA01
cgcgccggaaguggcagcgcc

SEQ ID NO: 1535734 - RNA, 21 nt, Pseudomonas aeruginosa PA01
cgcgccggacaggccacccgc

SEQ ID NO: 1535735 - RNA, 18 nt, Pseudomonas aeruginosa PA01
cgccucccaccgcgcggc

SEQ ID NO: 1535736 - RNA, 11 nt, Pseudomonas aeruginosa PA01
cgccucccggc

SEQ ID NO: 1535737 - RNA, 12 nt, Pseudomonas aeruginosa PA01
cgccuccaggac

SEQ ID NO: 1535738 - RNA, 15 nt, Pseudomonas aeruginosa PA01
cgccuccaggcgcgc

SEQ ID NO: 1535739 - RNA, 17 nt, Pseudomonas aeruginosa PA01
cgccuccaggcgcgccu

SEQ ID NO: 1535740 - RNA, 14 nt, Pseudomonas aeruginosa PA01
cgccucagcggccu

SEQ ID NO: 1535741 - RNA, 15 nt, Pseudomonas aeruginosa PA01
cgccucagcggcugg

SEQ ID NO: 1535742 - RNA, 13 nt, Pseudomonas aeruginosa PA01
cgccuccaccagc

SEQ ID NO: 1535743 - RNA, 14 nt, Pseudomonas aeruginosa PA01
cgccuccaccagcg

SEQ ID NO: 1535744 - RNA, 19 nt, Pseudomonas aeruginosa PA01
cgccuccaccagcgccggc

SEQ ID NO: 1535745 - RNA, 18 nt, Pseudomonas aeruginosa PA01
cgccuccacggcggccuc

SEQ ID NO: 1535746 - RNA, 20 nt, Pseudomonas aeruginosa PA01
cgccucacggucgcaggggc

SEQ ID NO: 1535747 - RNA, 21 nt, Pseudomonas aeruginosa PA01
cgccucacggucgcaggggcu

SEQ ID NO: 1535748 - RNA, 17 nt, Pseudomonas aeruginosa PA01
cgccucaaggugaagug

SEQ ID NO: 1535749 - RNA, 22 nt, Pseudomonas aeruginosa PA01
cgccuccucggcggccuuuucg

SEQ ID NO: 1535750 - RNA, 13 nt, Pseudomonas aeruginosa PA01
cgccuccggcagc

SEQ ID NO: 1535751 - RNA, 14 nt, Pseudomonas aeruginosa PA01
cgccuccggcagcg

SEQ ID NO: 1535752 - RNA, 15 nt, Pseudomonas aeruginosa PA01
cgccuccggcagcgu

SEQ ID NO: 1535753 - RNA, 15 nt, Pseudomonas aeruginosa PA01
cgccucgaccagcgc

SEQ ID NO: 1535754 - RNA, 19 nt, Pseudomonas aeruginosa PA01
cgccucgaccucggccgca

SEQ ID NO: 1535755 - RNA, 15 nt, Pseudomonas aeruginosa PA01
cgccucgaccuggcc

SEQ ID NO: 1535756 - RNA, 22 nt, Pseudomonas aeruginosa PA01
cgccucgaagaaaaggcccggc

SEQ ID NO: 1535757 - RNA, 19 nt, Pseudomonas aeruginosa PA01
cgccucgcagagcgccagc

SEQ ID NO: 1535758 - RNA, 15 nt, Pseudomonas aeruginosa PA01
cgccucgccccagac

SEQ ID NO: 1535759 - RNA, 21 nt, Pseudomonas aeruginosa PA01
cgccucgccccagacccaggu

SEQ ID NO: 1535760 - RNA, 14 nt, Pseudomonas aeruginosa PA01
cgccucgccggcca

SEQ ID NO: 1535761 - RNA, 13 nt, Pseudomonas aeruginosa PA01
cgccucgccggcc

SEQ ID NO: 1535762 - RNA, 21 nt, Pseudomonas aeruginosa PA01
cgccucgaucgccucgggcga

SEQ ID NO: 1535763 - RNA, 14 nt, Pseudomonas aeruginosa PA01
cgccucgaucuucu

SEQ ID NO: 1535764 - RNA, 17 nt, Pseudomonas aeruginosa PA01
cgccucgaucuucuucc

SEQ ID NO: 1535765 - RNA, 22 nt, Pseudomonas aeruginosa PA01
cgccguuggcguuaugcgcccu

SEQ ID NO: 1535766 - RNA, 13 nt, Pseudomonas aeruginosa PA01
cgccuaccggcgc

SEQ ID NO: 1535767 - RNA, 18 nt, Pseudomonas aeruginosa PA01
cgccuagacccugggcca

SEQ ID NO: 1535768 - RNA, 19 nt, Pseudomonas aeruginosa PA01
cgccuaccagaccgcagcc

SEQ ID NO: 1535769 - RNA, 23 nt, Pseudomonas aeruginosa PA01
cgccuauccacgacgucggcggc

SEQ ID NO: 1535770 - RNA, 22 nt, Pseudomonas aeruginosa PA01
cgccguuccuccucgccgccga

SEQ ID NO: 1535771 - RNA, 24 nt, Pseudomonas aeruginosa PA01
cgccguggcugugcuggccacccu

SEQ ID NO: 1535772 - RNA, 13 nt, Pseudomonas aeruginosa PA01
cgccgugggaacg

SEQ ID NO: 1535773 - RNA, 21 nt, Pseudomonas aeruginosa PA01
cgccgugggaguccagguaca

SEQ ID NO: 1535774 - RNA, 16 nt, Pseudomonas aeruginosa PA01
cgccguccaccaagcg

SEQ ID NO: 1535775 - RNA, 20 nt, Pseudomonas aeruginosa PA01
cgccgucaucgagcaguucc

SEQ ID NO: 1535776 - RNA, 18 nt, Pseudomonas aeruginosa PA01
cgccgucauggcgggcgu

SEQ ID NO: 1535777 - RNA, 20 nt, Pseudomonas aeruginosa PA01
cgccgugcaucaccggcagc

SEQ ID NO: 1535778 - RNA, 20 nt, Pseudomonas aeruginosa PA01
cgccgugacgaggggcugcg

SEQ ID NO: 1535779 - RNA, 21 nt, Pseudomonas aeruginosa PA01
cgccguccuugucgcagcggc

SEQ ID NO: 1535780 - RNA, 23 nt, Pseudomonas aeruginosa PA01
cgccgucuugccgcugcgcgcag

SEQ ID NO: 1535781 - RNA, 19 nt, Pseudomonas aeruginosa PA01
cgccgugcgcuccgccagg

SEQ ID NO: 1535782 - RNA, 12 nt, Pseudomonas aeruginosa PA01
cgccguggaacg

SEQ ID NO: 1535783 - RNA, 14 nt, Pseudomonas aeruginosa PA01
cgccguggaacgca

SEQ ID NO: 1535784 - RNA, 14 nt, Pseudomonas aeruginosa PA01
cgccguggcaccag

SEQ ID NO: 1535785 - RNA, 20 nt, Pseudomonas aeruginosa PA01
cgccgguucaguucagccgg

SEQ ID NO: 1535786 - RNA, 17 nt, Pseudomonas aeruginosa PA01
cgccggggcgugcaggc

SEQ ID NO: 1535787 - RNA, 13 nt, Pseudomonas aeruginosa PA01
cgccgccggaggg

SEQ ID NO: 1535788 - RNA, 20 nt, Pseudomonas aeruginosa PA01
cgccgggucgacaugcaggc

SEQ ID NO: 1535789 - RNA, 16 nt, Pseudomonas aeruginosa PA01
cgccgggucgccgcag

SEQ ID NO: 1535790 - RNA, 19 nt, Pseudomonas aeruginosa PA01
cgccgggugaccgugcggg

SEQ ID NO: 1535791 - RNA, 16 nt, Pseudomonas aeruginosa PA01
cgccggguugcgccgc

SEQ ID NO: 1535792 - RNA, 18 nt, Pseudomonas aeruginosa PA01
cgccggguguuuuuccuc

SEQ ID NO: 1535793 - RNA, 20 nt, Pseudomonas aeruginosa PA01
cgccgguaaugaaaagcccc

SEQ ID NO: 1535794 - RNA, 21 nt, Pseudomonas aeruginosa PA01
cgccgguaaugaaaagccccg

SEQ ID NO: 1535795 - RNA, 16 nt, Pseudomonas aeruginosa PA01
cgccgguagcggcgca

SEQ ID NO: 1535796 - RNA, 23 nt, Pseudomonas aeruginosa PA01
cgccgguagcggcgcaccgacgc

SEQ ID NO: 1535797 - RNA, 12 nt, Pseudomonas aeruginosa PA01
cgccggguuuuu

SEQ ID NO: 1535798 - RNA, 14 nt, Pseudomonas aeruginosa PA01
cgccgccgcggcgc

SEQ ID NO: 1535799 - RNA, 12 nt, Pseudomonas aeruginosa PA01
cgccgccgcggg

SEQ ID NO: 1535800 - RNA, 13 nt, Pseudomonas aeruginosa PA01
cgccgccgcgggc

SEQ ID NO: 1535801 - RNA, 14 nt, Pseudomonas aeruginosa PA01
cgccgccgcggcca

SEQ ID NO: 1535802 - RNA, 16 nt, Pseudomonas aeruginosa PA01
cgccgccgcggccagc

SEQ ID NO: 1535803 - RNA, 14 nt, Pseudomonas aeruginosa PA01
cgccgccgcgcgcg

SEQ ID NO: 1535804 - RNA, 12 nt, Pseudomonas aeruginosa PA01
cgccgccgagaa

SEQ ID NO: 1535805 - RNA, 19 nt, Pseudomonas aeruginosa PA01
cgccgccgagaacccggcc

SEQ ID NO: 1535806 - RNA, 19 nt, Pseudomonas aeruginosa PA01
cgccgccgacacccgcgcc

SEQ ID NO: 1535807 - RNA, 20 nt, Pseudomonas aeruginosa PA01
cgccgccgacacccgcgccg

SEQ ID NO: 1535808 - RNA, 18 nt, Pseudomonas aeruginosa PA01
cgccgccgaggcgcgcca

SEQ ID NO: 1535809 - RNA, 19 nt, Pseudomonas aeruginosa PA01
cgccgccgagguugcgcag

SEQ ID NO: 1535810 - RNA, 15 nt, Pseudomonas aeruginosa PA01
cgcgacgcuccagcg

SEQ ID NO: 1535811 - RNA, 20 nt, Pseudomonas aeruginosa PA01
cgcgacugccgucggcgccc

SEQ ID NO: 1535812 - RNA, 18 nt, Pseudomonas aeruginosa PA01
cgcgacugcugaucagcu

SEQ ID NO: 1535813 - RNA, 13 nt, Pseudomonas aeruginosa PA01
cgcgagcgccgcc

SEQ ID NO: 1535814 - RNA, 17 nt, Pseudomonas aeruginosa PA01
cgcgacagauagcaggu

SEQ ID NO: 1535815 - RNA, 19 nt, Pseudomonas aeruginosa PA01
cgcgacacauggucggcca

SEQ ID NO: 1535816 - RNA, 17 nt, Pseudomonas aeruginosa PA01
cgcgacaacccuguccc

SEQ ID NO: 1535817 - RNA, 22 nt, Pseudomonas aeruginosa PA01
cgcgacaacccuguccccucac

SEQ ID NO: 1535818 - RNA, 15 nt, Pseudomonas aeruginosa PA01
cgcgaauggcauuca

SEQ ID NO: 1535819 - RNA, 14 nt, Pseudomonas aeruginosa PA01
cgcgaccacaggcg

SEQ ID NO: 1535820 - RNA, 18 nt, Pseudomonas aeruginosa PA01
cgcgacaguucgccgccc

SEQ ID NO: 1535821 - RNA, 14 nt, Pseudomonas aeruginosa PA01
cgccuucgcggccg

SEQ ID NO: 1535822 - RNA, 15 nt, Pseudomonas aeruginosa PA01
cgccuucgcggccga

SEQ ID NO: 1535823 - RNA, 17 nt, Pseudomonas aeruginosa PA01
cgcgaacacacccugcg

SEQ ID NO: 1535824 - RNA, 22 nt, Pseudomonas aeruginosa PA01
cgccuucgacgcguugcuugug

SEQ ID NO: 1535825 - RNA, 19 nt, Pseudomonas aeruginosa PA01
cgccuuccggguugaaggc

SEQ ID NO: 1535826 - RNA, 20 nt, Pseudomonas aeruginosa PA01
cgccuuccucggccgccagg

SEQ ID NO: 1535827 - RNA, 17 nt, Pseudomonas aeruginosa PA01
cgccuuccggcagguuc

SEQ ID NO: 1535828 - RNA, 15 nt, Pseudomonas aeruginosa PA01
cgccuuccagcccuu

SEQ ID NO: 1535829 - RNA, 12 nt, Pseudomonas aeruginosa PA01
cgccuuccaggc

SEQ ID NO: 1535830 - RNA, 17 nt, Pseudomonas aeruginosa PA01
cgccuucagcgccgcca

SEQ ID NO: 1535831 - RNA, 19 nt, Pseudomonas aeruginosa PA01
cgccuucagcgccgccagg

SEQ ID NO: 1535832 - RNA, 16 nt, Pseudomonas aeruginosa PA01
cgcgaaccagcagcag

SEQ ID NO: 1535833 - RNA, 19 nt, Pseudomonas aeruginosa PA01
cgcgaaccacauccuugcc

SEQ ID NO: 1535834 - RNA, 22 nt, Pseudomonas aeruginosa PA01
cgcgaauccggucggacuccgc

SEQ ID NO: 1535835 - RNA, 19 nt, Pseudomonas aeruginosa PA01
cgcgaaucuucggcgcgcc

SEQ ID NO: 1535836 - RNA, 18 nt, Pseudomonas aeruginosa PA01
cgcgaaugcccggcagcg

SEQ ID NO: 1535837 - RNA, 20 nt, Pseudomonas aeruginosa PA01
cgcgaaugcccggcagcgcc

SEQ ID NO: 1535838 - RNA, 22 nt, Pseudomonas aeruginosa PA01
cgccucgcgcaacgccgacggc

SEQ ID NO: 1535839 - RNA, 13 nt, Pseudomonas aeruginosa PA01
cgccucgcugggc

SEQ ID NO: 1535840 - RNA, 22 nt, Pseudomonas aeruginosa PA01
cgccucggcgcgauccuccgcc

SEQ ID NO: 1535841 - RNA, 16 nt, Pseudomonas aeruginosa PA01
cgccucggcgcgcgcc

SEQ ID NO: 1535842 - RNA, 18 nt, Pseudomonas aeruginosa PA01
cgccucggcgcgcgcccc

SEQ ID NO: 1535843 - RNA, 19 nt, Pseudomonas aeruginosa PA01
cgccucggcgcgcgccccc

SEQ ID NO: 1535844 - RNA, 21 nt, Pseudomonas aeruginosa PA01
cgccucggccaucgagcgcuc

SEQ ID NO: 1535845 - RNA, 23 nt, Pseudomonas aeruginosa PA01
cgccucggccaucgagcgcucca

SEQ ID NO: 1535846 - RNA, 15 nt, Pseudomonas aeruginosa PA01
cgccucgggcagccc

SEQ ID NO: 1535847 - RNA, 14 nt, Pseudomonas aeruginosa PA01
cgccucgggccaug

SEQ ID NO: 1535848 - RNA, 14 nt, Pseudomonas aeruginosa PA01
cgccucgggccgga

SEQ ID NO: 1535849 - RNA, 13 nt, Pseudomonas aeruginosa PA01
cgccucgucgcca

SEQ ID NO: 1535850 - RNA, 21 nt, Pseudomonas aeruginosa PA01
cgccucgucgccaugcggcag

SEQ ID NO: 1535851 - RNA, 22 nt, Pseudomonas aeruginosa PA01
cgccucgugcagcaagccgcag

SEQ ID NO: 1535852 - RNA, 22 nt, Pseudomonas aeruginosa PA01
cgccucguggaacagcgcgucg

SEQ ID NO: 1535853 - RNA, 19 nt, Pseudomonas aeruginosa PA01
cgccucuuccuggaccucc

SEQ ID NO: 1535854 - RNA, 15 nt, Pseudomonas aeruginosa PA01
cgccugagcuggccc

SEQ ID NO: 1535855 - RNA, 16 nt, Pseudomonas aeruginosa PA01
cgccugcaacgccagc

SEQ ID NO: 1535856 - RNA, 22 nt, Pseudomonas aeruginosa PA01
cgccugcaacguccucgcgccg

SEQ ID NO: 1535857 - RNA, 24 nt, Pseudomonas aeruginosa PA01
cgccugcaacguccucgcgccgcu

SEQ ID NO: 1535858 - RNA, 16 nt, Pseudomonas aeruginosa PA01
cgccugccccacuucc

SEQ ID NO: 1535859 - RNA, 15 nt, Pseudomonas aeruginosa PA01
cgccugccaggcggg

SEQ ID NO: 1535860 - RNA, 22 nt, Pseudomonas aeruginosa PA01
cgccugcaggaaggcuuccggc

SEQ ID NO: 1535861 - RNA, 14 nt, Pseudomonas aeruginosa PA01
cgccugcagcacca

SEQ ID NO: 1535862 - RNA, 22 nt, Pseudomonas aeruginosa PA01
cgccuggagcagaaccgccagc

SEQ ID NO: 1535863 - RNA, 21 nt, Pseudomonas aeruginosa PA01
cgccuggaugaucgcgugggc

SEQ ID NO: 1535864 - RNA, 21 nt, Pseudomonas aeruginosa PA01
cgccuggaaggcgcugggcgg

SEQ ID NO: 1535865 - RNA, 14 nt, Pseudomonas aeruginosa PA01
cgccuggccacgcc

SEQ ID NO: 1535866 - RNA, 22 nt, Pseudomonas aeruginosa PA01
cgccuggcgcaacgccggcagg

SEQ ID NO: 1535867 - RNA, 15 nt, Pseudomonas aeruginosa PA01
cgccuggccggccag

SEQ ID NO: 1535868 - RNA, 15 nt, Pseudomonas aeruginosa PA01
cgccuggcgucccgu

SEQ ID NO: 1535869 - RNA, 15 nt, Pseudomonas aeruginosa PA01
cgccugguccagcag

SEQ ID NO: 1535870 - RNA, 16 nt, Pseudomonas aeruginosa PA01
cgccugguccagcagg

SEQ ID NO: 1535871 - RNA, 15 nt, Pseudomonas aeruginosa PA01
cgccugggccgcgcu

SEQ ID NO: 1535872 - RNA, 23 nt, Pseudomonas aeruginosa PA01
cgccugggccgcgcugucggccu

SEQ ID NO: 1535873 - RNA, 15 nt, Pseudomonas aeruginosa PA01
cgccuggcuggccag

SEQ ID NO: 1535874 - RNA, 18 nt, Pseudomonas aeruginosa PA01
cgccuggcuggccagcag

SEQ ID NO: 1535875 - RNA, 19 nt, Pseudomonas aeruginosa PA01
cgccuggcuggccagcagg

SEQ ID NO: 1535876 - RNA, 17 nt, Pseudomonas aeruginosa PA01
uuuuauuccucagugcg

SEQ ID NO: 1535877 - RNA, 16 nt, Pseudomonas aeruginosa PA01
uuuucggcggccaggc

SEQ ID NO: 1535878 - RNA, 20 nt, Pseudomonas aeruginosa PA01
uuuuacucgucgccaaagaa

SEQ ID NO: 1535879 - RNA, 20 nt, Pseudomonas aeruginosa PA01
uugaacaccugaucgaagcc

SEQ ID NO: 1535880 - RNA, 13 nt, Pseudomonas aeruginosa PA01
uugaagccgccau

SEQ ID NO: 1535881 - RNA, 17 nt, Pseudomonas aeruginosa PA01
uugaccaccgccaggcu

SEQ ID NO: 1535882 - RNA, 13 nt, Pseudomonas aeruginosa PA01
uugaccagcggcc

SEQ ID NO: 1535883 - RNA, 12 nt, Pseudomonas aeruginosa PA01
uucuuuucuucc

SEQ ID NO: 1535884 - RNA, 13 nt, Pseudomonas aeruginosa PA01
uucuuuucuuccg

SEQ ID NO: 1535885 - RNA, 22 nt, Pseudomonas aeruginosa PA01
uugagcacccgggcgaccugcu

SEQ ID NO: 1535886 - RNA, 16 nt, Pseudomonas aeruginosa PA01
uugacccgcaguuccu

SEQ ID NO: 1535887 - RNA, 15 nt, Pseudomonas aeruginosa PA01
uugacccucugguug

SEQ ID NO: 1535888 - RNA, 17 nt, Pseudomonas aeruginosa PA01
uugacccucugguuggc

SEQ ID NO: 1535889 - RNA, 20 nt, Pseudomonas aeruginosa PA01
uugaccaucuuuuccugcug

SEQ ID NO: 1535890 - RNA, 19 nt, Pseudomonas aeruginosa PA01
uugagggccuuggccucca

SEQ ID NO: 1535891 - RNA, 19 nt, Pseudomonas aeruginosa PA01
uugaggccgucgaagugga

SEQ ID NO: 1535892 - RNA, 17 nt, Pseudomonas aeruginosa PA01
uugaggaaguagugcag

SEQ ID NO: 1535893 - RNA, 20 nt, Pseudomonas aeruginosa PA01
uugaucaccaccacgccguc

SEQ ID NO: 1535894 - RNA, 23 nt, Pseudomonas aeruginosa PA01
uugaucagcgcgcguuccagguc

SEQ ID NO: 1535895 - RNA, 17 nt, Pseudomonas aeruginosa PA01
uugaucaccuugccauc

SEQ ID NO: 1535896 - RNA, 22 nt, Pseudomonas aeruginosa PA01
uugaucagguucggcagcgccu

SEQ ID NO: 1535897 - RNA, 14 nt, Pseudomonas aeruginosa PA01
uucugucuuguccu

SEQ ID NO: 1535898 - RNA, 15 nt, Pseudomonas aeruginosa PA01
uucugcccgccggcg

SEQ ID NO: 1535899 - RNA, 13 nt, Pseudomonas aeruginosa PA01
uucugccgcagac

SEQ ID NO: 1535900 - RNA, 17 nt, Pseudomonas aeruginosa PA01
uucugccgcgacaggau

SEQ ID NO: 1535901 - RNA, 12 nt, Pseudomonas aeruginosa PA01
uucuccaggcuu

SEQ ID NO: 1535902 - RNA, 22 nt, Pseudomonas aeruginosa PA01
uucucccacagucgaugacgag

SEQ ID NO: 1535903 - RNA, 22 nt, Pseudomonas aeruginosa PA01
uucuaaaauggcugccgaagaa

SEQ ID NO: 1535904 - RNA, 21 nt, Pseudomonas aeruginosa PA01
uucuauuccggggacgcuguc

SEQ ID NO: 1535905 - RNA, 14 nt, Pseudomonas aeruginosa PA01
uucggcgguccagg

SEQ ID NO: 1535906 - RNA, 21 nt, Pseudomonas aeruginosa PA01
uucggcgugauccgcagguag

SEQ ID NO: 1535907 - RNA, 23 nt, Pseudomonas aeruginosa PA01
uucggcgaugccgcgccaggcgc

SEQ ID NO: 1535908 - RNA, 16 nt, Pseudomonas aeruginosa PA01
uucggcgagcagguag

SEQ ID NO: 1535909 - RNA, 17 nt, Pseudomonas aeruginosa PA01
uucggcgcgccggugau

SEQ ID NO: 1535910 - RNA, 15 nt, Pseudomonas aeruginosa PA01
uucggcgcgcggcag

SEQ ID NO: 1535911 - RNA, 15 nt, Pseudomonas aeruginosa PA01
uucggcggccagcgg

SEQ ID NO: 1535912 - RNA, 22 nt, Pseudomonas aeruginosa PA01
uucggucgaucguugccagccg

SEQ ID NO: 1535913 - RNA, 16 nt, Pseudomonas aeruginosa PA01
uucguuggcccagacc

SEQ ID NO: 1535914 - RNA, 21 nt, Pseudomonas aeruginosa PA01
uuguucggcugggccaggauc

SEQ ID NO: 1535915 - RNA, 19 nt, Pseudomonas aeruginosa PA01
uuguggccgaucuccuggu

SEQ ID NO: 1535916 - RNA, 11 nt, Pseudomonas aeruginosa PA01
uugucccugcg

SEQ ID NO: 1535917 - RNA, 22 nt, Pseudomonas aeruginosa PA01
uuguccgcgcgcuuccaggcac

SEQ ID NO: 1535918 - RNA, 16 nt, Pseudomonas aeruginosa PA01
uugucggccagcagca

SEQ ID NO: 1535919 - RNA, 19 nt, Pseudomonas aeruginosa PA01
uuguccaggcgcugcucga

SEQ ID NO: 1535920 - RNA, 15 nt, Pseudomonas aeruginosa PA01
uuguccaggguuucc

SEQ ID NO: 1535921 - RNA, 16 nt, Pseudomonas aeruginosa PA01
uuguauaccagcggcu

SEQ ID NO: 1535922 - RNA, 23 nt, Pseudomonas aeruginosa PA01
uugcugaucaggccgaggaugcu

SEQ ID NO: 1535923 - RNA, 15 nt, Pseudomonas aeruginosa PA01
uugcugacggcgugg

SEQ ID NO: 1535924 - RNA, 16 nt, Pseudomonas aeruginosa PA01
uuggacgcggccuggg

SEQ ID NO: 1535925 - RNA, 17 nt, Pseudomonas aeruginosa PA01
uuggacgcggccugggc

SEQ ID NO: 1535926 - RNA, 17 nt, Pseudomonas aeruginosa PA01
uuggcagauuccuggac

SEQ ID NO: 1535927 - RNA, 20 nt, Pseudomonas aeruginosa PA01
uuggcgaaguucccgccgcu

SEQ ID NO: 1535928 - RNA, 19 nt, Pseudomonas aeruginosa PA01
uuggccaggcgcuuguccg

SEQ ID NO: 1535929 - RNA, 20 nt, Pseudomonas aeruginosa PA01
uuggcgaaauugccuccgcu

SEQ ID NO: 1535930 - RNA, 21 nt, Pseudomonas aeruginosa PA01
uuggcgaacuucaggccggcg

SEQ ID NO: 1535931 - RNA, 13 nt, Pseudomonas aeruginosa PA01
uuggccagcagca

SEQ ID NO: 1535932 - RNA, 11 nt, Pseudomonas aeruginosa PA01
uuggccaggac

SEQ ID NO: 1535933 - RNA, 14 nt, Pseudomonas aeruginosa PA01
uuggcuccgggccg

SEQ ID NO: 1535934 - RNA, 14 nt, Pseudomonas aeruginosa PA01
uugggcgaccugcu

SEQ ID NO: 1535935 - RNA, 22 nt, Pseudomonas aeruginosa PA01
uugggcacgcggaucuggcccu

SEQ ID NO: 1535936 - RNA, 22 nt, Pseudomonas aeruginosa PA01
uugggaucgucgaagcucggcg

SEQ ID NO: 1535937 - RNA, 22 nt, Pseudomonas aeruginosa PA01
uuggucacggcgaagcggcccu

SEQ ID NO: 1535938 - RNA, 23 nt, Pseudomonas aeruginosa PA01
uugcccaugugcagcuucuccag

SEQ ID NO: 1535939 - RNA, 21 nt, Pseudomonas aeruginosa PA01
uugccaagguguggccgagcc

SEQ ID NO: 1535940 - RNA, 16 nt, Pseudomonas aeruginosa PA01
uugccgaccgagcagc

SEQ ID NO: 1535941 - RNA, 22 nt, Pseudomonas aeruginosa PA01
uugccgaugguuucgugccauu

SEQ ID NO: 1535942 - RNA, 15 nt, Pseudomonas aeruginosa PA01
uugcccggcuugccg

SEQ ID NO: 1535943 - RNA, 18 nt, Pseudomonas aeruginosa PA01
uugcauggcaugcaagag

SEQ ID NO: 1535944 - RNA, 20 nt, Pseudomonas aeruginosa PA01
uugcagcaacucgccgccga

SEQ ID NO: 1535945 - RNA, 18 nt, Pseudomonas aeruginosa PA01
uugcaugaccuucaggua

SEQ ID NO: 1535946 - RNA, 20 nt, Pseudomonas aeruginosa PA01
uugcacgucgguucagcgcg

SEQ ID NO: 1535947 - RNA, 19 nt, Pseudomonas aeruginosa PA01
uugcacuuccacuccaggc

SEQ ID NO: 1535948 - RNA, 23 nt, Pseudomonas aeruginosa PA01
uugcagcacccccagcaggccag

SEQ ID NO: 1535949 - RNA, 13 nt, Pseudomonas aeruginosa PA01
uugcagcaccgcc

SEQ ID NO: 1535950 - RNA, 22 nt, Pseudomonas aeruginosa PA01
uugcagcagaaguuguucgaug

SEQ ID NO: 1535951 - RNA, 23 nt, Pseudomonas aeruginosa PA01
uugcagauaaccgauaucuccca

SEQ ID NO: 1535952 - RNA, 14 nt, Pseudomonas aeruginosa PA01
uugcgcuccgacuc

SEQ ID NO: 1535953 - RNA, 15 nt, Pseudomonas aeruginosa PA01
uugcgcuccuuggcu

SEQ ID NO: 1535954 - RNA, 16 nt, Pseudomonas aeruginosa PA01
uugcgcuccuuggcug

SEQ ID NO: 1535955 - RNA, 23 nt, Pseudomonas aeruginosa PA01
uugcgcgcggcgucgaccacggc

SEQ ID NO: 1535956 - RNA, 23 nt, Pseudomonas aeruginosa PA01
uugcgcggcagguggcuggccau

SEQ ID NO: 1535957 - RNA, 19 nt, Pseudomonas aeruginosa PA01
uugcgcuggcgcagcagca

SEQ ID NO: 1535958 - RNA, 20 nt, Pseudomonas aeruginosa PA01
uugcgcuggcgcagcagcag

SEQ ID NO: 1535959 - RNA, 20 nt, Pseudomonas aeruginosa PA01
uugcgccguggcaccagguc

SEQ ID NO: 1535960 - RNA, 17 nt, Pseudomonas aeruginosa PA01
uugcgccgccugcggcu

SEQ ID NO: 1535961 - RNA, 24 nt, Pseudomonas aeruginosa PA01
uugcgcccggcgcgaccgucggcc

SEQ ID NO: 1535962 - RNA, 16 nt, Pseudomonas aeruginosa PA01
uugcgaccgagaugcu

SEQ ID NO: 1535963 - RNA, 15 nt, Pseudomonas aeruginosa PA01
uugcgaccggccuuu

SEQ ID NO: 1535964 - RNA, 18 nt, Pseudomonas aeruginosa PA01
uugcgagcgagcuugcaa

SEQ ID NO: 1535965 - RNA, 18 nt, Pseudomonas aeruginosa PA01
uugccgcaggucuugucg

SEQ ID NO: 1535966 - RNA, 23 nt, Pseudomonas aeruginosa PA01
uugccgcgagcuuggcccuggcc

SEQ ID NO: 1535967 - RNA, 20 nt, Pseudomonas aeruginosa PA01
uugccgccgcuggccuggcc

SEQ ID NO: 1535968 - RNA, 20 nt, Pseudomonas aeruginosa PA01
uugccgcuggugaucgacca

SEQ ID NO: 1535969 - RNA, 16 nt, Pseudomonas aeruginosa PA01
uugccgcucaggcugu

SEQ ID NO: 1535970 - RNA, 18 nt, Pseudomonas aeruginosa PA01
uugccgcgccaaaaagca

SEQ ID NO: 1535971 - RNA, 19 nt, Pseudomonas aeruginosa PA01
uugccgcgcccggccaggc

SEQ ID NO: 1535972 - RNA, 14 nt, Pseudomonas aeruginosa PA01
uuucuaucucccua

SEQ ID NO: 1535973 - RNA, 18 nt, Pseudomonas aeruginosa PA01
uuucuacuucccugccgg

SEQ ID NO: 1535974 - RNA, 15 nt, Pseudomonas aeruginosa PA01
uuucgugaaaugaaa

SEQ ID NO: 1535975 - RNA, 14 nt, Pseudomonas aeruginosa PA01
uuucguuggccagg

SEQ ID NO: 1535976 - RNA, 12 nt, Pseudomonas aeruginosa PA01
uuucguccccuu

SEQ ID NO: 1535977 - RNA, 14 nt, Pseudomonas aeruginosa PA01
uuucgcucaggccu

SEQ ID NO: 1535978 - RNA, 18 nt, Pseudomonas aeruginosa PA01
uuucgcucaggccucgag

SEQ ID NO: 1535979 - RNA, 14 nt, Pseudomonas aeruginosa PA01
uuucccauauggaa

SEQ ID NO: 1535980 - RNA, 15 nt, Pseudomonas aeruginosa PA01
uuuccgauccuccug

SEQ ID NO: 1535981 - RNA, 20 nt, Pseudomonas aeruginosa PA01
uuuccgcaggaaaccccucg

SEQ ID NO: 1535982 - RNA, 20 nt, Pseudomonas aeruginosa PA01
uuuccggauacaugcugcuc

SEQ ID NO: 1535983 - RNA, 21 nt, Pseudomonas aeruginosa PA01
uuuccggauacaugcugcuca

SEQ ID NO: 1535984 - RNA, 22 nt, Pseudomonas aeruginosa PA01
uuuccagcagcacccggaccuu

SEQ ID NO: 1535985 - RNA, 21 nt, Pseudomonas aeruginosa PA01
uuuccagaaggcuucuuccug

SEQ ID NO: 1535986 - RNA, 21 nt, Pseudomonas aeruginosa PA01
uuuccagggcaaacagcuccg

SEQ ID NO: 1535987 - RNA, 23 nt, Pseudomonas aeruginosa PA01
uuuccucuaugggacgaccucag

SEQ ID NO: 1535988 - RNA, 16 nt, Pseudomonas aeruginosa PA01
uuuccugcuccagcag

SEQ ID NO: 1535989 - RNA, 10 nt, Pseudomonas aeruginosa PA01
uuuccugcug

SEQ ID NO: 1535990 - RNA, 11 nt, Pseudomonas aeruginosa PA01
uuuccugcccc

SEQ ID NO: 1535991 - RNA, 13 nt, Pseudomonas aeruginosa PA01
uuuccuggcccug

SEQ ID NO: 1535992 - RNA, 22 nt, Pseudomonas aeruginosa PA01
uuuccgugcggaaaccgcggcc

SEQ ID NO: 1535993 - RNA, 20 nt, Pseudomonas aeruginosa PA01
uuuccgcuguccgccgccgc

SEQ ID NO: 1535994 - RNA, 13 nt, Pseudomonas aeruginosa PA01
uuuccggccaggc

SEQ ID NO: 1535995 - RNA, 20 nt, Pseudomonas aeruginosa PA01
uuuccggugcaccugggugc

SEQ ID NO: 1535996 - RNA, 15 nt, Pseudomonas aeruginosa PA01
uuucgaagccgccgc

SEQ ID NO: 1535997 - RNA, 21 nt, Pseudomonas aeruginosa PA01
uuugcgccagguagccuggau

SEQ ID NO: 1535998 - RNA, 23 nt, Pseudomonas aeruginosa PA01
uuugccgucccggaguuccagcg

SEQ ID NO: 1535999 - RNA, 22 nt, Pseudomonas aeruginosa PA01
uuugcccagcgccgccugcugg

SEQ ID NO: 1536000 - RNA, 18 nt, Pseudomonas aeruginosa PA01
uuugcccgucuagcgcag

SEQ ID NO: 1536001 - RNA, 16 nt, Pseudomonas aeruginosa PA01
uuugagggucagacca

SEQ ID NO: 1536002 - RNA, 12 nt, Pseudomonas aeruginosa PA01
uuucuucagccu

SEQ ID NO: 1536003 - RNA, 22 nt, Pseudomonas aeruginosa PA01
uuucuucaccaccccacaaaaa

SEQ ID NO: 1536004 - RNA, 14 nt, Pseudomonas aeruginosa PA01
uuuauuccucccau

SEQ ID NO: 1536005 - RNA, 12 nt, Pseudomonas aeruginosa PA01
uuucaaccaggc

SEQ ID NO: 1536006 - RNA, 14 nt, Pseudomonas aeruginosa PA01
uuucagcuucaucg

SEQ ID NO: 1536007 - RNA, 22 nt, Pseudomonas aeruginosa PA01
uuuauccacgcgguuccacucc

SEQ ID NO: 1536008 - RNA, 20 nt, Pseudomonas aeruginosa PA01
uuuagaaaaauauauuccuu

SEQ ID NO: 1536009 - RNA, 18 nt, Pseudomonas aeruginosa PA01
uuuacggauucucuccca

SEQ ID NO: 1536010 - RNA, 12 nt, Pseudomonas aeruginosa PA01
ucaggcugugca

SEQ ID NO: 1536011 - RNA, 16 nt, Pseudomonas aeruginosa PA01
ucaggcugugcaggaa

SEQ ID NO: 1536012 - RNA, 18 nt, Pseudomonas aeruginosa PA01
ucaggcugggguugcggc

SEQ ID NO: 1536013 - RNA, 21 nt, Pseudomonas aeruginosa PA01
ucaggcugggguugcggcgcc

SEQ ID NO: 1536014 - RNA, 18 nt, Pseudomonas aeruginosa PA01
ucaggcgugggccagccc

SEQ ID NO: 1536015 - RNA, 17 nt, Pseudomonas aeruginosa PA01
ucaggcucagcucggcg

SEQ ID NO: 1536016 - RNA, 13 nt, Pseudomonas aeruginosa PA01
ucaggcucaggcg

SEQ ID NO: 1536017 - RNA, 15 nt, Pseudomonas aeruginosa PA01
ucaggcugcgcaccu

SEQ ID NO: 1536018 - RNA, 12 nt, Pseudomonas aeruginosa PA01
ucaggcucagcu

SEQ ID NO: 1536019 - RNA, 18 nt, Pseudomonas aeruginosa PA01
ucaggcucuuugcgacug
